United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 40

SEQ ID NO: 1673015 - DNA, 19 bp, Homo sapiens
atggaaaaaaacataaaaa

SEQ ID NO: 1673016 - DNA, 14 bp, Homo sapiens
atggaaaaataaca

SEQ ID NO: 1673017 - DNA, 16 bp, Homo sapiens
atggaaaaataacaac

SEQ ID NO: 1673018 - DNA, 14 bp, Homo sapiens
atggaaaaatagta

SEQ ID NO: 1673019 - DNA, 16 bp, Homo sapiens
atggaaaaatggttga

SEQ ID NO: 1673020 - DNA, 23 bp, Homo sapiens
atggaaaacaaaccatctctagt

SEQ ID NO: 1673021 - DNA, 22 bp, Homo sapiens
atggaaaagcaacttcatttga

SEQ ID NO: 1673022 - DNA, 15 bp, Homo sapiens
atggaaaataaacat

SEQ ID NO: 1673023 - DNA, 13 bp, Homo sapiens
atggaaaatacca

SEQ ID NO: 1673024 - DNA, 20 bp, Homo sapiens
atggaaaattttctccttgg

SEQ ID NO: 1673025 - DNA, 15 bp, Homo sapiens
atggaaactggccag

SEQ ID NO: 1673026 - DNA, 20 bp, Homo sapiens
atggaaagaaaagttattgc

SEQ ID NO: 1673027 - DNA, 17 bp, Homo sapiens
atggaaagaatctaata

SEQ ID NO: 1673028 - DNA, 16 bp, Homo sapiens
atggaaagacaaactg

SEQ ID NO: 1673029 - DNA, 23 bp, Homo sapiens
atggaaagcagagttttcattaa

SEQ ID NO: 1673030 - DNA, 17 bp, Homo sapiens
atggaaatacagttatt

SEQ ID NO: 1673031 - DNA, 18 bp, Homo sapiens
atggaaatacagttattt

SEQ ID NO: 1673032 - DNA, 15 bp, Homo sapiens
atggaaattctgaaa

SEQ ID NO: 1673033 - DNA, 16 bp, Homo sapiens
atggaacataaaatac

SEQ ID NO: 1673034 - DNA, 20 bp, Homo sapiens
atggaacataaagttgtatt

SEQ ID NO: 1673035 - DNA, 18 bp, Homo sapiens
atggaactactgtacttt

SEQ ID NO: 1673036 - DNA, 19 bp, Homo sapiens
atggaactactgtactttg

SEQ ID NO: 1673037 - DNA, 22 bp, Homo sapiens
atggaactcattcctgcctgtc

SEQ ID NO: 1673038 - DNA, 15 bp, Homo sapiens
atggaaggaagaaaa

SEQ ID NO: 1673039 - DNA, 16 bp, Homo sapiens
atggaaggagacttag

SEQ ID NO: 1673040 - DNA, 17 bp, Homo sapiens
atggaagtggcagtgaa

SEQ ID NO: 1673041 - DNA, 18 bp, Homo sapiens
atggaagtggcagtgaaa

SEQ ID NO: 1673042 - DNA, 15 bp, Homo sapiens
atggaagttttccta

SEQ ID NO: 1673043 - DNA, 14 bp, Homo sapiens
atggaataacatgt

SEQ ID NO: 1673044 - DNA, 15 bp, Homo sapiens
atggaatacagtgtt

SEQ ID NO: 1673045 - DNA, 22 bp, Homo sapiens
atggaatacagtgttattttct

SEQ ID NO: 1673046 - DNA, 15 bp, Homo sapiens
atggaatatcagaag

SEQ ID NO: 1673047 - DNA, 21 bp, Homo sapiens
atggaatcccactgtatgatt

SEQ ID NO: 1673048 - DNA, 17 bp, Homo sapiens
atggaatcgatttcctc

SEQ ID NO: 1673049 - DNA, 20 bp, Homo sapiens
atggaatcgatttcctccca

SEQ ID NO: 1673050 - DNA, 14 bp, Homo sapiens
atggaattattttg

SEQ ID NO: 1673051 - DNA, 17 bp, Homo sapiens
atggaattgcttaccaa

SEQ ID NO: 1673052 - DNA, 17 bp, Homo sapiens
atggaatttctcccagt

SEQ ID NO: 1673053 - DNA, 17 bp, Homo sapiens
atggacacgagccacaa

SEQ ID NO: 1673054 - DNA, 20 bp, Homo sapiens
atggacacgagccacaagct

SEQ ID NO: 1673055 - DNA, 22 bp, Homo sapiens
atggacactttgaaatgtgttt

SEQ ID NO: 1673056 - DNA, 14 bp, Homo sapiens
atggacccactacc

SEQ ID NO: 1673057 - DNA, 22 bp, Homo sapiens
atggacccactacccttctcct

SEQ ID NO: 1673058 - DNA, 18 bp, Homo sapiens
atggaccgggtgggcctg

SEQ ID NO: 1673059 - DNA, 20 bp, Homo sapiens
atggaccgggtgggcctggc

SEQ ID NO: 1673060 - DNA, 20 bp, Homo sapiens
atggactatctgtctggtgg

SEQ ID NO: 1673061 - DNA, 15 bp, Homo sapiens
atggactcctgacca

SEQ ID NO: 1673062 - DNA, 17 bp, Homo sapiens
atggacttgtatatttg

SEQ ID NO: 1673063 - DNA, 19 bp, Homo sapiens
atggagaaagaagtggaga

SEQ ID NO: 1673064 - DNA, 22 bp, Homo sapiens
atggagaaagaagtggagacag

SEQ ID NO: 1673065 - DNA, 18 bp, Homo sapiens
atggagacaccctctggg

SEQ ID NO: 1673066 - DNA, 19 bp, Homo sapiens
atggagacaccctctgggg

SEQ ID NO: 1673067 - DNA, 18 bp, Homo sapiens
atggagactcctgccctg

SEQ ID NO: 1673068 - DNA, 16 bp, Homo sapiens
atggagccccaccttg

SEQ ID NO: 1673069 - DNA, 22 bp, Homo sapiens
atggagccccaccttgtctgct

SEQ ID NO: 1673070 - DNA, 21 bp, Homo sapiens
atggagcctggcacaggactg

SEQ ID NO: 1673071 - DNA, 23 bp, Homo sapiens
atggagcctggcacaggactgat

SEQ ID NO: 1673072 - DNA, 24 bp, Homo sapiens
atggagctcacactccagtggcag

SEQ ID NO: 1673073 - DNA, 22 bp, Homo sapiens
atggagctcagtaacataactg

SEQ ID NO: 1673074 - DNA, 14 bp, Homo sapiens
atggagctgggcta

SEQ ID NO: 1673075 - DNA, 15 bp, Homo sapiens
atggagctttctgta

SEQ ID NO: 1673076 - DNA, 15 bp, Homo sapiens
atggaggaagaacaa

SEQ ID NO: 1673077 - DNA, 18 bp, Homo sapiens
atggaggattctttcccc

SEQ ID NO: 1673078 - DNA, 19 bp, Homo sapiens
atggaggattctttcccca

SEQ ID NO: 1673079 - DNA, 20 bp, Homo sapiens
atggaggattctttccccag

SEQ ID NO: 1673080 - DNA, 21 bp, Homo sapiens
atggaggattctttccccaga

SEQ ID NO: 1673081 - DNA, 12 bp, Homo sapiens
atggaggcctgt

SEQ ID NO: 1673082 - DNA, 19 bp, Homo sapiens
atggagggcaacattccac

SEQ ID NO: 1673083 - DNA, 20 bp, Homo sapiens
atggaggggtggtcctgact

SEQ ID NO: 1673084 - DNA, 15 bp, Homo sapiens
atggaggttctaagg

SEQ ID NO: 1673085 - DNA, 17 bp, Homo sapiens
atggaggttctaaggcc

SEQ ID NO: 1673086 - DNA, 22 bp, Homo sapiens
atggaggtttaccggttgttta

SEQ ID NO: 1673087 - DNA, 19 bp, Homo sapiens
atggagtggcaatatagaa

SEQ ID NO: 1673088 - DNA, 16 bp, Homo sapiens
atggagtgtacaagta

SEQ ID NO: 1673089 - DNA, 21 bp, Homo sapiens
atggagttaacgggtgaataa

SEQ ID NO: 1673090 - DNA, 14 bp, Homo sapiens
atggagtttctaag

SEQ ID NO: 1673091 - DNA, 13 bp, Homo sapiens
atggataaactga

SEQ ID NO: 1673092 - DNA, 17 bp, Homo sapiens
atggataaactgagcct

SEQ ID NO: 1673093 - DNA, 21 bp, Homo sapiens
atggataatgccggtgagaat

SEQ ID NO: 1673094 - DNA, 13 bp, Homo sapiens
atggatatatttg

SEQ ID NO: 1673095 - DNA, 15 bp, Homo sapiens
atggatatatttgaa

SEQ ID NO: 1673096 - DNA, 19 bp, Homo sapiens
atggatatatttgaaatag

SEQ ID NO: 1673097 - DNA, 14 bp, Homo sapiens
atggatatgctgct

SEQ ID NO: 1673098 - DNA, 19 bp, Homo sapiens
atggatgcccagaggactc

SEQ ID NO: 1673099 - DNA, 17 bp, Homo sapiens
atggatggcaccctgga

SEQ ID NO: 1673100 - DNA, 13 bp, Homo sapiens
atggatggggaga

SEQ ID NO: 1673101 - DNA, 15 bp, Homo sapiens
atggattccaaacca

SEQ ID NO: 1673102 - DNA, 16 bp, Homo sapiens
atggatttccactgct

SEQ ID NO: 1673103 - DNA, 14 bp, Homo sapiens
atggatttgcctgt

SEQ ID NO: 1673104 - DNA, 21 bp, Homo sapiens
atggatttgcctgtgccaccc

SEQ ID NO: 1673105 - DNA, 21 bp, Homo sapiens
atggattttgggagtgactca

SEQ ID NO: 1673106 - DNA, 18 bp, Homo sapiens
atggcaaaggaaggtgga

SEQ ID NO: 1673107 - DNA, 18 bp, Homo sapiens
atggcaaggcagccctgt

SEQ ID NO: 1673108 - DNA, 21 bp, Homo sapiens
atggcaaggcagccctgtctg

SEQ ID NO: 1673109 - DNA, 20 bp, Homo sapiens
atggcaagttgcatcagaaa

SEQ ID NO: 1673110 - DNA, 15 bp, Homo sapiens
atggcaattttgtaa

SEQ ID NO: 1673111 - DNA, 17 bp, Homo sapiens
atggcacagaaggatct

SEQ ID NO: 1673112 - DNA, 19 bp, Homo sapiens
atggcaccaaagccaccag

SEQ ID NO: 1673113 - DNA, 22 bp, Homo sapiens
atggcaccaacgggaccccctg

SEQ ID NO: 1673114 - DNA, 18 bp, Homo sapiens
atggcaccagccccctgg

SEQ ID NO: 1673115 - DNA, 19 bp, Homo sapiens
atggcaccagccccctgga

SEQ ID NO: 1673116 - DNA, 13 bp, Homo sapiens
atggcaccctgga

SEQ ID NO: 1673117 - DNA, 14 bp, Homo sapiens
atggcaccctggaa

SEQ ID NO: 1673118 - DNA, 14 bp, Homo sapiens
atggcacctcaggc

SEQ ID NO: 1673119 - DNA, 17 bp, Homo sapiens
atggcacctcaggctga

SEQ ID NO: 1673120 - DNA, 17 bp, Homo sapiens
atggcaccttcagactt

SEQ ID NO: 1673121 - DNA, 13 bp, Homo sapiens
atggcagagccag

SEQ ID NO: 1673122 - DNA, 19 bp, Homo sapiens
atggcagagtttgtgtgtt

SEQ ID NO: 1673123 - DNA, 22 bp, Homo sapiens
atggcagagtttgtgtgttgtc

SEQ ID NO: 1673124 - DNA, 23 bp, Homo sapiens
atggcagagtttgtgtgttgtct

SEQ ID NO: 1673125 - DNA, 21 bp, Homo sapiens
atggcagcagccagggacccc

SEQ ID NO: 1673126 - DNA, 19 bp, Homo sapiens
atggcagcctactctcctt

SEQ ID NO: 1673127 - DNA, 24 bp, Homo sapiens
atgtaagattatagattctaaaga

SEQ ID NO: 1673128 - DNA, 22 bp, Homo sapiens
atgtaagcaaaggctctgaaat

SEQ ID NO: 1673129 - DNA, 15 bp, Homo sapiens
atgtaagcatacttt

SEQ ID NO: 1673130 - DNA, 17 bp, Homo sapiens
atgtaagccaagtcatg

SEQ ID NO: 1673131 - DNA, 17 bp, Homo sapiens
atgtaagctctactgag

SEQ ID NO: 1673132 - DNA, 12 bp, Homo sapiens
atgtaaggcact

SEQ ID NO: 1673133 - DNA, 16 bp, Homo sapiens
atgtaagggaaactgc

SEQ ID NO: 1673134 - DNA, 11 bp, Homo sapiens
atgtaagggtc

SEQ ID NO: 1673135 - DNA, 13 bp, Homo sapiens
atgtaaggtatat

SEQ ID NO: 1673136 - DNA, 17 bp, Homo sapiens
atgtaagtgtggttttg

SEQ ID NO: 1673137 - DNA, 16 bp, Homo sapiens
atgtaataaactttaa

SEQ ID NO: 1673138 - DNA, 17 bp, Homo sapiens
atgtaataactgtgaag

SEQ ID NO: 1673139 - DNA, 22 bp, Homo sapiens
atgtaatagttctatccttttg

SEQ ID NO: 1673140 - DNA, 14 bp, Homo sapiens
atgtaatataaatt

SEQ ID NO: 1673141 - DNA, 21 bp, Homo sapiens
atgtaatatatttcagacatt

SEQ ID NO: 1673142 - DNA, 15 bp, Homo sapiens
atgtaatcaatgttt

SEQ ID NO: 1673143 - DNA, 17 bp, Homo sapiens
atgtaatcccagctact

SEQ ID NO: 1673144 - DNA, 19 bp, Homo sapiens
atgtaatctctctgcagct

SEQ ID NO: 1673145 - DNA, 21 bp, Homo sapiens
atgtaatctctctgcagctgc

SEQ ID NO: 1673146 - DNA, 23 bp, Homo sapiens
atgtaatctctctgcagctgccg

SEQ ID NO: 1673147 - DNA, 18 bp, Homo sapiens
atgtaatgttaatgttat

SEQ ID NO: 1673148 - DNA, 13 bp, Homo sapiens
atgtaatttaaat

SEQ ID NO: 1673149 - DNA, 16 bp, Homo sapiens
atgtaatttaaatgaa

SEQ ID NO: 1673150 - DNA, 20 bp, Homo sapiens
atgtaatttaaatgaaagaa

SEQ ID NO: 1673151 - DNA, 16 bp, Homo sapiens
atgtaatttcaaaata

SEQ ID NO: 1673152 - DNA, 17 bp, Homo sapiens
atgtaatttcaaaatac

SEQ ID NO: 1673153 - DNA, 15 bp, Homo sapiens
atgtaatttgtttcc

SEQ ID NO: 1673154 - DNA, 22 bp, Homo sapiens
atgtaatttgtttcccctagct

SEQ ID NO: 1673155 - DNA, 16 bp, Homo sapiens
atgtacaagttttgta

SEQ ID NO: 1673156 - DNA, 22 bp, Homo sapiens
atgtacaagttttgtataaata

SEQ ID NO: 1673157 - DNA, 13 bp, Homo sapiens
atgtacaatacaa

SEQ ID NO: 1673158 - DNA, 14 bp, Homo sapiens
atgtacaatacaat

SEQ ID NO: 1673159 - DNA, 20 bp, Homo sapiens
atgtacaatacaatgtacaa

SEQ ID NO: 1673160 - DNA, 19 bp, Homo sapiens
atgtacaattatgtctctt

SEQ ID NO: 1673161 - DNA, 22 bp, Homo sapiens
atgtacaattatgtctcttgag

SEQ ID NO: 1673162 - DNA, 15 bp, Homo sapiens
atgtacacaggtcaa

SEQ ID NO: 1673163 - DNA, 18 bp, Homo sapiens
atgtacactggatatgtt

SEQ ID NO: 1673164 - DNA, 18 bp, Homo sapiens
atgtacagattctttcag

SEQ ID NO: 1673165 - DNA, 21 bp, Homo sapiens
atgtacagattttatttgtaa

SEQ ID NO: 1673166 - DNA, 16 bp, Homo sapiens
atgtacagtctgtcat

SEQ ID NO: 1673167 - DNA, 17 bp, Homo sapiens
atgtacatagaccctct

SEQ ID NO: 1673168 - DNA, 21 bp, Homo sapiens
atgtacatagtaaagtatttt

SEQ ID NO: 1673169 - DNA, 15 bp, Homo sapiens
atgtacatgaagcaa

SEQ ID NO: 1673170 - DNA, 13 bp, Homo sapiens
atgtacatgtatt

SEQ ID NO: 1673171 - DNA, 14 bp, Homo sapiens
atgtacatgtatta

SEQ ID NO: 1673172 - DNA, 13 bp, Homo sapiens
atgtaccatcaat

SEQ ID NO: 1673173 - DNA, 21 bp, Homo sapiens
atgtaccatgtacatgaagaa

SEQ ID NO: 1673174 - DNA, 15 bp, Homo sapiens
atgtaccatttgcat

SEQ ID NO: 1673175 - DNA, 18 bp, Homo sapiens
atgtaccatttgcatggc

SEQ ID NO: 1673176 - DNA, 22 bp, Homo sapiens
atgtaccatttgcatggctcca

SEQ ID NO: 1673177 - DNA, 20 bp, Homo sapiens
atgtacgtccagcctgcccc

SEQ ID NO: 1673178 - DNA, 21 bp, Homo sapiens
atgtacgtttgtatgtgtgta

SEQ ID NO: 1673179 - DNA, 23 bp, Homo sapiens
atgtactaagaatgtccttattc

SEQ ID NO: 1673180 - DNA, 16 bp, Homo sapiens
atgtactacagctata

SEQ ID NO: 1673181 - DNA, 18 bp, Homo sapiens
atgtactacagctatatt

SEQ ID NO: 1673182 - DNA, 19 bp, Homo sapiens
atgtactacagctatattt

SEQ ID NO: 1673183 - DNA, 21 bp, Homo sapiens
atgtactacagctatatttga

SEQ ID NO: 1673184 - DNA, 20 bp, Homo sapiens
atgtactatgtctgaacata

SEQ ID NO: 1673185 - DNA, 20 bp, Homo sapiens
atgtactctgttgagtaaaa

SEQ ID NO: 1673186 - DNA, 22 bp, Homo sapiens
atgtactgcaaagtcgccagtc

SEQ ID NO: 1673187 - DNA, 16 bp, Homo sapiens
atgtactggtaattgt

SEQ ID NO: 1673188 - DNA, 20 bp, Homo sapiens
atgtacttcctgtgtactct

SEQ ID NO: 1673189 - DNA, 19 bp, Homo sapiens
atgtacttctctgtgtgca

SEQ ID NO: 1673190 - DNA, 15 bp, Homo sapiens
atgtacttgtttgct

SEQ ID NO: 1673191 - DNA, 20 bp, Homo sapiens
atgtacttttattttacaca

SEQ ID NO: 1673192 - DNA, 14 bp, Homo sapiens
atgtagaaacttaa

SEQ ID NO: 1673193 - DNA, 20 bp, Homo sapiens
atgtagaaagttgtaaaata

SEQ ID NO: 1673194 - DNA, 20 bp, Homo sapiens
atgtagaactcagcagttga

SEQ ID NO: 1673195 - DNA, 12 bp, Homo sapiens
atgtagaactgt

SEQ ID NO: 1673196 - DNA, 21 bp, Homo sapiens
atgtagaactgttcatttcca

SEQ ID NO: 1673197 - DNA, 16 bp, Homo sapiens
atgtagacagatattt

SEQ ID NO: 1673198 - DNA, 19 bp, Homo sapiens
atgtagagagaacaggtgg

SEQ ID NO: 1673199 - DNA, 21 bp, Homo sapiens
atgtagatattgttttctgta

SEQ ID NO: 1673200 - DNA, 22 bp, Homo sapiens
atgtagatattgttttctgtaa

SEQ ID NO: 1673201 - DNA, 17 bp, Homo sapiens
atgtagatgtgcatttt

SEQ ID NO: 1673202 - DNA, 17 bp, Homo sapiens
atgtgtacatatatgta

SEQ ID NO: 1673203 - DNA, 18 bp, Homo sapiens
atgtgtacattctgccta

SEQ ID NO: 1673204 - DNA, 15 bp, Homo sapiens
atgtgtagcctgtgc

SEQ ID NO: 1673205 - DNA, 13 bp, Homo sapiens
atgtgtataaaaa

SEQ ID NO: 1673206 - DNA, 14 bp, Homo sapiens
atgtgtataagaat

SEQ ID NO: 1673207 - DNA, 18 bp, Homo sapiens
atgtgtatcggatgcttt

SEQ ID NO: 1673208 - DNA, 20 bp, Homo sapiens
atgtgtatgcacagtaaaaa

SEQ ID NO: 1673209 - DNA, 19 bp, Homo sapiens
atgtgtatgtgagtattct

SEQ ID NO: 1673210 - DNA, 21 bp, Homo sapiens
atgtgtcaacttcaacattta

SEQ ID NO: 1673211 - DNA, 19 bp, Homo sapiens
atgtgtcagaataggaaaa

SEQ ID NO: 1673212 - DNA, 22 bp, Homo sapiens
atgtgtcagaataggaaaacat

SEQ ID NO: 1673213 - DNA, 23 bp, Homo sapiens
atgtgtcagaataggaaaacatt

SEQ ID NO: 1673214 - DNA, 20 bp, Homo sapiens
atgtgtcccgaatccacagt

SEQ ID NO: 1673215 - DNA, 18 bp, Homo sapiens
atgtgtcctatctatctt

SEQ ID NO: 1673216 - DNA, 19 bp, Homo sapiens
atgtgtcctatctatcttc

SEQ ID NO: 1673217 - DNA, 13 bp, Homo sapiens
atgtgtcctggtt

SEQ ID NO: 1673218 - DNA, 16 bp, Homo sapiens
atgtgtgaaacaatgt

SEQ ID NO: 1673219 - DNA, 15 bp, Homo sapiens
atgtgtgaggagctg

SEQ ID NO: 1673220 - DNA, 12 bp, Homo sapiens
atgtgtgcatgt

SEQ ID NO: 1673221 - DNA, 15 bp, Homo sapiens
atgtgtggcagattt

SEQ ID NO: 1673222 - DNA, 12 bp, Homo sapiens
atgtgtgtgtgt

SEQ ID NO: 1673223 - DNA, 19 bp, Homo sapiens
atgtgttattacttcctca

SEQ ID NO: 1673224 - DNA, 17 bp, Homo sapiens
atgtgttcattcaagct

SEQ ID NO: 1673225 - DNA, 18 bp, Homo sapiens
atgtgttcattcaagcta

SEQ ID NO: 1673226 - DNA, 21 bp, Homo sapiens
atgtgttcattcaagctattt

SEQ ID NO: 1673227 - DNA, 22 bp, Homo sapiens
atgtgttgcaaattattctagt

SEQ ID NO: 1673228 - DNA, 15 bp, Homo sapiens
atgtgttttagatgg

SEQ ID NO: 1673229 - DNA, 19 bp, Homo sapiens
atgttaaaaagaaatccag

SEQ ID NO: 1673230 - DNA, 11 bp, Homo sapiens
atgttaaaaga

SEQ ID NO: 1673231 - DNA, 23 bp, Homo sapiens
atgttaagaatgaagttctgcta

SEQ ID NO: 1673232 - DNA, 20 bp, Homo sapiens
atgttaagataacttactgt

SEQ ID NO: 1673233 - DNA, 21 bp, Homo sapiens
atgttaagataacttactgta

SEQ ID NO: 1673234 - DNA, 16 bp, Homo sapiens
atgttaatttatttag

SEQ ID NO: 1673235 - DNA, 13 bp, Homo sapiens
atgttaatttcat

SEQ ID NO: 1673236 - DNA, 20 bp, Homo sapiens
atgttacaagtttatatata

SEQ ID NO: 1673237 - DNA, 20 bp, Homo sapiens
atgttacacattaaacagga

SEQ ID NO: 1673238 - DNA, 17 bp, Homo sapiens
atgttacactaagggtg

SEQ ID NO: 1673239 - DNA, 18 bp, Homo sapiens
atgttactcagtgttaga

SEQ ID NO: 1673240 - DNA, 23 bp, Homo sapiens
atgttactcagtgttagagaaat

SEQ ID NO: 1673241 - DNA, 21 bp, Homo sapiens
atgttagaggttttaaagtga

SEQ ID NO: 1673242 - DNA, 22 bp, Homo sapiens
atgttagaggttttaaagtgat

SEQ ID NO: 1673243 - DNA, 16 bp, Homo sapiens
atgttagggtgctctg

SEQ ID NO: 1673244 - DNA, 16 bp, Homo sapiens
atgttagtcattgtta

SEQ ID NO: 1673245 - DNA, 22 bp, Homo sapiens
atgttagtcattgttatttata

SEQ ID NO: 1673246 - DNA, 22 bp, Homo sapiens
atgttagttaccttatagttac

SEQ ID NO: 1673247 - DNA, 15 bp, Homo sapiens
atgttatacaaggca

SEQ ID NO: 1673248 - DNA, 18 bp, Homo sapiens
atgttatatcatatgtat

SEQ ID NO: 1673249 - DNA, 14 bp, Homo sapiens
atgttatcggctct

SEQ ID NO: 1673250 - DNA, 16 bp, Homo sapiens
atgttatcggctctat

SEQ ID NO: 1673251 - DNA, 19 bp, Homo sapiens
atgttatcggctctattct

SEQ ID NO: 1673252 - DNA, 17 bp, Homo sapiens
atgttatcttctcaagt

SEQ ID NO: 1673253 - DNA, 21 bp, Homo sapiens
atgttatcttctcaagttcta

SEQ ID NO: 1673254 - DNA, 19 bp, Homo sapiens
atgttatgggatgtaaaca

SEQ ID NO: 1673255 - DNA, 20 bp, Homo sapiens
atgttatgggatgtaaacaa

SEQ ID NO: 1673256 - DNA, 21 bp, Homo sapiens
atgttatgggatgtaaacaat

SEQ ID NO: 1673257 - DNA, 16 bp, Homo sapiens
atgttatgtatatggt

SEQ ID NO: 1673258 - DNA, 18 bp, Homo sapiens
atgttattttctgttgaa

SEQ ID NO: 1673259 - DNA, 18 bp, Homo sapiens
atgttcaaagccacatta

SEQ ID NO: 1673260 - DNA, 15 bp, Homo sapiens
atgttcacaaggtac

SEQ ID NO: 1673261 - DNA, 12 bp, Homo sapiens
attattccctct

SEQ ID NO: 1673262 - DNA, 16 bp, Homo sapiens
attattctgattccac

SEQ ID NO: 1673263 - DNA, 13 bp, Homo sapiens
attattctgtttt

SEQ ID NO: 1673264 - DNA, 14 bp, Homo sapiens
attattctgttttg

SEQ ID NO: 1673265 - DNA, 12 bp, Homo sapiens
attattcttcag

SEQ ID NO: 1673266 - DNA, 20 bp, Homo sapiens
attattcttgttcagggaga

SEQ ID NO: 1673267 - DNA, 20 bp, Homo sapiens
attattctttctcctttttt

SEQ ID NO: 1673268 - DNA, 22 bp, Homo sapiens
attattgaatgttatatcatca

SEQ ID NO: 1673269 - DNA, 16 bp, Homo sapiens
attattgacactgaac

SEQ ID NO: 1673270 - DNA, 18 bp, Homo sapiens
attattgacactgaactt

SEQ ID NO: 1673271 - DNA, 19 bp, Homo sapiens
attattgagagccctagaa

SEQ ID NO: 1673272 - DNA, 20 bp, Homo sapiens
attattgctgtttggtttgt

SEQ ID NO: 1673273 - DNA, 18 bp, Homo sapiens
attattgtgacttcactg

SEQ ID NO: 1673274 - DNA, 23 bp, Homo sapiens
attattgtgtgttatttaaatga

SEQ ID NO: 1673275 - DNA, 13 bp, Homo sapiens
attatttattatt

SEQ ID NO: 1673276 - DNA, 12 bp, Homo sapiens
attatttattgt

SEQ ID NO: 1673277 - DNA, 15 bp, Homo sapiens
attatttatttattt

SEQ ID NO: 1673278 - DNA, 21 bp, Homo sapiens
attatttcactttagatgctg

SEQ ID NO: 1673279 - DNA, 16 bp, Homo sapiens
attatttgctatggca

SEQ ID NO: 1673280 - DNA, 12 bp, Homo sapiens
attatttgcttt

SEQ ID NO: 1673281 - DNA, 14 bp, Homo sapiens
attattttaaaata

SEQ ID NO: 1673282 - DNA, 19 bp, Homo sapiens
attattttaaaatatatga

SEQ ID NO: 1673283 - DNA, 14 bp, Homo sapiens
attattttcttcat

SEQ ID NO: 1673284 - DNA, 14 bp, Homo sapiens
attattttgtattc

SEQ ID NO: 1673285 - DNA, 14 bp, Homo sapiens
attatttttgtgtt

SEQ ID NO: 1673286 - DNA, 18 bp, Homo sapiens
attatttttttaaaattt

SEQ ID NO: 1673287 - DNA, 19 bp, Homo sapiens
attatttttttaaaatttt

SEQ ID NO: 1673288 - DNA, 20 bp, Homo sapiens
attatttttttaaaattttg

SEQ ID NO: 1673289 - DNA, 22 bp, Homo sapiens
attattttttttatatttattg

SEQ ID NO: 1673290 - DNA, 22 bp, Homo sapiens
attcaaaaaactctctcccagg

SEQ ID NO: 1673291 - DNA, 18 bp, Homo sapiens
attcaaaagtattgaaag

SEQ ID NO: 1673292 - DNA, 14 bp, Homo sapiens
attcaaaagttcca

SEQ ID NO: 1673293 - DNA, 16 bp, Homo sapiens
attcaaaagttccaag

SEQ ID NO: 1673294 - DNA, 12 bp, Homo sapiens
attcaaaatagt

SEQ ID NO: 1673295 - DNA, 22 bp, Homo sapiens
attcaaaatagttctatttcta

SEQ ID NO: 1673296 - DNA, 19 bp, Homo sapiens
attcaaaattgacattgct

SEQ ID NO: 1673297 - DNA, 18 bp, Homo sapiens
attcaaacagtctcagga

SEQ ID NO: 1673298 - DNA, 20 bp, Homo sapiens
attcaaacagtctcaggaaa

SEQ ID NO: 1673299 - DNA, 18 bp, Homo sapiens
attcaaagcataaaactt

SEQ ID NO: 1673300 - DNA, 12 bp, Homo sapiens
attcaaagcatg

SEQ ID NO: 1673301 - DNA, 15 bp, Homo sapiens
attcaaaggttctag

SEQ ID NO: 1673302 - DNA, 21 bp, Homo sapiens
attcaaaggttctaggtttca

SEQ ID NO: 1673303 - DNA, 12 bp, Homo sapiens
attcaaagtgtt

SEQ ID NO: 1673304 - DNA, 14 bp, Homo sapiens
attcaaataccaat

SEQ ID NO: 1673305 - DNA, 16 bp, Homo sapiens
attcaaatttgatgat

SEQ ID NO: 1673306 - DNA, 11 bp, Homo sapiens
attcaacaaat

SEQ ID NO: 1673307 - DNA, 13 bp, Homo sapiens
attcaacaaatga

SEQ ID NO: 1673308 - DNA, 19 bp, Homo sapiens
attcaacacttattttctg

SEQ ID NO: 1673309 - DNA, 15 bp, Homo sapiens
attcaactttgtaaa

SEQ ID NO: 1673310 - DNA, 14 bp, Homo sapiens
attcaacttttcta

SEQ ID NO: 1673311 - DNA, 13 bp, Homo sapiens
attcaagaaagga

SEQ ID NO: 1673312 - DNA, 21 bp, Homo sapiens
attcaagaatgaaaaatataa

SEQ ID NO: 1673313 - DNA, 21 bp, Homo sapiens
attcaagaatgccagtagaaa

SEQ ID NO: 1673314 - DNA, 16 bp, Homo sapiens
attcaagagcctcccc

SEQ ID NO: 1673315 - DNA, 21 bp, Homo sapiens
attcaaggcatttctatcaca

SEQ ID NO: 1673316 - DNA, 19 bp, Homo sapiens
attcaaggctcagaaggaa

SEQ ID NO: 1673317 - DNA, 14 bp, Homo sapiens
attcaagtgcctct

SEQ ID NO: 1673318 - DNA, 22 bp, Homo sapiens
attcaataccgctcagtatttt

SEQ ID NO: 1673319 - DNA, 16 bp, Homo sapiens
attcaatattgacatt

SEQ ID NO: 1673320 - DNA, 19 bp, Homo sapiens
attcaatattgacatttgt

SEQ ID NO: 1673321 - DNA, 19 bp, Homo sapiens
attcaatcatttattcatt

SEQ ID NO: 1673322 - DNA, 18 bp, Homo sapiens
attcaatctgtaaactgt

SEQ ID NO: 1673323 - DNA, 13 bp, Homo sapiens
attcaatgaactt

SEQ ID NO: 1673324 - DNA, 21 bp, Homo sapiens
attcaattagtggtcataaaa

SEQ ID NO: 1673325 - DNA, 22 bp, Homo sapiens
attcaattagtggtcataaaat

SEQ ID NO: 1673326 - DNA, 16 bp, Homo sapiens
attcaattcctctggg

SEQ ID NO: 1673327 - DNA, 16 bp, Homo sapiens
attcacacacccctca

SEQ ID NO: 1673328 - DNA, 15 bp, Homo sapiens
attcacagagccttt

SEQ ID NO: 1673329 - DNA, 24 bp, Homo sapiens
attcacagtggtcccatttatatc

SEQ ID NO: 1673330 - DNA, 13 bp, Homo sapiens
attcacatttgat

SEQ ID NO: 1673331 - DNA, 23 bp, Homo sapiens
attcacatttgatgtacatgtgt

SEQ ID NO: 1673332 - DNA, 22 bp, Homo sapiens
attcaccaacacagttgggacc

SEQ ID NO: 1673333 - DNA, 16 bp, Homo sapiens
atgtcctaaggacaca

SEQ ID NO: 1673334 - DNA, 17 bp, Homo sapiens
atgtcctaaggacacac

SEQ ID NO: 1673335 - DNA, 19 bp, Homo sapiens
atgtcctccagaagcctct

SEQ ID NO: 1673336 - DNA, 20 bp, Homo sapiens
atgtcctccagaagcctctg

SEQ ID NO: 1673337 - DNA, 22 bp, Homo sapiens
atgtcctgcctattatctgtca

SEQ ID NO: 1673338 - DNA, 13 bp, Homo sapiens
atgtcctgccttt

SEQ ID NO: 1673339 - DNA, 13 bp, Homo sapiens
atgtcctgtaaag

SEQ ID NO: 1673340 - DNA, 15 bp, Homo sapiens
atgtcctgtcctggt

SEQ ID NO: 1673341 - DNA, 14 bp, Homo sapiens
atgtcgattaaaat

SEQ ID NO: 1673342 - DNA, 12 bp, Homo sapiens
atgtcgcttttg

SEQ ID NO: 1673343 - DNA, 18 bp, Homo sapiens
atgtcgcttttgggcctc

SEQ ID NO: 1673344 - DNA, 21 bp, Homo sapiens
atgtcggtcatagtttcctga

SEQ ID NO: 1673345 - DNA, 19 bp, Homo sapiens
atgtcgtagaattccttcg

SEQ ID NO: 1673346 - DNA, 19 bp, Homo sapiens
atgtctactcagcatttga

SEQ ID NO: 1673347 - DNA, 13 bp, Homo sapiens
atgtctactgctt

SEQ ID NO: 1673348 - DNA, 14 bp, Homo sapiens
atgtctattcagct

SEQ ID NO: 1673349 - DNA, 16 bp, Homo sapiens
atgtctattcagcttc

SEQ ID NO: 1673350 - DNA, 16 bp, Homo sapiens
atgtctattttcttga

SEQ ID NO: 1673351 - DNA, 21 bp, Homo sapiens
atgtctattttcttgaggaaa

SEQ ID NO: 1673352 - DNA, 18 bp, Homo sapiens
atgtctcctcaacccaca

SEQ ID NO: 1673353 - DNA, 16 bp, Homo sapiens
atgtctcctttgctct

SEQ ID NO: 1673354 - DNA, 20 bp, Homo sapiens
atgtctcctttgctcttgcc

SEQ ID NO: 1673355 - DNA, 13 bp, Homo sapiens
atgtctctcagaa

SEQ ID NO: 1673356 - DNA, 12 bp, Homo sapiens
atgtctctgcct

SEQ ID NO: 1673357 - DNA, 16 bp, Homo sapiens
atgtctcttctgagct

SEQ ID NO: 1673358 - DNA, 18 bp, Homo sapiens
atgtctcttgagcatcaa

SEQ ID NO: 1673359 - DNA, 21 bp, Homo sapiens
atgtctcttgagcatcaatct

SEQ ID NO: 1673360 - DNA, 16 bp, Homo sapiens
atgtctcttgtagaag

SEQ ID NO: 1673361 - DNA, 15 bp, Homo sapiens
atgtctctttaagtt

SEQ ID NO: 1673362 - DNA, 17 bp, Homo sapiens
atgtctgaaacagagaa

SEQ ID NO: 1673363 - DNA, 19 bp, Homo sapiens
atgtctgagatacgtctgt

SEQ ID NO: 1673364 - DNA, 20 bp, Homo sapiens
atgtctgagcggcgcagagc

SEQ ID NO: 1673365 - DNA, 13 bp, Homo sapiens
atgtctgccaatt

SEQ ID NO: 1673366 - DNA, 13 bp, Homo sapiens
atgtctgccttcg

SEQ ID NO: 1673367 - DNA, 21 bp, Homo sapiens
atgtctgccttcgaccacagc

SEQ ID NO: 1673368 - DNA, 13 bp, Homo sapiens
atgtctgctgagt

SEQ ID NO: 1673369 - DNA, 12 bp, Homo sapiens
atgtctgtaaat

SEQ ID NO: 1673370 - DNA, 16 bp, Homo sapiens
atgtctgtagctcctc

SEQ ID NO: 1673371 - DNA, 18 bp, Homo sapiens
atgtctgtagctcctcaa

SEQ ID NO: 1673372 - DNA, 17 bp, Homo sapiens
atgtctgtatactcctg

SEQ ID NO: 1673373 - DNA, 17 bp, Homo sapiens
atgtctgtgtatgtata

SEQ ID NO: 1673374 - DNA, 14 bp, Homo sapiens
atgtctgttctaca

SEQ ID NO: 1673375 - DNA, 23 bp, Homo sapiens
atgtctgtttattaactactgaa

SEQ ID NO: 1673376 - DNA, 19 bp, Homo sapiens
atgtctgtttttgtatctt

SEQ ID NO: 1673377 - DNA, 20 bp, Homo sapiens
atgtcttaacgaataaaggt

SEQ ID NO: 1673378 - DNA, 17 bp, Homo sapiens
atgtcttctgcctgtta

SEQ ID NO: 1673379 - DNA, 15 bp, Homo sapiens
atgtcttcttttgtg

SEQ ID NO: 1673380 - DNA, 20 bp, Homo sapiens
atgtcttggaacattggaat

SEQ ID NO: 1673381 - DNA, 15 bp, Homo sapiens
attcagacatctgag

SEQ ID NO: 1673382 - DNA, 18 bp, Homo sapiens
attcagactaaaaataca

SEQ ID NO: 1673383 - DNA, 19 bp, Homo sapiens
attcagactttcacaccat

SEQ ID NO: 1673384 - DNA, 12 bp, Homo sapiens
attcagaggcag

SEQ ID NO: 1673385 - DNA, 15 bp, Homo sapiens
attcagaggcagtga

SEQ ID NO: 1673386 - DNA, 18 bp, Homo sapiens
attcagatatatttttca

SEQ ID NO: 1673387 - DNA, 14 bp, Homo sapiens
attcagcaaatatt

SEQ ID NO: 1673388 - DNA, 17 bp, Homo sapiens
attcagcaccctgggtg

SEQ ID NO: 1673389 - DNA, 21 bp, Homo sapiens
attcagcaccctgggtgccat

SEQ ID NO: 1673390 - DNA, 18 bp, Homo sapiens
attcagccctcagaagaa

SEQ ID NO: 1673391 - DNA, 14 bp, Homo sapiens
attcagctctggag

SEQ ID NO: 1673392 - DNA, 17 bp, Homo sapiens
attcagctctggagaac

SEQ ID NO: 1673393 - DNA, 21 bp, Homo sapiens
attcaggacttaacggctcca

SEQ ID NO: 1673394 - DNA, 21 bp, Homo sapiens
attcaggagagtagaacagat

SEQ ID NO: 1673395 - DNA, 11 bp, Homo sapiens
attcaggcagc

SEQ ID NO: 1673396 - DNA, 17 bp, Homo sapiens
attcaggcagcagtgtc

SEQ ID NO: 1673397 - DNA, 15 bp, Homo sapiens
attcaggccagccca

SEQ ID NO: 1673398 - DNA, 18 bp, Homo sapiens
attcaggccagcccagcc

SEQ ID NO: 1673399 - DNA, 23 bp, Homo sapiens
attcaggccagcccagccaggcc

SEQ ID NO: 1673400 - DNA, 11 bp, Homo sapiens
attcaggctgc

SEQ ID NO: 1673401 - DNA, 13 bp, Homo sapiens
attcaggctgctt

SEQ ID NO: 1673402 - DNA, 16 bp, Homo sapiens
attcaggctgcttggg

SEQ ID NO: 1673403 - DNA, 17 bp, Homo sapiens
attcaggtatgttgcct

SEQ ID NO: 1673404 - DNA, 16 bp, Homo sapiens
attcaggtggccagaa

SEQ ID NO: 1673405 - DNA, 16 bp, Homo sapiens
attcaggtttttcctt

SEQ ID NO: 1673406 - DNA, 14 bp, Homo sapiens
attcagtaaacaaa

SEQ ID NO: 1673407 - DNA, 12 bp, Homo sapiens
attcagtcacat

SEQ ID NO: 1673408 - DNA, 18 bp, Homo sapiens
attcagtccgcctggccg

SEQ ID NO: 1673409 - DNA, 16 bp, Homo sapiens
attcagtgagggtctt

SEQ ID NO: 1673410 - DNA, 16 bp, Homo sapiens
attcagtgccttcaac

SEQ ID NO: 1673411 - DNA, 21 bp, Homo sapiens
attcagtgctgtggcctgggc

SEQ ID NO: 1673412 - DNA, 22 bp, Homo sapiens
attcagttcccaccatctgatt

SEQ ID NO: 1673413 - DNA, 19 bp, Homo sapiens
attcagtttttttccagtt

SEQ ID NO: 1673414 - DNA, 14 bp, Homo sapiens
attcataaaaataa

SEQ ID NO: 1673415 - DNA, 13 bp, Homo sapiens
attcataatgaat

SEQ ID NO: 1673416 - DNA, 18 bp, Homo sapiens
attcataatgaattataa

SEQ ID NO: 1673417 - DNA, 14 bp, Homo sapiens
attcatattaagac

SEQ ID NO: 1673418 - DNA, 15 bp, Homo sapiens
attcatattaagaca

SEQ ID NO: 1673419 - DNA, 17 bp, Homo sapiens
attcatattaagacagt

SEQ ID NO: 1673420 - DNA, 19 bp, Homo sapiens
attcatattaagacagtgt

SEQ ID NO: 1673421 - DNA, 23 bp, Homo sapiens
attcatattaagacagtgtacaa

SEQ ID NO: 1673422 - DNA, 12 bp, Homo sapiens
attcatatttgt

SEQ ID NO: 1673423 - DNA, 15 bp, Homo sapiens
attcatatttgtact

SEQ ID NO: 1673424 - DNA, 21 bp, Homo sapiens
attcatatttgtactttctgt

SEQ ID NO: 1673425 - DNA, 23 bp, Homo sapiens
attcatatttgtactttctgtta

SEQ ID NO: 1673426 - DNA, 20 bp, Homo sapiens
attcatcctgggatgtaaac

SEQ ID NO: 1673427 - DNA, 21 bp, Homo sapiens
attcatcctgggatgtaaacc

SEQ ID NO: 1673428 - DNA, 19 bp, Homo sapiens
attcatctgggaggcagaa

SEQ ID NO: 1673429 - DNA, 20 bp, Homo sapiens
attcatctgtttttcttttt

SEQ ID NO: 1673430 - DNA, 17 bp, Homo sapiens
attcatgagctgggtac

SEQ ID NO: 1673431 - DNA, 17 bp, Homo sapiens
attcatgtattttgttt

SEQ ID NO: 1673432 - DNA, 17 bp, Homo sapiens
attcatgttcatgtgat

SEQ ID NO: 1673433 - DNA, 20 bp, Homo sapiens
attcatgttcatgtgattaa

SEQ ID NO: 1673434 - DNA, 13 bp, Homo sapiens
attcatgtttctt

SEQ ID NO: 1673435 - DNA, 15 bp, Homo sapiens
attcatgtttcttaa

SEQ ID NO: 1673436 - DNA, 14 bp, Homo sapiens
attcattcttagct

SEQ ID NO: 1673437 - DNA, 20 bp, Homo sapiens
attcattgagcagttagctc

SEQ ID NO: 1673438 - DNA, 13 bp, Homo sapiens
attcattgtctct

SEQ ID NO: 1673439 - DNA, 13 bp, Homo sapiens
attcatttcctgc

SEQ ID NO: 1673440 - DNA, 11 bp, Homo sapiens
attcatttcta

SEQ ID NO: 1673441 - DNA, 19 bp, Homo sapiens
attcatttctagactcaaa

SEQ ID NO: 1673442 - DNA, 19 bp, Homo sapiens
attcatttgagttatttta

SEQ ID NO: 1673443 - DNA, 12 bp, Homo sapiens
attcatttgtgg

SEQ ID NO: 1673444 - DNA, 13 bp, Homo sapiens
attcattttcctg

SEQ ID NO: 1673445 - DNA, 17 bp, Homo sapiens
attcattttttaaattc

SEQ ID NO: 1673446 - DNA, 14 bp, Homo sapiens
attccaaaatatta

SEQ ID NO: 1673447 - DNA, 15 bp, Homo sapiens
attccaaaatattat

SEQ ID NO: 1673448 - DNA, 15 bp, Homo sapiens
attccaaatatgtat

SEQ ID NO: 1673449 - DNA, 13 bp, Homo sapiens
attccaaattcat

SEQ ID NO: 1673450 - DNA, 23 bp, Homo sapiens
attccaacaatggggtgggccca

SEQ ID NO: 1673451 - DNA, 20 bp, Homo sapiens
attccaacagctcaagtctt

SEQ ID NO: 1673452 - DNA, 16 bp, Homo sapiens
attccaagactctaga

SEQ ID NO: 1673453 - DNA, 12 bp, Homo sapiens
attccaataaac

SEQ ID NO: 1673454 - DNA, 14 bp, Homo sapiens
attccaatctctgt

SEQ ID NO: 1673455 - DNA, 23 bp, Homo sapiens
attccacaggtcatcagatgcct

SEQ ID NO: 1673456 - DNA, 19 bp, Homo sapiens
attccactacacctggctg

SEQ ID NO: 1673457 - DNA, 19 bp, Homo sapiens
attccagaagaagagaagc

SEQ ID NO: 1673458 - DNA, 21 bp, Homo sapiens
attccagaagaagagaagctg

SEQ ID NO: 1673459 - DNA, 16 bp, Homo sapiens
attccagatctttcag

SEQ ID NO: 1673460 - DNA, 20 bp, Homo sapiens
attccagatctttcagaaat

SEQ ID NO: 1673461 - DNA, 12 bp, Homo sapiens
attccagctctg

SEQ ID NO: 1673462 - DNA, 15 bp, Homo sapiens
attccagctctgccc

SEQ ID NO: 1673463 - DNA, 13 bp, Homo sapiens
attccaggagaag

SEQ ID NO: 1673464 - DNA, 18 bp, Homo sapiens
attccaggctgagccatg

SEQ ID NO: 1673465 - DNA, 19 bp, Homo sapiens
attccaggctgagccatga

SEQ ID NO: 1673466 - DNA, 23 bp, Homo sapiens
attccaggctgagccatgaggag

SEQ ID NO: 1673467 - DNA, 16 bp, Homo sapiens
attccagtaacttttt

SEQ ID NO: 1673468 - DNA, 17 bp, Homo sapiens
attccagtacagtattc

SEQ ID NO: 1673469 - DNA, 20 bp, Homo sapiens
attccagtcaaatctgggct

SEQ ID NO: 1673470 - DNA, 17 bp, Homo sapiens
attccatatttattcaa

SEQ ID NO: 1673471 - DNA, 15 bp, Homo sapiens
attccatgaatgttc

SEQ ID NO: 1673472 - DNA, 18 bp, Homo sapiens
attccatgagctgctcat

SEQ ID NO: 1673473 - DNA, 17 bp, Homo sapiens
attccattggtccaaga

SEQ ID NO: 1673474 - DNA, 18 bp, Homo sapiens
attccatttaaaaaacaa

SEQ ID NO: 1673475 - DNA, 16 bp, Homo sapiens
attccatttccagttc

SEQ ID NO: 1673476 - DNA, 15 bp, Homo sapiens
attcccttctgggct

SEQ ID NO: 1673477 - DNA, 17 bp, Homo sapiens
attcccttgaattgtgt

SEQ ID NO: 1673478 - DNA, 17 bp, Homo sapiens
attcccttgtattttgt

SEQ ID NO: 1673479 - DNA, 15 bp, Homo sapiens
attccgaagagggaa

SEQ ID NO: 1673480 - DNA, 18 bp, Homo sapiens
attccgagcattccagta

SEQ ID NO: 1673481 - DNA, 22 bp, Homo sapiens
attccggaaactagtgtacatt

SEQ ID NO: 1673482 - DNA, 17 bp, Homo sapiens
attccggactggcagaa

SEQ ID NO: 1673483 - DNA, 20 bp, Homo sapiens
attccggactggcagaagca

SEQ ID NO: 1673484 - DNA, 15 bp, Homo sapiens
attccggatcctaag

SEQ ID NO: 1673485 - DNA, 19 bp, Homo sapiens
attccgttgtctgtggatg

SEQ ID NO: 1673486 - DNA, 18 bp, Homo sapiens
attcctaaagaaaaatat

SEQ ID NO: 1673487 - DNA, 17 bp, Homo sapiens
attcctaacctgtcaga

SEQ ID NO: 1673488 - DNA, 18 bp, Homo sapiens
attcctaactagaattag

SEQ ID NO: 1673489 - DNA, 20 bp, Homo sapiens
attcctaactagaattagta

SEQ ID NO: 1673490 - DNA, 18 bp, Homo sapiens
attcctaagagtggagga

SEQ ID NO: 1673491 - DNA, 14 bp, Homo sapiens
attcctacaactta

SEQ ID NO: 1673492 - DNA, 18 bp, Homo sapiens
attcctagaaattgaaca

SEQ ID NO: 1673493 - DNA, 16 bp, Homo sapiens
attcctcagctgccaa

SEQ ID NO: 1673494 - DNA, 17 bp, Homo sapiens
attcctcatgaatgtaa

SEQ ID NO: 1673495 - DNA, 22 bp, Homo sapiens
attcctcatgaatgtaaatttg

SEQ ID NO: 1673496 - DNA, 12 bp, Homo sapiens
attcctcccagg

SEQ ID NO: 1673497 - DNA, 11 bp, Homo sapiens
attcctccctc

SEQ ID NO: 1673498 - DNA, 14 bp, Homo sapiens
attcctcctgctca

SEQ ID NO: 1673499 - DNA, 16 bp, Homo sapiens
attcctcctgctcata

SEQ ID NO: 1673500 - DNA, 14 bp, Homo sapiens
attcctctccaggc

SEQ ID NO: 1673501 - DNA, 13 bp, Homo sapiens
attcctctgggaa

SEQ ID NO: 1673502 - DNA, 19 bp, Homo sapiens
attcctgaatgaaatatca

SEQ ID NO: 1673503 - DNA, 11 bp, Homo sapiens
attcctgaccc

SEQ ID NO: 1673504 - DNA, 16 bp, Homo sapiens
attcctgatatgattt

SEQ ID NO: 1673505 - DNA, 20 bp, Homo sapiens
attcctgatatgatttaaaa

SEQ ID NO: 1673506 - DNA, 22 bp, Homo sapiens
attcctgatatgatttaaaaca

SEQ ID NO: 1673507 - DNA, 16 bp, Homo sapiens
attcctgatcccatgg

SEQ ID NO: 1673508 - DNA, 19 bp, Homo sapiens
attcctgatcccatggcca

SEQ ID NO: 1673509 - DNA, 21 bp, Homo sapiens
attcctggagcccgaggcacc

SEQ ID NO: 1673510 - DNA, 18 bp, Homo sapiens
attcctggtacccagcca

SEQ ID NO: 1673511 - DNA, 20 bp, Homo sapiens
attcctgtgttcaatattta

SEQ ID NO: 1673512 - DNA, 21 bp, Homo sapiens
attcctgttgctgtcttcagt

SEQ ID NO: 1673513 - DNA, 13 bp, Homo sapiens
attccttcactca

SEQ ID NO: 1673514 - DNA, 14 bp, Homo sapiens
attccttcactcat

SEQ ID NO: 1673515 - DNA, 19 bp, Homo sapiens
attccttcgaaaggccttc

SEQ ID NO: 1673516 - DNA, 22 bp, Homo sapiens
attccttctcttttttcagaga

SEQ ID NO: 1673517 - DNA, 21 bp, Homo sapiens
attccttggcatgccttccag

SEQ ID NO: 1673518 - DNA, 17 bp, Homo sapiens
attccttgtcaccagca

SEQ ID NO: 1673519 - DNA, 18 bp, Homo sapiens
attccttttgatggggag

SEQ ID NO: 1673520 - DNA, 18 bp, Homo sapiens
attccttttgtgtacagt

SEQ ID NO: 1673521 - DNA, 21 bp, Homo sapiens
attcgctgtaccctttaagat

SEQ ID NO: 1673522 - DNA, 12 bp, Homo sapiens
attcgctgtccc

SEQ ID NO: 1673523 - DNA, 14 bp, Homo sapiens
attcgctgtcccct

SEQ ID NO: 1673524 - DNA, 18 bp, Homo sapiens
attcgctgtcccctcagc

SEQ ID NO: 1673525 - DNA, 19 bp, Homo sapiens
attcgctgtcccctcagcg

SEQ ID NO: 1673526 - DNA, 20 bp, Homo sapiens
attcggaactgtcctttcct

SEQ ID NO: 1673527 - DNA, 14 bp, Homo sapiens
attcggacggccaa

SEQ ID NO: 1673528 - DNA, 22 bp, Homo sapiens
attcggacggccaatggtgctt

SEQ ID NO: 1673529 - DNA, 16 bp, Homo sapiens
attcggactgctgtgc

SEQ ID NO: 1673530 - DNA, 18 bp, Homo sapiens
attcggtgtgctgccaac

SEQ ID NO: 1673531 - DNA, 14 bp, Homo sapiens
attcgtgagctggg

SEQ ID NO: 1673532 - DNA, 22 bp, Homo sapiens
attcgtgagctggggactcagg

SEQ ID NO: 1673533 - DNA, 21 bp, Homo sapiens
attcgtgattttcaagcagca

SEQ ID NO: 1673534 - DNA, 15 bp, Homo sapiens
attctaaaacattct

SEQ ID NO: 1673535 - DNA, 20 bp, Homo sapiens
attctaaaatgtgatgttct

SEQ ID NO: 1673536 - DNA, 14 bp, Homo sapiens
attctaaagattct

SEQ ID NO: 1673537 - DNA, 15 bp, Homo sapiens
attctaaagattcta

SEQ ID NO: 1673538 - DNA, 17 bp, Homo sapiens
attctaaagattctata

SEQ ID NO: 1673539 - DNA, 21 bp, Homo sapiens
attctaaatccgacttgaata

SEQ ID NO: 1673540 - DNA, 17 bp, Homo sapiens
attctaaatgaatgttt

SEQ ID NO: 1673541 - DNA, 18 bp, Homo sapiens
attctaagccagttttca

SEQ ID NO: 1673542 - DNA, 20 bp, Homo sapiens
attctaagccagttttcatt

SEQ ID NO: 1673543 - DNA, 13 bp, Homo sapiens
attctaagttatt

SEQ ID NO: 1673544 - DNA, 21 bp, Homo sapiens
attctaagttatttactttta

SEQ ID NO: 1673545 - DNA, 18 bp, Homo sapiens
attctaataaatatacta

SEQ ID NO: 1673546 - DNA, 22 bp, Homo sapiens
attctacaaaaaaccaggatgc

SEQ ID NO: 1673547 - DNA, 16 bp, Homo sapiens
attctacacatgtaaa

SEQ ID NO: 1673548 - DNA, 22 bp, Homo sapiens
attctacagaaagaaaaatgca

SEQ ID NO: 1673549 - DNA, 15 bp, Homo sapiens
attctacagtttctt

SEQ ID NO: 1673550 - DNA, 15 bp, Homo sapiens
attctactcttgtca

SEQ ID NO: 1673551 - DNA, 13 bp, Homo sapiens
attctactggaaa

SEQ ID NO: 1673552 - DNA, 17 bp, Homo sapiens
attctactggcctgtaa

SEQ ID NO: 1673553 - DNA, 19 bp, Homo sapiens
attctactggcctgtaatc

SEQ ID NO: 1673554 - DNA, 16 bp, Homo sapiens
attctactttgagtgc

SEQ ID NO: 1673555 - DNA, 22 bp, Homo sapiens
attctagatcctgcaccccagc

SEQ ID NO: 1673556 - DNA, 18 bp, Homo sapiens
attctagctaatgtaata

SEQ ID NO: 1673557 - DNA, 21 bp, Homo sapiens
attctagctgtatgatttgtt

SEQ ID NO: 1673558 - DNA, 13 bp, Homo sapiens
attctagtatttt

SEQ ID NO: 1673559 - DNA, 15 bp, Homo sapiens
attctagtcaactgc

SEQ ID NO: 1673560 - DNA, 14 bp, Homo sapiens
attctagtgctgct

SEQ ID NO: 1673561 - DNA, 17 bp, Homo sapiens
attctagtgctgctgaa

SEQ ID NO: 1673562 - DNA, 23 bp, Homo sapiens
attctagtgtctgacttttgtta

SEQ ID NO: 1673563 - DNA, 16 bp, Homo sapiens
attctagttttgtcaa

SEQ ID NO: 1673564 - DNA, 15 bp, Homo sapiens
attctataaaactct

SEQ ID NO: 1673565 - DNA, 17 bp, Homo sapiens
attctataaattcaaca

SEQ ID NO: 1673566 - DNA, 13 bp, Homo sapiens
attctatagttct

SEQ ID NO: 1673567 - DNA, 16 bp, Homo sapiens
attctatagttctaga

SEQ ID NO: 1673568 - DNA, 17 bp, Homo sapiens
attctatagttctagac

SEQ ID NO: 1673569 - DNA, 16 bp, Homo sapiens
attctatatgaattta

SEQ ID NO: 1673570 - DNA, 17 bp, Homo sapiens
attctatatgaatttaa

SEQ ID NO: 1673571 - DNA, 17 bp, Homo sapiens
attctatccatctcctg

SEQ ID NO: 1673572 - DNA, 16 bp, Homo sapiens
attctatgcctgtatt

SEQ ID NO: 1673573 - DNA, 23 bp, Homo sapiens
attctatggaatagttctgtata

SEQ ID NO: 1673574 - DNA, 21 bp, Homo sapiens
attctatgtatgttaatttat

SEQ ID NO: 1673575 - DNA, 13 bp, Homo sapiens
attctattgaaaa

SEQ ID NO: 1673576 - DNA, 16 bp, Homo sapiens
attctcaagccctgca

SEQ ID NO: 1673577 - DNA, 23 bp, Homo sapiens
attctcacataagcccagttcat

SEQ ID NO: 1673578 - DNA, 14 bp, Homo sapiens
attctcagaatctc

SEQ ID NO: 1673579 - DNA, 18 bp, Homo sapiens
attctcagaatctcaaat

SEQ ID NO: 1673580 - DNA, 19 bp, Homo sapiens
attctcataggagactgcg

SEQ ID NO: 1673581 - DNA, 20 bp, Homo sapiens
attctcatgcctcagcctct

SEQ ID NO: 1673582 - DNA, 18 bp, Homo sapiens
attctcattaaaagaata

SEQ ID NO: 1673583 - DNA, 12 bp, Homo sapiens
attctcattctt

SEQ ID NO: 1673584 - DNA, 15 bp, Homo sapiens
attctccaacagctg

SEQ ID NO: 1673585 - DNA, 23 bp, Homo sapiens
attctcccgcctcagcctcctga

SEQ ID NO: 1673586 - DNA, 21 bp, Homo sapiens
attctcccttctctcttttct

SEQ ID NO: 1673587 - DNA, 23 bp, Homo sapiens
attctcctgcctcagcctcccaa

SEQ ID NO: 1673588 - DNA, 13 bp, Homo sapiens
attctcctgtgct

SEQ ID NO: 1673589 - DNA, 15 bp, Homo sapiens
attctccttcagccc

SEQ ID NO: 1673590 - DNA, 22 bp, Homo sapiens
attctccttcagccctcacccc

SEQ ID NO: 1673591 - DNA, 18 bp, Homo sapiens
attctccttgttgttggt

SEQ ID NO: 1673592 - DNA, 19 bp, Homo sapiens
attctcgtttaaacaacaa

SEQ ID NO: 1673593 - DNA, 14 bp, Homo sapiens
attctctccaaaaa

SEQ ID NO: 1673594 - DNA, 10 bp, Homo sapiens
attctctctc

SEQ ID NO: 1673595 - DNA, 17 bp, Homo sapiens
attctctctcctgtcca

SEQ ID NO: 1673596 - DNA, 23 bp, Homo sapiens
attctctgcaatttgtttaaaga

SEQ ID NO: 1673597 - DNA, 14 bp, Homo sapiens
attctcttcactcc

SEQ ID NO: 1673598 - DNA, 16 bp, Homo sapiens
attctcttgaataaag

SEQ ID NO: 1673599 - DNA, 17 bp, Homo sapiens
attctctttgataacaa

SEQ ID NO: 1673600 - DNA, 20 bp, Homo sapiens
attctctttgataacaaaaa

SEQ ID NO: 1673601 - DNA, 14 bp, Homo sapiens
attctgaaaactga

SEQ ID NO: 1673602 - DNA, 11 bp, Homo sapiens
attctgaacca

SEQ ID NO: 1673603 - DNA, 22 bp, Homo sapiens
attctgacatgtaagaaaatgt

SEQ ID NO: 1673604 - DNA, 20 bp, Homo sapiens
attctgactcggtttctcca

SEQ ID NO: 1673605 - DNA, 12 bp, Homo sapiens
attctgactgtc

SEQ ID NO: 1673606 - DNA, 20 bp, Homo sapiens
attctgactgtccaggagct

SEQ ID NO: 1673607 - DNA, 14 bp, Homo sapiens
attctgacttcctc

SEQ ID NO: 1673608 - DNA, 14 bp, Homo sapiens
attctgagccttga

SEQ ID NO: 1673609 - DNA, 15 bp, Homo sapiens
attctgatgtttctg

SEQ ID NO: 1673610 - DNA, 14 bp, Homo sapiens
attctgatttcagt

SEQ ID NO: 1673611 - DNA, 15 bp, Homo sapiens
attctgcagcatgac

SEQ ID NO: 1673612 - DNA, 22 bp, Homo sapiens
attctgcagcatgacctgtgac

SEQ ID NO: 1673613 - DNA, 21 bp, Homo sapiens
attctgcagctgcttttgcat

SEQ ID NO: 1673614 - DNA, 16 bp, Homo sapiens
attctgcccaaaaata

SEQ ID NO: 1673615 - DNA, 22 bp, Homo sapiens
attctgccgtgtgccctcgggc

SEQ ID NO: 1673616 - DNA, 15 bp, Homo sapiens
attctgcctcagcct

SEQ ID NO: 1673617 - DNA, 19 bp, Homo sapiens
attctgcctcagcctcctg

SEQ ID NO: 1673618 - DNA, 15 bp, Homo sapiens
attctgcctctctag

SEQ ID NO: 1673619 - DNA, 21 bp, Homo sapiens
attctggaatacatattccat

SEQ ID NO: 1673620 - DNA, 23 bp, Homo sapiens
attctggaatacatattccatgg

SEQ ID NO: 1673621 - DNA, 15 bp, Homo sapiens
attctggatctcctg

SEQ ID NO: 1673622 - DNA, 19 bp, Homo sapiens
attctggcccagccaatct

SEQ ID NO: 1673623 - DNA, 19 bp, Homo sapiens
attctggctttaagccttc

SEQ ID NO: 1673624 - DNA, 10 bp, Homo sapiens
attctgggaa

SEQ ID NO: 1673625 - DNA, 21 bp, Homo sapiens
attctgggaagcttgagcctc

SEQ ID NO: 1673626 - DNA, 22 bp, Homo sapiens
attctgggaggcaagaaaagga

SEQ ID NO: 1673627 - DNA, 21 bp, Homo sapiens
attctgggctcctggaaccaa

SEQ ID NO: 1673628 - DNA, 19 bp, Homo sapiens
attctggttccagggtccc

SEQ ID NO: 1673629 - DNA, 12 bp, Homo sapiens
attctgtaaatg

SEQ ID NO: 1673630 - DNA, 13 bp, Homo sapiens
attctgtactgat

SEQ ID NO: 1673631 - DNA, 15 bp, Homo sapiens
attctgtactgattt

SEQ ID NO: 1673632 - DNA, 21 bp, Homo sapiens
attctgtactgatttttgtaa

SEQ ID NO: 1673633 - DNA, 14 bp, Homo sapiens
attctgtagttgca

SEQ ID NO: 1673634 - DNA, 20 bp, Homo sapiens
attctgtatccgtgaattgc

SEQ ID NO: 1673635 - DNA, 17 bp, Homo sapiens
attctgtcatagaaagt

SEQ ID NO: 1673636 - DNA, 17 bp, Homo sapiens
attctgtggaacaagcc

SEQ ID NO: 1673637 - DNA, 15 bp, Homo sapiens
attctgtggattcta

SEQ ID NO: 1673638 - DNA, 22 bp, Homo sapiens
attctgtgtcagagcccagccc

SEQ ID NO: 1673639 - DNA, 13 bp, Homo sapiens
attctgtgttgaa

SEQ ID NO: 1673640 - DNA, 20 bp, Homo sapiens
attctgttgcatagactagt

SEQ ID NO: 1673641 - DNA, 14 bp, Homo sapiens
attctgttgcttta

SEQ ID NO: 1673642 - DNA, 15 bp, Homo sapiens
attctgttgctttac

SEQ ID NO: 1673643 - DNA, 14 bp, Homo sapiens
attctgttgttcca

SEQ ID NO: 1673644 - DNA, 21 bp, Homo sapiens
attctgttgttccattttatg

SEQ ID NO: 1673645 - DNA, 21 bp, Homo sapiens
attctgtttattcttccagaa

SEQ ID NO: 1673646 - DNA, 22 bp, Homo sapiens
attctgtttgcgtacttgtaat

SEQ ID NO: 1673647 - DNA, 19 bp, Homo sapiens
attctgtttttaatgctat

SEQ ID NO: 1673648 - DNA, 17 bp, Homo sapiens
attcttaaaaattgaat

SEQ ID NO: 1673649 - DNA, 17 bp, Homo sapiens
attcttaattctctgca

SEQ ID NO: 1673650 - DNA, 18 bp, Homo sapiens
attcttacaattgcactg

SEQ ID NO: 1673651 - DNA, 16 bp, Homo sapiens
attcttatgttccaga

SEQ ID NO: 1673652 - DNA, 20 bp, Homo sapiens
attcttatgttccagatggc

SEQ ID NO: 1673653 - DNA, 21 bp, Homo sapiens
attcttattgacaattgtgta

SEQ ID NO: 1673654 - DNA, 13 bp, Homo sapiens
attcttatttaat

SEQ ID NO: 1673655 - DNA, 17 bp, Homo sapiens
attcttcacctttgtaa

SEQ ID NO: 1673656 - DNA, 11 bp, Homo sapiens
attcttccaga

SEQ ID NO: 1673657 - DNA, 12 bp, Homo sapiens
attcttccagaa

SEQ ID NO: 1673658 - DNA, 18 bp, Homo sapiens
attcttccatcatcactg

SEQ ID NO: 1673659 - DNA, 18 bp, Homo sapiens
attcttcccgctccccac

SEQ ID NO: 1673660 - DNA, 24 bp, Homo sapiens
attcttcccgctccccacctaccc

SEQ ID NO: 1673661 - DNA, 17 bp, Homo sapiens
attcttcctagttttct

SEQ ID NO: 1673662 - DNA, 19 bp, Homo sapiens
attcttcctagttttctcc

SEQ ID NO: 1673663 - DNA, 13 bp, Homo sapiens
attcttctgaact

SEQ ID NO: 1673664 - DNA, 20 bp, Homo sapiens
attcttctggtgctactcca

SEQ ID NO: 1673665 - DNA, 13 bp, Homo sapiens
attcttctgtcct

SEQ ID NO: 1673666 - DNA, 13 bp, Homo sapiens
attcttctgtgtt

SEQ ID NO: 1673667 - DNA, 15 bp, Homo sapiens
attcttctgtgttta

SEQ ID NO: 1673668 - DNA, 15 bp, Homo sapiens
attcttgaaggaaaa

SEQ ID NO: 1673669 - DNA, 18 bp, Homo sapiens
attcttgaaggaaaatga

SEQ ID NO: 1673670 - DNA, 21 bp, Homo sapiens
attcttgatgaaaagctttgt

SEQ ID NO: 1673671 - DNA, 14 bp, Homo sapiens
attcttgatgtaaa

SEQ ID NO: 1673672 - DNA, 18 bp, Homo sapiens
attcttgatgtaaaatct

SEQ ID NO: 1673673 - DNA, 17 bp, Homo sapiens
attcttgattcctggct

SEQ ID NO: 1673674 - DNA, 22 bp, Homo sapiens
attcttgattttcaagctttca

SEQ ID NO: 1673675 - DNA, 15 bp, Homo sapiens
attcttgtaaatctt

SEQ ID NO: 1673676 - DNA, 18 bp, Homo sapiens
attcttgtgggagacagc

SEQ ID NO: 1673677 - DNA, 19 bp, Homo sapiens
attcttgtgggagacagca

SEQ ID NO: 1673678 - DNA, 20 bp, Homo sapiens
attcttgtgggagacagcag

SEQ ID NO: 1673679 - DNA, 17 bp, Homo sapiens
attcttgtggttaaaaa

SEQ ID NO: 1673680 - DNA, 20 bp, Homo sapiens
attcttgtggttaaaaacct

SEQ ID NO: 1673681 - DNA, 19 bp, Homo sapiens
attcttgttggtagcatgt

SEQ ID NO: 1673682 - DNA, 13 bp, Homo sapiens
attcttgtttgaa

SEQ ID NO: 1673683 - DNA, 14 bp, Homo sapiens
attcttgtttgaat

SEQ ID NO: 1673684 - DNA, 21 bp, Homo sapiens
attcttgtttgaattcctcct

SEQ ID NO: 1673685 - DNA, 15 bp, Homo sapiens
attctttaaggagat

SEQ ID NO: 1673686 - DNA, 18 bp, Homo sapiens
attctttaaggagataga

SEQ ID NO: 1673687 - DNA, 15 bp, Homo sapiens
attctttaatagaag

SEQ ID NO: 1673688 - DNA, 22 bp, Homo sapiens
attctttagtactcaatgtttc

SEQ ID NO: 1673689 - DNA, 17 bp, Homo sapiens
attctttccattatgat

SEQ ID NO: 1673690 - DNA, 12 bp, Homo sapiens
atttaaaaataa

SEQ ID NO: 1673691 - DNA, 13 bp, Homo sapiens
atttaaaaatatt

SEQ ID NO: 1673692 - DNA, 14 bp, Homo sapiens
atttaaaaatattt

SEQ ID NO: 1673693 - DNA, 13 bp, Homo sapiens
atttaaaaattgt

SEQ ID NO: 1673694 - DNA, 15 bp, Homo sapiens
atttaaaacagacac

SEQ ID NO: 1673695 - DNA, 17 bp, Homo sapiens
atttaaaacagacactg

SEQ ID NO: 1673696 - DNA, 15 bp, Homo sapiens
atttaaaacatgtaa

SEQ ID NO: 1673697 - DNA, 21 bp, Homo sapiens
atttaaaactgggtcatcatt

SEQ ID NO: 1673698 - DNA, 18 bp, Homo sapiens
atttaaaagattcatttt

SEQ ID NO: 1673699 - DNA, 19 bp, Homo sapiens
atttaaaagattcattttt

SEQ ID NO: 1673700 - DNA, 23 bp, Homo sapiens
atttaaaaggatggcaagttgca

SEQ ID NO: 1673701 - DNA, 14 bp, Homo sapiens
atttaaaataaatt

SEQ ID NO: 1673702 - DNA, 21 bp, Homo sapiens
atttaaaattaagtagaacaa

SEQ ID NO: 1673703 - DNA, 17 bp, Homo sapiens
atttaaaattaatcttg

SEQ ID NO: 1673704 - DNA, 21 bp, Homo sapiens
atttaaaattgctatgttact

SEQ ID NO: 1673705 - DNA, 15 bp, Homo sapiens
atttaaaattgtgat

SEQ ID NO: 1673706 - DNA, 20 bp, Homo sapiens
atttaaaattgtgatgtgtc

SEQ ID NO: 1673707 - DNA, 21 bp, Homo sapiens
atttaaaatttcgttgtccaa

SEQ ID NO: 1673708 - DNA, 19 bp, Homo sapiens
atttaaacaataaatgtgc

SEQ ID NO: 1673709 - DNA, 14 bp, Homo sapiens
atttaaacacacag

SEQ ID NO: 1673710 - DNA, 15 bp, Homo sapiens
atttaaacaggccca

SEQ ID NO: 1673711 - DNA, 16 bp, Homo sapiens
atttaaactatcttgt

SEQ ID NO: 1673712 - DNA, 19 bp, Homo sapiens
atttaaagaaaataaacac

SEQ ID NO: 1673713 - DNA, 16 bp, Homo sapiens
atttaaagatctttta

SEQ ID NO: 1673714 - DNA, 21 bp, Homo sapiens
atttaaagctaaattttgtta

SEQ ID NO: 1673715 - DNA, 15 bp, Homo sapiens
atttaaatataattc

SEQ ID NO: 1673716 - DNA, 20 bp, Homo sapiens
atttaaatataattctgtaa

SEQ ID NO: 1673717 - DNA, 13 bp, Homo sapiens
atttaaatgaaag

SEQ ID NO: 1673718 - DNA, 13 bp, Homo sapiens
atttaaatgccat

SEQ ID NO: 1673719 - DNA, 12 bp, Homo sapiens
atttaaatttga

SEQ ID NO: 1673720 - DNA, 21 bp, Homo sapiens
atttaaatttgatttccatct

SEQ ID NO: 1673721 - DNA, 17 bp, Homo sapiens
atttaaatttttttcct

SEQ ID NO: 1673722 - DNA, 21 bp, Homo sapiens
atttaacaatgacaagatgtt

SEQ ID NO: 1673723 - DNA, 18 bp, Homo sapiens
atttaacagaaattgtat

SEQ ID NO: 1673724 - DNA, 15 bp, Homo sapiens
atttaacagtcattt

SEQ ID NO: 1673725 - DNA, 16 bp, Homo sapiens
atttaacagtcattta

SEQ ID NO: 1673726 - DNA, 16 bp, Homo sapiens
atttaacattatttat

SEQ ID NO: 1673727 - DNA, 22 bp, Homo sapiens
atttaactactaagaataaata

SEQ ID NO: 1673728 - DNA, 12 bp, Homo sapiens
atttaactgcat

SEQ ID NO: 1673729 - DNA, 17 bp, Homo sapiens
atttaactgcatataga

SEQ ID NO: 1673730 - DNA, 18 bp, Homo sapiens
atttaactgcatatagat

SEQ ID NO: 1673731 - DNA, 13 bp, Homo sapiens
atttaagaaaaca

SEQ ID NO: 1673732 - DNA, 14 bp, Homo sapiens
atttaagaaaacac

SEQ ID NO: 1673733 - DNA, 21 bp, Homo sapiens
atttaagaaaatacaataaac

SEQ ID NO: 1673734 - DNA, 15 bp, Homo sapiens
atttaagataattat

SEQ ID NO: 1673735 - DNA, 13 bp, Homo sapiens
atttaagatatat

SEQ ID NO: 1673736 - DNA, 15 bp, Homo sapiens
atttaagcaaacgtc

SEQ ID NO: 1673737 - DNA, 21 bp, Homo sapiens
atttaagcaaaggctccctcg

SEQ ID NO: 1673738 - DNA, 21 bp, Homo sapiens
atttaagccttacaaagggaa

SEQ ID NO: 1673739 - DNA, 17 bp, Homo sapiens
atttaagccttttgtgt

SEQ ID NO: 1673740 - DNA, 12 bp, Homo sapiens
atttaaggatgg

SEQ ID NO: 1673741 - DNA, 13 bp, Homo sapiens
atttaaggatgga

SEQ ID NO: 1673742 - DNA, 21 bp, Homo sapiens
atttaaggatggatggcaccc

SEQ ID NO: 1673743 - DNA, 23 bp, Homo sapiens
atttaaggatggatggcaccctg

SEQ ID NO: 1673744 - DNA, 21 bp, Homo sapiens
atttataaacagacaatatgt

SEQ ID NO: 1673745 - DNA, 17 bp, Homo sapiens
atttataaagctaaaat

SEQ ID NO: 1673746 - DNA, 22 bp, Homo sapiens
atttataaatatatttaagata

SEQ ID NO: 1673747 - DNA, 20 bp, Homo sapiens
atttataacgtgttcaatat

SEQ ID NO: 1673748 - DNA, 20 bp, Homo sapiens
atttataactcatcataaaa

SEQ ID NO: 1673749 - DNA, 17 bp, Homo sapiens
atttataatacagaatc

SEQ ID NO: 1673750 - DNA, 13 bp, Homo sapiens
atttatacaagat

SEQ ID NO: 1673751 - DNA, 19 bp, Homo sapiens
atttatacaggtcatatta

SEQ ID NO: 1673752 - DNA, 19 bp, Homo sapiens
atttatacccccaggaaac

SEQ ID NO: 1673753 - DNA, 11 bp, Homo sapiens
atttatactct

SEQ ID NO: 1673754 - DNA, 14 bp, Homo sapiens
atttatactttgca

SEQ ID NO: 1673755 - DNA, 22 bp, Homo sapiens
atttatactttgcaatccaaat

SEQ ID NO: 1673756 - DNA, 23 bp, Homo sapiens
atttatagaacagttgatttccc

SEQ ID NO: 1673757 - DNA, 20 bp, Homo sapiens
atttatataaaacttaaaaa

SEQ ID NO: 1673758 - DNA, 14 bp, Homo sapiens
atttatatatttat

SEQ ID NO: 1673759 - DNA, 16 bp, Homo sapiens
atttatatatttataa

SEQ ID NO: 1673760 - DNA, 15 bp, Homo sapiens
atttatatttagtaa

SEQ ID NO: 1673761 - DNA, 18 bp, Homo sapiens
atttatatttggaaagag

SEQ ID NO: 1673762 - DNA, 13 bp, Homo sapiens
atttatcaaatca

SEQ ID NO: 1673763 - DNA, 14 bp, Homo sapiens
atttatcaaatcag

SEQ ID NO: 1673764 - DNA, 18 bp, Homo sapiens
atttatcaatcagtataa

SEQ ID NO: 1673765 - DNA, 23 bp, Homo sapiens
atttatcaatttttcccagtatt

SEQ ID NO: 1673766 - DNA, 17 bp, Homo sapiens
atttatcagtgacagag

SEQ ID NO: 1673767 - DNA, 23 bp, Homo sapiens
atttatcagtgacagagttcact

SEQ ID NO: 1673768 - DNA, 17 bp, Homo sapiens
atttatccaaaatgtgt

SEQ ID NO: 1673769 - DNA, 18 bp, Homo sapiens
atttatccaaaatgtgta

SEQ ID NO: 1673770 - DNA, 19 bp, Homo sapiens
atttatccaaaatgtgtat

SEQ ID NO: 1673771 - DNA, 16 bp, Homo sapiens
atttatccagaaaact

SEQ ID NO: 1673772 - DNA, 19 bp, Homo sapiens
atttatcctagtattccta

SEQ ID NO: 1673773 - DNA, 18 bp, Homo sapiens
atttatcctgaaatttca

SEQ ID NO: 1673774 - DNA, 19 bp, Homo sapiens
atttatcttgtctctgggc

SEQ ID NO: 1673775 - DNA, 24 bp, Homo sapiens
atttatctttaccaaaaaccatgt

SEQ ID NO: 1673776 - DNA, 22 bp, Homo sapiens
atttatctttacttttaaacag

SEQ ID NO: 1673777 - DNA, 22 bp, Homo sapiens
atttatgaaaaaatatgaacct

SEQ ID NO: 1673778 - DNA, 15 bp, Homo sapiens
atttatgaagaaaat

SEQ ID NO: 1673779 - DNA, 19 bp, Homo sapiens
atttatgaagaaaatactt

SEQ ID NO: 1673780 - DNA, 18 bp, Homo sapiens
atttatgacctgaaataa

SEQ ID NO: 1673781 - DNA, 16 bp, Homo sapiens
atttatgcatttcatt

SEQ ID NO: 1673782 - DNA, 18 bp, Homo sapiens
atttatgcatttcattca

SEQ ID NO: 1673783 - DNA, 12 bp, Homo sapiens
atttatggagga

SEQ ID NO: 1673784 - DNA, 13 bp, Homo sapiens
atttatgggcccc

SEQ ID NO: 1673785 - DNA, 12 bp, Homo sapiens
atttatgtaaac

SEQ ID NO: 1673786 - DNA, 23 bp, Homo sapiens
atttatgtaaactgcattagaaa

SEQ ID NO: 1673787 - DNA, 14 bp, Homo sapiens
atttatgtagatgt

SEQ ID NO: 1673788 - DNA, 20 bp, Homo sapiens
atttatgtagatgtgcattt

SEQ ID NO: 1673789 - DNA, 18 bp, Homo sapiens
atttatgtgaaatgcttt

SEQ ID NO: 1673790 - DNA, 12 bp, Homo sapiens
atttatgtgcac

SEQ ID NO: 1673791 - DNA, 12 bp, Homo sapiens
atttattaatat

SEQ ID NO: 1673792 - DNA, 21 bp, Homo sapiens
atttattacaaatcagaactt

SEQ ID NO: 1673793 - DNA, 15 bp, Homo sapiens
atttattacacaaag

SEQ ID NO: 1673794 - DNA, 15 bp, Homo sapiens
atttattagccaact

SEQ ID NO: 1673795 - DNA, 19 bp, Homo sapiens
atttattatttatttatta

SEQ ID NO: 1673796 - DNA, 21 bp, Homo sapiens
atttattattttttttatatt

SEQ ID NO: 1673797 - DNA, 12 bp, Homo sapiens
atttattcaagt

SEQ ID NO: 1673798 - DNA, 19 bp, Homo sapiens
atttattcaattcctctgg

SEQ ID NO: 1673799 - DNA, 15 bp, Homo sapiens
atttattcactgtaa

SEQ ID NO: 1673800 - DNA, 16 bp, Homo sapiens
atttattcataatgaa

SEQ ID NO: 1673801 - DNA, 13 bp, Homo sapiens
atttattcctgtt

SEQ ID NO: 1673802 - DNA, 14 bp, Homo sapiens
atttattgactttg

SEQ ID NO: 1673803 - DNA, 18 bp, Homo sapiens
atttattgactttgacaa

SEQ ID NO: 1673804 - DNA, 20 bp, Homo sapiens
atttattgattaaaaatgtg

SEQ ID NO: 1673805 - DNA, 24 bp, Homo sapiens
atttattgcagaggatgttcataa

SEQ ID NO: 1673806 - DNA, 16 bp, Homo sapiens
atttattgcattgctg

SEQ ID NO: 1673807 - DNA, 14 bp, Homo sapiens
atttattggttttg

SEQ ID NO: 1673808 - DNA, 17 bp, Homo sapiens
atttattgtattaggaa

SEQ ID NO: 1673809 - DNA, 13 bp, Homo sapiens
atttattgtctgt

SEQ ID NO: 1673810 - DNA, 16 bp, Homo sapiens
atttattgtctgtcta

SEQ ID NO: 1673811 - DNA, 19 bp, Homo sapiens
atttattgtttatgtaaat

SEQ ID NO: 1673812 - DNA, 21 bp, Homo sapiens
atttattgtttatgtaaatgt

SEQ ID NO: 1673813 - DNA, 14 bp, Homo sapiens
atttatttaaattt

SEQ ID NO: 1673814 - DNA, 23 bp, Homo sapiens
atttatttacagatgaatgtatt

SEQ ID NO: 1673815 - DNA, 24 bp, Homo sapiens
atttatttactgagcttctctgtg

SEQ ID NO: 1673816 - DNA, 13 bp, Homo sapiens
atttatttatatt

SEQ ID NO: 1673817 - DNA, 13 bp, Homo sapiens
atttatttatgaa

SEQ ID NO: 1673818 - DNA, 18 bp, Homo sapiens
atttatttatgtactttt

SEQ ID NO: 1673819 - DNA, 14 bp, Homo sapiens
atttatttatgtgt

SEQ ID NO: 1673820 - DNA, 14 bp, Homo sapiens
atttatttcaaaaa

SEQ ID NO: 1673821 - DNA, 14 bp, Homo sapiens
atttatttgaaaat

SEQ ID NO: 1673822 - DNA, 13 bp, Homo sapiens
atttatttgtttc

SEQ ID NO: 1673823 - DNA, 16 bp, Homo sapiens
atttattttataagaa

SEQ ID NO: 1673824 - DNA, 16 bp, Homo sapiens
atttattttcctaaag

SEQ ID NO: 1673825 - DNA, 19 bp, Homo sapiens
atttcaaaaaaataaaata

SEQ ID NO: 1673826 - DNA, 19 bp, Homo sapiens
atttcaaaaatataactta

SEQ ID NO: 1673827 - DNA, 14 bp, Homo sapiens
atttcaaaactcat

SEQ ID NO: 1673828 - DNA, 13 bp, Homo sapiens
atttcaaaatata

SEQ ID NO: 1673829 - DNA, 19 bp, Homo sapiens
atttcaaacttaaacaaaa

SEQ ID NO: 1673830 - DNA, 23 bp, Homo sapiens
atttcaaacttaaacaaaaaact

SEQ ID NO: 1673831 - DNA, 15 bp, Homo sapiens
atttcaaagccctgc

SEQ ID NO: 1673832 - DNA, 22 bp, Homo sapiens
atttcaaagccctgcctctgtg

SEQ ID NO: 1673833 - DNA, 23 bp, Homo sapiens
atttcaaagccctgcctctgtgt

SEQ ID NO: 1673834 - DNA, 18 bp, Homo sapiens
atttcaaagttttgttgt

SEQ ID NO: 1673835 - DNA, 14 bp, Homo sapiens
atttcaaatgcaga

SEQ ID NO: 1673836 - DNA, 15 bp, Homo sapiens
atttcaaatgcagaa

SEQ ID NO: 1673837 - DNA, 19 bp, Homo sapiens
atttcaacatgagtgtatt

SEQ ID NO: 1673838 - DNA, 14 bp, Homo sapiens
atttcaactaatgt

SEQ ID NO: 1673839 - DNA, 17 bp, Homo sapiens
atttcaagacagattgt

SEQ ID NO: 1673840 - DNA, 21 bp, Homo sapiens
atttcaagacattaaatctat

SEQ ID NO: 1673841 - DNA, 14 bp, Homo sapiens
atttcaaggttcta

SEQ ID NO: 1673842 - DNA, 17 bp, Homo sapiens
atttcaaggttctaacc

SEQ ID NO: 1673843 - DNA, 16 bp, Homo sapiens
atttcaagtgcctaga

SEQ ID NO: 1673844 - DNA, 23 bp, Homo sapiens
atttcaagtgcctagactgttac

SEQ ID NO: 1673845 - DNA, 11 bp, Homo sapiens
atttcaagttc

SEQ ID NO: 1673846 - DNA, 16 bp, Homo sapiens
atttcaatcttttaaa

SEQ ID NO: 1673847 - DNA, 22 bp, Homo sapiens
atttcaatcttttaaattgcaa

SEQ ID NO: 1673848 - DNA, 15 bp, Homo sapiens
atttcacaacagatc

SEQ ID NO: 1673849 - DNA, 17 bp, Homo sapiens
atttcacacataagaaa

SEQ ID NO: 1673850 - DNA, 22 bp, Homo sapiens
atttcacagtgcccaagagtgg

SEQ ID NO: 1673851 - DNA, 23 bp, Homo sapiens
atttcacagtgtgtttgtgattg

SEQ ID NO: 1673852 - DNA, 15 bp, Homo sapiens
atttcacatgccttg

SEQ ID NO: 1673853 - DNA, 16 bp, Homo sapiens
atttcacatgccttgc

SEQ ID NO: 1673854 - DNA, 21 bp, Homo sapiens
atttcacattaatatttgctg

SEQ ID NO: 1673855 - DNA, 22 bp, Homo sapiens
atttcacattaatatttgctga

SEQ ID NO: 1673856 - DNA, 18 bp, Homo sapiens
atttcaccagaagttaca

SEQ ID NO: 1673857 - DNA, 12 bp, Homo sapiens
atttcaccagca

SEQ ID NO: 1673858 - DNA, 14 bp, Homo sapiens
atttcaccagcagc

SEQ ID NO: 1673859 - DNA, 15 bp, Homo sapiens
atttcacccctccct

SEQ ID NO: 1673860 - DNA, 16 bp, Homo sapiens
atttcacctgtaaacc

SEQ ID NO: 1673861 - DNA, 18 bp, Homo sapiens
attttaagggggaaaact

SEQ ID NO: 1673862 - DNA, 15 bp, Homo sapiens
attttaagtaggaaa

SEQ ID NO: 1673863 - DNA, 12 bp, Homo sapiens
attttaagtgct

SEQ ID NO: 1673864 - DNA, 20 bp, Homo sapiens
attttaagtgctttgtaatg

SEQ ID NO: 1673865 - DNA, 17 bp, Homo sapiens
attttaagtttgtagta

SEQ ID NO: 1673866 - DNA, 15 bp, Homo sapiens
attttaatagaaata

SEQ ID NO: 1673867 - DNA, 20 bp, Homo sapiens
attttaatagggaatatatc

SEQ ID NO: 1673868 - DNA, 15 bp, Homo sapiens
attttaatattttgt

SEQ ID NO: 1673869 - DNA, 20 bp, Homo sapiens
attttctatcagaagttgta

SEQ ID NO: 1673870 - DNA, 15 bp, Homo sapiens
attttctcaatctcc

SEQ ID NO: 1673871 - DNA, 14 bp, Homo sapiens
attttctcttagaa

SEQ ID NO: 1673872 - DNA, 16 bp, Homo sapiens
attttctcttagaaaa

SEQ ID NO: 1673873 - DNA, 19 bp, Homo sapiens
attttctgaattcataaaa

SEQ ID NO: 1673874 - DNA, 22 bp, Homo sapiens
attttctgcagctgtttcaaag

SEQ ID NO: 1673875 - DNA, 12 bp, Homo sapiens
attttctgtaag

SEQ ID NO: 1673876 - DNA, 20 bp, Homo sapiens
attttctgtaagagaaaata

SEQ ID NO: 1673877 - DNA, 18 bp, Homo sapiens
attttctgtgcctgaata

SEQ ID NO: 1673878 - DNA, 21 bp, Homo sapiens
attttctgtgcctgaatattt

SEQ ID NO: 1673879 - DNA, 21 bp, Homo sapiens
attttcttattgcgctgctac

SEQ ID NO: 1673880 - DNA, 14 bp, Homo sapiens
attttcttcatgca

SEQ ID NO: 1673881 - DNA, 18 bp, Homo sapiens
attttcttcatgcaatga

SEQ ID NO: 1673882 - DNA, 14 bp, Homo sapiens
attttctttctatg

SEQ ID NO: 1673883 - DNA, 21 bp, Homo sapiens
attttctttctatgtagaact

SEQ ID NO: 1673884 - DNA, 15 bp, Homo sapiens
attttctttgaaatt

SEQ ID NO: 1673885 - DNA, 23 bp, Homo sapiens
attttctttgtgtagctttgctc

SEQ ID NO: 1673886 - DNA, 15 bp, Homo sapiens
attttctttgtttct

SEQ ID NO: 1673887 - DNA, 18 bp, Homo sapiens
attttcttttatatctgt

SEQ ID NO: 1673888 - DNA, 20 bp, Homo sapiens
attttcttttatatctgtaa

SEQ ID NO: 1673889 - DNA, 22 bp, Homo sapiens
attttcttttatatctgtaaat

SEQ ID NO: 1673890 - DNA, 20 bp, Homo sapiens
attttcttttctttcaactt

SEQ ID NO: 1673891 - DNA, 16 bp, Homo sapiens
attttcttttgtaaat

SEQ ID NO: 1673892 - DNA, 13 bp, Homo sapiens
attttctttttcg

SEQ ID NO: 1673893 - DNA, 22 bp, Homo sapiens
attttgaaacaaagtactcttt

SEQ ID NO: 1673894 - DNA, 19 bp, Homo sapiens
attttgaagtgctgtttat

SEQ ID NO: 1673895 - DNA, 11 bp, Homo sapiens
attttgaatac

SEQ ID NO: 1673896 - DNA, 22 bp, Homo sapiens
attttgaataccattaaaactg

SEQ ID NO: 1673897 - DNA, 17 bp, Homo sapiens
attttgacctactctca

SEQ ID NO: 1673898 - DNA, 18 bp, Homo sapiens
attttgacctactctcat

SEQ ID NO: 1673899 - DNA, 17 bp, Homo sapiens
attttgactgtgattta

SEQ ID NO: 1673900 - DNA, 13 bp, Homo sapiens
attttgagaaact

SEQ ID NO: 1673901 - DNA, 13 bp, Homo sapiens
attttgagatgta

SEQ ID NO: 1673902 - DNA, 19 bp, Homo sapiens
attttgagatgtaaaaaga

SEQ ID NO: 1673903 - DNA, 18 bp, Homo sapiens
attttgagtattccatga

SEQ ID NO: 1673904 - DNA, 19 bp, Homo sapiens
attttgataccagaaggga

SEQ ID NO: 1673905 - DNA, 20 bp, Homo sapiens
attttgatctcacattttta

SEQ ID NO: 1673906 - DNA, 15 bp, Homo sapiens
attttgcaaaatttc

SEQ ID NO: 1673907 - DNA, 13 bp, Homo sapiens
attttgcaaagat

SEQ ID NO: 1673908 - DNA, 12 bp, Homo sapiens
attttgcaatgt

SEQ ID NO: 1673909 - DNA, 13 bp, Homo sapiens
attttgcaatgta

SEQ ID NO: 1673910 - DNA, 14 bp, Homo sapiens
attttgcaatgtat

SEQ ID NO: 1673911 - DNA, 14 bp, Homo sapiens
attttgcagcagtg

SEQ ID NO: 1673912 - DNA, 14 bp, Homo sapiens
attttgctaactgg

SEQ ID NO: 1673913 - DNA, 15 bp, Homo sapiens
attttgctaactggt

SEQ ID NO: 1673914 - DNA, 20 bp, Homo sapiens
attttgctatatataaagac

SEQ ID NO: 1673915 - DNA, 19 bp, Homo sapiens
attttgctgagttgttcta

SEQ ID NO: 1673916 - DNA, 21 bp, Homo sapiens
attttgctttagagaatgcca

SEQ ID NO: 1673917 - DNA, 19 bp, Homo sapiens
attttggaaaataaattat

SEQ ID NO: 1673918 - DNA, 20 bp, Homo sapiens
attttggagattataataaa

SEQ ID NO: 1673919 - DNA, 21 bp, Homo sapiens
attttggagattataataaat

SEQ ID NO: 1673920 - DNA, 22 bp, Homo sapiens
attttggatctatcacctgtca

SEQ ID NO: 1673921 - DNA, 21 bp, Homo sapiens
attttggccatgaaagcatgg

SEQ ID NO: 1673922 - DNA, 21 bp, Homo sapiens
attttggcgaatctcaaaatt

SEQ ID NO: 1673923 - DNA, 20 bp, Homo sapiens
attttgggccttgctaaatt

SEQ ID NO: 1673924 - DNA, 14 bp, Homo sapiens
attttgggtactgg

SEQ ID NO: 1673925 - DNA, 15 bp, Homo sapiens
attttggtactttta

SEQ ID NO: 1673926 - DNA, 21 bp, Homo sapiens
attttggtcatagcattcact

SEQ ID NO: 1673927 - DNA, 18 bp, Homo sapiens
attttggtccaagttgtg

SEQ ID NO: 1673928 - DNA, 18 bp, Homo sapiens
attttggtgaatgtgggt

SEQ ID NO: 1673929 - DNA, 16 bp, Homo sapiens
attttggttttgttcc

SEQ ID NO: 1673930 - DNA, 21 bp, Homo sapiens
attttggttttgttcccctcc

SEQ ID NO: 1673931 - DNA, 17 bp, Homo sapiens
attttgtaaaacaatgc

SEQ ID NO: 1673932 - DNA, 19 bp, Homo sapiens
attttgtaaaacaatgcca

SEQ ID NO: 1673933 - DNA, 17 bp, Homo sapiens
attttgtaacaaatgaa

SEQ ID NO: 1673934 - DNA, 12 bp, Homo sapiens
attttgtaagaa

SEQ ID NO: 1673935 - DNA, 21 bp, Homo sapiens
attttgtaagaaggcaatatt

SEQ ID NO: 1673936 - DNA, 12 bp, Homo sapiens
attttgtacatt

SEQ ID NO: 1673937 - DNA, 14 bp, Homo sapiens
attttgtactttgt

SEQ ID NO: 1673938 - DNA, 10 bp, Homo sapiens
attttgtatg

SEQ ID NO: 1673939 - DNA, 17 bp, Homo sapiens
attttgtatgctgaatt

SEQ ID NO: 1673940 - DNA, 21 bp, Homo sapiens
attttgtatggagttaaataa

SEQ ID NO: 1673941 - DNA, 10 bp, Homo sapiens
attttgtatt

SEQ ID NO: 1673942 - DNA, 17 bp, Homo sapiens
attttgtattttaagat

SEQ ID NO: 1673943 - DNA, 23 bp, Homo sapiens
attttgtcatataagattcatat

SEQ ID NO: 1673944 - DNA, 15 bp, Homo sapiens
attttgtcttaagtg

SEQ ID NO: 1673945 - DNA, 17 bp, Homo sapiens
attttgtcttaagtgtt

SEQ ID NO: 1673946 - DNA, 19 bp, Homo sapiens
attttgtcttaagtgtttc

SEQ ID NO: 1673947 - DNA, 13 bp, Homo sapiens
attttgtgatgaa

SEQ ID NO: 1673948 - DNA, 22 bp, Homo sapiens
attttgtgatgaatctacattt

SEQ ID NO: 1673949 - DNA, 16 bp, Homo sapiens
attttgtgctcattta

SEQ ID NO: 1673950 - DNA, 20 bp, Homo sapiens
attttgtgggctggttgctg

SEQ ID NO: 1673951 - DNA, 23 bp, Homo sapiens
attttgtgggctggttgctgtag

SEQ ID NO: 1673952 - DNA, 12 bp, Homo sapiens
attttgtgtcct

SEQ ID NO: 1673953 - DNA, 14 bp, Homo sapiens
attttgtgtgattg

SEQ ID NO: 1673954 - DNA, 18 bp, Homo sapiens
attttgtgtttattcttg

SEQ ID NO: 1673955 - DNA, 15 bp, Homo sapiens
attttgttactgatt

SEQ ID NO: 1673956 - DNA, 21 bp, Homo sapiens
attttgttctctgggagaaaa

SEQ ID NO: 1673957 - DNA, 20 bp, Homo sapiens
attttgttgcttttgtgaac

SEQ ID NO: 1673958 - DNA, 15 bp, Homo sapiens
attttgttggcatag

SEQ ID NO: 1673959 - DNA, 22 bp, Homo sapiens
attttgtttcagaattttgtat

SEQ ID NO: 1673960 - DNA, 16 bp, Homo sapiens
attttgtttctgtata

SEQ ID NO: 1673961 - DNA, 16 bp, Homo sapiens
attttgttttgttgga

SEQ ID NO: 1673962 - DNA, 20 bp, Homo sapiens
attttgtttttattttcaag

SEQ ID NO: 1673963 - DNA, 14 bp, Homo sapiens
atttttaaaaaata

SEQ ID NO: 1673964 - DNA, 17 bp, Homo sapiens
atttttaaaaagaaatc

SEQ ID NO: 1673965 - DNA, 23 bp, Homo sapiens
atttttaaaaagaaatctggtct

SEQ ID NO: 1673966 - DNA, 16 bp, Homo sapiens
atttttaaaacccatt

SEQ ID NO: 1673967 - DNA, 13 bp, Homo sapiens
atttttaaacttg

SEQ ID NO: 1673968 - DNA, 18 bp, Homo sapiens
atttttaaacttgaaata

SEQ ID NO: 1673969 - DNA, 15 bp, Homo sapiens
atttttaaagataga

SEQ ID NO: 1673970 - DNA, 14 bp, Homo sapiens
atttttaaattata

SEQ ID NO: 1673971 - DNA, 12 bp, Homo sapiens
atttttaaattc

SEQ ID NO: 1673972 - DNA, 19 bp, Homo sapiens
atttttaaattcttactct

SEQ ID NO: 1673973 - DNA, 16 bp, Homo sapiens
atttttaacacttaaa

SEQ ID NO: 1673974 - DNA, 18 bp, Homo sapiens
atttttaagataataata

SEQ ID NO: 1673975 - DNA, 19 bp, Homo sapiens
atttttaagataataatat

SEQ ID NO: 1673976 - DNA, 22 bp, Homo sapiens
atttttaagataataatatatg

SEQ ID NO: 1673977 - DNA, 16 bp, Homo sapiens
atttttaatcatgaaa

SEQ ID NO: 1673978 - DNA, 11 bp, Homo sapiens
atttttaatgg

SEQ ID NO: 1673979 - DNA, 14 bp, Homo sapiens
atttttaatgtatc

SEQ ID NO: 1673980 - DNA, 17 bp, Homo sapiens
atttttaatgtatctat

SEQ ID NO: 1673981 - DNA, 19 bp, Homo sapiens
atttttaatgtatctattt

SEQ ID NO: 1673982 - DNA, 21 bp, Homo sapiens
atttttaatgtatctatttgt

SEQ ID NO: 1673983 - DNA, 23 bp, Homo sapiens
atttttaatgtatctatttgtac

SEQ ID NO: 1673984 - DNA, 19 bp, Homo sapiens
atttggtaaaaatgctgct

SEQ ID NO: 1673985 - DNA, 20 bp, Homo sapiens
atttggtaaaaatgctgctc

SEQ ID NO: 1673986 - DNA, 18 bp, Homo sapiens
atttggtaatgtttttaa

SEQ ID NO: 1673987 - DNA, 23 bp, Homo sapiens
atttggtcaagattttgaatgct

SEQ ID NO: 1673988 - DNA, 19 bp, Homo sapiens
atttggtctcactacttga

SEQ ID NO: 1673989 - DNA, 17 bp, Homo sapiens
atttggtgctctgctaa

SEQ ID NO: 1673990 - DNA, 19 bp, Homo sapiens
atttggtgttcctggaagc

SEQ ID NO: 1673991 - DNA, 20 bp, Homo sapiens
atttggtgttcctggaagca

SEQ ID NO: 1673992 - DNA, 15 bp, Homo sapiens
atttggttctaatag

SEQ ID NO: 1673993 - DNA, 22 bp, Homo sapiens
atttgtaaaaacagcattgctt

SEQ ID NO: 1673994 - DNA, 17 bp, Homo sapiens
atttgtaaagctattta

SEQ ID NO: 1673995 - DNA, 17 bp, Homo sapiens
atttgtaaatctgccac

SEQ ID NO: 1673996 - DNA, 19 bp, Homo sapiens
atttgtaaatttatgtgat

SEQ ID NO: 1673997 - DNA, 14 bp, Homo sapiens
atttgtaagtaaca

SEQ ID NO: 1673998 - DNA, 20 bp, Homo sapiens
atttttacctttttccttcc

SEQ ID NO: 1673999 - DNA, 21 bp, Homo sapiens
atttttactatcacacatgaa

SEQ ID NO: 1674000 - DNA, 15 bp, Homo sapiens
atttttagactattt

SEQ ID NO: 1674001 - DNA, 14 bp, Homo sapiens
atttttagtagaga

SEQ ID NO: 1674002 - DNA, 20 bp, Homo sapiens
atttttataaactaccaaat

SEQ ID NO: 1674003 - DNA, 18 bp, Homo sapiens
atttttataacatcttta

SEQ ID NO: 1674004 - DNA, 18 bp, Homo sapiens
atttttatacaagtaatt

SEQ ID NO: 1674005 - DNA, 19 bp, Homo sapiens
atttttatacaagtaattt

SEQ ID NO: 1674006 - DNA, 23 bp, Homo sapiens
atttttatacaagtaatttcctg

SEQ ID NO: 1674007 - DNA, 16 bp, Homo sapiens
atttttatacctgttt

SEQ ID NO: 1674008 - DNA, 16 bp, Homo sapiens
atttttatactttatt

SEQ ID NO: 1674009 - DNA, 20 bp, Homo sapiens
atttttatactttattgaaa

SEQ ID NO: 1674010 - DNA, 14 bp, Homo sapiens
atttttatatttcc

SEQ ID NO: 1674011 - DNA, 16 bp, Homo sapiens
atttttatatttcctt

SEQ ID NO: 1674012 - DNA, 14 bp, Homo sapiens
atttttatcatgaa

SEQ ID NO: 1674013 - DNA, 16 bp, Homo sapiens
atttttatcatgaatt

SEQ ID NO: 1674014 - DNA, 12 bp, Homo sapiens
atttttatccat

SEQ ID NO: 1674015 - DNA, 12 bp, Homo sapiens
atttttatcttt

SEQ ID NO: 1674016 - DNA, 15 bp, Homo sapiens
atttttatctttcgt

SEQ ID NO: 1674017 - DNA, 15 bp, Homo sapiens
atttttatgcagaca

SEQ ID NO: 1674018 - DNA, 17 bp, Homo sapiens
atttttatgcagacagt

SEQ ID NO: 1674019 - DNA, 15 bp, Homo sapiens
atttttattaaatgt

SEQ ID NO: 1674020 - DNA, 16 bp, Homo sapiens
atttttattaaattat

SEQ ID NO: 1674021 - DNA, 14 bp, Homo sapiens
atttttattcatgt

SEQ ID NO: 1674022 - DNA, 14 bp, Homo sapiens
atttttatttcaaa

SEQ ID NO: 1674023 - DNA, 21 bp, Homo sapiens
atttttatttctttttaatta

SEQ ID NO: 1674024 - DNA, 16 bp, Homo sapiens
atttttatttgtaaag

SEQ ID NO: 1674025 - DNA, 14 bp, Homo sapiens
atttttatttttga

SEQ ID NO: 1674026 - DNA, 17 bp, Homo sapiens
atttttcaaaaccctaa

SEQ ID NO: 1674027 - DNA, 12 bp, Homo sapiens
atttttcaaggc

SEQ ID NO: 1674028 - DNA, 20 bp, Homo sapiens
atttttcaatagcacatatg

SEQ ID NO: 1674029 - DNA, 18 bp, Homo sapiens
atttttcaatatattgaa

SEQ ID NO: 1674030 - DNA, 22 bp, Homo sapiens
atttttcaatatattgaacttt

SEQ ID NO: 1674031 - DNA, 15 bp, Homo sapiens
atttttcacatatct

SEQ ID NO: 1674032 - DNA, 23 bp, Homo sapiens
atttttccaaatgaaaaatctca

SEQ ID NO: 1674033 - DNA, 17 bp, Homo sapiens
atttttccgtttgcttt

SEQ ID NO: 1674034 - DNA, 12 bp, Homo sapiens
atttttctcatg

SEQ ID NO: 1674035 - DNA, 19 bp, Homo sapiens
atttttctcccaagaaacc

SEQ ID NO: 1674036 - DNA, 24 bp, Homo sapiens
atttttctcccaagaaacctgact

SEQ ID NO: 1674037 - DNA, 12 bp, Homo sapiens
atttttctcttc

SEQ ID NO: 1674038 - DNA, 20 bp, Homo sapiens
atttttctctttaaaaacat

SEQ ID NO: 1674039 - DNA, 22 bp, Homo sapiens
atttttctcttttttaaaaaca

SEQ ID NO: 1674040 - DNA, 15 bp, Homo sapiens
atttttctgccctgg

SEQ ID NO: 1674041 - DNA, 19 bp, Homo sapiens
atttttctgccctgggttc

SEQ ID NO: 1674042 - DNA, 20 bp, Homo sapiens
atttttcttatttcatttct

SEQ ID NO: 1674043 - DNA, 15 bp, Homo sapiens
atttttctttaactg

SEQ ID NO: 1674044 - DNA, 16 bp, Homo sapiens
atttttctttaactgc

SEQ ID NO: 1674045 - DNA, 14 bp, Homo sapiens
atttttgaaaaaga

SEQ ID NO: 1674046 - DNA, 14 bp, Homo sapiens
atttttgaaaaggc

SEQ ID NO: 1674047 - DNA, 14 bp, Homo sapiens
atttttgacagaat

SEQ ID NO: 1674048 - DNA, 21 bp, Homo sapiens
atttttgacagactatttgct

SEQ ID NO: 1674049 - DNA, 17 bp, Homo sapiens
atttttgatgtatatat

SEQ ID NO: 1674050 - DNA, 22 bp, Homo sapiens
atttttgccctgagtccaagag

SEQ ID NO: 1674051 - DNA, 21 bp, Homo sapiens
atttttgcctcttccagtctt

SEQ ID NO: 1674052 - DNA, 14 bp, Homo sapiens
atttttgctgaatt

SEQ ID NO: 1674053 - DNA, 20 bp, Homo sapiens
atttttgggggctttccttt

SEQ ID NO: 1674054 - DNA, 14 bp, Homo sapiens
atttttgtacatat

SEQ ID NO: 1674055 - DNA, 20 bp, Homo sapiens
atttttgtagcactgacaga

SEQ ID NO: 1674056 - DNA, 21 bp, Homo sapiens
atttttgtagcactgacagat

SEQ ID NO: 1674057 - DNA, 13 bp, Homo sapiens
atttttgtatcta

SEQ ID NO: 1674058 - DNA, 21 bp, Homo sapiens
atttttgtatctacatctttt

SEQ ID NO: 1674059 - DNA, 14 bp, Homo sapiens
atttttgtatttct

SEQ ID NO: 1674060 - DNA, 23 bp, Homo sapiens
atttttgtcttatatatatttct

SEQ ID NO: 1674061 - DNA, 20 bp, Homo sapiens
atttttgtgaagtattcaca

SEQ ID NO: 1674062 - DNA, 15 bp, Homo sapiens
atttttgtgtttcta

SEQ ID NO: 1674063 - DNA, 17 bp, Homo sapiens
atttttgttagcaaaga

SEQ ID NO: 1674064 - DNA, 22 bp, Homo sapiens
atttttgtttttgagtactgta

SEQ ID NO: 1674065 - DNA, 15 bp, Homo sapiens
attttttaaatcttg

SEQ ID NO: 1674066 - DNA, 18 bp, Homo sapiens
attttttaaatcttgacc

SEQ ID NO: 1674067 - DNA, 13 bp, Homo sapiens
attttttaaattc

SEQ ID NO: 1674068 - DNA, 16 bp, Homo sapiens
attttttaactgctgc

SEQ ID NO: 1674069 - DNA, 21 bp, Homo sapiens
attttttaagcttcagttgct

SEQ ID NO: 1674070 - DNA, 12 bp, Homo sapiens
attttttatact

SEQ ID NO: 1674071 - DNA, 18 bp, Homo sapiens
attttttatatatacagt

SEQ ID NO: 1674072 - DNA, 16 bp, Homo sapiens
attttttatcatgcat

SEQ ID NO: 1674073 - DNA, 12 bp, Homo sapiens
attttttccctt

SEQ ID NO: 1674074 - DNA, 13 bp, Homo sapiens
attttttcccttt

SEQ ID NO: 1674075 - DNA, 13 bp, Homo sapiens
attttttgaaatg

SEQ ID NO: 1674076 - DNA, 16 bp, Homo sapiens
attttttgaaatgctg

SEQ ID NO: 1674077 - DNA, 19 bp, Homo sapiens
attttttgaaatgctgaaa

SEQ ID NO: 1674078 - DNA, 21 bp, Homo sapiens
attttttgaaatgctgaaaat

SEQ ID NO: 1674079 - DNA, 23 bp, Homo sapiens
attttttgactttttttgtatgt

SEQ ID NO: 1674080 - DNA, 20 bp, Homo sapiens
attttttgctataatcatta

SEQ ID NO: 1674081 - DNA, 17 bp, Homo sapiens
atttttttaaaattttg

SEQ ID NO: 1674082 - DNA, 15 bp, Homo sapiens
atttttttagattga

SEQ ID NO: 1674083 - DNA, 21 bp, Homo sapiens
atttttttatcttgggactgg

SEQ ID NO: 1674084 - DNA, 12 bp, Homo sapiens
atttttttcctg

SEQ ID NO: 1674085 - DNA, 15 bp, Homo sapiens
atttttttctttact

SEQ ID NO: 1674086 - DNA, 13 bp, Homo sapiens
atttttttgtctt

SEQ ID NO: 1674087 - DNA, 18 bp, Homo sapiens
attttttttaacattcct

SEQ ID NO: 1674088 - DNA, 18 bp, Homo sapiens
attttttttaagtattta

SEQ ID NO: 1674089 - DNA, 14 bp, Homo sapiens
attttttttatatt

SEQ ID NO: 1674090 - DNA, 22 bp, Homo sapiens
attttttttggcctgtttgatg

SEQ ID NO: 1674091 - DNA, 21 bp, Homo sapiens
attttttttgttttttgtaac

SEQ ID NO: 1674092 - DNA, 24 bp, Homo sapiens
attttttttgttttttgtaactac

SEQ ID NO: 1674093 - DNA, 15 bp, Homo sapiens
atttttttttcaatc

SEQ ID NO: 1674094 - DNA, 16 bp, Homo sapiens
atttttttttcaatca

SEQ ID NO: 1674095 - DNA, 16 bp, Homo sapiens
atttttttttcataca

SEQ ID NO: 1674096 - DNA, 20 bp, Homo sapiens
atttttttttcatacactta

SEQ ID NO: 1674097 - DNA, 21 bp, Homo sapiens
atttttttttcatacacttat

SEQ ID NO: 1674098 - DNA, 13 bp, Homo sapiens
atttttttttcct

SEQ ID NO: 1674099 - DNA, 17 bp, Homo sapiens
atttttttttcctagcc

SEQ ID NO: 1674100 - DNA, 19 bp, Homo sapiens
atttttttttcctggaatt

SEQ ID NO: 1674101 - DNA, 21 bp, Homo sapiens
attttttttttctttttgggg

SEQ ID NO: 1674102 - DNA, 18 bp, Homo sapiens
caaaaaaaaaccatgcat

SEQ ID NO: 1674103 - DNA, 19 bp, Homo sapiens
caaaaaactctctcccagg

SEQ ID NO: 1674104 - DNA, 19 bp, Homo sapiens
caaaaaaggaaaagttaaa

SEQ ID NO: 1674105 - DNA, 11 bp, Homo sapiens
caaaaaataaa

SEQ ID NO: 1674106 - DNA, 20 bp, Homo sapiens
caaaaaataaattttaaaaa

SEQ ID NO: 1674107 - DNA, 11 bp, Homo sapiens
caaaaaataca

SEQ ID NO: 1674108 - DNA, 18 bp, Homo sapiens
caaaaaatcatgtttatt

SEQ ID NO: 1674109 - DNA, 13 bp, Homo sapiens
caaaaaatcttaa

SEQ ID NO: 1674110 - DNA, 12 bp, Homo sapiens
caaaaaatgagc

SEQ ID NO: 1674111 - DNA, 15 bp, Homo sapiens
caaaaaatgttttaa

SEQ ID NO: 1674112 - DNA, 18 bp, Homo sapiens
caaaaacaaaaccagctg

SEQ ID NO: 1674113 - DNA, 20 bp, Homo sapiens
caaaaacaaaattagccggg

SEQ ID NO: 1674114 - DNA, 22 bp, Homo sapiens
caaaaacaggtatatactttga

SEQ ID NO: 1674115 - DNA, 14 bp, Homo sapiens
caaaaaccagcagg

SEQ ID NO: 1674116 - DNA, 14 bp, Homo sapiens
caaaaaccagccag

SEQ ID NO: 1674117 - DNA, 16 bp, Homo sapiens
caaaaaccagccaggc

SEQ ID NO: 1674118 - DNA, 15 bp, Homo sapiens
caaaaaccatgttgc

SEQ ID NO: 1674119 - DNA, 21 bp, Homo sapiens
caaaaacccagcaacagaaaa

SEQ ID NO: 1674120 - DNA, 16 bp, Homo sapiens
caaaaactacacatat

SEQ ID NO: 1674121 - DNA, 23 bp, Homo sapiens
caaaaactttggagtcccctcac

SEQ ID NO: 1674122 - DNA, 13 bp, Homo sapiens
caaaaagaaatga

SEQ ID NO: 1674123 - DNA, 23 bp, Homo sapiens
caaaaagaacaataatgagagca

SEQ ID NO: 1674124 - DNA, 14 bp, Homo sapiens
caaaaagcaaggga

SEQ ID NO: 1674125 - DNA, 13 bp, Homo sapiens
caaaaagcagaag

SEQ ID NO: 1674126 - DNA, 16 bp, Homo sapiens
caaaaagcagaaggag

SEQ ID NO: 1674127 - DNA, 23 bp, Homo sapiens
caaaaagcagagtggactgcatt

SEQ ID NO: 1674128 - DNA, 13 bp, Homo sapiens
caaaaagctaatg

SEQ ID NO: 1674129 - DNA, 21 bp, Homo sapiens
caaaaaggagccttttgctct

SEQ ID NO: 1674130 - DNA, 14 bp, Homo sapiens
caaaaagtattatc

SEQ ID NO: 1674131 - DNA, 15 bp, Homo sapiens
caaaaataaactagt

SEQ ID NO: 1674132 - DNA, 14 bp, Homo sapiens
caaaaatagaaatt

SEQ ID NO: 1674133 - DNA, 11 bp, Homo sapiens
caaaaatataa

SEQ ID NO: 1674134 - DNA, 18 bp, Homo sapiens
caaaaatcaaagaacaga

SEQ ID NO: 1674135 - DNA, 19 bp, Homo sapiens
caaaaatcaaagaacagat

SEQ ID NO: 1674136 - DNA, 20 bp, Homo sapiens
caaaaatcccaccttcccac

SEQ ID NO: 1674137 - DNA, 21 bp, Homo sapiens
caaaaatgacaacagaaaaac

SEQ ID NO: 1674138 - DNA, 20 bp, Homo sapiens
caaaaattagccggacgtgg

SEQ ID NO: 1674139 - DNA, 17 bp, Homo sapiens
caaaaattagccgggca

SEQ ID NO: 1674140 - DNA, 16 bp, Homo sapiens
caaaacaaaacaaaac

SEQ ID NO: 1674141 - DNA, 21 bp, Homo sapiens
caaaacaaagcagctttaaaa

SEQ ID NO: 1674142 - DNA, 19 bp, Homo sapiens
caaaacagagatgtgataa

SEQ ID NO: 1674143 - DNA, 12 bp, Homo sapiens
caaaaccagctg

SEQ ID NO: 1674144 - DNA, 14 bp, Homo sapiens
caaaaccagctgct

SEQ ID NO: 1674145 - DNA, 23 bp, Homo sapiens
caaaaccatgcctggtattttca

SEQ ID NO: 1674146 - DNA, 16 bp, Homo sapiens
caaaaccctgaagcca

SEQ ID NO: 1674147 - DNA, 17 bp, Homo sapiens
caaaacctgcagttaac

SEQ ID NO: 1674148 - DNA, 14 bp, Homo sapiens
caaaacctgcttcc

SEQ ID NO: 1674149 - DNA, 15 bp, Homo sapiens
caaaacctgcttcct

SEQ ID NO: 1674150 - DNA, 18 bp, Homo sapiens
caaaacctgcttccttca

SEQ ID NO: 1674151 - DNA, 16 bp, Homo sapiens
caaaacctgtattact

SEQ ID NO: 1674152 - DNA, 23 bp, Homo sapiens
caaaacctgtattactgaataat

SEQ ID NO: 1674153 - DNA, 17 bp, Homo sapiens
caaaacctgtgccaggc

SEQ ID NO: 1674154 - DNA, 13 bp, Homo sapiens
caaaaccttcctt

SEQ ID NO: 1674155 - DNA, 17 bp, Homo sapiens
caaaaccttccttccct

SEQ ID NO: 1674156 - DNA, 18 bp, Homo sapiens
caaaaccttccttccctg

SEQ ID NO: 1674157 - DNA, 18 bp, Homo sapiens
caaaacgcacaagccaga

SEQ ID NO: 1674158 - DNA, 14 bp, Homo sapiens
caaaacgggtcagt

SEQ ID NO: 1674159 - DNA, 19 bp, Homo sapiens
caaaactactgacagggag

SEQ ID NO: 1674160 - DNA, 22 bp, Homo sapiens
caaaactatcctgattccaaat

SEQ ID NO: 1674161 - DNA, 20 bp, Homo sapiens
caaaactatcggttcaagtt

SEQ ID NO: 1674162 - DNA, 19 bp, Homo sapiens
caaaactctacttaatcca

SEQ ID NO: 1674163 - DNA, 17 bp, Homo sapiens
caaaactgcactgtcaa

SEQ ID NO: 1674164 - DNA, 22 bp, Homo sapiens
caaaactgcctcaggaggcagg

SEQ ID NO: 1674165 - DNA, 16 bp, Homo sapiens
caaaactgtaaataaa

SEQ ID NO: 1674166 - DNA, 20 bp, Homo sapiens
caaaactgtaaataaaatgt

SEQ ID NO: 1674167 - DNA, 21 bp, Homo sapiens
caaaagaaaaaagcaagtaca

SEQ ID NO: 1674168 - DNA, 19 bp, Homo sapiens
caaaagaacaagaatttct

SEQ ID NO: 1674169 - DNA, 16 bp, Homo sapiens
caaaagaagcccccag

SEQ ID NO: 1674170 - DNA, 17 bp, Homo sapiens
caaaagaagcccccagc

SEQ ID NO: 1674171 - DNA, 18 bp, Homo sapiens
caaaagaagcccccagct

SEQ ID NO: 1674172 - DNA, 19 bp, Homo sapiens
caaaagaagcccccagcta

SEQ ID NO: 1674173 - DNA, 16 bp, Homo sapiens
caaaagaataagacaa

SEQ ID NO: 1674174 - DNA, 14 bp, Homo sapiens
caaaagacaaaaat

SEQ ID NO: 1674175 - DNA, 17 bp, Homo sapiens
caaaagaccaaatctca

SEQ ID NO: 1674176 - DNA, 19 bp, Homo sapiens
caaaagaccaaatctcagt

SEQ ID NO: 1674177 - DNA, 15 bp, Homo sapiens
caaaagacttgagcc

SEQ ID NO: 1674178 - DNA, 19 bp, Homo sapiens
caaaagacttgagccatcc

SEQ ID NO: 1674179 - DNA, 14 bp, Homo sapiens
caaaagagggttta

SEQ ID NO: 1674180 - DNA, 16 bp, Homo sapiens
caaaagaggttacttt

SEQ ID NO: 1674181 - DNA, 21 bp, Homo sapiens
caaaagatgtatccttccaat

SEQ ID NO: 1674182 - DNA, 19 bp, Homo sapiens
caaaagatgtgcaaaatca

SEQ ID NO: 1674183 - DNA, 18 bp, Homo sapiens
caaaagattaatctttaa

SEQ ID NO: 1674184 - DNA, 14 bp, Homo sapiens
caaaagatttattg

SEQ ID NO: 1674185 - DNA, 21 bp, Homo sapiens
caaaagatttgtttttgtaga

SEQ ID NO: 1674186 - DNA, 21 bp, Homo sapiens
caaaagcaaaacatctctgca

SEQ ID NO: 1674187 - DNA, 23 bp, Homo sapiens
caaaagcaaaacatctctgcagt

SEQ ID NO: 1674188 - DNA, 16 bp, Homo sapiens
caaaagcaagactgtt

SEQ ID NO: 1674189 - DNA, 16 bp, Homo sapiens
caaaagcaggcgacaa

SEQ ID NO: 1674190 - DNA, 20 bp, Homo sapiens
caaaagcagtaaatttgcta

SEQ ID NO: 1674191 - DNA, 21 bp, Homo sapiens
caaaagctatttaaagcatct

SEQ ID NO: 1674192 - DNA, 20 bp, Homo sapiens
caaaagctgaacacatttct

SEQ ID NO: 1674193 - DNA, 21 bp, Homo sapiens
caaaagctgaacacatttctt

SEQ ID NO: 1674194 - DNA, 16 bp, Homo sapiens
caaaagcttcaaatta

SEQ ID NO: 1674195 - DNA, 13 bp, Homo sapiens
caaaagcttttta

SEQ ID NO: 1674196 - DNA, 20 bp, Homo sapiens
caaaagctttttaaaattta

SEQ ID NO: 1674197 - DNA, 12 bp, Homo sapiens
caaaaggaaacc

SEQ ID NO: 1674198 - DNA, 21 bp, Homo sapiens
cacagccagacttgcttcctg

SEQ ID NO: 1674199 - DNA, 15 bp, Homo sapiens
cacagccagcacctg

SEQ ID NO: 1674200 - DNA, 12 bp, Homo sapiens
cacagcccagcc

SEQ ID NO: 1674201 - DNA, 14 bp, Homo sapiens
cacagcccagcccg

SEQ ID NO: 1674202 - DNA, 15 bp, Homo sapiens
cacagcccagcttgg

SEQ ID NO: 1674203 - DNA, 14 bp, Homo sapiens
cacagcccccttgc

SEQ ID NO: 1674204 - DNA, 18 bp, Homo sapiens
cacagcccctcaaagact

SEQ ID NO: 1674205 - DNA, 22 bp, Homo sapiens
cacagccctccgaccctcatgg

SEQ ID NO: 1674206 - DNA, 18 bp, Homo sapiens
cacagccctgagtgtccc

SEQ ID NO: 1674207 - DNA, 21 bp, Homo sapiens
cacagccctgagtgtcccaag

SEQ ID NO: 1674208 - DNA, 17 bp, Homo sapiens
cacagccctgggagggg

SEQ ID NO: 1674209 - DNA, 23 bp, Homo sapiens
cacagcccttatgcggttaattt

SEQ ID NO: 1674210 - DNA, 21 bp, Homo sapiens
cacagccgcagcctccctctg

SEQ ID NO: 1674211 - DNA, 21 bp, Homo sapiens
cacagcctgggccccagctcg

SEQ ID NO: 1674212 - DNA, 23 bp, Homo sapiens
cacagccttcggacagacatatg

SEQ ID NO: 1674213 - DNA, 17 bp, Homo sapiens
cacagcgagggcagctg

SEQ ID NO: 1674214 - DNA, 19 bp, Homo sapiens
cacagcgagggcagctgct

SEQ ID NO: 1674215 - DNA, 22 bp, Homo sapiens
cacagcggaggagaccagctca

SEQ ID NO: 1674216 - DNA, 16 bp, Homo sapiens
cacagcgtccctggcg

SEQ ID NO: 1674217 - DNA, 22 bp, Homo sapiens
cacagcgtccctggcgcaggtg

SEQ ID NO: 1674218 - DNA, 23 bp, Homo sapiens
cacattagattttattttactat

SEQ ID NO: 1674219 - DNA, 22 bp, Homo sapiens
cacattatcgggagcagtgtct

SEQ ID NO: 1674220 - DNA, 15 bp, Homo sapiens
cacattatttgcatg

SEQ ID NO: 1674221 - DNA, 14 bp, Homo sapiens
cacattcctggccc

SEQ ID NO: 1674222 - DNA, 15 bp, Homo sapiens
cacattcctggcccc

SEQ ID NO: 1674223 - DNA, 21 bp, Homo sapiens
cacattcctggccccgggctc

SEQ ID NO: 1674224 - DNA, 13 bp, Homo sapiens
cacattctatttt

SEQ ID NO: 1674225 - DNA, 16 bp, Homo sapiens
cacattctcttcccag

SEQ ID NO: 1674226 - DNA, 15 bp, Homo sapiens
cacattgcctgttct

SEQ ID NO: 1674227 - DNA, 20 bp, Homo sapiens
cacattgcctgttctgcttc

SEQ ID NO: 1674228 - DNA, 22 bp, Homo sapiens
cacattgcctgttctgcttcga

SEQ ID NO: 1674229 - DNA, 15 bp, Homo sapiens
cacattgctggctgc

SEQ ID NO: 1674230 - DNA, 17 bp, Homo sapiens
cacattggaccagatga

SEQ ID NO: 1674231 - DNA, 12 bp, Homo sapiens
cacattgtgcag

SEQ ID NO: 1674232 - DNA, 22 bp, Homo sapiens
cacattgttgtttttttaatag

SEQ ID NO: 1674233 - DNA, 18 bp, Homo sapiens
cacattgtttgctgctat

SEQ ID NO: 1674234 - DNA, 15 bp, Homo sapiens
cacatttatatatat

SEQ ID NO: 1674235 - DNA, 18 bp, Homo sapiens
cacatttatatatatatg

SEQ ID NO: 1674236 - DNA, 21 bp, Homo sapiens
cacatttatatatatatgtat

SEQ ID NO: 1674237 - DNA, 21 bp, Homo sapiens
cacatttccagggcagcagcc

SEQ ID NO: 1674238 - DNA, 13 bp, Homo sapiens
cacatttctggat

SEQ ID NO: 1674239 - DNA, 20 bp, Homo sapiens
cacatttgggctcagggttg

SEQ ID NO: 1674240 - DNA, 13 bp, Homo sapiens
cacattttgtaca

SEQ ID NO: 1674241 - DNA, 14 bp, Homo sapiens
cacattttgtacat

SEQ ID NO: 1674242 - DNA, 20 bp, Homo sapiens
cacattttgtggctgttgag

SEQ ID NO: 1674243 - DNA, 17 bp, Homo sapiens
cacatttttatacctgt

SEQ ID NO: 1674244 - DNA, 12 bp, Homo sapiens
caccaaaaaata

SEQ ID NO: 1674245 - DNA, 13 bp, Homo sapiens
caccaaactgcca

SEQ ID NO: 1674246 - DNA, 21 bp, Homo sapiens
caccaaagaattgtaggcagt

SEQ ID NO: 1674247 - DNA, 12 bp, Homo sapiens
caccaaagttct

SEQ ID NO: 1674248 - DNA, 13 bp, Homo sapiens
caccaaagttcta

SEQ ID NO: 1674249 - DNA, 14 bp, Homo sapiens
caccaaagttctaa

SEQ ID NO: 1674250 - DNA, 17 bp, Homo sapiens
caccaaagttctaataa

SEQ ID NO: 1674251 - DNA, 14 bp, Homo sapiens
caccaacatcccat

SEQ ID NO: 1674252 - DNA, 23 bp, Homo sapiens
caccaacatcccattgccctggt

SEQ ID NO: 1674253 - DNA, 14 bp, Homo sapiens
caccaaccaggcct

SEQ ID NO: 1674254 - DNA, 15 bp, Homo sapiens
caccaaccaggcctt

SEQ ID NO: 1674255 - DNA, 16 bp, Homo sapiens
caccaacccctgacct

SEQ ID NO: 1674256 - DNA, 13 bp, Homo sapiens
caccaaccctcag

SEQ ID NO: 1674257 - DNA, 18 bp, Homo sapiens
caccaactctgcactcca

SEQ ID NO: 1674258 - DNA, 22 bp, Homo sapiens
caccaagacttgttttatgctc

SEQ ID NO: 1674259 - DNA, 15 bp, Homo sapiens
caccaagagggtgga

SEQ ID NO: 1674260 - DNA, 19 bp, Homo sapiens
caccaagctcacagttcct

SEQ ID NO: 1674261 - DNA, 11 bp, Homo sapiens
caccaaggaaa

SEQ ID NO: 1674262 - DNA, 14 bp, Homo sapiens
caccaagggatctg

SEQ ID NO: 1674263 - DNA, 15 bp, Homo sapiens
caccaagggtatctg

SEQ ID NO: 1674264 - DNA, 19 bp, Homo sapiens
caccaagggtatctgctgc

SEQ ID NO: 1674265 - DNA, 21 bp, Homo sapiens
caccaagggtatctgctgcct

SEQ ID NO: 1674266 - DNA, 19 bp, Homo sapiens
caccaagtggctgggtgcc

SEQ ID NO: 1674267 - DNA, 21 bp, Homo sapiens
caccaagtggctgggtgccct

SEQ ID NO: 1674268 - DNA, 22 bp, Homo sapiens
caccaataatggggcagacaca

SEQ ID NO: 1674269 - DNA, 16 bp, Homo sapiens
caccaattatcatctt

SEQ ID NO: 1674270 - DNA, 23 bp, Homo sapiens
caccaatttggtaaaaatgctgc

SEQ ID NO: 1674271 - DNA, 15 bp, Homo sapiens
caccacagacacaca

SEQ ID NO: 1674272 - DNA, 21 bp, Homo sapiens
caccacagacacacacacgca

SEQ ID NO: 1674273 - DNA, 17 bp, Homo sapiens
caccacagtaagttcct

SEQ ID NO: 1674274 - DNA, 18 bp, Homo sapiens
caccacatcctccgtcca

SEQ ID NO: 1674275 - DNA, 21 bp, Homo sapiens
caccacatcctccgtccagcc

SEQ ID NO: 1674276 - DNA, 16 bp, Homo sapiens
caccaccaggagcagc

SEQ ID NO: 1674277 - DNA, 22 bp, Homo sapiens
caccaccaggagcagcagccag

SEQ ID NO: 1674278 - DNA, 23 bp, Homo sapiens
caccaccaggagcagcagccagc

SEQ ID NO: 1674279 - DNA, 11 bp, Homo sapiens
caccacccaaa

SEQ ID NO: 1674280 - DNA, 12 bp, Homo sapiens
caccacccaccc

SEQ ID NO: 1674281 - DNA, 18 bp, Homo sapiens
caccaccccaacaaacca

SEQ ID NO: 1674282 - DNA, 22 bp, Homo sapiens
caccaccctagtcccttcccct

SEQ ID NO: 1674283 - DNA, 20 bp, Homo sapiens
caccaccctgctcatccact

SEQ ID NO: 1674284 - DNA, 13 bp, Homo sapiens
caccaccctggca

SEQ ID NO: 1674285 - DNA, 14 bp, Homo sapiens
caccaccgcctctg

SEQ ID NO: 1674286 - DNA, 22 bp, Homo sapiens
caccaccgcctctggccgccac

SEQ ID NO: 1674287 - DNA, 23 bp, Homo sapiens
caccacctaggccactcctccaa

SEQ ID NO: 1674288 - DNA, 21 bp, Homo sapiens
caccaccttcccagctctccc

SEQ ID NO: 1674289 - DNA, 19 bp, Homo sapiens
caccacgatgtggccctgg

SEQ ID NO: 1674290 - DNA, 22 bp, Homo sapiens
caccacgatgtggccctggcct

SEQ ID NO: 1674291 - DNA, 15 bp, Homo sapiens
caccacgtctgccag

SEQ ID NO: 1674292 - DNA, 17 bp, Homo sapiens
caccacgtctgccaggc

SEQ ID NO: 1674293 - DNA, 21 bp, Homo sapiens
caccacgtctgccaggcccat

SEQ ID NO: 1674294 - DNA, 19 bp, Homo sapiens
cacccaccttgacgtttct

SEQ ID NO: 1674295 - DNA, 22 bp, Homo sapiens
cacccacctttgccacaaagct

SEQ ID NO: 1674296 - DNA, 19 bp, Homo sapiens
cacccacgcatacacacat

SEQ ID NO: 1674297 - DNA, 21 bp, Homo sapiens
cacccacgcatacacacatgc

SEQ ID NO: 1674298 - DNA, 15 bp, Homo sapiens
cacccactcaccagg

SEQ ID NO: 1674299 - DNA, 13 bp, Homo sapiens
cacccagcccatt

SEQ ID NO: 1674300 - DNA, 23 bp, Homo sapiens
cacccagcccattctctctcctg

SEQ ID NO: 1674301 - DNA, 11 bp, Homo sapiens
cacccaggagg

SEQ ID NO: 1674302 - DNA, 15 bp, Homo sapiens
cacccaggcctccct

SEQ ID NO: 1674303 - DNA, 19 bp, Homo sapiens
cacccaggcctccctgcag

SEQ ID NO: 1674304 - DNA, 18 bp, Homo sapiens
cacccaggctgcactgca

SEQ ID NO: 1674305 - DNA, 20 bp, Homo sapiens
cacccaggctggactgcaat

SEQ ID NO: 1674306 - DNA, 19 bp, Homo sapiens
cacccaggtcccccgactg

SEQ ID NO: 1674307 - DNA, 23 bp, Homo sapiens
cacccaggtcccccgactgcctg

SEQ ID NO: 1674308 - DNA, 18 bp, Homo sapiens
cacccagtccatgctcca

SEQ ID NO: 1674309 - DNA, 21 bp, Homo sapiens
cacccagtccatgctccaggg

SEQ ID NO: 1674310 - DNA, 14 bp, Homo sapiens
cacccagtccccac

SEQ ID NO: 1674311 - DNA, 15 bp, Homo sapiens
cacccagtccccacc

SEQ ID NO: 1674312 - DNA, 17 bp, Homo sapiens
cacccagtctgttcccc

SEQ ID NO: 1674313 - DNA, 13 bp, Homo sapiens
cacccagtgctgc

SEQ ID NO: 1674314 - DNA, 17 bp, Homo sapiens
cacccagtgctgccatg

SEQ ID NO: 1674315 - DNA, 18 bp, Homo sapiens
cacccagtgtccttccat

SEQ ID NO: 1674316 - DNA, 15 bp, Homo sapiens
cacccatcttcctgc

SEQ ID NO: 1674317 - DNA, 19 bp, Homo sapiens
cacccatcttcctgctgct

SEQ ID NO: 1674318 - DNA, 15 bp, Homo sapiens
cacccatgaagacag

SEQ ID NO: 1674319 - DNA, 20 bp, Homo sapiens
cacccatgacaatcaccttc

SEQ ID NO: 1674320 - DNA, 21 bp, Homo sapiens
cacccatgtgggcgcccaccc

SEQ ID NO: 1674321 - DNA, 17 bp, Homo sapiens
caccccaaacttccagg

SEQ ID NO: 1674322 - DNA, 17 bp, Homo sapiens
caccccaacacttccag

SEQ ID NO: 1674323 - DNA, 20 bp, Homo sapiens
caccccaactctccccagtg

SEQ ID NO: 1674324 - DNA, 22 bp, Homo sapiens
caccccaactctccccagtgcc

SEQ ID NO: 1674325 - DNA, 11 bp, Homo sapiens
caccccacact

SEQ ID NO: 1674326 - DNA, 12 bp, Homo sapiens
caccccacactt

SEQ ID NO: 1674327 - DNA, 16 bp, Homo sapiens
caccccacagaacctt

SEQ ID NO: 1674328 - DNA, 15 bp, Homo sapiens
caccccactccagcc

SEQ ID NO: 1674329 - DNA, 16 bp, Homo sapiens
caccccactccagccc

SEQ ID NO: 1674330 - DNA, 17 bp, Homo sapiens
caccccactccagccct

SEQ ID NO: 1674331 - DNA, 17 bp, Homo sapiens
caccccagcattccagc

SEQ ID NO: 1674332 - DNA, 12 bp, Homo sapiens
caccccatgcca

SEQ ID NO: 1674333 - DNA, 14 bp, Homo sapiens
cacccccaacccgt

SEQ ID NO: 1674334 - DNA, 20 bp, Homo sapiens
cacccccaacttcaccaccc

SEQ ID NO: 1674335 - DNA, 21 bp, Homo sapiens
cacccccacaagctgtccctg

SEQ ID NO: 1674336 - DNA, 14 bp, Homo sapiens
cacccccagttcct

SEQ ID NO: 1674337 - DNA, 13 bp, Homo sapiens
cacccccatctct

SEQ ID NO: 1674338 - DNA, 12 bp, Homo sapiens
cacccccatggc

SEQ ID NO: 1674339 - DNA, 22 bp, Homo sapiens
cacccgtaggcagcctctctgc

SEQ ID NO: 1674340 - DNA, 14 bp, Homo sapiens
cacccgtcttcaat

SEQ ID NO: 1674341 - DNA, 17 bp, Homo sapiens
cacccgtggggtgctgc

SEQ ID NO: 1674342 - DNA, 19 bp, Homo sapiens
cacccgtggggtgctgccc

SEQ ID NO: 1674343 - DNA, 16 bp, Homo sapiens
caccctacctgttcag

SEQ ID NO: 1674344 - DNA, 22 bp, Homo sapiens
caccctaccttccccagacttg

SEQ ID NO: 1674345 - DNA, 23 bp, Homo sapiens
caccctaccttccccagacttgc

SEQ ID NO: 1674346 - DNA, 16 bp, Homo sapiens
caccctagtcccttcc

SEQ ID NO: 1674347 - DNA, 17 bp, Homo sapiens
caccctagtcccttccc

SEQ ID NO: 1674348 - DNA, 18 bp, Homo sapiens
caccctagtcccttcccc

SEQ ID NO: 1674349 - DNA, 16 bp, Homo sapiens
caccctcagcacccct

SEQ ID NO: 1674350 - DNA, 21 bp, Homo sapiens
caccctcagcaccccttccat

SEQ ID NO: 1674351 - DNA, 17 bp, Homo sapiens
caccctcattctactga

SEQ ID NO: 1674352 - DNA, 16 bp, Homo sapiens
caccctccagagacaa

SEQ ID NO: 1674353 - DNA, 20 bp, Homo sapiens
caccctcccaagtagctggg

SEQ ID NO: 1674354 - DNA, 16 bp, Homo sapiens
caccctcccacccggc

SEQ ID NO: 1674355 - DNA, 17 bp, Homo sapiens
caccctcccctctcttg

SEQ ID NO: 1674356 - DNA, 23 bp, Homo sapiens
caccctcccctctcttgcacccg

SEQ ID NO: 1674357 - DNA, 11 bp, Homo sapiens
caccctccttc

SEQ ID NO: 1674358 - DNA, 15 bp, Homo sapiens
caccctctcccagga

SEQ ID NO: 1674359 - DNA, 14 bp, Homo sapiens
caccctcttcctgt

SEQ ID NO: 1674360 - DNA, 18 bp, Homo sapiens
caccctgaatggttccat

SEQ ID NO: 1674361 - DNA, 19 bp, Homo sapiens
caccctgaggcctctggaa

SEQ ID NO: 1674362 - DNA, 22 bp, Homo sapiens
caccctgatttaggagaagcca

SEQ ID NO: 1674363 - DNA, 14 bp, Homo sapiens
caccctgcacctgc

SEQ ID NO: 1674364 - DNA, 15 bp, Homo sapiens
caccctgcacctgct

SEQ ID NO: 1674365 - DNA, 17 bp, Homo sapiens
caccctgcacctgctgc

SEQ ID NO: 1674366 - DNA, 18 bp, Homo sapiens
caccctgcacctgctgcg

SEQ ID NO: 1674367 - DNA, 15 bp, Homo sapiens
caccctgcagagcac

SEQ ID NO: 1674368 - DNA, 23 bp, Homo sapiens
caccctgcagagcacacaggtac

SEQ ID NO: 1674369 - DNA, 15 bp, Homo sapiens
caccctgcaggactt

SEQ ID NO: 1674370 - DNA, 19 bp, Homo sapiens
caccctgccaagactcctc

SEQ ID NO: 1674371 - DNA, 21 bp, Homo sapiens
caccctgccccccctaagaga

SEQ ID NO: 1674372 - DNA, 15 bp, Homo sapiens
caccctgcccgctcc

SEQ ID NO: 1674373 - DNA, 12 bp, Homo sapiens
caccctgcctta

SEQ ID NO: 1674374 - DNA, 15 bp, Homo sapiens
caccctgcgcctcca

SEQ ID NO: 1674375 - DNA, 17 bp, Homo sapiens
caccctgcgcctccaga

SEQ ID NO: 1674376 - DNA, 18 bp, Homo sapiens
caccctgcgcctccagag

SEQ ID NO: 1674377 - DNA, 17 bp, Homo sapiens
caccctgctgctggtgc

SEQ ID NO: 1674378 - DNA, 21 bp, Homo sapiens
caccctggaaccgggaagggt

SEQ ID NO: 1674379 - DNA, 22 bp, Homo sapiens
caccctggaaccgggaagggtg

SEQ ID NO: 1674380 - DNA, 12 bp, Homo sapiens
caccctggcccg

SEQ ID NO: 1674381 - DNA, 19 bp, Homo sapiens
caccctggcctagaccagc

SEQ ID NO: 1674382 - DNA, 23 bp, Homo sapiens
caccctggcctagaccagcagac

SEQ ID NO: 1674383 - DNA, 16 bp, Homo sapiens
caccctggcctgaact

SEQ ID NO: 1674384 - DNA, 14 bp, Homo sapiens
caccctggcctggt

SEQ ID NO: 1674385 - DNA, 12 bp, Homo sapiens
caccctgggagc

SEQ ID NO: 1674386 - DNA, 14 bp, Homo sapiens
caccctgggccctg

SEQ ID NO: 1674387 - DNA, 22 bp, Homo sapiens
caccctgggccctgggctggaa

SEQ ID NO: 1674388 - DNA, 13 bp, Homo sapiens
caccctggggcct

SEQ ID NO: 1674389 - DNA, 20 bp, Homo sapiens
caccctggggcctggacctg

SEQ ID NO: 1674390 - DNA, 21 bp, Homo sapiens
caccctggggcctggacctgc

SEQ ID NO: 1674391 - DNA, 14 bp, Homo sapiens
cacttgacattcct

SEQ ID NO: 1674392 - DNA, 13 bp, Homo sapiens
cacttgagagaaa

SEQ ID NO: 1674393 - DNA, 14 bp, Homo sapiens
cacttgaggcctga

SEQ ID NO: 1674394 - DNA, 16 bp, Homo sapiens
cacttgaggcctgatc

SEQ ID NO: 1674395 - DNA, 18 bp, Homo sapiens
cacttgagttcaggagtt

SEQ ID NO: 1674396 - DNA, 19 bp, Homo sapiens
cacttgatgtttcctggaa

SEQ ID NO: 1674397 - DNA, 16 bp, Homo sapiens
cacttgccaaaatcca

SEQ ID NO: 1674398 - DNA, 16 bp, Homo sapiens
cacttgccatgcagga

SEQ ID NO: 1674399 - DNA, 12 bp, Homo sapiens
cacttgcctggg

SEQ ID NO: 1674400 - DNA, 17 bp, Homo sapiens
cacttgcgtcctgcaga

SEQ ID NO: 1674401 - DNA, 19 bp, Homo sapiens
cacttgcgtcctgcagagg

SEQ ID NO: 1674402 - DNA, 20 bp, Homo sapiens
cacttgcgtcctgcagagga

SEQ ID NO: 1674403 - DNA, 12 bp, Homo sapiens
cacttggagccc

SEQ ID NO: 1674404 - DNA, 15 bp, Homo sapiens
cacttggagcccgtg

SEQ ID NO: 1674405 - DNA, 18 bp, Homo sapiens
cacttggagcccgtgcag

SEQ ID NO: 1674406 - DNA, 20 bp, Homo sapiens
cacttggatttcatttgtaa

SEQ ID NO: 1674407 - DNA, 22 bp, Homo sapiens
cacttggctgtctgaccagaga

SEQ ID NO: 1674408 - DNA, 19 bp, Homo sapiens
cacttggttagacgccttc

SEQ ID NO: 1674409 - DNA, 20 bp, Homo sapiens
cacttggtttttggctcttt

SEQ ID NO: 1674410 - DNA, 16 bp, Homo sapiens
cacttgtatatacgca

SEQ ID NO: 1674411 - DNA, 11 bp, Homo sapiens
cacttgtattt

SEQ ID NO: 1674412 - DNA, 15 bp, Homo sapiens
cacttgtatttaatt

SEQ ID NO: 1674413 - DNA, 14 bp, Homo sapiens
cacttgtgactttt

SEQ ID NO: 1674414 - DNA, 17 bp, Homo sapiens
cacttgtgacttttgct

SEQ ID NO: 1674415 - DNA, 18 bp, Homo sapiens
cacttgtgacttttgctt

SEQ ID NO: 1674416 - DNA, 20 bp, Homo sapiens
cacttgtgggcttcaggtgt

SEQ ID NO: 1674417 - DNA, 17 bp, Homo sapiens
cacttgtgtgtgggctg

SEQ ID NO: 1674418 - DNA, 13 bp, Homo sapiens
cacttgttccagc

SEQ ID NO: 1674419 - DNA, 12 bp, Homo sapiens
cacttgtttgca

SEQ ID NO: 1674420 - DNA, 15 bp, Homo sapiens
cacttgtttgcactg

SEQ ID NO: 1674421 - DNA, 16 bp, Homo sapiens
cacttgtttgcactgt

SEQ ID NO: 1674422 - DNA, 15 bp, Homo sapiens
cactttaagctcctt

SEQ ID NO: 1674423 - DNA, 16 bp, Homo sapiens
cactttacacaagaat

SEQ ID NO: 1674424 - DNA, 19 bp, Homo sapiens
cactttacacaagaatcta

SEQ ID NO: 1674425 - DNA, 17 bp, Homo sapiens
cactttacccacctaga

SEQ ID NO: 1674426 - DNA, 20 bp, Homo sapiens
cactttacccacctagaaca

SEQ ID NO: 1674427 - DNA, 22 bp, Homo sapiens
cactttacccacctagaacact

SEQ ID NO: 1674428 - DNA, 19 bp, Homo sapiens
cactttacctgcaggctcc

SEQ ID NO: 1674429 - DNA, 15 bp, Homo sapiens
cactttagatgctga

SEQ ID NO: 1674430 - DNA, 17 bp, Homo sapiens
cactttcaagctgcact

SEQ ID NO: 1674431 - DNA, 21 bp, Homo sapiens
cactttcagagcccccagccc

SEQ ID NO: 1674432 - DNA, 14 bp, Homo sapiens
cactttccatctct

SEQ ID NO: 1674433 - DNA, 16 bp, Homo sapiens
cactttcccccttccc

SEQ ID NO: 1674434 - DNA, 18 bp, Homo sapiens
cactttcccccttcccgc

SEQ ID NO: 1674435 - DNA, 14 bp, Homo sapiens
cactttcctgagct

SEQ ID NO: 1674436 - DNA, 18 bp, Homo sapiens
cactttctaatgtttctg

SEQ ID NO: 1674437 - DNA, 16 bp, Homo sapiens
cactttctatagcaga

SEQ ID NO: 1674438 - DNA, 22 bp, Homo sapiens
cactttctcatgatttacagag

SEQ ID NO: 1674439 - DNA, 18 bp, Homo sapiens
cactttcttattctgtat

SEQ ID NO: 1674440 - DNA, 15 bp, Homo sapiens
cactttgaaatgtgt

SEQ ID NO: 1674441 - DNA, 17 bp, Homo sapiens
cactttgaaatgtgttt

SEQ ID NO: 1674442 - DNA, 19 bp, Homo sapiens
cactttgaaatgtgtttct

SEQ ID NO: 1674443 - DNA, 16 bp, Homo sapiens
cactttgagaaacacc

SEQ ID NO: 1674444 - DNA, 18 bp, Homo sapiens
cactttgagcctgggaaa

SEQ ID NO: 1674445 - DNA, 19 bp, Homo sapiens
cactttgagcctgggaaat

SEQ ID NO: 1674446 - DNA, 14 bp, Homo sapiens
cactttgcacagct

SEQ ID NO: 1674447 - DNA, 17 bp, Homo sapiens
cactttgcacagctctc

SEQ ID NO: 1674448 - DNA, 20 bp, Homo sapiens
cactttggatttcatcagac

SEQ ID NO: 1674449 - DNA, 13 bp, Homo sapiens
cactttggcttct

SEQ ID NO: 1674450 - DNA, 20 bp, Homo sapiens
cactttggcttctcctgtga

SEQ ID NO: 1674451 - DNA, 13 bp, Homo sapiens
cactttgggaggc

SEQ ID NO: 1674452 - DNA, 20 bp, Homo sapiens
cactttggtacatggccagt

SEQ ID NO: 1674453 - DNA, 22 bp, Homo sapiens
cactttggtttatgcggtgctg

SEQ ID NO: 1674454 - DNA, 19 bp, Homo sapiens
cactttggttttgctgaga

SEQ ID NO: 1674455 - DNA, 15 bp, Homo sapiens
cactttgtaattttt

SEQ ID NO: 1674456 - DNA, 14 bp, Homo sapiens
cactttgttgcaag

SEQ ID NO: 1674457 - DNA, 23 bp, Homo sapiens
cactttgttgcaagatgtgaatt

SEQ ID NO: 1674458 - DNA, 14 bp, Homo sapiens
cacttttcatcctt

SEQ ID NO: 1674459 - DNA, 16 bp, Homo sapiens
cactttttttttttct

SEQ ID NO: 1674460 - DNA, 22 bp, Homo sapiens
cagaaaaaaaagtgtctcaaag

SEQ ID NO: 1674461 - DNA, 11 bp, Homo sapiens
cagaaaaacaa

SEQ ID NO: 1674462 - DNA, 15 bp, Homo sapiens
cagaaaaacaatctt

SEQ ID NO: 1674463 - DNA, 16 bp, Homo sapiens
cagaaaaactctggga

SEQ ID NO: 1674464 - DNA, 19 bp, Homo sapiens
cagaaaaactctgggaaat

SEQ ID NO: 1674465 - DNA, 21 bp, Homo sapiens
cagaaaaagcatgatgggaaa

SEQ ID NO: 1674466 - DNA, 22 bp, Homo sapiens
cagaaaacaacttggcatttct

SEQ ID NO: 1674467 - DNA, 16 bp, Homo sapiens
cagaaaacagggtctg

SEQ ID NO: 1674468 - DNA, 23 bp, Homo sapiens
cagaaaacccttgggccagaagt

SEQ ID NO: 1674469 - DNA, 13 bp, Homo sapiens
cagaaaacctcca

SEQ ID NO: 1674470 - DNA, 20 bp, Homo sapiens
cagaaaagaggagaccctgg

SEQ ID NO: 1674471 - DNA, 10 bp, Homo sapiens
cagaaaagtg

SEQ ID NO: 1674472 - DNA, 15 bp, Homo sapiens
cagaaaagtgcctga

SEQ ID NO: 1674473 - DNA, 16 bp, Homo sapiens
cagaaaagtgcctgag

SEQ ID NO: 1674474 - DNA, 23 bp, Homo sapiens
cagaaaataaggcacccatctgt

SEQ ID NO: 1674475 - DNA, 20 bp, Homo sapiens
cagaaaatatttaatatcaa

SEQ ID NO: 1674476 - DNA, 20 bp, Homo sapiens
cagaaacaaaaacactaaaa

SEQ ID NO: 1674477 - DNA, 16 bp, Homo sapiens
cagaaacacccctctg

SEQ ID NO: 1674478 - DNA, 17 bp, Homo sapiens
cagaaacacccctctgt

SEQ ID NO: 1674479 - DNA, 13 bp, Homo sapiens
cagaaacactgcc

SEQ ID NO: 1674480 - DNA, 17 bp, Homo sapiens
cagaaacactgcctttt

SEQ ID NO: 1674481 - DNA, 18 bp, Homo sapiens
cagaaacactgccttttt

SEQ ID NO: 1674482 - DNA, 22 bp, Homo sapiens
cagaaacatcagttactctgaa

SEQ ID NO: 1674483 - DNA, 13 bp, Homo sapiens
cagaaacatctct

SEQ ID NO: 1674484 - DNA, 15 bp, Homo sapiens
cagaaacatctctgg

SEQ ID NO: 1674485 - DNA, 14 bp, Homo sapiens
cagaaaccagttat

SEQ ID NO: 1674486 - DNA, 22 bp, Homo sapiens
cagaaaccctcattgtgtttct

SEQ ID NO: 1674487 - DNA, 17 bp, Homo sapiens
cagaaactcctgtttct

SEQ ID NO: 1674488 - DNA, 19 bp, Homo sapiens
cagaaactcctgtttctcc

SEQ ID NO: 1674489 - DNA, 19 bp, Homo sapiens
cagaaagaactttaaagct

SEQ ID NO: 1674490 - DNA, 19 bp, Homo sapiens
cagaaagatggatgtgctt

SEQ ID NO: 1674491 - DNA, 21 bp, Homo sapiens
cagaaagatggatgtgctttg

SEQ ID NO: 1674492 - DNA, 19 bp, Homo sapiens
cagaaagcactacaatcat

SEQ ID NO: 1674493 - DNA, 19 bp, Homo sapiens
cagaaagcaggagcagctg

SEQ ID NO: 1674494 - DNA, 15 bp, Homo sapiens
cagaaagcctctctc

SEQ ID NO: 1674495 - DNA, 12 bp, Homo sapiens
cagaaaggagag

SEQ ID NO: 1674496 - DNA, 21 bp, Homo sapiens
cagaaaggatgttttgtccca

SEQ ID NO: 1674497 - DNA, 20 bp, Homo sapiens
cagaaaggggcattttgtac

SEQ ID NO: 1674498 - DNA, 19 bp, Homo sapiens
cagaaagtgataagtgcag

SEQ ID NO: 1674499 - DNA, 17 bp, Homo sapiens
cagaaagttcaacttcc

SEQ ID NO: 1674500 - DNA, 15 bp, Homo sapiens
cagaaatacaaaaaa

SEQ ID NO: 1674501 - DNA, 19 bp, Homo sapiens
cactgatttcacaacagat

SEQ ID NO: 1674502 - DNA, 19 bp, Homo sapiens
cactgcaacctccacctcg

SEQ ID NO: 1674503 - DNA, 14 bp, Homo sapiens
cactgcaacctctg

SEQ ID NO: 1674504 - DNA, 12 bp, Homo sapiens
cactgcaagaag

SEQ ID NO: 1674505 - DNA, 18 bp, Homo sapiens
cactgcaagagccttggt

SEQ ID NO: 1674506 - DNA, 19 bp, Homo sapiens
cactgcaatcctgtctttc

SEQ ID NO: 1674507 - DNA, 18 bp, Homo sapiens
cactgcacagtgcatctc

SEQ ID NO: 1674508 - DNA, 21 bp, Homo sapiens
cactgcacagtgcatctcagc

SEQ ID NO: 1674509 - DNA, 17 bp, Homo sapiens
cactgcactccagcctg

SEQ ID NO: 1674510 - DNA, 20 bp, Homo sapiens
cactgcactccagcctgggc

SEQ ID NO: 1674511 - DNA, 14 bp, Homo sapiens
cactgcacttcagt

SEQ ID NO: 1674512 - DNA, 16 bp, Homo sapiens
cactgcagtttcctgg

SEQ ID NO: 1674513 - DNA, 17 bp, Homo sapiens
cactgcagtttcctgga

SEQ ID NO: 1674514 - DNA, 18 bp, Homo sapiens
cactgcatgagcttttat

SEQ ID NO: 1674515 - DNA, 16 bp, Homo sapiens
cactgcattcctgtgc

SEQ ID NO: 1674516 - DNA, 17 bp, Homo sapiens
cactgcattcctgtgcc

SEQ ID NO: 1674517 - DNA, 15 bp, Homo sapiens
cactgccacaccctc

SEQ ID NO: 1674518 - DNA, 20 bp, Homo sapiens
cactgccacactctccatca

SEQ ID NO: 1674519 - DNA, 14 bp, Homo sapiens
cactgccagaagag

SEQ ID NO: 1674520 - DNA, 14 bp, Homo sapiens
cactgccagcagca

SEQ ID NO: 1674521 - DNA, 19 bp, Homo sapiens
cactgccaggcacctggcc

SEQ ID NO: 1674522 - DNA, 20 bp, Homo sapiens
cactgccaggcacctggcct

SEQ ID NO: 1674523 - DNA, 13 bp, Homo sapiens
cagacctggaaga

SEQ ID NO: 1674524 - DNA, 21 bp, Homo sapiens
cagacctggaagaacaggcct

SEQ ID NO: 1674525 - DNA, 13 bp, Homo sapiens
cagacctggagcc

SEQ ID NO: 1674526 - DNA, 14 bp, Homo sapiens
cagacctggagccc

SEQ ID NO: 1674527 - DNA, 15 bp, Homo sapiens
cagacctggagcccc

SEQ ID NO: 1674528 - DNA, 17 bp, Homo sapiens
cagacctggagcccctg

SEQ ID NO: 1674529 - DNA, 19 bp, Homo sapiens
cagacctggagcccctggg

SEQ ID NO: 1674530 - DNA, 20 bp, Homo sapiens
cagacctggagcccctgggt

SEQ ID NO: 1674531 - DNA, 22 bp, Homo sapiens
cagacctggagcccctgggtgg

SEQ ID NO: 1674532 - DNA, 12 bp, Homo sapiens
cagacctggctc

SEQ ID NO: 1674533 - DNA, 21 bp, Homo sapiens
cagacctggctctcagaggaa

SEQ ID NO: 1674534 - DNA, 19 bp, Homo sapiens
cagacctgtcaccctgcag

SEQ ID NO: 1674535 - DNA, 19 bp, Homo sapiens
cagacctgtcgtctctccc

SEQ ID NO: 1674536 - DNA, 20 bp, Homo sapiens
cagacctgtcgtctctccca

SEQ ID NO: 1674537 - DNA, 23 bp, Homo sapiens
cagacctgtcttccaaggagacc

SEQ ID NO: 1674538 - DNA, 16 bp, Homo sapiens
cagacggagctgcgct

SEQ ID NO: 1674539 - DNA, 13 bp, Homo sapiens
cagacggcggcca

SEQ ID NO: 1674540 - DNA, 16 bp, Homo sapiens
cagacggcggccaggc

SEQ ID NO: 1674541 - DNA, 21 bp, Homo sapiens
cagacggcggccaggcacagg

SEQ ID NO: 1674542 - DNA, 18 bp, Homo sapiens
cagacgggcacacagact

SEQ ID NO: 1674543 - DNA, 16 bp, Homo sapiens
cagacgggcacagaca

SEQ ID NO: 1674544 - DNA, 18 bp, Homo sapiens
cagacgggcacagacacg

SEQ ID NO: 1674545 - DNA, 19 bp, Homo sapiens
cagacggttcaccagcctc

SEQ ID NO: 1674546 - DNA, 21 bp, Homo sapiens
cagacgtatattgtatcattt

SEQ ID NO: 1674547 - DNA, 14 bp, Homo sapiens
cagacgtgtgacct

SEQ ID NO: 1674548 - DNA, 17 bp, Homo sapiens
cagacgtgtgacctcca

SEQ ID NO: 1674549 - DNA, 18 bp, Homo sapiens
cagacgtgtgacctccat

SEQ ID NO: 1674550 - DNA, 23 bp, Homo sapiens
cagacgttaggcatttcctgctg

SEQ ID NO: 1674551 - DNA, 14 bp, Homo sapiens
cagactaaaaagaa

SEQ ID NO: 1674552 - DNA, 16 bp, Homo sapiens
cagactaaaaatacac

SEQ ID NO: 1674553 - DNA, 21 bp, Homo sapiens
cagactagatggacctgcctg

SEQ ID NO: 1674554 - DNA, 19 bp, Homo sapiens
cagactagccactcctgcc

SEQ ID NO: 1674555 - DNA, 21 bp, Homo sapiens
cagactatttgctaatgtata

SEQ ID NO: 1674556 - DNA, 23 bp, Homo sapiens
cagactcaaacggaggaagccca

SEQ ID NO: 1674557 - DNA, 16 bp, Homo sapiens
cagactcagtttgtca

SEQ ID NO: 1674558 - DNA, 14 bp, Homo sapiens
cagactccaatggg

SEQ ID NO: 1674559 - DNA, 21 bp, Homo sapiens
cagactccaatggggccagca

SEQ ID NO: 1674560 - DNA, 19 bp, Homo sapiens
cagactcccattcctgaag

SEQ ID NO: 1674561 - DNA, 22 bp, Homo sapiens
cagactctttcgatacccagga

SEQ ID NO: 1674562 - DNA, 22 bp, Homo sapiens
cagactctttttttgagtgaca

SEQ ID NO: 1674563 - DNA, 19 bp, Homo sapiens
cagactgaactcgcaggga

SEQ ID NO: 1674564 - DNA, 20 bp, Homo sapiens
cagactgacaaatgtgtatc

SEQ ID NO: 1674565 - DNA, 17 bp, Homo sapiens
cagactgagctctccag

SEQ ID NO: 1674566 - DNA, 21 bp, Homo sapiens
cagactgagctctccaggcca

SEQ ID NO: 1674567 - DNA, 22 bp, Homo sapiens
cagactgatggcgattccctct

SEQ ID NO: 1674568 - DNA, 23 bp, Homo sapiens
cagactgcagaggggaaagactt

SEQ ID NO: 1674569 - DNA, 17 bp, Homo sapiens
cagactggaagacactt

SEQ ID NO: 1674570 - DNA, 22 bp, Homo sapiens
cagactggcacagttttctgag

SEQ ID NO: 1674571 - DNA, 12 bp, Homo sapiens
cagactgggccc

SEQ ID NO: 1674572 - DNA, 15 bp, Homo sapiens
cagactgggcccagg

SEQ ID NO: 1674573 - DNA, 16 bp, Homo sapiens
cagactgggcccaggc

SEQ ID NO: 1674574 - DNA, 23 bp, Homo sapiens
cagactgggcccaggcaggtctg

SEQ ID NO: 1674575 - DNA, 21 bp, Homo sapiens
cagactggggcatcctgtgcc

SEQ ID NO: 1674576 - DNA, 22 bp, Homo sapiens
cagactggggcatcctgtgcca

SEQ ID NO: 1674577 - DNA, 17 bp, Homo sapiens
cagactgtgaacttgac

SEQ ID NO: 1674578 - DNA, 14 bp, Homo sapiens
cagactgttttact

SEQ ID NO: 1674579 - DNA, 19 bp, Homo sapiens
cagacttcacagcgtctgc

SEQ ID NO: 1674580 - DNA, 20 bp, Homo sapiens
cagacttcacagcgtctgct

SEQ ID NO: 1674581 - DNA, 22 bp, Homo sapiens
cagacttccaaatcctggaagg

SEQ ID NO: 1674582 - DNA, 23 bp, Homo sapiens
cagacttccaaatcctggaagga

SEQ ID NO: 1674583 - DNA, 20 bp, Homo sapiens
cagacttcccagctaggaag

SEQ ID NO: 1674584 - DNA, 21 bp, Homo sapiens
cagacttccctgaatgtattg

SEQ ID NO: 1674585 - DNA, 24 bp, Homo sapiens
cagacttccttgagacacggagcc

SEQ ID NO: 1674586 - DNA, 21 bp, Homo sapiens
cagacttctggaaggctggct

SEQ ID NO: 1674587 - DNA, 22 bp, Homo sapiens
cagacttctggaaggctggctg

SEQ ID NO: 1674588 - DNA, 20 bp, Homo sapiens
cagacttcttaaaaggagct

SEQ ID NO: 1674589 - DNA, 15 bp, Homo sapiens
cagacttgcactgaa

SEQ ID NO: 1674590 - DNA, 16 bp, Homo sapiens
cagacttgcactgaag

SEQ ID NO: 1674591 - DNA, 14 bp, Homo sapiens
cagacttgcactgg

SEQ ID NO: 1674592 - DNA, 14 bp, Homo sapiens
cagacttgcttcct

SEQ ID NO: 1674593 - DNA, 15 bp, Homo sapiens
cagacttgcttcctg

SEQ ID NO: 1674594 - DNA, 12 bp, Homo sapiens
cagactttctgt

SEQ ID NO: 1674595 - DNA, 23 bp, Homo sapiens
cagagaaaaatgctccccacagc

SEQ ID NO: 1674596 - DNA, 16 bp, Homo sapiens
cagagaaaatgaattt

SEQ ID NO: 1674597 - DNA, 19 bp, Homo sapiens
cagagaaaatgagaaagga

SEQ ID NO: 1674598 - DNA, 20 bp, Homo sapiens
cagagaaaatgagaaaggac

SEQ ID NO: 1674599 - DNA, 22 bp, Homo sapiens
cagagaaaatgagaaaggacag

SEQ ID NO: 1674600 - DNA, 23 bp, Homo sapiens
cagagaaaatgagaaaggacaga

SEQ ID NO: 1674601 - DNA, 19 bp, Homo sapiens
cagagaaacttaagcaaag

SEQ ID NO: 1674602 - DNA, 20 bp, Homo sapiens
cagagaaacttaagcaaagg

SEQ ID NO: 1674603 - DNA, 15 bp, Homo sapiens
cagagaagataatgt

SEQ ID NO: 1674604 - DNA, 17 bp, Homo sapiens
cagagaagctcctgcta

SEQ ID NO: 1674605 - DNA, 14 bp, Homo sapiens
cagagaaggaaaag

SEQ ID NO: 1674606 - DNA, 15 bp, Homo sapiens
cagagaaggaaaaga

SEQ ID NO: 1674607 - DNA, 16 bp, Homo sapiens
cagagaaggcagcagg

SEQ ID NO: 1674608 - DNA, 17 bp, Homo sapiens
cagagaaggcaggaatg

SEQ ID NO: 1674609 - DNA, 20 bp, Homo sapiens
cagagaaggcaggaatgtgt

SEQ ID NO: 1674610 - DNA, 19 bp, Homo sapiens
cagagaaggcctcttgtgc

SEQ ID NO: 1674611 - DNA, 21 bp, Homo sapiens
cagagaaggcctcttgtgctc

SEQ ID NO: 1674612 - DNA, 17 bp, Homo sapiens
cagagaaggctatgtaa

SEQ ID NO: 1674613 - DNA, 11 bp, Homo sapiens
cagagaagttc

SEQ ID NO: 1674614 - DNA, 20 bp, Homo sapiens
cagagaagtttgtagccagg

SEQ ID NO: 1674615 - DNA, 21 bp, Homo sapiens
cagagaagtttgtagccaggt

SEQ ID NO: 1674616 - DNA, 16 bp, Homo sapiens
cagagaatgcacctct

SEQ ID NO: 1674617 - DNA, 13 bp, Homo sapiens
cagagacgcagga

SEQ ID NO: 1674618 - DNA, 14 bp, Homo sapiens
cagagacgcaggaa

SEQ ID NO: 1674619 - DNA, 17 bp, Homo sapiens
cagagacgcaggaatgg

SEQ ID NO: 1674620 - DNA, 17 bp, Homo sapiens
cagagactcatttcaca

SEQ ID NO: 1674621 - DNA, 21 bp, Homo sapiens
cagagactcatttcacagcct

SEQ ID NO: 1674622 - DNA, 20 bp, Homo sapiens
cagagagacccgggaaggaa

SEQ ID NO: 1674623 - DNA, 21 bp, Homo sapiens
cagagagacccgggaaggaag

SEQ ID NO: 1674624 - DNA, 17 bp, Homo sapiens
cagagagaccctgcaag

SEQ ID NO: 1674625 - DNA, 20 bp, Homo sapiens
cagagagacctcatcctgct

SEQ ID NO: 1674626 - DNA, 12 bp, Homo sapiens
cagagagagggg

SEQ ID NO: 1674627 - DNA, 20 bp, Homo sapiens
cagagagaggggcctgcagg

SEQ ID NO: 1674628 - DNA, 13 bp, Homo sapiens
cagagaggaatca

SEQ ID NO: 1674629 - DNA, 14 bp, Homo sapiens
cagagaggagcacc

SEQ ID NO: 1674630 - DNA, 16 bp, Homo sapiens
cagagaggagcacctg

SEQ ID NO: 1674631 - DNA, 20 bp, Homo sapiens
cagagaggagcacctgaacc

SEQ ID NO: 1674632 - DNA, 13 bp, Homo sapiens
cagagaggagggg

SEQ ID NO: 1674633 - DNA, 21 bp, Homo sapiens
cagagagggagagcagagaaa

SEQ ID NO: 1674634 - DNA, 15 bp, Homo sapiens
cagagagggcccagc

SEQ ID NO: 1674635 - DNA, 18 bp, Homo sapiens
cagagagggcccagctgt

SEQ ID NO: 1674636 - DNA, 22 bp, Homo sapiens
cagagagggcccagctgtagcc

SEQ ID NO: 1674637 - DNA, 17 bp, Homo sapiens
cagagaggggctgctct

SEQ ID NO: 1674638 - DNA, 17 bp, Homo sapiens
cagagaggtctcaggtt

SEQ ID NO: 1674639 - DNA, 15 bp, Homo sapiens
cagagagtggctcct

SEQ ID NO: 1674640 - DNA, 21 bp, Homo sapiens
cagagatccaaaagaagcccc

SEQ ID NO: 1674641 - DNA, 20 bp, Homo sapiens
cagagatgcaccaccaagcc

SEQ ID NO: 1674642 - DNA, 21 bp, Homo sapiens
cagagatgcaccaccaagcca

SEQ ID NO: 1674643 - DNA, 14 bp, Homo sapiens
cagagatgcctcca

SEQ ID NO: 1674644 - DNA, 15 bp, Homo sapiens
cagagatgcctccac

SEQ ID NO: 1674645 - DNA, 22 bp, Homo sapiens
cagagatggtaatctacagctc

SEQ ID NO: 1674646 - DNA, 13 bp, Homo sapiens
cagagatgtactg

SEQ ID NO: 1674647 - DNA, 16 bp, Homo sapiens
cagagatgtactgcaa

SEQ ID NO: 1674648 - DNA, 14 bp, Homo sapiens
cagagattctggat

SEQ ID NO: 1674649 - DNA, 22 bp, Homo sapiens
cagagattctggatctcctgct

SEQ ID NO: 1674650 - DNA, 21 bp, Homo sapiens
cagagatttctcattgacttt

SEQ ID NO: 1674651 - DNA, 14 bp, Homo sapiens
cagagcaaaataat

SEQ ID NO: 1674652 - DNA, 16 bp, Homo sapiens
cagagcaaaatgctct

SEQ ID NO: 1674653 - DNA, 20 bp, Homo sapiens
cagagcaattccaggctgag

SEQ ID NO: 1674654 - DNA, 23 bp, Homo sapiens
cagagcacacaggtacagcaaca

SEQ ID NO: 1674655 - DNA, 16 bp, Homo sapiens
cagagcaccccctgct

SEQ ID NO: 1674656 - DNA, 19 bp, Homo sapiens
cagagcaccccctgctcca

SEQ ID NO: 1674657 - DNA, 14 bp, Homo sapiens
cagagcacctcacc

SEQ ID NO: 1674658 - DNA, 15 bp, Homo sapiens
cagagcacgcctgcc

SEQ ID NO: 1674659 - DNA, 17 bp, Homo sapiens
cagagcacgcctgccat

SEQ ID NO: 1674660 - DNA, 19 bp, Homo sapiens
cagagcagctaactccgag

SEQ ID NO: 1674661 - DNA, 22 bp, Homo sapiens
cagagcagctaactccgagagc

SEQ ID NO: 1674662 - DNA, 18 bp, Homo sapiens
cagagcaggaaatgagag

SEQ ID NO: 1674663 - DNA, 21 bp, Homo sapiens
cagagcaggaaggacaggaag

SEQ ID NO: 1674664 - DNA, 23 bp, Homo sapiens
cagagcaggaaggacaggaagct

SEQ ID NO: 1674665 - DNA, 14 bp, Homo sapiens
cagagcaggagccc

SEQ ID NO: 1674666 - DNA, 15 bp, Homo sapiens
cagagcaggagcccc

SEQ ID NO: 1674667 - DNA, 21 bp, Homo sapiens
cagagcaggagcccctggggc

SEQ ID NO: 1674668 - DNA, 17 bp, Homo sapiens
cagagcaggaggcccct

SEQ ID NO: 1674669 - DNA, 23 bp, Homo sapiens
cagagcagggccaaagcacagct

SEQ ID NO: 1674670 - DNA, 15 bp, Homo sapiens
cagagcaggggcagg

SEQ ID NO: 1674671 - DNA, 14 bp, Homo sapiens
cagagcatacaaca

SEQ ID NO: 1674672 - DNA, 11 bp, Homo sapiens
cagagccaacc

SEQ ID NO: 1674673 - DNA, 17 bp, Homo sapiens
cagagccaacctggact

SEQ ID NO: 1674674 - DNA, 13 bp, Homo sapiens
cagagccaagcac

SEQ ID NO: 1674675 - DNA, 16 bp, Homo sapiens
cagagccaagcactgc

SEQ ID NO: 1674676 - DNA, 13 bp, Homo sapiens
cagagccacctgg

SEQ ID NO: 1674677 - DNA, 19 bp, Homo sapiens
cagagccagatgcaggaca

SEQ ID NO: 1674678 - DNA, 23 bp, Homo sapiens
cagagccagatgcaggacaggag

SEQ ID NO: 1674679 - DNA, 13 bp, Homo sapiens
cagagccagcctg

SEQ ID NO: 1674680 - DNA, 17 bp, Homo sapiens
cagagccagcctggctc

SEQ ID NO: 1674681 - DNA, 15 bp, Homo sapiens
cagagccagcctggg

SEQ ID NO: 1674682 - DNA, 19 bp, Homo sapiens
cagagccagcctgggactc

SEQ ID NO: 1674683 - DNA, 17 bp, Homo sapiens
cagagccaggagaagct

SEQ ID NO: 1674684 - DNA, 18 bp, Homo sapiens
cagagccaggctgttgga

SEQ ID NO: 1674685 - DNA, 23 bp, Homo sapiens
cagagccaggggggtgaggagct

SEQ ID NO: 1674686 - DNA, 14 bp, Homo sapiens
cagagccatgggcc

SEQ ID NO: 1674687 - DNA, 18 bp, Homo sapiens
cagagccatgggcctggg

SEQ ID NO: 1674688 - DNA, 20 bp, Homo sapiens
cagagccatgggcctgggcc

SEQ ID NO: 1674689 - DNA, 11 bp, Homo sapiens
cagagcccagc

SEQ ID NO: 1674690 - DNA, 14 bp, Homo sapiens
cagagcccagcatc

SEQ ID NO: 1674691 - DNA, 15 bp, Homo sapiens
cagagcccagcatcc

SEQ ID NO: 1674692 - DNA, 16 bp, Homo sapiens
cagagcccagcatccc

SEQ ID NO: 1674693 - DNA, 14 bp, Homo sapiens
cagagcccagccca

SEQ ID NO: 1674694 - DNA, 15 bp, Homo sapiens
cagagcccagcccag

SEQ ID NO: 1674695 - DNA, 17 bp, Homo sapiens
cagagcccagcccagga

SEQ ID NO: 1674696 - DNA, 14 bp, Homo sapiens
cagagcccagctcc

SEQ ID NO: 1674697 - DNA, 15 bp, Homo sapiens
cagagcccagctctt

SEQ ID NO: 1674698 - DNA, 17 bp, Homo sapiens
cagagcccagctcttgc

SEQ ID NO: 1674699 - DNA, 22 bp, Homo sapiens
cagagcccatgctcaaccactg

SEQ ID NO: 1674700 - DNA, 23 bp, Homo sapiens
cagagccccacacggaggcatct

SEQ ID NO: 1674701 - DNA, 14 bp, Homo sapiens
cagagccccacgct

SEQ ID NO: 1674702 - DNA, 17 bp, Homo sapiens
cagagcccctcctccag

SEQ ID NO: 1674703 - DNA, 12 bp, Homo sapiens
cagagccctcca

SEQ ID NO: 1674704 - DNA, 15 bp, Homo sapiens
cagagccctcggagc

SEQ ID NO: 1674705 - DNA, 14 bp, Homo sapiens
cagagccgggagga

SEQ ID NO: 1674706 - DNA, 18 bp, Homo sapiens
cagagctgtgcctgctca

SEQ ID NO: 1674707 - DNA, 19 bp, Homo sapiens
cagagctgtgcctgctcag

SEQ ID NO: 1674708 - DNA, 22 bp, Homo sapiens
cagagctgtgcctgctcagcag

SEQ ID NO: 1674709 - DNA, 19 bp, Homo sapiens
cagagctgtttatggcctc

SEQ ID NO: 1674710 - DNA, 14 bp, Homo sapiens
cagagcttctctgg

SEQ ID NO: 1674711 - DNA, 20 bp, Homo sapiens
cagagctttggtctgtgtgt

SEQ ID NO: 1674712 - DNA, 23 bp, Homo sapiens
cagaggaaaaatgggagccagga

SEQ ID NO: 1674713 - DNA, 13 bp, Homo sapiens
cagaggaaagaca

SEQ ID NO: 1674714 - DNA, 15 bp, Homo sapiens
cagaggaagcccctt

SEQ ID NO: 1674715 - DNA, 20 bp, Homo sapiens
cagaggaatcctggcagccc

SEQ ID NO: 1674716 - DNA, 23 bp, Homo sapiens
cagaggaatcctggcagcccaga

SEQ ID NO: 1674717 - DNA, 12 bp, Homo sapiens
cagaggaccaca

SEQ ID NO: 1674718 - DNA, 21 bp, Homo sapiens
cagaggactcccaaccctggc

SEQ ID NO: 1674719 - DNA, 12 bp, Homo sapiens
cagaggagaaga

SEQ ID NO: 1674720 - DNA, 22 bp, Homo sapiens
cagaggagagtcccagagcagg

SEQ ID NO: 1674721 - DNA, 19 bp, Homo sapiens
cagaggagccaccagttct

SEQ ID NO: 1674722 - DNA, 20 bp, Homo sapiens
cagaggagctgggagccggg

SEQ ID NO: 1674723 - DNA, 22 bp, Homo sapiens
cagaggagggcagcagaagggg

SEQ ID NO: 1674724 - DNA, 15 bp, Homo sapiens
cagaggatgcctttt

SEQ ID NO: 1674725 - DNA, 23 bp, Homo sapiens
cagaggatgccttttctgtgatt

SEQ ID NO: 1674726 - DNA, 18 bp, Homo sapiens
cagaggatgctctttccc

SEQ ID NO: 1674727 - DNA, 20 bp, Homo sapiens
cagaggccagaggcccccag

SEQ ID NO: 1674728 - DNA, 14 bp, Homo sapiens
cagaggccccagcc

SEQ ID NO: 1674729 - DNA, 22 bp, Homo sapiens
cagaggcccccagcccagggct

SEQ ID NO: 1674730 - DNA, 23 bp, Homo sapiens
cagaggcccccagcccagggctc

SEQ ID NO: 1674731 - DNA, 14 bp, Homo sapiens
cagaggccctggag

SEQ ID NO: 1674732 - DNA, 16 bp, Homo sapiens
cagaggcctcccccag

SEQ ID NO: 1674733 - DNA, 16 bp, Homo sapiens
cagaggcctgctgcca

SEQ ID NO: 1674734 - DNA, 21 bp, Homo sapiens
cagaggcctgctgccagtgca

SEQ ID NO: 1674735 - DNA, 22 bp, Homo sapiens
cagaggcctgctgccagtgcag

SEQ ID NO: 1674736 - DNA, 23 bp, Homo sapiens
cagaggcctgctgccagtgcagc

SEQ ID NO: 1674737 - DNA, 14 bp, Homo sapiens
cagaggcctgggct

SEQ ID NO: 1674738 - DNA, 19 bp, Homo sapiens
cagaggcctgggctgggaa

SEQ ID NO: 1674739 - DNA, 17 bp, Homo sapiens
cagaggctaagatgaga

SEQ ID NO: 1674740 - DNA, 23 bp, Homo sapiens
cagaggctaattcagtgtcacat

SEQ ID NO: 1674741 - DNA, 17 bp, Homo sapiens
cagaggctaattctgca

SEQ ID NO: 1674742 - DNA, 13 bp, Homo sapiens
cagaggctgcctc

SEQ ID NO: 1674743 - DNA, 16 bp, Homo sapiens
cagaggcttcttcaga

SEQ ID NO: 1674744 - DNA, 17 bp, Homo sapiens
cagagggactgtcagct

SEQ ID NO: 1674745 - DNA, 22 bp, Homo sapiens
cagagggactgtcagctgagct

SEQ ID NO: 1674746 - DNA, 12 bp, Homo sapiens
cagagggagttt

SEQ ID NO: 1674747 - DNA, 17 bp, Homo sapiens
cagagggcacatgaaca

SEQ ID NO: 1674748 - DNA, 17 bp, Homo sapiens
cagagggcagaggctgg

SEQ ID NO: 1674749 - DNA, 14 bp, Homo sapiens
cagagggcatgctg

SEQ ID NO: 1674750 - DNA, 14 bp, Homo sapiens
cagagggccagcag

SEQ ID NO: 1674751 - DNA, 15 bp, Homo sapiens
cagagggcccaggca

SEQ ID NO: 1674752 - DNA, 13 bp, Homo sapiens
cagagggctaggg

SEQ ID NO: 1674753 - DNA, 10 bp, Homo sapiens
cagagggctg

SEQ ID NO: 1674754 - DNA, 11 bp, Homo sapiens
cagagggctgg

SEQ ID NO: 1674755 - DNA, 15 bp, Homo sapiens
cagagggctggaggc

SEQ ID NO: 1674756 - DNA, 18 bp, Homo sapiens
cagagggctggaggccca

SEQ ID NO: 1674757 - DNA, 19 bp, Homo sapiens
cagagggctggaggcccag

SEQ ID NO: 1674758 - DNA, 21 bp, Homo sapiens
cagaggggcagccgctaggag

SEQ ID NO: 1674759 - DNA, 19 bp, Homo sapiens
cagagggggagtagccaag

SEQ ID NO: 1674760 - DNA, 23 bp, Homo sapiens
cagaggggtgggttcctcttccc

SEQ ID NO: 1674761 - DNA, 15 bp, Homo sapiens
cagagggtggctgga

SEQ ID NO: 1674762 - DNA, 17 bp, Homo sapiens
cagagggtggctggagt

SEQ ID NO: 1674763 - DNA, 18 bp, Homo sapiens
cagagggtggctggagtg

SEQ ID NO: 1674764 - DNA, 14 bp, Homo sapiens
cagaggtaccctgg

SEQ ID NO: 1674765 - DNA, 15 bp, Homo sapiens
cagaggtaccctggg

SEQ ID NO: 1674766 - DNA, 18 bp, Homo sapiens
cagaggtaccctgggtgt

SEQ ID NO: 1674767 - DNA, 22 bp, Homo sapiens
cagaggtattaaaactaaattt

SEQ ID NO: 1674768 - DNA, 14 bp, Homo sapiens
cagaggtcgcagct

SEQ ID NO: 1674769 - DNA, 22 bp, Homo sapiens
cagaggtcgcagctaccctcag

SEQ ID NO: 1674770 - DNA, 15 bp, Homo sapiens
cagaggtctgtgctg

SEQ ID NO: 1674771 - DNA, 13 bp, Homo sapiens
cagaggtggagcc

SEQ ID NO: 1674772 - DNA, 13 bp, Homo sapiens
cagaggtggatgt

SEQ ID NO: 1674773 - DNA, 14 bp, Homo sapiens
cagaggtgggcagg

SEQ ID NO: 1674774 - DNA, 20 bp, Homo sapiens
cagaggtgggcaggtggtgg

SEQ ID NO: 1674775 - DNA, 22 bp, Homo sapiens
cagaggtgggcaggtggtggca

SEQ ID NO: 1674776 - DNA, 21 bp, Homo sapiens
cagaggttatctgcctggcct

SEQ ID NO: 1674777 - DNA, 23 bp, Homo sapiens
cagaggttatctgcctggcctgg

SEQ ID NO: 1674778 - DNA, 20 bp, Homo sapiens
cagaggttgtagtgagccaa

SEQ ID NO: 1674779 - DNA, 14 bp, Homo sapiens
cagaggtttcttga

SEQ ID NO: 1674780 - DNA, 16 bp, Homo sapiens
cagaggtttcttgaat

SEQ ID NO: 1674781 - DNA, 21 bp, Homo sapiens
cagaggttttaatgtctgttt

SEQ ID NO: 1674782 - DNA, 16 bp, Homo sapiens
cagagtagctgggact

SEQ ID NO: 1674783 - DNA, 22 bp, Homo sapiens
cagagtatgtccgatggtatct

SEQ ID NO: 1674784 - DNA, 16 bp, Homo sapiens
cagagtcaaggcctgc

SEQ ID NO: 1674785 - DNA, 19 bp, Homo sapiens
cagagtcaaggcctgctcc

SEQ ID NO: 1674786 - DNA, 19 bp, Homo sapiens
cagagtcagaggagaagag

SEQ ID NO: 1674787 - DNA, 23 bp, Homo sapiens
cagagtcagaggagaagagacat

SEQ ID NO: 1674788 - DNA, 16 bp, Homo sapiens
cagagtcagccaggac

SEQ ID NO: 1674789 - DNA, 22 bp, Homo sapiens
cagagtccatttcccacatctt

SEQ ID NO: 1674790 - DNA, 16 bp, Homo sapiens
cagagtccttaaaatg

SEQ ID NO: 1674791 - DNA, 17 bp, Homo sapiens
cagagtctcccgctgca

SEQ ID NO: 1674792 - DNA, 12 bp, Homo sapiens
cagagtctgagc

SEQ ID NO: 1674793 - DNA, 13 bp, Homo sapiens
cagagtctgagcc

SEQ ID NO: 1674794 - DNA, 15 bp, Homo sapiens
cagagtgaaagggct

SEQ ID NO: 1674795 - DNA, 15 bp, Homo sapiens
cagagtgaagaatct

SEQ ID NO: 1674796 - DNA, 19 bp, Homo sapiens
cagagtgagaccctgtctc

SEQ ID NO: 1674797 - DNA, 20 bp, Homo sapiens
cagagtgagaccctgtctca

SEQ ID NO: 1674798 - DNA, 20 bp, Homo sapiens
cagagtgagaccctgtctct

SEQ ID NO: 1674799 - DNA, 16 bp, Homo sapiens
cagagtgagactccat

SEQ ID NO: 1674800 - DNA, 14 bp, Homo sapiens
cagagtgattctag

SEQ ID NO: 1674801 - DNA, 15 bp, Homo sapiens
cagagtgattctagt

SEQ ID NO: 1674802 - DNA, 15 bp, Homo sapiens
cagagtgcacagctg

SEQ ID NO: 1674803 - DNA, 16 bp, Homo sapiens
cagagtgcacagctgt

SEQ ID NO: 1674804 - DNA, 18 bp, Homo sapiens
cagagtggaaactcagcc

SEQ ID NO: 1674805 - DNA, 20 bp, Homo sapiens
cagagtggaaactcagccgt

SEQ ID NO: 1674806 - DNA, 20 bp, Homo sapiens
cagagtggactcttccctct

SEQ ID NO: 1674807 - DNA, 16 bp, Homo sapiens
cagagtggactgcatt

SEQ ID NO: 1674808 - DNA, 18 bp, Homo sapiens
cagagtggactgcattta

SEQ ID NO: 1674809 - DNA, 13 bp, Homo sapiens
cagagtggagtct

SEQ ID NO: 1674810 - DNA, 15 bp, Homo sapiens
cagagtggagtctga

SEQ ID NO: 1674811 - DNA, 23 bp, Homo sapiens
cagagtggagttgaaactgctat

SEQ ID NO: 1674812 - DNA, 13 bp, Homo sapiens
cagagtggcctgg

SEQ ID NO: 1674813 - DNA, 15 bp, Homo sapiens
cagagtgggccccgg

SEQ ID NO: 1674814 - DNA, 18 bp, Homo sapiens
cagagtgggccccgggct

SEQ ID NO: 1674815 - DNA, 21 bp, Homo sapiens
cagagtgggccccgggctgga

SEQ ID NO: 1674816 - DNA, 16 bp, Homo sapiens
cagagtgtgctgctat

SEQ ID NO: 1674817 - DNA, 19 bp, Homo sapiens
cagagttaaaatgtttact

SEQ ID NO: 1674818 - DNA, 20 bp, Homo sapiens
cagagttaaaatgtttactg

SEQ ID NO: 1674819 - DNA, 13 bp, Homo sapiens
cagagttacagtt

SEQ ID NO: 1674820 - DNA, 18 bp, Homo sapiens
cagagttacagttctgtg

SEQ ID NO: 1674821 - DNA, 19 bp, Homo sapiens
cagagttacagttctgtgg

SEQ ID NO: 1674822 - DNA, 18 bp, Homo sapiens
cagatctgtgccccatgc

SEQ ID NO: 1674823 - DNA, 21 bp, Homo sapiens
cagatctgtgccccatgcctg

SEQ ID NO: 1674824 - DNA, 22 bp, Homo sapiens
cagatcttccgtggtcagagtg

SEQ ID NO: 1674825 - DNA, 14 bp, Homo sapiens
cagatctttctctt

SEQ ID NO: 1674826 - DNA, 16 bp, Homo sapiens
cagatctttctcttcc

SEQ ID NO: 1674827 - DNA, 19 bp, Homo sapiens
cagatgaatgataaactct

SEQ ID NO: 1674828 - DNA, 19 bp, Homo sapiens
cagatgaatgtatttattt

SEQ ID NO: 1674829 - DNA, 23 bp, Homo sapiens
cagatgaatgtatttatttggga

SEQ ID NO: 1674830 - DNA, 17 bp, Homo sapiens
cagatgaattgataaaa

SEQ ID NO: 1674831 - DNA, 23 bp, Homo sapiens
cagatgaattgataaaagagttc

SEQ ID NO: 1674832 - DNA, 19 bp, Homo sapiens
cagatgacacataaatctg

SEQ ID NO: 1674833 - DNA, 17 bp, Homo sapiens
cagatgagatccgggag

SEQ ID NO: 1674834 - DNA, 20 bp, Homo sapiens
cagatgagcagaagctctcg

SEQ ID NO: 1674835 - DNA, 12 bp, Homo sapiens
cagatgagctgt

SEQ ID NO: 1674836 - DNA, 22 bp, Homo sapiens
cagatgaggatccgaaacggca

SEQ ID NO: 1674837 - DNA, 18 bp, Homo sapiens
cagatgaggcaaacagca

SEQ ID NO: 1674838 - DNA, 18 bp, Homo sapiens
cagatgatcaactcttcg

SEQ ID NO: 1674839 - DNA, 13 bp, Homo sapiens
cagatgcaggaca

SEQ ID NO: 1674840 - DNA, 16 bp, Homo sapiens
cagatgccacacctgc

SEQ ID NO: 1674841 - DNA, 22 bp, Homo sapiens
cagatgcccagagggcccaggc

SEQ ID NO: 1674842 - DNA, 14 bp, Homo sapiens
cagatgcctcccca

SEQ ID NO: 1674843 - DNA, 18 bp, Homo sapiens
cagatgcctccccaagac

SEQ ID NO: 1674844 - DNA, 22 bp, Homo sapiens
cagatgcctgcttgataatata

SEQ ID NO: 1674845 - DNA, 15 bp, Homo sapiens
cagatgccttctaga

SEQ ID NO: 1674846 - DNA, 16 bp, Homo sapiens
cagatgccttctagat

SEQ ID NO: 1674847 - DNA, 20 bp, Homo sapiens
cagatgcgtcccaagatgtt

SEQ ID NO: 1674848 - DNA, 14 bp, Homo sapiens
cagatgctccaaga

SEQ ID NO: 1674849 - DNA, 15 bp, Homo sapiens
cagatgctccaagat

SEQ ID NO: 1674850 - DNA, 16 bp, Homo sapiens
cagatgctccaagatt

SEQ ID NO: 1674851 - DNA, 18 bp, Homo sapiens
cagatgctccaagattct

SEQ ID NO: 1674852 - DNA, 13 bp, Homo sapiens
cagatggaaaaat

SEQ ID NO: 1674853 - DNA, 17 bp, Homo sapiens
cagatggaatgctgtgt

SEQ ID NO: 1674854 - DNA, 15 bp, Homo sapiens
cagatggatttgcct

SEQ ID NO: 1674855 - DNA, 21 bp, Homo sapiens
cagatggatttgcctgtgcca

SEQ ID NO: 1674856 - DNA, 21 bp, Homo sapiens
cagatggggctcccgcccgtg

SEQ ID NO: 1674857 - DNA, 18 bp, Homo sapiens
cagatggggtctgtgact

SEQ ID NO: 1674858 - DNA, 22 bp, Homo sapiens
cagatggggtctgtgactggat

SEQ ID NO: 1674859 - DNA, 16 bp, Homo sapiens
cagatgggtattaaac

SEQ ID NO: 1674860 - DNA, 15 bp, Homo sapiens
cagatggtcatccag

SEQ ID NO: 1674861 - DNA, 19 bp, Homo sapiens
cagatggtttccacattta

SEQ ID NO: 1674862 - DNA, 18 bp, Homo sapiens
cagatgtcttctgcctgt

SEQ ID NO: 1674863 - DNA, 22 bp, Homo sapiens
cagatgtcttctgcctgttata

SEQ ID NO: 1674864 - DNA, 18 bp, Homo sapiens
cagatgtgcaataatttg

SEQ ID NO: 1674865 - DNA, 13 bp, Homo sapiens
cagatgttcaaat

SEQ ID NO: 1674866 - DNA, 23 bp, Homo sapiens
cagatgttgaatgcccacaggca

SEQ ID NO: 1674867 - DNA, 18 bp, Homo sapiens
cagatgttgttcctggct

SEQ ID NO: 1674868 - DNA, 14 bp, Homo sapiens
cagatgtttccaga

SEQ ID NO: 1674869 - DNA, 16 bp, Homo sapiens
cagatgtttccagact

SEQ ID NO: 1674870 - DNA, 16 bp, Homo sapiens
cagatgtttgcctcat

SEQ ID NO: 1674871 - DNA, 19 bp, Homo sapiens
cagattaggtttgtcccag

SEQ ID NO: 1674872 - DNA, 15 bp, Homo sapiens
cagattcaggccagc

SEQ ID NO: 1674873 - DNA, 17 bp, Homo sapiens
cagattcaggccagccc

SEQ ID NO: 1674874 - DNA, 15 bp, Homo sapiens
cagattcatttttct

SEQ ID NO: 1674875 - DNA, 14 bp, Homo sapiens
cagattcccagagc

SEQ ID NO: 1674876 - DNA, 21 bp, Homo sapiens
cagcaagccctacagagctgt

SEQ ID NO: 1674877 - DNA, 14 bp, Homo sapiens
cagcaagcgggagc

SEQ ID NO: 1674878 - DNA, 21 bp, Homo sapiens
cagcaaggcgcctgccttggg

SEQ ID NO: 1674879 - DNA, 12 bp, Homo sapiens
cagcaaggctgc

SEQ ID NO: 1674880 - DNA, 15 bp, Homo sapiens
cagcaagggacctgc

SEQ ID NO: 1674881 - DNA, 12 bp, Homo sapiens
cagcaaggggct

SEQ ID NO: 1674882 - DNA, 15 bp, Homo sapiens
cagcaagtacagaga

SEQ ID NO: 1674883 - DNA, 22 bp, Homo sapiens
cagcaagtacagagattctatg

SEQ ID NO: 1674884 - DNA, 16 bp, Homo sapiens
cagcaagtgagcagag

SEQ ID NO: 1674885 - DNA, 17 bp, Homo sapiens
cagcaagtgagcagaga

SEQ ID NO: 1674886 - DNA, 13 bp, Homo sapiens
cagcaagtgccca

SEQ ID NO: 1674887 - DNA, 13 bp, Homo sapiens
cagcaagtgtttg

SEQ ID NO: 1674888 - DNA, 20 bp, Homo sapiens
cagcaatatattaccagcaa

SEQ ID NO: 1674889 - DNA, 21 bp, Homo sapiens
cagcaatctgcattttaacaa

SEQ ID NO: 1674890 - DNA, 22 bp, Homo sapiens
cagcacaagggcacattgccca

SEQ ID NO: 1674891 - DNA, 20 bp, Homo sapiens
cagcacacacaaacctactg

SEQ ID NO: 1674892 - DNA, 22 bp, Homo sapiens
cagcacacacacataagcactg

SEQ ID NO: 1674893 - DNA, 13 bp, Homo sapiens
cagcacacacagt

SEQ ID NO: 1674894 - DNA, 13 bp, Homo sapiens
cagcacacctcag

SEQ ID NO: 1674895 - DNA, 18 bp, Homo sapiens
cagcacacctcagcccca

SEQ ID NO: 1674896 - DNA, 15 bp, Homo sapiens
cagcacacctgtgtc

SEQ ID NO: 1674897 - DNA, 17 bp, Homo sapiens
cagcacacctgtgtcca

SEQ ID NO: 1674898 - DNA, 21 bp, Homo sapiens
cagcacagaaggaatctgtgc

SEQ ID NO: 1674899 - DNA, 22 bp, Homo sapiens
cagcacagcttgacctgaggct

SEQ ID NO: 1674900 - DNA, 16 bp, Homo sapiens
cagcacaggggcccca

SEQ ID NO: 1674901 - DNA, 20 bp, Homo sapiens
cagcacaggggccccagatc

SEQ ID NO: 1674902 - DNA, 22 bp, Homo sapiens
cagcacaggggccccagatctg

SEQ ID NO: 1674903 - DNA, 15 bp, Homo sapiens
cagcacagtacacac

SEQ ID NO: 1674904 - DNA, 23 bp, Homo sapiens
cagcacagtaggtcccggccagc

SEQ ID NO: 1674905 - DNA, 14 bp, Homo sapiens
cagcacatcacctc

SEQ ID NO: 1674906 - DNA, 15 bp, Homo sapiens
cagcaccaaccacag

SEQ ID NO: 1674907 - DNA, 16 bp, Homo sapiens
cagcaccaaccacagc

SEQ ID NO: 1674908 - DNA, 17 bp, Homo sapiens
cagcaccaaccacagca

SEQ ID NO: 1674909 - DNA, 23 bp, Homo sapiens
cagcaccacactgggtgcgtctc

SEQ ID NO: 1674910 - DNA, 19 bp, Homo sapiens
cagcaccacctacacagga

SEQ ID NO: 1674911 - DNA, 21 bp, Homo sapiens
cagcaccacctacacaggagt

SEQ ID NO: 1674912 - DNA, 14 bp, Homo sapiens
cagcaccccttcca

SEQ ID NO: 1674913 - DNA, 22 bp, Homo sapiens
cagcaccccttccatgtggaga

SEQ ID NO: 1674914 - DNA, 16 bp, Homo sapiens
cagcaccctgcagagc

SEQ ID NO: 1674915 - DNA, 12 bp, Homo sapiens
cagcaccctggg

SEQ ID NO: 1674916 - DNA, 20 bp, Homo sapiens
cagcaccctgggtgccattc

SEQ ID NO: 1674917 - DNA, 18 bp, Homo sapiens
cagcacccttctcggaga

SEQ ID NO: 1674918 - DNA, 22 bp, Homo sapiens
cagcacccttctcggagaccca

SEQ ID NO: 1674919 - DNA, 14 bp, Homo sapiens
cagcacctccaggc

SEQ ID NO: 1674920 - DNA, 14 bp, Homo sapiens
cagcacctgctccc

SEQ ID NO: 1674921 - DNA, 16 bp, Homo sapiens
cagcacctgctcccag

SEQ ID NO: 1674922 - DNA, 12 bp, Homo sapiens
cagcacctggag

SEQ ID NO: 1674923 - DNA, 14 bp, Homo sapiens
cagcaccttggccc

SEQ ID NO: 1674924 - DNA, 16 bp, Homo sapiens
cagcaccttggcccag

SEQ ID NO: 1674925 - DNA, 20 bp, Homo sapiens
cagcaccttggcccaggagc

SEQ ID NO: 1674926 - DNA, 22 bp, Homo sapiens
cagcaccttggcccaggagctc

SEQ ID NO: 1674927 - DNA, 23 bp, Homo sapiens
cagcaccttggcccaggagctct

SEQ ID NO: 1674928 - DNA, 16 bp, Homo sapiens
cagcaccttgtgcctg

SEQ ID NO: 1674929 - DNA, 17 bp, Homo sapiens
cagcaccttgtgcctgg

SEQ ID NO: 1674930 - DNA, 19 bp, Homo sapiens
cagcaccttgtgcctgggg

SEQ ID NO: 1674931 - DNA, 20 bp, Homo sapiens
cagcaccttgtgcctggggt

SEQ ID NO: 1674932 - DNA, 14 bp, Homo sapiens
cagcactaaagcag

SEQ ID NO: 1674933 - DNA, 10 bp, Homo sapiens
cagcactaac

SEQ ID NO: 1674934 - DNA, 20 bp, Homo sapiens
cagcactagaaattgggcag

SEQ ID NO: 1674935 - DNA, 15 bp, Homo sapiens
cagcactcagcctca

SEQ ID NO: 1674936 - DNA, 19 bp, Homo sapiens
cagcactcagcctcattca

SEQ ID NO: 1674937 - DNA, 21 bp, Homo sapiens
cagccttccccctcccagggc

SEQ ID NO: 1674938 - DNA, 23 bp, Homo sapiens
cagccttccccttgcccagggct

SEQ ID NO: 1674939 - DNA, 20 bp, Homo sapiens
cagccttcctctgcagctga

SEQ ID NO: 1674940 - DNA, 22 bp, Homo sapiens
cagccttcggagcgttctctgt

SEQ ID NO: 1674941 - DNA, 15 bp, Homo sapiens
cagccttgccagaga

SEQ ID NO: 1674942 - DNA, 13 bp, Homo sapiens
cagccttgctgct

SEQ ID NO: 1674943 - DNA, 17 bp, Homo sapiens
cagccttgctgctctgc

SEQ ID NO: 1674944 - DNA, 19 bp, Homo sapiens
cagcctttctcccaggcca

SEQ ID NO: 1674945 - DNA, 23 bp, Homo sapiens
cagcctttctcccaggccaggct

SEQ ID NO: 1674946 - DNA, 15 bp, Homo sapiens
cagcctttgcccaaa

SEQ ID NO: 1674947 - DNA, 24 bp, Homo sapiens
cagcctttgcccaaaactgtcatc

SEQ ID NO: 1674948 - DNA, 21 bp, Homo sapiens
cagcgaaaggatgtaaacagt

SEQ ID NO: 1674949 - DNA, 13 bp, Homo sapiens
cagcgaccccagg

SEQ ID NO: 1674950 - DNA, 17 bp, Homo sapiens
cagcgaccgccccctcc

SEQ ID NO: 1674951 - DNA, 21 bp, Homo sapiens
cagcgacctcaagtgtcctga

SEQ ID NO: 1674952 - DNA, 18 bp, Homo sapiens
cagcgaccttcctcatcc

SEQ ID NO: 1674953 - DNA, 17 bp, Homo sapiens
cagcgactccgttggcc

SEQ ID NO: 1674954 - DNA, 22 bp, Homo sapiens
cagcgactccgttggccactcc

SEQ ID NO: 1674955 - DNA, 16 bp, Homo sapiens
cagcgagggcagctgc

SEQ ID NO: 1674956 - DNA, 18 bp, Homo sapiens
cagcgatggtgctgccca

SEQ ID NO: 1674957 - DNA, 22 bp, Homo sapiens
cagcgcatgtgtgcatgtgctg

SEQ ID NO: 1674958 - DNA, 24 bp, Homo sapiens
cagcgccaagtaaacagggtacct

SEQ ID NO: 1674959 - DNA, 22 bp, Homo sapiens
cagcgcctagtggggtctccct

SEQ ID NO: 1674960 - DNA, 23 bp, Homo sapiens
cagcgcctagtggggtctccctc

SEQ ID NO: 1674961 - DNA, 13 bp, Homo sapiens
cagcgcgcaggcc

SEQ ID NO: 1674962 - DNA, 12 bp, Homo sapiens
cagcgcggccag

SEQ ID NO: 1674963 - DNA, 15 bp, Homo sapiens
cagcgctctcctgga

SEQ ID NO: 1674964 - DNA, 22 bp, Homo sapiens
cagcgctgagcatggggcgctc

SEQ ID NO: 1674965 - DNA, 15 bp, Homo sapiens
cagcggaggagacca

SEQ ID NO: 1674966 - DNA, 22 bp, Homo sapiens
cagcggaggtgtggagccgagg

SEQ ID NO: 1674967 - DNA, 17 bp, Homo sapiens
cagcggattgctctgga

SEQ ID NO: 1674968 - DNA, 18 bp, Homo sapiens
cagcggattgctctggag

SEQ ID NO: 1674969 - DNA, 21 bp, Homo sapiens
cagcggattgctctggagcag

SEQ ID NO: 1674970 - DNA, 23 bp, Homo sapiens
cagcggattgctctggagcagcc

SEQ ID NO: 1674971 - DNA, 13 bp, Homo sapiens
cagcggcagagca

SEQ ID NO: 1674972 - DNA, 19 bp, Homo sapiens
cagcggcaggaccgccatg

SEQ ID NO: 1674973 - DNA, 23 bp, Homo sapiens
cagcggccttgaagacagagcaa

SEQ ID NO: 1674974 - DNA, 14 bp, Homo sapiens
cagcggctccaact

SEQ ID NO: 1674975 - DNA, 15 bp, Homo sapiens
cagcggctccaactc

SEQ ID NO: 1674976 - DNA, 13 bp, Homo sapiens
cagcggctgctca

SEQ ID NO: 1674977 - DNA, 18 bp, Homo sapiens
cagcggctggtgcagggc

SEQ ID NO: 1674978 - DNA, 19 bp, Homo sapiens
cagcgggagacctgtgcta

SEQ ID NO: 1674979 - DNA, 16 bp, Homo sapiens
cagcgggcacagggca

SEQ ID NO: 1674980 - DNA, 17 bp, Homo sapiens
cagcgggcacagggcac

SEQ ID NO: 1674981 - DNA, 13 bp, Homo sapiens
cagcgggcaggtt

SEQ ID NO: 1674982 - DNA, 14 bp, Homo sapiens
cagcgggccaggcc

SEQ ID NO: 1674983 - DNA, 19 bp, Homo sapiens
cagcgggccaggcccgcac

SEQ ID NO: 1674984 - DNA, 15 bp, Homo sapiens
cagcgggtctcctcc

SEQ ID NO: 1674985 - DNA, 18 bp, Homo sapiens
cagcgggtctcctcccag

SEQ ID NO: 1674986 - DNA, 21 bp, Homo sapiens
cagcgggtctcctcccagcgg

SEQ ID NO: 1674987 - DNA, 18 bp, Homo sapiens
cagcggtccaaagttatc

SEQ ID NO: 1674988 - DNA, 16 bp, Homo sapiens
cagcgtcactccagtg

SEQ ID NO: 1674989 - DNA, 19 bp, Homo sapiens
cagcgtcccccgccgcgcc

SEQ ID NO: 1674990 - DNA, 15 bp, Homo sapiens
cagcgtccctggcgc

SEQ ID NO: 1674991 - DNA, 15 bp, Homo sapiens
cagcgtcccttggtg

SEQ ID NO: 1674992 - DNA, 17 bp, Homo sapiens
cagcgtcccttggtgag

SEQ ID NO: 1674993 - DNA, 22 bp, Homo sapiens
cagcgtccggggtggtggacag

SEQ ID NO: 1674994 - DNA, 20 bp, Homo sapiens
cagcgtcctgggctcaaatg

SEQ ID NO: 1674995 - DNA, 14 bp, Homo sapiens
cagcgtctgctcat

SEQ ID NO: 1674996 - DNA, 12 bp, Homo sapiens
cagcgtctgttg

SEQ ID NO: 1674997 - DNA, 22 bp, Homo sapiens
cagcgtgggaactcactttccc

SEQ ID NO: 1674998 - DNA, 13 bp, Homo sapiens
cagcgtgtggagc

SEQ ID NO: 1674999 - DNA, 22 bp, Homo sapiens
cagcgtgtggagcagagctctc

SEQ ID NO: 1675000 - DNA, 18 bp, Homo sapiens
cagcgttaacacaaaatc

SEQ ID NO: 1675001 - DNA, 15 bp, Homo sapiens
cagcgttagggctgc

SEQ ID NO: 1675002 - DNA, 22 bp, Homo sapiens
cagcgtttagtttctagaggcc

SEQ ID NO: 1675003 - DNA, 17 bp, Homo sapiens
cagcgtttatggtgctt

SEQ ID NO: 1675004 - DNA, 15 bp, Homo sapiens
cagctaaagatgaga

SEQ ID NO: 1675005 - DNA, 16 bp, Homo sapiens
cagctaaatgtaactt

SEQ ID NO: 1675006 - DNA, 20 bp, Homo sapiens
cagctaaatgtaacttattc

SEQ ID NO: 1675007 - DNA, 15 bp, Homo sapiens
cagctaactccgaga

SEQ ID NO: 1675008 - DNA, 17 bp, Homo sapiens
cagctaactccgagagc

SEQ ID NO: 1675009 - DNA, 14 bp, Homo sapiens
cagctaagaacctg

SEQ ID NO: 1675010 - DNA, 15 bp, Homo sapiens
cagctcaactcacag

SEQ ID NO: 1675011 - DNA, 21 bp, Homo sapiens
cagctcaactcacagcttctc

SEQ ID NO: 1675012 - DNA, 15 bp, Homo sapiens
cagctcaagggctgg

SEQ ID NO: 1675013 - DNA, 18 bp, Homo sapiens
cagctcaagggctggcac

SEQ ID NO: 1675014 - DNA, 21 bp, Homo sapiens
cagctcacaccctaccttccc

SEQ ID NO: 1675015 - DNA, 20 bp, Homo sapiens
cagctcacagtgctgtgtgc

SEQ ID NO: 1675016 - DNA, 19 bp, Homo sapiens
cagctcacctctgaaggca

SEQ ID NO: 1675017 - DNA, 13 bp, Homo sapiens
cagctcactgctg

SEQ ID NO: 1675018 - DNA, 18 bp, Homo sapiens
cagctcagaggcccagga

SEQ ID NO: 1675019 - DNA, 13 bp, Homo sapiens
cagctcagccagt

SEQ ID NO: 1675020 - DNA, 15 bp, Homo sapiens
cagctcagccagtgg

SEQ ID NO: 1675021 - DNA, 12 bp, Homo sapiens
cagctcagctgc

SEQ ID NO: 1675022 - DNA, 14 bp, Homo sapiens
cagctcagctgccc

SEQ ID NO: 1675023 - DNA, 15 bp, Homo sapiens
cagctcagctgccca

SEQ ID NO: 1675024 - DNA, 13 bp, Homo sapiens
cagctcaggacag

SEQ ID NO: 1675025 - DNA, 23 bp, Homo sapiens
cagctccaacctgcaaagatctg

SEQ ID NO: 1675026 - DNA, 21 bp, Homo sapiens
cagctccaggtggctctgagg

SEQ ID NO: 1675027 - DNA, 16 bp, Homo sapiens
cagctcccaacagagg

SEQ ID NO: 1675028 - DNA, 22 bp, Homo sapiens
cagctcccaacagaggcctccc

SEQ ID NO: 1675029 - DNA, 19 bp, Homo sapiens
cagctcccaccccaccccc

SEQ ID NO: 1675030 - DNA, 23 bp, Homo sapiens
cagctcccaccccacccccttca

SEQ ID NO: 1675031 - DNA, 15 bp, Homo sapiens
cagctcccagggtgg

SEQ ID NO: 1675032 - DNA, 21 bp, Homo sapiens
cagctcccagggtggacttca

SEQ ID NO: 1675033 - DNA, 15 bp, Homo sapiens
cagctccccaggact

SEQ ID NO: 1675034 - DNA, 13 bp, Homo sapiens
cagctccccccgc

SEQ ID NO: 1675035 - DNA, 22 bp, Homo sapiens
cagctcccccgacggtgggcat

SEQ ID NO: 1675036 - DNA, 15 bp, Homo sapiens
cagctcccgctgtgg

SEQ ID NO: 1675037 - DNA, 20 bp, Homo sapiens
cagctccctaggagaccaag

SEQ ID NO: 1675038 - DNA, 14 bp, Homo sapiens
cagctccctctgcc

SEQ ID NO: 1675039 - DNA, 16 bp, Homo sapiens
cagctccctctgcctg

SEQ ID NO: 1675040 - DNA, 18 bp, Homo sapiens
cagctccgagctgtagga

SEQ ID NO: 1675041 - DNA, 14 bp, Homo sapiens
cagctccgcctgct

SEQ ID NO: 1675042 - DNA, 14 bp, Homo sapiens
cagctcctcccaca

SEQ ID NO: 1675043 - DNA, 14 bp, Homo sapiens
cagctcctctcctt

SEQ ID NO: 1675044 - DNA, 17 bp, Homo sapiens
cagctcctctccttggg

SEQ ID NO: 1675045 - DNA, 18 bp, Homo sapiens
cagctcctctccttgggc

SEQ ID NO: 1675046 - DNA, 11 bp, Homo sapiens
cagctcctgcc

SEQ ID NO: 1675047 - DNA, 15 bp, Homo sapiens
cagctcctgtaacat

SEQ ID NO: 1675048 - DNA, 14 bp, Homo sapiens
cagctccttactct

SEQ ID NO: 1675049 - DNA, 21 bp, Homo sapiens
cagctccttggggcagggcct

SEQ ID NO: 1675050 - DNA, 23 bp, Homo sapiens
cagctccttggggcagggcctgg

SEQ ID NO: 1675051 - DNA, 20 bp, Homo sapiens
cagctccttttgtccccagg

SEQ ID NO: 1675052 - DNA, 23 bp, Homo sapiens
cagctccttttgtccccagggcc

SEQ ID NO: 1675053 - DNA, 17 bp, Homo sapiens
cagctctccctctggcc

SEQ ID NO: 1675054 - DNA, 18 bp, Homo sapiens
cagctctccctctggccc

SEQ ID NO: 1675055 - DNA, 21 bp, Homo sapiens
cagctctccctctggccctgc

SEQ ID NO: 1675056 - DNA, 23 bp, Homo sapiens
cagctctccctctggccctgcct

SEQ ID NO: 1675057 - DNA, 13 bp, Homo sapiens
cagctctctgacg

SEQ ID NO: 1675058 - DNA, 16 bp, Homo sapiens
cagctctctgacgctt

SEQ ID NO: 1675059 - DNA, 15 bp, Homo sapiens
cagctctctgcagaa

SEQ ID NO: 1675060 - DNA, 20 bp, Homo sapiens
cagctctgacatcccttcct

SEQ ID NO: 1675061 - DNA, 23 bp, Homo sapiens
cagctctgagacccttttctcag

SEQ ID NO: 1675062 - DNA, 20 bp, Homo sapiens
cagctctgcccccgcgggtt

SEQ ID NO: 1675063 - DNA, 21 bp, Homo sapiens
cagctctggacagccccaccc

SEQ ID NO: 1675064 - DNA, 23 bp, Homo sapiens
cagctctggacagccccaccctg

SEQ ID NO: 1675065 - DNA, 11 bp, Homo sapiens
cagctctggag

SEQ ID NO: 1675066 - DNA, 12 bp, Homo sapiens
cagctctggaga

SEQ ID NO: 1675067 - DNA, 16 bp, Homo sapiens
cagctctggatgaagg

SEQ ID NO: 1675068 - DNA, 14 bp, Homo sapiens
cagctctggcttcc

SEQ ID NO: 1675069 - DNA, 20 bp, Homo sapiens
cagctctggtccaggccctg

SEQ ID NO: 1675070 - DNA, 17 bp, Homo sapiens
cagctctgtcctcttgg

SEQ ID NO: 1675071 - DNA, 23 bp, Homo sapiens
cagctctgtcctcttggccatcc

SEQ ID NO: 1675072 - DNA, 23 bp, Homo sapiens
cagctctgtggcctgtgtccagc

SEQ ID NO: 1675073 - DNA, 24 bp, Homo sapiens
cagctctgtggcctgtgtccagca

SEQ ID NO: 1675074 - DNA, 12 bp, Homo sapiens
cagctcttcatt

SEQ ID NO: 1675075 - DNA, 15 bp, Homo sapiens
cagctcttctaagga

SEQ ID NO: 1675076 - DNA, 20 bp, Homo sapiens
cagctcttctcagtgtctga

SEQ ID NO: 1675077 - DNA, 17 bp, Homo sapiens
cagctcttctcttccta

SEQ ID NO: 1675078 - DNA, 19 bp, Homo sapiens
caggagcagcttttggtct

SEQ ID NO: 1675079 - DNA, 14 bp, Homo sapiens
caggagccccgcca

SEQ ID NO: 1675080 - DNA, 12 bp, Homo sapiens
caggagcccctg

SEQ ID NO: 1675081 - DNA, 18 bp, Homo sapiens
caggagccgggcctccca

SEQ ID NO: 1675082 - DNA, 21 bp, Homo sapiens
caggagccgggcctcccaccg

SEQ ID NO: 1675083 - DNA, 18 bp, Homo sapiens
caggagcctagcggagcc

SEQ ID NO: 1675084 - DNA, 23 bp, Homo sapiens
caggagcctagcggagcccagcc

SEQ ID NO: 1675085 - DNA, 20 bp, Homo sapiens
caggagctagttctcagctt

SEQ ID NO: 1675086 - DNA, 12 bp, Homo sapiens
caggagctcctg

SEQ ID NO: 1675087 - DNA, 15 bp, Homo sapiens
caggagctcctggaa

SEQ ID NO: 1675088 - DNA, 12 bp, Homo sapiens
caggagctctgc

SEQ ID NO: 1675089 - DNA, 12 bp, Homo sapiens
caggagctcttc

SEQ ID NO: 1675090 - DNA, 15 bp, Homo sapiens
caggagctcttcagg

SEQ ID NO: 1675091 - DNA, 14 bp, Homo sapiens
caggagctgagtca

SEQ ID NO: 1675092 - DNA, 20 bp, Homo sapiens
caggagctgagtcacctcct

SEQ ID NO: 1675093 - DNA, 16 bp, Homo sapiens
caggagctgatggcag

SEQ ID NO: 1675094 - DNA, 17 bp, Homo sapiens
caggagctgatggcagc

SEQ ID NO: 1675095 - DNA, 19 bp, Homo sapiens
caggagctgtcaccaagga

SEQ ID NO: 1675096 - DNA, 21 bp, Homo sapiens
caggagctgtcaccaaggaaa

SEQ ID NO: 1675097 - DNA, 17 bp, Homo sapiens
caggagcttgcaagaag

SEQ ID NO: 1675098 - DNA, 19 bp, Homo sapiens
caggagcttgcaagaagca

SEQ ID NO: 1675099 - DNA, 22 bp, Homo sapiens
caggaggattgcttgagcccag

SEQ ID NO: 1675100 - DNA, 23 bp, Homo sapiens
caggaggattgcttgagcccagg

SEQ ID NO: 1675101 - DNA, 15 bp, Homo sapiens
caggaggcaggacct

SEQ ID NO: 1675102 - DNA, 18 bp, Homo sapiens
caggaggcaggcatggcc

SEQ ID NO: 1675103 - DNA, 13 bp, Homo sapiens
caggaggcagtgg

SEQ ID NO: 1675104 - DNA, 21 bp, Homo sapiens
caggaggcatctggaaagggg

SEQ ID NO: 1675105 - DNA, 11 bp, Homo sapiens
caggaggcccc

SEQ ID NO: 1675106 - DNA, 14 bp, Homo sapiens
caggaggcccctgg

SEQ ID NO: 1675107 - DNA, 13 bp, Homo sapiens
caggaggccctgg

SEQ ID NO: 1675108 - DNA, 21 bp, Homo sapiens
caggaggccctggtcctggcc

SEQ ID NO: 1675109 - DNA, 22 bp, Homo sapiens
caggaggccctggtcctggcct

SEQ ID NO: 1675110 - DNA, 23 bp, Homo sapiens
caggaggccctggtgtcaggcag

SEQ ID NO: 1675111 - DNA, 17 bp, Homo sapiens
caggaggcgcccttggc

SEQ ID NO: 1675112 - DNA, 19 bp, Homo sapiens
caggaggcggcccggccag

SEQ ID NO: 1675113 - DNA, 22 bp, Homo sapiens
caggaggcggcccggccagcgg

SEQ ID NO: 1675114 - DNA, 21 bp, Homo sapiens
caggaggctgagacaggagaa

SEQ ID NO: 1675115 - DNA, 17 bp, Homo sapiens
caggaggctgaggcaga

SEQ ID NO: 1675116 - DNA, 21 bp, Homo sapiens
caggaggctgaggcagaagaa

SEQ ID NO: 1675117 - DNA, 18 bp, Homo sapiens
caggaggctgaggcagga

SEQ ID NO: 1675118 - DNA, 20 bp, Homo sapiens
caggaggctgaggcaggagg

SEQ ID NO: 1675119 - DNA, 19 bp, Homo sapiens
cagggtggtgctgggactg

SEQ ID NO: 1675120 - DNA, 22 bp, Homo sapiens
cagggtgtgaacatgttctcca

SEQ ID NO: 1675121 - DNA, 19 bp, Homo sapiens
cagggtgtttgcagctgtg

SEQ ID NO: 1675122 - DNA, 19 bp, Homo sapiens
cagggttaggaatctcttc

SEQ ID NO: 1675123 - DNA, 20 bp, Homo sapiens
cagggttctgctcggcttct

SEQ ID NO: 1675124 - DNA, 16 bp, Homo sapiens
cagggttgtgctttct

SEQ ID NO: 1675125 - DNA, 20 bp, Homo sapiens
caggtaaaacagggccacat

SEQ ID NO: 1675126 - DNA, 23 bp, Homo sapiens
caggtaaaacagggccacataga

SEQ ID NO: 1675127 - DNA, 21 bp, Homo sapiens
caggtaatatacctggtttac

SEQ ID NO: 1675128 - DNA, 19 bp, Homo sapiens
caggtaatgtgaataaatt

SEQ ID NO: 1675129 - DNA, 13 bp, Homo sapiens
caggtacaggaga

SEQ ID NO: 1675130 - DNA, 16 bp, Homo sapiens
caggtaccagctgcgc

SEQ ID NO: 1675131 - DNA, 18 bp, Homo sapiens
caggtaccagctgcgctt

SEQ ID NO: 1675132 - DNA, 21 bp, Homo sapiens
caggtaccagctgcgcttgct

SEQ ID NO: 1675133 - DNA, 15 bp, Homo sapiens
caggtacggagaaga

SEQ ID NO: 1675134 - DNA, 16 bp, Homo sapiens
caggtacggagaagaa

SEQ ID NO: 1675135 - DNA, 24 bp, Homo sapiens
caggtacggagaagaatagaggtc

SEQ ID NO: 1675136 - DNA, 21 bp, Homo sapiens
caggtacttcctcctgatggc

SEQ ID NO: 1675137 - DNA, 22 bp, Homo sapiens
caggtagaaggttgacacagtt

SEQ ID NO: 1675138 - DNA, 22 bp, Homo sapiens
caggtagaattatctaatttat

SEQ ID NO: 1675139 - DNA, 23 bp, Homo sapiens
caggtagaattatctaatttata

SEQ ID NO: 1675140 - DNA, 20 bp, Homo sapiens
caggtagatcgcttgagccc

SEQ ID NO: 1675141 - DNA, 19 bp, Homo sapiens
caggtaggaagcaacagct

SEQ ID NO: 1675142 - DNA, 13 bp, Homo sapiens
caggtaggccctt

SEQ ID NO: 1675143 - DNA, 23 bp, Homo sapiens
caggtagttgcaattgaattaaa

SEQ ID NO: 1675144 - DNA, 22 bp, Homo sapiens
caggtatatactttgaaaggag

SEQ ID NO: 1675145 - DNA, 15 bp, Homo sapiens
caggtatccaaaaat

SEQ ID NO: 1675146 - DNA, 14 bp, Homo sapiens
caggtatgttgcct

SEQ ID NO: 1675147 - DNA, 15 bp, Homo sapiens
caggtatgttgcctt

SEQ ID NO: 1675148 - DNA, 20 bp, Homo sapiens
caggtatgttgcctttatgg

SEQ ID NO: 1675149 - DNA, 19 bp, Homo sapiens
caggtattacacaagccaa

SEQ ID NO: 1675150 - DNA, 23 bp, Homo sapiens
caggtcaataaacttagaggaaa

SEQ ID NO: 1675151 - DNA, 15 bp, Homo sapiens
caggtcactgtcact

SEQ ID NO: 1675152 - DNA, 15 bp, Homo sapiens
caggtcagcctggaa

SEQ ID NO: 1675153 - DNA, 15 bp, Homo sapiens
caggtcaggatgcac

SEQ ID NO: 1675154 - DNA, 18 bp, Homo sapiens
caggtcaggatgcacatt

SEQ ID NO: 1675155 - DNA, 21 bp, Homo sapiens
caggtcagggaggatctgttc

SEQ ID NO: 1675156 - DNA, 14 bp, Homo sapiens
caggtcatcagatg

SEQ ID NO: 1675157 - DNA, 17 bp, Homo sapiens
caggtcatcagatgcct

SEQ ID NO: 1675158 - DNA, 13 bp, Homo sapiens
caggtcatgcagt

SEQ ID NO: 1675159 - DNA, 23 bp, Homo sapiens
caggtcatgcagttcctggccca

SEQ ID NO: 1675160 - DNA, 16 bp, Homo sapiens
caggtccagctctgga

SEQ ID NO: 1675161 - DNA, 18 bp, Homo sapiens
caggtcccccgactgcct

SEQ ID NO: 1675162 - DNA, 20 bp, Homo sapiens
caggtcccccgactgcctgt

SEQ ID NO: 1675163 - DNA, 16 bp, Homo sapiens
caggtccctggaccag

SEQ ID NO: 1675164 - DNA, 19 bp, Homo sapiens
caggtcctgctccgctgcc

SEQ ID NO: 1675165 - DNA, 20 bp, Homo sapiens
caggtcctgctccgctgcct

SEQ ID NO: 1675166 - DNA, 21 bp, Homo sapiens
caggtcctggtgggtcagccc

SEQ ID NO: 1675167 - DNA, 14 bp, Homo sapiens
caggtcgggcagtg

SEQ ID NO: 1675168 - DNA, 12 bp, Homo sapiens
caggtctagact

SEQ ID NO: 1675169 - DNA, 14 bp, Homo sapiens
caggtctcactgct

SEQ ID NO: 1675170 - DNA, 11 bp, Homo sapiens
caggtctcctc

SEQ ID NO: 1675171 - DNA, 23 bp, Homo sapiens
caggtctctccactgctctcagc

SEQ ID NO: 1675172 - DNA, 14 bp, Homo sapiens
caggtctcttctgg

SEQ ID NO: 1675173 - DNA, 15 bp, Homo sapiens
caggtctcttctggg

SEQ ID NO: 1675174 - DNA, 13 bp, Homo sapiens
caggtctgagata

SEQ ID NO: 1675175 - DNA, 15 bp, Homo sapiens
caggtctgcaagggc

SEQ ID NO: 1675176 - DNA, 21 bp, Homo sapiens
caggtctgcaagggcccagag

SEQ ID NO: 1675177 - DNA, 20 bp, Homo sapiens
caggtcttgactcatggcag

SEQ ID NO: 1675178 - DNA, 20 bp, Homo sapiens
caggtgacgatttagctgtg

SEQ ID NO: 1675179 - DNA, 19 bp, Homo sapiens
caggtgagaacccagagag

SEQ ID NO: 1675180 - DNA, 20 bp, Homo sapiens
caggtgagcaggcagggctg

SEQ ID NO: 1675181 - DNA, 13 bp, Homo sapiens
caggtgcagtggc

SEQ ID NO: 1675182 - DNA, 15 bp, Homo sapiens
caggtgcagtggctc

SEQ ID NO: 1675183 - DNA, 14 bp, Homo sapiens
caggtgccactccc

SEQ ID NO: 1675184 - DNA, 18 bp, Homo sapiens
caggtgccactccctgag

SEQ ID NO: 1675185 - DNA, 21 bp, Homo sapiens
caggtgccactccctgagctt

SEQ ID NO: 1675186 - DNA, 19 bp, Homo sapiens
caggtgccatgcctgctcc

SEQ ID NO: 1675187 - DNA, 20 bp, Homo sapiens
caggtgccatgcctgctccc

SEQ ID NO: 1675188 - DNA, 16 bp, Homo sapiens
caggtgccgccagctg

SEQ ID NO: 1675189 - DNA, 22 bp, Homo sapiens
caggtgccgccagctgccgcac

SEQ ID NO: 1675190 - DNA, 14 bp, Homo sapiens
caggtgcctccagg

SEQ ID NO: 1675191 - DNA, 16 bp, Homo sapiens
caggtgcctccaggtg

SEQ ID NO: 1675192 - DNA, 18 bp, Homo sapiens
caggtgcctccaggtgtg

SEQ ID NO: 1675193 - DNA, 20 bp, Homo sapiens
caggtgctaatttgttttgg

SEQ ID NO: 1675194 - DNA, 14 bp, Homo sapiens
caggtgctcccctg

SEQ ID NO: 1675195 - DNA, 12 bp, Homo sapiens
caggtgctgcct

SEQ ID NO: 1675196 - DNA, 13 bp, Homo sapiens
caggtgctgcctt

SEQ ID NO: 1675197 - DNA, 15 bp, Homo sapiens
caggtgctgggctgg

SEQ ID NO: 1675198 - DNA, 19 bp, Homo sapiens
caggtgctgggctggactg

SEQ ID NO: 1675199 - DNA, 14 bp, Homo sapiens
caggtgctggtccc

SEQ ID NO: 1675200 - DNA, 13 bp, Homo sapiens
caggtgctgtcca

SEQ ID NO: 1675201 - DNA, 16 bp, Homo sapiens
caggtggactgactgt

SEQ ID NO: 1675202 - DNA, 16 bp, Homo sapiens
caggtggagggcacag

SEQ ID NO: 1675203 - DNA, 17 bp, Homo sapiens
caggtggagggcacagc

SEQ ID NO: 1675204 - DNA, 16 bp, Homo sapiens
caggtggaggtgtggg

SEQ ID NO: 1675205 - DNA, 18 bp, Homo sapiens
caggtggatcacgaggtc

SEQ ID NO: 1675206 - DNA, 18 bp, Homo sapiens
caggtggatgaggagaca

SEQ ID NO: 1675207 - DNA, 15 bp, Homo sapiens
caggtggccactcca

SEQ ID NO: 1675208 - DNA, 20 bp, Homo sapiens
caggtggccagaagagcttg

SEQ ID NO: 1675209 - DNA, 15 bp, Homo sapiens
caggtggccaggcag

SEQ ID NO: 1675210 - DNA, 15 bp, Homo sapiens
caggtggcctagcag

SEQ ID NO: 1675211 - DNA, 20 bp, Homo sapiens
caggtggcctagcaggcaca

SEQ ID NO: 1675212 - DNA, 22 bp, Homo sapiens
caggtggctgacccagtccctg

SEQ ID NO: 1675213 - DNA, 21 bp, Homo sapiens
caggtgggaggaaagggcctg

SEQ ID NO: 1675214 - DNA, 16 bp, Homo sapiens
caggtgggccctctga

SEQ ID NO: 1675215 - DNA, 15 bp, Homo sapiens
caggtggtggcactg

SEQ ID NO: 1675216 - DNA, 20 bp, Homo sapiens
caggtggtggcactgagccc

SEQ ID NO: 1675217 - DNA, 21 bp, Homo sapiens
caggtggtggcactgagcccc

SEQ ID NO: 1675218 - DNA, 13 bp, Homo sapiens
caggtggttttta

SEQ ID NO: 1675219 - DNA, 15 bp, Homo sapiens
caggtgtcaggcccg

SEQ ID NO: 1675220 - DNA, 16 bp, Homo sapiens
cagtgtacatggaata

SEQ ID NO: 1675221 - DNA, 20 bp, Homo sapiens
cagtgtcaagttgtgcttgt

SEQ ID NO: 1675222 - DNA, 17 bp, Homo sapiens
cagtgtcacatgaggaa

SEQ ID NO: 1675223 - DNA, 13 bp, Homo sapiens
cagtgtcactggt

SEQ ID NO: 1675224 - DNA, 20 bp, Homo sapiens
cagtgtcatttatgaaaaga

SEQ ID NO: 1675225 - DNA, 20 bp, Homo sapiens
cagtgtcccctgccccagag

SEQ ID NO: 1675226 - DNA, 21 bp, Homo sapiens
cagtgtcccctgccccagagg

SEQ ID NO: 1675227 - DNA, 18 bp, Homo sapiens
cagtgtcctcttgctcaa

SEQ ID NO: 1675228 - DNA, 16 bp, Homo sapiens
catacaacagaaacca

SEQ ID NO: 1675229 - DNA, 14 bp, Homo sapiens
catacaacagaggg

SEQ ID NO: 1675230 - DNA, 17 bp, Homo sapiens
catacaagaaaatgtat

SEQ ID NO: 1675231 - DNA, 19 bp, Homo sapiens
catacaagtttataaagag

SEQ ID NO: 1675232 - DNA, 11 bp, Homo sapiens
catacaatgta

SEQ ID NO: 1675233 - DNA, 21 bp, Homo sapiens
catacactgtagtttttgaaa

SEQ ID NO: 1675234 - DNA, 17 bp, Homo sapiens
catacactgtgaactca

SEQ ID NO: 1675235 - DNA, 15 bp, Homo sapiens
catacagagtgggcc

SEQ ID NO: 1675236 - DNA, 17 bp, Homo sapiens
catacagagtgggcccc

SEQ ID NO: 1675237 - DNA, 14 bp, Homo sapiens
catacagcctctac

SEQ ID NO: 1675238 - DNA, 19 bp, Homo sapiens
catacataagcagcatttc

SEQ ID NO: 1675239 - DNA, 19 bp, Homo sapiens
catacatatttttgtagca

SEQ ID NO: 1675240 - DNA, 19 bp, Homo sapiens
catacattatttcttccca

SEQ ID NO: 1675241 - DNA, 21 bp, Homo sapiens
catacattatttcttcccaga

SEQ ID NO: 1675242 - DNA, 23 bp, Homo sapiens
catacattatttcttcccagaat

SEQ ID NO: 1675243 - DNA, 23 bp, Homo sapiens
cataccagaaagctctacatttg

SEQ ID NO: 1675244 - DNA, 16 bp, Homo sapiens
cataccatctgctgcc

SEQ ID NO: 1675245 - DNA, 19 bp, Homo sapiens
catacccgtgacagtggct

SEQ ID NO: 1675246 - DNA, 16 bp, Homo sapiens
cataccgcctcgtgcc

SEQ ID NO: 1675247 - DNA, 21 bp, Homo sapiens
cataccgcctcgtgccagcag

SEQ ID NO: 1675248 - DNA, 16 bp, Homo sapiens
catacctaccagtatt

SEQ ID NO: 1675249 - DNA, 13 bp, Homo sapiens
catacctctgacc

SEQ ID NO: 1675250 - DNA, 17 bp, Homo sapiens
catacctctgaccaaca

SEQ ID NO: 1675251 - DNA, 21 bp, Homo sapiens
cataccttccttccctgggct

SEQ ID NO: 1675252 - DNA, 21 bp, Homo sapiens
catacctttttcttaaaaaaa

SEQ ID NO: 1675253 - DNA, 14 bp, Homo sapiens
catacgatttaagg

SEQ ID NO: 1675254 - DNA, 22 bp, Homo sapiens
catacgtggaaacaatcctgtt

SEQ ID NO: 1675255 - DNA, 19 bp, Homo sapiens
catactatttagattttct

SEQ ID NO: 1675256 - DNA, 20 bp, Homo sapiens
catactccccaatttagtct

SEQ ID NO: 1675257 - DNA, 20 bp, Homo sapiens
catactccttccatcaaata

SEQ ID NO: 1675258 - DNA, 20 bp, Homo sapiens
catactgagggaccaactgg

SEQ ID NO: 1675259 - DNA, 13 bp, Homo sapiens
catactggcctgg

SEQ ID NO: 1675260 - DNA, 18 bp, Homo sapiens
catactggcctggactgt

SEQ ID NO: 1675261 - DNA, 17 bp, Homo sapiens
catactggcttcaccat

SEQ ID NO: 1675262 - DNA, 17 bp, Homo sapiens
catactgtaacattcag

SEQ ID NO: 1675263 - DNA, 23 bp, Homo sapiens
catactgtctgggattaagggca

SEQ ID NO: 1675264 - DNA, 16 bp, Homo sapiens
catacttcctggattt

SEQ ID NO: 1675265 - DNA, 14 bp, Homo sapiens
catacttctctcag

SEQ ID NO: 1675266 - DNA, 14 bp, Homo sapiens
catacttggctgct

SEQ ID NO: 1675267 - DNA, 21 bp, Homo sapiens
catacttggctgcttcctgtg

SEQ ID NO: 1675268 - DNA, 12 bp, Homo sapiens
catactttctct

SEQ ID NO: 1675269 - DNA, 15 bp, Homo sapiens
catactttctctcta

SEQ ID NO: 1675270 - DNA, 14 bp, Homo sapiens
catactttgacaag

SEQ ID NO: 1675271 - DNA, 14 bp, Homo sapiens
catactttgtctga

SEQ ID NO: 1675272 - DNA, 17 bp, Homo sapiens
catacttttgagagggg

SEQ ID NO: 1675273 - DNA, 14 bp, Homo sapiens
catagaaacatgac

SEQ ID NO: 1675274 - DNA, 18 bp, Homo sapiens
catagaaacatgacactg

SEQ ID NO: 1675275 - DNA, 23 bp, Homo sapiens
catagaccctctttcttgtttgt

SEQ ID NO: 1675276 - DNA, 19 bp, Homo sapiens
catagacctacagacctgg

SEQ ID NO: 1675277 - DNA, 20 bp, Homo sapiens
catagactgaggtataaaga

SEQ ID NO: 1675278 - DNA, 22 bp, Homo sapiens
catagactgaggtataaagaca

SEQ ID NO: 1675279 - DNA, 23 bp, Homo sapiens
catagactgaggtataaagacaa

SEQ ID NO: 1675280 - DNA, 16 bp, Homo sapiens
catagacttaggcatt

SEQ ID NO: 1675281 - DNA, 24 bp, Homo sapiens
catagacttaggcattaacatgtt

SEQ ID NO: 1675282 - DNA, 14 bp, Homo sapiens
catagagcaatgtt

SEQ ID NO: 1675283 - DNA, 16 bp, Homo sapiens
catagagcaatgttgg

SEQ ID NO: 1675284 - DNA, 20 bp, Homo sapiens
catagagcaatgttggtttt

SEQ ID NO: 1675285 - DNA, 13 bp, Homo sapiens
catagagcttttt

SEQ ID NO: 1675286 - DNA, 15 bp, Homo sapiens
catagaggcccaggc

SEQ ID NO: 1675287 - DNA, 17 bp, Homo sapiens
catagaggcccaggcac

SEQ ID NO: 1675288 - DNA, 12 bp, Homo sapiens
catagaggcttc

SEQ ID NO: 1675289 - DNA, 16 bp, Homo sapiens
catagataatattgtt

SEQ ID NO: 1675290 - DNA, 17 bp, Homo sapiens
catagataatattgttt

SEQ ID NO: 1675291 - DNA, 23 bp, Homo sapiens
catagataatattgtttggtaaa

SEQ ID NO: 1675292 - DNA, 17 bp, Homo sapiens
catagattccctgagca

SEQ ID NO: 1675293 - DNA, 21 bp, Homo sapiens
catagatttcttctctttagt

SEQ ID NO: 1675294 - DNA, 20 bp, Homo sapiens
catagcaagacacatcccta

SEQ ID NO: 1675295 - DNA, 16 bp, Homo sapiens
catagcagatctgttt

SEQ ID NO: 1675296 - DNA, 17 bp, Homo sapiens
catagcagattttaatt

SEQ ID NO: 1675297 - DNA, 18 bp, Homo sapiens
catagcagattttaattt

SEQ ID NO: 1675298 - DNA, 14 bp, Homo sapiens
catagcagtatatg

SEQ ID NO: 1675299 - DNA, 17 bp, Homo sapiens
catagcatgacatttct

SEQ ID NO: 1675300 - DNA, 18 bp, Homo sapiens
catagcatgacatttctt

SEQ ID NO: 1675301 - DNA, 19 bp, Homo sapiens
catagcatgcttcctttct

SEQ ID NO: 1675302 - DNA, 15 bp, Homo sapiens
catagccagcatttt

SEQ ID NO: 1675303 - DNA, 15 bp, Homo sapiens
catagccaggaaact

SEQ ID NO: 1675304 - DNA, 17 bp, Homo sapiens
catagccataaatgatg

SEQ ID NO: 1675305 - DNA, 19 bp, Homo sapiens
catagccccggccccccgc

SEQ ID NO: 1675306 - DNA, 15 bp, Homo sapiens
catagccctcctgag

SEQ ID NO: 1675307 - DNA, 18 bp, Homo sapiens
catagcctaatccctggg

SEQ ID NO: 1675308 - DNA, 19 bp, Homo sapiens
catagcctcatgttctgtg

SEQ ID NO: 1675309 - DNA, 17 bp, Homo sapiens
catagcctgcctgatcc

SEQ ID NO: 1675310 - DNA, 18 bp, Homo sapiens
catagcgggggcctaaaa

SEQ ID NO: 1675311 - DNA, 14 bp, Homo sapiens
catagcgtcctgcc

SEQ ID NO: 1675312 - DNA, 16 bp, Homo sapiens
catagcgtcctgccct

SEQ ID NO: 1675313 - DNA, 17 bp, Homo sapiens
catagcgtcctgccctg

SEQ ID NO: 1675314 - DNA, 18 bp, Homo sapiens
catagcgtcctgccctgc

SEQ ID NO: 1675315 - DNA, 20 bp, Homo sapiens
catagcgtcctgccctgccc

SEQ ID NO: 1675316 - DNA, 21 bp, Homo sapiens
catagctgtacttcttgaata

SEQ ID NO: 1675317 - DNA, 22 bp, Homo sapiens
catagcttacaagccagctgga

SEQ ID NO: 1675318 - DNA, 21 bp, Homo sapiens
catagcttgataaagggccaa

SEQ ID NO: 1675319 - DNA, 12 bp, Homo sapiens
cataggaaaagt

SEQ ID NO: 1675320 - DNA, 22 bp, Homo sapiens
cataggacctgcatccttcctg

SEQ ID NO: 1675321 - DNA, 18 bp, Homo sapiens
cataggacctttccacca

SEQ ID NO: 1675322 - DNA, 21 bp, Homo sapiens
cataggactaccgcaggcccg

SEQ ID NO: 1675323 - DNA, 16 bp, Homo sapiens
cataggagtttggagg

SEQ ID NO: 1675324 - DNA, 20 bp, Homo sapiens
cataggagtttggaggaagt

SEQ ID NO: 1675325 - DNA, 15 bp, Homo sapiens
cataggcctgggtgc

SEQ ID NO: 1675326 - DNA, 18 bp, Homo sapiens
cataggcctgggtgctgg

SEQ ID NO: 1675327 - DNA, 17 bp, Homo sapiens
cataggcggtcatgtgt

SEQ ID NO: 1675328 - DNA, 19 bp, Homo sapiens
cataggctcttaagcagca

SEQ ID NO: 1675329 - DNA, 17 bp, Homo sapiens
cataggctggtggcctt

SEQ ID NO: 1675330 - DNA, 20 bp, Homo sapiens
cataggctggtggccttggg

SEQ ID NO: 1675331 - DNA, 19 bp, Homo sapiens
catagggtcactttgccat

SEQ ID NO: 1675332 - DNA, 16 bp, Homo sapiens
cataggtcactggctc

SEQ ID NO: 1675333 - DNA, 18 bp, Homo sapiens
cataggtcactggctctc

SEQ ID NO: 1675334 - DNA, 17 bp, Homo sapiens
catcaaacctttgagta

SEQ ID NO: 1675335 - DNA, 23 bp, Homo sapiens
catcaaagcagaagtctggcttt

SEQ ID NO: 1675336 - DNA, 23 bp, Homo sapiens
catcaaagtggtaaatactgtga

SEQ ID NO: 1675337 - DNA, 13 bp, Homo sapiens
catcaaataagaa

SEQ ID NO: 1675338 - DNA, 23 bp, Homo sapiens
catcaactaaagttgtactttaa

SEQ ID NO: 1675339 - DNA, 18 bp, Homo sapiens
catcaagcaggaattatg

SEQ ID NO: 1675340 - DNA, 12 bp, Homo sapiens
catcaagggaga

SEQ ID NO: 1675341 - DNA, 21 bp, Homo sapiens
catcaagtccatctgacaaaa

SEQ ID NO: 1675342 - DNA, 13 bp, Homo sapiens
catcaagttctcc

SEQ ID NO: 1675343 - DNA, 17 bp, Homo sapiens
catcaatacaaccagcc

SEQ ID NO: 1675344 - DNA, 23 bp, Homo sapiens
catcaatacttttgtgtattctg

SEQ ID NO: 1675345 - DNA, 12 bp, Homo sapiens
catcaatcttgt

SEQ ID NO: 1675346 - DNA, 15 bp, Homo sapiens
catcttactgaaggt

SEQ ID NO: 1675347 - DNA, 22 bp, Homo sapiens
catcttactgtacctgttcctt

SEQ ID NO: 1675348 - DNA, 17 bp, Homo sapiens
catcttagacctccaca

SEQ ID NO: 1675349 - DNA, 14 bp, Homo sapiens
catcttagtgcctg

SEQ ID NO: 1675350 - DNA, 20 bp, Homo sapiens
catcttattttcatgtatat

SEQ ID NO: 1675351 - DNA, 21 bp, Homo sapiens
catcttcacttctaaatgcat

SEQ ID NO: 1675352 - DNA, 9 bp, Homo sapiens
catcttcag

SEQ ID NO: 1675353 - DNA, 13 bp, Homo sapiens
catcttccagcca

SEQ ID NO: 1675354 - DNA, 15 bp, Homo sapiens
catcttcctgctgct

SEQ ID NO: 1675355 - DNA, 13 bp, Homo sapiens
catcttcctgtgt

SEQ ID NO: 1675356 - DNA, 20 bp, Homo sapiens
catcttctccccgaggctgc

SEQ ID NO: 1675357 - DNA, 17 bp, Homo sapiens
catcttctgccttagtc

SEQ ID NO: 1675358 - DNA, 14 bp, Homo sapiens
catcttctggagaa

SEQ ID NO: 1675359 - DNA, 13 bp, Homo sapiens
catcttctggctt

SEQ ID NO: 1675360 - DNA, 13 bp, Homo sapiens
catcttcttccct

SEQ ID NO: 1675361 - DNA, 11 bp, Homo sapiens
catcttgagct

SEQ ID NO: 1675362 - DNA, 20 bp, Homo sapiens
catcttgcacggtgacccct

SEQ ID NO: 1675363 - DNA, 19 bp, Homo sapiens
catcttgcagcatttacta

SEQ ID NO: 1675364 - DNA, 20 bp, Homo sapiens
catcttgcagcatttactat

SEQ ID NO: 1675365 - DNA, 22 bp, Homo sapiens
catcttgcctccaggtgcagag

SEQ ID NO: 1675366 - DNA, 14 bp, Homo sapiens
catcttgctaccag

SEQ ID NO: 1675367 - DNA, 23 bp, Homo sapiens
catcttgctaccagtatttagaa

SEQ ID NO: 1675368 - DNA, 13 bp, Homo sapiens
catcttgctggct

SEQ ID NO: 1675369 - DNA, 14 bp, Homo sapiens
catcttgctggcta

SEQ ID NO: 1675370 - DNA, 18 bp, Homo sapiens
catcttggtagttctgtg

SEQ ID NO: 1675371 - DNA, 23 bp, Homo sapiens
catcttggtagttctgtgcctcc

SEQ ID NO: 1675372 - DNA, 23 bp, Homo sapiens
catcttggttatttctgaaggta

SEQ ID NO: 1675373 - DNA, 16 bp, Homo sapiens
catcttgtggggccag

SEQ ID NO: 1675374 - DNA, 17 bp, Homo sapiens
catcttgtggggccagg

SEQ ID NO: 1675375 - DNA, 16 bp, Homo sapiens
catctttatctgttct

SEQ ID NO: 1675376 - DNA, 14 bp, Homo sapiens
catctttccatcca

SEQ ID NO: 1675377 - DNA, 23 bp, Homo sapiens
catctttcttctattttattccc

SEQ ID NO: 1675378 - DNA, 15 bp, Homo sapiens
catctttgatccttc

SEQ ID NO: 1675379 - DNA, 18 bp, Homo sapiens
catctttgatccttctga

SEQ ID NO: 1675380 - DNA, 15 bp, Homo sapiens
catctttgccttggg

SEQ ID NO: 1675381 - DNA, 22 bp, Homo sapiens
catctttgccttgggctgctcc

SEQ ID NO: 1675382 - DNA, 13 bp, Homo sapiens
catcttttacatt

SEQ ID NO: 1675383 - DNA, 17 bp, Homo sapiens
catcttttattttggaa

SEQ ID NO: 1675384 - DNA, 19 bp, Homo sapiens
catcttttattttggaact

SEQ ID NO: 1675385 - DNA, 22 bp, Homo sapiens
catcttttattttggaactatg

SEQ ID NO: 1675386 - DNA, 13 bp, Homo sapiens
catcttttctaat

SEQ ID NO: 1675387 - DNA, 20 bp, Homo sapiens
catcttttctagagacacat

SEQ ID NO: 1675388 - DNA, 22 bp, Homo sapiens
catcttttctagagacacattg

SEQ ID NO: 1675389 - DNA, 13 bp, Homo sapiens
catcttttgtatt

SEQ ID NO: 1675390 - DNA, 14 bp, Homo sapiens
catcttttgtatta

SEQ ID NO: 1675391 - DNA, 15 bp, Homo sapiens
catcttttgtattaa

SEQ ID NO: 1675392 - DNA, 18 bp, Homo sapiens
catcttttgtattaagaa

SEQ ID NO: 1675393 - DNA, 22 bp, Homo sapiens
catcttttgtattaagaaagga

SEQ ID NO: 1675394 - DNA, 15 bp, Homo sapiens
catgaaaaagcagct

SEQ ID NO: 1675395 - DNA, 19 bp, Homo sapiens
catgaaaaagcagctacca

SEQ ID NO: 1675396 - DNA, 23 bp, Homo sapiens
catgaaaaagcagctaccaggtg

SEQ ID NO: 1675397 - DNA, 13 bp, Homo sapiens
catgaaacagaaa

SEQ ID NO: 1675398 - DNA, 19 bp, Homo sapiens
catcaatcttgttactgct

SEQ ID NO: 1675399 - DNA, 19 bp, Homo sapiens
catcaatggggccagtcag

SEQ ID NO: 1675400 - DNA, 16 bp, Homo sapiens
catcaattaacatcgt

SEQ ID NO: 1675401 - DNA, 18 bp, Homo sapiens
catcacaaccagatttga

SEQ ID NO: 1675402 - DNA, 14 bp, Homo sapiens
catcacactgggtg

SEQ ID NO: 1675403 - DNA, 14 bp, Homo sapiens
catcacagcccagc

SEQ ID NO: 1675404 - DNA, 16 bp, Homo sapiens
catcacagcccagccc

SEQ ID NO: 1675405 - DNA, 17 bp, Homo sapiens
catcacagcccagcccg

SEQ ID NO: 1675406 - DNA, 20 bp, Homo sapiens
catcacagggcagagccggg

SEQ ID NO: 1675407 - DNA, 18 bp, Homo sapiens
catcacagggtgggcctc

SEQ ID NO: 1675408 - DNA, 15 bp, Homo sapiens
catcacatgatgaaa

SEQ ID NO: 1675409 - DNA, 18 bp, Homo sapiens
catcaccatttcctcctt

SEQ ID NO: 1675410 - DNA, 20 bp, Homo sapiens
catcaccatttcttggcatt

SEQ ID NO: 1675411 - DNA, 14 bp, Homo sapiens
catcaccctcttcc

SEQ ID NO: 1675412 - DNA, 22 bp, Homo sapiens
catcaccctgggagtttcctga

SEQ ID NO: 1675413 - DNA, 14 bp, Homo sapiens
catcacctctttgc

SEQ ID NO: 1675414 - DNA, 19 bp, Homo sapiens
catcacgtaccccactggg

SEQ ID NO: 1675415 - DNA, 23 bp, Homo sapiens
catcacgtaccccactgggccag

SEQ ID NO: 1675416 - DNA, 15 bp, Homo sapiens
catcactagaagaaa

SEQ ID NO: 1675417 - DNA, 14 bp, Homo sapiens
catcactagtgaca

SEQ ID NO: 1675418 - DNA, 15 bp, Homo sapiens
catcactccctctcc

SEQ ID NO: 1675419 - DNA, 22 bp, Homo sapiens
catcactccctctccctcccta

SEQ ID NO: 1675420 - DNA, 16 bp, Homo sapiens
catcactcttttaaga

SEQ ID NO: 1675421 - DNA, 19 bp, Homo sapiens
catcactggagcaccaggc

SEQ ID NO: 1675422 - DNA, 20 bp, Homo sapiens
catcactgtaaagacaaata

SEQ ID NO: 1675423 - DNA, 14 bp, Homo sapiens
catcacttccctac

SEQ ID NO: 1675424 - DNA, 14 bp, Homo sapiens
catcacttctcccc

SEQ ID NO: 1675425 - DNA, 15 bp, Homo sapiens
catcactttgaccta

SEQ ID NO: 1675426 - DNA, 18 bp, Homo sapiens
catcagaaaataaaatat

SEQ ID NO: 1675427 - DNA, 11 bp, Homo sapiens
catcagaaata

SEQ ID NO: 1675428 - DNA, 23 bp, Homo sapiens
catcagaaggagaaggaaggaga

SEQ ID NO: 1675429 - DNA, 15 bp, Homo sapiens
catcagacctgtctt

SEQ ID NO: 1675430 - DNA, 21 bp, Homo sapiens
catcagagagtgtacatcatg

SEQ ID NO: 1675431 - DNA, 14 bp, Homo sapiens
catcagagggctga

SEQ ID NO: 1675432 - DNA, 15 bp, Homo sapiens
catcagcaccccagt

SEQ ID NO: 1675433 - DNA, 15 bp, Homo sapiens
catcagcctgcttct

SEQ ID NO: 1675434 - DNA, 16 bp, Homo sapiens
catcagcgggtctcct

SEQ ID NO: 1675435 - DNA, 17 bp, Homo sapiens
catcagcgggtctcctc

SEQ ID NO: 1675436 - DNA, 14 bp, Homo sapiens
catcagctccagct

SEQ ID NO: 1675437 - DNA, 15 bp, Homo sapiens
catcagctgaattca

SEQ ID NO: 1675438 - DNA, 15 bp, Homo sapiens
catcagctgctgaaa

SEQ ID NO: 1675439 - DNA, 19 bp, Homo sapiens
catcagctgtaagaagaga

SEQ ID NO: 1675440 - DNA, 20 bp, Homo sapiens
catcagcttgccctgttaaa

SEQ ID NO: 1675441 - DNA, 22 bp, Homo sapiens
catcaggaattgtcaaatgatg

SEQ ID NO: 1675442 - DNA, 21 bp, Homo sapiens
catcaggagactgggctctgg

SEQ ID NO: 1675443 - DNA, 11 bp, Homo sapiens
catcaggcact

SEQ ID NO: 1675444 - DNA, 17 bp, Homo sapiens
catcaggcactggtggc

SEQ ID NO: 1675445 - DNA, 17 bp, Homo sapiens
catcaggttccatcccg

SEQ ID NO: 1675446 - DNA, 17 bp, Homo sapiens
catcagtctccaacatg

SEQ ID NO: 1675447 - DNA, 14 bp, Homo sapiens
catcagtgaggagg

SEQ ID NO: 1675448 - DNA, 19 bp, Homo sapiens
catcagtgaggagggatgt

SEQ ID NO: 1675449 - DNA, 15 bp, Homo sapiens
catcagtgttaaaaa

SEQ ID NO: 1675450 - DNA, 18 bp, Homo sapiens
catcagttcccccagtac

SEQ ID NO: 1675451 - DNA, 12 bp, Homo sapiens
catcataaaata

SEQ ID NO: 1675452 - DNA, 24 bp, Homo sapiens
catcataactggcttctgcttgtc

SEQ ID NO: 1675453 - DNA, 15 bp, Homo sapiens
catcataattacatt

SEQ ID NO: 1675454 - DNA, 19 bp, Homo sapiens
catcataattacattccta

SEQ ID NO: 1675455 - DNA, 12 bp, Homo sapiens
catcatcactgt

SEQ ID NO: 1675456 - DNA, 15 bp, Homo sapiens
catcatcactgtaaa

SEQ ID NO: 1675457 - DNA, 14 bp, Homo sapiens
catcatctctgaag

SEQ ID NO: 1675458 - DNA, 13 bp, Homo sapiens
catcatctgtaga

SEQ ID NO: 1675459 - DNA, 18 bp, Homo sapiens
catcatctgtagatacta

SEQ ID NO: 1675460 - DNA, 23 bp, Homo sapiens
catcatgaactggcttgtacatt

SEQ ID NO: 1675461 - DNA, 12 bp, Homo sapiens
catcatgcatgt

SEQ ID NO: 1675462 - DNA, 17 bp, Homo sapiens
catcatggtttttgaag

SEQ ID NO: 1675463 - DNA, 12 bp, Homo sapiens
catcatgtctgt

SEQ ID NO: 1675464 - DNA, 12 bp, Homo sapiens
catcatgtttca

SEQ ID NO: 1675465 - DNA, 20 bp, Homo sapiens
catcatgtttcagtgaagat

SEQ ID NO: 1675466 - DNA, 16 bp, Homo sapiens
catcattaataagtga

SEQ ID NO: 1675467 - DNA, 18 bp, Homo sapiens
catcattaataagtgaag

SEQ ID NO: 1675468 - DNA, 10 bp, Homo sapiens
catcattaga

SEQ ID NO: 1675469 - DNA, 13 bp, Homo sapiens
catcattagaaca

SEQ ID NO: 1675470 - DNA, 14 bp, Homo sapiens
catcattagaacaa

SEQ ID NO: 1675471 - DNA, 21 bp, Homo sapiens
catcattatttgcagagacag

SEQ ID NO: 1675472 - DNA, 14 bp, Homo sapiens
catcattccctctc

SEQ ID NO: 1675473 - DNA, 15 bp, Homo sapiens
catcattcttgtggg

SEQ ID NO: 1675474 - DNA, 21 bp, Homo sapiens
catcattcttgtgggagacag

SEQ ID NO: 1675475 - DNA, 23 bp, Homo sapiens
catcattcttgtgggagacagca

SEQ ID NO: 1675476 - DNA, 15 bp, Homo sapiens
catcattgcacctgc

SEQ ID NO: 1675477 - DNA, 21 bp, Homo sapiens
catcattgcacctgcaggctt

SEQ ID NO: 1675478 - DNA, 11 bp, Homo sapiens
catccagtggg

SEQ ID NO: 1675479 - DNA, 13 bp, Homo sapiens
catccagttcatg

SEQ ID NO: 1675480 - DNA, 19 bp, Homo sapiens
catccatcagcaccccagt

SEQ ID NO: 1675481 - DNA, 16 bp, Homo sapiens
catccatctccaggga

SEQ ID NO: 1675482 - DNA, 23 bp, Homo sapiens
catccatgtgctagtcactggca

SEQ ID NO: 1675483 - DNA, 15 bp, Homo sapiens
catccattacctcca

SEQ ID NO: 1675484 - DNA, 20 bp, Homo sapiens
catccattaggccagcaacg

SEQ ID NO: 1675485 - DNA, 15 bp, Homo sapiens
catccattcctcagg

SEQ ID NO: 1675486 - DNA, 16 bp, Homo sapiens
catccattcctcaggg

SEQ ID NO: 1675487 - DNA, 19 bp, Homo sapiens
catccattcctcagggaca

SEQ ID NO: 1675488 - DNA, 13 bp, Homo sapiens
catccattgttgt

SEQ ID NO: 1675489 - DNA, 19 bp, Homo sapiens
catccatttcatctatttc

SEQ ID NO: 1675490 - DNA, 13 bp, Homo sapiens
catcccacagtgg

SEQ ID NO: 1675491 - DNA, 21 bp, Homo sapiens
catcccacccccgaccctgcc

SEQ ID NO: 1675492 - DNA, 23 bp, Homo sapiens
catcccacccccgaccctgccct

SEQ ID NO: 1675493 - DNA, 18 bp, Homo sapiens
catcccacttagccgcac

SEQ ID NO: 1675494 - DNA, 23 bp, Homo sapiens
catcccacttagccgcaccctgc

SEQ ID NO: 1675495 - DNA, 17 bp, Homo sapiens
catcccagacaggtccc

SEQ ID NO: 1675496 - DNA, 23 bp, Homo sapiens
catcccagacaggtccctcccct

SEQ ID NO: 1675497 - DNA, 12 bp, Homo sapiens
catcccagcctg

SEQ ID NO: 1675498 - DNA, 18 bp, Homo sapiens
catcccagcctgtggtta

SEQ ID NO: 1675499 - DNA, 13 bp, Homo sapiens
catcccagcggct

SEQ ID NO: 1675500 - DNA, 19 bp, Homo sapiens
catcccaggcttcaccctg

SEQ ID NO: 1675501 - DNA, 13 bp, Homo sapiens
catcccaggggac

SEQ ID NO: 1675502 - DNA, 23 bp, Homo sapiens
catcccagtccctcgccgtccct

SEQ ID NO: 1675503 - DNA, 12 bp, Homo sapiens
catcccattgcc

SEQ ID NO: 1675504 - DNA, 16 bp, Homo sapiens
catcccattgccctgg

SEQ ID NO: 1675505 - DNA, 17 bp, Homo sapiens
catcccattgccctggt

SEQ ID NO: 1675506 - DNA, 14 bp, Homo sapiens
catccccaactcca

SEQ ID NO: 1675507 - DNA, 16 bp, Homo sapiens
catccccagagcccag

SEQ ID NO: 1675508 - DNA, 12 bp, Homo sapiens
catccccagggg

SEQ ID NO: 1675509 - DNA, 23 bp, Homo sapiens
catcccccactgccacaccctcc

SEQ ID NO: 1675510 - DNA, 15 bp, Homo sapiens
catcccccctgctgc

SEQ ID NO: 1675511 - DNA, 17 bp, Homo sapiens
catcccccctgctgccc

SEQ ID NO: 1675512 - DNA, 19 bp, Homo sapiens
catcccccctgctgcccag

SEQ ID NO: 1675513 - DNA, 11 bp, Homo sapiens
catccccctgc

SEQ ID NO: 1675514 - DNA, 14 bp, Homo sapiens
catccccctgccct

SEQ ID NO: 1675515 - DNA, 17 bp, Homo sapiens
catcccctcgtcctgtc

SEQ ID NO: 1675516 - DNA, 22 bp, Homo sapiens
catcccctcgtcctgtcccaga

SEQ ID NO: 1675517 - DNA, 12 bp, Homo sapiens
catcccggcctc

SEQ ID NO: 1675518 - DNA, 18 bp, Homo sapiens
catcccgtatcacagtgt

SEQ ID NO: 1675519 - DNA, 20 bp, Homo sapiens
catcccgtatcacagtgttt

SEQ ID NO: 1675520 - DNA, 22 bp, Homo sapiens
catccctaccccctaagagcca

SEQ ID NO: 1675521 - DNA, 13 bp, Homo sapiens
catccctcaactg

SEQ ID NO: 1675522 - DNA, 15 bp, Homo sapiens
catccctcaactgag

SEQ ID NO: 1675523 - DNA, 19 bp, Homo sapiens
catccctcggaagccgtct

SEQ ID NO: 1675524 - DNA, 19 bp, Homo sapiens
catccctcgggaagcagcc

SEQ ID NO: 1675525 - DNA, 22 bp, Homo sapiens
catccctcgggaagcagccagc

SEQ ID NO: 1675526 - DNA, 17 bp, Homo sapiens
catccctgactggccaa

SEQ ID NO: 1675527 - DNA, 21 bp, Homo sapiens
catccctgactggccaaaccc

SEQ ID NO: 1675528 - DNA, 14 bp, Homo sapiens
catccctgcttctg

SEQ ID NO: 1675529 - DNA, 18 bp, Homo sapiens
catccctgcttctggcgc

SEQ ID NO: 1675530 - DNA, 13 bp, Homo sapiens
catccctggagca

SEQ ID NO: 1675531 - DNA, 22 bp, Homo sapiens
catccctggagcaggagccccg

SEQ ID NO: 1675532 - DNA, 20 bp, Homo sapiens
catccctgggggccttgggt

SEQ ID NO: 1675533 - DNA, 18 bp, Homo sapiens
catccctttttttacatt

SEQ ID NO: 1675534 - DNA, 15 bp, Homo sapiens
catccgaggcagggt

SEQ ID NO: 1675535 - DNA, 17 bp, Homo sapiens
catccgcgtgtgcctgt

SEQ ID NO: 1675536 - DNA, 20 bp, Homo sapiens
catccgcgtgtgcctgtgtg

SEQ ID NO: 1675537 - DNA, 16 bp, Homo sapiens
catccggcagcctgga

SEQ ID NO: 1675538 - DNA, 18 bp, Homo sapiens
catccggtggcctattcc

SEQ ID NO: 1675539 - DNA, 17 bp, Homo sapiens
catccgtcattgctgct

SEQ ID NO: 1675540 - DNA, 18 bp, Homo sapiens
catccgtcattgctgctg

SEQ ID NO: 1675541 - DNA, 16 bp, Homo sapiens
catcctaaaagccacc

SEQ ID NO: 1675542 - DNA, 19 bp, Homo sapiens
catcctaaaagccacccca

SEQ ID NO: 1675543 - DNA, 15 bp, Homo sapiens
catcctaccgtcttt

SEQ ID NO: 1675544 - DNA, 20 bp, Homo sapiens
catcctagaggtagagaaac

SEQ ID NO: 1675545 - DNA, 20 bp, Homo sapiens
catcctcaaagaaagtgtat

SEQ ID NO: 1675546 - DNA, 17 bp, Homo sapiens
catcctcatccctgact

SEQ ID NO: 1675547 - DNA, 19 bp, Homo sapiens
catcctcattgcctcctgt

SEQ ID NO: 1675548 - DNA, 17 bp, Homo sapiens
catgcctgtccagcctg

SEQ ID NO: 1675549 - DNA, 23 bp, Homo sapiens
catgcctgtccagcctgggcagc

SEQ ID NO: 1675550 - DNA, 20 bp, Homo sapiens
catgccttaaacctacctcc

SEQ ID NO: 1675551 - DNA, 19 bp, Homo sapiens
catgccttccagcaccctg

SEQ ID NO: 1675552 - DNA, 21 bp, Homo sapiens
catgccttccagcaccctgca

SEQ ID NO: 1675553 - DNA, 18 bp, Homo sapiens
catgcgcagaggccagtt

SEQ ID NO: 1675554 - DNA, 14 bp, Homo sapiens
catgcgctcagggc

SEQ ID NO: 1675555 - DNA, 17 bp, Homo sapiens
catgcgtatatgtgcgt

SEQ ID NO: 1675556 - DNA, 16 bp, Homo sapiens
catgcgtcaggggcct

SEQ ID NO: 1675557 - DNA, 19 bp, Homo sapiens
catgcgtgccgcctgctcc

SEQ ID NO: 1675558 - DNA, 15 bp, Homo sapiens
catgctactaaattt

SEQ ID NO: 1675559 - DNA, 22 bp, Homo sapiens
catgctagcatgggtattttta

SEQ ID NO: 1675560 - DNA, 23 bp, Homo sapiens
catgctagcatgggtatttttat

SEQ ID NO: 1675561 - DNA, 21 bp, Homo sapiens
catgctatatatcttttgtaa

SEQ ID NO: 1675562 - DNA, 17 bp, Homo sapiens
catgctatctgttccta

SEQ ID NO: 1675563 - DNA, 17 bp, Homo sapiens
catgctatgagttttct

SEQ ID NO: 1675564 - DNA, 16 bp, Homo sapiens
catgctatgttctgtc

SEQ ID NO: 1675565 - DNA, 18 bp, Homo sapiens
catgctatgttctgtctt

SEQ ID NO: 1675566 - DNA, 21 bp, Homo sapiens
catgctatgttctgtcttccc

SEQ ID NO: 1675567 - DNA, 12 bp, Homo sapiens
catgctcacaca

SEQ ID NO: 1675568 - DNA, 19 bp, Homo sapiens
catgctcagccttgctgct

SEQ ID NO: 1675569 - DNA, 17 bp, Homo sapiens
catgctcatctgctggt

SEQ ID NO: 1675570 - DNA, 22 bp, Homo sapiens
catgctccagattagagcctgt

SEQ ID NO: 1675571 - DNA, 18 bp, Homo sapiens
catgctcctcacctgtct

SEQ ID NO: 1675572 - DNA, 17 bp, Homo sapiens
catgctccttgagagga

SEQ ID NO: 1675573 - DNA, 15 bp, Homo sapiens
catgctctctgcagc

SEQ ID NO: 1675574 - DNA, 12 bp, Homo sapiens
catgctctgccc

SEQ ID NO: 1675575 - DNA, 14 bp, Homo sapiens
catgctctgcccca

SEQ ID NO: 1675576 - DNA, 18 bp, Homo sapiens
catgctctgccccaagcc

SEQ ID NO: 1675577 - DNA, 19 bp, Homo sapiens
catgctctggaagcctgga

SEQ ID NO: 1675578 - DNA, 12 bp, Homo sapiens
catgctgaatgc

SEQ ID NO: 1675579 - DNA, 13 bp, Homo sapiens
catgctgcccagc

SEQ ID NO: 1675580 - DNA, 16 bp, Homo sapiens
catgctgctggggaag

SEQ ID NO: 1675581 - DNA, 17 bp, Homo sapiens
catggctcctgtctggc

SEQ ID NO: 1675582 - DNA, 15 bp, Homo sapiens
catggctgctgttgc

SEQ ID NO: 1675583 - DNA, 18 bp, Homo sapiens
catggctgctgttgctta

SEQ ID NO: 1675584 - DNA, 12 bp, Homo sapiens
catggctgggaa

SEQ ID NO: 1675585 - DNA, 22 bp, Homo sapiens
catggctgggaacatgacccag

SEQ ID NO: 1675586 - DNA, 12 bp, Homo sapiens
catggctggggt

SEQ ID NO: 1675587 - DNA, 17 bp, Homo sapiens
catggctgtgtttgcag

SEQ ID NO: 1675588 - DNA, 23 bp, Homo sapiens
catggctgtgtttgcagcctgct

SEQ ID NO: 1675589 - DNA, 20 bp, Homo sapiens
catggcttaatgtttattcc

SEQ ID NO: 1675590 - DNA, 13 bp, Homo sapiens
catgggaaaggag

SEQ ID NO: 1675591 - DNA, 21 bp, Homo sapiens
catgggaaaggaggcatgcct

SEQ ID NO: 1675592 - DNA, 17 bp, Homo sapiens
catgggagccagctgct

SEQ ID NO: 1675593 - DNA, 14 bp, Homo sapiens
catgggagggggct

SEQ ID NO: 1675594 - DNA, 22 bp, Homo sapiens
catgggagggggcttgaagcca

SEQ ID NO: 1675595 - DNA, 18 bp, Homo sapiens
catgggccccaccattta

SEQ ID NO: 1675596 - DNA, 12 bp, Homo sapiens
catgggcctccc

SEQ ID NO: 1675597 - DNA, 14 bp, Homo sapiens
catgggcctcccac

SEQ ID NO: 1675598 - DNA, 23 bp, Homo sapiens
catgggcctggccacctctctcc

SEQ ID NO: 1675599 - DNA, 24 bp, Homo sapiens
catgggcctggccacctctctcct

SEQ ID NO: 1675600 - DNA, 18 bp, Homo sapiens
catgggcctgggcctgct

SEQ ID NO: 1675601 - DNA, 20 bp, Homo sapiens
catgggcttggacttcctgg

SEQ ID NO: 1675602 - DNA, 15 bp, Homo sapiens
catggggaggcagca

SEQ ID NO: 1675603 - DNA, 17 bp, Homo sapiens
catggggaggcagcaga

SEQ ID NO: 1675604 - DNA, 19 bp, Homo sapiens
catcgctcccaaaggaaag

SEQ ID NO: 1675605 - DNA, 14 bp, Homo sapiens
catcggaaaaataa

SEQ ID NO: 1675606 - DNA, 21 bp, Homo sapiens
catcggccaagaatacttgaa

SEQ ID NO: 1675607 - DNA, 12 bp, Homo sapiens
catcgggctttg

SEQ ID NO: 1675608 - DNA, 21 bp, Homo sapiens
catcggtgaaactaacagata

SEQ ID NO: 1675609 - DNA, 22 bp, Homo sapiens
catcggtgaaactaacagataa

SEQ ID NO: 1675610 - DNA, 17 bp, Homo sapiens
catcgtaggcagccacg

SEQ ID NO: 1675611 - DNA, 21 bp, Homo sapiens
catcgtaggcagccacggccc

SEQ ID NO: 1675612 - DNA, 17 bp, Homo sapiens
catcgtgaagaagcctg

SEQ ID NO: 1675613 - DNA, 16 bp, Homo sapiens
catcgtgacccttcag

SEQ ID NO: 1675614 - DNA, 20 bp, Homo sapiens
catcgtgacccttcagggcc

SEQ ID NO: 1675615 - DNA, 21 bp, Homo sapiens
catctaaaaatatacatgttt

SEQ ID NO: 1675616 - DNA, 14 bp, Homo sapiens
catctaaaatactc

SEQ ID NO: 1675617 - DNA, 14 bp, Homo sapiens
catctaattctgat

SEQ ID NO: 1675618 - DNA, 16 bp, Homo sapiens
catctaattctgattc

SEQ ID NO: 1675619 - DNA, 14 bp, Homo sapiens
catctactcccaag

SEQ ID NO: 1675620 - DNA, 20 bp, Homo sapiens
catctactctaaagaaaaat

SEQ ID NO: 1675621 - DNA, 18 bp, Homo sapiens
catctagtacttgaaaaa

SEQ ID NO: 1675622 - DNA, 14 bp, Homo sapiens
catctataaagaag

SEQ ID NO: 1675623 - DNA, 17 bp, Homo sapiens
catctatagaaagctat

SEQ ID NO: 1675624 - DNA, 14 bp, Homo sapiens
catctatcgagttt

SEQ ID NO: 1675625 - DNA, 15 bp, Homo sapiens
catctatctcaatcc

SEQ ID NO: 1675626 - DNA, 13 bp, Homo sapiens
catctattctctc

SEQ ID NO: 1675627 - DNA, 13 bp, Homo sapiens
catctatttctga

SEQ ID NO: 1675628 - DNA, 16 bp, Homo sapiens
catctatttctgagaa

SEQ ID NO: 1675629 - DNA, 18 bp, Homo sapiens
catctcaaaacagagggc

SEQ ID NO: 1675630 - DNA, 19 bp, Homo sapiens
catctcaaaacagagggct

SEQ ID NO: 1675631 - DNA, 19 bp, Homo sapiens
catctcagctcactgcaac

SEQ ID NO: 1675632 - DNA, 22 bp, Homo sapiens
catctcagcttttctgtccctt

SEQ ID NO: 1675633 - DNA, 20 bp, Homo sapiens
catctcaggacacttccgta

SEQ ID NO: 1675634 - DNA, 17 bp, Homo sapiens
catctcaggagatggag

SEQ ID NO: 1675635 - DNA, 23 bp, Homo sapiens
catctcaggaggggcagcgcatg

SEQ ID NO: 1675636 - DNA, 21 bp, Homo sapiens
catctcagggtccagaccctg

SEQ ID NO: 1675637 - DNA, 13 bp, Homo sapiens
catctcaggtgcc

SEQ ID NO: 1675638 - DNA, 16 bp, Homo sapiens
catctcaggtgccact

SEQ ID NO: 1675639 - DNA, 22 bp, Homo sapiens
catctcaggtgccactccctga

SEQ ID NO: 1675640 - DNA, 21 bp, Homo sapiens
catctcatcctggcacgccct

SEQ ID NO: 1675641 - DNA, 18 bp, Homo sapiens
catctcatgaggggagag

SEQ ID NO: 1675642 - DNA, 17 bp, Homo sapiens
catctcattccaacttc

SEQ ID NO: 1675643 - DNA, 22 bp, Homo sapiens
catctccagggagcaagacaga

SEQ ID NO: 1675644 - DNA, 19 bp, Homo sapiens
catctccagggagtcccct

SEQ ID NO: 1675645 - DNA, 15 bp, Homo sapiens
catctccatcagctg

SEQ ID NO: 1675646 - DNA, 14 bp, Homo sapiens
catctccccaggcc

SEQ ID NO: 1675647 - DNA, 15 bp, Homo sapiens
catctccccaggcct

SEQ ID NO: 1675648 - DNA, 19 bp, Homo sapiens
catctccccaggcctccag

SEQ ID NO: 1675649 - DNA, 20 bp, Homo sapiens
catctccccaggcctccagc

SEQ ID NO: 1675650 - DNA, 15 bp, Homo sapiens
catctcccctagctc

SEQ ID NO: 1675651 - DNA, 15 bp, Homo sapiens
catctcccctcctgg

SEQ ID NO: 1675652 - DNA, 14 bp, Homo sapiens
catctccctgcctg

SEQ ID NO: 1675653 - DNA, 15 bp, Homo sapiens
catctccctgcctgg

SEQ ID NO: 1675654 - DNA, 12 bp, Homo sapiens
catctccgcctc

SEQ ID NO: 1675655 - DNA, 15 bp, Homo sapiens
catctcctgatttct

SEQ ID NO: 1675656 - DNA, 13 bp, Homo sapiens
catctcctgtgca

SEQ ID NO: 1675657 - DNA, 15 bp, Homo sapiens
catctcctgtgcatg

SEQ ID NO: 1675658 - DNA, 19 bp, Homo sapiens
catctcctgtgcatgggtg

SEQ ID NO: 1675659 - DNA, 20 bp, Homo sapiens
catctcctgtgcatgggtga

SEQ ID NO: 1675660 - DNA, 12 bp, Homo sapiens
catctccttccc

SEQ ID NO: 1675661 - DNA, 16 bp, Homo sapiens
catctccttcccccag

SEQ ID NO: 1675662 - DNA, 18 bp, Homo sapiens
catctccttcccccagcc

SEQ ID NO: 1675663 - DNA, 15 bp, Homo sapiens
catctcgagccccct

SEQ ID NO: 1675664 - DNA, 13 bp, Homo sapiens
cattgtcttgatg

SEQ ID NO: 1675665 - DNA, 19 bp, Homo sapiens
cattgtctttgctgtactc

SEQ ID NO: 1675666 - DNA, 20 bp, Homo sapiens
cattgtctttgctgtactct

SEQ ID NO: 1675667 - DNA, 13 bp, Homo sapiens
cattgtgagctct

SEQ ID NO: 1675668 - DNA, 15 bp, Homo sapiens
cattgtgagctctgg

SEQ ID NO: 1675669 - DNA, 16 bp, Homo sapiens
cattgtgattggcctg

SEQ ID NO: 1675670 - DNA, 16 bp, Homo sapiens
cattgttattgtggaa

SEQ ID NO: 1675671 - DNA, 15 bp, Homo sapiens
cattgttcccttcct

SEQ ID NO: 1675672 - DNA, 20 bp, Homo sapiens
cattgttcccttcctcttcc

SEQ ID NO: 1675673 - DNA, 13 bp, Homo sapiens
cattgttgtcaag

SEQ ID NO: 1675674 - DNA, 16 bp, Homo sapiens
cattgttgtcaaggaa

SEQ ID NO: 1675675 - DNA, 17 bp, Homo sapiens
cattgtttcgtaacaca

SEQ ID NO: 1675676 - DNA, 18 bp, Homo sapiens
cattgtttgtctgtcttc

SEQ ID NO: 1675677 - DNA, 22 bp, Homo sapiens
cattgtttgtctgtcttcatag

SEQ ID NO: 1675678 - DNA, 14 bp, Homo sapiens
cattgttttgcaaa

SEQ ID NO: 1675679 - DNA, 14 bp, Homo sapiens
catttaaaatgatt

SEQ ID NO: 1675680 - DNA, 18 bp, Homo sapiens
catttaaaatgattagaa

SEQ ID NO: 1675681 - DNA, 17 bp, Homo sapiens
catttaaaatggaaaat

SEQ ID NO: 1675682 - DNA, 16 bp, Homo sapiens
catttaaaattgctat

SEQ ID NO: 1675683 - DNA, 20 bp, Homo sapiens
catttaaaattgctatgtta

SEQ ID NO: 1675684 - DNA, 16 bp, Homo sapiens
catttaaatatctgtt

SEQ ID NO: 1675685 - DNA, 16 bp, Homo sapiens
catttaaatggttctg

SEQ ID NO: 1675686 - DNA, 18 bp, Homo sapiens
catttaaatggttctgtg

SEQ ID NO: 1675687 - DNA, 17 bp, Homo sapiens
catttaaattttttggc

SEQ ID NO: 1675688 - DNA, 18 bp, Homo sapiens
catttaaatttttttcct

SEQ ID NO: 1675689 - DNA, 14 bp, Homo sapiens
catttaagtgacct

SEQ ID NO: 1675690 - DNA, 13 bp, Homo sapiens
catttaataaaac

SEQ ID NO: 1675691 - DNA, 15 bp, Homo sapiens
catttaataaaactg

SEQ ID NO: 1675692 - DNA, 17 bp, Homo sapiens
catttaataaagatgag

SEQ ID NO: 1675693 - DNA, 16 bp, Homo sapiens
catttaatacagataa

SEQ ID NO: 1675694 - DNA, 21 bp, Homo sapiens
catttaatacagataagtgtt

SEQ ID NO: 1675695 - DNA, 13 bp, Homo sapiens
catttaatagact

SEQ ID NO: 1675696 - DNA, 18 bp, Homo sapiens
catttacaaaagatttat

SEQ ID NO: 1675697 - DNA, 24 bp, Homo sapiens
catttacattaggtattacaagta

SEQ ID NO: 1675698 - DNA, 14 bp, Homo sapiens
catttactatgcac

SEQ ID NO: 1675699 - DNA, 16 bp, Homo sapiens
catttactatgcacaa

SEQ ID NO: 1675700 - DNA, 17 bp, Homo sapiens
catttactatgcacaac

SEQ ID NO: 1675701 - DNA, 19 bp, Homo sapiens
catttactatgcacaacag

SEQ ID NO: 1675702 - DNA, 12 bp, Homo sapiens
catttactttta

SEQ ID NO: 1675703 - DNA, 17 bp, Homo sapiens
catttagaagaaagatg

SEQ ID NO: 1675704 - DNA, 21 bp, Homo sapiens
catttagaatggtgattttaa

SEQ ID NO: 1675705 - DNA, 23 bp, Homo sapiens
catttagagaactgtggccgtta

SEQ ID NO: 1675706 - DNA, 20 bp, Homo sapiens
catttagagaggaaaagtaa

SEQ ID NO: 1675707 - DNA, 19 bp, Homo sapiens
catttagattgaaaacttt

SEQ ID NO: 1675708 - DNA, 12 bp, Homo sapiens
catttaggagaa

SEQ ID NO: 1675709 - DNA, 14 bp, Homo sapiens
catttagttctttg

SEQ ID NO: 1675710 - DNA, 14 bp, Homo sapiens
catttataatgttt

SEQ ID NO: 1675711 - DNA, 13 bp, Homo sapiens
catttatatagat

SEQ ID NO: 1675712 - DNA, 17 bp, Homo sapiens
catttatatatatatgt

SEQ ID NO: 1675713 - DNA, 22 bp, Homo sapiens
catttatatatatatgtatatg

SEQ ID NO: 1675714 - DNA, 21 bp, Homo sapiens
catttatattgcagattgaat

SEQ ID NO: 1675715 - DNA, 14 bp, Homo sapiens
catttatctataat

SEQ ID NO: 1675716 - DNA, 16 bp, Homo sapiens
catttatctataattt

SEQ ID NO: 1675717 - DNA, 21 bp, Homo sapiens
catttatctataatttaccta

SEQ ID NO: 1675718 - DNA, 12 bp, Homo sapiens
catttatcttga

SEQ ID NO: 1675719 - DNA, 14 bp, Homo sapiens
catttatcttgaag

SEQ ID NO: 1675720 - DNA, 20 bp, Homo sapiens
catttatggtcaacacttaa

SEQ ID NO: 1675721 - DNA, 13 bp, Homo sapiens
catttattgttta

SEQ ID NO: 1675722 - DNA, 13 bp, Homo sapiens
catttattttgac

SEQ ID NO: 1675723 - DNA, 20 bp, Homo sapiens
catttattttgagaagctct

SEQ ID NO: 1675724 - DNA, 18 bp, Homo sapiens
catttatttttagttaaa

SEQ ID NO: 1675725 - DNA, 21 bp, Homo sapiens
catttatttttagttaaaaat

SEQ ID NO: 1675726 - DNA, 15 bp, Homo sapiens
catttcaaagccctg

SEQ ID NO: 1675727 - DNA, 20 bp, Homo sapiens
catttcaaagccctgcctct

SEQ ID NO: 1675728 - DNA, 21 bp, Homo sapiens
catttcaaagccctgcctctg

SEQ ID NO: 1675729 - DNA, 22 bp, Homo sapiens
catttcaaagccctgcctctgt

SEQ ID NO: 1675730 - DNA, 15 bp, Homo sapiens
catttcaactgtttg

SEQ ID NO: 1675731 - DNA, 11 bp, Homo sapiens
catttcaatcc

SEQ ID NO: 1675732 - DNA, 19 bp, Homo sapiens
catttcaatccatttttta

SEQ ID NO: 1675733 - DNA, 16 bp, Homo sapiens
catttcaattcctggc

SEQ ID NO: 1675734 - DNA, 18 bp, Homo sapiens
catttcaattcctggccc

SEQ ID NO: 1675735 - DNA, 14 bp, Homo sapiens
catttcacatgcct

SEQ ID NO: 1675736 - DNA, 18 bp, Homo sapiens
catttcacatgccttgca

SEQ ID NO: 1675737 - DNA, 18 bp, Homo sapiens
catttcacccctcccttt

SEQ ID NO: 1675738 - DNA, 11 bp, Homo sapiens
catttcagaaa

SEQ ID NO: 1675739 - DNA, 15 bp, Homo sapiens
catttcatagtttca

SEQ ID NO: 1675740 - DNA, 19 bp, Homo sapiens
catttcatcattgtttctg

SEQ ID NO: 1675741 - DNA, 17 bp, Homo sapiens
catttcatgaaaaagct

SEQ ID NO: 1675742 - DNA, 15 bp, Homo sapiens
catttcattcctaac

SEQ ID NO: 1675743 - DNA, 18 bp, Homo sapiens
catttcattcctaacaca

SEQ ID NO: 1675744 - DNA, 22 bp, Homo sapiens
catttccaacaccacagacaca

SEQ ID NO: 1675745 - DNA, 17 bp, Homo sapiens
catttccaactcaggtt

SEQ ID NO: 1675746 - DNA, 18 bp, Homo sapiens
catttccaagaggctgta

SEQ ID NO: 1675747 - DNA, 22 bp, Homo sapiens
catttcccaaagtcctctgctc

SEQ ID NO: 1675748 - DNA, 16 bp, Homo sapiens
catttcccacatcttt

SEQ ID NO: 1675749 - DNA, 18 bp, Homo sapiens
catttcccacatctttcc

SEQ ID NO: 1675750 - DNA, 15 bp, Homo sapiens
catttcccatctgca

SEQ ID NO: 1675751 - DNA, 16 bp, Homo sapiens
catttccccctcctca

SEQ ID NO: 1675752 - DNA, 17 bp, Homo sapiens
catttccccctcctcag

SEQ ID NO: 1675753 - DNA, 22 bp, Homo sapiens
catttcctcacactaagagggc

SEQ ID NO: 1675754 - DNA, 14 bp, Homo sapiens
catttcctcacgtg

SEQ ID NO: 1675755 - DNA, 13 bp, Homo sapiens
catttcctgacag

SEQ ID NO: 1675756 - DNA, 12 bp, Homo sapiens
catttcctgccc

SEQ ID NO: 1675757 - DNA, 13 bp, Homo sapiens
catttcctgccct

SEQ ID NO: 1675758 - DNA, 21 bp, Homo sapiens
catttcctgcccttcctcagt

SEQ ID NO: 1675759 - DNA, 12 bp, Homo sapiens
catttcctgctg

SEQ ID NO: 1675760 - DNA, 13 bp, Homo sapiens
catttcctgctga

SEQ ID NO: 1675761 - DNA, 16 bp, Homo sapiens
catttccttcaaggca

SEQ ID NO: 1675762 - DNA, 17 bp, Homo sapiens
catttccttggaggcca

SEQ ID NO: 1675763 - DNA, 20 bp, Homo sapiens
catttcctttgttgtctaca

SEQ ID NO: 1675764 - DNA, 20 bp, Homo sapiens
catttcgggaagggcatgca

SEQ ID NO: 1675765 - DNA, 13 bp, Homo sapiens
catttctaattaa

SEQ ID NO: 1675766 - DNA, 12 bp, Homo sapiens
catttctagact

SEQ ID NO: 1675767 - DNA, 14 bp, Homo sapiens
catttctagactca

SEQ ID NO: 1675768 - DNA, 18 bp, Homo sapiens
catttctcaatcagtgca

SEQ ID NO: 1675769 - DNA, 15 bp, Homo sapiens
catttctcactgaaa

SEQ ID NO: 1675770 - DNA, 19 bp, Homo sapiens
catttctcataattttgca

SEQ ID NO: 1675771 - DNA, 20 bp, Homo sapiens
catttctcctttgataaaat

SEQ ID NO: 1675772 - DNA, 20 bp, Homo sapiens
catttctctaactcctgcca

SEQ ID NO: 1675773 - DNA, 21 bp, Homo sapiens
catttctctaactcctgccat

SEQ ID NO: 1675774 - DNA, 13 bp, Homo sapiens
catttctctttaa

SEQ ID NO: 1675775 - DNA, 17 bp, Homo sapiens
catttctgaactgttac

SEQ ID NO: 1675776 - DNA, 16 bp, Homo sapiens
catttctgccagcgca

SEQ ID NO: 1675777 - DNA, 17 bp, Homo sapiens
cattttattaataatat

SEQ ID NO: 1675778 - DNA, 19 bp, Homo sapiens
cattttattttttcttgca

SEQ ID NO: 1675779 - DNA, 17 bp, Homo sapiens
cattttcaccccaccct

SEQ ID NO: 1675780 - DNA, 19 bp, Homo sapiens
cattttcccatcatccttt

SEQ ID NO: 1675781 - DNA, 15 bp, Homo sapiens
cattttccccccact

SEQ ID NO: 1675782 - DNA, 17 bp, Homo sapiens
cattttccccccactct

SEQ ID NO: 1675783 - DNA, 23 bp, Homo sapiens
cattttcctcttgtcctggccct

SEQ ID NO: 1675784 - DNA, 10 bp, Homo sapiens
cattttcctg

SEQ ID NO: 1675785 - DNA, 12 bp, Homo sapiens
cattttcctgag

SEQ ID NO: 1675786 - DNA, 12 bp, Homo sapiens
cattttcctgtt

SEQ ID NO: 1675787 - DNA, 11 bp, Homo sapiens
cattttctaaa

SEQ ID NO: 1675788 - DNA, 17 bp, Homo sapiens
cattttctaaactgttt

SEQ ID NO: 1675789 - DNA, 18 bp, Homo sapiens
cattttctaaactgtttt

SEQ ID NO: 1675790 - DNA, 15 bp, Homo sapiens
cattttctcttagaa

SEQ ID NO: 1675791 - DNA, 16 bp, Homo sapiens
cattttctcttagaaa

SEQ ID NO: 1675792 - DNA, 16 bp, Homo sapiens
cattttcttaatccag

SEQ ID NO: 1675793 - DNA, 20 bp, Homo sapiens
cattttcttattgcgctgct

SEQ ID NO: 1675794 - DNA, 18 bp, Homo sapiens
cattttgacaaagtgcct

SEQ ID NO: 1675795 - DNA, 22 bp, Homo sapiens
cattttgagctgaaatgctgca

SEQ ID NO: 1675796 - DNA, 23 bp, Homo sapiens
cattttgagctgaaatgctgcat

SEQ ID NO: 1675797 - DNA, 22 bp, Homo sapiens
cattttgaggttttgtaaaact

SEQ ID NO: 1675798 - DNA, 23 bp, Homo sapiens
cattttgaggttttgtaaaactg

SEQ ID NO: 1675799 - DNA, 13 bp, Homo sapiens
cattttgcaaaat

SEQ ID NO: 1675800 - DNA, 12 bp, Homo sapiens
cattttgcactg

SEQ ID NO: 1675801 - DNA, 15 bp, Homo sapiens
cattttgcagcagtg

SEQ ID NO: 1675802 - DNA, 14 bp, Homo sapiens
cattttgctttaat

SEQ ID NO: 1675803 - DNA, 20 bp, Homo sapiens
cattttggagagtttcctga

SEQ ID NO: 1675804 - DNA, 22 bp, Homo sapiens
cattttggggctatatttacat

SEQ ID NO: 1675805 - DNA, 17 bp, Homo sapiens
cattttggggttttata

SEQ ID NO: 1675806 - DNA, 18 bp, Homo sapiens
cattttgtgaatttgggt

SEQ ID NO: 1675807 - DNA, 15 bp, Homo sapiens
cattttgtgtgagac

SEQ ID NO: 1675808 - DNA, 21 bp, Homo sapiens
cattttgtgtgagacttaaaa

SEQ ID NO: 1675809 - DNA, 22 bp, Homo sapiens
cattttgtgtgagacttaaaac

SEQ ID NO: 1675810 - DNA, 23 bp, Homo sapiens
cattttgtgtgagacttaaaaca

SEQ ID NO: 1675811 - DNA, 18 bp, Homo sapiens
cattttgtgttgaagagc

SEQ ID NO: 1675812 - DNA, 12 bp, Homo sapiens
cattttgttaca

SEQ ID NO: 1675813 - DNA, 17 bp, Homo sapiens
catttttaaacttgaaa

SEQ ID NO: 1675814 - DNA, 20 bp, Homo sapiens
catttttaaacttgaaatat

SEQ ID NO: 1675815 - DNA, 23 bp, Homo sapiens
catttttaaagtagaagagggtt

SEQ ID NO: 1675816 - DNA, 19 bp, Homo sapiens
catttttaaattcttactc

SEQ ID NO: 1675817 - DNA, 21 bp, Homo sapiens
catttttaagatagaacacaa

SEQ ID NO: 1675818 - DNA, 22 bp, Homo sapiens
catttttaatattactgtcttt

SEQ ID NO: 1675819 - DNA, 19 bp, Homo sapiens
catttttaatgatctcgga

SEQ ID NO: 1675820 - DNA, 13 bp, Homo sapiens
catttttaatgta

SEQ ID NO: 1675821 - DNA, 14 bp, Homo sapiens
catttttaatgtat

SEQ ID NO: 1675822 - DNA, 20 bp, Homo sapiens
catttttaattcacgtgctt

SEQ ID NO: 1675823 - DNA, 21 bp, Homo sapiens
catttttaattcacgtgcttt

SEQ ID NO: 1675824 - DNA, 17 bp, Homo sapiens
catttttacaataaata

SEQ ID NO: 1675825 - DNA, 15 bp, Homo sapiens
catttttatgcagac

SEQ ID NO: 1675826 - DNA, 23 bp, Homo sapiens
catttttattaaagcatttccta

SEQ ID NO: 1675827 - DNA, 10 bp, Homo sapiens
catttttcaa

SEQ ID NO: 1675828 - DNA, 19 bp, Homo sapiens
catttttccgtttgctttt

SEQ ID NO: 1675829 - DNA, 14 bp, Homo sapiens
catttttcctctgt

SEQ ID NO: 1675830 - DNA, 11 bp, Homo sapiens
catttttcctt

SEQ ID NO: 1675831 - DNA, 17 bp, Homo sapiens
catttttctataaatca

SEQ ID NO: 1675832 - DNA, 16 bp, Homo sapiens
catttttctcccaaga

SEQ ID NO: 1675833 - DNA, 16 bp, Homo sapiens
catttttgctgaattc

SEQ ID NO: 1675834 - DNA, 17 bp, Homo sapiens
catttttgctgaattca

SEQ ID NO: 1675835 - DNA, 13 bp, Homo sapiens
cattttttaagaa

SEQ ID NO: 1675836 - DNA, 17 bp, Homo sapiens
cattttttaggtgcttt

SEQ ID NO: 1675837 - DNA, 14 bp, Homo sapiens
cattttttcttccc

SEQ ID NO: 1675838 - DNA, 14 bp, Homo sapiens
cattttttgaaatg

SEQ ID NO: 1675839 - DNA, 17 bp, Homo sapiens
catttttttccaggctg

SEQ ID NO: 1675840 - DNA, 17 bp, Homo sapiens
catttttttctctctgg

SEQ ID NO: 1675841 - DNA, 21 bp, Homo sapiens
catttttttctctctggagcc

SEQ ID NO: 1675842 - DNA, 14 bp, Homo sapiens
catttttttcttta

SEQ ID NO: 1675843 - DNA, 14 bp, Homo sapiens
catttttttgcatg

SEQ ID NO: 1675844 - DNA, 15 bp, Homo sapiens
catttttttttcaat

SEQ ID NO: 1675845 - DNA, 21 bp, Homo sapiens
catttttttttcaatcaactt

SEQ ID NO: 1675846 - DNA, 14 bp, Homo sapiens
ccaaaaaaaggaaa

SEQ ID NO: 1675847 - DNA, 16 bp, Homo sapiens
ccaaaaaaaggaaaaa

SEQ ID NO: 1675848 - DNA, 17 bp, Homo sapiens
ccaaaaaaaggaaaaat

SEQ ID NO: 1675849 - DNA, 19 bp, Homo sapiens
ccaaaaaatgtgagctata

SEQ ID NO: 1675850 - DNA, 19 bp, Homo sapiens
ccaaaaagattttcagaaa

SEQ ID NO: 1675851 - DNA, 14 bp, Homo sapiens
ccaaaaaggcaaat

SEQ ID NO: 1675852 - DNA, 21 bp, Homo sapiens
ccaaaaaggcaaataatggaa

SEQ ID NO: 1675853 - DNA, 22 bp, Homo sapiens
ccaaaaatagaaattagatttg

SEQ ID NO: 1675854 - DNA, 12 bp, Homo sapiens
ccaaaacaaaca

SEQ ID NO: 1675855 - DNA, 13 bp, Homo sapiens
ccaaaacacagga

SEQ ID NO: 1675856 - DNA, 11 bp, Homo sapiens
ccaaaactgct

SEQ ID NO: 1675857 - DNA, 22 bp, Homo sapiens
ccaaaacttctcttgaaaagtt

SEQ ID NO: 1675858 - DNA, 16 bp, Homo sapiens
ccaaaagattgctgaa

SEQ ID NO: 1675859 - DNA, 21 bp, Homo sapiens
ccaaaaggattcctctttgtt

SEQ ID NO: 1675860 - DNA, 19 bp, Homo sapiens
ccaaaaggtttaagaaata

SEQ ID NO: 1675861 - DNA, 17 bp, Homo sapiens
ccaaaagtggctagtcc

SEQ ID NO: 1675862 - DNA, 14 bp, Homo sapiens
ccaaaagttattaa

SEQ ID NO: 1675863 - DNA, 21 bp, Homo sapiens
ccaaaatattatattttttct

SEQ ID NO: 1675864 - DNA, 21 bp, Homo sapiens
ccaaaatgttggtcattttat

SEQ ID NO: 1675865 - DNA, 16 bp, Homo sapiens
ccaaacaaatatgcaa

SEQ ID NO: 1675866 - DNA, 13 bp, Homo sapiens
ccaaacaaggaag

SEQ ID NO: 1675867 - DNA, 21 bp, Homo sapiens
ccaaacaaggaagccaaagtt

SEQ ID NO: 1675868 - DNA, 16 bp, Homo sapiens
ccaaacaccagtcacc

SEQ ID NO: 1675869 - DNA, 15 bp, Homo sapiens
ccaaacactcagtcc

SEQ ID NO: 1675870 - DNA, 16 bp, Homo sapiens
ccaaacagccacactg

SEQ ID NO: 1675871 - DNA, 20 bp, Homo sapiens
ccaaacatcagacctgtctt

SEQ ID NO: 1675872 - DNA, 16 bp, Homo sapiens
ccaaacattcttattt

SEQ ID NO: 1675873 - DNA, 20 bp, Homo sapiens
ccaaacccctagagacagtg

SEQ ID NO: 1675874 - DNA, 19 bp, Homo sapiens
ccaaaccctataaacctga

SEQ ID NO: 1675875 - DNA, 14 bp, Homo sapiens
ccaaaccctcacaa

SEQ ID NO: 1675876 - DNA, 13 bp, Homo sapiens
ccaaaccggcagg

SEQ ID NO: 1675877 - DNA, 18 bp, Homo sapiens
ccaaaccggcaggtgcga

SEQ ID NO: 1675878 - DNA, 13 bp, Homo sapiens
ccaaacctccagc

SEQ ID NO: 1675879 - DNA, 14 bp, Homo sapiens
ccaaacctccagcc

SEQ ID NO: 1675880 - DNA, 17 bp, Homo sapiens
ccaaacctccagcctcc

SEQ ID NO: 1675881 - DNA, 20 bp, Homo sapiens
ccaaactgcacacacagctc

SEQ ID NO: 1675882 - DNA, 19 bp, Homo sapiens
ccaaactgcctaagccctc

SEQ ID NO: 1675883 - DNA, 20 bp, Homo sapiens
ccaaactgtctttgtcacca

SEQ ID NO: 1675884 - DNA, 13 bp, Homo sapiens
ccaaacttccagg

SEQ ID NO: 1675885 - DNA, 12 bp, Homo sapiens
ccaaagaaacaa

SEQ ID NO: 1675886 - DNA, 19 bp, Homo sapiens
ccaaagaaacaagctgtgc

SEQ ID NO: 1675887 - DNA, 22 bp, Homo sapiens
ccaaagaaacactaagctctct

SEQ ID NO: 1675888 - DNA, 15 bp, Homo sapiens
ccaaagacctgcctg

SEQ ID NO: 1675889 - DNA, 15 bp, Homo sapiens
ccaaagactgcagaa

SEQ ID NO: 1675890 - DNA, 12 bp, Homo sapiens
ccaaagaggctg

SEQ ID NO: 1675891 - DNA, 13 bp, Homo sapiens
ccaaagaggctgc

SEQ ID NO: 1675892 - DNA, 17 bp, Homo sapiens
ccaaagaggctgcccct

SEQ ID NO: 1675893 - DNA, 19 bp, Homo sapiens
ccaaagagggcttcctcta

SEQ ID NO: 1675894 - DNA, 23 bp, Homo sapiens
ccaggacttaagacaaatgggac

SEQ ID NO: 1675895 - DNA, 21 bp, Homo sapiens
ccaggacttatttaaactctg

SEQ ID NO: 1675896 - DNA, 13 bp, Homo sapiens
ccaggagaagctc

SEQ ID NO: 1675897 - DNA, 14 bp, Homo sapiens
ccaggagaagctca

SEQ ID NO: 1675898 - DNA, 16 bp, Homo sapiens
ccaggagaagggctgg

SEQ ID NO: 1675899 - DNA, 19 bp, Homo sapiens
ccaggagaagggctggggc

SEQ ID NO: 1675900 - DNA, 22 bp, Homo sapiens
ccaggagaagggggctctgccc

SEQ ID NO: 1675901 - DNA, 19 bp, Homo sapiens
ccaggagaagtgctccctg

SEQ ID NO: 1675902 - DNA, 23 bp, Homo sapiens
ccaggagaataaaagaaattcct

SEQ ID NO: 1675903 - DNA, 17 bp, Homo sapiens
ccaggagacagaccact

SEQ ID NO: 1675904 - DNA, 17 bp, Homo sapiens
ccaggagacctccagct

SEQ ID NO: 1675905 - DNA, 18 bp, Homo sapiens
ccaggagacctgctctcc

SEQ ID NO: 1675906 - DNA, 19 bp, Homo sapiens
ccaggagcagatggacagc

SEQ ID NO: 1675907 - DNA, 21 bp, Homo sapiens
ccaggagcagcagccagcacc

SEQ ID NO: 1675908 - DNA, 22 bp, Homo sapiens
ccaggagcaggacctactagga

SEQ ID NO: 1675909 - DNA, 15 bp, Homo sapiens
ccaggagcaggcacg

SEQ ID NO: 1675910 - DNA, 20 bp, Homo sapiens
ccaggagccgggcctcccac

SEQ ID NO: 1675911 - DNA, 16 bp, Homo sapiens
ccaggagcctgtgcct

SEQ ID NO: 1675912 - DNA, 14 bp, Homo sapiens
ccaggagctctgcg

SEQ ID NO: 1675913 - DNA, 16 bp, Homo sapiens
ccaggagctctgcgcc

SEQ ID NO: 1675914 - DNA, 18 bp, Homo sapiens
ccaggagctctgcgccag

SEQ ID NO: 1675915 - DNA, 22 bp, Homo sapiens
ccaggagctctgcgccaggcag

SEQ ID NO: 1675916 - DNA, 23 bp, Homo sapiens
ccaggagctctgcgccaggcaga

SEQ ID NO: 1675917 - DNA, 13 bp, Homo sapiens
ccaggagctcttc

SEQ ID NO: 1675918 - DNA, 19 bp, Homo sapiens
ccaggagctgagtcacctc

SEQ ID NO: 1675919 - DNA, 21 bp, Homo sapiens
ccaggagctgagtcacctcct

SEQ ID NO: 1675920 - DNA, 16 bp, Homo sapiens
ccaggagctgcccaga

SEQ ID NO: 1675921 - DNA, 16 bp, Homo sapiens
ccaggagctgggcaga

SEQ ID NO: 1675922 - DNA, 23 bp, Homo sapiens
ccaggagctgggcagaaggccaa

SEQ ID NO: 1675923 - DNA, 23 bp, Homo sapiens
ccaggagctgtcaccaaggaaac

SEQ ID NO: 1675924 - DNA, 21 bp, Homo sapiens
ccaggagcttcttgtttcctt

SEQ ID NO: 1675925 - DNA, 24 bp, Homo sapiens
ccaggaggaagtcgggaggcgtgg

SEQ ID NO: 1675926 - DNA, 13 bp, Homo sapiens
ccaggaggcagtg

SEQ ID NO: 1675927 - DNA, 16 bp, Homo sapiens
ccaggaggcagtggac

SEQ ID NO: 1675928 - DNA, 15 bp, Homo sapiens
ccaggaggctgaggt

SEQ ID NO: 1675929 - DNA, 16 bp, Homo sapiens
ccaggaggctgaggtg

SEQ ID NO: 1675930 - DNA, 23 bp, Homo sapiens
ccaggagggtctcgaactcctgg

SEQ ID NO: 1675931 - DNA, 17 bp, Homo sapiens
ccaggagtctgtgctct

SEQ ID NO: 1675932 - DNA, 21 bp, Homo sapiens
ccaggagtttaagaccagcct

SEQ ID NO: 1675933 - DNA, 23 bp, Homo sapiens
ccaggagtttgagacaagccctg

SEQ ID NO: 1675934 - DNA, 20 bp, Homo sapiens
ccaggatactggcacagagg

SEQ ID NO: 1675935 - DNA, 21 bp, Homo sapiens
ccaggatcccaagcctcctgc

SEQ ID NO: 1675936 - DNA, 17 bp, Homo sapiens
ccaggatcctgcaggaa

SEQ ID NO: 1675937 - DNA, 16 bp, Homo sapiens
ccaggatctgctccaa

SEQ ID NO: 1675938 - DNA, 18 bp, Homo sapiens
ccaggatctgctccaaca

SEQ ID NO: 1675939 - DNA, 22 bp, Homo sapiens
ccaggatgacacctccatttct

SEQ ID NO: 1675940 - DNA, 21 bp, Homo sapiens
ccaggatgccacgcctggaag

SEQ ID NO: 1675941 - DNA, 13 bp, Homo sapiens
ccaggatggtctc

SEQ ID NO: 1675942 - DNA, 18 bp, Homo sapiens
ccaggattcccccagcca

SEQ ID NO: 1675943 - DNA, 23 bp, Homo sapiens
ccaggattttaatttcaggaaaa

SEQ ID NO: 1675944 - DNA, 15 bp, Homo sapiens
ccaggcacagctgag

SEQ ID NO: 1675945 - DNA, 15 bp, Homo sapiens
ccaggcacagggccc

SEQ ID NO: 1675946 - DNA, 22 bp, Homo sapiens
ccaggcaccaccaggagcagca

SEQ ID NO: 1675947 - DNA, 17 bp, Homo sapiens
ccaggcaccaggactag

SEQ ID NO: 1675948 - DNA, 16 bp, Homo sapiens
ccaggcacccatgtgg

SEQ ID NO: 1675949 - DNA, 23 bp, Homo sapiens
ccaggcacccatgtgggcgccca

SEQ ID NO: 1675950 - DNA, 14 bp, Homo sapiens
ccaggcacctggcc

SEQ ID NO: 1675951 - DNA, 15 bp, Homo sapiens
ccaggcacctggcct

SEQ ID NO: 1675952 - DNA, 17 bp, Homo sapiens
ccaggcacctggcctgc

SEQ ID NO: 1675953 - DNA, 20 bp, Homo sapiens
ccaggcacctggcctgctgg

SEQ ID NO: 1675954 - DNA, 22 bp, Homo sapiens
ccaggcacctggcctgctggga

SEQ ID NO: 1675955 - DNA, 22 bp, Homo sapiens
ccagggactcagcgtcccctgc

SEQ ID NO: 1675956 - DNA, 18 bp, Homo sapiens
ccagggagactttctgaa

SEQ ID NO: 1675957 - DNA, 19 bp, Homo sapiens
ccagggagactttctgaag

SEQ ID NO: 1675958 - DNA, 17 bp, Homo sapiens
ccagggagcaagacaga

SEQ ID NO: 1675959 - DNA, 13 bp, Homo sapiens
ccagggagccttt

SEQ ID NO: 1675960 - DNA, 22 bp, Homo sapiens
ccagggagcttgaaagttttca

SEQ ID NO: 1675961 - DNA, 20 bp, Homo sapiens
ccagggaggcgatgccagcc

SEQ ID NO: 1675962 - DNA, 22 bp, Homo sapiens
ccagggaggcgatgccagcctt

SEQ ID NO: 1675963 - DNA, 14 bp, Homo sapiens
ccagggaggggccg

SEQ ID NO: 1675964 - DNA, 23 bp, Homo sapiens
ccagggaggggccggccctgtgt

SEQ ID NO: 1675965 - DNA, 16 bp, Homo sapiens
ccagggagtcccctcc

SEQ ID NO: 1675966 - DNA, 14 bp, Homo sapiens
ccagggatgctggg

SEQ ID NO: 1675967 - DNA, 17 bp, Homo sapiens
ccagggatgctgggctg

SEQ ID NO: 1675968 - DNA, 18 bp, Homo sapiens
ccagggatgctgggctgg

SEQ ID NO: 1675969 - DNA, 23 bp, Homo sapiens
ccagggcaagggttaaggcctga

SEQ ID NO: 1675970 - DNA, 14 bp, Homo sapiens
ccagggcagaggaa

SEQ ID NO: 1675971 - DNA, 22 bp, Homo sapiens
ccagggcagcaagggacctgct

SEQ ID NO: 1675972 - DNA, 14 bp, Homo sapiens
ccagggcagcagcc

SEQ ID NO: 1675973 - DNA, 15 bp, Homo sapiens
ccagggcagcagccg

SEQ ID NO: 1675974 - DNA, 13 bp, Homo sapiens
ccagggcagcctc

SEQ ID NO: 1675975 - DNA, 19 bp, Homo sapiens
ccagggcatcttgctggct

SEQ ID NO: 1675976 - DNA, 21 bp, Homo sapiens
ccagggcatcttgctggctac

SEQ ID NO: 1675977 - DNA, 21 bp, Homo sapiens
ccagggcattgctcagcccgc

SEQ ID NO: 1675978 - DNA, 22 bp, Homo sapiens
ccagggcattgctcagcccgct

SEQ ID NO: 1675979 - DNA, 16 bp, Homo sapiens
ccagggccacgctcca

SEQ ID NO: 1675980 - DNA, 18 bp, Homo sapiens
ccagggccacgctccagc

SEQ ID NO: 1675981 - DNA, 17 bp, Homo sapiens
ccagggccacgtgccag

SEQ ID NO: 1675982 - DNA, 18 bp, Homo sapiens
ccagggccagtgggaccc

SEQ ID NO: 1675983 - DNA, 16 bp, Homo sapiens
ccagggcccagagccc

SEQ ID NO: 1675984 - DNA, 19 bp, Homo sapiens
ccagggcccagagcccagc

SEQ ID NO: 1675985 - DNA, 21 bp, Homo sapiens
ccagggcccagagcccagctc

SEQ ID NO: 1675986 - DNA, 22 bp, Homo sapiens
ccagggcccagagcccagctcc

SEQ ID NO: 1675987 - DNA, 17 bp, Homo sapiens
ccagggcccctccctct

SEQ ID NO: 1675988 - DNA, 15 bp, Homo sapiens
ccagggccctcccag

SEQ ID NO: 1675989 - DNA, 14 bp, Homo sapiens
ccagggccctgcag

SEQ ID NO: 1675990 - DNA, 13 bp, Homo sapiens
ccagggcctccag

SEQ ID NO: 1675991 - DNA, 15 bp, Homo sapiens
ccagggcctccaggg

SEQ ID NO: 1675992 - DNA, 12 bp, Homo sapiens
ccagggcctctc

SEQ ID NO: 1675993 - DNA, 16 bp, Homo sapiens
ccagggcctgacaccc

SEQ ID NO: 1675994 - DNA, 13 bp, Homo sapiens
ccagggcctgggg

SEQ ID NO: 1675995 - DNA, 19 bp, Homo sapiens
ccagggcctgggggcagtg

SEQ ID NO: 1675996 - DNA, 12 bp, Homo sapiens
ccagggcctttt

SEQ ID NO: 1675997 - DNA, 15 bp, Homo sapiens
ccagggctcaccagc

SEQ ID NO: 1675998 - DNA, 13 bp, Homo sapiens
ccagggctcagcc

SEQ ID NO: 1675999 - DNA, 14 bp, Homo sapiens
ccagggctcagcct

SEQ ID NO: 1676000 - DNA, 20 bp, Homo sapiens
ccagggctcagcctggtggg

SEQ ID NO: 1676001 - DNA, 12 bp, Homo sapiens
ccagggctccag

SEQ ID NO: 1676002 - DNA, 13 bp, Homo sapiens
ccagggctcctgc

SEQ ID NO: 1676003 - DNA, 15 bp, Homo sapiens
ccagggctcctgtgg

SEQ ID NO: 1676004 - DNA, 22 bp, Homo sapiens
ccagggctcctgtggcagctgc

SEQ ID NO: 1676005 - DNA, 16 bp, Homo sapiens
ccagggctctgcagca

SEQ ID NO: 1676006 - DNA, 22 bp, Homo sapiens
ccagggctctgcagcacctcac

SEQ ID NO: 1676007 - DNA, 17 bp, Homo sapiens
ccagggctctgcaggcc

SEQ ID NO: 1676008 - DNA, 13 bp, Homo sapiens
ccagggctggact

SEQ ID NO: 1676009 - DNA, 11 bp, Homo sapiens
ccagggctggg

SEQ ID NO: 1676010 - DNA, 21 bp, Homo sapiens
ccagggctgggaggaaggact

SEQ ID NO: 1676011 - DNA, 15 bp, Homo sapiens
ccaggggaacctgcc

SEQ ID NO: 1676012 - DNA, 16 bp, Homo sapiens
ccaggggaacctgcca

SEQ ID NO: 1676013 - DNA, 24 bp, Homo sapiens
ccaggggaacctgccatgccagga

SEQ ID NO: 1676014 - DNA, 19 bp, Homo sapiens
ccaggggacccctgccagt

SEQ ID NO: 1676015 - DNA, 15 bp, Homo sapiens
ccaggtccagctctg

SEQ ID NO: 1676016 - DNA, 19 bp, Homo sapiens
ccaggtccagctctggagg

SEQ ID NO: 1676017 - DNA, 15 bp, Homo sapiens
ccaggtcccccgact

SEQ ID NO: 1676018 - DNA, 19 bp, Homo sapiens
ccaggtcccccgactgcct

SEQ ID NO: 1676019 - DNA, 18 bp, Homo sapiens
ccaggtcctttctcctga

SEQ ID NO: 1676020 - DNA, 20 bp, Homo sapiens
ccaggtcctttctcctgata

SEQ ID NO: 1676021 - DNA, 18 bp, Homo sapiens
ccaggtcggagtgcctgg

SEQ ID NO: 1676022 - DNA, 22 bp, Homo sapiens
ccaggtcggagtgcctggagtc

SEQ ID NO: 1676023 - DNA, 17 bp, Homo sapiens
ccaggtcgggcagtgga

SEQ ID NO: 1676024 - DNA, 15 bp, Homo sapiens
ccaggtctcactgct

SEQ ID NO: 1676025 - DNA, 15 bp, Homo sapiens
ccaggtcttgactca

SEQ ID NO: 1676026 - DNA, 21 bp, Homo sapiens
ccaggtcttgactcatggcag

SEQ ID NO: 1676027 - DNA, 22 bp, Homo sapiens
ccaggtggagggcacagccctc

SEQ ID NO: 1676028 - DNA, 23 bp, Homo sapiens
ccaggtggagggtttgcactcca

SEQ ID NO: 1676029 - DNA, 19 bp, Homo sapiens
ccaggtggctgacccagtc

SEQ ID NO: 1676030 - DNA, 22 bp, Homo sapiens
ccaggtggttgggttctgcctt

SEQ ID NO: 1676031 - DNA, 15 bp, Homo sapiens
ccaggtgtgcctgtg

SEQ ID NO: 1676032 - DNA, 16 bp, Homo sapiens
ccaggtgtgcctgtgc

SEQ ID NO: 1676033 - DNA, 18 bp, Homo sapiens
ccaggtgtgcctgtgctc

SEQ ID NO: 1676034 - DNA, 20 bp, Homo sapiens
ccaggtgtgcctgtgctcct

SEQ ID NO: 1676035 - DNA, 21 bp, Homo sapiens
ccaggtgtgcctgtgctcctg

SEQ ID NO: 1676036 - DNA, 23 bp, Homo sapiens
ccaggtgtgcctgtgctcctgcc

SEQ ID NO: 1676037 - DNA, 15 bp, Homo sapiens
ccaggtgttgccatt

SEQ ID NO: 1676038 - DNA, 20 bp, Homo sapiens
ccaggttcaacccacagcta

SEQ ID NO: 1676039 - DNA, 22 bp, Homo sapiens
ccaggttcctgtactactgcct

SEQ ID NO: 1676040 - DNA, 22 bp, Homo sapiens
ccaggttctccgttagctcctg

SEQ ID NO: 1676041 - DNA, 13 bp, Homo sapiens
ccaggttgcagct

SEQ ID NO: 1676042 - DNA, 19 bp, Homo sapiens
ccaggttgcagctgctctt

SEQ ID NO: 1676043 - DNA, 21 bp, Homo sapiens
ccaggttgcagctgctcttgc

SEQ ID NO: 1676044 - DNA, 17 bp, Homo sapiens
ccaggtttgatgcctgt

SEQ ID NO: 1676045 - DNA, 21 bp, Homo sapiens
ccagtaacgcgtcttcctgag

SEQ ID NO: 1676046 - DNA, 13 bp, Homo sapiens
ccagtaacttttt

SEQ ID NO: 1676047 - DNA, 16 bp, Homo sapiens
ccagtaacttttttgt

SEQ ID NO: 1676048 - DNA, 17 bp, Homo sapiens
ccagtacaagatctcag

SEQ ID NO: 1676049 - DNA, 19 bp, Homo sapiens
ccagtacagtattctttta

SEQ ID NO: 1676050 - DNA, 12 bp, Homo sapiens
ccagtacctcca

SEQ ID NO: 1676051 - DNA, 17 bp, Homo sapiens
ccagtacctttgtcaca

SEQ ID NO: 1676052 - DNA, 19 bp, Homo sapiens
ccagtacgtcccgctgctg

SEQ ID NO: 1676053 - DNA, 20 bp, Homo sapiens
ccagtacgtcccgctgctgt

SEQ ID NO: 1676054 - DNA, 16 bp, Homo sapiens
ccagtacgtgctaaca

SEQ ID NO: 1676055 - DNA, 13 bp, Homo sapiens
ccagtagtcagaa

SEQ ID NO: 1676056 - DNA, 14 bp, Homo sapiens
ccagtatctatata

SEQ ID NO: 1676057 - DNA, 15 bp, Homo sapiens
ccagtatctcttcag

SEQ ID NO: 1676058 - DNA, 16 bp, Homo sapiens
ccagtatctcttcagt

SEQ ID NO: 1676059 - DNA, 14 bp, Homo sapiens
ccagtattgccccc

SEQ ID NO: 1676060 - DNA, 9 bp, Homo sapiens
ccagtattt

SEQ ID NO: 1676061 - DNA, 22 bp, Homo sapiens
ccagtatttttatacggaaaaa

SEQ ID NO: 1676062 - DNA, 12 bp, Homo sapiens
ccagtcactgct

SEQ ID NO: 1676063 - DNA, 14 bp, Homo sapiens
ccagtcactgctgc

SEQ ID NO: 1676064 - DNA, 17 bp, Homo sapiens
ccagtcagatgaggcaa

SEQ ID NO: 1676065 - DNA, 21 bp, Homo sapiens
ccagtcagggacagcagcctc

SEQ ID NO: 1676066 - DNA, 16 bp, Homo sapiens
ccagtccaggctgccg

SEQ ID NO: 1676067 - DNA, 15 bp, Homo sapiens
ccagtccatgctcca

SEQ ID NO: 1676068 - DNA, 19 bp, Homo sapiens
ccagtcccagacaattcca

SEQ ID NO: 1676069 - DNA, 17 bp, Homo sapiens
ccagtccccgaggagct

SEQ ID NO: 1676070 - DNA, 15 bp, Homo sapiens
ccagtccccgtgccc

SEQ ID NO: 1676071 - DNA, 21 bp, Homo sapiens
ccagtccctcgccgtccctcc

SEQ ID NO: 1676072 - DNA, 16 bp, Homo sapiens
ccagtccctggagctg

SEQ ID NO: 1676073 - DNA, 12 bp, Homo sapiens
ccagtccctggg

SEQ ID NO: 1676074 - DNA, 23 bp, Homo sapiens
ccagtccctgggggaagccctgg

SEQ ID NO: 1676075 - DNA, 15 bp, Homo sapiens
ccagtcctgcctggc

SEQ ID NO: 1676076 - DNA, 13 bp, Homo sapiens
ccagtcctggtcc

SEQ ID NO: 1676077 - DNA, 19 bp, Homo sapiens
ccagtcctggtcctggctg

SEQ ID NO: 1676078 - DNA, 17 bp, Homo sapiens
ccagtcggccccatctc

SEQ ID NO: 1676079 - DNA, 22 bp, Homo sapiens
ccagtctatttccactgaacaa

SEQ ID NO: 1676080 - DNA, 22 bp, Homo sapiens
ccagtctcccaggccccctgca

SEQ ID NO: 1676081 - DNA, 12 bp, Homo sapiens
ccagtctgtgga

SEQ ID NO: 1676082 - DNA, 19 bp, Homo sapiens
ccagtcttcctcttagcct

SEQ ID NO: 1676083 - DNA, 13 bp, Homo sapiens
ccagtcttgccta

SEQ ID NO: 1676084 - DNA, 12 bp, Homo sapiens
ccagtcttgtgt

SEQ ID NO: 1676085 - DNA, 15 bp, Homo sapiens
ccagtgaacattccc

SEQ ID NO: 1676086 - DNA, 22 bp, Homo sapiens
ccagtgaacattcccagcccag

SEQ ID NO: 1676087 - DNA, 21 bp, Homo sapiens
ccagtgaacttacacttggag

SEQ ID NO: 1676088 - DNA, 23 bp, Homo sapiens
ccagtgaacttacacttggagcc

SEQ ID NO: 1676089 - DNA, 15 bp, Homo sapiens
ccagtgaagcctctg

SEQ ID NO: 1676090 - DNA, 18 bp, Homo sapiens
ccagtgacagacaggctc

SEQ ID NO: 1676091 - DNA, 21 bp, Homo sapiens
ccagtgacagacaggctctta

SEQ ID NO: 1676092 - DNA, 18 bp, Homo sapiens
ccagtgagtacctgcaaa

SEQ ID NO: 1676093 - DNA, 17 bp, Homo sapiens
ccagtgagtggccccac

SEQ ID NO: 1676094 - DNA, 14 bp, Homo sapiens
ccagtggccggttg

SEQ ID NO: 1676095 - DNA, 17 bp, Homo sapiens
ccagtggctgttctgga

SEQ ID NO: 1676096 - DNA, 16 bp, Homo sapiens
ccagtgggaccctctc

SEQ ID NO: 1676097 - DNA, 14 bp, Homo sapiens
ccagtgggaggggc

SEQ ID NO: 1676098 - DNA, 16 bp, Homo sapiens
ccagtgggaggggcag

SEQ ID NO: 1676099 - DNA, 20 bp, Homo sapiens
ccagtgggaggggcaggctg

SEQ ID NO: 1676100 - DNA, 21 bp, Homo sapiens
ccagtgggaggggcaggctga

SEQ ID NO: 1676101 - DNA, 22 bp, Homo sapiens
ccagtgggaggggcaggctgac

SEQ ID NO: 1676102 - DNA, 19 bp, Homo sapiens
ccagtgggccagccacaga

SEQ ID NO: 1676103 - DNA, 20 bp, Homo sapiens
ccagtgggccagccacagag

SEQ ID NO: 1676104 - DNA, 14 bp, Homo sapiens
ccagtggggtcccc

SEQ ID NO: 1676105 - DNA, 16 bp, Homo sapiens
ccagtgggtctgggat

SEQ ID NO: 1676106 - DNA, 20 bp, Homo sapiens
ccagtggtcatgctcagcct

SEQ ID NO: 1676107 - DNA, 22 bp, Homo sapiens
ccagtggtgggtaattgtacaa

SEQ ID NO: 1676108 - DNA, 23 bp, Homo sapiens
ccagtggtgggtaattgtacaat

SEQ ID NO: 1676109 - DNA, 19 bp, Homo sapiens
ccagtggtttccagtcatg

SEQ ID NO: 1676110 - DNA, 12 bp, Homo sapiens
ccagtgtacagg

SEQ ID NO: 1676111 - DNA, 14 bp, Homo sapiens
ccagtgtagccttg

SEQ ID NO: 1676112 - DNA, 15 bp, Homo sapiens
ccagtgtagccttgc

SEQ ID NO: 1676113 - DNA, 17 bp, Homo sapiens
ccagtgtcctcccctca

SEQ ID NO: 1676114 - DNA, 18 bp, Homo sapiens
ccagtgtgggcttgacca

SEQ ID NO: 1676115 - DNA, 19 bp, Homo sapiens
ccagtgttctgcatggatt

SEQ ID NO: 1676116 - DNA, 17 bp, Homo sapiens
ccagtgttggctgtgtg

SEQ ID NO: 1676117 - DNA, 23 bp, Homo sapiens
ccagtgttggctgtgtgacagaa

SEQ ID NO: 1676118 - DNA, 18 bp, Homo sapiens
ccagtgttgtttgtaaat

SEQ ID NO: 1676119 - DNA, 21 bp, Homo sapiens
ccagtgttgtttgtaaataag

SEQ ID NO: 1676120 - DNA, 21 bp, Homo sapiens
ccagtgtttgggatgaccagg

SEQ ID NO: 1676121 - DNA, 13 bp, Homo sapiens
ccagttaaagatt

SEQ ID NO: 1676122 - DNA, 14 bp, Homo sapiens
ccagttaaagatta

SEQ ID NO: 1676123 - DNA, 15 bp, Homo sapiens
ccagttaaagattat

SEQ ID NO: 1676124 - DNA, 18 bp, Homo sapiens
ccagttaatttttccaac

SEQ ID NO: 1676125 - DNA, 21 bp, Homo sapiens
ccagttatggctataggtgct

SEQ ID NO: 1676126 - DNA, 12 bp, Homo sapiens
ccagttcaaagt

SEQ ID NO: 1676127 - DNA, 19 bp, Homo sapiens
ccagttcaaagtgtatatt

SEQ ID NO: 1676128 - DNA, 13 bp, Homo sapiens
ccagttcaccctg

SEQ ID NO: 1676129 - DNA, 20 bp, Homo sapiens
ccagttcagaaatttggcat

SEQ ID NO: 1676130 - DNA, 18 bp, Homo sapiens
ccagttcaggagtcccaa

SEQ ID NO: 1676131 - DNA, 13 bp, Homo sapiens
ccagttcctatga

SEQ ID NO: 1676132 - DNA, 17 bp, Homo sapiens
ccagttcctatgacaca

SEQ ID NO: 1676133 - DNA, 16 bp, Homo sapiens
ccagttcctcttttgt

SEQ ID NO: 1676134 - DNA, 13 bp, Homo sapiens
ccagttctctgtg

SEQ ID NO: 1676135 - DNA, 17 bp, Homo sapiens
ccagttgaataaaagtg

SEQ ID NO: 1676136 - DNA, 18 bp, Homo sapiens
ccagttgaataaaagtgc

SEQ ID NO: 1676137 - DNA, 18 bp, Homo sapiens
ccagttgcactcaggtga

SEQ ID NO: 1676138 - DNA, 22 bp, Homo sapiens
ccagttgccaaagttttgctgt

SEQ ID NO: 1676139 - DNA, 23 bp, Homo sapiens
ccagttgctgatccctgctctct

SEQ ID NO: 1676140 - DNA, 13 bp, Homo sapiens
ccagttggacaca

SEQ ID NO: 1676141 - DNA, 20 bp, Homo sapiens
ccagttgggagcactggagt

SEQ ID NO: 1676142 - DNA, 19 bp, Homo sapiens
ccagttggtgactgggaaa

SEQ ID NO: 1676143 - DNA, 21 bp, Homo sapiens
ccagtttatggatatgctgct

SEQ ID NO: 1676144 - DNA, 22 bp, Homo sapiens
ccagtttccccatggggctgcg

SEQ ID NO: 1676145 - DNA, 11 bp, Homo sapiens
ccagtttctcc

SEQ ID NO: 1676146 - DNA, 13 bp, Homo sapiens
ccagtttctttgt

SEQ ID NO: 1676147 - DNA, 14 bp, Homo sapiens
ccagtttgcagaaa

SEQ ID NO: 1676148 - DNA, 12 bp, Homo sapiens
ccagttttcatt

SEQ ID NO: 1676149 - DNA, 12 bp, Homo sapiens
ccagttttccct

SEQ ID NO: 1676150 - DNA, 14 bp, Homo sapiens
ccagttttccctgg

SEQ ID NO: 1676151 - DNA, 16 bp, Homo sapiens
ccagttttccctggaa

SEQ ID NO: 1676152 - DNA, 20 bp, Homo sapiens
ccagttttccctggaactcc

SEQ ID NO: 1676153 - DNA, 17 bp, Homo sapiens
ccagttttggaggctga

SEQ ID NO: 1676154 - DNA, 21 bp, Homo sapiens
ccataaacagcacacctgtgt

SEQ ID NO: 1676155 - DNA, 23 bp, Homo sapiens
ccataaacagcacacctgtgtcc

SEQ ID NO: 1676156 - DNA, 19 bp, Homo sapiens
ccataaagacaatcactgc

SEQ ID NO: 1676157 - DNA, 21 bp, Homo sapiens
ccataaagggtgtaggggcca

SEQ ID NO: 1676158 - DNA, 15 bp, Homo sapiens
ccataaatgtgttcc

SEQ ID NO: 1676159 - DNA, 21 bp, Homo sapiens
ccataacaccgtcccagggct

SEQ ID NO: 1676160 - DNA, 23 bp, Homo sapiens
ccataagaggagtaggccctggt

SEQ ID NO: 1676161 - DNA, 20 bp, Homo sapiens
ccataaggtttcgtttctgt

SEQ ID NO: 1676162 - DNA, 22 bp, Homo sapiens
ccataaggtttcgtttctgtat

SEQ ID NO: 1676163 - DNA, 22 bp, Homo sapiens
ccataataagagaatgttccta

SEQ ID NO: 1676164 - DNA, 16 bp, Homo sapiens
ccataatcctagcccc

SEQ ID NO: 1676165 - DNA, 23 bp, Homo sapiens
ccataatgctaatttaaagagac

SEQ ID NO: 1676166 - DNA, 14 bp, Homo sapiens
ccatacaatgtatg

SEQ ID NO: 1676167 - DNA, 18 bp, Homo sapiens
ccatacaatgtatgtaca

SEQ ID NO: 1676168 - DNA, 20 bp, Homo sapiens
ccatacaatgtatgtacaat

SEQ ID NO: 1676169 - DNA, 20 bp, Homo sapiens
ccatacactttgttgcaaga

SEQ ID NO: 1676170 - DNA, 13 bp, Homo sapiens
ccatacagcctct

SEQ ID NO: 1676171 - DNA, 23 bp, Homo sapiens
ccataccttccttccctgggctg

SEQ ID NO: 1676172 - DNA, 13 bp, Homo sapiens
ccataccttttct

SEQ ID NO: 1676173 - DNA, 20 bp, Homo sapiens
ccatactccttgcttcctga

SEQ ID NO: 1676174 - DNA, 19 bp, Homo sapiens
ccatactttgtctgaaaaa

SEQ ID NO: 1676175 - DNA, 17 bp, Homo sapiens
ccatacttttggctcct

SEQ ID NO: 1676176 - DNA, 14 bp, Homo sapiens
ccatagaaaaatgt

SEQ ID NO: 1676177 - DNA, 17 bp, Homo sapiens
ccatagaaacatgacac

SEQ ID NO: 1676178 - DNA, 22 bp, Homo sapiens
ccatagaaacatgacactgacc

SEQ ID NO: 1676179 - DNA, 24 bp, Homo sapiens
ccatagacctacagacctggctct

SEQ ID NO: 1676180 - DNA, 14 bp, Homo sapiens
ccatagaggcccag

SEQ ID NO: 1676181 - DNA, 18 bp, Homo sapiens
ccatagaggcccaggcac

SEQ ID NO: 1676182 - DNA, 21 bp, Homo sapiens
ccatagaggcccaggcaccac

SEQ ID NO: 1676183 - DNA, 19 bp, Homo sapiens
ccatgtattcacacacccc

SEQ ID NO: 1676184 - DNA, 16 bp, Homo sapiens
ccatgtcacctcagct

SEQ ID NO: 1676185 - DNA, 19 bp, Homo sapiens
ccatgtccaaagaggctgc

SEQ ID NO: 1676186 - DNA, 16 bp, Homo sapiens
ccatgtcccaccctcc

SEQ ID NO: 1676187 - DNA, 11 bp, Homo sapiens
ccatgtccccc

SEQ ID NO: 1676188 - DNA, 15 bp, Homo sapiens
ccatgtcctcagcat

SEQ ID NO: 1676189 - DNA, 23 bp, Homo sapiens
ccatgtctgagcggcgcagagcc

SEQ ID NO: 1676190 - DNA, 17 bp, Homo sapiens
ccatgtgcaataagatt

SEQ ID NO: 1676191 - DNA, 15 bp, Homo sapiens
ccatgtgcctgcacc

SEQ ID NO: 1676192 - DNA, 18 bp, Homo sapiens
ccatgtgcctttctttgc

SEQ ID NO: 1676193 - DNA, 21 bp, Homo sapiens
ccatgtgctagtcactggcag

SEQ ID NO: 1676194 - DNA, 23 bp, Homo sapiens
ccatgtgctgcggtcactcaggc

SEQ ID NO: 1676195 - DNA, 20 bp, Homo sapiens
ccatgtggaaggcaagccag

SEQ ID NO: 1676196 - DNA, 18 bp, Homo sapiens
ccatgtgggcgcccaccc

SEQ ID NO: 1676197 - DNA, 21 bp, Homo sapiens
ccatgtgggcgcccaccctgg

SEQ ID NO: 1676198 - DNA, 18 bp, Homo sapiens
ccatgtggtggcacaggc

SEQ ID NO: 1676199 - DNA, 14 bp, Homo sapiens
cccagcacctgctc

SEQ ID NO: 1676200 - DNA, 13 bp, Homo sapiens
cccagcacctgga

SEQ ID NO: 1676201 - DNA, 16 bp, Homo sapiens
cccagcactaaagcag

SEQ ID NO: 1676202 - DNA, 13 bp, Homo sapiens
cccagcactgagg

SEQ ID NO: 1676203 - DNA, 15 bp, Homo sapiens
cccagcactgaggaa

SEQ ID NO: 1676204 - DNA, 24 bp, Homo sapiens
cccagcactgaggaagaacggggc

SEQ ID NO: 1676205 - DNA, 13 bp, Homo sapiens
cccagcactgtga

SEQ ID NO: 1676206 - DNA, 22 bp, Homo sapiens
cccagcactgtgaagacccagc

SEQ ID NO: 1676207 - DNA, 20 bp, Homo sapiens
cccagcactttgagaggctg

SEQ ID NO: 1676208 - DNA, 20 bp, Homo sapiens
cccagcactttgggaggcag

SEQ ID NO: 1676209 - DNA, 20 bp, Homo sapiens
cccagcactttgggaggctg

SEQ ID NO: 1676210 - DNA, 21 bp, Homo sapiens
cccagcactttgggaggctga

SEQ ID NO: 1676211 - DNA, 22 bp, Homo sapiens
cccagcagccctaaggatctct

SEQ ID NO: 1676212 - DNA, 21 bp, Homo sapiens
cccagcaggaagccaggctga

SEQ ID NO: 1676213 - DNA, 16 bp, Homo sapiens
cccagcaggcccagca

SEQ ID NO: 1676214 - DNA, 13 bp, Homo sapiens
cccagcagggcct

SEQ ID NO: 1676215 - DNA, 12 bp, Homo sapiens
cccagcatctcc

SEQ ID NO: 1676216 - DNA, 13 bp, Homo sapiens
cccagcatgcagg

SEQ ID NO: 1676217 - DNA, 20 bp, Homo sapiens
cccagcattccagctctgcc

SEQ ID NO: 1676218 - DNA, 21 bp, Homo sapiens
cccagcattccagctctgccc

SEQ ID NO: 1676219 - DNA, 22 bp, Homo sapiens
cccagcattccagctctgcccc

SEQ ID NO: 1676220 - DNA, 18 bp, Homo sapiens
cccagccacgcagggcca

SEQ ID NO: 1676221 - DNA, 22 bp, Homo sapiens
cccagccacggacgctggctcc

SEQ ID NO: 1676222 - DNA, 13 bp, Homo sapiens
cccagccatctgc

SEQ ID NO: 1676223 - DNA, 18 bp, Homo sapiens
cccagccatctgcccagg

SEQ ID NO: 1676224 - DNA, 23 bp, Homo sapiens
cccagccatctgcccaggggtgc

SEQ ID NO: 1676225 - DNA, 22 bp, Homo sapiens
cccagccattaccatggagaca

SEQ ID NO: 1676226 - DNA, 13 bp, Homo sapiens
cccagcccaataa

SEQ ID NO: 1676227 - DNA, 15 bp, Homo sapiens
cccagcccaataaag

SEQ ID NO: 1676228 - DNA, 12 bp, Homo sapiens
cccagcccagag

SEQ ID NO: 1676229 - DNA, 14 bp, Homo sapiens
cccagcccagagac

SEQ ID NO: 1676230 - DNA, 16 bp, Homo sapiens
cccagcccagagacat

SEQ ID NO: 1676231 - DNA, 21 bp, Homo sapiens
cccagcccagagccacctgga

SEQ ID NO: 1676232 - DNA, 16 bp, Homo sapiens
cccagcccagctggtg

SEQ ID NO: 1676233 - DNA, 18 bp, Homo sapiens
cccagcccattgctgcca

SEQ ID NO: 1676234 - DNA, 15 bp, Homo sapiens
cccagccccagcccc

SEQ ID NO: 1676235 - DNA, 15 bp, Homo sapiens
cccagcccctactgc

SEQ ID NO: 1676236 - DNA, 14 bp, Homo sapiens
cccagcccctgccc

SEQ ID NO: 1676237 - DNA, 15 bp, Homo sapiens
cccagcccctgcccc

SEQ ID NO: 1676238 - DNA, 16 bp, Homo sapiens
cccagcccctgcccct

SEQ ID NO: 1676239 - DNA, 22 bp, Homo sapiens
cccagccctgggaaccactccc

SEQ ID NO: 1676240 - DNA, 20 bp, Homo sapiens
cccagcccttctgcctttct

SEQ ID NO: 1676241 - DNA, 17 bp, Homo sapiens
cccagccggcctctctg

SEQ ID NO: 1676242 - DNA, 23 bp, Homo sapiens
cccagccggcctctctggcctcc

SEQ ID NO: 1676243 - DNA, 17 bp, Homo sapiens
cccagcctccctgaagc

SEQ ID NO: 1676244 - DNA, 16 bp, Homo sapiens
cccagcctcgttggag

SEQ ID NO: 1676245 - DNA, 20 bp, Homo sapiens
cccagcctgggagcccagag

SEQ ID NO: 1676246 - DNA, 13 bp, Homo sapiens
cccagcgcggcca

SEQ ID NO: 1676247 - DNA, 14 bp, Homo sapiens
cccagcgcggccag

SEQ ID NO: 1676248 - DNA, 23 bp, Homo sapiens
cccagcggccccccgcacagcca

SEQ ID NO: 1676249 - DNA, 22 bp, Homo sapiens
cccagcggctggtgcagggcct

SEQ ID NO: 1676250 - DNA, 22 bp, Homo sapiens
cccagcggtttccacttgtggg

SEQ ID NO: 1676251 - DNA, 24 bp, Homo sapiens
cccagcgtttagtttctagaggcc

SEQ ID NO: 1676252 - DNA, 17 bp, Homo sapiens
cccagctaagaacctgg

SEQ ID NO: 1676253 - DNA, 20 bp, Homo sapiens
cccagctaagaacctggaac

SEQ ID NO: 1676254 - DNA, 15 bp, Homo sapiens
cccagctaataaacc

SEQ ID NO: 1676255 - DNA, 16 bp, Homo sapiens
cccagctaataaacca

SEQ ID NO: 1676256 - DNA, 19 bp, Homo sapiens
cccagctaatctgtagggc

SEQ ID NO: 1676257 - DNA, 20 bp, Homo sapiens
cccagctaatctgtagggct

SEQ ID NO: 1676258 - DNA, 17 bp, Homo sapiens
cccagctacattcctca

SEQ ID NO: 1676259 - DNA, 21 bp, Homo sapiens
cccagctacattcctcagctg

SEQ ID NO: 1676260 - DNA, 18 bp, Homo sapiens
cccagctaccaagtcaga

SEQ ID NO: 1676261 - DNA, 20 bp, Homo sapiens
cccagctacgtgggaggctg

SEQ ID NO: 1676262 - DNA, 17 bp, Homo sapiens
cccagctactctgtcca

SEQ ID NO: 1676263 - DNA, 18 bp, Homo sapiens
cccagctactctgtccag

SEQ ID NO: 1676264 - DNA, 17 bp, Homo sapiens
cccagctactggggagg

SEQ ID NO: 1676265 - DNA, 18 bp, Homo sapiens
cccagctaggaagagcag

SEQ ID NO: 1676266 - DNA, 13 bp, Homo sapiens
cccagctccaggg

SEQ ID NO: 1676267 - DNA, 16 bp, Homo sapiens
cccagctccccaggac

SEQ ID NO: 1676268 - DNA, 15 bp, Homo sapiens
cccagctccctagga

SEQ ID NO: 1676269 - DNA, 15 bp, Homo sapiens
cccagctccgcctgc

SEQ ID NO: 1676270 - DNA, 19 bp, Homo sapiens
cccagctccgcctgctggg

SEQ ID NO: 1676271 - DNA, 17 bp, Homo sapiens
cccagctcgctggcttt

SEQ ID NO: 1676272 - DNA, 19 bp, Homo sapiens
cccagctcgctggctttct

SEQ ID NO: 1676273 - DNA, 12 bp, Homo sapiens
cccagctctccc

SEQ ID NO: 1676274 - DNA, 13 bp, Homo sapiens
cccagctctccct

SEQ ID NO: 1676275 - DNA, 18 bp, Homo sapiens
cccagctctccctctggc

SEQ ID NO: 1676276 - DNA, 13 bp, Homo sapiens
cccagctctctga

SEQ ID NO: 1676277 - DNA, 16 bp, Homo sapiens
cccagctctctgacgc

SEQ ID NO: 1676278 - DNA, 13 bp, Homo sapiens
cccagctctggat

SEQ ID NO: 1676279 - DNA, 19 bp, Homo sapiens
cccagctctggatgaaggc

SEQ ID NO: 1676280 - DNA, 15 bp, Homo sapiens
cccagctctggtgag

SEQ ID NO: 1676281 - DNA, 15 bp, Homo sapiens
cccagctcttctctt

SEQ ID NO: 1676282 - DNA, 18 bp, Homo sapiens
cccagctcttctcttcct

SEQ ID NO: 1676283 - DNA, 14 bp, Homo sapiens
cccagctcttgctc

SEQ ID NO: 1676284 - DNA, 18 bp, Homo sapiens
cccagctcttgctctctt

SEQ ID NO: 1676285 - DNA, 19 bp, Homo sapiens
cccagctcttgctctcttg

SEQ ID NO: 1676286 - DNA, 20 bp, Homo sapiens
cccagctcttgctctcttgt

SEQ ID NO: 1676287 - DNA, 21 bp, Homo sapiens
cccagctcttgctctcttgtg

SEQ ID NO: 1676288 - DNA, 17 bp, Homo sapiens
cccagctgaaggcagtg

SEQ ID NO: 1676289 - DNA, 18 bp, Homo sapiens
cccagctgaaggcagtgg

SEQ ID NO: 1676290 - DNA, 17 bp, Homo sapiens
cccagctgacatggaaa

SEQ ID NO: 1676291 - DNA, 22 bp, Homo sapiens
cccagctgagtctatgtaggtg

SEQ ID NO: 1676292 - DNA, 23 bp, Homo sapiens
cccagctgcacctgccagcctgg

SEQ ID NO: 1676293 - DNA, 13 bp, Homo sapiens
cccagctgccgcc

SEQ ID NO: 1676294 - DNA, 22 bp, Homo sapiens
cccagctgggaggcaagagggg

SEQ ID NO: 1676295 - DNA, 12 bp, Homo sapiens
cccagctgggct

SEQ ID NO: 1676296 - DNA, 20 bp, Homo sapiens
cccagctgggctctgccacc

SEQ ID NO: 1676297 - DNA, 24 bp, Homo sapiens
cccagctgggctctgccaccctac

SEQ ID NO: 1676298 - DNA, 13 bp, Homo sapiens
cccagctggtggc

SEQ ID NO: 1676299 - DNA, 19 bp, Homo sapiens
cccaggggtgccccctcct

SEQ ID NO: 1676300 - DNA, 21 bp, Homo sapiens
cccaggggtgccccctcctct

SEQ ID NO: 1676301 - DNA, 19 bp, Homo sapiens
cccagggttaatagggcct

SEQ ID NO: 1676302 - DNA, 14 bp, Homo sapiens
cccaggtaccagct

SEQ ID NO: 1676303 - DNA, 15 bp, Homo sapiens
cccaggtaccagctg

SEQ ID NO: 1676304 - DNA, 17 bp, Homo sapiens
cccaggtaccagctgcg

SEQ ID NO: 1676305 - DNA, 19 bp, Homo sapiens
cccaggtaccagctgcgct

SEQ ID NO: 1676306 - DNA, 13 bp, Homo sapiens
cccaggtccttcc

SEQ ID NO: 1676307 - DNA, 16 bp, Homo sapiens
cccaggtcgggcagtg

SEQ ID NO: 1676308 - DNA, 19 bp, Homo sapiens
cccaggtggagggcacagc

SEQ ID NO: 1676309 - DNA, 15 bp, Homo sapiens
cccaggtggcctgga

SEQ ID NO: 1676310 - DNA, 19 bp, Homo sapiens
cccaggtggctgacccagt

SEQ ID NO: 1676311 - DNA, 22 bp, Homo sapiens
cccaggtggctgacccagtccc

SEQ ID NO: 1676312 - DNA, 21 bp, Homo sapiens
cccaggtgtgcctgtgctcct

SEQ ID NO: 1676313 - DNA, 21 bp, Homo sapiens
cccaggtgttaacattccaag

SEQ ID NO: 1676314 - DNA, 18 bp, Homo sapiens
cccaggttggagtgcagt

SEQ ID NO: 1676315 - DNA, 19 bp, Homo sapiens
cccaggttggagtgcagtg

SEQ ID NO: 1676316 - DNA, 18 bp, Homo sapiens
cccaggtttttcatctga

SEQ ID NO: 1676317 - DNA, 16 bp, Homo sapiens
cccagtagaccttgtt

SEQ ID NO: 1676318 - DNA, 14 bp, Homo sapiens
cccacagaactgct

SEQ ID NO: 1676319 - DNA, 15 bp, Homo sapiens
cccacagaactgctt

SEQ ID NO: 1676320 - DNA, 17 bp, Homo sapiens
cccacagaactgcttac

SEQ ID NO: 1676321 - DNA, 21 bp, Homo sapiens
cccactctaggggtcaggctc

SEQ ID NO: 1676322 - DNA, 21 bp, Homo sapiens
cccactctcattccccaggtg

SEQ ID NO: 1676323 - DNA, 15 bp, Homo sapiens
cccactctccccaca

SEQ ID NO: 1676324 - DNA, 21 bp, Homo sapiens
cccactctgtaatagttcagt

SEQ ID NO: 1676325 - DNA, 19 bp, Homo sapiens
cccactgcaggccccgctt

SEQ ID NO: 1676326 - DNA, 18 bp, Homo sapiens
cccactgccacaccctcc

SEQ ID NO: 1676327 - DNA, 13 bp, Homo sapiens
cccactgccagca

SEQ ID NO: 1676328 - DNA, 12 bp, Homo sapiens
cccactgcccac

SEQ ID NO: 1676329 - DNA, 19 bp, Homo sapiens
cccactgcccaccccctca

SEQ ID NO: 1676330 - DNA, 22 bp, Homo sapiens
cccactgctcgtggactgtgct

SEQ ID NO: 1676331 - DNA, 15 bp, Homo sapiens
cccactgctggctgc

SEQ ID NO: 1676332 - DNA, 19 bp, Homo sapiens
cccactgggaccaaccctg

SEQ ID NO: 1676333 - DNA, 13 bp, Homo sapiens
cccactgggccag

SEQ ID NO: 1676334 - DNA, 20 bp, Homo sapiens
cccactgggccagccctgca

SEQ ID NO: 1676335 - DNA, 22 bp, Homo sapiens
cccactggggccggcggggccc

SEQ ID NO: 1676336 - DNA, 22 bp, Homo sapiens
cccactgtcctgggcctgcaga

SEQ ID NO: 1676337 - DNA, 17 bp, Homo sapiens
cccactgtcctgggcgc

SEQ ID NO: 1676338 - DNA, 16 bp, Homo sapiens
cccactgtgcctcaga

SEQ ID NO: 1676339 - DNA, 19 bp, Homo sapiens
cccacttagccgcaccctg

SEQ ID NO: 1676340 - DNA, 21 bp, Homo sapiens
cccacttagccgtccatggca

SEQ ID NO: 1676341 - DNA, 23 bp, Homo sapiens
cccacttagccgtccatggcacc

SEQ ID NO: 1676342 - DNA, 19 bp, Homo sapiens
cccacttcagaaggtaggg

SEQ ID NO: 1676343 - DNA, 17 bp, Homo sapiens
cccacttcccaccctgc

SEQ ID NO: 1676344 - DNA, 21 bp, Homo sapiens
cccactttcatctaccttttc

SEQ ID NO: 1676345 - DNA, 16 bp, Homo sapiens
cccactttcctgagct

SEQ ID NO: 1676346 - DNA, 17 bp, Homo sapiens
cccagaaacatctctgg

SEQ ID NO: 1676347 - DNA, 21 bp, Homo sapiens
cccagaaagcctctctctccc

SEQ ID NO: 1676348 - DNA, 17 bp, Homo sapiens
cccagaaaggagactag

SEQ ID NO: 1676349 - DNA, 20 bp, Homo sapiens
cccagaaattctggcccagc

SEQ ID NO: 1676350 - DNA, 14 bp, Homo sapiens
cccagaacccacat

SEQ ID NO: 1676351 - DNA, 22 bp, Homo sapiens
cccagaacccttcctgagacct

SEQ ID NO: 1676352 - DNA, 23 bp, Homo sapiens
cccagaaggcagggaaaggctct

SEQ ID NO: 1676353 - DNA, 20 bp, Homo sapiens
cccagaatctctgagccaac

SEQ ID NO: 1676354 - DNA, 12 bp, Homo sapiens
cccagaatgaga

SEQ ID NO: 1676355 - DNA, 20 bp, Homo sapiens
cccagaatgagacatccagc

SEQ ID NO: 1676356 - DNA, 18 bp, Homo sapiens
cccagaatgcctcctgca

SEQ ID NO: 1676357 - DNA, 14 bp, Homo sapiens
cccagaatggagcc

SEQ ID NO: 1676358 - DNA, 15 bp, Homo sapiens
cccagaatggagcct

SEQ ID NO: 1676359 - DNA, 17 bp, Homo sapiens
cccagaatggagcctgc

SEQ ID NO: 1676360 - DNA, 20 bp, Homo sapiens
cccagaatggagcctgctct

SEQ ID NO: 1676361 - DNA, 21 bp, Homo sapiens
cccagaatttaccatcatctc

SEQ ID NO: 1676362 - DNA, 20 bp, Homo sapiens
cccagacacatcgcactgtg

SEQ ID NO: 1676363 - DNA, 21 bp, Homo sapiens
cccagacaccatgtgcaataa

SEQ ID NO: 1676364 - DNA, 12 bp, Homo sapiens
cccagacagctc

SEQ ID NO: 1676365 - DNA, 17 bp, Homo sapiens
cccagaccactgtctcc

SEQ ID NO: 1676366 - DNA, 19 bp, Homo sapiens
cccagaccaggaaaggctt

SEQ ID NO: 1676367 - DNA, 14 bp, Homo sapiens
cccagaccccgccc

SEQ ID NO: 1676368 - DNA, 21 bp, Homo sapiens
cccagaccccgcccctgggga

SEQ ID NO: 1676369 - DNA, 19 bp, Homo sapiens
cccagacccctctggccag

SEQ ID NO: 1676370 - DNA, 15 bp, Homo sapiens
cccagaccctgggca

SEQ ID NO: 1676371 - DNA, 22 bp, Homo sapiens
cccagacctgaatgcttctgag

SEQ ID NO: 1676372 - DNA, 18 bp, Homo sapiens
cccagacgcatagactga

SEQ ID NO: 1676373 - DNA, 12 bp, Homo sapiens
cccagactcaga

SEQ ID NO: 1676374 - DNA, 16 bp, Homo sapiens
cccagactcagacatt

SEQ ID NO: 1676375 - DNA, 15 bp, Homo sapiens
cccagactgagctct

SEQ ID NO: 1676376 - DNA, 17 bp, Homo sapiens
cccagactgagctctcc

SEQ ID NO: 1676377 - DNA, 21 bp, Homo sapiens
cccagactgagctctccaggc

SEQ ID NO: 1676378 - DNA, 22 bp, Homo sapiens
cccagactgagctctccaggcc

SEQ ID NO: 1676379 - DNA, 23 bp, Homo sapiens
cccagactgagctctccaggcca

SEQ ID NO: 1676380 - DNA, 13 bp, Homo sapiens
cccagactgggcc

SEQ ID NO: 1676381 - DNA, 15 bp, Homo sapiens
cccagactgggccca

SEQ ID NO: 1676382 - DNA, 17 bp, Homo sapiens
cccagactgggcccagg

SEQ ID NO: 1676383 - DNA, 19 bp, Homo sapiens
cccagactgggcccaggca

SEQ ID NO: 1676384 - DNA, 22 bp, Homo sapiens
cccagactgggcccaggcaggt

SEQ ID NO: 1676385 - DNA, 20 bp, Homo sapiens
cccagacttgcactggggtg

SEQ ID NO: 1676386 - DNA, 13 bp, Homo sapiens
cccagagaagcca

SEQ ID NO: 1676387 - DNA, 23 bp, Homo sapiens
cccagagaagctggaagcctgcc

SEQ ID NO: 1676388 - DNA, 17 bp, Homo sapiens
cccagagacaggaaaat

SEQ ID NO: 1676389 - DNA, 18 bp, Homo sapiens
cccagagacatacttgaa

SEQ ID NO: 1676390 - DNA, 23 bp, Homo sapiens
cccagagacatacttgaagggcc

SEQ ID NO: 1676391 - DNA, 20 bp, Homo sapiens
cccagagagaggggcctgca

SEQ ID NO: 1676392 - DNA, 14 bp, Homo sapiens
cccagagatgcctc

SEQ ID NO: 1676393 - DNA, 18 bp, Homo sapiens
cccagagatgcctccacc

SEQ ID NO: 1676394 - DNA, 19 bp, Homo sapiens
cccagagatgcctccaccg

SEQ ID NO: 1676395 - DNA, 23 bp, Homo sapiens
cccagagatgcctccaccgctgc

SEQ ID NO: 1676396 - DNA, 20 bp, Homo sapiens
cccagagcaccccctgctcc

SEQ ID NO: 1676397 - DNA, 16 bp, Homo sapiens
cccagagcaggaggcc

SEQ ID NO: 1676398 - DNA, 21 bp, Homo sapiens
cccagagcaggaggcccctgg

SEQ ID NO: 1676399 - DNA, 23 bp, Homo sapiens
cccagagcaggaggcccctggcc

SEQ ID NO: 1676400 - DNA, 18 bp, Homo sapiens
cccagagccacctggatc

SEQ ID NO: 1676401 - DNA, 15 bp, Homo sapiens
cccagagcccagctc

SEQ ID NO: 1676402 - DNA, 19 bp, Homo sapiens
cccagagcccagctcttgc

SEQ ID NO: 1676403 - DNA, 16 bp, Homo sapiens
cccagagcccctcctc

SEQ ID NO: 1676404 - DNA, 13 bp, Homo sapiens
cccagagctgtgc

SEQ ID NO: 1676405 - DNA, 18 bp, Homo sapiens
cccagagctgtgccagca

SEQ ID NO: 1676406 - DNA, 22 bp, Homo sapiens
cccagagctgtttatggcctca

SEQ ID NO: 1676407 - DNA, 19 bp, Homo sapiens
cccagagcttattggccac

SEQ ID NO: 1676408 - DNA, 21 bp, Homo sapiens
cccagagcttattggccactg

SEQ ID NO: 1676409 - DNA, 23 bp, Homo sapiens
cccagagcttattggccactggg

SEQ ID NO: 1676410 - DNA, 12 bp, Homo sapiens
cccagaggcaga

SEQ ID NO: 1676411 - DNA, 12 bp, Homo sapiens
cccagaggccct

SEQ ID NO: 1676412 - DNA, 13 bp, Homo sapiens
cccagaggctccc

SEQ ID NO: 1676413 - DNA, 18 bp, Homo sapiens
cccagagggcccaggcag

SEQ ID NO: 1676414 - DNA, 22 bp, Homo sapiens
cccagagggcccaggcaggcca

SEQ ID NO: 1676415 - DNA, 19 bp, Homo sapiens
cccagaggttatctgcctg

SEQ ID NO: 1676416 - DNA, 15 bp, Homo sapiens
cccagagtcatctga

SEQ ID NO: 1676417 - DNA, 17 bp, Homo sapiens
cccagagtggagtctga

SEQ ID NO: 1676418 - DNA, 19 bp, Homo sapiens
cccagagtggagtctgagt

SEQ ID NO: 1676419 - DNA, 23 bp, Homo sapiens
cccagagtgtgggaagggagagc

SEQ ID NO: 1676420 - DNA, 21 bp, Homo sapiens
cccagatacgggggctgtgac

SEQ ID NO: 1676421 - DNA, 23 bp, Homo sapiens
cccagatacgggggctgtgactc

SEQ ID NO: 1676422 - DNA, 12 bp, Homo sapiens
cccagatctcat

SEQ ID NO: 1676423 - DNA, 16 bp, Homo sapiens
cccatgggcttggact

SEQ ID NO: 1676424 - DNA, 22 bp, Homo sapiens
cccatggggaaaccctggagcc

SEQ ID NO: 1676425 - DNA, 19 bp, Homo sapiens
cccatggggagggattctg

SEQ ID NO: 1676426 - DNA, 18 bp, Homo sapiens
cccatggtcatctctgtt

SEQ ID NO: 1676427 - DNA, 21 bp, Homo sapiens
cccatggtgggtaggtggttc

SEQ ID NO: 1676428 - DNA, 21 bp, Homo sapiens
cccatgtagccccctggcctc

SEQ ID NO: 1676429 - DNA, 23 bp, Homo sapiens
cccatgtagccccctggcctctg

SEQ ID NO: 1676430 - DNA, 14 bp, Homo sapiens
cccatgtcacctca

SEQ ID NO: 1676431 - DNA, 22 bp, Homo sapiens
cccatgtgcctgcaccaggaga

SEQ ID NO: 1676432 - DNA, 22 bp, Homo sapiens
cccatgtgggcgcccaccctgg

SEQ ID NO: 1676433 - DNA, 19 bp, Homo sapiens
cccatgtgtacattctgcc

SEQ ID NO: 1676434 - DNA, 21 bp, Homo sapiens
cccatgtgtacattctgccta

SEQ ID NO: 1676435 - DNA, 21 bp, Homo sapiens
cccatgtgtcctggttcccgt

SEQ ID NO: 1676436 - DNA, 14 bp, Homo sapiens
cccattcacagagc

SEQ ID NO: 1676437 - DNA, 15 bp, Homo sapiens
cccattcacagagcc

SEQ ID NO: 1676438 - DNA, 12 bp, Homo sapiens
cccattccaggc

SEQ ID NO: 1676439 - DNA, 15 bp, Homo sapiens
cccattccctccatt

SEQ ID NO: 1676440 - DNA, 13 bp, Homo sapiens
cccattcctgaag

SEQ ID NO: 1676441 - DNA, 19 bp, Homo sapiens
cccattcctgatcccatgg

SEQ ID NO: 1676442 - DNA, 16 bp, Homo sapiens
cccattcggactgctg

SEQ ID NO: 1676443 - DNA, 15 bp, Homo sapiens
cccattctagatcct

SEQ ID NO: 1676444 - DNA, 19 bp, Homo sapiens
cccattctctctcctgtcc

SEQ ID NO: 1676445 - DNA, 20 bp, Homo sapiens
cccattctgccccagagtgg

SEQ ID NO: 1676446 - DNA, 20 bp, Homo sapiens
cccattcttcctagttttct

SEQ ID NO: 1676447 - DNA, 21 bp, Homo sapiens
cccattcttcctagttttctc

SEQ ID NO: 1676448 - DNA, 20 bp, Homo sapiens
cccattggttcacctgtgac

SEQ ID NO: 1676449 - DNA, 12 bp, Homo sapiens
cccattgtcctc

SEQ ID NO: 1676450 - DNA, 17 bp, Homo sapiens
cccattgttcccttcct

SEQ ID NO: 1676451 - DNA, 16 bp, Homo sapiens
cccatttctatttatt

SEQ ID NO: 1676452 - DNA, 19 bp, Homo sapiens
cccatttctatttatttac

SEQ ID NO: 1676453 - DNA, 15 bp, Homo sapiens
cccattttcctctga

SEQ ID NO: 1676454 - DNA, 22 bp, Homo sapiens
cccattttgcaaaatttccagt

SEQ ID NO: 1676455 - DNA, 16 bp, Homo sapiens
cccatttttgagccaa

SEQ ID NO: 1676456 - DNA, 15 bp, Homo sapiens
ccccaaaatccaaaa

SEQ ID NO: 1676457 - DNA, 17 bp, Homo sapiens
ccccaaaatccaaaact

SEQ ID NO: 1676458 - DNA, 21 bp, Homo sapiens
ccccaaaatccaaaacttctc

SEQ ID NO: 1676459 - DNA, 22 bp, Homo sapiens
ccccaaaatccaaaacttctct

SEQ ID NO: 1676460 - DNA, 21 bp, Homo sapiens
ccccaaagatagacaggtcct

SEQ ID NO: 1676461 - DNA, 16 bp, Homo sapiens
ccccaaagctttcctg

SEQ ID NO: 1676462 - DNA, 18 bp, Homo sapiens
ccccaaagctttcctgcc

SEQ ID NO: 1676463 - DNA, 17 bp, Homo sapiens
ccccaaaggaacactga

SEQ ID NO: 1676464 - DNA, 17 bp, Homo sapiens
ccccaaattgccttcag

SEQ ID NO: 1676465 - DNA, 22 bp, Homo sapiens
ccccaacaaaccatccagtgac

SEQ ID NO: 1676466 - DNA, 16 bp, Homo sapiens
ccccaacactgtgccc

SEQ ID NO: 1676467 - DNA, 22 bp, Homo sapiens
ccccaacactgtgccctggtgg

SEQ ID NO: 1676468 - DNA, 16 bp, Homo sapiens
ccccaaccccgcggtg

SEQ ID NO: 1676469 - DNA, 20 bp, Homo sapiens
ccccaacctcagggctccca

SEQ ID NO: 1676470 - DNA, 14 bp, Homo sapiens
ccccaacctgctga

SEQ ID NO: 1676471 - DNA, 19 bp, Homo sapiens
ccccaacgtcccctccgcc

SEQ ID NO: 1676472 - DNA, 13 bp, Homo sapiens
ccccaactcctgg

SEQ ID NO: 1676473 - DNA, 14 bp, Homo sapiens
ccccaactcctgga

SEQ ID NO: 1676474 - DNA, 15 bp, Homo sapiens
ccccaactcctggaa

SEQ ID NO: 1676475 - DNA, 19 bp, Homo sapiens
ccccaactctccccagtgc

SEQ ID NO: 1676476 - DNA, 22 bp, Homo sapiens
ccccaactgtggtagctccagc

SEQ ID NO: 1676477 - DNA, 17 bp, Homo sapiens
ccccaacttcaccaccc

SEQ ID NO: 1676478 - DNA, 20 bp, Homo sapiens
ccccaacttccctagtcccc

SEQ ID NO: 1676479 - DNA, 12 bp, Homo sapiens
ccccaaggccag

SEQ ID NO: 1676480 - DNA, 12 bp, Homo sapiens
ccccaaggcctc

SEQ ID NO: 1676481 - DNA, 15 bp, Homo sapiens
ccccaaggcctctct

SEQ ID NO: 1676482 - DNA, 20 bp, Homo sapiens
ccccaaggcctctctctgcc

SEQ ID NO: 1676483 - DNA, 13 bp, Homo sapiens
ccccaagggccct

SEQ ID NO: 1676484 - DNA, 17 bp, Homo sapiens
ccccaagggccctggca

SEQ ID NO: 1676485 - DNA, 18 bp, Homo sapiens
ccccaagggccctggcac

SEQ ID NO: 1676486 - DNA, 20 bp, Homo sapiens
ccccaaggttttggagtcag

SEQ ID NO: 1676487 - DNA, 13 bp, Homo sapiens
ccccaataaaggc

SEQ ID NO: 1676488 - DNA, 15 bp, Homo sapiens
ccccaataaaggcag

SEQ ID NO: 1676489 - DNA, 22 bp, Homo sapiens
ccccaataaaggcagctgcctc

SEQ ID NO: 1676490 - DNA, 19 bp, Homo sapiens
ccccaatcggactgccaaa

SEQ ID NO: 1676491 - DNA, 19 bp, Homo sapiens
ccccaatcgggtccagaga

SEQ ID NO: 1676492 - DNA, 20 bp, Homo sapiens
ccccacaagctgtccctgca

SEQ ID NO: 1676493 - DNA, 23 bp, Homo sapiens
ccccacaagctgtccctgcaggg

SEQ ID NO: 1676494 - DNA, 13 bp, Homo sapiens
ccccacaatctgg

SEQ ID NO: 1676495 - DNA, 14 bp, Homo sapiens
ccccacacctgcag

SEQ ID NO: 1676496 - DNA, 15 bp, Homo sapiens
ccccacacctgcagt

SEQ ID NO: 1676497 - DNA, 12 bp, Homo sapiens
ccccacactcca

SEQ ID NO: 1676498 - DNA, 15 bp, Homo sapiens
ccccacactccactc

SEQ ID NO: 1676499 - DNA, 14 bp, Homo sapiens
ccccacagctggct

SEQ ID NO: 1676500 - DNA, 12 bp, Homo sapiens
ccccaccaccta

SEQ ID NO: 1676501 - DNA, 22 bp, Homo sapiens
ccccaccacgtctggctccctg

SEQ ID NO: 1676502 - DNA, 19 bp, Homo sapiens
ccccacccaagcttggcag

SEQ ID NO: 1676503 - DNA, 12 bp, Homo sapiens
ccccacccagga

SEQ ID NO: 1676504 - DNA, 12 bp, Homo sapiens
ccccaccccatc

SEQ ID NO: 1676505 - DNA, 21 bp, Homo sapiens
ccccatccagcctccagggca

SEQ ID NO: 1676506 - DNA, 16 bp, Homo sapiens
ccccatctccccaggc

SEQ ID NO: 1676507 - DNA, 19 bp, Homo sapiens
ccccatctccccaggcctc

SEQ ID NO: 1676508 - DNA, 13 bp, Homo sapiens
ccccatctctcat

SEQ ID NO: 1676509 - DNA, 13 bp, Homo sapiens
ccccatctggatg

SEQ ID NO: 1676510 - DNA, 21 bp, Homo sapiens
ccccatctggatgtaaatcct

SEQ ID NO: 1676511 - DNA, 16 bp, Homo sapiens
ccccatcttccacctg

SEQ ID NO: 1676512 - DNA, 12 bp, Homo sapiens
ccccatcttgct

SEQ ID NO: 1676513 - DNA, 20 bp, Homo sapiens
ccccatgacttgatgcagtt

SEQ ID NO: 1676514 - DNA, 14 bp, Homo sapiens
ccccatgcccctcc

SEQ ID NO: 1676515 - DNA, 13 bp, Homo sapiens
ccccatgcctgtc

SEQ ID NO: 1676516 - DNA, 21 bp, Homo sapiens
ccccatgcctgtccagcctgg

SEQ ID NO: 1676517 - DNA, 17 bp, Homo sapiens
ccccatgctctgcccca

SEQ ID NO: 1676518 - DNA, 21 bp, Homo sapiens
ccccatgctctgccccaagcc

SEQ ID NO: 1676519 - DNA, 22 bp, Homo sapiens
ccccatgctctgccccaagccc

SEQ ID NO: 1676520 - DNA, 20 bp, Homo sapiens
ccccatggccccaggcccac

SEQ ID NO: 1676521 - DNA, 23 bp, Homo sapiens
ccccatgggctgtgtcctaaggc

SEQ ID NO: 1676522 - DNA, 12 bp, Homo sapiens
ccccatgggctt

SEQ ID NO: 1676523 - DNA, 15 bp, Homo sapiens
ccccatgggcttgga

SEQ ID NO: 1676524 - DNA, 15 bp, Homo sapiens
ccccatgtctctcag

SEQ ID NO: 1676525 - DNA, 14 bp, Homo sapiens
ccccatgtgcctgc

SEQ ID NO: 1676526 - DNA, 14 bp, Homo sapiens
ccccatgtgcctgt

SEQ ID NO: 1676527 - DNA, 17 bp, Homo sapiens
ccccatgtgcctgtcac

SEQ ID NO: 1676528 - DNA, 14 bp, Homo sapiens
ccccatgtgtcctg

SEQ ID NO: 1676529 - DNA, 23 bp, Homo sapiens
ccccatgttgtaatgctgcactt

SEQ ID NO: 1676530 - DNA, 17 bp, Homo sapiens
ccccattagagtcagcc

SEQ ID NO: 1676531 - DNA, 21 bp, Homo sapiens
ccccattcttcctagttttct

SEQ ID NO: 1676532 - DNA, 22 bp, Homo sapiens
ccccatttcccatctgcacccc

SEQ ID NO: 1676533 - DNA, 14 bp, Homo sapiens
ccccatttcccgca

SEQ ID NO: 1676534 - DNA, 13 bp, Homo sapiens
ccccatttcctca

SEQ ID NO: 1676535 - DNA, 20 bp, Homo sapiens
cccccaaattgccttcagcc

SEQ ID NO: 1676536 - DNA, 14 bp, Homo sapiens
cccccaacctcagg

SEQ ID NO: 1676537 - DNA, 19 bp, Homo sapiens
cccccaagctgttttcttc

SEQ ID NO: 1676538 - DNA, 19 bp, Homo sapiens
cccccaaggttctggttcc

SEQ ID NO: 1676539 - DNA, 13 bp, Homo sapiens
cccccaataaagg

SEQ ID NO: 1676540 - DNA, 15 bp, Homo sapiens
cccccaataaaggca

SEQ ID NO: 1676541 - DNA, 18 bp, Homo sapiens
cccccaataaaggcagct

SEQ ID NO: 1676542 - DNA, 20 bp, Homo sapiens
cccccacaagctgtccctgc

SEQ ID NO: 1676543 - DNA, 21 bp, Homo sapiens
ccctaggatgctgcagcagag

SEQ ID NO: 1676544 - DNA, 16 bp, Homo sapiens
ccctaggcagcctgca

SEQ ID NO: 1676545 - DNA, 18 bp, Homo sapiens
ccctaggggacacttccc

SEQ ID NO: 1676546 - DNA, 16 bp, Homo sapiens
ccctaggtgcccaggg

SEQ ID NO: 1676547 - DNA, 23 bp, Homo sapiens
ccctagtagctggcgcccatcct

SEQ ID NO: 1676548 - DNA, 17 bp, Homo sapiens
ccctagtccccctgttt

SEQ ID NO: 1676549 - DNA, 16 bp, Homo sapiens
ccctagtcccttcccc

SEQ ID NO: 1676550 - DNA, 22 bp, Homo sapiens
ccctatacctgagcctcaacct

SEQ ID NO: 1676551 - DNA, 21 bp, Homo sapiens
ccctatagagagggggctctc

SEQ ID NO: 1676552 - DNA, 23 bp, Homo sapiens
ccctatatgtagtataaagaaaa

SEQ ID NO: 1676553 - DNA, 14 bp, Homo sapiens
ccctatcctctgag

SEQ ID NO: 1676554 - DNA, 14 bp, Homo sapiens
ccctatctcctgac

SEQ ID NO: 1676555 - DNA, 17 bp, Homo sapiens
ccctatctcctgacaga

SEQ ID NO: 1676556 - DNA, 22 bp, Homo sapiens
ccctatctcctgacagaaggtg

SEQ ID NO: 1676557 - DNA, 21 bp, Homo sapiens
ccctatgggcctgccgggctg

SEQ ID NO: 1676558 - DNA, 14 bp, Homo sapiens
ccctatttaaaact

SEQ ID NO: 1676559 - DNA, 18 bp, Homo sapiens
ccctatttattgactttg

SEQ ID NO: 1676560 - DNA, 21 bp, Homo sapiens
ccctcaaacctcctcttctga

SEQ ID NO: 1676561 - DNA, 22 bp, Homo sapiens
ccctcaaagaagtcggaatgtc

SEQ ID NO: 1676562 - DNA, 23 bp, Homo sapiens
ccctcaaagaagtcggaatgtca

SEQ ID NO: 1676563 - DNA, 15 bp, Homo sapiens
ccctcaaagggagag

SEQ ID NO: 1676564 - DNA, 15 bp, Homo sapiens
ccctcaactgaaggg

SEQ ID NO: 1676565 - DNA, 21 bp, Homo sapiens
ccctcaagccaatcccctcct

SEQ ID NO: 1676566 - DNA, 23 bp, Homo sapiens
ccctcaaggacaaagtctccagc

SEQ ID NO: 1676567 - DNA, 18 bp, Homo sapiens
ccctcaaggctgtgacct

SEQ ID NO: 1676568 - DNA, 11 bp, Homo sapiens
ccctcacccat

SEQ ID NO: 1676569 - DNA, 18 bp, Homo sapiens
ccctcacccccaggtgtt

SEQ ID NO: 1676570 - DNA, 17 bp, Homo sapiens
ccctcacccccatggcc

SEQ ID NO: 1676571 - DNA, 16 bp, Homo sapiens
ccctcaccctgcctta

SEQ ID NO: 1676572 - DNA, 14 bp, Homo sapiens
ccctcacctcctct

SEQ ID NO: 1676573 - DNA, 12 bp, Homo sapiens
ccctcacctctg

SEQ ID NO: 1676574 - DNA, 19 bp, Homo sapiens
ccctcacctctgaggacag

SEQ ID NO: 1676575 - DNA, 19 bp, Homo sapiens
ccctcacctggtacctgga

SEQ ID NO: 1676576 - DNA, 16 bp, Homo sapiens
ccctcactccccaggg

SEQ ID NO: 1676577 - DNA, 12 bp, Homo sapiens
ccctcagaaacc

SEQ ID NO: 1676578 - DNA, 20 bp, Homo sapiens
ccctcagaagaaaacttttg

SEQ ID NO: 1676579 - DNA, 13 bp, Homo sapiens
ccctcagagccac

SEQ ID NO: 1676580 - DNA, 13 bp, Homo sapiens
ccctcagcccttg

SEQ ID NO: 1676581 - DNA, 21 bp, Homo sapiens
ccctcagcgggggccttgaag

SEQ ID NO: 1676582 - DNA, 22 bp, Homo sapiens
ccctcagcgggggccttgaaga

SEQ ID NO: 1676583 - DNA, 13 bp, Homo sapiens
ccctcagctcctg

SEQ ID NO: 1676584 - DNA, 15 bp, Homo sapiens
ccctcagctctctgg

SEQ ID NO: 1676585 - DNA, 15 bp, Homo sapiens
ccctcaggaattcag

SEQ ID NO: 1676586 - DNA, 21 bp, Homo sapiens
ccctcaggcataggcctgggt

SEQ ID NO: 1676587 - DNA, 15 bp, Homo sapiens
ccctcaggttccttt

SEQ ID NO: 1676588 - DNA, 16 bp, Homo sapiens
ccctcataccatctgc

SEQ ID NO: 1676589 - DNA, 22 bp, Homo sapiens
ccctcatacccatgcacagtac

SEQ ID NO: 1676590 - DNA, 13 bp, Homo sapiens
ccctcatggcccc

SEQ ID NO: 1676591 - DNA, 21 bp, Homo sapiens
ccctcatggcccccaggggca

SEQ ID NO: 1676592 - DNA, 16 bp, Homo sapiens
ccctcatggcccctct

SEQ ID NO: 1676593 - DNA, 23 bp, Homo sapiens
ccctccaaacctccagcctccct

SEQ ID NO: 1676594 - DNA, 22 bp, Homo sapiens
ccctccacagctgcagctgatc

SEQ ID NO: 1676595 - DNA, 16 bp, Homo sapiens
ccctccaccagcctgc

SEQ ID NO: 1676596 - DNA, 17 bp, Homo sapiens
ccctccaccagcctgct

SEQ ID NO: 1676597 - DNA, 20 bp, Homo sapiens
ccctccagacacccagaatg

SEQ ID NO: 1676598 - DNA, 16 bp, Homo sapiens
ccctccagaccctgcc

SEQ ID NO: 1676599 - DNA, 19 bp, Homo sapiens
ccctccagaccctgcctga

SEQ ID NO: 1676600 - DNA, 22 bp, Homo sapiens
ccctccagaccctgcctgagcc

SEQ ID NO: 1676601 - DNA, 13 bp, Homo sapiens
ccctccagagaca

SEQ ID NO: 1676602 - DNA, 15 bp, Homo sapiens
ccctccagcacacac

SEQ ID NO: 1676603 - DNA, 13 bp, Homo sapiens
ccctccaggaaga

SEQ ID NO: 1676604 - DNA, 21 bp, Homo sapiens
ccctccaggaagaagcagggg

SEQ ID NO: 1676605 - DNA, 12 bp, Homo sapiens
ccctccaggaga

SEQ ID NO: 1676606 - DNA, 14 bp, Homo sapiens
ccctccatccaccc

SEQ ID NO: 1676607 - DNA, 11 bp, Homo sapiens
ccctcccaaca

SEQ ID NO: 1676608 - DNA, 18 bp, Homo sapiens
ccctcccaacctcaatgc

SEQ ID NO: 1676609 - DNA, 21 bp, Homo sapiens
ccctcccaagcgttcctggcc

SEQ ID NO: 1676610 - DNA, 17 bp, Homo sapiens
ccctcccacagcctcct

SEQ ID NO: 1676611 - DNA, 18 bp, Homo sapiens
ccctcccacagcctcctt

SEQ ID NO: 1676612 - DNA, 12 bp, Homo sapiens
ccctgccctggt

SEQ ID NO: 1676613 - DNA, 18 bp, Homo sapiens
ccctgccctggtccaggg

SEQ ID NO: 1676614 - DNA, 14 bp, Homo sapiens
ccctgccgcctcaa

SEQ ID NO: 1676615 - DNA, 13 bp, Homo sapiens
ccctgccggccgg

SEQ ID NO: 1676616 - DNA, 16 bp, Homo sapiens
ccctgcctcagtggct

SEQ ID NO: 1676617 - DNA, 17 bp, Homo sapiens
ccctgcctcatccacca

SEQ ID NO: 1676618 - DNA, 16 bp, Homo sapiens
ccctgcctcctgccac

SEQ ID NO: 1676619 - DNA, 21 bp, Homo sapiens
ccctgcctgagcccaggagct

SEQ ID NO: 1676620 - DNA, 18 bp, Homo sapiens
ccctgcctgaggaggagg

SEQ ID NO: 1676621 - DNA, 22 bp, Homo sapiens
ccctgcctgaggaggaggacac

SEQ ID NO: 1676622 - DNA, 13 bp, Homo sapiens
ccctgcctgaggg

SEQ ID NO: 1676623 - DNA, 20 bp, Homo sapiens
ccctgcctgagggcccctct

SEQ ID NO: 1676624 - DNA, 15 bp, Homo sapiens
ccctgcctgcccact

SEQ ID NO: 1676625 - DNA, 21 bp, Homo sapiens
ccctgcctggcccccaacctc

SEQ ID NO: 1676626 - DNA, 18 bp, Homo sapiens
ccctgcctgttggcaggc

SEQ ID NO: 1676627 - DNA, 21 bp, Homo sapiens
ccctgccttgctgacaataaa

SEQ ID NO: 1676628 - DNA, 22 bp, Homo sapiens
ccctgcgcctgtgatgctgggc

SEQ ID NO: 1676629 - DNA, 14 bp, Homo sapiens
ccctgcggcctcca

SEQ ID NO: 1676630 - DNA, 23 bp, Homo sapiens
ccctgcgggcgcgggcagccacc

SEQ ID NO: 1676631 - DNA, 24 bp, Homo sapiens
ccctgcgggcgcgggcagccaccc

SEQ ID NO: 1676632 - DNA, 21 bp, Homo sapiens
ccctgcgtcctgacgccctgc

SEQ ID NO: 1676633 - DNA, 22 bp, Homo sapiens
ccctgcgttggagccactcctg

SEQ ID NO: 1676634 - DNA, 13 bp, Homo sapiens
ccctgctacctgt

SEQ ID NO: 1676635 - DNA, 17 bp, Homo sapiens
ccctgctacctgttctt

SEQ ID NO: 1676636 - DNA, 18 bp, Homo sapiens
ccctgctactcctgtgct

SEQ ID NO: 1676637 - DNA, 22 bp, Homo sapiens
ccctgctactcctgtgctctgg

SEQ ID NO: 1676638 - DNA, 15 bp, Homo sapiens
ccctgctcatccact

SEQ ID NO: 1676639 - DNA, 15 bp, Homo sapiens
ccctgctccaccagc

SEQ ID NO: 1676640 - DNA, 16 bp, Homo sapiens
ccctgctccaccagca

SEQ ID NO: 1676641 - DNA, 12 bp, Homo sapiens
ccctgctcccag

SEQ ID NO: 1676642 - DNA, 14 bp, Homo sapiens
ccctgctctctgag

SEQ ID NO: 1676643 - DNA, 19 bp, Homo sapiens
ccctgctgaagctgctgca

SEQ ID NO: 1676644 - DNA, 18 bp, Homo sapiens
ccctgctgagtcatctgt

SEQ ID NO: 1676645 - DNA, 16 bp, Homo sapiens
ccctgctgctggtgca

SEQ ID NO: 1676646 - DNA, 17 bp, Homo sapiens
ccctgctgtctctctgg

SEQ ID NO: 1676647 - DNA, 19 bp, Homo sapiens
ccctgctgtctctctgggc

SEQ ID NO: 1676648 - DNA, 14 bp, Homo sapiens
ccctgcttccagga

SEQ ID NO: 1676649 - DNA, 15 bp, Homo sapiens
ccctgcttcctgctt

SEQ ID NO: 1676650 - DNA, 18 bp, Homo sapiens
ccctgcttctgctgccct

SEQ ID NO: 1676651 - DNA, 13 bp, Homo sapiens
ccctgcttctggc

SEQ ID NO: 1676652 - DNA, 15 bp, Homo sapiens
ccctgcttctggcgc

SEQ ID NO: 1676653 - DNA, 19 bp, Homo sapiens
ccctgcttgcacacttccc

SEQ ID NO: 1676654 - DNA, 18 bp, Homo sapiens
ccctgctttgggctgccc

SEQ ID NO: 1676655 - DNA, 23 bp, Homo sapiens
ccctgctttgggctgccctggtg

SEQ ID NO: 1676656 - DNA, 10 bp, Homo sapiens
ccctgctttt

SEQ ID NO: 1676657 - DNA, 22 bp, Homo sapiens
ccctgctttttttcttaaaagt

SEQ ID NO: 1676658 - DNA, 17 bp, Homo sapiens
ccctggaaacccacctc

SEQ ID NO: 1676659 - DNA, 22 bp, Homo sapiens
ccctggaaaccttccacccagt

SEQ ID NO: 1676660 - DNA, 19 bp, Homo sapiens
ccctggaactcctggcctt

SEQ ID NO: 1676661 - DNA, 17 bp, Homo sapiens
ccctggaagagcccagt

SEQ ID NO: 1676662 - DNA, 18 bp, Homo sapiens
ccctggaagccggcggcc

SEQ ID NO: 1676663 - DNA, 16 bp, Homo sapiens
ccctggaagctggaag

SEQ ID NO: 1676664 - DNA, 21 bp, Homo sapiens
ccctggaattcagcaccctgg

SEQ ID NO: 1676665 - DNA, 14 bp, Homo sapiens
ccctggacacagct

SEQ ID NO: 1676666 - DNA, 15 bp, Homo sapiens
ccctggacacagctc

SEQ ID NO: 1676667 - DNA, 20 bp, Homo sapiens
ccctggacaggcagcctcct

SEQ ID NO: 1676668 - DNA, 22 bp, Homo sapiens
ccctggacaggcagcctccttt

SEQ ID NO: 1676669 - DNA, 20 bp, Homo sapiens
ccctggaccaccagccccag

SEQ ID NO: 1676670 - DNA, 22 bp, Homo sapiens
ccctggaccaccagccccagca

SEQ ID NO: 1676671 - DNA, 23 bp, Homo sapiens
ccctggactggtggcccctgcct

SEQ ID NO: 1676672 - DNA, 20 bp, Homo sapiens
ccctggagagccccatggtg

SEQ ID NO: 1676673 - DNA, 13 bp, Homo sapiens
ccctggagcagga

SEQ ID NO: 1676674 - DNA, 14 bp, Homo sapiens
ccctggagcaggag

SEQ ID NO: 1676675 - DNA, 21 bp, Homo sapiens
ccctggagccagcagggctgt

SEQ ID NO: 1676676 - DNA, 13 bp, Homo sapiens
ccctggagccagg

SEQ ID NO: 1676677 - DNA, 14 bp, Homo sapiens
ccctggagccaggg

SEQ ID NO: 1676678 - DNA, 16 bp, Homo sapiens
ccctggagccatccct

SEQ ID NO: 1676679 - DNA, 14 bp, Homo sapiens
ccctggagctgtcc

SEQ ID NO: 1676680 - DNA, 15 bp, Homo sapiens
ccctggagctgtcct

SEQ ID NO: 1676681 - DNA, 17 bp, Homo sapiens
ccctggaggcacgcacc

SEQ ID NO: 1676682 - DNA, 21 bp, Homo sapiens
ccctggaggcacgcaccactg

SEQ ID NO: 1676683 - DNA, 13 bp, Homo sapiens
ccctggagtcagg

SEQ ID NO: 1676684 - DNA, 14 bp, Homo sapiens
ccctggagtcaggg

SEQ ID NO: 1676685 - DNA, 20 bp, Homo sapiens
ccctggatcacataccaggt

SEQ ID NO: 1676686 - DNA, 22 bp, Homo sapiens
ccctggatgggcattgggctga

SEQ ID NO: 1676687 - DNA, 13 bp, Homo sapiens
ccctggatgtgtg

SEQ ID NO: 1676688 - DNA, 21 bp, Homo sapiens
ccctggatgtgtggggcatgg

SEQ ID NO: 1676689 - DNA, 21 bp, Homo sapiens
ccctggcacccccacaagctg

SEQ ID NO: 1676690 - DNA, 13 bp, Homo sapiens
ccctggcagcagc

SEQ ID NO: 1676691 - DNA, 22 bp, Homo sapiens
ccctggcaggatgaccctgcga

SEQ ID NO: 1676692 - DNA, 16 bp, Homo sapiens
ccctggcaggcttcca

SEQ ID NO: 1676693 - DNA, 13 bp, Homo sapiens
ccctggcagggac

SEQ ID NO: 1676694 - DNA, 20 bp, Homo sapiens
ccctggcaggtggccaggca

SEQ ID NO: 1676695 - DNA, 16 bp, Homo sapiens
ccctggcagtgctgag

SEQ ID NO: 1676696 - DNA, 23 bp, Homo sapiens
ccctggcattatgtccactgtgt

SEQ ID NO: 1676697 - DNA, 22 bp, Homo sapiens
ccctggccaccttgtcctggct

SEQ ID NO: 1676698 - DNA, 14 bp, Homo sapiens
ccctggcccagagt

SEQ ID NO: 1676699 - DNA, 14 bp, Homo sapiens
ccctggccctgagg

SEQ ID NO: 1676700 - DNA, 16 bp, Homo sapiens
ccctggccctgaggtg

SEQ ID NO: 1676701 - DNA, 13 bp, Homo sapiens
ccctggccctgcc

SEQ ID NO: 1676702 - DNA, 16 bp, Homo sapiens
ccctggccctgcccag

SEQ ID NO: 1676703 - DNA, 16 bp, Homo sapiens
ccctggcctagaccag

SEQ ID NO: 1676704 - DNA, 13 bp, Homo sapiens
ccctggcctcccc

SEQ ID NO: 1676705 - DNA, 14 bp, Homo sapiens
ccctggcctcccct

SEQ ID NO: 1676706 - DNA, 19 bp, Homo sapiens
ccctggcctcccctgccac

SEQ ID NO: 1676707 - DNA, 19 bp, Homo sapiens
ccctggcctctgtgccttc

SEQ ID NO: 1676708 - DNA, 21 bp, Homo sapiens
ccctggcctctgtgccttctt

SEQ ID NO: 1676709 - DNA, 11 bp, Homo sapiens
ccctggcctga

SEQ ID NO: 1676710 - DNA, 14 bp, Homo sapiens
ccctggcctgaact

SEQ ID NO: 1676711 - DNA, 18 bp, Homo sapiens
ccctggcctgaactgagg

SEQ ID NO: 1676712 - DNA, 21 bp, Homo sapiens
ccctggcctgaactgaggaga

SEQ ID NO: 1676713 - DNA, 13 bp, Homo sapiens
ccctggcctgctg

SEQ ID NO: 1676714 - DNA, 22 bp, Homo sapiens
ccctggcctgctgggctctcca

SEQ ID NO: 1676715 - DNA, 14 bp, Homo sapiens
ccctggcctggtcc

SEQ ID NO: 1676716 - DNA, 19 bp, Homo sapiens
ccctggcctggtccctggt

SEQ ID NO: 1676717 - DNA, 16 bp, Homo sapiens
ccctggccttgcccgt

SEQ ID NO: 1676718 - DNA, 17 bp, Homo sapiens
ccctggctacttccctt

SEQ ID NO: 1676719 - DNA, 19 bp, Homo sapiens
ccctggctacttcccttcc

SEQ ID NO: 1676720 - DNA, 16 bp, Homo sapiens
ccctggctcactggca

SEQ ID NO: 1676721 - DNA, 19 bp, Homo sapiens
ccctggctcactggcaggt

SEQ ID NO: 1676722 - DNA, 19 bp, Homo sapiens
ccctggctcccacaggccc

SEQ ID NO: 1676723 - DNA, 14 bp, Homo sapiens
ccctggctcccatg

SEQ ID NO: 1676724 - DNA, 12 bp, Homo sapiens
ccctggctccct

SEQ ID NO: 1676725 - DNA, 13 bp, Homo sapiens
ccctggctccctc

SEQ ID NO: 1676726 - DNA, 14 bp, Homo sapiens
ccctggctgccctg

SEQ ID NO: 1676727 - DNA, 16 bp, Homo sapiens
ccctggctgccctggc

SEQ ID NO: 1676728 - DNA, 15 bp, Homo sapiens
ccctggctgctgccc

SEQ ID NO: 1676729 - DNA, 22 bp, Homo sapiens
ccctgttgaattggtgaataaa

SEQ ID NO: 1676730 - DNA, 23 bp, Homo sapiens
ccctgttgaattggtgaataaaa

SEQ ID NO: 1676731 - DNA, 22 bp, Homo sapiens
ccctgttgaattttgttctctg

SEQ ID NO: 1676732 - DNA, 23 bp, Homo sapiens
ccctgttgattatcttcagccca

SEQ ID NO: 1676733 - DNA, 23 bp, Homo sapiens
ccggggtctgtgctgtgcctgct

SEQ ID NO: 1676734 - DNA, 22 bp, Homo sapiens
ccggggtggggtgcactcgcca

SEQ ID NO: 1676735 - DNA, 17 bp, Homo sapiens
ccggggtgtaacttcct

SEQ ID NO: 1676736 - DNA, 18 bp, Homo sapiens
ccggggtgtaacttcctg

SEQ ID NO: 1676737 - DNA, 19 bp, Homo sapiens
ccggggtgtaacttcctgc

SEQ ID NO: 1676738 - DNA, 19 bp, Homo sapiens
ccggggttccccacacagg

SEQ ID NO: 1676739 - DNA, 20 bp, Homo sapiens
ccggggttccccacacaggg

SEQ ID NO: 1676740 - DNA, 12 bp, Homo sapiens
ccgggtccagga

SEQ ID NO: 1676741 - DNA, 17 bp, Homo sapiens
ccgggtccccagctccc

SEQ ID NO: 1676742 - DNA, 18 bp, Homo sapiens
ccgggtccccagctcccc

SEQ ID NO: 1676743 - DNA, 23 bp, Homo sapiens
ccgggtctcgcagcctgaagcct

SEQ ID NO: 1676744 - DNA, 13 bp, Homo sapiens
ccgggtgggcctg

SEQ ID NO: 1676745 - DNA, 19 bp, Homo sapiens
ccgggtgggcctggcctga

SEQ ID NO: 1676746 - DNA, 21 bp, Homo sapiens
ccgggtgggcctggcctgagc

SEQ ID NO: 1676747 - DNA, 16 bp, Homo sapiens
ccgggttcatgccatt

SEQ ID NO: 1676748 - DNA, 17 bp, Homo sapiens
ccgggttctagtctcct

SEQ ID NO: 1676749 - DNA, 19 bp, Homo sapiens
ccggtaactgtcctgtcct

SEQ ID NO: 1676750 - DNA, 15 bp, Homo sapiens
ccggtccagctggcc

SEQ ID NO: 1676751 - DNA, 22 bp, Homo sapiens
ccggtcccttgagacctcagcc

SEQ ID NO: 1676752 - DNA, 16 bp, Homo sapiens
ccggtcgggcagccag

SEQ ID NO: 1676753 - DNA, 22 bp, Homo sapiens
ccggtctatgtcgagagctggc

SEQ ID NO: 1676754 - DNA, 23 bp, Homo sapiens
ccggtctatgtcgagagctggcc

SEQ ID NO: 1676755 - DNA, 14 bp, Homo sapiens
ccggtgcacaggcc

SEQ ID NO: 1676756 - DNA, 21 bp, Homo sapiens
ccggtgcacaggcctctgcct

SEQ ID NO: 1676757 - DNA, 16 bp, Homo sapiens
ccggtgctccctctgt

SEQ ID NO: 1676758 - DNA, 20 bp, Homo sapiens
ccggtgctgggttcccactc

SEQ ID NO: 1676759 - DNA, 22 bp, Homo sapiens
ccggtgctgggttcccactccc

SEQ ID NO: 1676760 - DNA, 23 bp, Homo sapiens
ccggtgcttccaacaaggacagc

SEQ ID NO: 1676761 - DNA, 18 bp, Homo sapiens
ccggtggcctattccagg

SEQ ID NO: 1676762 - DNA, 18 bp, Homo sapiens
ccggtggcggccccagca

SEQ ID NO: 1676763 - DNA, 14 bp, Homo sapiens
ccggtggctgggca

SEQ ID NO: 1676764 - DNA, 16 bp, Homo sapiens
ccggtggctgggcaga

SEQ ID NO: 1676765 - DNA, 13 bp, Homo sapiens
ccggtggtgcccg

SEQ ID NO: 1676766 - DNA, 11 bp, Homo sapiens
ccggtgtcctt

SEQ ID NO: 1676767 - DNA, 17 bp, Homo sapiens
ccggttcagacccctgc

SEQ ID NO: 1676768 - DNA, 21 bp, Homo sapiens
ccggttccccgcaacccacag

SEQ ID NO: 1676769 - DNA, 22 bp, Homo sapiens
ccggttccccgcaacccacagc

SEQ ID NO: 1676770 - DNA, 17 bp, Homo sapiens
ccgtaataattattatt

SEQ ID NO: 1676771 - DNA, 16 bp, Homo sapiens
ccgtaattctttctgt

SEQ ID NO: 1676772 - DNA, 12 bp, Homo sapiens
ccgtaatttaac

SEQ ID NO: 1676773 - DNA, 18 bp, Homo sapiens
ccgtacattcaatgttta

SEQ ID NO: 1676774 - DNA, 16 bp, Homo sapiens
ccgtaccccaccctca

SEQ ID NO: 1676775 - DNA, 18 bp, Homo sapiens
ccgtaccccaccctcagc

SEQ ID NO: 1676776 - DNA, 20 bp, Homo sapiens
ccgtaccccaccctcagcac

SEQ ID NO: 1676777 - DNA, 18 bp, Homo sapiens
ccgtagggagtacctgct

SEQ ID NO: 1676778 - DNA, 14 bp, Homo sapiens
ccgtagttccctga

SEQ ID NO: 1676779 - DNA, 16 bp, Homo sapiens
ccgtagttccctgaaa

SEQ ID NO: 1676780 - DNA, 18 bp, Homo sapiens
ccgtataggatgtcagac

SEQ ID NO: 1676781 - DNA, 22 bp, Homo sapiens
ccgtattggttgggggctcctg

SEQ ID NO: 1676782 - DNA, 20 bp, Homo sapiens
ccgtcaccacgactggccag

SEQ ID NO: 1676783 - DNA, 16 bp, Homo sapiens
ccgtcagggagaggtc

SEQ ID NO: 1676784 - DNA, 21 bp, Homo sapiens
ccgtcagggagaggtcaccag

SEQ ID NO: 1676785 - DNA, 14 bp, Homo sapiens
ccgtcagggcccaa

SEQ ID NO: 1676786 - DNA, 21 bp, Homo sapiens
ccgtcatggcttaatgtttat

SEQ ID NO: 1676787 - DNA, 16 bp, Homo sapiens
ccgtcatgttcctcaa

SEQ ID NO: 1676788 - DNA, 15 bp, Homo sapiens
ccgtcattgctgctg

SEQ ID NO: 1676789 - DNA, 17 bp, Homo sapiens
ccgtcattgctgctgct

SEQ ID NO: 1676790 - DNA, 19 bp, Homo sapiens
ccgtcattgctgctgctac

SEQ ID NO: 1676791 - DNA, 18 bp, Homo sapiens
ccgtccatatcagaactg

SEQ ID NO: 1676792 - DNA, 13 bp, Homo sapiens
ccgtccatggcac

SEQ ID NO: 1676793 - DNA, 15 bp, Homo sapiens
ccgtccatggcacca

SEQ ID NO: 1676794 - DNA, 16 bp, Homo sapiens
ccgtccatggcaccag

SEQ ID NO: 1676795 - DNA, 20 bp, Homo sapiens
ccgtccatggcaccagcccc

SEQ ID NO: 1676796 - DNA, 12 bp, Homo sapiens
ccgtcccaggcc

SEQ ID NO: 1676797 - DNA, 14 bp, Homo sapiens
ccgtcccagggctc

SEQ ID NO: 1676798 - DNA, 13 bp, Homo sapiens
ccgtccgccctgc

SEQ ID NO: 1676799 - DNA, 19 bp, Homo sapiens
ccgtcctcccgggccctcc

SEQ ID NO: 1676800 - DNA, 19 bp, Homo sapiens
ccgtccttcccctcttctt

SEQ ID NO: 1676801 - DNA, 15 bp, Homo sapiens
ccgtcgcgctggaca

SEQ ID NO: 1676802 - DNA, 20 bp, Homo sapiens
ccgtcggagctgcctgcagc

SEQ ID NO: 1676803 - DNA, 13 bp, Homo sapiens
ccgtcgtgtgctg

SEQ ID NO: 1676804 - DNA, 20 bp, Homo sapiens
ccgtctccaggggctgcttc

SEQ ID NO: 1676805 - DNA, 15 bp, Homo sapiens
ccgtctcccttggcc

SEQ ID NO: 1676806 - DNA, 14 bp, Homo sapiens
ccgtctcctccctc

SEQ ID NO: 1676807 - DNA, 17 bp, Homo sapiens
ccgtctcctccctcagc

SEQ ID NO: 1676808 - DNA, 14 bp, Homo sapiens
ccgtctgactccag

SEQ ID NO: 1676809 - DNA, 20 bp, Homo sapiens
ccgtctgactccagagtctg

SEQ ID NO: 1676810 - DNA, 17 bp, Homo sapiens
ccgtctggggttcagcc

SEQ ID NO: 1676811 - DNA, 23 bp, Homo sapiens
ccgtctggggttcagcccctcct

SEQ ID NO: 1676812 - DNA, 22 bp, Homo sapiens
ccgtctgtctcagagtcccagg

SEQ ID NO: 1676813 - DNA, 16 bp, Homo sapiens
ccgtctgtctcgatgc

SEQ ID NO: 1676814 - DNA, 14 bp, Homo sapiens
ccgtcttcacactg

SEQ ID NO: 1676815 - DNA, 18 bp, Homo sapiens
ccgtcttcacactgcgca

SEQ ID NO: 1676816 - DNA, 17 bp, Homo sapiens
ccgtgaaaacggagctg

SEQ ID NO: 1676817 - DNA, 14 bp, Homo sapiens
ccgtgaagcagtgc

SEQ ID NO: 1676818 - DNA, 19 bp, Homo sapiens
ccgtgaatggtctctgtca

SEQ ID NO: 1676819 - DNA, 12 bp, Homo sapiens
ccgtgaattgct

SEQ ID NO: 1676820 - DNA, 21 bp, Homo sapiens
ccgtgacctattcaccctcca

SEQ ID NO: 1676821 - DNA, 14 bp, Homo sapiens
ccgtgacgaggctc

SEQ ID NO: 1676822 - DNA, 15 bp, Homo sapiens
ccgtgacgaggctca

SEQ ID NO: 1676823 - DNA, 13 bp, Homo sapiens
ccgtgagcaggct

SEQ ID NO: 1676824 - DNA, 18 bp, Homo sapiens
ccgtgagtgacatagcct

SEQ ID NO: 1676825 - DNA, 14 bp, Homo sapiens
ccgtgatctcccct

SEQ ID NO: 1676826 - DNA, 16 bp, Homo sapiens
ccgtgatctcccctca

SEQ ID NO: 1676827 - DNA, 22 bp, Homo sapiens
ccgtgccacccgtaggcagcct

SEQ ID NO: 1676828 - DNA, 20 bp, Homo sapiens
ccgtgcccccgcctgccacc

SEQ ID NO: 1676829 - DNA, 15 bp, Homo sapiens
ccgtgccccgcctcc

SEQ ID NO: 1676830 - DNA, 14 bp, Homo sapiens
ccgtgcccgcagga

SEQ ID NO: 1676831 - DNA, 18 bp, Homo sapiens
ccgtgcccttgcccttgg

SEQ ID NO: 1676832 - DNA, 19 bp, Homo sapiens
ccgtgcccttgcccttgga

SEQ ID NO: 1676833 - DNA, 22 bp, Homo sapiens
ccgtgccggcggcagccccact

SEQ ID NO: 1676834 - DNA, 23 bp, Homo sapiens
ccgtgccggcggcagccccactt

SEQ ID NO: 1676835 - DNA, 15 bp, Homo sapiens
ccgtgccttcagctc

SEQ ID NO: 1676836 - DNA, 12 bp, Homo sapiens
ccgtggacaggc

SEQ ID NO: 1676837 - DNA, 17 bp, Homo sapiens
ccgtggacaggcccagc

SEQ ID NO: 1676838 - DNA, 23 bp, Homo sapiens
ccgtggagatcgcttttctcaga

SEQ ID NO: 1676839 - DNA, 19 bp, Homo sapiens
ccgtggattgcacgtggcc

SEQ ID NO: 1676840 - DNA, 20 bp, Homo sapiens
ccgtggattgcacgtggcct

SEQ ID NO: 1676841 - DNA, 23 bp, Homo sapiens
ccgtggattgcacgtggcctctt

SEQ ID NO: 1676842 - DNA, 23 bp, Homo sapiens
ccgtggcttcccgctcagccctc

SEQ ID NO: 1676843 - DNA, 21 bp, Homo sapiens
ccgtgggcgcaaaggtgcctc

SEQ ID NO: 1676844 - DNA, 13 bp, Homo sapiens
ccgtggggcaggg

SEQ ID NO: 1676845 - DNA, 16 bp, Homo sapiens
ccgtggggtgctgccc

SEQ ID NO: 1676846 - DNA, 24 bp, Homo sapiens
ccgtggtcagagggactgtcagct

SEQ ID NO: 1676847 - DNA, 17 bp, Homo sapiens
ccgtggtcagagtgcca

SEQ ID NO: 1676848 - DNA, 14 bp, Homo sapiens
ccgtggtccagctc

SEQ ID NO: 1676849 - DNA, 15 bp, Homo sapiens
ccgtggtccagctct

SEQ ID NO: 1676850 - DNA, 18 bp, Homo sapiens
ccgtggtccagctcttgg

SEQ ID NO: 1676851 - DNA, 13 bp, Homo sapiens
ccgtggtccctga

SEQ ID NO: 1676852 - DNA, 14 bp, Homo sapiens
ccgtggtccctgag

SEQ ID NO: 1676853 - DNA, 18 bp, Homo sapiens
ccgtgtccagcacagaag

SEQ ID NO: 1676854 - DNA, 14 bp, Homo sapiens
ccgtgtcccaagga

SEQ ID NO: 1676855 - DNA, 17 bp, Homo sapiens
ccgtgtcctctccctgc

SEQ ID NO: 1676856 - DNA, 14 bp, Homo sapiens
ccgtgtctcagcct

SEQ ID NO: 1676857 - DNA, 19 bp, Homo sapiens
ccgtgtctcagcctctgcc

SEQ ID NO: 1676858 - DNA, 16 bp, Homo sapiens
ccgtgtctgtctggca

SEQ ID NO: 1676859 - DNA, 22 bp, Homo sapiens
ccgtgtgagaagtgaatgctgg

SEQ ID NO: 1676860 - DNA, 23 bp, Homo sapiens
ccgtgtgagaagtgaatgctggg

SEQ ID NO: 1676861 - DNA, 19 bp, Homo sapiens
ccgtgtgtcccagatgctg

SEQ ID NO: 1676862 - DNA, 19 bp, Homo sapiens
ccgtgttagccaggatggt

SEQ ID NO: 1676863 - DNA, 17 bp, Homo sapiens
ccgttactctccaacct

SEQ ID NO: 1676864 - DNA, 20 bp, Homo sapiens
ccgttaggaataacactgca

SEQ ID NO: 1676865 - DNA, 16 bp, Homo sapiens
ccgttaggattcaggc

SEQ ID NO: 1676866 - DNA, 19 bp, Homo sapiens
ccgttaggattcaggcagc

SEQ ID NO: 1676867 - DNA, 14 bp, Homo sapiens
ccgttcacatgtgt

SEQ ID NO: 1676868 - DNA, 15 bp, Homo sapiens
ccgttcagcctgtct

SEQ ID NO: 1676869 - DNA, 18 bp, Homo sapiens
ccgttccaccccaagaga

SEQ ID NO: 1676870 - DNA, 21 bp, Homo sapiens
ccgttccaccccaagagaact

SEQ ID NO: 1676871 - DNA, 13 bp, Homo sapiens
ccgttccctgtca

SEQ ID NO: 1676872 - DNA, 14 bp, Homo sapiens
ccgttccctgtcag

SEQ ID NO: 1676873 - DNA, 15 bp, Homo sapiens
ccgttccctgtcaga

SEQ ID NO: 1676874 - DNA, 18 bp, Homo sapiens
ccgttcgtacgcccagga

SEQ ID NO: 1676875 - DNA, 21 bp, Homo sapiens
ccgttctattgtgtggatgac

SEQ ID NO: 1676876 - DNA, 15 bp, Homo sapiens
ccgttctgctggcct

SEQ ID NO: 1676877 - DNA, 12 bp, Homo sapiens
ccgttctgttcc

SEQ ID NO: 1676878 - DNA, 14 bp, Homo sapiens
ccgttctgttccaa

SEQ ID NO: 1676879 - DNA, 15 bp, Homo sapiens
ccgtttatgggcctt

SEQ ID NO: 1676880 - DNA, 12 bp, Homo sapiens
ccgtttcagaag

SEQ ID NO: 1676881 - DNA, 12 bp, Homo sapiens
ccgtttcccggt

SEQ ID NO: 1676882 - DNA, 19 bp, Homo sapiens
ccgttttgtcactttttct

SEQ ID NO: 1676883 - DNA, 13 bp, Homo sapiens
cctaaaaattggt

SEQ ID NO: 1676884 - DNA, 19 bp, Homo sapiens
cctaaaagaaaccctgcac

SEQ ID NO: 1676885 - DNA, 13 bp, Homo sapiens
cctaaaagcactc

SEQ ID NO: 1676886 - DNA, 22 bp, Homo sapiens
cctaaaaggaaatctcacccca

SEQ ID NO: 1676887 - DNA, 23 bp, Homo sapiens
cctaaaaggaaatctcaccccat

SEQ ID NO: 1676888 - DNA, 17 bp, Homo sapiens
cctaaaagttgaaaagc

SEQ ID NO: 1676889 - DNA, 19 bp, Homo sapiens
cctaaaataacagtatgtg

SEQ ID NO: 1676890 - DNA, 17 bp, Homo sapiens
cctaaaattgtatgaaa

SEQ ID NO: 1676891 - DNA, 23 bp, Homo sapiens
cctaaacaaaagcaaagatgcat

SEQ ID NO: 1676892 - DNA, 17 bp, Homo sapiens
cctaaacataattgtgg

SEQ ID NO: 1676893 - DNA, 13 bp, Homo sapiens
cctcagcctccaa

SEQ ID NO: 1676894 - DNA, 19 bp, Homo sapiens
cctcagcctcccaaagtgc

SEQ ID NO: 1676895 - DNA, 21 bp, Homo sapiens
cctcagcctcccaaagtgctg

SEQ ID NO: 1676896 - DNA, 13 bp, Homo sapiens
cctcagcctggcc

SEQ ID NO: 1676897 - DNA, 17 bp, Homo sapiens
cctcagcctggccagac

SEQ ID NO: 1676898 - DNA, 18 bp, Homo sapiens
cctcagcctggccagaca

SEQ ID NO: 1676899 - DNA, 19 bp, Homo sapiens
cctcagcctggccagacac

SEQ ID NO: 1676900 - DNA, 20 bp, Homo sapiens
cctcagcctggccagacaca

SEQ ID NO: 1676901 - DNA, 21 bp, Homo sapiens
cctcagcctggccagacacag

SEQ ID NO: 1676902 - DNA, 11 bp, Homo sapiens
cctcagcctgt

SEQ ID NO: 1676903 - DNA, 23 bp, Homo sapiens
cctcagccttgaaaaacaagtct

SEQ ID NO: 1676904 - DNA, 19 bp, Homo sapiens
cctcagccttgccagagat

SEQ ID NO: 1676905 - DNA, 21 bp, Homo sapiens
cctcagccttgccagagatcc

SEQ ID NO: 1676906 - DNA, 22 bp, Homo sapiens
cctcagccttgccagagatcca

SEQ ID NO: 1676907 - DNA, 23 bp, Homo sapiens
cctcagccttggataatgctgtt

SEQ ID NO: 1676908 - DNA, 15 bp, Homo sapiens
cctcagcgagaggca

SEQ ID NO: 1676909 - DNA, 16 bp, Homo sapiens
cctcagcgagaggcag

SEQ ID NO: 1676910 - DNA, 17 bp, Homo sapiens
cctcagcgagaggcagc

SEQ ID NO: 1676911 - DNA, 21 bp, Homo sapiens
cctcagcgagaggcagcaagg

SEQ ID NO: 1676912 - DNA, 15 bp, Homo sapiens
cctcagctctctggg

SEQ ID NO: 1676913 - DNA, 12 bp, Homo sapiens
cctcagctgcca

SEQ ID NO: 1676914 - DNA, 16 bp, Homo sapiens
cctcagctgcctcact

SEQ ID NO: 1676915 - DNA, 17 bp, Homo sapiens
cctcagctgcctcactt

SEQ ID NO: 1676916 - DNA, 15 bp, Homo sapiens
cctcaggagagaccc

SEQ ID NO: 1676917 - DNA, 19 bp, Homo sapiens
cctcaggaggcaggacctt

SEQ ID NO: 1676918 - DNA, 23 bp, Homo sapiens
cctcaggcagcgtgtgggtcccg

SEQ ID NO: 1676919 - DNA, 13 bp, Homo sapiens
cctcaggcagctc

SEQ ID NO: 1676920 - DNA, 14 bp, Homo sapiens
cctcaggcagctca

SEQ ID NO: 1676921 - DNA, 15 bp, Homo sapiens
cctcaggcagctcaa

SEQ ID NO: 1676922 - DNA, 15 bp, Homo sapiens
cctcaggccagggct

SEQ ID NO: 1676923 - DNA, 20 bp, Homo sapiens
cctcagggacagagacacct

SEQ ID NO: 1676924 - DNA, 22 bp, Homo sapiens
cctcagggacagagacacctgc

SEQ ID NO: 1676925 - DNA, 24 bp, Homo sapiens
cctcagggacagagacacctgcac

SEQ ID NO: 1676926 - DNA, 21 bp, Homo sapiens
cctcagggagcagggaaggcc

SEQ ID NO: 1676927 - DNA, 23 bp, Homo sapiens
cctcagggagcagggaaggcctg

SEQ ID NO: 1676928 - DNA, 22 bp, Homo sapiens
cctcagggcacgcaggaccagt

SEQ ID NO: 1676929 - DNA, 14 bp, Homo sapiens
cctcagggcgctca

SEQ ID NO: 1676930 - DNA, 18 bp, Homo sapiens
cctcagggcgctcagacg

SEQ ID NO: 1676931 - DNA, 16 bp, Homo sapiens
cctcagggctcccagg

SEQ ID NO: 1676932 - DNA, 19 bp, Homo sapiens
cctcaggtacggagaagaa

SEQ ID NO: 1676933 - DNA, 16 bp, Homo sapiens
cctcaggtgctgtcca

SEQ ID NO: 1676934 - DNA, 21 bp, Homo sapiens
cctcaggtggccagcctggat

SEQ ID NO: 1676935 - DNA, 18 bp, Homo sapiens
cctcagtagtccctgcac

SEQ ID NO: 1676936 - DNA, 19 bp, Homo sapiens
cctcagtgccacttgacat

SEQ ID NO: 1676937 - DNA, 23 bp, Homo sapiens
cctcagtgccacttgacattcct

SEQ ID NO: 1676938 - DNA, 12 bp, Homo sapiens
cctcagtgtcat

SEQ ID NO: 1676939 - DNA, 23 bp, Homo sapiens
cctcagtgtcatttatgaaaaga

SEQ ID NO: 1676940 - DNA, 17 bp, Homo sapiens
cctcagttcccttggcc

SEQ ID NO: 1676941 - DNA, 20 bp, Homo sapiens
cctcagttcccttggcctca

SEQ ID NO: 1676942 - DNA, 22 bp, Homo sapiens
cctcagttcccttggcctcaga

SEQ ID NO: 1676943 - DNA, 23 bp, Homo sapiens
cctcagtttaatccttctagttt

SEQ ID NO: 1676944 - DNA, 19 bp, Homo sapiens
cctcagttttatcattttc

SEQ ID NO: 1676945 - DNA, 16 bp, Homo sapiens
cctcagttttccttct

SEQ ID NO: 1676946 - DNA, 17 bp, Homo sapiens
cctcagttttccttctg

SEQ ID NO: 1676947 - DNA, 18 bp, Homo sapiens
cctcagttttccttctgt

SEQ ID NO: 1676948 - DNA, 15 bp, Homo sapiens
cctcatattttctgt

SEQ ID NO: 1676949 - DNA, 18 bp, Homo sapiens
cctcatcactggactgca

SEQ ID NO: 1676950 - DNA, 22 bp, Homo sapiens
cctcatcactggactgcatggg

SEQ ID NO: 1676951 - DNA, 15 bp, Homo sapiens
cctcatccaaagttc

SEQ ID NO: 1676952 - DNA, 22 bp, Homo sapiens
cctcatccaccccatccctccc

SEQ ID NO: 1676953 - DNA, 20 bp, Homo sapiens
cctcatcccgtgttctcctt

SEQ ID NO: 1676954 - DNA, 11 bp, Homo sapiens
cctcatccctc

SEQ ID NO: 1676955 - DNA, 23 bp, Homo sapiens
cctcatcctgctcttttgtgatg

SEQ ID NO: 1676956 - DNA, 11 bp, Homo sapiens
cctcatctcct

SEQ ID NO: 1676957 - DNA, 13 bp, Homo sapiens
cctcatctccttt

SEQ ID NO: 1676958 - DNA, 13 bp, Homo sapiens
cctcatctgagag

SEQ ID NO: 1676959 - DNA, 18 bp, Homo sapiens
cctcatctgagaggctct

SEQ ID NO: 1676960 - DNA, 18 bp, Homo sapiens
cctcatctgtggagctgc

SEQ ID NO: 1676961 - DNA, 20 bp, Homo sapiens
cctcatgaatgtaaatttgt

SEQ ID NO: 1676962 - DNA, 14 bp, Homo sapiens
cctccaggtgcaga

SEQ ID NO: 1676963 - DNA, 16 bp, Homo sapiens
cctccagtaccttgct

SEQ ID NO: 1676964 - DNA, 23 bp, Homo sapiens
cctccagtacgtcccgctgctgt

SEQ ID NO: 1676965 - DNA, 20 bp, Homo sapiens
cctccagtagtggacaacag

SEQ ID NO: 1676966 - DNA, 16 bp, Homo sapiens
cctccagtgtgggctt

SEQ ID NO: 1676967 - DNA, 14 bp, Homo sapiens
cctccatagccacg

SEQ ID NO: 1676968 - DNA, 15 bp, Homo sapiens
cctccatctttctac

SEQ ID NO: 1676969 - DNA, 17 bp, Homo sapiens
cctccatgcaggcctta

SEQ ID NO: 1676970 - DNA, 14 bp, Homo sapiens
cctccatgctcctc

SEQ ID NO: 1676971 - DNA, 19 bp, Homo sapiens
cctccatgctcctcacctg

SEQ ID NO: 1676972 - DNA, 20 bp, Homo sapiens
cctccatgctcctcacctgt

SEQ ID NO: 1676973 - DNA, 19 bp, Homo sapiens
cctccatggcagcagccag

SEQ ID NO: 1676974 - DNA, 23 bp, Homo sapiens
cctccattcatccttccatccat

SEQ ID NO: 1676975 - DNA, 20 bp, Homo sapiens
cctccatttctctccaggaa

SEQ ID NO: 1676976 - DNA, 13 bp, Homo sapiens
cctccatttctgt

SEQ ID NO: 1676977 - DNA, 14 bp, Homo sapiens
cctccatttctgtc

SEQ ID NO: 1676978 - DNA, 18 bp, Homo sapiens
cctcccaaagtgctgaga

SEQ ID NO: 1676979 - DNA, 23 bp, Homo sapiens
cctcccaaagtgctgggattaca

SEQ ID NO: 1676980 - DNA, 16 bp, Homo sapiens
cctcccaacctcaatg

SEQ ID NO: 1676981 - DNA, 19 bp, Homo sapiens
cctcccaagcgttcctggc

SEQ ID NO: 1676982 - DNA, 21 bp, Homo sapiens
cctcccaagcgttcctggcct

SEQ ID NO: 1676983 - DNA, 15 bp, Homo sapiens
cctcccaaggtcctc

SEQ ID NO: 1676984 - DNA, 21 bp, Homo sapiens
cctcccaaggtttgagtccct

SEQ ID NO: 1676985 - DNA, 17 bp, Homo sapiens
cctcccaagtagctggg

SEQ ID NO: 1676986 - DNA, 19 bp, Homo sapiens
cctcccaatttcagactcc

SEQ ID NO: 1676987 - DNA, 11 bp, Homo sapiens
cctcccacaca

SEQ ID NO: 1676988 - DNA, 18 bp, Homo sapiens
cctcccacacccaaagct

SEQ ID NO: 1676989 - DNA, 19 bp, Homo sapiens
cctcccacacccaaagctg

SEQ ID NO: 1676990 - DNA, 14 bp, Homo sapiens
cctcccaccagagc

SEQ ID NO: 1676991 - DNA, 20 bp, Homo sapiens
cctcccacccacagccatag

SEQ ID NO: 1676992 - DNA, 12 bp, Homo sapiens
cctcccacccca

SEQ ID NO: 1676993 - DNA, 13 bp, Homo sapiens
cctcccaccccac

SEQ ID NO: 1676994 - DNA, 16 bp, Homo sapiens
cctcccaccccactcc

SEQ ID NO: 1676995 - DNA, 23 bp, Homo sapiens
cctcccaccccactccagccctg

SEQ ID NO: 1676996 - DNA, 20 bp, Homo sapiens
cctcccacccccttctctgc

SEQ ID NO: 1676997 - DNA, 21 bp, Homo sapiens
cctcccacccccttctctgct

SEQ ID NO: 1676998 - DNA, 10 bp, Homo sapiens
cctcccaccg

SEQ ID NO: 1676999 - DNA, 19 bp, Homo sapiens
cctcccacgcctcaccagc

SEQ ID NO: 1677000 - DNA, 14 bp, Homo sapiens
cctcccacggcacc

SEQ ID NO: 1677001 - DNA, 21 bp, Homo sapiens
cctcccactcctgctgcacag

SEQ ID NO: 1677002 - DNA, 16 bp, Homo sapiens
cctcccacttcactgc

SEQ ID NO: 1677003 - DNA, 15 bp, Homo sapiens
cctcccagcccattg

SEQ ID NO: 1677004 - DNA, 23 bp, Homo sapiens
cctcccagcccattgctgccaag

SEQ ID NO: 1677005 - DNA, 19 bp, Homo sapiens
cctcccaggaggtgcttga

SEQ ID NO: 1677006 - DNA, 22 bp, Homo sapiens
cctcccaggggagccagctgct

SEQ ID NO: 1677007 - DNA, 13 bp, Homo sapiens
cctcccagtgcct

SEQ ID NO: 1677008 - DNA, 18 bp, Homo sapiens
cctcccagtgccttctgg

SEQ ID NO: 1677009 - DNA, 22 bp, Homo sapiens
cctcccataattgctttgccaa

SEQ ID NO: 1677010 - DNA, 17 bp, Homo sapiens
cctcccatctccttccc

SEQ ID NO: 1677011 - DNA, 21 bp, Homo sapiens
cctcccatctccttcccccag

SEQ ID NO: 1677012 - DNA, 21 bp, Homo sapiens
cctccccaaagccactggaag

SEQ ID NO: 1677013 - DNA, 22 bp, Homo sapiens
cctccccaaagccactggaagg

SEQ ID NO: 1677014 - DNA, 23 bp, Homo sapiens
cctccccaaagccactggaagga

SEQ ID NO: 1677015 - DNA, 16 bp, Homo sapiens
cctccccacactccac

SEQ ID NO: 1677016 - DNA, 19 bp, Homo sapiens
cctccccacagtgccaccc

SEQ ID NO: 1677017 - DNA, 15 bp, Homo sapiens
cctccccagctcttc

SEQ ID NO: 1677018 - DNA, 20 bp, Homo sapiens
cctccccattagagtcagcc

SEQ ID NO: 1677019 - DNA, 21 bp, Homo sapiens
cctccccattagagtcagcct

SEQ ID NO: 1677020 - DNA, 20 bp, Homo sapiens
cctccccatttcccatctgc

SEQ ID NO: 1677021 - DNA, 21 bp, Homo sapiens
cctccccatttcccatctgca

SEQ ID NO: 1677022 - DNA, 22 bp, Homo sapiens
cctccccatttcccatctgcac

SEQ ID NO: 1677023 - DNA, 23 bp, Homo sapiens
cctccccatttcccatctgcacc

SEQ ID NO: 1677024 - DNA, 18 bp, Homo sapiens
cctcccccaacccccacc

SEQ ID NO: 1677025 - DNA, 15 bp, Homo sapiens
cctcccccagagggg

SEQ ID NO: 1677026 - DNA, 14 bp, Homo sapiens
cctcccccagcaga

SEQ ID NO: 1677027 - DNA, 15 bp, Homo sapiens
cctcccccagccagg

SEQ ID NO: 1677028 - DNA, 13 bp, Homo sapiens
cctccccccactg

SEQ ID NO: 1677029 - DNA, 19 bp, Homo sapiens
cctccccccagaccccgcc

SEQ ID NO: 1677030 - DNA, 17 bp, Homo sapiens
cctcccccccatgcact

SEQ ID NO: 1677031 - DNA, 18 bp, Homo sapiens
cctccccctcctgctgtg

SEQ ID NO: 1677032 - DNA, 14 bp, Homo sapiens
cctccccctgcaac

SEQ ID NO: 1677033 - DNA, 13 bp, Homo sapiens
cctccccctgcca

SEQ ID NO: 1677034 - DNA, 14 bp, Homo sapiens
cctccccctgccag

SEQ ID NO: 1677035 - DNA, 19 bp, Homo sapiens
cctccccctgccagtgcct

SEQ ID NO: 1677036 - DNA, 19 bp, Homo sapiens
cctccccctttcacactgg

SEQ ID NO: 1677037 - DNA, 20 bp, Homo sapiens
cctccccctttcacactgga

SEQ ID NO: 1677038 - DNA, 21 bp, Homo sapiens
cctccccgcaccccccaagct

SEQ ID NO: 1677039 - DNA, 20 bp, Homo sapiens
cctccccgctccgtctctgt

SEQ ID NO: 1677040 - DNA, 21 bp, Homo sapiens
cctccccgctccgtctctgtc

SEQ ID NO: 1677041 - DNA, 23 bp, Homo sapiens
cctccccgctccgtctctgtcct

SEQ ID NO: 1677042 - DNA, 13 bp, Homo sapiens
cctcccctatcca

SEQ ID NO: 1677043 - DNA, 14 bp, Homo sapiens
cctcccctccgcag

SEQ ID NO: 1677044 - DNA, 19 bp, Homo sapiens
cctccttttcactttattg

SEQ ID NO: 1677045 - DNA, 20 bp, Homo sapiens
cctccttttcactttattgc

SEQ ID NO: 1677046 - DNA, 15 bp, Homo sapiens
cctccttttttctta

SEQ ID NO: 1677047 - DNA, 16 bp, Homo sapiens
cctcgaaccaaggcag

SEQ ID NO: 1677048 - DNA, 19 bp, Homo sapiens
cctcgaaccaaggcagcct

SEQ ID NO: 1677049 - DNA, 22 bp, Homo sapiens
cctcgaaccaaggcagcctcca

SEQ ID NO: 1677050 - DNA, 23 bp, Homo sapiens
cctcgaaccaaggcagcctccag

SEQ ID NO: 1677051 - DNA, 22 bp, Homo sapiens
cctcgaacccactccggttccc

SEQ ID NO: 1677052 - DNA, 17 bp, Homo sapiens
cctcgaattttatctgt

SEQ ID NO: 1677053 - DNA, 20 bp, Homo sapiens
cctcgaattttatctgtgga

SEQ ID NO: 1677054 - DNA, 21 bp, Homo sapiens
cctcgaattttatctgtggag

SEQ ID NO: 1677055 - DNA, 14 bp, Homo sapiens
cctcgaccctgtgc

SEQ ID NO: 1677056 - DNA, 22 bp, Homo sapiens
cctcgaggaaggggggccgccg

SEQ ID NO: 1677057 - DNA, 15 bp, Homo sapiens
cctcgaggcaccggc

SEQ ID NO: 1677058 - DNA, 19 bp, Homo sapiens
cctcgcacaggccctagct

SEQ ID NO: 1677059 - DNA, 20 bp, Homo sapiens
cctcgcacaggccctagctt

SEQ ID NO: 1677060 - DNA, 12 bp, Homo sapiens
cctcgcagacct

SEQ ID NO: 1677061 - DNA, 15 bp, Homo sapiens
cctcgccctgtgagg

SEQ ID NO: 1677062 - DNA, 15 bp, Homo sapiens
cctcgccgtccctcc

SEQ ID NO: 1677063 - DNA, 16 bp, Homo sapiens
cctcgccgtccctccc

SEQ ID NO: 1677064 - DNA, 19 bp, Homo sapiens
cctcgccgtccctcccagg

SEQ ID NO: 1677065 - DNA, 21 bp, Homo sapiens
cctcgccgtccctcccaggtc

SEQ ID NO: 1677066 - DNA, 12 bp, Homo sapiens
cctcgctgcttc

SEQ ID NO: 1677067 - DNA, 14 bp, Homo sapiens
cctcggaagagccc

SEQ ID NO: 1677068 - DNA, 21 bp, Homo sapiens
cctcggagagcagcagcacca

SEQ ID NO: 1677069 - DNA, 14 bp, Homo sapiens
cctcggagcctcat

SEQ ID NO: 1677070 - DNA, 23 bp, Homo sapiens
cctcggagcctcatccgaggcag

SEQ ID NO: 1677071 - DNA, 20 bp, Homo sapiens
cctcggaggtccagctgggc

SEQ ID NO: 1677072 - DNA, 21 bp, Homo sapiens
cctcggaggtccagctgggcc

SEQ ID NO: 1677073 - DNA, 18 bp, Homo sapiens
cctcggcccctcccacac

SEQ ID NO: 1677074 - DNA, 13 bp, Homo sapiens
cctcgggaagcag

SEQ ID NO: 1677075 - DNA, 12 bp, Homo sapiens
cctcgggatgcc

SEQ ID NO: 1677076 - DNA, 23 bp, Homo sapiens
cctcgggatgccgttctgttcca

SEQ ID NO: 1677077 - DNA, 15 bp, Homo sapiens
cctcgggcccacctg

SEQ ID NO: 1677078 - DNA, 17 bp, Homo sapiens
cctcgggcccacctggc

SEQ ID NO: 1677079 - DNA, 19 bp, Homo sapiens
cctcgggcccacctggcca

SEQ ID NO: 1677080 - DNA, 22 bp, Homo sapiens
cctcgggcccacctggccacct

SEQ ID NO: 1677081 - DNA, 20 bp, Homo sapiens
cctcgggctggagcctccga

SEQ ID NO: 1677082 - DNA, 19 bp, Homo sapiens
cctcggggacaccagagct

SEQ ID NO: 1677083 - DNA, 16 bp, Homo sapiens
cctcgggggcctgtgg

SEQ ID NO: 1677084 - DNA, 17 bp, Homo sapiens
cctcgggggcctgtggt

SEQ ID NO: 1677085 - DNA, 15 bp, Homo sapiens
cctcggtactcccat

SEQ ID NO: 1677086 - DNA, 17 bp, Homo sapiens
cctcggtatctggcttc

SEQ ID NO: 1677087 - DNA, 23 bp, Homo sapiens
cctcggtatctggcttccctgga

SEQ ID NO: 1677088 - DNA, 17 bp, Homo sapiens
cctcggtgggccagagc

SEQ ID NO: 1677089 - DNA, 18 bp, Homo sapiens
cctcggtgggccagagct

SEQ ID NO: 1677090 - DNA, 13 bp, Homo sapiens
cctcgtcaagagc

SEQ ID NO: 1677091 - DNA, 18 bp, Homo sapiens
cctcgtcaagagcatgca

SEQ ID NO: 1677092 - DNA, 23 bp, Homo sapiens
cctcgtccacaggggcaggcctg

SEQ ID NO: 1677093 - DNA, 14 bp, Homo sapiens
cctcgtccgtctgt

SEQ ID NO: 1677094 - DNA, 17 bp, Homo sapiens
cctcgtcctccccctgc

SEQ ID NO: 1677095 - DNA, 19 bp, Homo sapiens
cctcgtcctccccctgcca

SEQ ID NO: 1677096 - DNA, 20 bp, Homo sapiens
cctcgtcctccccctgccag

SEQ ID NO: 1677097 - DNA, 15 bp, Homo sapiens
cctcgtcctgtccca

SEQ ID NO: 1677098 - DNA, 16 bp, Homo sapiens
cctcgtcctgtcccag

SEQ ID NO: 1677099 - DNA, 19 bp, Homo sapiens
cctcgtctccctggtgcct

SEQ ID NO: 1677100 - DNA, 18 bp, Homo sapiens
cctcgtggccagcccggc

SEQ ID NO: 1677101 - DNA, 19 bp, Homo sapiens
cctcgtggccttccccagc

SEQ ID NO: 1677102 - DNA, 18 bp, Homo sapiens
cctcgttggagagcagca

SEQ ID NO: 1677103 - DNA, 16 bp, Homo sapiens
cctctaaagcagaggc

SEQ ID NO: 1677104 - DNA, 15 bp, Homo sapiens
cctctaacccagtgg

SEQ ID NO: 1677105 - DNA, 14 bp, Homo sapiens
cctctaactcactg

SEQ ID NO: 1677106 - DNA, 19 bp, Homo sapiens
cctctacgaggccatccag

SEQ ID NO: 1677107 - DNA, 19 bp, Homo sapiens
cctctagaaatttttcaga

SEQ ID NO: 1677108 - DNA, 14 bp, Homo sapiens
cctctagaatccca

SEQ ID NO: 1677109 - DNA, 20 bp, Homo sapiens
cctctagaatcccagcagca

SEQ ID NO: 1677110 - DNA, 14 bp, Homo sapiens
cctctagagctgga

SEQ ID NO: 1677111 - DNA, 19 bp, Homo sapiens
cctctagcccactccctgc

SEQ ID NO: 1677112 - DNA, 22 bp, Homo sapiens
cctctagctgtgggggtgaggg

SEQ ID NO: 1677113 - DNA, 21 bp, Homo sapiens
cctctagtccccaaggcctct

SEQ ID NO: 1677114 - DNA, 13 bp, Homo sapiens
cctctagtgccct

SEQ ID NO: 1677115 - DNA, 21 bp, Homo sapiens
cctctatactttgttctgttg

SEQ ID NO: 1677116 - DNA, 20 bp, Homo sapiens
cctctattaattactgtgtg

SEQ ID NO: 1677117 - DNA, 14 bp, Homo sapiens
cctctattgatgta

SEQ ID NO: 1677118 - DNA, 23 bp, Homo sapiens
cctctattgatgtacagtctgtc

SEQ ID NO: 1677119 - DNA, 21 bp, Homo sapiens
cctctatttatgtttgcactt

SEQ ID NO: 1677120 - DNA, 21 bp, Homo sapiens
cctctatttattagccaactg

SEQ ID NO: 1677121 - DNA, 18 bp, Homo sapiens
cctctcaagtagctggga

SEQ ID NO: 1677122 - DNA, 13 bp, Homo sapiens
cctctcacacaca

SEQ ID NO: 1677123 - DNA, 22 bp, Homo sapiens
cctctcagaggcctgctgccag

SEQ ID NO: 1677124 - DNA, 21 bp, Homo sapiens
cctctcagcatagcctgcctg

SEQ ID NO: 1677125 - DNA, 15 bp, Homo sapiens
cctctcaggatccaa

SEQ ID NO: 1677126 - DNA, 18 bp, Homo sapiens
cctctcaggatccaagct

SEQ ID NO: 1677127 - DNA, 23 bp, Homo sapiens
cctctcaggatccaagctaagca

SEQ ID NO: 1677128 - DNA, 13 bp, Homo sapiens
cctctcagtgcct

SEQ ID NO: 1677129 - DNA, 17 bp, Homo sapiens
cctctcagtgccttctc

SEQ ID NO: 1677130 - DNA, 15 bp, Homo sapiens
cctctcatctcaggt

SEQ ID NO: 1677131 - DNA, 18 bp, Homo sapiens
cctctcattccagaggaa

SEQ ID NO: 1677132 - DNA, 15 bp, Homo sapiens
cctctccaaccactg

SEQ ID NO: 1677133 - DNA, 23 bp, Homo sapiens
cctctccaaccactgtgccactg

SEQ ID NO: 1677134 - DNA, 23 bp, Homo sapiens
cctctccaagggcttctgcaccc

SEQ ID NO: 1677135 - DNA, 16 bp, Homo sapiens
cctctccactgccttc

SEQ ID NO: 1677136 - DNA, 14 bp, Homo sapiens
cctctccactgctg

SEQ ID NO: 1677137 - DNA, 18 bp, Homo sapiens
cctctccactgctggaca

SEQ ID NO: 1677138 - DNA, 23 bp, Homo sapiens
cctctcccggctgcctgccgccc

SEQ ID NO: 1677139 - DNA, 17 bp, Homo sapiens
cctctcccgtcagggcc

SEQ ID NO: 1677140 - DNA, 13 bp, Homo sapiens
cctctccctctct

SEQ ID NO: 1677141 - DNA, 13 bp, Homo sapiens
cctctccctgcca

SEQ ID NO: 1677142 - DNA, 15 bp, Homo sapiens
cctctccctggccct

SEQ ID NO: 1677143 - DNA, 22 bp, Homo sapiens
cctctcctatgtggcagctggg

SEQ ID NO: 1677144 - DNA, 11 bp, Homo sapiens
cctctcctgcc

SEQ ID NO: 1677145 - DNA, 13 bp, Homo sapiens
cctctcctgccta

SEQ ID NO: 1677146 - DNA, 14 bp, Homo sapiens
cctctcctgtctgc

SEQ ID NO: 1677147 - DNA, 21 bp, Homo sapiens
cctctccttgggctcctggct

SEQ ID NO: 1677148 - DNA, 23 bp, Homo sapiens
cctctccttgggctcctggctgc

SEQ ID NO: 1677149 - DNA, 13 bp, Homo sapiens
cctctccttttga

SEQ ID NO: 1677150 - DNA, 16 bp, Homo sapiens
cctctcgagggcaggg

SEQ ID NO: 1677151 - DNA, 22 bp, Homo sapiens
cctctcgcttcctcagcctcca

SEQ ID NO: 1677152 - DNA, 15 bp, Homo sapiens
cctctcggtgctcca

SEQ ID NO: 1677153 - DNA, 17 bp, Homo sapiens
cctctctatcctctctt

SEQ ID NO: 1677154 - DNA, 19 bp, Homo sapiens
cctctctatcctctcttcc

SEQ ID NO: 1677155 - DNA, 13 bp, Homo sapiens
cctctctctcttc

SEQ ID NO: 1677156 - DNA, 14 bp, Homo sapiens
cctctctctcttct

SEQ ID NO: 1677157 - DNA, 12 bp, Homo sapiens
cctctctctggg

SEQ ID NO: 1677158 - DNA, 11 bp, Homo sapiens
cctctctctgt

SEQ ID NO: 1677159 - DNA, 22 bp, Homo sapiens
cctctctctttcctccacccat

SEQ ID NO: 1677160 - DNA, 16 bp, Homo sapiens
cctctctgagtcaaat

SEQ ID NO: 1677161 - DNA, 17 bp, Homo sapiens
cctctctgagtcaaatc

SEQ ID NO: 1677162 - DNA, 24 bp, Homo sapiens
cctctctgagtcaaatccagtggt

SEQ ID NO: 1677163 - DNA, 22 bp, Homo sapiens
cctctctgcagacttcccagct

SEQ ID NO: 1677164 - DNA, 14 bp, Homo sapiens
cctctctgcctggg

SEQ ID NO: 1677165 - DNA, 12 bp, Homo sapiens
cctctctgctat

SEQ ID NO: 1677166 - DNA, 17 bp, Homo sapiens
cctctctgctccttcac

SEQ ID NO: 1677167 - DNA, 22 bp, Homo sapiens
cctctctggcctcccacccgat

SEQ ID NO: 1677168 - DNA, 23 bp, Homo sapiens
cctctctgtagtttatggcagaa

SEQ ID NO: 1677169 - DNA, 13 bp, Homo sapiens
cctctctgtccct

SEQ ID NO: 1677170 - DNA, 21 bp, Homo sapiens
cctctcttcagcccctagtgc

SEQ ID NO: 1677171 - DNA, 13 bp, Homo sapiens
cctctcttcccct

SEQ ID NO: 1677172 - DNA, 12 bp, Homo sapiens
cctctcttcctc

SEQ ID NO: 1677173 - DNA, 11 bp, Homo sapiens
cctctcttgca

SEQ ID NO: 1677174 - DNA, 13 bp, Homo sapiens
cctctcttgcacc

SEQ ID NO: 1677175 - DNA, 23 bp, Homo sapiens
cctctcttgcacccgcctctccc

SEQ ID NO: 1677176 - DNA, 15 bp, Homo sapiens
cctctcttggctatt

SEQ ID NO: 1677177 - DNA, 15 bp, Homo sapiens
cctctctttctctgg

SEQ ID NO: 1677178 - DNA, 17 bp, Homo sapiens
cctctgaccaacaggct

SEQ ID NO: 1677179 - DNA, 15 bp, Homo sapiens
cctctgacctgcagg

SEQ ID NO: 1677180 - DNA, 17 bp, Homo sapiens
cctctgacctgcaggcc

SEQ ID NO: 1677181 - DNA, 19 bp, Homo sapiens
cctctgacgtccacctcct

SEQ ID NO: 1677182 - DNA, 11 bp, Homo sapiens
cctctgagaag

SEQ ID NO: 1677183 - DNA, 22 bp, Homo sapiens
cctctgagcagcctctgccagg

SEQ ID NO: 1677184 - DNA, 14 bp, Homo sapiens
cctctgagccttgg

SEQ ID NO: 1677185 - DNA, 16 bp, Homo sapiens
cctctgagccttggtg

SEQ ID NO: 1677186 - DNA, 13 bp, Homo sapiens
cctctgaggacag

SEQ ID NO: 1677187 - DNA, 21 bp, Homo sapiens
cctctgatcacattcttcaaa

SEQ ID NO: 1677188 - DNA, 16 bp, Homo sapiens
cctctgcaactgctca

SEQ ID NO: 1677189 - DNA, 20 bp, Homo sapiens
cctctgcacaccctccagag

SEQ ID NO: 1677190 - DNA, 17 bp, Homo sapiens
cctctgcacccagaaca

SEQ ID NO: 1677191 - DNA, 16 bp, Homo sapiens
cctctgcactcccacc

SEQ ID NO: 1677192 - DNA, 16 bp, Homo sapiens
cctctgcagctgacct

SEQ ID NO: 1677193 - DNA, 14 bp, Homo sapiens
cctctgcagtctca

SEQ ID NO: 1677194 - DNA, 19 bp, Homo sapiens
cctctgcagtctcatttct

SEQ ID NO: 1677195 - DNA, 17 bp, Homo sapiens
cctctgcagtgccttgg

SEQ ID NO: 1677196 - DNA, 12 bp, Homo sapiens
cctctgccacct

SEQ ID NO: 1677197 - DNA, 11 bp, Homo sapiens
cctctgcccag

SEQ ID NO: 1677198 - DNA, 20 bp, Homo sapiens
cctctgcccagcttgggccc

SEQ ID NO: 1677199 - DNA, 11 bp, Homo sapiens
cctctgcccca

SEQ ID NO: 1677200 - DNA, 14 bp, Homo sapiens
cctctgccccaagc

SEQ ID NO: 1677201 - DNA, 19 bp, Homo sapiens
cctctgccccaagcagcca

SEQ ID NO: 1677202 - DNA, 12 bp, Homo sapiens
cctctgccctgg

SEQ ID NO: 1677203 - DNA, 20 bp, Homo sapiens
cctctgccggtcgggcagcc

SEQ ID NO: 1677204 - DNA, 12 bp, Homo sapiens
cctctgcctcaa

SEQ ID NO: 1677205 - DNA, 13 bp, Homo sapiens
cctctgcctctag

SEQ ID NO: 1677206 - DNA, 10 bp, Homo sapiens
cctctgcctg

SEQ ID NO: 1677207 - DNA, 20 bp, Homo sapiens
cctctgcctgcactccctgg

SEQ ID NO: 1677208 - DNA, 17 bp, Homo sapiens
cctctgcctgcattctg

SEQ ID NO: 1677209 - DNA, 13 bp, Homo sapiens
cctctgcctgccc

SEQ ID NO: 1677210 - DNA, 21 bp, Homo sapiens
cctctgcctgccccgccccca

SEQ ID NO: 1677211 - DNA, 13 bp, Homo sapiens
cctctgcctgctg

SEQ ID NO: 1677212 - DNA, 11 bp, Homo sapiens
cctctgcctgg

SEQ ID NO: 1677213 - DNA, 13 bp, Homo sapiens
cctctgcctggga

SEQ ID NO: 1677214 - DNA, 19 bp, Homo sapiens
cctctgccttcaggcttct

SEQ ID NO: 1677215 - DNA, 13 bp, Homo sapiens
cctctgctcaccg

SEQ ID NO: 1677216 - DNA, 20 bp, Homo sapiens
cctctgctcaccgcccatca

SEQ ID NO: 1677217 - DNA, 23 bp, Homo sapiens
cctctgctcaccgcccatcaggg

SEQ ID NO: 1677218 - DNA, 11 bp, Homo sapiens
cctctgctcca

SEQ ID NO: 1677219 - DNA, 19 bp, Homo sapiens
cctctgctgccggctctgg

SEQ ID NO: 1677220 - DNA, 20 bp, Homo sapiens
cctctgctgccggctctggg

SEQ ID NO: 1677221 - DNA, 12 bp, Homo sapiens
cctctgctgctg

SEQ ID NO: 1677222 - DNA, 18 bp, Homo sapiens
cctctgctgtcctgcagt

SEQ ID NO: 1677223 - DNA, 18 bp, Homo sapiens
cctctgcttttgcacacc

SEQ ID NO: 1677224 - DNA, 18 bp, Homo sapiens
cctctggactggctagag

SEQ ID NO: 1677225 - DNA, 17 bp, Homo sapiens
cctctggagcaccaggt

SEQ ID NO: 1677226 - DNA, 17 bp, Homo sapiens
cctctggaggggtgtgg

SEQ ID NO: 1677227 - DNA, 23 bp, Homo sapiens
cctctggagtgcccccagcccag

SEQ ID NO: 1677228 - DNA, 11 bp, Homo sapiens
cctctggatct

SEQ ID NO: 1677229 - DNA, 12 bp, Homo sapiens
cctctggatcta

SEQ ID NO: 1677230 - DNA, 21 bp, Homo sapiens
cctctggcattagaattattt

SEQ ID NO: 1677231 - DNA, 23 bp, Homo sapiens
cctctggcattagaattatttaa

SEQ ID NO: 1677232 - DNA, 17 bp, Homo sapiens
cctctggccgccacccc

SEQ ID NO: 1677233 - DNA, 19 bp, Homo sapiens
cctctggccgccaccccca

SEQ ID NO: 1677234 - DNA, 15 bp, Homo sapiens
cctctggctagagcc

SEQ ID NO: 1677235 - DNA, 15 bp, Homo sapiens
cctctggcttcccat

SEQ ID NO: 1677236 - DNA, 14 bp, Homo sapiens
cctctgggcagtgt

SEQ ID NO: 1677237 - DNA, 15 bp, Homo sapiens
cctctgggcagtgtg

SEQ ID NO: 1677238 - DNA, 12 bp, Homo sapiens
cctctgggccat

SEQ ID NO: 1677239 - DNA, 20 bp, Homo sapiens
cctctgggggtcctctctga

SEQ ID NO: 1677240 - DNA, 15 bp, Homo sapiens
cctctgggtccctcc

SEQ ID NO: 1677241 - DNA, 16 bp, Homo sapiens
cctctggtcgctcctg

SEQ ID NO: 1677242 - DNA, 15 bp, Homo sapiens
cctctggtggctcct

SEQ ID NO: 1677243 - DNA, 18 bp, Homo sapiens
cctctggtgtgtggtgag

SEQ ID NO: 1677244 - DNA, 12 bp, Homo sapiens
cctctggttcct

SEQ ID NO: 1677245 - DNA, 17 bp, Homo sapiens
cctctgtagctccctcc

SEQ ID NO: 1677246 - DNA, 22 bp, Homo sapiens
cctctgtagctccctcctccca

SEQ ID NO: 1677247 - DNA, 14 bp, Homo sapiens
cctctgtcaggcct

SEQ ID NO: 1677248 - DNA, 13 bp, Homo sapiens
cctgaagggaact

SEQ ID NO: 1677249 - DNA, 18 bp, Homo sapiens
cctgaaggtcccctggca

SEQ ID NO: 1677250 - DNA, 20 bp, Homo sapiens
cctgaagttatgtgtatgtg

SEQ ID NO: 1677251 - DNA, 12 bp, Homo sapiens
cctgaatatttt

SEQ ID NO: 1677252 - DNA, 14 bp, Homo sapiens
cctgaatcatgagc

SEQ ID NO: 1677253 - DNA, 17 bp, Homo sapiens
cctgaatccaaactaat

SEQ ID NO: 1677254 - DNA, 21 bp, Homo sapiens
cctgaatgtttaaagatcatg

SEQ ID NO: 1677255 - DNA, 15 bp, Homo sapiens
cctgaattctttttc

SEQ ID NO: 1677256 - DNA, 19 bp, Homo sapiens
cctgacaaccactggtctg

SEQ ID NO: 1677257 - DNA, 16 bp, Homo sapiens
cctgacaatggcagct

SEQ ID NO: 1677258 - DNA, 17 bp, Homo sapiens
cctgacaatggcagcta

SEQ ID NO: 1677259 - DNA, 18 bp, Homo sapiens
cctgacaatggcagctag

SEQ ID NO: 1677260 - DNA, 12 bp, Homo sapiens
cctgacaccccc

SEQ ID NO: 1677261 - DNA, 17 bp, Homo sapiens
cctgacagaaggtgcca

SEQ ID NO: 1677262 - DNA, 20 bp, Homo sapiens
cctgacagatgtcagccgag

SEQ ID NO: 1677263 - DNA, 22 bp, Homo sapiens
cctgacatcatcattcttgtgg

SEQ ID NO: 1677264 - DNA, 19 bp, Homo sapiens
cctgaccaacatggagaaa

SEQ ID NO: 1677265 - DNA, 17 bp, Homo sapiens
cctgaccaccctcccct

SEQ ID NO: 1677266 - DNA, 14 bp, Homo sapiens
cctgaccagctgct

SEQ ID NO: 1677267 - DNA, 15 bp, Homo sapiens
cctgaccagctgctc

SEQ ID NO: 1677268 - DNA, 19 bp, Homo sapiens
cctgacccaggccgcagct

SEQ ID NO: 1677269 - DNA, 14 bp, Homo sapiens
cctgacccctgctc

SEQ ID NO: 1677270 - DNA, 16 bp, Homo sapiens
cctgacctaccccagc

SEQ ID NO: 1677271 - DNA, 19 bp, Homo sapiens
cctgacctaccccagccag

SEQ ID NO: 1677272 - DNA, 17 bp, Homo sapiens
cctgaccttagcgttct

SEQ ID NO: 1677273 - DNA, 22 bp, Homo sapiens
cctgaccttgtcatccacctgt

SEQ ID NO: 1677274 - DNA, 14 bp, Homo sapiens
cctgacgccctgcg

SEQ ID NO: 1677275 - DNA, 21 bp, Homo sapiens
cctgacgccctgcgttggagc

SEQ ID NO: 1677276 - DNA, 22 bp, Homo sapiens
cctgacgccctgcgttggagcc

SEQ ID NO: 1677277 - DNA, 19 bp, Homo sapiens
cctgacggcgcccccagtg

SEQ ID NO: 1677278 - DNA, 21 bp, Homo sapiens
cctgacggcgcccccagtgtg

SEQ ID NO: 1677279 - DNA, 19 bp, Homo sapiens
cctgactctcacctgtact

SEQ ID NO: 1677280 - DNA, 13 bp, Homo sapiens
cctgactctctgt

SEQ ID NO: 1677281 - DNA, 17 bp, Homo sapiens
cctgactctctgtgacc

SEQ ID NO: 1677282 - DNA, 13 bp, Homo sapiens
cctgactctgaaa

SEQ ID NO: 1677283 - DNA, 14 bp, Homo sapiens
cctgactgctcaga

SEQ ID NO: 1677284 - DNA, 12 bp, Homo sapiens
cctgactggtgc

SEQ ID NO: 1677285 - DNA, 16 bp, Homo sapiens
cctgacttctggagat

SEQ ID NO: 1677286 - DNA, 14 bp, Homo sapiens
cctgacttgcttta

SEQ ID NO: 1677287 - DNA, 23 bp, Homo sapiens
cctgacttggggagatggagttc

SEQ ID NO: 1677288 - DNA, 17 bp, Homo sapiens
cctgagaatgagtggga

SEQ ID NO: 1677289 - DNA, 19 bp, Homo sapiens
cctgagaatgagtgggaat

SEQ ID NO: 1677290 - DNA, 20 bp, Homo sapiens
cctgagaatgagtgggaatc

SEQ ID NO: 1677291 - DNA, 22 bp, Homo sapiens
cctgagaatgagtgggaatccg

SEQ ID NO: 1677292 - DNA, 20 bp, Homo sapiens
cctgagacaaatggaggcct

SEQ ID NO: 1677293 - DNA, 21 bp, Homo sapiens
cctgagacaaatggaggcctg

SEQ ID NO: 1677294 - DNA, 12 bp, Homo sapiens
cctgagaccaca

SEQ ID NO: 1677295 - DNA, 14 bp, Homo sapiens
cctgagacctccac

SEQ ID NO: 1677296 - DNA, 15 bp, Homo sapiens
cctgagactccagaa

SEQ ID NO: 1677297 - DNA, 23 bp, Homo sapiens
cctgagactccagaatctgctgt

SEQ ID NO: 1677298 - DNA, 20 bp, Homo sapiens
cctgagagagaatagagctg

SEQ ID NO: 1677299 - DNA, 13 bp, Homo sapiens
cctgagaggcagg

SEQ ID NO: 1677300 - DNA, 14 bp, Homo sapiens
cctgagaggcaggc

SEQ ID NO: 1677301 - DNA, 15 bp, Homo sapiens
cctgagaggggaagc

SEQ ID NO: 1677302 - DNA, 20 bp, Homo sapiens
cctgagagtcagctctctgc

SEQ ID NO: 1677303 - DNA, 22 bp, Homo sapiens
cctgagagtcagctctctgccc

SEQ ID NO: 1677304 - DNA, 23 bp, Homo sapiens
cctgagagtcagctctctgccct

SEQ ID NO: 1677305 - DNA, 18 bp, Homo sapiens
cctgagatctgcacagtc

SEQ ID NO: 1677306 - DNA, 21 bp, Homo sapiens
cctgagatctgcacagtcaga

SEQ ID NO: 1677307 - DNA, 16 bp, Homo sapiens
cctgagatgcaggtga

SEQ ID NO: 1677308 - DNA, 17 bp, Homo sapiens
cctgagatgcaggtgat

SEQ ID NO: 1677309 - DNA, 20 bp, Homo sapiens
cctgagatgcaggtgatgcc

SEQ ID NO: 1677310 - DNA, 11 bp, Homo sapiens
cctgagattct

SEQ ID NO: 1677311 - DNA, 11 bp, Homo sapiens
cctgagatttc

SEQ ID NO: 1677312 - DNA, 16 bp, Homo sapiens
cctgagatttcatctg

SEQ ID NO: 1677313 - DNA, 17 bp, Homo sapiens
cctgagatttcatctgc

SEQ ID NO: 1677314 - DNA, 22 bp, Homo sapiens
cctgagatttcatctgctctcc

SEQ ID NO: 1677315 - DNA, 23 bp, Homo sapiens
cctgagcaacagagtgagaccct

SEQ ID NO: 1677316 - DNA, 19 bp, Homo sapiens
cctgagcaatgtctgtgct

SEQ ID NO: 1677317 - DNA, 19 bp, Homo sapiens
cctgagcacccgctgacat

SEQ ID NO: 1677318 - DNA, 16 bp, Homo sapiens
cctgagcacctcccag

SEQ ID NO: 1677319 - DNA, 17 bp, Homo sapiens
cctgagcacctcccagc

SEQ ID NO: 1677320 - DNA, 19 bp, Homo sapiens
cctgagcacctcccagccc

SEQ ID NO: 1677321 - DNA, 21 bp, Homo sapiens
cctgagcacctcccagcccct

SEQ ID NO: 1677322 - DNA, 13 bp, Homo sapiens
cctgagcagctgg

SEQ ID NO: 1677323 - DNA, 12 bp, Homo sapiens
cctgagcagggt

SEQ ID NO: 1677324 - DNA, 19 bp, Homo sapiens
cctgagcagggtccacagc

SEQ ID NO: 1677325 - DNA, 21 bp, Homo sapiens
cctgagcagggtccacagctg

SEQ ID NO: 1677326 - DNA, 22 bp, Homo sapiens
cctgagcagggtccacagctgg

SEQ ID NO: 1677327 - DNA, 17 bp, Homo sapiens
cctgagcatcctggttc

SEQ ID NO: 1677328 - DNA, 17 bp, Homo sapiens
cctgagccccctgcacc

SEQ ID NO: 1677329 - DNA, 17 bp, Homo sapiens
cctgagccctactccct

SEQ ID NO: 1677330 - DNA, 19 bp, Homo sapiens
cctgagccctactccctgc

SEQ ID NO: 1677331 - DNA, 17 bp, Homo sapiens
cctgagccggccccagg

SEQ ID NO: 1677332 - DNA, 12 bp, Homo sapiens
cctgagcgctcc

SEQ ID NO: 1677333 - DNA, 16 bp, Homo sapiens
cctgagcgctcctgcc

SEQ ID NO: 1677334 - DNA, 21 bp, Homo sapiens
cctgagcgctcctgccgcaga

SEQ ID NO: 1677335 - DNA, 21 bp, Homo sapiens
cctgagcgctgtggactgtcc

SEQ ID NO: 1677336 - DNA, 23 bp, Homo sapiens
cctgagcgctgtggactgtcctg

SEQ ID NO: 1677337 - DNA, 16 bp, Homo sapiens
cctgagctcggtggac

SEQ ID NO: 1677338 - DNA, 18 bp, Homo sapiens
cctgagctcggtggaccc

SEQ ID NO: 1677339 - DNA, 20 bp, Homo sapiens
cctgagctcggtggacccag

SEQ ID NO: 1677340 - DNA, 17 bp, Homo sapiens
cctgagctggggaagcc

SEQ ID NO: 1677341 - DNA, 14 bp, Homo sapiens
cctgagctggggcc

SEQ ID NO: 1677342 - DNA, 15 bp, Homo sapiens
cctgagctggggcca

SEQ ID NO: 1677343 - DNA, 17 bp, Homo sapiens
cctgagctggggccaca

SEQ ID NO: 1677344 - DNA, 18 bp, Homo sapiens
cctgagctgtcgctgcct

SEQ ID NO: 1677345 - DNA, 23 bp, Homo sapiens
cctgagctgtcgctgcctccatg

SEQ ID NO: 1677346 - DNA, 16 bp, Homo sapiens
cctgaggacctctcag

SEQ ID NO: 1677347 - DNA, 18 bp, Homo sapiens
cctgaggacctctcagca

SEQ ID NO: 1677348 - DNA, 17 bp, Homo sapiens
cctgaggactggagacc

SEQ ID NO: 1677349 - DNA, 20 bp, Homo sapiens
cctgaggagccctgaggacc

SEQ ID NO: 1677350 - DNA, 12 bp, Homo sapiens
cctgaggaggag

SEQ ID NO: 1677351 - DNA, 17 bp, Homo sapiens
cctgaggaggaggacac

SEQ ID NO: 1677352 - DNA, 19 bp, Homo sapiens
cctgaggaggaggacacag

SEQ ID NO: 1677353 - DNA, 20 bp, Homo sapiens
cctgaggatgagctggaagg

SEQ ID NO: 1677354 - DNA, 20 bp, Homo sapiens
cctgaggatgggtcagagct

SEQ ID NO: 1677355 - DNA, 21 bp, Homo sapiens
cctgaggcaggtgagaaccca

SEQ ID NO: 1677356 - DNA, 22 bp, Homo sapiens
cctgaggcaggtgagaacccag

SEQ ID NO: 1677357 - DNA, 23 bp, Homo sapiens
cctgaggcaggtgagaacccaga

SEQ ID NO: 1677358 - DNA, 19 bp, Homo sapiens
cctgaggcctagactctgt

SEQ ID NO: 1677359 - DNA, 16 bp, Homo sapiens
cctgaggcctcatttt

SEQ ID NO: 1677360 - DNA, 21 bp, Homo sapiens
cctgaggcctctggaaagcaa

SEQ ID NO: 1677361 - DNA, 21 bp, Homo sapiens
cctgcagaggtctgtgctgag

SEQ ID NO: 1677362 - DNA, 15 bp, Homo sapiens
cctgcagagtagtta

SEQ ID NO: 1677363 - DNA, 13 bp, Homo sapiens
cctgcagatgcca

SEQ ID NO: 1677364 - DNA, 20 bp, Homo sapiens
cctgcagatgccaccctagc

SEQ ID NO: 1677365 - DNA, 18 bp, Homo sapiens
cctgcagcaaacactcca

SEQ ID NO: 1677366 - DNA, 19 bp, Homo sapiens
cctgcagcaaacactccac

SEQ ID NO: 1677367 - DNA, 21 bp, Homo sapiens
cctgcagcaaacactccaccc

SEQ ID NO: 1677368 - DNA, 12 bp, Homo sapiens
cctgcagcacat

SEQ ID NO: 1677369 - DNA, 22 bp, Homo sapiens
cctggaattcagcaccctgggt

SEQ ID NO: 1677370 - DNA, 23 bp, Homo sapiens
cctggaattcagcaccctgggtg

SEQ ID NO: 1677371 - DNA, 15 bp, Homo sapiens
cctggaattgccagc

SEQ ID NO: 1677372 - DNA, 10 bp, Homo sapiens
cctggaattt

SEQ ID NO: 1677373 - DNA, 13 bp, Homo sapiens
cctggacacagct

SEQ ID NO: 1677374 - DNA, 18 bp, Homo sapiens
cctggacacagctcttca

SEQ ID NO: 1677375 - DNA, 13 bp, Homo sapiens
cctggacactagg

SEQ ID NO: 1677376 - DNA, 20 bp, Homo sapiens
cctggacaggcagcctcctt

SEQ ID NO: 1677377 - DNA, 23 bp, Homo sapiens
cctggacagtatcccacatccaa

SEQ ID NO: 1677378 - DNA, 20 bp, Homo sapiens
cctggaccaccagccccagc

SEQ ID NO: 1677379 - DNA, 14 bp, Homo sapiens
cctggaccagcctc

SEQ ID NO: 1677380 - DNA, 14 bp, Homo sapiens
cctggacctgcctc

SEQ ID NO: 1677381 - DNA, 16 bp, Homo sapiens
cctggacctgcctcct

SEQ ID NO: 1677382 - DNA, 15 bp, Homo sapiens
cctggaccttgacag

SEQ ID NO: 1677383 - DNA, 21 bp, Homo sapiens
cctggaccttgacagagcagc

SEQ ID NO: 1677384 - DNA, 23 bp, Homo sapiens
cctggaccttgacagagcagcta

SEQ ID NO: 1677385 - DNA, 19 bp, Homo sapiens
cctggaccttttgttttct

SEQ ID NO: 1677386 - DNA, 20 bp, Homo sapiens
cctggaccttttgttttctg

SEQ ID NO: 1677387 - DNA, 18 bp, Homo sapiens
cctggacgaagagcaggc

SEQ ID NO: 1677388 - DNA, 20 bp, Homo sapiens
cctggactctaagctggagc

SEQ ID NO: 1677389 - DNA, 18 bp, Homo sapiens
cctggactgaccacacca

SEQ ID NO: 1677390 - DNA, 17 bp, Homo sapiens
cctggactggtggcccc

SEQ ID NO: 1677391 - DNA, 22 bp, Homo sapiens
cctggactggtggcccctgcct

SEQ ID NO: 1677392 - DNA, 13 bp, Homo sapiens
cctggacttcctg

SEQ ID NO: 1677393 - DNA, 13 bp, Homo sapiens
cctggacttgcct

SEQ ID NO: 1677394 - DNA, 16 bp, Homo sapiens
cctggactttcctgca

SEQ ID NO: 1677395 - DNA, 21 bp, Homo sapiens
cctggactttggttctctcca

SEQ ID NO: 1677396 - DNA, 16 bp, Homo sapiens
cctggagacaaggtgc

SEQ ID NO: 1677397 - DNA, 19 bp, Homo sapiens
cctggagacaaggtgctaa

SEQ ID NO: 1677398 - DNA, 21 bp, Homo sapiens
cctggagaccacactgcacac

SEQ ID NO: 1677399 - DNA, 15 bp, Homo sapiens
cctggagatcctcct

SEQ ID NO: 1677400 - DNA, 17 bp, Homo sapiens
cctggagatcctcctgc

SEQ ID NO: 1677401 - DNA, 21 bp, Homo sapiens
cctggagatcctcctgcagac

SEQ ID NO: 1677402 - DNA, 22 bp, Homo sapiens
cctggagatgcagctactggaa

SEQ ID NO: 1677403 - DNA, 14 bp, Homo sapiens
cctggagcaggagc

SEQ ID NO: 1677404 - DNA, 12 bp, Homo sapiens
cctggagccagc

SEQ ID NO: 1677405 - DNA, 14 bp, Homo sapiens
cctggagccagcag

SEQ ID NO: 1677406 - DNA, 18 bp, Homo sapiens
cctggagccagcagggct

SEQ ID NO: 1677407 - DNA, 14 bp, Homo sapiens
cctggagccagggc

SEQ ID NO: 1677408 - DNA, 15 bp, Homo sapiens
cctggagccagggca

SEQ ID NO: 1677409 - DNA, 14 bp, Homo sapiens
cctggagccatccc

SEQ ID NO: 1677410 - DNA, 14 bp, Homo sapiens
cctggagcccagag

SEQ ID NO: 1677411 - DNA, 12 bp, Homo sapiens
cctggagcccct

SEQ ID NO: 1677412 - DNA, 14 bp, Homo sapiens
cctggagcccctgg

SEQ ID NO: 1677413 - DNA, 12 bp, Homo sapiens
cctggagcccga

SEQ ID NO: 1677414 - DNA, 14 bp, Homo sapiens
cctggagcccgagg

SEQ ID NO: 1677415 - DNA, 20 bp, Homo sapiens
cctggagcccgaggcaccag

SEQ ID NO: 1677416 - DNA, 13 bp, Homo sapiens
cctggagccctgg

SEQ ID NO: 1677417 - DNA, 19 bp, Homo sapiens
cctggagccctgggcggag

SEQ ID NO: 1677418 - DNA, 11 bp, Homo sapiens
cctggagctgt

SEQ ID NO: 1677419 - DNA, 18 bp, Homo sapiens
cctggaggcacgcaccac

SEQ ID NO: 1677420 - DNA, 19 bp, Homo sapiens
cctggaggcacgcaccact

SEQ ID NO: 1677421 - DNA, 21 bp, Homo sapiens
cctggaggcacgcaccactgc

SEQ ID NO: 1677422 - DNA, 23 bp, Homo sapiens
cctggaggcacgcaccactgctt

SEQ ID NO: 1677423 - DNA, 14 bp, Homo sapiens
cctggaggcactga

SEQ ID NO: 1677424 - DNA, 14 bp, Homo sapiens
cctggaggcagggg

SEQ ID NO: 1677425 - DNA, 13 bp, Homo sapiens
cctggaggcccag

SEQ ID NO: 1677426 - DNA, 18 bp, Homo sapiens
cctggaggggcaccaggt

SEQ ID NO: 1677427 - DNA, 20 bp, Homo sapiens
cctggagggggagcaccagc

SEQ ID NO: 1677428 - DNA, 21 bp, Homo sapiens
cctggaggtctccaggggcct

SEQ ID NO: 1677429 - DNA, 14 bp, Homo sapiens
cctggaggtgggca

SEQ ID NO: 1677430 - DNA, 22 bp, Homo sapiens
cctggagtgtcggatcctgtga

SEQ ID NO: 1677431 - DNA, 22 bp, Homo sapiens
cctggatgagaaacagctcagc

SEQ ID NO: 1677432 - DNA, 22 bp, Homo sapiens
cctggatgatttcatcttctgg

SEQ ID NO: 1677433 - DNA, 21 bp, Homo sapiens
cctggatgccaaggagcccct

SEQ ID NO: 1677434 - DNA, 20 bp, Homo sapiens
cctggatgtcccctgtccca

SEQ ID NO: 1677435 - DNA, 21 bp, Homo sapiens
cctggatgtcccctgtcccac

SEQ ID NO: 1677436 - DNA, 20 bp, Homo sapiens
cctggatgtgtggggcatgg

SEQ ID NO: 1677437 - DNA, 15 bp, Homo sapiens
cctggattaccaggg

SEQ ID NO: 1677438 - DNA, 15 bp, Homo sapiens
cctggattcatttcc

SEQ ID NO: 1677439 - DNA, 21 bp, Homo sapiens
cctggattcatttcctgccct

SEQ ID NO: 1677440 - DNA, 23 bp, Homo sapiens
cctggattcatttcctgcccttc

SEQ ID NO: 1677441 - DNA, 13 bp, Homo sapiens
cctggattttctt

SEQ ID NO: 1677442 - DNA, 20 bp, Homo sapiens
cctggattttctttctatgt

SEQ ID NO: 1677443 - DNA, 19 bp, Homo sapiens
cctggcaaagggagcagaa

SEQ ID NO: 1677444 - DNA, 23 bp, Homo sapiens
cctggcaaagggagcagaactga

SEQ ID NO: 1677445 - DNA, 17 bp, Homo sapiens
cctggcaacagagcgag

SEQ ID NO: 1677446 - DNA, 13 bp, Homo sapiens
cctggcacacatc

SEQ ID NO: 1677447 - DNA, 21 bp, Homo sapiens
cctggcacacatcaggagttc

SEQ ID NO: 1677448 - DNA, 14 bp, Homo sapiens
cctggcacaggact

SEQ ID NO: 1677449 - DNA, 17 bp, Homo sapiens
cctggcacagggcagtg

SEQ ID NO: 1677450 - DNA, 23 bp, Homo sapiens
cctggcacccccacaagctgtcc

SEQ ID NO: 1677451 - DNA, 17 bp, Homo sapiens
cctggcacgccctactc

SEQ ID NO: 1677452 - DNA, 23 bp, Homo sapiens
cctggcactaacgttgagcccct

SEQ ID NO: 1677453 - DNA, 14 bp, Homo sapiens
cctggcagcccaga

SEQ ID NO: 1677454 - DNA, 18 bp, Homo sapiens
cctggcagcccagagact

SEQ ID NO: 1677455 - DNA, 19 bp, Homo sapiens
cctggcagccgtgccttca

SEQ ID NO: 1677456 - DNA, 14 bp, Homo sapiens
cctggcagctctgg

SEQ ID NO: 1677457 - DNA, 19 bp, Homo sapiens
cctggcagggacctgagag

SEQ ID NO: 1677458 - DNA, 12 bp, Homo sapiens
cctggcaggtgg

SEQ ID NO: 1677459 - DNA, 21 bp, Homo sapiens
cctggcatcgcaccattctga

SEQ ID NO: 1677460 - DNA, 19 bp, Homo sapiens
cctggcattatgtccactg

SEQ ID NO: 1677461 - DNA, 23 bp, Homo sapiens
cctggccaatgcggcccactttc

SEQ ID NO: 1677462 - DNA, 18 bp, Homo sapiens
cctggccacctctctcct

SEQ ID NO: 1677463 - DNA, 16 bp, Homo sapiens
cctggccacctgaggt

SEQ ID NO: 1677464 - DNA, 17 bp, Homo sapiens
cctggccacctgaggtg

SEQ ID NO: 1677465 - DNA, 12 bp, Homo sapiens
cctggttcattg

SEQ ID NO: 1677466 - DNA, 13 bp, Homo sapiens
cctggttcccgtt

SEQ ID NO: 1677467 - DNA, 17 bp, Homo sapiens
cctggttcctgctgtcc

SEQ ID NO: 1677468 - DNA, 23 bp, Homo sapiens
cctggttcctgctgtcctggtgg

SEQ ID NO: 1677469 - DNA, 13 bp, Homo sapiens
cctggttctcatc

SEQ ID NO: 1677470 - DNA, 22 bp, Homo sapiens
cctggttctgtctagactggcc

SEQ ID NO: 1677471 - DNA, 23 bp, Homo sapiens
cctggttctgtctagactggcct

SEQ ID NO: 1677472 - DNA, 17 bp, Homo sapiens
cctggttggccgtggtc

SEQ ID NO: 1677473 - DNA, 18 bp, Homo sapiens
cctggttgttcctgcatc

SEQ ID NO: 1677474 - DNA, 19 bp, Homo sapiens
cctggttgttcctgcatcc

SEQ ID NO: 1677475 - DNA, 22 bp, Homo sapiens
cctggtttttaaatagagtttg

SEQ ID NO: 1677476 - DNA, 19 bp, Homo sapiens
cctggtttttgtagccttc

SEQ ID NO: 1677477 - DNA, 22 bp, Homo sapiens
cctggtttttgtagccttcctc

SEQ ID NO: 1677478 - DNA, 12 bp, Homo sapiens
cctgtaaacctg

SEQ ID NO: 1677479 - DNA, 13 bp, Homo sapiens
cctgtaaacctga

SEQ ID NO: 1677480 - DNA, 12 bp, Homo sapiens
cctgtaaacttt

SEQ ID NO: 1677481 - DNA, 20 bp, Homo sapiens
cctgtaaactttatcactta

SEQ ID NO: 1677482 - DNA, 12 bp, Homo sapiens
cctgtaaataag

SEQ ID NO: 1677483 - DNA, 18 bp, Homo sapiens
cctgtaacactcctctgc

SEQ ID NO: 1677484 - DNA, 19 bp, Homo sapiens
cctgtaacatactggcctg

SEQ ID NO: 1677485 - DNA, 19 bp, Homo sapiens
cctgtaatcccagaacttt

SEQ ID NO: 1677486 - DNA, 19 bp, Homo sapiens
cctgtaatcccagcacttt

SEQ ID NO: 1677487 - DNA, 23 bp, Homo sapiens
cctgtaatcccagcactttggga

SEQ ID NO: 1677488 - DNA, 16 bp, Homo sapiens
cctgtaatcccagcag

SEQ ID NO: 1677489 - DNA, 17 bp, Homo sapiens
cctgtaccttgctgtgg

SEQ ID NO: 1677490 - DNA, 18 bp, Homo sapiens
cctgtactgttctgtgtc

SEQ ID NO: 1677491 - DNA, 16 bp, Homo sapiens
cctgtagagttgctga

SEQ ID NO: 1677492 - DNA, 16 bp, Homo sapiens
cctgtagccactggca

SEQ ID NO: 1677493 - DNA, 13 bp, Homo sapiens
cctgtagctctgc

SEQ ID NO: 1677494 - DNA, 15 bp, Homo sapiens
cctgtagctctgcct

SEQ ID NO: 1677495 - DNA, 20 bp, Homo sapiens
cctgtaggcagaggctgccg

SEQ ID NO: 1677496 - DNA, 13 bp, Homo sapiens
cctgtagtcctag

SEQ ID NO: 1677497 - DNA, 15 bp, Homo sapiens
cctgtagtctcagct

SEQ ID NO: 1677498 - DNA, 16 bp, Homo sapiens
cctgtagtctcagcta

SEQ ID NO: 1677499 - DNA, 13 bp, Homo sapiens
cctgtagtgagaa

SEQ ID NO: 1677500 - DNA, 19 bp, Homo sapiens
cctgtatatttgtaaagct

SEQ ID NO: 1677501 - DNA, 22 bp, Homo sapiens
cctgtatgtcaataaacaacag

SEQ ID NO: 1677502 - DNA, 16 bp, Homo sapiens
cctgtatgtctccagt

SEQ ID NO: 1677503 - DNA, 17 bp, Homo sapiens
cctgtatgtctccagta

SEQ ID NO: 1677504 - DNA, 13 bp, Homo sapiens
cctgtatgttgtc

SEQ ID NO: 1677505 - DNA, 20 bp, Homo sapiens
cctgtattactgaataatat

SEQ ID NO: 1677506 - DNA, 23 bp, Homo sapiens
cctgtattcctgacctccgccat

SEQ ID NO: 1677507 - DNA, 16 bp, Homo sapiens
cctgtatttaactcat

SEQ ID NO: 1677508 - DNA, 19 bp, Homo sapiens
cctgtcaagttaacaagga

SEQ ID NO: 1677509 - DNA, 23 bp, Homo sapiens
cctgtcaagttaacaaggaatgc

SEQ ID NO: 1677510 - DNA, 14 bp, Homo sapiens
cctgtcaccagagc

SEQ ID NO: 1677511 - DNA, 15 bp, Homo sapiens
cctgtcaccagagct

SEQ ID NO: 1677512 - DNA, 21 bp, Homo sapiens
cctgtcaccagagcttctctg

SEQ ID NO: 1677513 - DNA, 18 bp, Homo sapiens
cctgtcacgctcatgtcc

SEQ ID NO: 1677514 - DNA, 19 bp, Homo sapiens
cctgtcacgctcatgtcct

SEQ ID NO: 1677515 - DNA, 18 bp, Homo sapiens
cctgtcactcagctgaga

SEQ ID NO: 1677516 - DNA, 19 bp, Homo sapiens
cctgtcactcagctgagaa

SEQ ID NO: 1677517 - DNA, 15 bp, Homo sapiens
cctgtcagagccgcc

SEQ ID NO: 1677518 - DNA, 20 bp, Homo sapiens
cctgtcatccagctcactca

SEQ ID NO: 1677519 - DNA, 21 bp, Homo sapiens
cctgtcatgcccccctcaaac

SEQ ID NO: 1677520 - DNA, 17 bp, Homo sapiens
cctgtccaaactgccta

SEQ ID NO: 1677521 - DNA, 22 bp, Homo sapiens
ccttgctgcaagcacagccctt

SEQ ID NO: 1677522 - DNA, 15 bp, Homo sapiens
ccttgctgctctgcg

SEQ ID NO: 1677523 - DNA, 16 bp, Homo sapiens
ccttgctggccccagc

SEQ ID NO: 1677524 - DNA, 20 bp, Homo sapiens
ccttgctggccccagccctg

SEQ ID NO: 1677525 - DNA, 21 bp, Homo sapiens
ccttgctggccccagccctgc

SEQ ID NO: 1677526 - DNA, 12 bp, Homo sapiens
ccttgctgggcc

SEQ ID NO: 1677527 - DNA, 15 bp, Homo sapiens
ccttgctgggccagg

SEQ ID NO: 1677528 - DNA, 18 bp, Homo sapiens
ccttgctgtaccatattc

SEQ ID NO: 1677529 - DNA, 18 bp, Homo sapiens
ccttgcttatgacatcac

SEQ ID NO: 1677530 - DNA, 20 bp, Homo sapiens
ccttgcttcttactgataat

SEQ ID NO: 1677531 - DNA, 18 bp, Homo sapiens
ccttgcttgtatgatcgt

SEQ ID NO: 1677532 - DNA, 13 bp, Homo sapiens
ccttgctttcctg

SEQ ID NO: 1677533 - DNA, 20 bp, Homo sapiens
ccttgctttcggagctcctg

SEQ ID NO: 1677534 - DNA, 18 bp, Homo sapiens
ccttggaaacctgccctg

SEQ ID NO: 1677535 - DNA, 19 bp, Homo sapiens
ccttggaaatgtctgctgg

SEQ ID NO: 1677536 - DNA, 20 bp, Homo sapiens
ccttggaaatgtctgctggt

SEQ ID NO: 1677537 - DNA, 16 bp, Homo sapiens
ccttggaacaccctgg

SEQ ID NO: 1677538 - DNA, 13 bp, Homo sapiens
ccttggagaggag

SEQ ID NO: 1677539 - DNA, 23 bp, Homo sapiens
cgagaagtgctcttggctgaccc

SEQ ID NO: 1677540 - DNA, 16 bp, Homo sapiens
cgagacaccatcctga

SEQ ID NO: 1677541 - DNA, 17 bp, Homo sapiens
cgagacaccatcctgag

SEQ ID NO: 1677542 - DNA, 18 bp, Homo sapiens
cgagacaccatcctgagc

SEQ ID NO: 1677543 - DNA, 20 bp, Homo sapiens
cgagacaccatcctgagcca

SEQ ID NO: 1677544 - DNA, 16 bp, Homo sapiens
cgagaccagcctggcc

SEQ ID NO: 1677545 - DNA, 17 bp, Homo sapiens
cgagaccagcctggcca

SEQ ID NO: 1677546 - DNA, 15 bp, Homo sapiens
cgagaccatcctggc

SEQ ID NO: 1677547 - DNA, 17 bp, Homo sapiens
cgagaccatcctggcca

SEQ ID NO: 1677548 - DNA, 14 bp, Homo sapiens
cgccacggcctggc

SEQ ID NO: 1677549 - DNA, 16 bp, Homo sapiens
cgccacggcctggctg

SEQ ID NO: 1677550 - DNA, 19 bp, Homo sapiens
cgccacggcctggctggtg

SEQ ID NO: 1677551 - DNA, 17 bp, Homo sapiens
cgccacgtcccagcatc

SEQ ID NO: 1677552 - DNA, 22 bp, Homo sapiens
cgccactacactccagcctgag

SEQ ID NO: 1677553 - DNA, 16 bp, Homo sapiens
cgccactaggtgtccc

SEQ ID NO: 1677554 - DNA, 17 bp, Homo sapiens
cgccactgcactccagc

SEQ ID NO: 1677555 - DNA, 23 bp, Homo sapiens
cgccactgttttgaatctcataa

SEQ ID NO: 1677556 - DNA, 19 bp, Homo sapiens
cgccagcagcgcgcaggcc

SEQ ID NO: 1677557 - DNA, 17 bp, Homo sapiens
cgccagcctcagtgcca

SEQ ID NO: 1677558 - DNA, 13 bp, Homo sapiens
cgccagcctcctc

SEQ ID NO: 1677559 - DNA, 17 bp, Homo sapiens
cgccagcctcctctgga

SEQ ID NO: 1677560 - DNA, 18 bp, Homo sapiens
cgccagcctcctctggac

SEQ ID NO: 1677561 - DNA, 18 bp, Homo sapiens
cgccagcgtgtggagcag

SEQ ID NO: 1677562 - DNA, 23 bp, Homo sapiens
cgccagctgccgcaccagcccga

SEQ ID NO: 1677563 - DNA, 20 bp, Homo sapiens
cgccagctgggagcactggt

SEQ ID NO: 1677564 - DNA, 14 bp, Homo sapiens
cgccaggcagagct

SEQ ID NO: 1677565 - DNA, 19 bp, Homo sapiens
cgccaggcgctgcagggcc

SEQ ID NO: 1677566 - DNA, 13 bp, Homo sapiens
cgccagggctggg

SEQ ID NO: 1677567 - DNA, 14 bp, Homo sapiens
cgccagggctgggg

SEQ ID NO: 1677568 - DNA, 14 bp, Homo sapiens
cgccagtctcccag

SEQ ID NO: 1677569 - DNA, 22 bp, Homo sapiens
cgccatctgtgtgcagcaacca

SEQ ID NO: 1677570 - DNA, 16 bp, Homo sapiens
cgccatcttcttccct

SEQ ID NO: 1677571 - DNA, 21 bp, Homo sapiens
cgccatgttgacgagactggt

SEQ ID NO: 1677572 - DNA, 15 bp, Homo sapiens
cgccattgcactcca

SEQ ID NO: 1677573 - DNA, 14 bp, Homo sapiens
cgccattgccacca

SEQ ID NO: 1677574 - DNA, 16 bp, Homo sapiens
cgccattggttggaag

SEQ ID NO: 1677575 - DNA, 17 bp, Homo sapiens
cgccattgtactccagc

SEQ ID NO: 1677576 - DNA, 14 bp, Homo sapiens
cgccatttcctcac

SEQ ID NO: 1677577 - DNA, 22 bp, Homo sapiens
cgctgtcccctcagcgggggcc

SEQ ID NO: 1677578 - DNA, 18 bp, Homo sapiens
cgctgtggactgtcctga

SEQ ID NO: 1677579 - DNA, 20 bp, Homo sapiens
cgctgtgtgttagttcccaa

SEQ ID NO: 1677580 - DNA, 21 bp, Homo sapiens
cgctgtttttgttgtgtgtgc

SEQ ID NO: 1677581 - DNA, 14 bp, Homo sapiens
cgcttcacccctgc

SEQ ID NO: 1677582 - DNA, 15 bp, Homo sapiens
cgcttcacccctgca

SEQ ID NO: 1677583 - DNA, 16 bp, Homo sapiens
cgcttcacccctgcac

SEQ ID NO: 1677584 - DNA, 15 bp, Homo sapiens
cgcttcctggcctcc

SEQ ID NO: 1677585 - DNA, 17 bp, Homo sapiens
cgcttcctggcctccct

SEQ ID NO: 1677586 - DNA, 12 bp, Homo sapiens
cgcttctgactg

SEQ ID NO: 1677587 - DNA, 13 bp, Homo sapiens
cgcttctgctgaa

SEQ ID NO: 1677588 - DNA, 19 bp, Homo sapiens
cgcttcttgcctctgtgct

SEQ ID NO: 1677589 - DNA, 12 bp, Homo sapiens
cgcttgagccca

SEQ ID NO: 1677590 - DNA, 13 bp, Homo sapiens
cgcttgagcccag

SEQ ID NO: 1677591 - DNA, 15 bp, Homo sapiens
cgcttgagcccagga

SEQ ID NO: 1677592 - DNA, 18 bp, Homo sapiens
cgcttgagcccaggagtt

SEQ ID NO: 1677593 - DNA, 23 bp, Homo sapiens
cgcttgccgggcctgggcctcct

SEQ ID NO: 1677594 - DNA, 18 bp, Homo sapiens
cgcttgcttttctgtatt

SEQ ID NO: 1677595 - DNA, 17 bp, Homo sapiens
cgcttgtccagcgccta

SEQ ID NO: 1677596 - DNA, 16 bp, Homo sapiens
cgctttctagctgttg

SEQ ID NO: 1677597 - DNA, 15 bp, Homo sapiens
cgctttctcctgtgc

SEQ ID NO: 1677598 - DNA, 16 bp, Homo sapiens
cgctttctcctgtgcc

SEQ ID NO: 1677599 - DNA, 17 bp, Homo sapiens
cgctttctcctgtgccc

SEQ ID NO: 1677600 - DNA, 12 bp, Homo sapiens
cgcttttctcag

SEQ ID NO: 1677601 - DNA, 18 bp, Homo sapiens
cgcttttgttttcataat

SEQ ID NO: 1677602 - DNA, 13 bp, Homo sapiens
cggaaagtgagag

SEQ ID NO: 1677603 - DNA, 22 bp, Homo sapiens
cggaaagtgagagccagcagca

SEQ ID NO: 1677604 - DNA, 19 bp, Homo sapiens
cggaacagctccttactct

SEQ ID NO: 1677605 - DNA, 17 bp, Homo sapiens
cggaacccaagcttaga

SEQ ID NO: 1677606 - DNA, 17 bp, Homo sapiens
cggaagaatcacttgaa

SEQ ID NO: 1677607 - DNA, 17 bp, Homo sapiens
cggaagccaaaggcagc

SEQ ID NO: 1677608 - DNA, 22 bp, Homo sapiens
cggaagccgtctgactccagag

SEQ ID NO: 1677609 - DNA, 23 bp, Homo sapiens
cggaaggaatgtcagggccaggt

SEQ ID NO: 1677610 - DNA, 22 bp, Homo sapiens
cggaaggaggccaaccagcccg

SEQ ID NO: 1677611 - DNA, 23 bp, Homo sapiens
cggaagggctttggttccttctc

SEQ ID NO: 1677612 - DNA, 20 bp, Homo sapiens
cggacaagacccccagcact

SEQ ID NO: 1677613 - DNA, 13 bp, Homo sapiens
cggacagctgccc

SEQ ID NO: 1677614 - DNA, 17 bp, Homo sapiens
cggacagctgcccagac

SEQ ID NO: 1677615 - DNA, 16 bp, Homo sapiens
cggacagtgcccatgc

SEQ ID NO: 1677616 - DNA, 20 bp, Homo sapiens
cggacccaccaaactgcaca

SEQ ID NO: 1677617 - DNA, 20 bp, Homo sapiens
cggacccaccccaactctcc

SEQ ID NO: 1677618 - DNA, 22 bp, Homo sapiens
cggacccaccccaactctcccc

SEQ ID NO: 1677619 - DNA, 14 bp, Homo sapiens
cggacgcaggtgct

SEQ ID NO: 1677620 - DNA, 13 bp, Homo sapiens
cggacgcatctca

SEQ ID NO: 1677621 - DNA, 22 bp, Homo sapiens
cggacggccaatggtgcttccc

SEQ ID NO: 1677622 - DNA, 15 bp, Homo sapiens
cggacgtttccatca

SEQ ID NO: 1677623 - DNA, 16 bp, Homo sapiens
cggacgtttccatcag

SEQ ID NO: 1677624 - DNA, 19 bp, Homo sapiens
cggactcaccaacttgcca

SEQ ID NO: 1677625 - DNA, 23 bp, Homo sapiens
cggactcacttgatgtttcctgg

SEQ ID NO: 1677626 - DNA, 24 bp, Homo sapiens
cggactctcccaggcctgcctgca

SEQ ID NO: 1677627 - DNA, 12 bp, Homo sapiens
cggactgctgtg

SEQ ID NO: 1677628 - DNA, 22 bp, Homo sapiens
cggagaagaatagaggtcctca

SEQ ID NO: 1677629 - DNA, 17 bp, Homo sapiens
cggagcacagccctggg

SEQ ID NO: 1677630 - DNA, 12 bp, Homo sapiens
cggagcaccctt

SEQ ID NO: 1677631 - DNA, 21 bp, Homo sapiens
cggagccaatgaacagctcct

SEQ ID NO: 1677632 - DNA, 13 bp, Homo sapiens
cggagcccagcct

SEQ ID NO: 1677633 - DNA, 14 bp, Homo sapiens
cggagcccagcctg

SEQ ID NO: 1677634 - DNA, 22 bp, Homo sapiens
cggagcccagcctgggagccca

SEQ ID NO: 1677635 - DNA, 21 bp, Homo sapiens
cggagcccctgaaagcctcac

SEQ ID NO: 1677636 - DNA, 21 bp, Homo sapiens
cggagcccgatattctccctg

SEQ ID NO: 1677637 - DNA, 17 bp, Homo sapiens
cggagccggcacctaca

SEQ ID NO: 1677638 - DNA, 13 bp, Homo sapiens
cggagctgcctgc

SEQ ID NO: 1677639 - DNA, 17 bp, Homo sapiens
cggagctgcctgcagca

SEQ ID NO: 1677640 - DNA, 20 bp, Homo sapiens
cggagctgcctgcagcacat

SEQ ID NO: 1677641 - DNA, 16 bp, Homo sapiens
cggagctgctgagtga

SEQ ID NO: 1677642 - DNA, 15 bp, Homo sapiens
cggagctggcccagg

SEQ ID NO: 1677643 - DNA, 16 bp, Homo sapiens
cggagctggcccaggg

SEQ ID NO: 1677644 - DNA, 15 bp, Homo sapiens
cggagcttgcagtga

SEQ ID NO: 1677645 - DNA, 16 bp, Homo sapiens
cggaggaagcccacat

SEQ ID NO: 1677646 - DNA, 14 bp, Homo sapiens
cggaggactcacca

SEQ ID NO: 1677647 - DNA, 21 bp, Homo sapiens
cggaggagaccagctcagagg

SEQ ID NO: 1677648 - DNA, 15 bp, Homo sapiens
cggaggagctgcctg

SEQ ID NO: 1677649 - DNA, 22 bp, Homo sapiens
cggaggaggagggaggccaggc

SEQ ID NO: 1677650 - DNA, 23 bp, Homo sapiens
cggaggaggagggaggccaggcg

SEQ ID NO: 1677651 - DNA, 17 bp, Homo sapiens
cggaggagggatgctgc

SEQ ID NO: 1677652 - DNA, 13 bp, Homo sapiens
cggaggaggggaa

SEQ ID NO: 1677653 - DNA, 17 bp, Homo sapiens
cggaggaggggaagggg

SEQ ID NO: 1677654 - DNA, 21 bp, Homo sapiens
cggaggaggggaaggggctga

SEQ ID NO: 1677655 - DNA, 16 bp, Homo sapiens
cggaggcaaagctggc

SEQ ID NO: 1677656 - DNA, 15 bp, Homo sapiens
cggaggcccatgccc

SEQ ID NO: 1677657 - DNA, 18 bp, Homo sapiens
cggaggcctgcgaccctg

SEQ ID NO: 1677658 - DNA, 22 bp, Homo sapiens
cggagggcccctgcgtgggggc

SEQ ID NO: 1677659 - DNA, 15 bp, Homo sapiens
cggaggggatccagc

SEQ ID NO: 1677660 - DNA, 15 bp, Homo sapiens
cggaggtccagctgg

SEQ ID NO: 1677661 - DNA, 19 bp, Homo sapiens
cggaggttccagtgagccg

SEQ ID NO: 1677662 - DNA, 13 bp, Homo sapiens
cggaggttgcagg

SEQ ID NO: 1677663 - DNA, 23 bp, Homo sapiens
cggagtcctgtgtttgtgagtcg

SEQ ID NO: 1677664 - DNA, 14 bp, Homo sapiens
cggagtgaagaggg

SEQ ID NO: 1677665 - DNA, 23 bp, Homo sapiens
cggagtgaagaggggcagccctt

SEQ ID NO: 1677666 - DNA, 13 bp, Homo sapiens
cggagtgcctgga

SEQ ID NO: 1677667 - DNA, 16 bp, Homo sapiens
cggagttcctaacagg

SEQ ID NO: 1677668 - DNA, 20 bp, Homo sapiens
cggagttcctaacaggatga

SEQ ID NO: 1677669 - DNA, 17 bp, Homo sapiens
cggatcctaagcatcta

SEQ ID NO: 1677670 - DNA, 19 bp, Homo sapiens
cggatcctaagcatctaag

SEQ ID NO: 1677671 - DNA, 13 bp, Homo sapiens
cggatcctgctgg

SEQ ID NO: 1677672 - DNA, 14 bp, Homo sapiens
cggatcctgtgagt

SEQ ID NO: 1677673 - DNA, 19 bp, Homo sapiens
cggatcctgtgagtaggct

SEQ ID NO: 1677674 - DNA, 21 bp, Homo sapiens
cggatgaccaaaccagccttc

SEQ ID NO: 1677675 - DNA, 19 bp, Homo sapiens
cggattactgaattgtatc

SEQ ID NO: 1677676 - DNA, 15 bp, Homo sapiens
cggatttgtccaaat

SEQ ID NO: 1677677 - DNA, 18 bp, Homo sapiens
cggcaacgtagcctgggc

SEQ ID NO: 1677678 - DNA, 15 bp, Homo sapiens
cggcacccaggcctc

SEQ ID NO: 1677679 - DNA, 18 bp, Homo sapiens
cggcacctacatccccag

SEQ ID NO: 1677680 - DNA, 17 bp, Homo sapiens
cggcacgcacttgcctg

SEQ ID NO: 1677681 - DNA, 15 bp, Homo sapiens
cggcacgtccttggg

SEQ ID NO: 1677682 - DNA, 20 bp, Homo sapiens
cggcagagcaattccaggct

SEQ ID NO: 1677683 - DNA, 21 bp, Homo sapiens
cggcagagcaattccaggctg

SEQ ID NO: 1677684 - DNA, 19 bp, Homo sapiens
cggggtaaaaagtggctgc

SEQ ID NO: 1677685 - DNA, 16 bp, Homo sapiens
cggggtctcctggacc

SEQ ID NO: 1677686 - DNA, 17 bp, Homo sapiens
cggggtctcctggacct

SEQ ID NO: 1677687 - DNA, 17 bp, Homo sapiens
cggggtctgtgctgtgc

SEQ ID NO: 1677688 - DNA, 20 bp, Homo sapiens
cggggtctgtgctgtgcctg

SEQ ID NO: 1677689 - DNA, 21 bp, Homo sapiens
cgtgccagtcaagaagaaaaa

SEQ ID NO: 1677690 - DNA, 20 bp, Homo sapiens
cgtgcccaggcccttggctg

SEQ ID NO: 1677691 - DNA, 23 bp, Homo sapiens
cgtgcccaggcccttggctgcag

SEQ ID NO: 1677692 - DNA, 14 bp, Homo sapiens
cgtgcccccctcct

SEQ ID NO: 1677693 - DNA, 19 bp, Homo sapiens
cgtgcccccctcctccagt

SEQ ID NO: 1677694 - DNA, 15 bp, Homo sapiens
cgtgcccgcaggaac

SEQ ID NO: 1677695 - DNA, 15 bp, Homo sapiens
cgtgccgcctgctcc

SEQ ID NO: 1677696 - DNA, 16 bp, Homo sapiens
cgtgccgcctgctcct

SEQ ID NO: 1677697 - DNA, 18 bp, Homo sapiens
cgtgccgcctgctcctca

SEQ ID NO: 1677698 - DNA, 14 bp, Homo sapiens
cgtgcctccaccac

SEQ ID NO: 1677699 - DNA, 18 bp, Homo sapiens
cgtgcctccaccaccact

SEQ ID NO: 1677700 - DNA, 12 bp, Homo sapiens
cgtgcctgtgtc

SEQ ID NO: 1677701 - DNA, 15 bp, Homo sapiens
cgtgccttcagctct

SEQ ID NO: 1677702 - DNA, 23 bp, Homo sapiens
cgtgccttttgcacccctcccat

SEQ ID NO: 1677703 - DNA, 15 bp, Homo sapiens
cgtgcgacagagaga

SEQ ID NO: 1677704 - DNA, 15 bp, Homo sapiens
cgtgcgtgtctctgc

SEQ ID NO: 1677705 - DNA, 22 bp, Homo sapiens
cgtgcgtgttagtgtgtgtgca

SEQ ID NO: 1677706 - DNA, 14 bp, Homo sapiens
cgtgctaaattttc

SEQ ID NO: 1677707 - DNA, 15 bp, Homo sapiens
cgtgctactgcactc

SEQ ID NO: 1677708 - DNA, 13 bp, Homo sapiens
cgtggacaggccc

SEQ ID NO: 1677709 - DNA, 14 bp, Homo sapiens
cgtggactcctctt

SEQ ID NO: 1677710 - DNA, 13 bp, Homo sapiens
cgtggactctgca

SEQ ID NO: 1677711 - DNA, 16 bp, Homo sapiens
cgtggactctgcacat

SEQ ID NO: 1677712 - DNA, 15 bp, Homo sapiens
cgtggactgagtggg

SEQ ID NO: 1677713 - DNA, 15 bp, Homo sapiens
cgtggagccagggag

SEQ ID NO: 1677714 - DNA, 12 bp, Homo sapiens
cgtggagctcgg

SEQ ID NO: 1677715 - DNA, 13 bp, Homo sapiens
cgtggagggaggc

SEQ ID NO: 1677716 - DNA, 20 bp, Homo sapiens
cgtggagggaggccccaggg

SEQ ID NO: 1677717 - DNA, 20 bp, Homo sapiens
cgtggatctccttcccttct

SEQ ID NO: 1677718 - DNA, 23 bp, Homo sapiens
cgtggatctccttcccttctctt

SEQ ID NO: 1677719 - DNA, 22 bp, Homo sapiens
cgtggcatttcaattcctggcc

SEQ ID NO: 1677720 - DNA, 22 bp, Homo sapiens
cgtggccacgggggcagtgtga

SEQ ID NO: 1677721 - DNA, 11 bp, Homo sapiens
cgtggccagcc

SEQ ID NO: 1677722 - DNA, 15 bp, Homo sapiens
cgtggccagcccggc

SEQ ID NO: 1677723 - DNA, 15 bp, Homo sapiens
cgtggcccagagaag

SEQ ID NO: 1677724 - DNA, 16 bp, Homo sapiens
cgtggcccagagaagc

SEQ ID NO: 1677725 - DNA, 19 bp, Homo sapiens
cgtggcctccgcagtgtct

SEQ ID NO: 1677726 - DNA, 13 bp, Homo sapiens
cgtggcctgcacc

SEQ ID NO: 1677727 - DNA, 20 bp, Homo sapiens
cgtggccttccccagcctct

SEQ ID NO: 1677728 - DNA, 16 bp, Homo sapiens
cgtggcggggcagcag

SEQ ID NO: 1677729 - DNA, 21 bp, Homo sapiens
cgtggcttggggattgtacac

SEQ ID NO: 1677730 - DNA, 17 bp, Homo sapiens
cgtgggaatttcaatgc

SEQ ID NO: 1677731 - DNA, 17 bp, Homo sapiens
cgtgggacgtggtcagg

SEQ ID NO: 1677732 - DNA, 18 bp, Homo sapiens
cgtgggatggcatttggt

SEQ ID NO: 1677733 - DNA, 23 bp, Homo sapiens
cgtggggagggccgtaccccacc

SEQ ID NO: 1677734 - DNA, 11 bp, Homo sapiens
cgtggggaggt

SEQ ID NO: 1677735 - DNA, 15 bp, Homo sapiens
cgtggggcagggagc

SEQ ID NO: 1677736 - DNA, 17 bp, Homo sapiens
cgtgggtgccctctcca

SEQ ID NO: 1677737 - DNA, 19 bp, Homo sapiens
cgtggtggcggtggctgcc

SEQ ID NO: 1677738 - DNA, 22 bp, Homo sapiens
cgtggtgggactccagctcgtg

SEQ ID NO: 1677739 - DNA, 15 bp, Homo sapiens
cgtggtgtgtccctg

SEQ ID NO: 1677740 - DNA, 19 bp, Homo sapiens
cgtggtgtgtccctggaca

SEQ ID NO: 1677741 - DNA, 10 bp, Homo sapiens
cgtggtttgc

SEQ ID NO: 1677742 - DNA, 23 bp, Homo sapiens
cgtgtatagtgcctaaaattgta

SEQ ID NO: 1677743 - DNA, 17 bp, Homo sapiens
cgtgtattgagatttct

SEQ ID NO: 1677744 - DNA, 22 bp, Homo sapiens
cgtgtcaatgaatgccggggac

SEQ ID NO: 1677745 - DNA, 21 bp, Homo sapiens
cgtgtccagcacagaaggaat

SEQ ID NO: 1677746 - DNA, 17 bp, Homo sapiens
cgtgtcccaaggagctg

SEQ ID NO: 1677747 - DNA, 18 bp, Homo sapiens
cgtgtcccaaggagctga

SEQ ID NO: 1677748 - DNA, 15 bp, Homo sapiens
cgtgtccctctcgga

SEQ ID NO: 1677749 - DNA, 21 bp, Homo sapiens
cgtgtccgtccacccttccat

SEQ ID NO: 1677750 - DNA, 21 bp, Homo sapiens
cgtgtcggttcttcctggaag

SEQ ID NO: 1677751 - DNA, 14 bp, Homo sapiens
cgtgtctcagcctc

SEQ ID NO: 1677752 - DNA, 22 bp, Homo sapiens
cgtgtctgtatttatgtgtgag

SEQ ID NO: 1677753 - DNA, 21 bp, Homo sapiens
cgtgtgagaagtgaatgctgg

SEQ ID NO: 1677754 - DNA, 22 bp, Homo sapiens
cgtgtgagaagtgaatgctggg

SEQ ID NO: 1677755 - DNA, 20 bp, Homo sapiens
cgtgtgcatagcgtcctgcc

SEQ ID NO: 1677756 - DNA, 22 bp, Homo sapiens
cgtgtgcatagcgtcctgccct

SEQ ID NO: 1677757 - DNA, 13 bp, Homo sapiens
cgtgtggagcaga

SEQ ID NO: 1677758 - DNA, 21 bp, Homo sapiens
cgtgtgggtcccgcactctgc

SEQ ID NO: 1677759 - DNA, 19 bp, Homo sapiens
cgtgtgtacacgggactga

SEQ ID NO: 1677760 - DNA, 17 bp, Homo sapiens
cgtgtgtcccagatgct

SEQ ID NO: 1677761 - DNA, 15 bp, Homo sapiens
cgtgtgtggctggga

SEQ ID NO: 1677762 - DNA, 18 bp, Homo sapiens
cgtgtgtgtgtatgtgtg

SEQ ID NO: 1677763 - DNA, 23 bp, Homo sapiens
cgtgtgtgtgtatgtgtgtgtgt

SEQ ID NO: 1677764 - DNA, 20 bp, Homo sapiens
cgtgtgtttgtatgtctgtg

SEQ ID NO: 1677765 - DNA, 17 bp, Homo sapiens
cgtgttacccactgcca

SEQ ID NO: 1677766 - DNA, 19 bp, Homo sapiens
cgtgttaggaggctgcatg

SEQ ID NO: 1677767 - DNA, 18 bp, Homo sapiens
cgtgttagtgtgtgtgca

SEQ ID NO: 1677768 - DNA, 20 bp, Homo sapiens
cgtgttagtgtgtgtgcatg

SEQ ID NO: 1677769 - DNA, 13 bp, Homo sapiens
cgtgttcagcaga

SEQ ID NO: 1677770 - DNA, 15 bp, Homo sapiens
cgtgtttctgactct

SEQ ID NO: 1677771 - DNA, 21 bp, Homo sapiens
cgtgtttgggtttttttcctt

SEQ ID NO: 1677772 - DNA, 13 bp, Homo sapiens
cgttacctgccgc

SEQ ID NO: 1677773 - DNA, 13 bp, Homo sapiens
cgttagctcctgt

SEQ ID NO: 1677774 - DNA, 16 bp, Homo sapiens
cgttagctcctgtggc

SEQ ID NO: 1677775 - DNA, 21 bp, Homo sapiens
cgttaggaataacactgcagc

SEQ ID NO: 1677776 - DNA, 19 bp, Homo sapiens
cgttaggattcaggcagca

SEQ ID NO: 1677777 - DNA, 14 bp, Homo sapiens
cgttagtgggcagg

SEQ ID NO: 1677778 - DNA, 13 bp, Homo sapiens
cgttcagcctgtc

SEQ ID NO: 1677779 - DNA, 19 bp, Homo sapiens
cgttcatagaaattgtgtt

SEQ ID NO: 1677780 - DNA, 15 bp, Homo sapiens
cgttcatcacctgct

SEQ ID NO: 1677781 - DNA, 16 bp, Homo sapiens
cgttccatctgggctt

SEQ ID NO: 1677782 - DNA, 13 bp, Homo sapiens
cgttccctgtcag

SEQ ID NO: 1677783 - DNA, 18 bp, Homo sapiens
cgttccttactgcagaat

SEQ ID NO: 1677784 - DNA, 14 bp, Homo sapiens
cgttctcacaccca

SEQ ID NO: 1677785 - DNA, 16 bp, Homo sapiens
cgttctcacacccacc

SEQ ID NO: 1677786 - DNA, 17 bp, Homo sapiens
cgttctctgtcctactt

SEQ ID NO: 1677787 - DNA, 17 bp, Homo sapiens
cgttctgctggcctgga

SEQ ID NO: 1677788 - DNA, 17 bp, Homo sapiens
cgttgcttcccgctgca

SEQ ID NO: 1677789 - DNA, 21 bp, Homo sapiens
cgttggagagcagcaggtgct

SEQ ID NO: 1677790 - DNA, 18 bp, Homo sapiens
cgttgtttacttaaagat

SEQ ID NO: 1677791 - DNA, 20 bp, Homo sapiens
cgttgtttacttaaagattt

SEQ ID NO: 1677792 - DNA, 21 bp, Homo sapiens
cgtttaaggtgagcataaatc

SEQ ID NO: 1677793 - DNA, 19 bp, Homo sapiens
cgtttaatcccagcacttt

SEQ ID NO: 1677794 - DNA, 20 bp, Homo sapiens
cgtttacttatcttatgcca

SEQ ID NO: 1677795 - DNA, 23 bp, Homo sapiens
cgtttagaaaaaacaatttttga

SEQ ID NO: 1677796 - DNA, 18 bp, Homo sapiens
cgtttataaacagaaatg

SEQ ID NO: 1677797 - DNA, 16 bp, Homo sapiens
cgtttataattggctt

SEQ ID NO: 1677798 - DNA, 18 bp, Homo sapiens
cgtttattaatgcctctc

SEQ ID NO: 1677799 - DNA, 14 bp, Homo sapiens
cgtttattttcaag

SEQ ID NO: 1677800 - DNA, 22 bp, Homo sapiens
cgtttcagcgactccgttggcc

SEQ ID NO: 1677801 - DNA, 15 bp, Homo sapiens
cgtttccatcatgtc

SEQ ID NO: 1677802 - DNA, 18 bp, Homo sapiens
cgtttccatcatgtctgt

SEQ ID NO: 1677803 - DNA, 17 bp, Homo sapiens
cgtttcccggttcagga

SEQ ID NO: 1677804 - DNA, 21 bp, Homo sapiens
cgtttgagaagaaaacatcta

SEQ ID NO: 1677805 - DNA, 15 bp, Homo sapiens
cgtttgcaccgcctg

SEQ ID NO: 1677806 - DNA, 20 bp, Homo sapiens
cgtttggaggcccctgggct

SEQ ID NO: 1677807 - DNA, 15 bp, Homo sapiens
cgtttgtatgtgtgt

SEQ ID NO: 1677808 - DNA, 18 bp, Homo sapiens
cgtttgtgcagaatctct

SEQ ID NO: 1677809 - DNA, 23 bp, Homo sapiens
cgtttgtgcatatctgcctcccc

SEQ ID NO: 1677810 - DNA, 16 bp, Homo sapiens
cgttttagtgtctgac

SEQ ID NO: 1677811 - DNA, 14 bp, Homo sapiens
cgttttgcacattt

SEQ ID NO: 1677812 - DNA, 17 bp, Homo sapiens
ctaaaaaaaaaaaggcc

SEQ ID NO: 1677813 - DNA, 14 bp, Homo sapiens
ctaaaaaataactg

SEQ ID NO: 1677814 - DNA, 20 bp, Homo sapiens
ctaaaaacatttactgacca

SEQ ID NO: 1677815 - DNA, 11 bp, Homo sapiens
ctaaaaataaa

SEQ ID NO: 1677816 - DNA, 17 bp, Homo sapiens
ctaaaaataactgtaat

SEQ ID NO: 1677817 - DNA, 13 bp, Homo sapiens
ctaaaaatacacc

SEQ ID NO: 1677818 - DNA, 11 bp, Homo sapiens
ctaaaaatata

SEQ ID NO: 1677819 - DNA, 22 bp, Homo sapiens
ctaaaaatattataacttaaaa

SEQ ID NO: 1677820 - DNA, 21 bp, Homo sapiens
ctaaaaatctgagaaactcta

SEQ ID NO: 1677821 - DNA, 12 bp, Homo sapiens
ctaaaaatgaac

SEQ ID NO: 1677822 - DNA, 23 bp, Homo sapiens
ctaaaaatgagcttgattaaatc

SEQ ID NO: 1677823 - DNA, 22 bp, Homo sapiens
ctaaaacgaatggtctttgctc

SEQ ID NO: 1677824 - DNA, 22 bp, Homo sapiens
ctaaaactatggttcccaataa

SEQ ID NO: 1677825 - DNA, 23 bp, Homo sapiens
ctaaaactgggattaagaaacct

SEQ ID NO: 1677826 - DNA, 13 bp, Homo sapiens
ctaaaagatcctt

SEQ ID NO: 1677827 - DNA, 23 bp, Homo sapiens
ctaaaaggtatgcaatcaaatct

SEQ ID NO: 1677828 - DNA, 15 bp, Homo sapiens
ctaaaagtaaacatt

SEQ ID NO: 1677829 - DNA, 21 bp, Homo sapiens
ctaaaagttgaaaagccaaag

SEQ ID NO: 1677830 - DNA, 14 bp, Homo sapiens
ctaaaataagaata

SEQ ID NO: 1677831 - DNA, 21 bp, Homo sapiens
ctaaaatactcaccaaaatat

SEQ ID NO: 1677832 - DNA, 23 bp, Homo sapiens
ctaaaatagttagatctttgtaa

SEQ ID NO: 1677833 - DNA, 18 bp, Homo sapiens
ctaaaatatataatttat

SEQ ID NO: 1677834 - DNA, 22 bp, Homo sapiens
ctaaaatatttatgaagaaaat

SEQ ID NO: 1677835 - DNA, 14 bp, Homo sapiens
ctaaaatatttatt

SEQ ID NO: 1677836 - DNA, 13 bp, Homo sapiens
ctaaaatcatgaa

SEQ ID NO: 1677837 - DNA, 19 bp, Homo sapiens
ctaaaatcttatagttcta

SEQ ID NO: 1677838 - DNA, 13 bp, Homo sapiens
ctaaaatgcttca

SEQ ID NO: 1677839 - DNA, 19 bp, Homo sapiens
ctaaaatgtgatgttctaa

SEQ ID NO: 1677840 - DNA, 20 bp, Homo sapiens
ctaaaatgtgatgttctaag

SEQ ID NO: 1677841 - DNA, 22 bp, Homo sapiens
ctaaaatgtgatgttctaaggc

SEQ ID NO: 1677842 - DNA, 19 bp, Homo sapiens
ctaaaattcaacaaatgat

SEQ ID NO: 1677843 - DNA, 14 bp, Homo sapiens
ctaaaatttaaaat

SEQ ID NO: 1677844 - DNA, 17 bp, Homo sapiens
ctaaaatttaaaattaa

SEQ ID NO: 1677845 - DNA, 22 bp, Homo sapiens
ctaaaatttgtaatatttttgt

SEQ ID NO: 1677846 - DNA, 22 bp, Homo sapiens
ctaaacaagattttaaagacat

SEQ ID NO: 1677847 - DNA, 14 bp, Homo sapiens
ctaaacagactcat

SEQ ID NO: 1677848 - DNA, 13 bp, Homo sapiens
ctaaacagatata

SEQ ID NO: 1677849 - DNA, 18 bp, Homo sapiens
ctaaacagttatttctgt

SEQ ID NO: 1677850 - DNA, 14 bp, Homo sapiens
ctaaacataattgt

SEQ ID NO: 1677851 - DNA, 17 bp, Homo sapiens
ctaaaccaaggactgag

SEQ ID NO: 1677852 - DNA, 19 bp, Homo sapiens
ctaaaccccagattcttca

SEQ ID NO: 1677853 - DNA, 12 bp, Homo sapiens
ctaaacctcagt

SEQ ID NO: 1677854 - DNA, 18 bp, Homo sapiens
ctaaaccttagtactgag

SEQ ID NO: 1677855 - DNA, 19 bp, Homo sapiens
ctaaaccttagtactgagt

SEQ ID NO: 1677856 - DNA, 17 bp, Homo sapiens
ctaaacgtggtcacctt

SEQ ID NO: 1677857 - DNA, 15 bp, Homo sapiens
ctaaactcatttata

SEQ ID NO: 1677858 - DNA, 17 bp, Homo sapiens
ctaaactcatttataaa

SEQ ID NO: 1677859 - DNA, 14 bp, Homo sapiens
ctaaactccttcct

SEQ ID NO: 1677860 - DNA, 14 bp, Homo sapiens
ctaaactgtgaaaa

SEQ ID NO: 1677861 - DNA, 14 bp, Homo sapiens
ctaaactgttttca

SEQ ID NO: 1677862 - DNA, 14 bp, Homo sapiens
ctaaactttagact

SEQ ID NO: 1677863 - DNA, 21 bp, Homo sapiens
ctaaactttttttctgtacca

SEQ ID NO: 1677864 - DNA, 18 bp, Homo sapiens
ctaaagaaaaatgcctgt

SEQ ID NO: 1677865 - DNA, 21 bp, Homo sapiens
ctaaagaaagattacttagag

SEQ ID NO: 1677866 - DNA, 21 bp, Homo sapiens
ctaaagaccctaaatctgagg

SEQ ID NO: 1677867 - DNA, 14 bp, Homo sapiens
ctaaagactgggtt

SEQ ID NO: 1677868 - DNA, 19 bp, Homo sapiens
ctaaagagagaatgtagat

SEQ ID NO: 1677869 - DNA, 21 bp, Homo sapiens
ctaaagagcccttgcctcccc

SEQ ID NO: 1677870 - DNA, 23 bp, Homo sapiens
ctaaagagcccttgcctccccat

SEQ ID NO: 1677871 - DNA, 22 bp, Homo sapiens
ctaaagatatcagagctcttaa

SEQ ID NO: 1677872 - DNA, 17 bp, Homo sapiens
ctaaagatggagtttct

SEQ ID NO: 1677873 - DNA, 12 bp, Homo sapiens
ctaaagattcta

SEQ ID NO: 1677874 - DNA, 20 bp, Homo sapiens
ctaaagattctatagttcta

SEQ ID NO: 1677875 - DNA, 22 bp, Homo sapiens
ctaaagattctatagttctaga

SEQ ID NO: 1677876 - DNA, 23 bp, Homo sapiens
ctaaagattctatagttctagac

SEQ ID NO: 1677877 - DNA, 20 bp, Homo sapiens
ctaaagcaataatggtccca

SEQ ID NO: 1677878 - DNA, 13 bp, Homo sapiens
ctaaagcagaggc

SEQ ID NO: 1677879 - DNA, 12 bp, Homo sapiens
ctaaagctctga

SEQ ID NO: 1677880 - DNA, 14 bp, Homo sapiens
ctaaagctctgaca

SEQ ID NO: 1677881 - DNA, 14 bp, Homo sapiens
ctaaagctttggac

SEQ ID NO: 1677882 - DNA, 18 bp, Homo sapiens
ctaaaggcatccttgtct

SEQ ID NO: 1677883 - DNA, 23 bp, Homo sapiens
ctaaaggcatccttgtcttttga

SEQ ID NO: 1677884 - DNA, 19 bp, Homo sapiens
ctaaagggagaaggaaggg

SEQ ID NO: 1677885 - DNA, 13 bp, Homo sapiens
ctaaagggcaggg

SEQ ID NO: 1677886 - DNA, 22 bp, Homo sapiens
ctaaaggtaccaaacaaggaag

SEQ ID NO: 1677887 - DNA, 15 bp, Homo sapiens
ctaaaggtccacagg

SEQ ID NO: 1677888 - DNA, 20 bp, Homo sapiens
ctaaaggtccacaggtctag

SEQ ID NO: 1677889 - DNA, 17 bp, Homo sapiens
ctaaataaacatgtgcc

SEQ ID NO: 1677890 - DNA, 21 bp, Homo sapiens
ctaaataaatgtaatagccaa

SEQ ID NO: 1677891 - DNA, 21 bp, Homo sapiens
ctaaatatacatctgtgtatt

SEQ ID NO: 1677892 - DNA, 15 bp, Homo sapiens
ctaaatatttcctta

SEQ ID NO: 1677893 - DNA, 13 bp, Homo sapiens
ctaaatccaaaga

SEQ ID NO: 1677894 - DNA, 15 bp, Homo sapiens
ctaaatccaaagaaa

SEQ ID NO: 1677895 - DNA, 19 bp, Homo sapiens
ctaaatccattttctaaac

SEQ ID NO: 1677896 - DNA, 22 bp, Homo sapiens
ctaaatccattttctaaactgt

SEQ ID NO: 1677897 - DNA, 18 bp, Homo sapiens
ctaaatccgacttgaata

SEQ ID NO: 1677898 - DNA, 14 bp, Homo sapiens
ctaaatcctcatgt

SEQ ID NO: 1677899 - DNA, 23 bp, Homo sapiens
ctaaatccttttgttttgaagct

SEQ ID NO: 1677900 - DNA, 18 bp, Homo sapiens
ctaaatcttccttgtgag

SEQ ID NO: 1677901 - DNA, 19 bp, Homo sapiens
ctaaatcttccttgtgagg

SEQ ID NO: 1677902 - DNA, 12 bp, Homo sapiens
ctaaatgaatgt

SEQ ID NO: 1677903 - DNA, 23 bp, Homo sapiens
ctaaatgagctcctgcgggagta

SEQ ID NO: 1677904 - DNA, 19 bp, Homo sapiens
ctaaatgagtcactgagca

SEQ ID NO: 1677905 - DNA, 12 bp, Homo sapiens
ctaaatgatggt

SEQ ID NO: 1677906 - DNA, 20 bp, Homo sapiens
ctaaatgcaccaagaaagct

SEQ ID NO: 1677907 - DNA, 12 bp, Homo sapiens
ctaaatggcctc

SEQ ID NO: 1677908 - DNA, 13 bp, Homo sapiens
ctaaatggcctca

SEQ ID NO: 1677909 - DNA, 12 bp, Homo sapiens
ctaaatgtaaaa

SEQ ID NO: 1677910 - DNA, 19 bp, Homo sapiens
ctaaattacaattgtcatt

SEQ ID NO: 1677911 - DNA, 21 bp, Homo sapiens
ctaaattattagcatttgttt

SEQ ID NO: 1677912 - DNA, 14 bp, Homo sapiens
ctaaattatttact

SEQ ID NO: 1677913 - DNA, 12 bp, Homo sapiens
ctaaattgtata

SEQ ID NO: 1677914 - DNA, 17 bp, Homo sapiens
ctaaattgtatacattt

SEQ ID NO: 1677915 - DNA, 17 bp, Homo sapiens
ctaaatttaatgctgcc

SEQ ID NO: 1677916 - DNA, 18 bp, Homo sapiens
ctaaatttaatgctgcct

SEQ ID NO: 1677917 - DNA, 13 bp, Homo sapiens
ctaaatttcacta

SEQ ID NO: 1677918 - DNA, 20 bp, Homo sapiens
ctaaatttgtgctttttaag

SEQ ID NO: 1677919 - DNA, 16 bp, Homo sapiens
ctaaattttctaatta

SEQ ID NO: 1677920 - DNA, 12 bp, Homo sapiens
ctaacaaaagaa

SEQ ID NO: 1677921 - DNA, 11 bp, Homo sapiens
ctaacaaaata

SEQ ID NO: 1677922 - DNA, 15 bp, Homo sapiens
ctaacaaaatcaagc

SEQ ID NO: 1677923 - DNA, 18 bp, Homo sapiens
ctaacaataatatttcaa

SEQ ID NO: 1677924 - DNA, 16 bp, Homo sapiens
ctaacacagcatgtgt

SEQ ID NO: 1677925 - DNA, 17 bp, Homo sapiens
ctaacacagcatgtgta

SEQ ID NO: 1677926 - DNA, 17 bp, Homo sapiens
ctaacacattatcggga

SEQ ID NO: 1677927 - DNA, 20 bp, Homo sapiens
ctaacactggcatgttcaaa

SEQ ID NO: 1677928 - DNA, 18 bp, Homo sapiens
ctaacagataagcaagag

SEQ ID NO: 1677929 - DNA, 12 bp, Homo sapiens
ctaacagccctc

SEQ ID NO: 1677930 - DNA, 12 bp, Homo sapiens
ctaacagtcctt

SEQ ID NO: 1677931 - DNA, 17 bp, Homo sapiens
ctaacataaaatctgtg

SEQ ID NO: 1677932 - DNA, 15 bp, Homo sapiens
ctaacatcccactta

SEQ ID NO: 1677933 - DNA, 22 bp, Homo sapiens
ctaacatggtgaaaccccgtct

SEQ ID NO: 1677934 - DNA, 20 bp, Homo sapiens
ctaaccaagctgagtttcct

SEQ ID NO: 1677935 - DNA, 21 bp, Homo sapiens
ctaaccaagctgagtttccta

SEQ ID NO: 1677936 - DNA, 14 bp, Homo sapiens
ctaaccatccccaa

SEQ ID NO: 1677937 - DNA, 17 bp, Homo sapiens
ctaaccatccccaactc

SEQ ID NO: 1677938 - DNA, 19 bp, Homo sapiens
ctaaccatccccaactcca

SEQ ID NO: 1677939 - DNA, 21 bp, Homo sapiens
ctaaccatccccaactccatg

SEQ ID NO: 1677940 - DNA, 22 bp, Homo sapiens
ctaaccattcaaatgacgcctg

SEQ ID NO: 1677941 - DNA, 19 bp, Homo sapiens
ctaacccaggtatccaaaa

SEQ ID NO: 1677942 - DNA, 13 bp, Homo sapiens
ctaaccccttcca

SEQ ID NO: 1677943 - DNA, 19 bp, Homo sapiens
ctaaccccttccagatcac

SEQ ID NO: 1677944 - DNA, 14 bp, Homo sapiens
ctaacccctttcct

SEQ ID NO: 1677945 - DNA, 16 bp, Homo sapiens
ctaacccctttcctgc

SEQ ID NO: 1677946 - DNA, 23 bp, Homo sapiens
ctaaccctatactgtagtattct

SEQ ID NO: 1677947 - DNA, 17 bp, Homo sapiens
ctaacctgggttccctt

SEQ ID NO: 1677948 - DNA, 12 bp, Homo sapiens
ctaaccttgaat

SEQ ID NO: 1677949 - DNA, 18 bp, Homo sapiens
ctaaccttgaatgctgcc

SEQ ID NO: 1677950 - DNA, 20 bp, Homo sapiens
ctaaccttgaatgctgccag

SEQ ID NO: 1677951 - DNA, 15 bp, Homo sapiens
ctaacgtaaatacac

SEQ ID NO: 1677952 - DNA, 18 bp, Homo sapiens
ctaacgtccactagctta

SEQ ID NO: 1677953 - DNA, 19 bp, Homo sapiens
ctaacgtgtcagaatcctt

SEQ ID NO: 1677954 - DNA, 17 bp, Homo sapiens
ctaacgttgagcccctg

SEQ ID NO: 1677955 - DNA, 19 bp, Homo sapiens
ctaactcagaaacatcagt

SEQ ID NO: 1677956 - DNA, 23 bp, Homo sapiens
ctaactcctgccattcttctggt

SEQ ID NO: 1677957 - DNA, 20 bp, Homo sapiens
ctaactgctacaaatactct

SEQ ID NO: 1677958 - DNA, 13 bp, Homo sapiens
ctaactggaagca

SEQ ID NO: 1677959 - DNA, 20 bp, Homo sapiens
ctaactggacatgaaggaaa

SEQ ID NO: 1677960 - DNA, 15 bp, Homo sapiens
ctaactgtaaatcat

SEQ ID NO: 1677961 - DNA, 18 bp, Homo sapiens
ctaactgtaaatcatgtt

SEQ ID NO: 1677962 - DNA, 13 bp, Homo sapiens
ctaacttcataga

SEQ ID NO: 1677963 - DNA, 20 bp, Homo sapiens
ctaacttggagccccagtgc

SEQ ID NO: 1677964 - DNA, 15 bp, Homo sapiens
ctaagaaaatgtagt

SEQ ID NO: 1677965 - DNA, 16 bp, Homo sapiens
ctaagaaagaggagtg

SEQ ID NO: 1677966 - DNA, 20 bp, Homo sapiens
ctaagaaagaggagtgcttg

SEQ ID NO: 1677967 - DNA, 16 bp, Homo sapiens
ctaagaaatgctgaaa

SEQ ID NO: 1677968 - DNA, 15 bp, Homo sapiens
ctaagaacctggaac

SEQ ID NO: 1677969 - DNA, 14 bp, Homo sapiens
ctaagaagacattt

SEQ ID NO: 1677970 - DNA, 16 bp, Homo sapiens
ctaagaagacattttg

SEQ ID NO: 1677971 - DNA, 20 bp, Homo sapiens
ctaagaagacattttgttac

SEQ ID NO: 1677972 - DNA, 16 bp, Homo sapiens
ctaagaataaataaag

SEQ ID NO: 1677973 - DNA, 17 bp, Homo sapiens
ctaagaataaataaaga

SEQ ID NO: 1677974 - DNA, 20 bp, Homo sapiens
ctaagaataaataaagaaga

SEQ ID NO: 1677975 - DNA, 13 bp, Homo sapiens
ctaagaatttttc

SEQ ID NO: 1677976 - DNA, 21 bp, Homo sapiens
ctaagacacctgaaccctcca

SEQ ID NO: 1677977 - DNA, 21 bp, Homo sapiens
ctaagactcaaatgttctaag

SEQ ID NO: 1677978 - DNA, 14 bp, Homo sapiens
ctgctgccgccgcc

SEQ ID NO: 1677979 - DNA, 17 bp, Homo sapiens
ctgctgcctccctgggg

SEQ ID NO: 1677980 - DNA, 23 bp, Homo sapiens
ctgctgcctccctggggaccagg

SEQ ID NO: 1677981 - DNA, 13 bp, Homo sapiens
ctgctgcctctga

SEQ ID NO: 1677982 - DNA, 17 bp, Homo sapiens
ctgctgcctctttccct

SEQ ID NO: 1677983 - DNA, 20 bp, Homo sapiens
ctgctgcctctttccctagg

SEQ ID NO: 1677984 - DNA, 21 bp, Homo sapiens
ctgctgcctctttccctagga

SEQ ID NO: 1677985 - DNA, 22 bp, Homo sapiens
ctgctgcctctttccctaggaa

SEQ ID NO: 1677986 - DNA, 14 bp, Homo sapiens
ctgctgcctgctca

SEQ ID NO: 1677987 - DNA, 15 bp, Homo sapiens
ctgctgcctgctcat

SEQ ID NO: 1677988 - DNA, 18 bp, Homo sapiens
ctgctgcctgctcatggc

SEQ ID NO: 1677989 - DNA, 20 bp, Homo sapiens
ctgctgccttttctggagtt

SEQ ID NO: 1677990 - DNA, 14 bp, Homo sapiens
ctgctgcgcgtgtg

SEQ ID NO: 1677991 - DNA, 14 bp, Homo sapiens
ctgctgcggctgtg

SEQ ID NO: 1677992 - DNA, 18 bp, Homo sapiens
ctgctgcggctgtgggcg

SEQ ID NO: 1677993 - DNA, 14 bp, Homo sapiens
ctgctgctaccagc

SEQ ID NO: 1677994 - DNA, 22 bp, Homo sapiens
ctgctgctactacccgagccca

SEQ ID NO: 1677995 - DNA, 11 bp, Homo sapiens
ctgctgctgat

SEQ ID NO: 1677996 - DNA, 18 bp, Homo sapiens
ctgctgctgcctccctgg

SEQ ID NO: 1677997 - DNA, 16 bp, Homo sapiens
ctgctgctgctgccgc

SEQ ID NO: 1677998 - DNA, 14 bp, Homo sapiens
ctgctgctggagat

SEQ ID NO: 1677999 - DNA, 13 bp, Homo sapiens
ctgctgctggggc

SEQ ID NO: 1678000 - DNA, 10 bp, Homo sapiens
ctgctgctgt

SEQ ID NO: 1678001 - DNA, 17 bp, Homo sapiens
ctgctgcttcatgtttg

SEQ ID NO: 1678002 - DNA, 15 bp, Homo sapiens
ctgctggaagcccag

SEQ ID NO: 1678003 - DNA, 17 bp, Homo sapiens
ctgctggaaggggcagc

SEQ ID NO: 1678004 - DNA, 22 bp, Homo sapiens
ctgctggactgtggagggtcac

SEQ ID NO: 1678005 - DNA, 17 bp, Homo sapiens
ctgctggaggcctcagg

SEQ ID NO: 1678006 - DNA, 18 bp, Homo sapiens
ctgctggaggcctcaggt

SEQ ID NO: 1678007 - DNA, 17 bp, Homo sapiens
ctgctggcacccaccgt

SEQ ID NO: 1678008 - DNA, 15 bp, Homo sapiens
ctgctggcatcaaga

SEQ ID NO: 1678009 - DNA, 13 bp, Homo sapiens
ctgctggcctgga

SEQ ID NO: 1678010 - DNA, 15 bp, Homo sapiens
ctgctggcctggatc

SEQ ID NO: 1678011 - DNA, 11 bp, Homo sapiens
ctgctggctgc

SEQ ID NO: 1678012 - DNA, 11 bp, Homo sapiens
ctgctgggaac

SEQ ID NO: 1678013 - DNA, 18 bp, Homo sapiens
ctgctgggaaccccgcag

SEQ ID NO: 1678014 - DNA, 18 bp, Homo sapiens
ctgctgggacccacctcc

SEQ ID NO: 1678015 - DNA, 20 bp, Homo sapiens
ctgctgggacccacctcccc

SEQ ID NO: 1678016 - DNA, 21 bp, Homo sapiens
ctgctgggacccacctccccc

SEQ ID NO: 1678017 - DNA, 21 bp, Homo sapiens
ctgctgggacgatcgcccagg

SEQ ID NO: 1678018 - DNA, 17 bp, Homo sapiens
ctgctgggactggccag

SEQ ID NO: 1678019 - DNA, 14 bp, Homo sapiens
ctgctgggatcctt

SEQ ID NO: 1678020 - DNA, 21 bp, Homo sapiens
ctgctgggcgtgtgtgacact

SEQ ID NO: 1678021 - DNA, 22 bp, Homo sapiens
ctgctgggcgtgtgtgacactg

SEQ ID NO: 1678022 - DNA, 14 bp, Homo sapiens
ctgctgggctctcc

SEQ ID NO: 1678023 - DNA, 16 bp, Homo sapiens
ctgctgggctctccac

SEQ ID NO: 1678024 - DNA, 18 bp, Homo sapiens
ctgctgggctctccacct

SEQ ID NO: 1678025 - DNA, 21 bp, Homo sapiens
ctgctgggctctccacctcag

SEQ ID NO: 1678026 - DNA, 19 bp, Homo sapiens
ctgctggggaagacagtgg

SEQ ID NO: 1678027 - DNA, 12 bp, Homo sapiens
ctgctggggagt

SEQ ID NO: 1678028 - DNA, 22 bp, Homo sapiens
ctgctggggatccccgcctggc

SEQ ID NO: 1678029 - DNA, 21 bp, Homo sapiens
ctgctggggcatgtgtgcctg

SEQ ID NO: 1678030 - DNA, 16 bp, Homo sapiens
ctgctggtaacagtgg

SEQ ID NO: 1678031 - DNA, 14 bp, Homo sapiens
ctgctggtacctgc

SEQ ID NO: 1678032 - DNA, 19 bp, Homo sapiens
ctgctggtacctgccctct

SEQ ID NO: 1678033 - DNA, 16 bp, Homo sapiens
ctgctggtccgtggga

SEQ ID NO: 1678034 - DNA, 17 bp, Homo sapiens
ctgctggtccgtgggac

SEQ ID NO: 1678035 - DNA, 15 bp, Homo sapiens
ctgctggtgcacagc

SEQ ID NO: 1678036 - DNA, 15 bp, Homo sapiens
ctgctgtaactgctg

SEQ ID NO: 1678037 - DNA, 17 bp, Homo sapiens
ctgctgtaactgctgag

SEQ ID NO: 1678038 - DNA, 21 bp, Homo sapiens
ctgctgtaactgctgagccac

SEQ ID NO: 1678039 - DNA, 22 bp, Homo sapiens
ctgctgtaactgctgagccact

SEQ ID NO: 1678040 - DNA, 23 bp, Homo sapiens
ctgctgtaactgctgagccactc

SEQ ID NO: 1678041 - DNA, 15 bp, Homo sapiens
ctgctgtcataacat

SEQ ID NO: 1678042 - DNA, 22 bp, Homo sapiens
ctgctgtccacatgacctccat

SEQ ID NO: 1678043 - DNA, 13 bp, Homo sapiens
ctgctgtcctgca

SEQ ID NO: 1678044 - DNA, 14 bp, Homo sapiens
ctgctgtcctgcag

SEQ ID NO: 1678045 - DNA, 14 bp, Homo sapiens
ctgctgtctctctg

SEQ ID NO: 1678046 - DNA, 19 bp, Homo sapiens
ctgctgtctctctgggctg

SEQ ID NO: 1678047 - DNA, 14 bp, Homo sapiens
ctgctgtcttctgg

SEQ ID NO: 1678048 - DNA, 12 bp, Homo sapiens
ctgctgtcttgt

SEQ ID NO: 1678049 - DNA, 17 bp, Homo sapiens
ctgctgtgaaccctggg

SEQ ID NO: 1678050 - DNA, 23 bp, Homo sapiens
ctgctgtgaaccctggggcctga

SEQ ID NO: 1678051 - DNA, 23 bp, Homo sapiens
ctgctgtgccatgctgggccact

SEQ ID NO: 1678052 - DNA, 13 bp, Homo sapiens
ctgctgtgcccca

SEQ ID NO: 1678053 - DNA, 17 bp, Homo sapiens
ctgctgtgccccaccac

SEQ ID NO: 1678054 - DNA, 12 bp, Homo sapiens
ctgctgtgctct

SEQ ID NO: 1678055 - DNA, 19 bp, Homo sapiens
ctgctgtgctctggggatt

SEQ ID NO: 1678056 - DNA, 11 bp, Homo sapiens
ctgctgtgctg

SEQ ID NO: 1678057 - DNA, 19 bp, Homo sapiens
ctgctgtgggagagcgaag

SEQ ID NO: 1678058 - DNA, 22 bp, Homo sapiens
ctgctgtgtgctttttttgtgt

SEQ ID NO: 1678059 - DNA, 18 bp, Homo sapiens
ctgctgtttggtttggag

SEQ ID NO: 1678060 - DNA, 16 bp, Homo sapiens
ctgctgttttatgtca

SEQ ID NO: 1678061 - DNA, 17 bp, Homo sapiens
ctgcttagctgccttga

SEQ ID NO: 1678062 - DNA, 21 bp, Homo sapiens
ctgcttagctgccttgagcta

SEQ ID NO: 1678063 - DNA, 12 bp, Homo sapiens
ctgcttagcttg

SEQ ID NO: 1678064 - DNA, 17 bp, Homo sapiens
ctgcttaggtctcatgg

SEQ ID NO: 1678065 - DNA, 19 bp, Homo sapiens
ctgcttaggtctcatggac

SEQ ID NO: 1678066 - DNA, 23 bp, Homo sapiens
ctgcttatcaataaacctgtttg

SEQ ID NO: 1678067 - DNA, 13 bp, Homo sapiens
ctgcttcccatcc

SEQ ID NO: 1678068 - DNA, 20 bp, Homo sapiens
ctgcttcccttactttgctg

SEQ ID NO: 1678069 - DNA, 14 bp, Homo sapiens
ctgcttcctcagag

SEQ ID NO: 1678070 - DNA, 12 bp, Homo sapiens
ctgcttcctcct

SEQ ID NO: 1678071 - DNA, 13 bp, Homo sapiens
ctgcttcctcctg

SEQ ID NO: 1678072 - DNA, 14 bp, Homo sapiens
ctgcttcctcctgg

SEQ ID NO: 1678073 - DNA, 13 bp, Homo sapiens
ctgcttcctgctt

SEQ ID NO: 1678074 - DNA, 17 bp, Homo sapiens
ctgcttcctgtgacagt

SEQ ID NO: 1678075 - DNA, 16 bp, Homo sapiens
ctgcttctaagatgcc

SEQ ID NO: 1678076 - DNA, 14 bp, Homo sapiens
ctgcttctccacct

SEQ ID NO: 1678077 - DNA, 22 bp, Homo sapiens
ctgcttctctctctctcacaca

SEQ ID NO: 1678078 - DNA, 23 bp, Homo sapiens
ctgcttctctctctctcacacac

SEQ ID NO: 1678079 - DNA, 16 bp, Homo sapiens
ctgcttctctgacttc

SEQ ID NO: 1678080 - DNA, 19 bp, Homo sapiens
ctgcttctctgacttctgc

SEQ ID NO: 1678081 - DNA, 21 bp, Homo sapiens
ctgcttctctgacttctgcct

SEQ ID NO: 1678082 - DNA, 23 bp, Homo sapiens
ctgcttctctgacttctgcctgg

SEQ ID NO: 1678083 - DNA, 13 bp, Homo sapiens
ctgcttctctttt

SEQ ID NO: 1678084 - DNA, 14 bp, Homo sapiens
ctgcttctgaactc

SEQ ID NO: 1678085 - DNA, 18 bp, Homo sapiens
ctgcttcttcttccaaat

SEQ ID NO: 1678086 - DNA, 23 bp, Homo sapiens
ctgcttgacctagctctttgggc

SEQ ID NO: 1678087 - DNA, 20 bp, Homo sapiens
ctgcttgatttttgcctctt

SEQ ID NO: 1678088 - DNA, 18 bp, Homo sapiens
ctgcttgccaaggcagag

SEQ ID NO: 1678089 - DNA, 19 bp, Homo sapiens
ctgcttggatccatacaaa

SEQ ID NO: 1678090 - DNA, 13 bp, Homo sapiens
ctgcttgtcatcc

SEQ ID NO: 1678091 - DNA, 13 bp, Homo sapiens
ctgcttgtcctgc

SEQ ID NO: 1678092 - DNA, 13 bp, Homo sapiens
ctgctttaatcag

SEQ ID NO: 1678093 - DNA, 15 bp, Homo sapiens
ctgctttcccctgtg

SEQ ID NO: 1678094 - DNA, 19 bp, Homo sapiens
ctgctttcccctgtgggga

SEQ ID NO: 1678095 - DNA, 20 bp, Homo sapiens
ctgctttcccctgtggggat

SEQ ID NO: 1678096 - DNA, 21 bp, Homo sapiens
ctgctttcccctgtggggatc

SEQ ID NO: 1678097 - DNA, 18 bp, Homo sapiens
ctgctttctgcctctcct

SEQ ID NO: 1678098 - DNA, 13 bp, Homo sapiens
ctgctttgcaaag

SEQ ID NO: 1678099 - DNA, 15 bp, Homo sapiens
ctgctttgcaaagac

SEQ ID NO: 1678100 - DNA, 17 bp, Homo sapiens
ctgctttgcatctttgt

SEQ ID NO: 1678101 - DNA, 14 bp, Homo sapiens
ctgctttggcagtg

SEQ ID NO: 1678102 - DNA, 15 bp, Homo sapiens
ctgctttggcagtgc

SEQ ID NO: 1678103 - DNA, 23 bp, Homo sapiens
ctgctttgggctgccctggtgct

SEQ ID NO: 1678104 - DNA, 14 bp, Homo sapiens
ctgcttttaccatg

SEQ ID NO: 1678105 - DNA, 17 bp, Homo sapiens
ctgcttttcattagcag

SEQ ID NO: 1678106 - DNA, 17 bp, Homo sapiens
ctgcttttccaggatcc

SEQ ID NO: 1678107 - DNA, 19 bp, Homo sapiens
ctgcttttccaggatcctg

SEQ ID NO: 1678108 - DNA, 21 bp, Homo sapiens
ctgcttttccaggatcctgca

SEQ ID NO: 1678109 - DNA, 23 bp, Homo sapiens
ctgcttttccaggatcctgcagg

SEQ ID NO: 1678110 - DNA, 15 bp, Homo sapiens
ctgcttttctgccct

SEQ ID NO: 1678111 - DNA, 20 bp, Homo sapiens
ctgcttttctgccctggctg

SEQ ID NO: 1678112 - DNA, 21 bp, Homo sapiens
ctgcttttctgccctggctgc

SEQ ID NO: 1678113 - DNA, 12 bp, Homo sapiens
ctgcttttctgt

SEQ ID NO: 1678114 - DNA, 18 bp, Homo sapiens
ctgcttttctgtcctggg

SEQ ID NO: 1678115 - DNA, 14 bp, Homo sapiens
ctgcttttcttaag

SEQ ID NO: 1678116 - DNA, 16 bp, Homo sapiens
ctgcttttgcacacct

SEQ ID NO: 1678117 - DNA, 19 bp, Homo sapiens
ctgctttttaaagaatgct

SEQ ID NO: 1678118 - DNA, 14 bp, Homo sapiens
ctgctttttggaaa

SEQ ID NO: 1678119 - DNA, 19 bp, Homo sapiens
ctgctttttttcttaaaag

SEQ ID NO: 1678120 - DNA, 21 bp, Homo sapiens
ctgcttttttttttccagcaa

SEQ ID NO: 1678121 - DNA, 15 bp, Homo sapiens
ctggaaacagcatga

SEQ ID NO: 1678122 - DNA, 16 bp, Homo sapiens
ctggaaacagcatgaa

SEQ ID NO: 1678123 - DNA, 19 bp, Homo sapiens
ctggaaacagcatgaataa

SEQ ID NO: 1678124 - DNA, 19 bp, Homo sapiens
ctggaaacccacctctctg

SEQ ID NO: 1678125 - DNA, 20 bp, Homo sapiens
ctggaaaggctcagtctcag

SEQ ID NO: 1678126 - DNA, 16 bp, Homo sapiens
ctggaaaggggagagc

SEQ ID NO: 1678127 - DNA, 18 bp, Homo sapiens
ctggaaaggggagagcct

SEQ ID NO: 1678128 - DNA, 20 bp, Homo sapiens
ctggaaaggggagagcctgc

SEQ ID NO: 1678129 - DNA, 23 bp, Homo sapiens
ctggaaatactagatttgggaga

SEQ ID NO: 1678130 - DNA, 17 bp, Homo sapiens
ctggaaatgtagcactt

SEQ ID NO: 1678131 - DNA, 16 bp, Homo sapiens
ctggaacaaattattt

SEQ ID NO: 1678132 - DNA, 21 bp, Homo sapiens
ctggaacaacttgtagcagct

SEQ ID NO: 1678133 - DNA, 14 bp, Homo sapiens
ctggaacatggcta

SEQ ID NO: 1678134 - DNA, 16 bp, Homo sapiens
ctggaacatggctagc

SEQ ID NO: 1678135 - DNA, 17 bp, Homo sapiens
ctggaaccagggaggag

SEQ ID NO: 1678136 - DNA, 21 bp, Homo sapiens
ctggaaccgggaagggtggcc

SEQ ID NO: 1678137 - DNA, 12 bp, Homo sapiens
ctggaacctcag

SEQ ID NO: 1678138 - DNA, 17 bp, Homo sapiens
ctggaacctcagcctgg

SEQ ID NO: 1678139 - DNA, 17 bp, Homo sapiens
ctggaactcctggcctt

SEQ ID NO: 1678140 - DNA, 13 bp, Homo sapiens
ctggaactgtctg

SEQ ID NO: 1678141 - DNA, 14 bp, Homo sapiens
ctggaagaaaaaaa

SEQ ID NO: 1678142 - DNA, 18 bp, Homo sapiens
ctggaagaaaaaaaccac

SEQ ID NO: 1678143 - DNA, 13 bp, Homo sapiens
ctggaagaaagca

SEQ ID NO: 1678144 - DNA, 20 bp, Homo sapiens
ctggaagaaagcaacaaaga

SEQ ID NO: 1678145 - DNA, 18 bp, Homo sapiens
ctggaagaacaggcctct

SEQ ID NO: 1678146 - DNA, 21 bp, Homo sapiens
ctggaagaacaggcctctcca

SEQ ID NO: 1678147 - DNA, 17 bp, Homo sapiens
ctggaagaaccactgtc

SEQ ID NO: 1678148 - DNA, 18 bp, Homo sapiens
ctggaagactgtgcagaa

SEQ ID NO: 1678149 - DNA, 13 bp, Homo sapiens
ctggaagagagga

SEQ ID NO: 1678150 - DNA, 18 bp, Homo sapiens
ctggaagatataacattc

SEQ ID NO: 1678151 - DNA, 16 bp, Homo sapiens
ctggaagcagagcaaa

SEQ ID NO: 1678152 - DNA, 18 bp, Homo sapiens
ctggaagcaggtgctaca

SEQ ID NO: 1678153 - DNA, 22 bp, Homo sapiens
ctggaagccaaaatgtaggctt

SEQ ID NO: 1678154 - DNA, 15 bp, Homo sapiens
ctggaagccagcttt

SEQ ID NO: 1678155 - DNA, 16 bp, Homo sapiens
ctggaagccagctttc

SEQ ID NO: 1678156 - DNA, 12 bp, Homo sapiens
ctggaagcccag

SEQ ID NO: 1678157 - DNA, 21 bp, Homo sapiens
ctggaagcccctgggcccagt

SEQ ID NO: 1678158 - DNA, 23 bp, Homo sapiens
ctggaagctctccgagctctggt

SEQ ID NO: 1678159 - DNA, 14 bp, Homo sapiens
ctggaagctggaag

SEQ ID NO: 1678160 - DNA, 17 bp, Homo sapiens
ctggaaggacacagtga

SEQ ID NO: 1678161 - DNA, 14 bp, Homo sapiens
ctggaaggagcaca

SEQ ID NO: 1678162 - DNA, 15 bp, Homo sapiens
ctggaaggagcacat

SEQ ID NO: 1678163 - DNA, 12 bp, Homo sapiens
ctggaaggcagg

SEQ ID NO: 1678164 - DNA, 21 bp, Homo sapiens
ctggaaggcagggcagaggga

SEQ ID NO: 1678165 - DNA, 18 bp, Homo sapiens
ctggaaggccccttccct

SEQ ID NO: 1678166 - DNA, 19 bp, Homo sapiens
ctggaaggccccttccctg

SEQ ID NO: 1678167 - DNA, 20 bp, Homo sapiens
ctggaaggccccttccctgg

SEQ ID NO: 1678168 - DNA, 12 bp, Homo sapiens
ctggaaggctgg

SEQ ID NO: 1678169 - DNA, 19 bp, Homo sapiens
ctggaaggggcagcaggag

SEQ ID NO: 1678170 - DNA, 18 bp, Homo sapiens
ctggaatacatgaaatat

SEQ ID NO: 1678171 - DNA, 22 bp, Homo sapiens
ctggaatattgtttctagaaca

SEQ ID NO: 1678172 - DNA, 24 bp, Homo sapiens
ctggaatctggagaccagggagcc

SEQ ID NO: 1678173 - DNA, 14 bp, Homo sapiens
ctggaatgtaatca

SEQ ID NO: 1678174 - DNA, 18 bp, Homo sapiens
ctggaattcagcaccctg

SEQ ID NO: 1678175 - DNA, 19 bp, Homo sapiens
ctggaattcagcaccctgg

SEQ ID NO: 1678176 - DNA, 14 bp, Homo sapiens
ctggaattcttctg

SEQ ID NO: 1678177 - DNA, 19 bp, Homo sapiens
ctggaatttggacaagtgc

SEQ ID NO: 1678178 - DNA, 11 bp, Homo sapiens
ctggacaagcc

SEQ ID NO: 1678179 - DNA, 12 bp, Homo sapiens
ctggacacagct

SEQ ID NO: 1678180 - DNA, 13 bp, Homo sapiens
ctggacacagctc

SEQ ID NO: 1678181 - DNA, 15 bp, Homo sapiens
ctggacacagctctt

SEQ ID NO: 1678182 - DNA, 18 bp, Homo sapiens
ctggacaccctctgccga

SEQ ID NO: 1678183 - DNA, 19 bp, Homo sapiens
ctggacaccctctgccgag

SEQ ID NO: 1678184 - DNA, 22 bp, Homo sapiens
ctggacaccgggccagtatcta

SEQ ID NO: 1678185 - DNA, 15 bp, Homo sapiens
ctggacactcagacc

SEQ ID NO: 1678186 - DNA, 18 bp, Homo sapiens
ctggacactcagacctga

SEQ ID NO: 1678187 - DNA, 18 bp, Homo sapiens
ctggacactctatatgta

SEQ ID NO: 1678188 - DNA, 13 bp, Homo sapiens
ctggacagacaga

SEQ ID NO: 1678189 - DNA, 16 bp, Homo sapiens
ctggacagccccaccc

SEQ ID NO: 1678190 - DNA, 13 bp, Homo sapiens
ctggacaggctct

SEQ ID NO: 1678191 - DNA, 19 bp, Homo sapiens
ctggacaggctctgcttct

SEQ ID NO: 1678192 - DNA, 20 bp, Homo sapiens
ctggacagtatcccacatcc

SEQ ID NO: 1678193 - DNA, 17 bp, Homo sapiens
ctggacatcaccagtcc

SEQ ID NO: 1678194 - DNA, 16 bp, Homo sapiens
ctggacatgagatgga

SEQ ID NO: 1678195 - DNA, 17 bp, Homo sapiens
ctggacatgagatggag

SEQ ID NO: 1678196 - DNA, 23 bp, Homo sapiens
ctggacatgagatggagaggctg

SEQ ID NO: 1678197 - DNA, 14 bp, Homo sapiens
ctggacattctctt

SEQ ID NO: 1678198 - DNA, 23 bp, Homo sapiens
ctggaccaaagggaagtgaggcc

SEQ ID NO: 1678199 - DNA, 18 bp, Homo sapiens
ctggaccaccagccccag

SEQ ID NO: 1678200 - DNA, 21 bp, Homo sapiens
ctggaccaccagccccagcaa

SEQ ID NO: 1678201 - DNA, 15 bp, Homo sapiens
ctggaccactgggca

SEQ ID NO: 1678202 - DNA, 13 bp, Homo sapiens
ctggaccagcctc

SEQ ID NO: 1678203 - DNA, 15 bp, Homo sapiens
ctggaccgctgactg

SEQ ID NO: 1678204 - DNA, 19 bp, Homo sapiens
ctggacctagggtggcctg

SEQ ID NO: 1678205 - DNA, 20 bp, Homo sapiens
ctggacctagggtggcctga

SEQ ID NO: 1678206 - DNA, 19 bp, Homo sapiens
ctggacctatgtcctaagg

SEQ ID NO: 1678207 - DNA, 17 bp, Homo sapiens
ctggacctgcctcctgc

SEQ ID NO: 1678208 - DNA, 21 bp, Homo sapiens
ctggacctgcctcctgcctgc

SEQ ID NO: 1678209 - DNA, 13 bp, Homo sapiens
ctggacctgggat

SEQ ID NO: 1678210 - DNA, 16 bp, Homo sapiens
ctggacctgtatattt

SEQ ID NO: 1678211 - DNA, 14 bp, Homo sapiens
ctggaccttgacag

SEQ ID NO: 1678212 - DNA, 18 bp, Homo sapiens
ctggaccttgacagagca

SEQ ID NO: 1678213 - DNA, 19 bp, Homo sapiens
ctggaccttgacagagcag

SEQ ID NO: 1678214 - DNA, 21 bp, Homo sapiens
ctggaccttgacagagcagct

SEQ ID NO: 1678215 - DNA, 22 bp, Homo sapiens
ctggacctttgggttctttctg

SEQ ID NO: 1678216 - DNA, 18 bp, Homo sapiens
ctggacgaagagcaggcc

SEQ ID NO: 1678217 - DNA, 19 bp, Homo sapiens
ctggacgaagagcaggcca

SEQ ID NO: 1678218 - DNA, 21 bp, Homo sapiens
ctggacggcaggctcactgcc

SEQ ID NO: 1678219 - DNA, 20 bp, Homo sapiens
ctggactacacccaagcctg

SEQ ID NO: 1678220 - DNA, 21 bp, Homo sapiens
ctggactacacccaagcctga

SEQ ID NO: 1678221 - DNA, 16 bp, Homo sapiens
ctggactcaggaactt

SEQ ID NO: 1678222 - DNA, 14 bp, Homo sapiens
ctggactcccctcc

SEQ ID NO: 1678223 - DNA, 16 bp, Homo sapiens
ctggactcccctccct

SEQ ID NO: 1678224 - DNA, 17 bp, Homo sapiens
ctggactctgccccaat

SEQ ID NO: 1678225 - DNA, 19 bp, Homo sapiens
ctggactgaagcctgcagg

SEQ ID NO: 1678226 - DNA, 23 bp, Homo sapiens
ctggactgaagcctgcaggagtt

SEQ ID NO: 1678227 - DNA, 17 bp, Homo sapiens
ctggactgaccaaagac

SEQ ID NO: 1678228 - DNA, 16 bp, Homo sapiens
ctggactgactgcagc

SEQ ID NO: 1678229 - DNA, 15 bp, Homo sapiens
ctggactgaggcctg

SEQ ID NO: 1678230 - DNA, 14 bp, Homo sapiens
ctggactgcatggg

SEQ ID NO: 1678231 - DNA, 22 bp, Homo sapiens
ctggactggccatttttctggg

SEQ ID NO: 1678232 - DNA, 15 bp, Homo sapiens
ctggactggctagag

SEQ ID NO: 1678233 - DNA, 18 bp, Homo sapiens
ctggactgtcatagaaat

SEQ ID NO: 1678234 - DNA, 20 bp, Homo sapiens
ctggactgtcttctccctgc

SEQ ID NO: 1678235 - DNA, 19 bp, Homo sapiens
ctggacttacaaaatgcca

SEQ ID NO: 1678236 - DNA, 20 bp, Homo sapiens
ctggacttacaaaatgccaa

SEQ ID NO: 1678237 - DNA, 14 bp, Homo sapiens
ctggacttcctgtc

SEQ ID NO: 1678238 - DNA, 22 bp, Homo sapiens
ctggatagacttgggatgggga

SEQ ID NO: 1678239 - DNA, 14 bp, Homo sapiens
ctggatatttcaat

SEQ ID NO: 1678240 - DNA, 15 bp, Homo sapiens
ctggatatttcaatc

SEQ ID NO: 1678241 - DNA, 16 bp, Homo sapiens
ctggatatttcaatct

SEQ ID NO: 1678242 - DNA, 18 bp, Homo sapiens
ctggatatttcaatcttt

SEQ ID NO: 1678243 - DNA, 22 bp, Homo sapiens
ctggatatttcaatcttttaaa

SEQ ID NO: 1678244 - DNA, 20 bp, Homo sapiens
ctggatcagtcctttgatca

SEQ ID NO: 1678245 - DNA, 18 bp, Homo sapiens
ctggatccatggggggag

SEQ ID NO: 1678246 - DNA, 12 bp, Homo sapiens
ctggatctcctg

SEQ ID NO: 1678247 - DNA, 23 bp, Homo sapiens
ctggatctcctgctgccttttct

SEQ ID NO: 1678248 - DNA, 23 bp, Homo sapiens
ctggatgaagattctcctgtgct

SEQ ID NO: 1678249 - DNA, 23 bp, Homo sapiens
ctggatgatttcatcttctggaa

SEQ ID NO: 1678250 - DNA, 20 bp, Homo sapiens
ctggatgcacagatgccatg

SEQ ID NO: 1678251 - DNA, 16 bp, Homo sapiens
ctggatgctgttgagg

SEQ ID NO: 1678252 - DNA, 17 bp, Homo sapiens
ctggatgctgttgaggg

SEQ ID NO: 1678253 - DNA, 13 bp, Homo sapiens
ctggatggccggg

SEQ ID NO: 1678254 - DNA, 22 bp, Homo sapiens
ctggatggccgggctgctgctg

SEQ ID NO: 1678255 - DNA, 12 bp, Homo sapiens
ctggatgtaaat

SEQ ID NO: 1678256 - DNA, 17 bp, Homo sapiens
ctggatgtcccctgtcc

SEQ ID NO: 1678257 - DNA, 21 bp, Homo sapiens
ctggatgtcccctgtcccacc

SEQ ID NO: 1678258 - DNA, 22 bp, Homo sapiens
ctggatgtcccctgtcccacca

SEQ ID NO: 1678259 - DNA, 20 bp, Homo sapiens
ctggatgttttttccctgtt

SEQ ID NO: 1678260 - DNA, 23 bp, Homo sapiens
ctggccagtcttcctcttagcct

SEQ ID NO: 1678261 - DNA, 17 bp, Homo sapiens
ctggccagtgctgccca

SEQ ID NO: 1678262 - DNA, 13 bp, Homo sapiens
ctggccagtgttt

SEQ ID NO: 1678263 - DNA, 15 bp, Homo sapiens
ctggccagtgtttaa

SEQ ID NO: 1678264 - DNA, 17 bp, Homo sapiens
ctggcccacccagtcca

SEQ ID NO: 1678265 - DNA, 18 bp, Homo sapiens
ctggcccactgctggctg

SEQ ID NO: 1678266 - DNA, 15 bp, Homo sapiens
ctggcccagaaagcc

SEQ ID NO: 1678267 - DNA, 17 bp, Homo sapiens
ctggcccagaaagcctc

SEQ ID NO: 1678268 - DNA, 10 bp, Homo sapiens
ctggcccagc

SEQ ID NO: 1678269 - DNA, 22 bp, Homo sapiens
ctggcccagccggcctctctgg

SEQ ID NO: 1678270 - DNA, 13 bp, Homo sapiens
ctggcccagcggc

SEQ ID NO: 1678271 - DNA, 12 bp, Homo sapiens
ctggcccagggc

SEQ ID NO: 1678272 - DNA, 13 bp, Homo sapiens
ctggcccagggcc

SEQ ID NO: 1678273 - DNA, 16 bp, Homo sapiens
ctggcccagggcccag

SEQ ID NO: 1678274 - DNA, 18 bp, Homo sapiens
ctggcccagggcccagag

SEQ ID NO: 1678275 - DNA, 20 bp, Homo sapiens
ctggcccagggcccagagcc

SEQ ID NO: 1678276 - DNA, 21 bp, Homo sapiens
ctggcccagggcccagagccc

SEQ ID NO: 1678277 - DNA, 22 bp, Homo sapiens
ctggcccagggggcctggagca

SEQ ID NO: 1678278 - DNA, 18 bp, Homo sapiens
ctggctcccacaggccct

SEQ ID NO: 1678279 - DNA, 16 bp, Homo sapiens
ctggctcccaggacac

SEQ ID NO: 1678280 - DNA, 23 bp, Homo sapiens
ctggctccccacgagtcacctgc

SEQ ID NO: 1678281 - DNA, 18 bp, Homo sapiens
ctggctccctcctccagg

SEQ ID NO: 1678282 - DNA, 12 bp, Homo sapiens
ctggctccctgc

SEQ ID NO: 1678283 - DNA, 21 bp, Homo sapiens
ctggctccctgccccttaacc

SEQ ID NO: 1678284 - DNA, 16 bp, Homo sapiens
ctggctccctgggcag

SEQ ID NO: 1678285 - DNA, 15 bp, Homo sapiens
ctggctcctgagggg

SEQ ID NO: 1678286 - DNA, 16 bp, Homo sapiens
ctggctcctgaggggc

SEQ ID NO: 1678287 - DNA, 18 bp, Homo sapiens
ctggctcggacccacccc

SEQ ID NO: 1678288 - DNA, 15 bp, Homo sapiens
ctggctctaattcac

SEQ ID NO: 1678289 - DNA, 19 bp, Homo sapiens
ctggctctaccctgtctgt

SEQ ID NO: 1678290 - DNA, 16 bp, Homo sapiens
ctggctctcagaggaa

SEQ ID NO: 1678291 - DNA, 12 bp, Homo sapiens
ctggctctccaa

SEQ ID NO: 1678292 - DNA, 16 bp, Homo sapiens
ctggggcttctcctga

SEQ ID NO: 1678293 - DNA, 16 bp, Homo sapiens
ctgggggaagccctgg

SEQ ID NO: 1678294 - DNA, 12 bp, Homo sapiens
ctgggggagaga

SEQ ID NO: 1678295 - DNA, 14 bp, Homo sapiens
ctgggggagagccg

SEQ ID NO: 1678296 - DNA, 19 bp, Homo sapiens
ctgggggcaggagggccct

SEQ ID NO: 1678297 - DNA, 12 bp, Homo sapiens
ctgggggcagtg

SEQ ID NO: 1678298 - DNA, 20 bp, Homo sapiens
ctgggggcagtgactggcag

SEQ ID NO: 1678299 - DNA, 14 bp, Homo sapiens
ctggggggacccag

SEQ ID NO: 1678300 - DNA, 16 bp, Homo sapiens
ctggggggacccagtg

SEQ ID NO: 1678301 - DNA, 18 bp, Homo sapiens
ctggggggatatttccta

SEQ ID NO: 1678302 - DNA, 13 bp, Homo sapiens
ctggggggcagtg

SEQ ID NO: 1678303 - DNA, 16 bp, Homo sapiens
ctggggggctgtcctg

SEQ ID NO: 1678304 - DNA, 17 bp, Homo sapiens
ctgggggtcctctctga

SEQ ID NO: 1678305 - DNA, 16 bp, Homo sapiens
ctggggtacaggtttg

SEQ ID NO: 1678306 - DNA, 22 bp, Homo sapiens
ctggggtagttggtgagcagag

SEQ ID NO: 1678307 - DNA, 22 bp, Homo sapiens
ctggggtctggagttgatctgg

SEQ ID NO: 1678308 - DNA, 14 bp, Homo sapiens
ctggggtgcatctc

SEQ ID NO: 1678309 - DNA, 23 bp, Homo sapiens
ctggggtggcgtctgcctaggag

SEQ ID NO: 1678310 - DNA, 23 bp, Homo sapiens
ctggggtgggggtggggagacct

SEQ ID NO: 1678311 - DNA, 18 bp, Homo sapiens
ctggggttcaagcccagg

SEQ ID NO: 1678312 - DNA, 22 bp, Homo sapiens
ctggggttcaagcccaggcttc

SEQ ID NO: 1678313 - DNA, 23 bp, Homo sapiens
ctggggttcaagcccaggcttcc

SEQ ID NO: 1678314 - DNA, 15 bp, Homo sapiens
ctggggttcagcccc

SEQ ID NO: 1678315 - DNA, 19 bp, Homo sapiens
ctggggttcagcccctcct

SEQ ID NO: 1678316 - DNA, 22 bp, Homo sapiens
ctggggttcagcccctcctctg

SEQ ID NO: 1678317 - DNA, 17 bp, Homo sapiens
ctgggtaagaagaaagc

SEQ ID NO: 1678318 - DNA, 19 bp, Homo sapiens
ctgggtacaagagatggga

SEQ ID NO: 1678319 - DNA, 20 bp, Homo sapiens
ctgggtacctgcaagcagaa

SEQ ID NO: 1678320 - DNA, 19 bp, Homo sapiens
ctgggtactgactgagata

SEQ ID NO: 1678321 - DNA, 14 bp, Homo sapiens
ctgggtaggaaaga

SEQ ID NO: 1678322 - DNA, 16 bp, Homo sapiens
ctgggtagtcccctgt

SEQ ID NO: 1678323 - DNA, 19 bp, Homo sapiens
ctgggtatcccctgcctcc

SEQ ID NO: 1678324 - DNA, 16 bp, Homo sapiens
ctgggtcacagagtga

SEQ ID NO: 1678325 - DNA, 11 bp, Homo sapiens
ctgggtcaggg

SEQ ID NO: 1678326 - DNA, 13 bp, Homo sapiens
ctgggtccagaag

SEQ ID NO: 1678327 - DNA, 17 bp, Homo sapiens
ctgggtccttgggcctg

SEQ ID NO: 1678328 - DNA, 18 bp, Homo sapiens
ctgggtccttgggcctgg

SEQ ID NO: 1678329 - DNA, 19 bp, Homo sapiens
ctgggtccttgggcctggc

SEQ ID NO: 1678330 - DNA, 15 bp, Homo sapiens
ctgggtctcactcct

SEQ ID NO: 1678331 - DNA, 16 bp, Homo sapiens
ctgggtctgacctggt

SEQ ID NO: 1678332 - DNA, 17 bp, Homo sapiens
ctgggtctgattttctc

SEQ ID NO: 1678333 - DNA, 22 bp, Homo sapiens
ctgggtgacagagcaagactct

SEQ ID NO: 1678334 - DNA, 22 bp, Homo sapiens
ctgggtgagccaaggacagggc

SEQ ID NO: 1678335 - DNA, 16 bp, Homo sapiens
ctgggtgccctgaaag

SEQ ID NO: 1678336 - DNA, 17 bp, Homo sapiens
ctgggtgcgtctccagt

SEQ ID NO: 1678337 - DNA, 20 bp, Homo sapiens
ctgggtggaagtgcccagcc

SEQ ID NO: 1678338 - DNA, 21 bp, Homo sapiens
ctgggtggaagtgcccagccc

SEQ ID NO: 1678339 - DNA, 14 bp, Homo sapiens
ctgggtgggctctg

SEQ ID NO: 1678340 - DNA, 18 bp, Homo sapiens
ctgggtggggctgctcct

SEQ ID NO: 1678341 - DNA, 22 bp, Homo sapiens
ctgggtggggctgctcctccag

SEQ ID NO: 1678342 - DNA, 21 bp, Homo sapiens
ctgggtggggtgaggaccact

SEQ ID NO: 1678343 - DNA, 12 bp, Homo sapiens
ctgggtgggtgg

SEQ ID NO: 1678344 - DNA, 15 bp, Homo sapiens
ctgggtgggtggtgg

SEQ ID NO: 1678345 - DNA, 20 bp, Homo sapiens
ctgggtgggtggtggggagg

SEQ ID NO: 1678346 - DNA, 12 bp, Homo sapiens
ctgggtggtacc

SEQ ID NO: 1678347 - DNA, 16 bp, Homo sapiens
ctgggtggtaccctct

SEQ ID NO: 1678348 - DNA, 17 bp, Homo sapiens
ctgggtggtggcctggt

SEQ ID NO: 1678349 - DNA, 16 bp, Homo sapiens
ctgggttaacaaatga

SEQ ID NO: 1678350 - DNA, 18 bp, Homo sapiens
ctgggttcagaaatgctg

SEQ ID NO: 1678351 - DNA, 23 bp, Homo sapiens
ctgggttcagaaatgctgcctgc

SEQ ID NO: 1678352 - DNA, 19 bp, Homo sapiens
ctgggttcccactcccggc

SEQ ID NO: 1678353 - DNA, 17 bp, Homo sapiens
ctgggttgcctttattt

SEQ ID NO: 1678354 - DNA, 15 bp, Homo sapiens
ctgggttggtgcaca

SEQ ID NO: 1678355 - DNA, 15 bp, Homo sapiens
ctgggtttggacccc

SEQ ID NO: 1678356 - DNA, 18 bp, Homo sapiens
ctgggtttggaccccagc

SEQ ID NO: 1678357 - DNA, 21 bp, Homo sapiens
ctgggtttggaccccagctgg

SEQ ID NO: 1678358 - DNA, 23 bp, Homo sapiens
ctgggtttgtttttcaaagcctg

SEQ ID NO: 1678359 - DNA, 19 bp, Homo sapiens
ctggtaagcgatttgaaac

SEQ ID NO: 1678360 - DNA, 18 bp, Homo sapiens
ctggtaattcctctccag

SEQ ID NO: 1678361 - DNA, 19 bp, Homo sapiens
ctggtaattcctctccagg

SEQ ID NO: 1678362 - DNA, 17 bp, Homo sapiens
ctggtaattgtacaata

SEQ ID NO: 1678363 - DNA, 18 bp, Homo sapiens
ctggtacaacggaggcct

SEQ ID NO: 1678364 - DNA, 19 bp, Homo sapiens
ctggtacccagccatctgc

SEQ ID NO: 1678365 - DNA, 16 bp, Homo sapiens
ctggtacctgccctct

SEQ ID NO: 1678366 - DNA, 21 bp, Homo sapiens
ctggtacctgccctctattta

SEQ ID NO: 1678367 - DNA, 22 bp, Homo sapiens
ctggtacgaatctcatccctca

SEQ ID NO: 1678368 - DNA, 19 bp, Homo sapiens
ctggtactccctctcagga

SEQ ID NO: 1678369 - DNA, 17 bp, Homo sapiens
ctggtactgacccagga

SEQ ID NO: 1678370 - DNA, 18 bp, Homo sapiens
ctggtactgacccaggac

SEQ ID NO: 1678371 - DNA, 16 bp, Homo sapiens
ctggtacttcctttct

SEQ ID NO: 1678372 - DNA, 19 bp, Homo sapiens
ctggtagaaaaaggggcct

SEQ ID NO: 1678373 - DNA, 15 bp, Homo sapiens
ctggtagagaccccc

SEQ ID NO: 1678374 - DNA, 17 bp, Homo sapiens
ctggtagagacccccag

SEQ ID NO: 1678375 - DNA, 22 bp, Homo sapiens
ctggtagagacccccaggcctg

SEQ ID NO: 1678376 - DNA, 13 bp, Homo sapiens
ctggtagcagcag

SEQ ID NO: 1678377 - DNA, 19 bp, Homo sapiens
ctggtagcagcaggctcag

SEQ ID NO: 1678378 - DNA, 20 bp, Homo sapiens
ctggtagcagcaggctcagg

SEQ ID NO: 1678379 - DNA, 20 bp, Homo sapiens
ctggtaggttgggacaccag

SEQ ID NO: 1678380 - DNA, 16 bp, Homo sapiens
ctggtagtgtagctgt

SEQ ID NO: 1678381 - DNA, 20 bp, Homo sapiens
ctggtagtgtagctgtgtgg

SEQ ID NO: 1678382 - DNA, 22 bp, Homo sapiens
ctggtatcctcatcatgatgga

SEQ ID NO: 1678383 - DNA, 14 bp, Homo sapiens
ctggtatctcagaa

SEQ ID NO: 1678384 - DNA, 19 bp, Homo sapiens
ctggtattattatgttctt

SEQ ID NO: 1678385 - DNA, 15 bp, Homo sapiens
ctggtattctgttct

SEQ ID NO: 1678386 - DNA, 19 bp, Homo sapiens
ctggtattctgttctggag

SEQ ID NO: 1678387 - DNA, 13 bp, Homo sapiens
ctggtatttctaa

SEQ ID NO: 1678388 - DNA, 22 bp, Homo sapiens
ctggtattttaagagaaaactg

SEQ ID NO: 1678389 - DNA, 14 bp, Homo sapiens
ctggtattttatct

SEQ ID NO: 1678390 - DNA, 17 bp, Homo sapiens
ctggtcactctgccctc

SEQ ID NO: 1678391 - DNA, 18 bp, Homo sapiens
ctggtcactctgccctct

SEQ ID NO: 1678392 - DNA, 22 bp, Homo sapiens
ctggtcactctgccctctgctg

SEQ ID NO: 1678393 - DNA, 24 bp, Homo sapiens
ctggtcactctgccctctgctgct

SEQ ID NO: 1678394 - DNA, 23 bp, Homo sapiens
ctggtcagagagacctcatcctg

SEQ ID NO: 1678395 - DNA, 12 bp, Homo sapiens
ctggtcagtctt

SEQ ID NO: 1678396 - DNA, 18 bp, Homo sapiens
ctggtcagtctttgctca

SEQ ID NO: 1678397 - DNA, 20 bp, Homo sapiens
ctggtcagtctttgctcagt

SEQ ID NO: 1678398 - DNA, 13 bp, Homo sapiens
ctggtccagctct

SEQ ID NO: 1678399 - DNA, 23 bp, Homo sapiens
ctggtccagctctgacatccctt

SEQ ID NO: 1678400 - DNA, 17 bp, Homo sapiens
ctggtccagggaagctg

SEQ ID NO: 1678401 - DNA, 13 bp, Homo sapiens
ctggtccagggct

SEQ ID NO: 1678402 - DNA, 17 bp, Homo sapiens
ctggtcccctcctcagt

SEQ ID NO: 1678403 - DNA, 20 bp, Homo sapiens
ctggtcccggggccagcact

SEQ ID NO: 1678404 - DNA, 18 bp, Homo sapiens
ctggtccctcgtccacag

SEQ ID NO: 1678405 - DNA, 23 bp, Homo sapiens
ctggtccctcgtccacaggggca

SEQ ID NO: 1678406 - DNA, 15 bp, Homo sapiens
ctggtccctgccctc

SEQ ID NO: 1678407 - DNA, 16 bp, Homo sapiens
ctggtccctggtcctt

SEQ ID NO: 1678408 - DNA, 18 bp, Homo sapiens
ctgggccggctgagtggc

SEQ ID NO: 1678409 - DNA, 15 bp, Homo sapiens
ctgggccgggcctgg

SEQ ID NO: 1678410 - DNA, 13 bp, Homo sapiens
ctgggccgggctg

SEQ ID NO: 1678411 - DNA, 12 bp, Homo sapiens
ctgggcctcctg

SEQ ID NO: 1678412 - DNA, 16 bp, Homo sapiens
ctgggcctcctgggaa

SEQ ID NO: 1678413 - DNA, 21 bp, Homo sapiens
ctgggcctcgtgcgcccgtgg

SEQ ID NO: 1678414 - DNA, 14 bp, Homo sapiens
ctggtttgccaggc

SEQ ID NO: 1678415 - DNA, 18 bp, Homo sapiens
ctgtaaaaaatggagctc

SEQ ID NO: 1678416 - DNA, 15 bp, Homo sapiens
ctgtaaaacaggtta

SEQ ID NO: 1678417 - DNA, 23 bp, Homo sapiens
ctgtaaaatatacttaaatggaa

SEQ ID NO: 1678418 - DNA, 15 bp, Homo sapiens
ctgtaaaatgaaatt

SEQ ID NO: 1678419 - DNA, 21 bp, Homo sapiens
ctgtatacagtgcagagcctt

SEQ ID NO: 1678420 - DNA, 14 bp, Homo sapiens
ctgtatagacatgc

SEQ ID NO: 1678421 - DNA, 13 bp, Homo sapiens
ctgtatataaaca

SEQ ID NO: 1678422 - DNA, 14 bp, Homo sapiens
ctgtatataaacat

SEQ ID NO: 1678423 - DNA, 15 bp, Homo sapiens
ctgtatataaatgtg

SEQ ID NO: 1678424 - DNA, 17 bp, Homo sapiens
ctgtatataagttgctg

SEQ ID NO: 1678425 - DNA, 19 bp, Homo sapiens
ctgtatatgattctctgtg

SEQ ID NO: 1678426 - DNA, 20 bp, Homo sapiens
ctgtatatgattctctgtgg

SEQ ID NO: 1678427 - DNA, 14 bp, Homo sapiens
ctgtatatgtattc

SEQ ID NO: 1678428 - DNA, 19 bp, Homo sapiens
ctgtccccttctctcatct

SEQ ID NO: 1678429 - DNA, 20 bp, Homo sapiens
ctgtccccttctctcatctc

SEQ ID NO: 1678430 - DNA, 13 bp, Homo sapiens
ctgtccctcactg

SEQ ID NO: 1678431 - DNA, 18 bp, Homo sapiens
ctgtccctccatcccaga

SEQ ID NO: 1678432 - DNA, 18 bp, Homo sapiens
ctgtccctctcagtgcct

SEQ ID NO: 1678433 - DNA, 12 bp, Homo sapiens
ctgtccctgcag

SEQ ID NO: 1678434 - DNA, 14 bp, Homo sapiens
ctgtccctgcaggg

SEQ ID NO: 1678435 - DNA, 17 bp, Homo sapiens
ctgtccctgtagctcag

SEQ ID NO: 1678436 - DNA, 17 bp, Homo sapiens
ctgtccctgtcaccaag

SEQ ID NO: 1678437 - DNA, 13 bp, Homo sapiens
ctgtcccttgcct

SEQ ID NO: 1678438 - DNA, 21 bp, Homo sapiens
ctgtcccttgcctcaatgcca

SEQ ID NO: 1678439 - DNA, 16 bp, Homo sapiens
ctgtcccttgcctctg

SEQ ID NO: 1678440 - DNA, 17 bp, Homo sapiens
ctgtcccttgcctctgc

SEQ ID NO: 1678441 - DNA, 22 bp, Homo sapiens
ctgtcccttgcctctgccctgg

SEQ ID NO: 1678442 - DNA, 14 bp, Homo sapiens
ctgtcccttgctgt

SEQ ID NO: 1678443 - DNA, 17 bp, Homo sapiens
ctgtccctttgctcccg

SEQ ID NO: 1678444 - DNA, 19 bp, Homo sapiens
ctgtccctttgctcccggc

SEQ ID NO: 1678445 - DNA, 17 bp, Homo sapiens
ctgtcccttttccctta

SEQ ID NO: 1678446 - DNA, 20 bp, Homo sapiens
ctgtccggcccagtgccact

SEQ ID NO: 1678447 - DNA, 19 bp, Homo sapiens
ctgtccgggtgccagggct

SEQ ID NO: 1678448 - DNA, 17 bp, Homo sapiens
ctgtcctaaggaacctt

SEQ ID NO: 1678449 - DNA, 20 bp, Homo sapiens
ctgtcctaaggaaccttcct

SEQ ID NO: 1678450 - DNA, 22 bp, Homo sapiens
ctgtcctcagaggcgtgctggt

SEQ ID NO: 1678451 - DNA, 13 bp, Homo sapiens
ctgtcctcagcct

SEQ ID NO: 1678452 - DNA, 14 bp, Homo sapiens
ctgtcctcagcctt

SEQ ID NO: 1678453 - DNA, 18 bp, Homo sapiens
ctgtcctcagccttgcca

SEQ ID NO: 1678454 - DNA, 12 bp, Homo sapiens
ctgtcctctgta

SEQ ID NO: 1678455 - DNA, 15 bp, Homo sapiens
ctgtcctcttggcca

SEQ ID NO: 1678456 - DNA, 17 bp, Homo sapiens
ctgtcctgagccccctg

SEQ ID NO: 1678457 - DNA, 18 bp, Homo sapiens
ctgtcctgagccccctgc

SEQ ID NO: 1678458 - DNA, 19 bp, Homo sapiens
ctgtcctgagccccctgca

SEQ ID NO: 1678459 - DNA, 21 bp, Homo sapiens
ctgtcctgagccccctgcacc

SEQ ID NO: 1678460 - DNA, 17 bp, Homo sapiens
ctgtcctgaggagccct

SEQ ID NO: 1678461 - DNA, 18 bp, Homo sapiens
ctgtcctgaggagccctg

SEQ ID NO: 1678462 - DNA, 20 bp, Homo sapiens
ctgtcctgaggagccctgag

SEQ ID NO: 1678463 - DNA, 23 bp, Homo sapiens
ctgtcctgaggagccctgaggac

SEQ ID NO: 1678464 - DNA, 13 bp, Homo sapiens
ctgtcctgcagca

SEQ ID NO: 1678465 - DNA, 23 bp, Homo sapiens
ctgtcctgcagcaaacactccac

SEQ ID NO: 1678466 - DNA, 13 bp, Homo sapiens
ctgtcctgcagta

SEQ ID NO: 1678467 - DNA, 10 bp, Homo sapiens
ctgtcctgct

SEQ ID NO: 1678468 - DNA, 22 bp, Homo sapiens
ctgtcctgctcattatgccact

SEQ ID NO: 1678469 - DNA, 16 bp, Homo sapiens
ctgtcctgctgccctc

SEQ ID NO: 1678470 - DNA, 13 bp, Homo sapiens
ctgtcctgggcgc

SEQ ID NO: 1678471 - DNA, 19 bp, Homo sapiens
ctgtcctgggcgccctgga

SEQ ID NO: 1678472 - DNA, 19 bp, Homo sapiens
ctgtcctggtcctgatgcc

SEQ ID NO: 1678473 - DNA, 20 bp, Homo sapiens
ctgtccttaacccacctctc

SEQ ID NO: 1678474 - DNA, 21 bp, Homo sapiens
ctgtccttaacccacctctcc

SEQ ID NO: 1678475 - DNA, 22 bp, Homo sapiens
ctgtccttcattccgttaggaa

SEQ ID NO: 1678476 - DNA, 14 bp, Homo sapiens
ctgtccttccctgc

SEQ ID NO: 1678477 - DNA, 17 bp, Homo sapiens
ctgtccttgaaaaacaa

SEQ ID NO: 1678478 - DNA, 15 bp, Homo sapiens
ctgtcctttcttgca

SEQ ID NO: 1678479 - DNA, 18 bp, Homo sapiens
ctgtcgagacacttgcct

SEQ ID NO: 1678480 - DNA, 16 bp, Homo sapiens
ctgtcgcccaggctgg

SEQ ID NO: 1678481 - DNA, 17 bp, Homo sapiens
ctgtcgcccaggctgga

SEQ ID NO: 1678482 - DNA, 14 bp, Homo sapiens
ctgtcgctgcctcc

SEQ ID NO: 1678483 - DNA, 13 bp, Homo sapiens
ctgtcggcaccat

SEQ ID NO: 1678484 - DNA, 17 bp, Homo sapiens
ctgtcgtgccagtcctg

SEQ ID NO: 1678485 - DNA, 19 bp, Homo sapiens
ctgtcgtgccagtcctggg

SEQ ID NO: 1678486 - DNA, 23 bp, Homo sapiens
ctgtctaagcagttttgtaaatg

SEQ ID NO: 1678487 - DNA, 14 bp, Homo sapiens
ctgtctacaggaaa

SEQ ID NO: 1678488 - DNA, 20 bp, Homo sapiens
ctgtctactgtggtgatctg

SEQ ID NO: 1678489 - DNA, 17 bp, Homo sapiens
ctgtctattaaaattct

SEQ ID NO: 1678490 - DNA, 23 bp, Homo sapiens
ctgtctattaaaattctgatgtt

SEQ ID NO: 1678491 - DNA, 14 bp, Homo sapiens
ctgtctcaaaagga

SEQ ID NO: 1678492 - DNA, 19 bp, Homo sapiens
ctgtctcaagagggcactg

SEQ ID NO: 1678493 - DNA, 20 bp, Homo sapiens
ctgtctcaagagggcactgg

SEQ ID NO: 1678494 - DNA, 22 bp, Homo sapiens
ctgtctcaagagggcactggtg

SEQ ID NO: 1678495 - DNA, 12 bp, Homo sapiens
ctgtctcacctg

SEQ ID NO: 1678496 - DNA, 17 bp, Homo sapiens
ctgtctcacctggactt

SEQ ID NO: 1678497 - DNA, 16 bp, Homo sapiens
ctgtctcagcctccca

SEQ ID NO: 1678498 - DNA, 17 bp, Homo sapiens
ctgtctcagcctcctga

SEQ ID NO: 1678499 - DNA, 17 bp, Homo sapiens
ctgtctcagtttcactt

SEQ ID NO: 1678500 - DNA, 15 bp, Homo sapiens
ctgtctcatccccag

SEQ ID NO: 1678501 - DNA, 17 bp, Homo sapiens
ctgtctcatccccaggg

SEQ ID NO: 1678502 - DNA, 15 bp, Homo sapiens
ctgtctccagctgcc

SEQ ID NO: 1678503 - DNA, 21 bp, Homo sapiens
ctgtctccagctgcctgggcc

SEQ ID NO: 1678504 - DNA, 22 bp, Homo sapiens
ctgtctccctcccctctcagaa

SEQ ID NO: 1678505 - DNA, 22 bp, Homo sapiens
ctgtctcctaagctggagtgca

SEQ ID NO: 1678506 - DNA, 15 bp, Homo sapiens
ctgtctcgatgcctg

SEQ ID NO: 1678507 - DNA, 16 bp, Homo sapiens
ctgtctcgatgcctga

SEQ ID NO: 1678508 - DNA, 17 bp, Homo sapiens
ctgtctcgatgcctgat

SEQ ID NO: 1678509 - DNA, 23 bp, Homo sapiens
ctgtctctaaaaagaagccacag

SEQ ID NO: 1678510 - DNA, 18 bp, Homo sapiens
ctgtctctaaccattcaa

SEQ ID NO: 1678511 - DNA, 21 bp, Homo sapiens
ctgtctctaaggagcagcggg

SEQ ID NO: 1678512 - DNA, 20 bp, Homo sapiens
ctgtctgaaggacacttcct

SEQ ID NO: 1678513 - DNA, 22 bp, Homo sapiens
ctgtctgaaggacacttcctgc

SEQ ID NO: 1678514 - DNA, 18 bp, Homo sapiens
ctgtctgaatattctaga

SEQ ID NO: 1678515 - DNA, 20 bp, Homo sapiens
ctgtctgaccagagaatgca

SEQ ID NO: 1678516 - DNA, 15 bp, Homo sapiens
ctgtctgattctatg

SEQ ID NO: 1678517 - DNA, 17 bp, Homo sapiens
ctgtctgattctatgcc

SEQ ID NO: 1678518 - DNA, 21 bp, Homo sapiens
ctgtctgccagccagcagcca

SEQ ID NO: 1678519 - DNA, 11 bp, Homo sapiens
ctgtctgcccc

SEQ ID NO: 1678520 - DNA, 17 bp, Homo sapiens
ctgtctgccctctgggt

SEQ ID NO: 1678521 - DNA, 13 bp, Homo sapiens
ctgtctgctgcca

SEQ ID NO: 1678522 - DNA, 15 bp, Homo sapiens
ctgtctgctgccagc

SEQ ID NO: 1678523 - DNA, 16 bp, Homo sapiens
ctgtctgctgccagca

SEQ ID NO: 1678524 - DNA, 20 bp, Homo sapiens
ctgtctggctcggacccacc

SEQ ID NO: 1678525 - DNA, 23 bp, Homo sapiens
ctgtctggctcggacccacccca

SEQ ID NO: 1678526 - DNA, 15 bp, Homo sapiens
ctgtctggtggcccc

SEQ ID NO: 1678527 - DNA, 23 bp, Homo sapiens
ctgtctggtggccccgtttctgg

SEQ ID NO: 1678528 - DNA, 17 bp, Homo sapiens
ctgtctgtcccttttct

SEQ ID NO: 1678529 - DNA, 17 bp, Homo sapiens
ctgtggggaacatggct

SEQ ID NO: 1678530 - DNA, 22 bp, Homo sapiens
ctgtggggaacatggctggcct

SEQ ID NO: 1678531 - DNA, 14 bp, Homo sapiens
ctgtggggcaggag

SEQ ID NO: 1678532 - DNA, 20 bp, Homo sapiens
ctgtggggcaggagtgccag

SEQ ID NO: 1678533 - DNA, 12 bp, Homo sapiens
ctgtggggctga

SEQ ID NO: 1678534 - DNA, 18 bp, Homo sapiens
ctgtgggggactggctgg

SEQ ID NO: 1678535 - DNA, 14 bp, Homo sapiens
ctgtgggtctctga

SEQ ID NO: 1678536 - DNA, 17 bp, Homo sapiens
ctgtgggtctctgaagg

SEQ ID NO: 1678537 - DNA, 20 bp, Homo sapiens
ctgtgggtgtgggtgggagt

SEQ ID NO: 1678538 - DNA, 15 bp, Homo sapiens
ctgtggtagctccag

SEQ ID NO: 1678539 - DNA, 17 bp, Homo sapiens
ctgtggtaggggcaggg

SEQ ID NO: 1678540 - DNA, 23 bp, Homo sapiens
ctgtggtagtactcctgcaaaat

SEQ ID NO: 1678541 - DNA, 14 bp, Homo sapiens
ctgtggtggctccc

SEQ ID NO: 1678542 - DNA, 22 bp, Homo sapiens
ctgtggtggctccccctctgct

SEQ ID NO: 1678543 - DNA, 15 bp, Homo sapiens
ctgtggtttcagatg

SEQ ID NO: 1678544 - DNA, 21 bp, Homo sapiens
ctgtggtttcagatgtgcaat

SEQ ID NO: 1678545 - DNA, 16 bp, Homo sapiens
ctgtggttttcccctc

SEQ ID NO: 1678546 - DNA, 23 bp, Homo sapiens
ctgtggttttcccctccctgggt

SEQ ID NO: 1678547 - DNA, 18 bp, Homo sapiens
ctgtgtaaccttgggtgg

SEQ ID NO: 1678548 - DNA, 21 bp, Homo sapiens
ctgtgtaactttctcttaaga

SEQ ID NO: 1678549 - DNA, 22 bp, Homo sapiens
ctgtgtaagaagctgtgaatat

SEQ ID NO: 1678550 - DNA, 18 bp, Homo sapiens
ctgtgtaattagtgccac

SEQ ID NO: 1678551 - DNA, 16 bp, Homo sapiens
ctgtgtacaatgtgag

SEQ ID NO: 1678552 - DNA, 17 bp, Homo sapiens
ctgtgtacaatgtgaga

SEQ ID NO: 1678553 - DNA, 20 bp, Homo sapiens
ctgtgtacataactgaaaat

SEQ ID NO: 1678554 - DNA, 19 bp, Homo sapiens
ctgtgtaccacttcctgag

SEQ ID NO: 1678555 - DNA, 21 bp, Homo sapiens
ctgtgtaccacttcctgaggc

SEQ ID NO: 1678556 - DNA, 19 bp, Homo sapiens
ctgtgtagccgccctgaga

SEQ ID NO: 1678557 - DNA, 15 bp, Homo sapiens
ctgtgtatgtacata

SEQ ID NO: 1678558 - DNA, 15 bp, Homo sapiens
ctgtgtatttgcttt

SEQ ID NO: 1678559 - DNA, 23 bp, Homo sapiens
ctgtgtattttttaaagctacaa

SEQ ID NO: 1678560 - DNA, 18 bp, Homo sapiens
ctgtgtcacccagactgg

SEQ ID NO: 1678561 - DNA, 14 bp, Homo sapiens
ctgtgtcacccagg

SEQ ID NO: 1678562 - DNA, 14 bp, Homo sapiens
ctgtgtcactacgt

SEQ ID NO: 1678563 - DNA, 14 bp, Homo sapiens
ctgtgtcagagccc

SEQ ID NO: 1678564 - DNA, 17 bp, Homo sapiens
ctgtgtcagagcccagc

SEQ ID NO: 1678565 - DNA, 15 bp, Homo sapiens
ctgtgtcatttcttc

SEQ ID NO: 1678566 - DNA, 16 bp, Homo sapiens
ctgtgtcatttcttca

SEQ ID NO: 1678567 - DNA, 17 bp, Homo sapiens
ctgtgtccactgagact

SEQ ID NO: 1678568 - DNA, 17 bp, Homo sapiens
ctgtgtccagcagctgc

SEQ ID NO: 1678569 - DNA, 23 bp, Homo sapiens
ctgtgtccagttttggaggctga

SEQ ID NO: 1678570 - DNA, 13 bp, Homo sapiens
ctgtgtccatgcg

SEQ ID NO: 1678571 - DNA, 19 bp, Homo sapiens
ctgtgtccatgcgctcagg

SEQ ID NO: 1678572 - DNA, 23 bp, Homo sapiens
ctgtgtccatgcgctcagggcca

SEQ ID NO: 1678573 - DNA, 16 bp, Homo sapiens
ctgtgtcccagccacg

SEQ ID NO: 1678574 - DNA, 20 bp, Homo sapiens
ctgtgtcccatgacccaccc

SEQ ID NO: 1678575 - DNA, 23 bp, Homo sapiens
ctgtgtcccatgacccacccctg

SEQ ID NO: 1678576 - DNA, 21 bp, Homo sapiens
ctgtgtcccccccagtgcagg

SEQ ID NO: 1678577 - DNA, 22 bp, Homo sapiens
ctgtgtccccgatgctgacctc

SEQ ID NO: 1678578 - DNA, 17 bp, Homo sapiens
ctgtgtccgatgctgga

SEQ ID NO: 1678579 - DNA, 19 bp, Homo sapiens
ctgtgtctaagattctaga

SEQ ID NO: 1678580 - DNA, 21 bp, Homo sapiens
ctgtgtctaagattctagatc

SEQ ID NO: 1678581 - DNA, 21 bp, Homo sapiens
ctgtgtctgccaaacacattt

SEQ ID NO: 1678582 - DNA, 23 bp, Homo sapiens
ctgtgtgacagaatcttgtattt

SEQ ID NO: 1678583 - DNA, 16 bp, Homo sapiens
ctgtgtgcacaaatat

SEQ ID NO: 1678584 - DNA, 14 bp, Homo sapiens
ctgtgtgcccagca

SEQ ID NO: 1678585 - DNA, 18 bp, Homo sapiens
ctgtgtgcccagcacctg

SEQ ID NO: 1678586 - DNA, 20 bp, Homo sapiens
ctgtgtgcccagcacctgga

SEQ ID NO: 1678587 - DNA, 17 bp, Homo sapiens
ctgtgtgccccactcca

SEQ ID NO: 1678588 - DNA, 13 bp, Homo sapiens
ctgtgtgcttttt

SEQ ID NO: 1678589 - DNA, 23 bp, Homo sapiens
ctgtgtggagagggaatgtgaaa

SEQ ID NO: 1678590 - DNA, 21 bp, Homo sapiens
ctgtgtggcccagttctgaaa

SEQ ID NO: 1678591 - DNA, 19 bp, Homo sapiens
ctgtgtgggatacttagtg

SEQ ID NO: 1678592 - DNA, 24 bp, Homo sapiens
ctgtgtgggatacttagtggtatg

SEQ ID NO: 1678593 - DNA, 21 bp, Homo sapiens
ctgtgtggtggagccagggcc

SEQ ID NO: 1678594 - DNA, 22 bp, Homo sapiens
ctgtgtggtggagccagggcct

SEQ ID NO: 1678595 - DNA, 21 bp, Homo sapiens
ctgtgtgtccaaaactgcctc

SEQ ID NO: 1678596 - DNA, 22 bp, Homo sapiens
ctgtgtgtcccaggcagggaga

SEQ ID NO: 1678597 - DNA, 20 bp, Homo sapiens
ctgtgtgtctggtgggtgga

SEQ ID NO: 1678598 - DNA, 12 bp, Homo sapiens
ctgtgtgtctgt

SEQ ID NO: 1678599 - DNA, 15 bp, Homo sapiens
ctgtgtgtctgtcct

SEQ ID NO: 1678600 - DNA, 13 bp, Homo sapiens
ctgtgtgtgagct

SEQ ID NO: 1678601 - DNA, 20 bp, Homo sapiens
ctgtgtgtgagctaccgtgg

SEQ ID NO: 1678602 - DNA, 21 bp, Homo sapiens
ctgtgtgtggaaggcacccgc

SEQ ID NO: 1678603 - DNA, 16 bp, Homo sapiens
ctgtgtgtgtgtatgt

SEQ ID NO: 1678604 - DNA, 20 bp, Homo sapiens
ctgtgtgtgtgtatgtgggg

SEQ ID NO: 1678605 - DNA, 23 bp, Homo sapiens
ctgtgtgtgtgtgtgtgcgtgtg

SEQ ID NO: 1678606 - DNA, 16 bp, Homo sapiens
ctgtgtgttagttccc

SEQ ID NO: 1678607 - DNA, 22 bp, Homo sapiens
ctgtgttaaacactacacattt

SEQ ID NO: 1678608 - DNA, 23 bp, Homo sapiens
ctgtgttaattgcgtagaggcta

SEQ ID NO: 1678609 - DNA, 22 bp, Homo sapiens
ctgtgttactaaaaaaaagatg

SEQ ID NO: 1678610 - DNA, 15 bp, Homo sapiens
ctgtgttactgcttt

SEQ ID NO: 1678611 - DNA, 16 bp, Homo sapiens
ctgtgttatgaaaata

SEQ ID NO: 1678612 - DNA, 16 bp, Homo sapiens
ctgtgttgccaagctc

SEQ ID NO: 1678613 - DNA, 21 bp, Homo sapiens
ctgtgttgccaagctccaagc

SEQ ID NO: 1678614 - DNA, 16 bp, Homo sapiens
ctgtgtttataaaata

SEQ ID NO: 1678615 - DNA, 12 bp, Homo sapiens
ctgtgtttattc

SEQ ID NO: 1678616 - DNA, 19 bp, Homo sapiens
ctgtgtttcaagtggggct

SEQ ID NO: 1678617 - DNA, 19 bp, Homo sapiens
ctgtgtttccaaaggttcc

SEQ ID NO: 1678618 - DNA, 21 bp, Homo sapiens
ctgtgtttccaaaggttcccc

SEQ ID NO: 1678619 - DNA, 15 bp, Homo sapiens
ctgtgtttccatctc

SEQ ID NO: 1678620 - DNA, 23 bp, Homo sapiens
ctgtgtttccatctcaaagaagg

SEQ ID NO: 1678621 - DNA, 14 bp, Homo sapiens
ctgtgtttctggag

SEQ ID NO: 1678622 - DNA, 20 bp, Homo sapiens
ctgtgtttgcagcctgctct

SEQ ID NO: 1678623 - DNA, 12 bp, Homo sapiens
ctgtgttttagt

SEQ ID NO: 1678624 - DNA, 21 bp, Homo sapiens
ctgtgttttagtgtaaaattg

SEQ ID NO: 1678625 - DNA, 18 bp, Homo sapiens
ctgtgttttgaaagaata

SEQ ID NO: 1678626 - DNA, 22 bp, Homo sapiens
ctgtgttttgaaagaatagaac

SEQ ID NO: 1678627 - DNA, 15 bp, Homo sapiens
ctgttaaaagatgaa

SEQ ID NO: 1678628 - DNA, 19 bp, Homo sapiens
ctgttaaaagatgaaaata

SEQ ID NO: 1678629 - DNA, 17 bp, Homo sapiens
ctgttaaaatgtacact

SEQ ID NO: 1678630 - DNA, 11 bp, Homo sapiens
ctgttaaatac

SEQ ID NO: 1678631 - DNA, 16 bp, Homo sapiens
ctgttaaatacaggaa

SEQ ID NO: 1678632 - DNA, 17 bp, Homo sapiens
ctgttaaatacaggaaa

SEQ ID NO: 1678633 - DNA, 19 bp, Homo sapiens
ctgttaaatacaggaaaca

SEQ ID NO: 1678634 - DNA, 20 bp, Homo sapiens
ctgttaactttcatgctaca

SEQ ID NO: 1678635 - DNA, 18 bp, Homo sapiens
ctgttaatatttctaaaa

SEQ ID NO: 1678636 - DNA, 13 bp, Homo sapiens
ctgttacaaaaga

SEQ ID NO: 1678637 - DNA, 12 bp, Homo sapiens
ctgttacactgg

SEQ ID NO: 1678638 - DNA, 14 bp, Homo sapiens
ctgttacactgggc

SEQ ID NO: 1678639 - DNA, 16 bp, Homo sapiens
ctgttacactgggctg

SEQ ID NO: 1678640 - DNA, 17 bp, Homo sapiens
ctgttacccaggctgga

SEQ ID NO: 1678641 - DNA, 22 bp, Homo sapiens
ctgttacccagggctctgcagc

SEQ ID NO: 1678642 - DNA, 21 bp, Homo sapiens
ctgttactaaatccttttgtt

SEQ ID NO: 1678643 - DNA, 24 bp, Homo sapiens
ctgttactccattactgtgatttc

SEQ ID NO: 1678644 - DNA, 15 bp, Homo sapiens
ctgttactgggccct

SEQ ID NO: 1678645 - DNA, 15 bp, Homo sapiens
ctgttacttgcttca

SEQ ID NO: 1678646 - DNA, 15 bp, Homo sapiens
ctgttactttggcaa

SEQ ID NO: 1678647 - DNA, 23 bp, Homo sapiens
ctgttactttggcaatttcctgg

SEQ ID NO: 1678648 - DNA, 14 bp, Homo sapiens
ctgttagggccttg

SEQ ID NO: 1678649 - DNA, 17 bp, Homo sapiens
ctgttagtgcactgatt

SEQ ID NO: 1678650 - DNA, 17 bp, Homo sapiens
ctgttatatatctcttt

SEQ ID NO: 1678651 - DNA, 13 bp, Homo sapiens
ctgttatcaaata

SEQ ID NO: 1678652 - DNA, 19 bp, Homo sapiens
ctgttatcaaatagcgatg

SEQ ID NO: 1678653 - DNA, 19 bp, Homo sapiens
ctgttatcattttttcctg

SEQ ID NO: 1678654 - DNA, 20 bp, Homo sapiens
ctgttatcattttttcctgt

SEQ ID NO: 1678655 - DNA, 14 bp, Homo sapiens
ctgttatgtccaga

SEQ ID NO: 1678656 - DNA, 14 bp, Homo sapiens
ctgttatttagact

SEQ ID NO: 1678657 - DNA, 16 bp, Homo sapiens
ctgttatttagactca

SEQ ID NO: 1678658 - DNA, 14 bp, Homo sapiens
ctgttatttcttcc

SEQ ID NO: 1678659 - DNA, 21 bp, Homo sapiens
ctgttatttcttccctgcttt

SEQ ID NO: 1678660 - DNA, 16 bp, Homo sapiens
ctgttcaaagctgcct

SEQ ID NO: 1678661 - DNA, 22 bp, Homo sapiens
ctgttcaatgtttttaaaaatc

SEQ ID NO: 1678662 - DNA, 21 bp, Homo sapiens
ctgttcacaaactacctctgg

SEQ ID NO: 1678663 - DNA, 22 bp, Homo sapiens
ctgttcacagccagactggcac

SEQ ID NO: 1678664 - DNA, 19 bp, Homo sapiens
ctgttcacagtctctggaa

SEQ ID NO: 1678665 - DNA, 14 bp, Homo sapiens
ctgttcagatgtgc

SEQ ID NO: 1678666 - DNA, 13 bp, Homo sapiens
ctgttcagctttt

SEQ ID NO: 1678667 - DNA, 16 bp, Homo sapiens
ctgttcagtaataaaa

SEQ ID NO: 1678668 - DNA, 14 bp, Homo sapiens
ctgttcattctgat

SEQ ID NO: 1678669 - DNA, 20 bp, Homo sapiens
ctgttccaacctcctgctct

SEQ ID NO: 1678670 - DNA, 12 bp, Homo sapiens
ctgttccagact

SEQ ID NO: 1678671 - DNA, 20 bp, Homo sapiens
ctgttcccatgtagccccct

SEQ ID NO: 1678672 - DNA, 11 bp, Homo sapiens
ctgttccctag

SEQ ID NO: 1678673 - DNA, 14 bp, Homo sapiens
ctgttccctagaga

SEQ ID NO: 1678674 - DNA, 23 bp, Homo sapiens
ctgttccctagagagaataaatt

SEQ ID NO: 1678675 - DNA, 19 bp, Homo sapiens
ctgttccctctggcttccc

SEQ ID NO: 1678676 - DNA, 18 bp, Homo sapiens
ctgttccctggagtcagg

SEQ ID NO: 1678677 - DNA, 21 bp, Homo sapiens
ctgttccctggagtcagggtg

SEQ ID NO: 1678678 - DNA, 12 bp, Homo sapiens
ctgttccctggg

SEQ ID NO: 1678679 - DNA, 15 bp, Homo sapiens
ctgttccctgggctg

SEQ ID NO: 1678680 - DNA, 13 bp, Homo sapiens
ctgttcccttgca

SEQ ID NO: 1678681 - DNA, 16 bp, Homo sapiens
ctgttcctgctccatg

SEQ ID NO: 1678682 - DNA, 15 bp, Homo sapiens
ctgttccttagacct

SEQ ID NO: 1678683 - DNA, 18 bp, Homo sapiens
ctgttccttcacatcctg

SEQ ID NO: 1678684 - DNA, 17 bp, Homo sapiens
ctgttcctttctctggg

SEQ ID NO: 1678685 - DNA, 18 bp, Homo sapiens
ctgttcggaaggggttcc

SEQ ID NO: 1678686 - DNA, 16 bp, Homo sapiens
ctgttctaaagctctg

SEQ ID NO: 1678687 - DNA, 19 bp, Homo sapiens
ctgttctagacacagtgta

SEQ ID NO: 1678688 - DNA, 21 bp, Homo sapiens
ctgttctagcaagatagtctt

SEQ ID NO: 1678689 - DNA, 20 bp, Homo sapiens
ctgttctatgcctttagtca

SEQ ID NO: 1678690 - DNA, 21 bp, Homo sapiens
ctgttctgcgctgtgtacaat

SEQ ID NO: 1678691 - DNA, 14 bp, Homo sapiens
ctgttctgctccca

SEQ ID NO: 1678692 - DNA, 11 bp, Homo sapiens
ctgttctggaa

SEQ ID NO: 1678693 - DNA, 23 bp, Homo sapiens
ctgttctggaggaaagggaggag

SEQ ID NO: 1678694 - DNA, 22 bp, Homo sapiens
ctgttctgtttggcacttgtat

SEQ ID NO: 1678695 - DNA, 19 bp, Homo sapiens
ctgttcttagagtgtagct

SEQ ID NO: 1678696 - DNA, 21 bp, Homo sapiens
ctgttcttagagtgtagctgt

SEQ ID NO: 1678697 - DNA, 16 bp, Homo sapiens
ctgttcttgcataggc

SEQ ID NO: 1678698 - DNA, 18 bp, Homo sapiens
ctgttcttgggcctcagg

SEQ ID NO: 1678699 - DNA, 20 bp, Homo sapiens
ctgttcttgggcctcaggct

SEQ ID NO: 1678700 - DNA, 20 bp, Homo sapiens
ctgttgaaaagcacacacaa

SEQ ID NO: 1678701 - DNA, 19 bp, Homo sapiens
ctgttgaattggtgaataa

SEQ ID NO: 1678702 - DNA, 20 bp, Homo sapiens
ctgttgaattggtgaataaa

SEQ ID NO: 1678703 - DNA, 22 bp, Homo sapiens
ctgttgaattttgttctctggg

SEQ ID NO: 1678704 - DNA, 18 bp, Homo sapiens
ctgttgagatgtgctttg

SEQ ID NO: 1678705 - DNA, 18 bp, Homo sapiens
ctgttgagccccagtgct

SEQ ID NO: 1678706 - DNA, 20 bp, Homo sapiens
ctgttgagctgttttccctg

SEQ ID NO: 1678707 - DNA, 18 bp, Homo sapiens
ctgttgagggccactttt

SEQ ID NO: 1678708 - DNA, 17 bp, Homo sapiens
ctgttgatcccacttca

SEQ ID NO: 1678709 - DNA, 17 bp, Homo sapiens
ctgttgcactgatgtcc

SEQ ID NO: 1678710 - DNA, 15 bp, Homo sapiens
ctgttgcagtggcct

SEQ ID NO: 1678711 - DNA, 16 bp, Homo sapiens
ctgttgcatttacttt

SEQ ID NO: 1678712 - DNA, 21 bp, Homo sapiens
ctgttgccaggctggagtgca

SEQ ID NO: 1678713 - DNA, 18 bp, Homo sapiens
ctgttgccagtcagcaac

SEQ ID NO: 1678714 - DNA, 14 bp, Homo sapiens
ctgttgccatggat

SEQ ID NO: 1678715 - DNA, 17 bp, Homo sapiens
ctgttgccatggattca

SEQ ID NO: 1678716 - DNA, 20 bp, Homo sapiens
ctgttgcccaggctggagtg

SEQ ID NO: 1678717 - DNA, 18 bp, Homo sapiens
ctgttgctatagagccta

SEQ ID NO: 1678718 - DNA, 23 bp, Homo sapiens
ctgttgctatttgtatttctctt

SEQ ID NO: 1678719 - DNA, 11 bp, Homo sapiens
ctgttgctcaa

SEQ ID NO: 1678720 - DNA, 16 bp, Homo sapiens
ctgttgctgattttat

SEQ ID NO: 1678721 - DNA, 21 bp, Homo sapiens
ctgttgctgattttattcttg

SEQ ID NO: 1678722 - DNA, 19 bp, Homo sapiens
ctgttgctttaatatgagc

SEQ ID NO: 1678723 - DNA, 23 bp, Homo sapiens
ctgttggaatggatttttcttta

SEQ ID NO: 1678724 - DNA, 15 bp, Homo sapiens
ctgttggacagctgc

SEQ ID NO: 1678725 - DNA, 16 bp, Homo sapiens
ctgttggacagctgct

SEQ ID NO: 1678726 - DNA, 12 bp, Homo sapiens
ctgttggagaaa

SEQ ID NO: 1678727 - DNA, 14 bp, Homo sapiens
ctgttggaggcaca

SEQ ID NO: 1678728 - DNA, 18 bp, Homo sapiens
ctgtttatggcctcagct

SEQ ID NO: 1678729 - DNA, 14 bp, Homo sapiens
ctgtttattaatct

SEQ ID NO: 1678730 - DNA, 23 bp, Homo sapiens
ctgtttattcttccagaatgctg

SEQ ID NO: 1678731 - DNA, 17 bp, Homo sapiens
ctgtttatttaaggatg

SEQ ID NO: 1678732 - DNA, 20 bp, Homo sapiens
ctgtttatttaaggatggat

SEQ ID NO: 1678733 - DNA, 22 bp, Homo sapiens
ctgtttatttaaggatggatgg

SEQ ID NO: 1678734 - DNA, 23 bp, Homo sapiens
ctgtttatttaaggatggatggc

SEQ ID NO: 1678735 - DNA, 19 bp, Homo sapiens
ctgtttcaaaaaaatctat

SEQ ID NO: 1678736 - DNA, 16 bp, Homo sapiens
ctgtttcaaagcacaa

SEQ ID NO: 1678737 - DNA, 17 bp, Homo sapiens
ctgtttcaacacagacc

SEQ ID NO: 1678738 - DNA, 21 bp, Homo sapiens
ctgtttcaaggcactctagat

SEQ ID NO: 1678739 - DNA, 20 bp, Homo sapiens
ctgtttcactgaaatgtttg

SEQ ID NO: 1678740 - DNA, 18 bp, Homo sapiens
ctgtttcagaccccccca

SEQ ID NO: 1678741 - DNA, 19 bp, Homo sapiens
ctgtttcagacccccccat

SEQ ID NO: 1678742 - DNA, 14 bp, Homo sapiens
ctgtttccctgctg

SEQ ID NO: 1678743 - DNA, 16 bp, Homo sapiens
ctgtttctaagaaaat

SEQ ID NO: 1678744 - DNA, 12 bp, Homo sapiens
ctgtttctcatg

SEQ ID NO: 1678745 - DNA, 13 bp, Homo sapiens
ctgtttctcatga

SEQ ID NO: 1678746 - DNA, 14 bp, Homo sapiens
ctgtttctcatgaa

SEQ ID NO: 1678747 - DNA, 15 bp, Homo sapiens
ctgtttctcatgaag

SEQ ID NO: 1678748 - DNA, 15 bp, Homo sapiens
ctgtttctcttgagc

SEQ ID NO: 1678749 - DNA, 17 bp, Homo sapiens
ctgtttctcttgagctg

SEQ ID NO: 1678750 - DNA, 22 bp, Homo sapiens
ctgtttctcttgagctggcctc

SEQ ID NO: 1678751 - DNA, 19 bp, Homo sapiens
ctgtttctctttccttggc

SEQ ID NO: 1678752 - DNA, 18 bp, Homo sapiens
ctgtttcttcctttctgt

SEQ ID NO: 1678753 - DNA, 21 bp, Homo sapiens
ctgtttgatataccaaattaa

SEQ ID NO: 1678754 - DNA, 23 bp, Homo sapiens
ctgtttgatgctatttatgcaag

SEQ ID NO: 1678755 - DNA, 12 bp, Homo sapiens
ctgtttgatgta

SEQ ID NO: 1678756 - DNA, 15 bp, Homo sapiens
ctgtttgatgtatgt

SEQ ID NO: 1678757 - DNA, 19 bp, Homo sapiens
ctgtttgatgtatgtgtga

SEQ ID NO: 1678758 - DNA, 22 bp, Homo sapiens
ctgtttgctgttgctgatttta

SEQ ID NO: 1678759 - DNA, 17 bp, Homo sapiens
ctgtttggaaaagacag

SEQ ID NO: 1678760 - DNA, 13 bp, Homo sapiens
ctgtttggcactt

SEQ ID NO: 1678761 - DNA, 14 bp, Homo sapiens
ctgtttggcacttg

SEQ ID NO: 1678762 - DNA, 15 bp, Homo sapiens
ctgtttggcacttgt

SEQ ID NO: 1678763 - DNA, 20 bp, Homo sapiens
ctgtttggcacttgtattta

SEQ ID NO: 1678764 - DNA, 22 bp, Homo sapiens
ctgtttggcctttcttggggag

SEQ ID NO: 1678765 - DNA, 21 bp, Homo sapiens
ctgtttgggaagagcttagaa

SEQ ID NO: 1678766 - DNA, 20 bp, Homo sapiens
ctgtttgggttgttggtctg

SEQ ID NO: 1678767 - DNA, 23 bp, Homo sapiens
ctgtttgggttgttggtctgtgt

SEQ ID NO: 1678768 - DNA, 18 bp, Homo sapiens
ctgtttggtttgtttata

SEQ ID NO: 1678769 - DNA, 22 bp, Homo sapiens
ctgtttgtcctgagatggaaaa

SEQ ID NO: 1678770 - DNA, 18 bp, Homo sapiens
ctgtttgtctgaacaaag

SEQ ID NO: 1678771 - DNA, 20 bp, Homo sapiens
ctgtttgttatctcttgtta

SEQ ID NO: 1678772 - DNA, 22 bp, Homo sapiens
ctgttttaaatttatttcaaaa

SEQ ID NO: 1678773 - DNA, 15 bp, Homo sapiens
ctgttttaattgtag

SEQ ID NO: 1678774 - DNA, 19 bp, Homo sapiens
ctgttttaattgtagttct

SEQ ID NO: 1678775 - DNA, 15 bp, Homo sapiens
ctgttttagtttctg

SEQ ID NO: 1678776 - DNA, 14 bp, Homo sapiens
ctgttttatactgt

SEQ ID NO: 1678777 - DNA, 16 bp, Homo sapiens
ctgttttcccacgagg

SEQ ID NO: 1678778 - DNA, 16 bp, Homo sapiens
ctgttttcccccagca

SEQ ID NO: 1678779 - DNA, 12 bp, Homo sapiens
ctgttttctgaa

SEQ ID NO: 1678780 - DNA, 17 bp, Homo sapiens
ctgttttctgagcccgg

SEQ ID NO: 1678781 - DNA, 14 bp, Homo sapiens
ctgttttctggaag

SEQ ID NO: 1678782 - DNA, 18 bp, Homo sapiens
ctgttttcttctattcca

SEQ ID NO: 1678783 - DNA, 18 bp, Homo sapiens
ctgttttgaagctgggct

SEQ ID NO: 1678784 - DNA, 12 bp, Homo sapiens
ctgttttgggcc

SEQ ID NO: 1678785 - DNA, 13 bp, Homo sapiens
ctgttttgggcct

SEQ ID NO: 1678786 - DNA, 17 bp, Homo sapiens
ctgttttgggcctccat

SEQ ID NO: 1678787 - DNA, 18 bp, Homo sapiens
ctgttttgggcctccatg

SEQ ID NO: 1678788 - DNA, 23 bp, Homo sapiens
ctgttttggggctttcccaggag

SEQ ID NO: 1678789 - DNA, 19 bp, Homo sapiens
ctgttttgtggtttggaat

SEQ ID NO: 1678790 - DNA, 22 bp, Homo sapiens
ctgttttgtgtctggtgcagaa

SEQ ID NO: 1678791 - DNA, 14 bp, Homo sapiens
ctgttttgttctgt

SEQ ID NO: 1678792 - DNA, 15 bp, Homo sapiens
ctgtttttaagctgt

SEQ ID NO: 1678793 - DNA, 19 bp, Homo sapiens
ctgtttttaagctgtttcc

SEQ ID NO: 1678794 - DNA, 12 bp, Homo sapiens
ctgtttttggac

SEQ ID NO: 1678795 - DNA, 15 bp, Homo sapiens
ctgtttttgtatctt

SEQ ID NO: 1678796 - DNA, 16 bp, Homo sapiens
ctgtttttgtatcttt

SEQ ID NO: 1678797 - DNA, 23 bp, Homo sapiens
ctgtttttttttttttaaataat

SEQ ID NO: 1678798 - DNA, 14 bp, Homo sapiens
cttaaaaaaataaa

SEQ ID NO: 1678799 - DNA, 17 bp, Homo sapiens
cttaaaaaaataaaata

SEQ ID NO: 1678800 - DNA, 18 bp, Homo sapiens
cttaaaaaaataaaatat

SEQ ID NO: 1678801 - DNA, 17 bp, Homo sapiens
cttaaaaaaatgacaga

SEQ ID NO: 1678802 - DNA, 17 bp, Homo sapiens
cttaaaaaataaaaact

SEQ ID NO: 1678803 - DNA, 13 bp, Homo sapiens
cttaaaaaatgtc

SEQ ID NO: 1678804 - DNA, 13 bp, Homo sapiens
cttaaaaatcaca

SEQ ID NO: 1678805 - DNA, 22 bp, Homo sapiens
cttaaaaatcacactgtaaata

SEQ ID NO: 1678806 - DNA, 15 bp, Homo sapiens
cttacctgtacactg

SEQ ID NO: 1678807 - DNA, 17 bp, Homo sapiens
cttacctgtacactgac

SEQ ID NO: 1678808 - DNA, 20 bp, Homo sapiens
cttacctgtatgtctccagt

SEQ ID NO: 1678809 - DNA, 20 bp, Homo sapiens
cttaccttcccgcctcggct

SEQ ID NO: 1678810 - DNA, 22 bp, Homo sapiens
cttacctttcctgatgcccctg

SEQ ID NO: 1678811 - DNA, 14 bp, Homo sapiens
cttacgacactttg

SEQ ID NO: 1678812 - DNA, 19 bp, Homo sapiens
cttacgacactttggttta

SEQ ID NO: 1678813 - DNA, 19 bp, Homo sapiens
cttactattaagcagtaaa

SEQ ID NO: 1678814 - DNA, 11 bp, Homo sapiens
cttactatttc

SEQ ID NO: 1678815 - DNA, 22 bp, Homo sapiens
cttactattttgacagttattt

SEQ ID NO: 1678816 - DNA, 18 bp, Homo sapiens
cttactctgagcccaggc

SEQ ID NO: 1678817 - DNA, 22 bp, Homo sapiens
cttactctgagcccaggccgtt

SEQ ID NO: 1678818 - DNA, 19 bp, Homo sapiens
cttactcttcttgaaattt

SEQ ID NO: 1678819 - DNA, 14 bp, Homo sapiens
cttactctttccta

SEQ ID NO: 1678820 - DNA, 23 bp, Homo sapiens
cttactggtttccccagggaagg

SEQ ID NO: 1678821 - DNA, 18 bp, Homo sapiens
cttactgtacctgttcct

SEQ ID NO: 1678822 - DNA, 12 bp, Homo sapiens
cttactgtatat

SEQ ID NO: 1678823 - DNA, 16 bp, Homo sapiens
cttactgtatatgtat

SEQ ID NO: 1678824 - DNA, 17 bp, Homo sapiens
cttactgtatatgtatt

SEQ ID NO: 1678825 - DNA, 13 bp, Homo sapiens
cttactttgcttg

SEQ ID NO: 1678826 - DNA, 20 bp, Homo sapiens
cttactttgcttgagaatcc

SEQ ID NO: 1678827 - DNA, 21 bp, Homo sapiens
cttactttgcttgagaatcct

SEQ ID NO: 1678828 - DNA, 13 bp, Homo sapiens
cttagaaaatgtg

SEQ ID NO: 1678829 - DNA, 13 bp, Homo sapiens
cttagaaatactt

SEQ ID NO: 1678830 - DNA, 20 bp, Homo sapiens
cttagaaatcattgtagaaa

SEQ ID NO: 1678831 - DNA, 17 bp, Homo sapiens
cttagaacctttctgtg

SEQ ID NO: 1678832 - DNA, 21 bp, Homo sapiens
cttagaaggtattaagattat

SEQ ID NO: 1678833 - DNA, 17 bp, Homo sapiens
cttagaagtggaccagg

SEQ ID NO: 1678834 - DNA, 18 bp, Homo sapiens
cttagaagtggaccagga

SEQ ID NO: 1678835 - DNA, 19 bp, Homo sapiens
cttagaagtgttgtaaaag

SEQ ID NO: 1678836 - DNA, 16 bp, Homo sapiens
cttagaatacagtttt

SEQ ID NO: 1678837 - DNA, 23 bp, Homo sapiens
cttagaattgctggatgcatttt

SEQ ID NO: 1678838 - DNA, 18 bp, Homo sapiens
cttagacccgccaggtca

SEQ ID NO: 1678839 - DNA, 18 bp, Homo sapiens
cttagaccttccataatg

SEQ ID NO: 1678840 - DNA, 19 bp, Homo sapiens
cttagacttcgactcagga

SEQ ID NO: 1678841 - DNA, 15 bp, Homo sapiens
cttagaggaaaaggg

SEQ ID NO: 1678842 - DNA, 17 bp, Homo sapiens
cttagagtgtagctgta

SEQ ID NO: 1678843 - DNA, 15 bp, Homo sapiens
cttagagttcttctt

SEQ ID NO: 1678844 - DNA, 13 bp, Homo sapiens
cttagatgtatat

SEQ ID NO: 1678845 - DNA, 22 bp, Homo sapiens
cttagattctctgtgtctaaga

SEQ ID NO: 1678846 - DNA, 16 bp, Homo sapiens
cttagattcttaattc

SEQ ID NO: 1678847 - DNA, 18 bp, Homo sapiens
cttagcatgtgttgaaaa

SEQ ID NO: 1678848 - DNA, 18 bp, Homo sapiens
cttagccagttcaaagtg

SEQ ID NO: 1678849 - DNA, 14 bp, Homo sapiens
cttagcccaagagg

SEQ ID NO: 1678850 - DNA, 21 bp, Homo sapiens
cttagcccaagaggtctgagc

SEQ ID NO: 1678851 - DNA, 21 bp, Homo sapiens
cttagccccttggattcctgc

SEQ ID NO: 1678852 - DNA, 23 bp, Homo sapiens
cttagccccttggattcctgcac

SEQ ID NO: 1678853 - DNA, 17 bp, Homo sapiens
cttagccgcaccctgca

SEQ ID NO: 1678854 - DNA, 17 bp, Homo sapiens
cttagccgtccatggca

SEQ ID NO: 1678855 - DNA, 14 bp, Homo sapiens
cttagcctccctga

SEQ ID NO: 1678856 - DNA, 14 bp, Homo sapiens
cttagcctctggat

SEQ ID NO: 1678857 - DNA, 11 bp, Homo sapiens
cttagccttgt

SEQ ID NO: 1678858 - DNA, 18 bp, Homo sapiens
cttagcgtcaagacattt

SEQ ID NO: 1678859 - DNA, 19 bp, Homo sapiens
cttagcgtcaagacatttg

SEQ ID NO: 1678860 - DNA, 17 bp, Homo sapiens
cttagcgttctggactc

SEQ ID NO: 1678861 - DNA, 18 bp, Homo sapiens
cttagcgttctggactct

SEQ ID NO: 1678862 - DNA, 13 bp, Homo sapiens
cttagctatattt

SEQ ID NO: 1678863 - DNA, 16 bp, Homo sapiens
cttagctatccttggc

SEQ ID NO: 1678864 - DNA, 17 bp, Homo sapiens
cttagctatccttggct

SEQ ID NO: 1678865 - DNA, 14 bp, Homo sapiens
cttagctcccctcc

SEQ ID NO: 1678866 - DNA, 17 bp, Homo sapiens
cttagctcccctccaac

SEQ ID NO: 1678867 - DNA, 22 bp, Homo sapiens
cttagctctggacgtgaaatac

SEQ ID NO: 1678868 - DNA, 14 bp, Homo sapiens
cttagctgccttga

SEQ ID NO: 1678869 - DNA, 16 bp, Homo sapiens
cttagctttctcaggg

SEQ ID NO: 1678870 - DNA, 15 bp, Homo sapiens
cttagctttgaaact

SEQ ID NO: 1678871 - DNA, 14 bp, Homo sapiens
cttagcttttaata

SEQ ID NO: 1678872 - DNA, 22 bp, Homo sapiens
cttaggaagcagtccctggaga

SEQ ID NO: 1678873 - DNA, 16 bp, Homo sapiens
cttaggatgtgtgcat

SEQ ID NO: 1678874 - DNA, 22 bp, Homo sapiens
cttaggatgtgtgcatgtgtgt

SEQ ID NO: 1678875 - DNA, 13 bp, Homo sapiens
cttcaaccctcag

SEQ ID NO: 1678876 - DNA, 16 bp, Homo sapiens
cttcaaccctcagcct

SEQ ID NO: 1678877 - DNA, 14 bp, Homo sapiens
cttcaactcctggg

SEQ ID NO: 1678878 - DNA, 15 bp, Homo sapiens
cttcaactcctgggc

SEQ ID NO: 1678879 - DNA, 16 bp, Homo sapiens
cttcaacttttctctt

SEQ ID NO: 1678880 - DNA, 22 bp, Homo sapiens
cttcaagaatcagaagaaaggc

SEQ ID NO: 1678881 - DNA, 19 bp, Homo sapiens
cttcaagacgaggggcagg

SEQ ID NO: 1678882 - DNA, 21 bp, Homo sapiens
cttcaagcagaatcctcagtt

SEQ ID NO: 1678883 - DNA, 18 bp, Homo sapiens
cttcaaggactgtttcag

SEQ ID NO: 1678884 - DNA, 12 bp, Homo sapiens
cttcaagtgcca

SEQ ID NO: 1678885 - DNA, 18 bp, Homo sapiens
cttcaagttaaagtgaat

SEQ ID NO: 1678886 - DNA, 19 bp, Homo sapiens
cttcaagttagctcaggag

SEQ ID NO: 1678887 - DNA, 14 bp, Homo sapiens
cttcaatataagaa

SEQ ID NO: 1678888 - DNA, 22 bp, Homo sapiens
cttcaatataagaagcaatctt

SEQ ID NO: 1678889 - DNA, 20 bp, Homo sapiens
cttcaatcactgtaacctga

SEQ ID NO: 1678890 - DNA, 14 bp, Homo sapiens
cttcaatctctgtt

SEQ ID NO: 1678891 - DNA, 18 bp, Homo sapiens
cttcaatgggctcttcca

SEQ ID NO: 1678892 - DNA, 15 bp, Homo sapiens
cttcaattaataaaa

SEQ ID NO: 1678893 - DNA, 22 bp, Homo sapiens
cttcaattggtggaattcctct

SEQ ID NO: 1678894 - DNA, 20 bp, Homo sapiens
cttcaatttattactgaaaa

SEQ ID NO: 1678895 - DNA, 14 bp, Homo sapiens
cttcacaaagccaa

SEQ ID NO: 1678896 - DNA, 18 bp, Homo sapiens
cttcacaaagccaagcct

SEQ ID NO: 1678897 - DNA, 23 bp, Homo sapiens
cttcacaaatgtcattgtctact

SEQ ID NO: 1678898 - DNA, 12 bp, Homo sapiens
cttcacaacaga

SEQ ID NO: 1678899 - DNA, 21 bp, Homo sapiens
cttcacaatctgtcagttcta

SEQ ID NO: 1678900 - DNA, 18 bp, Homo sapiens
cttcacactgcaagagcc

SEQ ID NO: 1678901 - DNA, 20 bp, Homo sapiens
cttcacactgcaagagcctt

SEQ ID NO: 1678902 - DNA, 20 bp, Homo sapiens
cttcacactgcgcaggtctc

SEQ ID NO: 1678903 - DNA, 16 bp, Homo sapiens
cttcacagcgtctgct

SEQ ID NO: 1678904 - DNA, 17 bp, Homo sapiens
cttcacagcgtctgctc

SEQ ID NO: 1678905 - DNA, 14 bp, Homo sapiens
cttcacaggcactc

SEQ ID NO: 1678906 - DNA, 15 bp, Homo sapiens
cttcacaggcagtgc

SEQ ID NO: 1678907 - DNA, 21 bp, Homo sapiens
cttcacaggcagtgcatgtga

SEQ ID NO: 1678908 - DNA, 17 bp, Homo sapiens
cttcacagtagagccag

SEQ ID NO: 1678909 - DNA, 19 bp, Homo sapiens
cttcacagtagagccagct

SEQ ID NO: 1678910 - DNA, 16 bp, Homo sapiens
cttcacagtgacactg

SEQ ID NO: 1678911 - DNA, 21 bp, Homo sapiens
cttcacagtgacactggacca

SEQ ID NO: 1678912 - DNA, 14 bp, Homo sapiens
cttcacagtgtttc

SEQ ID NO: 1678913 - DNA, 17 bp, Homo sapiens
cttcacataccctcccc

SEQ ID NO: 1678914 - DNA, 17 bp, Homo sapiens
cttcacatcccattggg

SEQ ID NO: 1678915 - DNA, 14 bp, Homo sapiens
cttcaccagagccc

SEQ ID NO: 1678916 - DNA, 18 bp, Homo sapiens
cttcaccagagcccatgc

SEQ ID NO: 1678917 - DNA, 14 bp, Homo sapiens
cttcaccagtctgt

SEQ ID NO: 1678918 - DNA, 19 bp, Homo sapiens
cttcaccagtctgtctact

SEQ ID NO: 1678919 - DNA, 23 bp, Homo sapiens
cttcaccagtctgtctactgtgg

SEQ ID NO: 1678920 - DNA, 24 bp, Homo sapiens
cttcacccagctaatctgtagggc

SEQ ID NO: 1678921 - DNA, 15 bp, Homo sapiens
cttcacccctgcact

SEQ ID NO: 1678922 - DNA, 16 bp, Homo sapiens
cttcaccctcatcctt

SEQ ID NO: 1678923 - DNA, 19 bp, Homo sapiens
cttcacctaagtctctgtg

SEQ ID NO: 1678924 - DNA, 11 bp, Homo sapiens
cttcacctcag

SEQ ID NO: 1678925 - DNA, 13 bp, Homo sapiens
cttcacctcttcc

SEQ ID NO: 1678926 - DNA, 22 bp, Homo sapiens
cttccaaaacctgcttccttca

SEQ ID NO: 1678927 - DNA, 13 bp, Homo sapiens
cttccaaagcaca

SEQ ID NO: 1678928 - DNA, 15 bp, Homo sapiens
cttccaacaaggaca

SEQ ID NO: 1678929 - DNA, 20 bp, Homo sapiens
cttccaacatatatttattg

SEQ ID NO: 1678930 - DNA, 12 bp, Homo sapiens
cttccaagaaaa

SEQ ID NO: 1678931 - DNA, 16 bp, Homo sapiens
cttccaagcaaaggtg

SEQ ID NO: 1678932 - DNA, 12 bp, Homo sapiens
cttccaaggaga

SEQ ID NO: 1678933 - DNA, 20 bp, Homo sapiens
cttccaaggagaccaagtcc

SEQ ID NO: 1678934 - DNA, 15 bp, Homo sapiens
cttccaaggccctgc

SEQ ID NO: 1678935 - DNA, 16 bp, Homo sapiens
cttccaattaatgctt

SEQ ID NO: 1678936 - DNA, 17 bp, Homo sapiens
cttccaattaatgcttt

SEQ ID NO: 1678937 - DNA, 16 bp, Homo sapiens
cttccaccagcctgca

SEQ ID NO: 1678938 - DNA, 21 bp, Homo sapiens
cttccaccagcctgcactact

SEQ ID NO: 1678939 - DNA, 11 bp, Homo sapiens
cttccacctgt

SEQ ID NO: 1678940 - DNA, 19 bp, Homo sapiens
cttccacctgtgccctcac

SEQ ID NO: 1678941 - DNA, 17 bp, Homo sapiens
cttccactccttctctc

SEQ ID NO: 1678942 - DNA, 14 bp, Homo sapiens
cttccacttctcca

SEQ ID NO: 1678943 - DNA, 21 bp, Homo sapiens
cttccagaagctgtactttta

SEQ ID NO: 1678944 - DNA, 15 bp, Homo sapiens
cttccagaatgctga

SEQ ID NO: 1678945 - DNA, 18 bp, Homo sapiens
cttccagatcactgccac

SEQ ID NO: 1678946 - DNA, 20 bp, Homo sapiens
cttccagatcactgccacac

SEQ ID NO: 1678947 - DNA, 18 bp, Homo sapiens
cttccagatggtcatcca

SEQ ID NO: 1678948 - DNA, 19 bp, Homo sapiens
cttccagatggtcatccag

SEQ ID NO: 1678949 - DNA, 12 bp, Homo sapiens
cttccagattgt

SEQ ID NO: 1678950 - DNA, 23 bp, Homo sapiens
cttccagattttaaattttatgt

SEQ ID NO: 1678951 - DNA, 14 bp, Homo sapiens
cttccagcaccctg

SEQ ID NO: 1678952 - DNA, 16 bp, Homo sapiens
cttccagcgtctctcc

SEQ ID NO: 1678953 - DNA, 12 bp, Homo sapiens
cttccagctgct

SEQ ID NO: 1678954 - DNA, 17 bp, Homo sapiens
cttccaggaaactccac

SEQ ID NO: 1678955 - DNA, 18 bp, Homo sapiens
cttccaggaaactccaca

SEQ ID NO: 1678956 - DNA, 22 bp, Homo sapiens
cttccaggaaactccacatctg

SEQ ID NO: 1678957 - DNA, 13 bp, Homo sapiens
cttccaggctctt

SEQ ID NO: 1678958 - DNA, 21 bp, Homo sapiens
cttccaggctcttcctggacc

SEQ ID NO: 1678959 - DNA, 22 bp, Homo sapiens
cttccaggctcttcctggacct

SEQ ID NO: 1678960 - DNA, 22 bp, Homo sapiens
cttccagggcctgagcagctgg

SEQ ID NO: 1678961 - DNA, 23 bp, Homo sapiens
cttccaggtcaggatgcacattt

SEQ ID NO: 1678962 - DNA, 13 bp, Homo sapiens
cttccaggtggcg

SEQ ID NO: 1678963 - DNA, 21 bp, Homo sapiens
cttccagtcttcctgacactt

SEQ ID NO: 1678964 - DNA, 22 bp, Homo sapiens
cttccagtggctcgctccctgt

SEQ ID NO: 1678965 - DNA, 11 bp, Homo sapiens
cttccataatg

SEQ ID NO: 1678966 - DNA, 21 bp, Homo sapiens
cttccatcagcgggtctcctc

SEQ ID NO: 1678967 - DNA, 23 bp, Homo sapiens
cttccatcatcactgtaaagaca

SEQ ID NO: 1678968 - DNA, 15 bp, Homo sapiens
cttccatccctaccc

SEQ ID NO: 1678969 - DNA, 19 bp, Homo sapiens
cttccatccctacccccta

SEQ ID NO: 1678970 - DNA, 15 bp, Homo sapiens
cttccatctcgccac

SEQ ID NO: 1678971 - DNA, 17 bp, Homo sapiens
cttccatcttcacactg

SEQ ID NO: 1678972 - DNA, 19 bp, Homo sapiens
cttccatcttgtggggcca

SEQ ID NO: 1678973 - DNA, 15 bp, Homo sapiens
cttccatgccccagg

SEQ ID NO: 1678974 - DNA, 19 bp, Homo sapiens
cttccatgccccaggatca

SEQ ID NO: 1678975 - DNA, 21 bp, Homo sapiens
cttccatgcctgtagctttcc

SEQ ID NO: 1678976 - DNA, 15 bp, Homo sapiens
cttccatgctgtgcg

SEQ ID NO: 1678977 - DNA, 14 bp, Homo sapiens
cttccatgtgcctt

SEQ ID NO: 1678978 - DNA, 22 bp, Homo sapiens
cttccatgtgcctttctttgcc

SEQ ID NO: 1678979 - DNA, 23 bp, Homo sapiens
cttccatgtgcctttctttgcct

SEQ ID NO: 1678980 - DNA, 12 bp, Homo sapiens
cttccatttata

SEQ ID NO: 1678981 - DNA, 19 bp, Homo sapiens
cttccatttgtattcaaat

SEQ ID NO: 1678982 - DNA, 14 bp, Homo sapiens
cttccattttcccc

SEQ ID NO: 1678983 - DNA, 17 bp, Homo sapiens
cttcccaacttgccttt

SEQ ID NO: 1678984 - DNA, 13 bp, Homo sapiens
cttctaagtaaaa

SEQ ID NO: 1678985 - DNA, 17 bp, Homo sapiens
cttctaagtaaaaccac

SEQ ID NO: 1678986 - DNA, 23 bp, Homo sapiens
cttctaagtaaaaccacagcagt

SEQ ID NO: 1678987 - DNA, 15 bp, Homo sapiens
cttctacctgccctc

SEQ ID NO: 1678988 - DNA, 17 bp, Homo sapiens
cttctaccttaaaatgt

SEQ ID NO: 1678989 - DNA, 15 bp, Homo sapiens
cttctactcccctta

SEQ ID NO: 1678990 - DNA, 13 bp, Homo sapiens
cttctactttcat

SEQ ID NO: 1678991 - DNA, 16 bp, Homo sapiens
cttctactttcatctt

SEQ ID NO: 1678992 - DNA, 12 bp, Homo sapiens
cttctactttta

SEQ ID NO: 1678993 - DNA, 14 bp, Homo sapiens
cttctagagttcag

SEQ ID NO: 1678994 - DNA, 18 bp, Homo sapiens
cttctagatggaccccag

SEQ ID NO: 1678995 - DNA, 19 bp, Homo sapiens
cttctagatggaccccagc

SEQ ID NO: 1678996 - DNA, 20 bp, Homo sapiens
cttctagatggaccccagca

SEQ ID NO: 1678997 - DNA, 16 bp, Homo sapiens
cttctagctgcagatg

SEQ ID NO: 1678998 - DNA, 21 bp, Homo sapiens
cttctaggcccattgtcctcc

SEQ ID NO: 1678999 - DNA, 22 bp, Homo sapiens
cttctaggcccattgtcctcct

SEQ ID NO: 1679000 - DNA, 18 bp, Homo sapiens
cttctagtgatgatggtt

SEQ ID NO: 1679001 - DNA, 16 bp, Homo sapiens
cttctagtttcccaca

SEQ ID NO: 1679002 - DNA, 19 bp, Homo sapiens
cttctataattttgccttt

SEQ ID NO: 1679003 - DNA, 18 bp, Homo sapiens
cttctatacccacccaga

SEQ ID NO: 1679004 - DNA, 19 bp, Homo sapiens
cttctatattttaatagaa

SEQ ID NO: 1679005 - DNA, 22 bp, Homo sapiens
cttctatcattccaattctaaa

SEQ ID NO: 1679006 - DNA, 16 bp, Homo sapiens
cttctattaatcaaga

SEQ ID NO: 1679007 - DNA, 23 bp, Homo sapiens
cttctattaatcaagagaaactt

SEQ ID NO: 1679008 - DNA, 13 bp, Homo sapiens
cttctattctagc

SEQ ID NO: 1679009 - DNA, 11 bp, Homo sapiens
cttctatttaa

SEQ ID NO: 1679010 - DNA, 22 bp, Homo sapiens
cttctcaaacctgtttaaatat

SEQ ID NO: 1679011 - DNA, 13 bp, Homo sapiens
cttctcagaagca

SEQ ID NO: 1679012 - DNA, 16 bp, Homo sapiens
cttctcagaagcacag

SEQ ID NO: 1679013 - DNA, 13 bp, Homo sapiens
cttctcaggcccc

SEQ ID NO: 1679014 - DNA, 16 bp, Homo sapiens
cttctcagtgtctgaa

SEQ ID NO: 1679015 - DNA, 14 bp, Homo sapiens
cttctccaaggaaa

SEQ ID NO: 1679016 - DNA, 19 bp, Homo sapiens
cttctccaattctgcccaa

SEQ ID NO: 1679017 - DNA, 13 bp, Homo sapiens
cttctccactgga

SEQ ID NO: 1679018 - DNA, 14 bp, Homo sapiens
cttctccactggat

SEQ ID NO: 1679019 - DNA, 15 bp, Homo sapiens
cttctccatgctgca

SEQ ID NO: 1679020 - DNA, 14 bp, Homo sapiens
cttctccccagcca

SEQ ID NO: 1679021 - DNA, 15 bp, Homo sapiens
cttctccccagccag

SEQ ID NO: 1679022 - DNA, 15 bp, Homo sapiens
cttctcccccacggt

SEQ ID NO: 1679023 - DNA, 20 bp, Homo sapiens
cttctcccccacggtatcct

SEQ ID NO: 1679024 - DNA, 20 bp, Homo sapiens
cttctccccgaggctgcccc

SEQ ID NO: 1679025 - DNA, 23 bp, Homo sapiens
cttctccccgaggctgccccagg

SEQ ID NO: 1679026 - DNA, 15 bp, Homo sapiens
cttctccccgcagcc

SEQ ID NO: 1679027 - DNA, 19 bp, Homo sapiens
cttctccccgcagcccgcc

SEQ ID NO: 1679028 - DNA, 22 bp, Homo sapiens
cttctcccctgcactgtaaaat

SEQ ID NO: 1679029 - DNA, 16 bp, Homo sapiens
cttctcccctgccctt

SEQ ID NO: 1679030 - DNA, 23 bp, Homo sapiens
cttctcccctgggtcctccaaag

SEQ ID NO: 1679031 - DNA, 17 bp, Homo sapiens
cttctcccttgccctcc

SEQ ID NO: 1679032 - DNA, 13 bp, Homo sapiens
cttctccgccagc

SEQ ID NO: 1679033 - DNA, 15 bp, Homo sapiens
cttctccgccagcct

SEQ ID NO: 1679034 - DNA, 18 bp, Homo sapiens
cttctcctccccacccgc

SEQ ID NO: 1679035 - DNA, 13 bp, Homo sapiens
cttctcctgtgac

SEQ ID NO: 1679036 - DNA, 17 bp, Homo sapiens
cttctcctttcacaacc

SEQ ID NO: 1679037 - DNA, 20 bp, Homo sapiens
cttctctacccatctccccc

SEQ ID NO: 1679038 - DNA, 14 bp, Homo sapiens
cttctctcagctcc

SEQ ID NO: 1679039 - DNA, 18 bp, Homo sapiens
cttctctcagctcccagg

SEQ ID NO: 1679040 - DNA, 16 bp, Homo sapiens
cttctctcatctctta

SEQ ID NO: 1679041 - DNA, 18 bp, Homo sapiens
cttctctccacagtgttg

SEQ ID NO: 1679042 - DNA, 19 bp, Homo sapiens
cttctctccacagtgttgt

SEQ ID NO: 1679043 - DNA, 13 bp, Homo sapiens
cttctctcctccc

SEQ ID NO: 1679044 - DNA, 15 bp, Homo sapiens
cttctctcctcccca

SEQ ID NO: 1679045 - DNA, 12 bp, Homo sapiens
cttctctctcca

SEQ ID NO: 1679046 - DNA, 16 bp, Homo sapiens
cttctctctccagggt

SEQ ID NO: 1679047 - DNA, 20 bp, Homo sapiens
cttctctctctctctctcgc

SEQ ID NO: 1679048 - DNA, 13 bp, Homo sapiens
cttctctcttttc

SEQ ID NO: 1679049 - DNA, 18 bp, Homo sapiens
cttctctcttttcctcct

SEQ ID NO: 1679050 - DNA, 21 bp, Homo sapiens
cttctctgacttctgcctgga

SEQ ID NO: 1679051 - DNA, 22 bp, Homo sapiens
cttctctgacttctgcctggag

SEQ ID NO: 1679052 - DNA, 12 bp, Homo sapiens
cttctctgctcc

SEQ ID NO: 1679053 - DNA, 22 bp, Homo sapiens
cttctctgctccaccacatcct

SEQ ID NO: 1679054 - DNA, 21 bp, Homo sapiens
cttctctgtgaacgatttaga

SEQ ID NO: 1679055 - DNA, 13 bp, Homo sapiens
cttctcttagatt

SEQ ID NO: 1679056 - DNA, 17 bp, Homo sapiens
cttctcttgaaaagttc

SEQ ID NO: 1679057 - DNA, 20 bp, Homo sapiens
cttctcttgaaaagttcagg

SEQ ID NO: 1679058 - DNA, 21 bp, Homo sapiens
cttctcttgaaaagttcaggg

SEQ ID NO: 1679059 - DNA, 17 bp, Homo sapiens
cttctcttgctacctgt

SEQ ID NO: 1679060 - DNA, 15 bp, Homo sapiens
cttctgaaagcagga

SEQ ID NO: 1679061 - DNA, 18 bp, Homo sapiens
cttctgaactcaaactga

SEQ ID NO: 1679062 - DNA, 15 bp, Homo sapiens
cttctgaataaagca

SEQ ID NO: 1679063 - DNA, 15 bp, Homo sapiens
cttctgactacttgt

SEQ ID NO: 1679064 - DNA, 17 bp, Homo sapiens
cttctgactgtttattt

SEQ ID NO: 1679065 - DNA, 18 bp, Homo sapiens
cttctgactgtttattta

SEQ ID NO: 1679066 - DNA, 16 bp, Homo sapiens
cttctgactttacttg

SEQ ID NO: 1679067 - DNA, 18 bp, Homo sapiens
cttctgagctatttcatc

SEQ ID NO: 1679068 - DNA, 14 bp, Homo sapiens
cttctgagctccac

SEQ ID NO: 1679069 - DNA, 16 bp, Homo sapiens
cttctgagctccacct

SEQ ID NO: 1679070 - DNA, 20 bp, Homo sapiens
cttctgagctccacctctgg

SEQ ID NO: 1679071 - DNA, 23 bp, Homo sapiens
cttctgagctccacctctggtgg

SEQ ID NO: 1679072 - DNA, 14 bp, Homo sapiens
cttctgagtattct

SEQ ID NO: 1679073 - DNA, 18 bp, Homo sapiens
cttctgatttttctcttt

SEQ ID NO: 1679074 - DNA, 22 bp, Homo sapiens
cttctgcaaaaatggatattat

SEQ ID NO: 1679075 - DNA, 16 bp, Homo sapiens
cttctgcaagcctcat

SEQ ID NO: 1679076 - DNA, 23 bp, Homo sapiens
cttctgcaagcctcatgccaacc

SEQ ID NO: 1679077 - DNA, 13 bp, Homo sapiens
cttctgcaccctc

SEQ ID NO: 1679078 - DNA, 16 bp, Homo sapiens
cttctgcaccctccac

SEQ ID NO: 1679079 - DNA, 17 bp, Homo sapiens
cttctgcaccctccacc

SEQ ID NO: 1679080 - DNA, 20 bp, Homo sapiens
cttctgcaccctccaccctg

SEQ ID NO: 1679081 - DNA, 20 bp, Homo sapiens
cttctgccctaacctgacag

SEQ ID NO: 1679082 - DNA, 22 bp, Homo sapiens
cttctgccctaacctgacagag

SEQ ID NO: 1679083 - DNA, 18 bp, Homo sapiens
cttctgccctccctggag

SEQ ID NO: 1679084 - DNA, 14 bp, Homo sapiens
cttctgcctggaga

SEQ ID NO: 1679085 - DNA, 19 bp, Homo sapiens
cttctgccttagtctcagt

SEQ ID NO: 1679086 - DNA, 13 bp, Homo sapiens
cttctgccttttc

SEQ ID NO: 1679087 - DNA, 12 bp, Homo sapiens
cttctgctccac

SEQ ID NO: 1679088 - DNA, 17 bp, Homo sapiens
cttctgctccacccttg

SEQ ID NO: 1679089 - DNA, 16 bp, Homo sapiens
cttctgctcttttcct

SEQ ID NO: 1679090 - DNA, 18 bp, Homo sapiens
cttctgctgccctgatgc

SEQ ID NO: 1679091 - DNA, 19 bp, Homo sapiens
cttctgctggataaaatga

SEQ ID NO: 1679092 - DNA, 16 bp, Homo sapiens
cttctgcttgtcatcc

SEQ ID NO: 1679093 - DNA, 14 bp, Homo sapiens
cttctgcttttctg

SEQ ID NO: 1679094 - DNA, 16 bp, Homo sapiens
cttctgcttttctgcc

SEQ ID NO: 1679095 - DNA, 19 bp, Homo sapiens
cttctgcttttctgccctg

SEQ ID NO: 1679096 - DNA, 20 bp, Homo sapiens
cttctgcttttctgccctgg

SEQ ID NO: 1679097 - DNA, 23 bp, Homo sapiens
cttctgcttttctgccctggctg

SEQ ID NO: 1679098 - DNA, 15 bp, Homo sapiens
cttctggacactgag

SEQ ID NO: 1679099 - DNA, 14 bp, Homo sapiens
cttctggagccctt

SEQ ID NO: 1679100 - DNA, 16 bp, Homo sapiens
cttctggatccatggg

SEQ ID NO: 1679101 - DNA, 17 bp, Homo sapiens
cttctggatccatgggg

SEQ ID NO: 1679102 - DNA, 21 bp, Homo sapiens
cttctggccggtgctgggttc

SEQ ID NO: 1679103 - DNA, 13 bp, Homo sapiens
cttctggccttgt

SEQ ID NO: 1679104 - DNA, 17 bp, Homo sapiens
cttctgggactggacag

SEQ ID NO: 1679105 - DNA, 16 bp, Homo sapiens
cttctgggcacagtgg

SEQ ID NO: 1679106 - DNA, 21 bp, Homo sapiens
cttctgggcgtctgagctggg

SEQ ID NO: 1679107 - DNA, 14 bp, Homo sapiens
cttctggggcaggc

SEQ ID NO: 1679108 - DNA, 20 bp, Homo sapiens
cttctggggcaggctgggcc

SEQ ID NO: 1679109 - DNA, 12 bp, Homo sapiens
cttctgggggaa

SEQ ID NO: 1679110 - DNA, 18 bp, Homo sapiens
cttctgggtagtcccctg

SEQ ID NO: 1679111 - DNA, 24 bp, Homo sapiens
cttctgggtagtcccctgttgatt

SEQ ID NO: 1679112 - DNA, 19 bp, Homo sapiens
cttctggtgctactccatg

SEQ ID NO: 1679113 - DNA, 21 bp, Homo sapiens
cttctggtgctactccatgca

SEQ ID NO: 1679114 - DNA, 19 bp, Homo sapiens
cttctggttttcgaagact

SEQ ID NO: 1679115 - DNA, 15 bp, Homo sapiens
cttctgtaattgtgt

SEQ ID NO: 1679116 - DNA, 20 bp, Homo sapiens
cttctgtatttttttttcta

SEQ ID NO: 1679117 - DNA, 15 bp, Homo sapiens
cttctgtctcctgtc

SEQ ID NO: 1679118 - DNA, 21 bp, Homo sapiens
cttctgtcttcacaacagatt

SEQ ID NO: 1679119 - DNA, 22 bp, Homo sapiens
cttctgtcttcacaacagatta

SEQ ID NO: 1679120 - DNA, 14 bp, Homo sapiens
cttctgtgatgagc

SEQ ID NO: 1679121 - DNA, 22 bp, Homo sapiens
cttctgtgcactagcctgtgat

SEQ ID NO: 1679122 - DNA, 23 bp, Homo sapiens
cttctgtgcactagcctgtgatt

SEQ ID NO: 1679123 - DNA, 14 bp, Homo sapiens
cttctgtgccaccc

SEQ ID NO: 1679124 - DNA, 22 bp, Homo sapiens
cttctgtgtatctctttcacat

SEQ ID NO: 1679125 - DNA, 12 bp, Homo sapiens
cttctgtgttca

SEQ ID NO: 1679126 - DNA, 16 bp, Homo sapiens
cttctgtgttcatttt

SEQ ID NO: 1679127 - DNA, 18 bp, Homo sapiens
cttctgtgtttctggagt

SEQ ID NO: 1679128 - DNA, 15 bp, Homo sapiens
cttcttaaaggcctg

SEQ ID NO: 1679129 - DNA, 14 bp, Homo sapiens
cttcttacatgcat

SEQ ID NO: 1679130 - DNA, 15 bp, Homo sapiens
cttcttacatgcatt

SEQ ID NO: 1679131 - DNA, 22 bp, Homo sapiens
cttcttagctatcattgcttcc

SEQ ID NO: 1679132 - DNA, 22 bp, Homo sapiens
cttcttagggattaaatataga

SEQ ID NO: 1679133 - DNA, 13 bp, Homo sapiens
cttcttattttgt

SEQ ID NO: 1679134 - DNA, 14 bp, Homo sapiens
cttcttcacccagc

SEQ ID NO: 1679135 - DNA, 16 bp, Homo sapiens
cttcttcacccagcta

SEQ ID NO: 1679136 - DNA, 17 bp, Homo sapiens
cttcttcacctcttcca

SEQ ID NO: 1679137 - DNA, 16 bp, Homo sapiens
cttcttcagagtgaag

SEQ ID NO: 1679138 - DNA, 22 bp, Homo sapiens
cttcttcccttaactccaagaa

SEQ ID NO: 1679139 - DNA, 17 bp, Homo sapiens
cttcttctaagaagaca

SEQ ID NO: 1679140 - DNA, 19 bp, Homo sapiens
cttcttctaagaagacatt

SEQ ID NO: 1679141 - DNA, 12 bp, Homo sapiens
cttcttctccat

SEQ ID NO: 1679142 - DNA, 13 bp, Homo sapiens
cttcttcttcaga

SEQ ID NO: 1679143 - DNA, 12 bp, Homo sapiens
cttcttctttcc

SEQ ID NO: 1679144 - DNA, 22 bp, Homo sapiens
cttcttgaaattttaacctatg

SEQ ID NO: 1679145 - DNA, 20 bp, Homo sapiens
cttcttgccatcactggtcc

SEQ ID NO: 1679146 - DNA, 18 bp, Homo sapiens
cttcttgcctctgtgctg

SEQ ID NO: 1679147 - DNA, 18 bp, Homo sapiens
cttcttgctatatgattt

SEQ ID NO: 1679148 - DNA, 13 bp, Homo sapiens
cttcttgcttctc

SEQ ID NO: 1679149 - DNA, 16 bp, Homo sapiens
cttcttggaccttggc

SEQ ID NO: 1679150 - DNA, 22 bp, Homo sapiens
cttcttggagctttggaatatt

SEQ ID NO: 1679151 - DNA, 18 bp, Homo sapiens
cttcttggggcccagtgc

SEQ ID NO: 1679152 - DNA, 19 bp, Homo sapiens
cttcttggggcccagtgca

SEQ ID NO: 1679153 - DNA, 17 bp, Homo sapiens
cttcttggtttggggag

SEQ ID NO: 1679154 - DNA, 19 bp, Homo sapiens
cttcttggtttggggagaa

SEQ ID NO: 1679155 - DNA, 17 bp, Homo sapiens
cttcttgtgattgctgc

SEQ ID NO: 1679156 - DNA, 16 bp, Homo sapiens
cttcttgtttccttgt

SEQ ID NO: 1679157 - DNA, 20 bp, Homo sapiens
cttctttagcatttttatgc

SEQ ID NO: 1679158 - DNA, 21 bp, Homo sapiens
cttctttagcatttttatgca

SEQ ID NO: 1679159 - DNA, 22 bp, Homo sapiens
cttctttataattctactttga

SEQ ID NO: 1679160 - DNA, 14 bp, Homo sapiens
cttctttccctgga

SEQ ID NO: 1679161 - DNA, 16 bp, Homo sapiens
cttctttccctggaca

SEQ ID NO: 1679162 - DNA, 14 bp, Homo sapiens
cttctttccttcca

SEQ ID NO: 1679163 - DNA, 16 bp, Homo sapiens
cttctttctagaaaga

SEQ ID NO: 1679164 - DNA, 16 bp, Homo sapiens
cttctttctggttgtt

SEQ ID NO: 1679165 - DNA, 22 bp, Homo sapiens
cttctttgctgctgcttcctgt

SEQ ID NO: 1679166 - DNA, 20 bp, Homo sapiens
cttctttgtgcctttggcct

SEQ ID NO: 1679167 - DNA, 21 bp, Homo sapiens
cttctttgtgcctttggcctg

SEQ ID NO: 1679168 - DNA, 22 bp, Homo sapiens
cttctttgtgcctttggcctgg

SEQ ID NO: 1679169 - DNA, 13 bp, Homo sapiens
cttcttttgatta

SEQ ID NO: 1679170 - DNA, 13 bp, Homo sapiens
cttcttttgctct

SEQ ID NO: 1679171 - DNA, 21 bp, Homo sapiens
cttcttttgtggtgtcttcca

SEQ ID NO: 1679172 - DNA, 14 bp, Homo sapiens
cttcttttttaagt

SEQ ID NO: 1679173 - DNA, 14 bp, Homo sapiens
cttgaaaaaaaaca

SEQ ID NO: 1679174 - DNA, 18 bp, Homo sapiens
cttgaaaaaaaacagtgg

SEQ ID NO: 1679175 - DNA, 20 bp, Homo sapiens
cttgaaaaaaaacagtggat

SEQ ID NO: 1679176 - DNA, 13 bp, Homo sapiens
cttgaaaaacaaa

SEQ ID NO: 1679177 - DNA, 23 bp, Homo sapiens
cttgaaaaacaaagtttctattt

SEQ ID NO: 1679178 - DNA, 15 bp, Homo sapiens
cttgaaaagaaagaa

SEQ ID NO: 1679179 - DNA, 19 bp, Homo sapiens
cttgaaaagaaagaaacca

SEQ ID NO: 1679180 - DNA, 23 bp, Homo sapiens
cttgaaaatattttttatatata

SEQ ID NO: 1679181 - DNA, 23 bp, Homo sapiens
cttgaaactttgggaaaacatgt

SEQ ID NO: 1679182 - DNA, 13 bp, Homo sapiens
cttgaaagaaatg

SEQ ID NO: 1679183 - DNA, 13 bp, Homo sapiens
cttgaaatgaaag

SEQ ID NO: 1679184 - DNA, 16 bp, Homo sapiens
cttgaaatgaaaggga

SEQ ID NO: 1679185 - DNA, 18 bp, Homo sapiens
cttgaaatgaaagggaaa

SEQ ID NO: 1679186 - DNA, 20 bp, Homo sapiens
cttgaaatgaaagggaaact

SEQ ID NO: 1679187 - DNA, 15 bp, Homo sapiens
cttgaaatgagtaaa

SEQ ID NO: 1679188 - DNA, 13 bp, Homo sapiens
cttgaaattttaa

SEQ ID NO: 1679189 - DNA, 19 bp, Homo sapiens
cttgaactctgttccccca

SEQ ID NO: 1679190 - DNA, 23 bp, Homo sapiens
cttgaagaaacagagtggcctcc

SEQ ID NO: 1679191 - DNA, 22 bp, Homo sapiens
cttgaagaactgcaggccctgg

SEQ ID NO: 1679192 - DNA, 16 bp, Homo sapiens
cttgaagactccctga

SEQ ID NO: 1679193 - DNA, 12 bp, Homo sapiens
cttgaagccaaa

SEQ ID NO: 1679194 - DNA, 14 bp, Homo sapiens
cttgaagccaaaga

SEQ ID NO: 1679195 - DNA, 16 bp, Homo sapiens
cttgaagccactgaag

SEQ ID NO: 1679196 - DNA, 19 bp, Homo sapiens
cttgaagccactgaagctg

SEQ ID NO: 1679197 - DNA, 13 bp, Homo sapiens
cttgaaggaaaaa

SEQ ID NO: 1679198 - DNA, 13 bp, Homo sapiens
cttgaaggaagag

SEQ ID NO: 1679199 - DNA, 15 bp, Homo sapiens
cttgaaggaagaggg

SEQ ID NO: 1679200 - DNA, 15 bp, Homo sapiens
cttgaaggccctgct

SEQ ID NO: 1679201 - DNA, 20 bp, Homo sapiens
cttgaagggccagagccagg

SEQ ID NO: 1679202 - DNA, 20 bp, Homo sapiens
cttgaagtcacccggccccc

SEQ ID NO: 1679203 - DNA, 20 bp, Homo sapiens
cttgaagtctaaaagcagaa

SEQ ID NO: 1679204 - DNA, 15 bp, Homo sapiens
cttgaatataaaaaa

SEQ ID NO: 1679205 - DNA, 15 bp, Homo sapiens
cttgcatccaactcc

SEQ ID NO: 1679206 - DNA, 18 bp, Homo sapiens
cttgcatccattgttgtg

SEQ ID NO: 1679207 - DNA, 12 bp, Homo sapiens
cttgcatgtggt

SEQ ID NO: 1679208 - DNA, 22 bp, Homo sapiens
cttgcattccagagttaaaatg

SEQ ID NO: 1679209 - DNA, 23 bp, Homo sapiens
cttgcattccagagttaaaatgt

SEQ ID NO: 1679210 - DNA, 20 bp, Homo sapiens
cttgccaaggcagaggcctg

SEQ ID NO: 1679211 - DNA, 21 bp, Homo sapiens
cttgccaagggtccctgtgtg

SEQ ID NO: 1679212 - DNA, 15 bp, Homo sapiens
cttgccaatggtgta

SEQ ID NO: 1679213 - DNA, 22 bp, Homo sapiens
cttgccagccagaagcctctgc

SEQ ID NO: 1679214 - DNA, 16 bp, Homo sapiens
cttgccaggctccctt

SEQ ID NO: 1679215 - DNA, 11 bp, Homo sapiens
cttgccatcac

SEQ ID NO: 1679216 - DNA, 13 bp, Homo sapiens
cttgccatcactg

SEQ ID NO: 1679217 - DNA, 21 bp, Homo sapiens
cttgccatgcaggaagaggcc

SEQ ID NO: 1679218 - DNA, 17 bp, Homo sapiens
cttgcccagactacagg

SEQ ID NO: 1679219 - DNA, 19 bp, Homo sapiens
cttgcccagactacagggc

SEQ ID NO: 1679220 - DNA, 23 bp, Homo sapiens
cttgcccagagatgcctccaccg

SEQ ID NO: 1679221 - DNA, 13 bp, Homo sapiens
cttgcccagcagc

SEQ ID NO: 1679222 - DNA, 14 bp, Homo sapiens
cttgcccagggctc

SEQ ID NO: 1679223 - DNA, 18 bp, Homo sapiens
cttgcccagggctcagcc

SEQ ID NO: 1679224 - DNA, 13 bp, Homo sapiens
cttgcccatcctg

SEQ ID NO: 1679225 - DNA, 18 bp, Homo sapiens
cttgcccatcctgactga

SEQ ID NO: 1679226 - DNA, 21 bp, Homo sapiens
cttgccccactctgcctgcct

SEQ ID NO: 1679227 - DNA, 22 bp, Homo sapiens
cttgccccactctgcctgcctg

SEQ ID NO: 1679228 - DNA, 15 bp, Homo sapiens
cttgcccccatccct

SEQ ID NO: 1679229 - DNA, 21 bp, Homo sapiens
cttgccccggccccggcccca

SEQ ID NO: 1679230 - DNA, 15 bp, Homo sapiens
cttgcccgccagcct

SEQ ID NO: 1679231 - DNA, 17 bp, Homo sapiens
cttgcccgccagcctca

SEQ ID NO: 1679232 - DNA, 18 bp, Homo sapiens
cttgcccgccagcctcag

SEQ ID NO: 1679233 - DNA, 17 bp, Homo sapiens
cttgcccgtcgtgtgct

SEQ ID NO: 1679234 - DNA, 18 bp, Homo sapiens
cttgcccgtcgtgtgctg

SEQ ID NO: 1679235 - DNA, 18 bp, Homo sapiens
cttgccctccgcctggga

SEQ ID NO: 1679236 - DNA, 21 bp, Homo sapiens
cttgccctccgcctgggatct

SEQ ID NO: 1679237 - DNA, 12 bp, Homo sapiens
cttgcccttccc

SEQ ID NO: 1679238 - DNA, 19 bp, Homo sapiens
cttgccgactggctgtgag

SEQ ID NO: 1679239 - DNA, 19 bp, Homo sapiens
cttgccgagcctaatgaaa

SEQ ID NO: 1679240 - DNA, 23 bp, Homo sapiens
cttgccgagcctaatgaaaggga

SEQ ID NO: 1679241 - DNA, 22 bp, Homo sapiens
cttgcctaaatttaatgctgcc

SEQ ID NO: 1679242 - DNA, 16 bp, Homo sapiens
cttgcctccaggtgca

SEQ ID NO: 1679243 - DNA, 12 bp, Homo sapiens
cttgcctcccca

SEQ ID NO: 1679244 - DNA, 17 bp, Homo sapiens
cttgcctctgccctgga

SEQ ID NO: 1679245 - DNA, 17 bp, Homo sapiens
cttgcctctgtcccctt

SEQ ID NO: 1679246 - DNA, 23 bp, Homo sapiens
cttgcctctgtccccttctctca

SEQ ID NO: 1679247 - DNA, 14 bp, Homo sapiens
cttgcctctgtgct

SEQ ID NO: 1679248 - DNA, 15 bp, Homo sapiens
cttgcctctgtgctg

SEQ ID NO: 1679249 - DNA, 16 bp, Homo sapiens
cttgcctcttccttga

SEQ ID NO: 1679250 - DNA, 18 bp, Homo sapiens
cttgcctcttccttgaag

SEQ ID NO: 1679251 - DNA, 20 bp, Homo sapiens
cttgcctgaacatccttcct

SEQ ID NO: 1679252 - DNA, 17 bp, Homo sapiens
cttgcctgcagggccat

SEQ ID NO: 1679253 - DNA, 10 bp, Homo sapiens
cttgcctggg

SEQ ID NO: 1679254 - DNA, 17 bp, Homo sapiens
cttgcctgttggctgct

SEQ ID NO: 1679255 - DNA, 18 bp, Homo sapiens
cttgcctgttggctgctg

SEQ ID NO: 1679256 - DNA, 19 bp, Homo sapiens
cttgcctgttggctgctgc

SEQ ID NO: 1679257 - DNA, 22 bp, Homo sapiens
cttgcctgtttcccaggcccac

SEQ ID NO: 1679258 - DNA, 17 bp, Homo sapiens
cttgccttaataaatat

SEQ ID NO: 1679259 - DNA, 19 bp, Homo sapiens
cttgccttaataaatatgt

SEQ ID NO: 1679260 - DNA, 18 bp, Homo sapiens
cttgcctttcgaggcctg

SEQ ID NO: 1679261 - DNA, 17 bp, Homo sapiens
cttgcggcaaaaggaaa

SEQ ID NO: 1679262 - DNA, 18 bp, Homo sapiens
cttgcgtcctgcagagga

SEQ ID NO: 1679263 - DNA, 24 bp, Homo sapiens
cttgcgtcctgcagaggaccacag

SEQ ID NO: 1679264 - DNA, 19 bp, Homo sapiens
cttgctaaagcactttgca

SEQ ID NO: 1679265 - DNA, 13 bp, Homo sapiens
cttgctaccagta

SEQ ID NO: 1679266 - DNA, 18 bp, Homo sapiens
cttgctaccagtatttag

SEQ ID NO: 1679267 - DNA, 14 bp, Homo sapiens
cttgctagccctgg

SEQ ID NO: 1679268 - DNA, 15 bp, Homo sapiens
cttgctccagattct

SEQ ID NO: 1679269 - DNA, 20 bp, Homo sapiens
cttgctccagggtcttgggc

SEQ ID NO: 1679270 - DNA, 22 bp, Homo sapiens
cttgctccagggtcttgggcta

SEQ ID NO: 1679271 - DNA, 12 bp, Homo sapiens
cttgctcccaac

SEQ ID NO: 1679272 - DNA, 15 bp, Homo sapiens
cttgctctcctcatc

SEQ ID NO: 1679273 - DNA, 16 bp, Homo sapiens
cttgctctcctcatct

SEQ ID NO: 1679274 - DNA, 19 bp, Homo sapiens
cttgctctgttacccaggc

SEQ ID NO: 1679275 - DNA, 19 bp, Homo sapiens
cttgctcttcagtgggaga

SEQ ID NO: 1679276 - DNA, 22 bp, Homo sapiens
cttgctgatcagagttcctcct

SEQ ID NO: 1679277 - DNA, 22 bp, Homo sapiens
cttgctgatggctgctagattt

SEQ ID NO: 1679278 - DNA, 12 bp, Homo sapiens
cttgctgctgtc

SEQ ID NO: 1679279 - DNA, 15 bp, Homo sapiens
cttgctgctttagtc

SEQ ID NO: 1679280 - DNA, 13 bp, Homo sapiens
cttgctggcccca

SEQ ID NO: 1679281 - DNA, 21 bp, Homo sapiens
cttgctggccccagccctgct

SEQ ID NO: 1679282 - DNA, 13 bp, Homo sapiens
cttgctgggccag

SEQ ID NO: 1679283 - DNA, 22 bp, Homo sapiens
cttgctggtgcctgccaccttc

SEQ ID NO: 1679284 - DNA, 13 bp, Homo sapiens
cttgctgtatgct

SEQ ID NO: 1679285 - DNA, 19 bp, Homo sapiens
cttgctgtatgctgatcat

SEQ ID NO: 1679286 - DNA, 13 bp, Homo sapiens
cttgctgtccagg

SEQ ID NO: 1679287 - DNA, 16 bp, Homo sapiens
cttgctgtccaggcag

SEQ ID NO: 1679288 - DNA, 20 bp, Homo sapiens
cttgctgtccaggcagctcc

SEQ ID NO: 1679289 - DNA, 21 bp, Homo sapiens
cttgggctactggcagctcct

SEQ ID NO: 1679290 - DNA, 21 bp, Homo sapiens
cttgggctatttggactcagg

SEQ ID NO: 1679291 - DNA, 13 bp, Homo sapiens
cttgggctcctgg

SEQ ID NO: 1679292 - DNA, 17 bp, Homo sapiens
cttgggctcctggctgc

SEQ ID NO: 1679293 - DNA, 23 bp, Homo sapiens
cttgggctcctggctgccaggcg

SEQ ID NO: 1679294 - DNA, 14 bp, Homo sapiens
cttgggctgctcct

SEQ ID NO: 1679295 - DNA, 11 bp, Homo sapiens
cttggggaggc

SEQ ID NO: 1679296 - DNA, 20 bp, Homo sapiens
cttggggagttaagacctgg

SEQ ID NO: 1679297 - DNA, 13 bp, Homo sapiens
cttggggcagggc

SEQ ID NO: 1679298 - DNA, 16 bp, Homo sapiens
cttggggcagggcctg

SEQ ID NO: 1679299 - DNA, 22 bp, Homo sapiens
cttggggcagggcctgggcctc

SEQ ID NO: 1679300 - DNA, 22 bp, Homo sapiens
cttggggccaccaaagctgccc

SEQ ID NO: 1679301 - DNA, 19 bp, Homo sapiens
cttggggcccagtgcatgg

SEQ ID NO: 1679302 - DNA, 14 bp, Homo sapiens
cttggggcttccta

SEQ ID NO: 1679303 - DNA, 16 bp, Homo sapiens
cttgggggggtggccg

SEQ ID NO: 1679304 - DNA, 22 bp, Homo sapiens
cttgggggggtggccgctgagt

SEQ ID NO: 1679305 - DNA, 23 bp, Homo sapiens
cttgggggttcaggcccggcagg

SEQ ID NO: 1679306 - DNA, 18 bp, Homo sapiens
cttggggtgtggggtggg

SEQ ID NO: 1679307 - DNA, 15 bp, Homo sapiens
cttgggtaggcggga

SEQ ID NO: 1679308 - DNA, 16 bp, Homo sapiens
cttgggtccaccatgc

SEQ ID NO: 1679309 - DNA, 21 bp, Homo sapiens
cttgggtgtaacaggtctcct

SEQ ID NO: 1679310 - DNA, 18 bp, Homo sapiens
cttgggtgtattctctgt

SEQ ID NO: 1679311 - DNA, 23 bp, Homo sapiens
cttgggtgtattctctgtaagtg

SEQ ID NO: 1679312 - DNA, 23 bp, Homo sapiens
cttgggttcaagtgattctcctg

SEQ ID NO: 1679313 - DNA, 16 bp, Homo sapiens
cttggtagttctgtgc

SEQ ID NO: 1679314 - DNA, 20 bp, Homo sapiens
cttggtagttctgtgcctcc

SEQ ID NO: 1679315 - DNA, 15 bp, Homo sapiens
cttggtcagagccac

SEQ ID NO: 1679316 - DNA, 23 bp, Homo sapiens
cttggtccctatgggcttccgca

SEQ ID NO: 1679317 - DNA, 13 bp, Homo sapiens
cttggtccctggt

SEQ ID NO: 1679318 - DNA, 17 bp, Homo sapiens
cttggtccctggtccct

SEQ ID NO: 1679319 - DNA, 20 bp, Homo sapiens
cttggtctgatttcaggata

SEQ ID NO: 1679320 - DNA, 15 bp, Homo sapiens
cttggtcttatttat

SEQ ID NO: 1679321 - DNA, 15 bp, Homo sapiens
cttggtcttccatgg

SEQ ID NO: 1679322 - DNA, 18 bp, Homo sapiens
cttggtctttctgtgctt

SEQ ID NO: 1679323 - DNA, 16 bp, Homo sapiens
cttggtgctgtgtgcc

SEQ ID NO: 1679324 - DNA, 19 bp, Homo sapiens
cttggtgctgtgtgcccca

SEQ ID NO: 1679325 - DNA, 15 bp, Homo sapiens
cttggtggagcagcc

SEQ ID NO: 1679326 - DNA, 16 bp, Homo sapiens
cttggtggagcagcca

SEQ ID NO: 1679327 - DNA, 19 bp, Homo sapiens
cttggtggctcacgcctgt

SEQ ID NO: 1679328 - DNA, 16 bp, Homo sapiens
cttggtggcttatggg

SEQ ID NO: 1679329 - DNA, 18 bp, Homo sapiens
cttggtgggtgtggccag

SEQ ID NO: 1679330 - DNA, 16 bp, Homo sapiens
cttggtgtaatttgaa

SEQ ID NO: 1679331 - DNA, 15 bp, Homo sapiens
cttggtgtcttggca

SEQ ID NO: 1679332 - DNA, 13 bp, Homo sapiens
cttggttccagga

SEQ ID NO: 1679333 - DNA, 12 bp, Homo sapiens
cttggttctaaa

SEQ ID NO: 1679334 - DNA, 15 bp, Homo sapiens
cttggttgtctggca

SEQ ID NO: 1679335 - DNA, 17 bp, Homo sapiens
cttggtttggggagaaa

SEQ ID NO: 1679336 - DNA, 21 bp, Homo sapiens
cttggtttggtcatgcccgtc

SEQ ID NO: 1679337 - DNA, 22 bp, Homo sapiens
cttggtttttactgctctgaga

SEQ ID NO: 1679338 - DNA, 16 bp, Homo sapiens
cttggtttttggctct

SEQ ID NO: 1679339 - DNA, 14 bp, Homo sapiens
cttgtaaaaaaagc

SEQ ID NO: 1679340 - DNA, 12 bp, Homo sapiens
cttgtaaataca

SEQ ID NO: 1679341 - DNA, 13 bp, Homo sapiens
cttgtaaatacac

SEQ ID NO: 1679342 - DNA, 15 bp, Homo sapiens
cttgtaaatgtttct

SEQ ID NO: 1679343 - DNA, 19 bp, Homo sapiens
cttgtaaatgtttcttttc

SEQ ID NO: 1679344 - DNA, 17 bp, Homo sapiens
cttgtaacaagaaaaca

SEQ ID NO: 1679345 - DNA, 14 bp, Homo sapiens
cttgtaactccacc

SEQ ID NO: 1679346 - DNA, 15 bp, Homo sapiens
cttgtaactccacca

SEQ ID NO: 1679347 - DNA, 17 bp, Homo sapiens
cttgtaagatggataat

SEQ ID NO: 1679348 - DNA, 15 bp, Homo sapiens
cttgtaattctaaat

SEQ ID NO: 1679349 - DNA, 23 bp, Homo sapiens
cttgtaattctaaatgaatgttt

SEQ ID NO: 1679350 - DNA, 18 bp, Homo sapiens
cttgtaattgtggattaa

SEQ ID NO: 1679351 - DNA, 12 bp, Homo sapiens
cttgtaatttaa

SEQ ID NO: 1679352 - DNA, 21 bp, Homo sapiens
cttgtaatttaaacaggccca

SEQ ID NO: 1679353 - DNA, 12 bp, Homo sapiens
cttgtacaaaat

SEQ ID NO: 1679354 - DNA, 14 bp, Homo sapiens
cttgtacatgtgta

SEQ ID NO: 1679355 - DNA, 16 bp, Homo sapiens
cttgtactatgttaat

SEQ ID NO: 1679356 - DNA, 17 bp, Homo sapiens
cttgtacttctgtgttc

SEQ ID NO: 1679357 - DNA, 18 bp, Homo sapiens
cttgtagaactcactctg

SEQ ID NO: 1679358 - DNA, 19 bp, Homo sapiens
cttgtagaactcactctgg

SEQ ID NO: 1679359 - DNA, 16 bp, Homo sapiens
cttgtagccatggctg

SEQ ID NO: 1679360 - DNA, 21 bp, Homo sapiens
cttgtataaaatccaaaatga

SEQ ID NO: 1679361 - DNA, 13 bp, Homo sapiens
cttgtatattcca

SEQ ID NO: 1679362 - DNA, 11 bp, Homo sapiens
cttgtatattt

SEQ ID NO: 1679363 - DNA, 12 bp, Homo sapiens
cttgtatatttg

SEQ ID NO: 1679364 - DNA, 16 bp, Homo sapiens
cttgtatatttgtaca

SEQ ID NO: 1679365 - DNA, 17 bp, Homo sapiens
cttgtatatttgtacaa

SEQ ID NO: 1679366 - DNA, 14 bp, Homo sapiens
cttgtatgctgccc

SEQ ID NO: 1679367 - DNA, 20 bp, Homo sapiens
cttgtattctctttaccttc

SEQ ID NO: 1679368 - DNA, 12 bp, Homo sapiens
cttgtatttaat

SEQ ID NO: 1679369 - DNA, 17 bp, Homo sapiens
cttgtattttgttaaag

SEQ ID NO: 1679370 - DNA, 19 bp, Homo sapiens
cttgtattttgttaaagct

SEQ ID NO: 1679371 - DNA, 20 bp, Homo sapiens
cttgtattttgttaaagctg

SEQ ID NO: 1679372 - DNA, 14 bp, Homo sapiens
cttgtcacaataaa

SEQ ID NO: 1679373 - DNA, 17 bp, Homo sapiens
cttgtcacaataaatgt

SEQ ID NO: 1679374 - DNA, 21 bp, Homo sapiens
cttgtcatccacacaacacca

SEQ ID NO: 1679375 - DNA, 16 bp, Homo sapiens
cttgtcatgtgtataa

SEQ ID NO: 1679376 - DNA, 17 bp, Homo sapiens
cttgtcatgtgtataaa

SEQ ID NO: 1679377 - DNA, 18 bp, Homo sapiens
cttgtcatgtgtataaaa

SEQ ID NO: 1679378 - DNA, 14 bp, Homo sapiens
cttgtcattccaga

SEQ ID NO: 1679379 - DNA, 14 bp, Homo sapiens
cttgtccctctcac

SEQ ID NO: 1679380 - DNA, 21 bp, Homo sapiens
cttgtccctttccctaccttt

SEQ ID NO: 1679381 - DNA, 16 bp, Homo sapiens
cttgtcctgccagctg

SEQ ID NO: 1679382 - DNA, 13 bp, Homo sapiens
cttgtcctggccc

SEQ ID NO: 1679383 - DNA, 18 bp, Homo sapiens
cttgtcctggcccttcag

SEQ ID NO: 1679384 - DNA, 20 bp, Homo sapiens
cttgtctccactaaatgagc

SEQ ID NO: 1679385 - DNA, 13 bp, Homo sapiens
cttgtctgaggcc

SEQ ID NO: 1679386 - DNA, 17 bp, Homo sapiens
cttgtcttcctatttca

SEQ ID NO: 1679387 - DNA, 19 bp, Homo sapiens
cttgtcttcctatttcaga

SEQ ID NO: 1679388 - DNA, 13 bp, Homo sapiens
cttaaatttctta

SEQ ID NO: 1679389 - DNA, 23 bp, Homo sapiens
cttaaatttcttggcaaatttta

SEQ ID NO: 1679390 - DNA, 13 bp, Homo sapiens
cttaaattttaac

SEQ ID NO: 1679391 - DNA, 23 bp, Homo sapiens
cttaaattttaactaaattttaa

SEQ ID NO: 1679392 - DNA, 17 bp, Homo sapiens
cttaaattttaatttat

SEQ ID NO: 1679393 - DNA, 16 bp, Homo sapiens
cttaaattttcttcct

SEQ ID NO: 1679394 - DNA, 19 bp, Homo sapiens
cttaacaaaccaacatctt

SEQ ID NO: 1679395 - DNA, 13 bp, Homo sapiens
cttaacatgggct

SEQ ID NO: 1679396 - DNA, 17 bp, Homo sapiens
cttaacatttctctcca

SEQ ID NO: 1679397 - DNA, 14 bp, Homo sapiens
cttaacccacctct

SEQ ID NO: 1679398 - DNA, 22 bp, Homo sapiens
cttaacccacctctcctgccct

SEQ ID NO: 1679399 - DNA, 11 bp, Homo sapiens
cttaacctttg

SEQ ID NO: 1679400 - DNA, 16 bp, Homo sapiens
cttaacgaataaaggt

SEQ ID NO: 1679401 - DNA, 16 bp, Homo sapiens
cttaacggaccaaagc

SEQ ID NO: 1679402 - DNA, 17 bp, Homo sapiens
cttaacggaccaaagca

SEQ ID NO: 1679403 - DNA, 20 bp, Homo sapiens
cttaacggaccaaagcaaga

SEQ ID NO: 1679404 - DNA, 15 bp, Homo sapiens
cttaacggctccagg

SEQ ID NO: 1679405 - DNA, 18 bp, Homo sapiens
cttaactataaggtgcct

SEQ ID NO: 1679406 - DNA, 12 bp, Homo sapiens
cttaactatgag

SEQ ID NO: 1679407 - DNA, 23 bp, Homo sapiens
cttaactattaaggccttttcca

SEQ ID NO: 1679408 - DNA, 17 bp, Homo sapiens
cttaactcatctgttat

SEQ ID NO: 1679409 - DNA, 13 bp, Homo sapiens
cttaactccaaga

SEQ ID NO: 1679410 - DNA, 16 bp, Homo sapiens
cttaactggagcccca

SEQ ID NO: 1679411 - DNA, 15 bp, Homo sapiens
cttaacttcttgctt

SEQ ID NO: 1679412 - DNA, 21 bp, Homo sapiens
cttaacttcttgcttctttct

SEQ ID NO: 1679413 - DNA, 22 bp, Homo sapiens
cttaacttcttgcttctttcta

SEQ ID NO: 1679414 - DNA, 13 bp, Homo sapiens
cttaactttaact

SEQ ID NO: 1679415 - DNA, 15 bp, Homo sapiens
cttaactttcccatg

SEQ ID NO: 1679416 - DNA, 17 bp, Homo sapiens
cttaagaacacaaagcg

SEQ ID NO: 1679417 - DNA, 14 bp, Homo sapiens
cttaagacaaatgg

SEQ ID NO: 1679418 - DNA, 18 bp, Homo sapiens
cttaagacaaatgggact

SEQ ID NO: 1679419 - DNA, 23 bp, Homo sapiens
cttaagacctactgttctaaagc

SEQ ID NO: 1679420 - DNA, 17 bp, Homo sapiens
cttaagacggaagtaaa

SEQ ID NO: 1679421 - DNA, 21 bp, Homo sapiens
cttaagatctgactgccaaat

SEQ ID NO: 1679422 - DNA, 18 bp, Homo sapiens
cttaagattctttgtgat

SEQ ID NO: 1679423 - DNA, 14 bp, Homo sapiens
cttaagcaaaagaa

SEQ ID NO: 1679424 - DNA, 15 bp, Homo sapiens
cttaagcaaaagaaa

SEQ ID NO: 1679425 - DNA, 18 bp, Homo sapiens
cttaagcagaacaaatgt

SEQ ID NO: 1679426 - DNA, 15 bp, Homo sapiens
cttaagcagcatgga

SEQ ID NO: 1679427 - DNA, 21 bp, Homo sapiens
cttaagcagcatggaaaaatg

SEQ ID NO: 1679428 - DNA, 15 bp, Homo sapiens
cttaagcatctggct

SEQ ID NO: 1679429 - DNA, 22 bp, Homo sapiens
cttaagccaaactcaggcccag

SEQ ID NO: 1679430 - DNA, 19 bp, Homo sapiens
cttaagccctttgctctgg

SEQ ID NO: 1679431 - DNA, 23 bp, Homo sapiens
cttaagcgaagtctttgccttct

SEQ ID NO: 1679432 - DNA, 11 bp, Homo sapiens
cttaagctgat

SEQ ID NO: 1679433 - DNA, 18 bp, Homo sapiens
cttaagggaagctactga

SEQ ID NO: 1679434 - DNA, 19 bp, Homo sapiens
cttaagggttgaaggcagt

SEQ ID NO: 1679435 - DNA, 23 bp, Homo sapiens
cttaagggttgaaggcagtctga

SEQ ID NO: 1679436 - DNA, 16 bp, Homo sapiens
cttaagtctcgaatgt

SEQ ID NO: 1679437 - DNA, 14 bp, Homo sapiens
cttaagtgagcaga

SEQ ID NO: 1679438 - DNA, 16 bp, Homo sapiens
cttaagtgagcagaac

SEQ ID NO: 1679439 - DNA, 22 bp, Homo sapiens
cttaagtgagcagaacaggtag

SEQ ID NO: 1679440 - DNA, 13 bp, Homo sapiens
cttaagtgtctgg

SEQ ID NO: 1679441 - DNA, 11 bp, Homo sapiens
cttaagtgttt

SEQ ID NO: 1679442 - DNA, 13 bp, Homo sapiens
cttaagtgtttct

SEQ ID NO: 1679443 - DNA, 14 bp, Homo sapiens
cttaagtgtttctc

SEQ ID NO: 1679444 - DNA, 16 bp, Homo sapiens
cttaagttttttatgc

SEQ ID NO: 1679445 - DNA, 18 bp, Homo sapiens
cttaataaaataaactag

SEQ ID NO: 1679446 - DNA, 13 bp, Homo sapiens
cttaataaatatg

SEQ ID NO: 1679447 - DNA, 18 bp, Homo sapiens
cttaataaatatgtaata

SEQ ID NO: 1679448 - DNA, 12 bp, Homo sapiens
cttaataaattc

SEQ ID NO: 1679449 - DNA, 15 bp, Homo sapiens
cttaatagctgtagt

SEQ ID NO: 1679450 - DNA, 21 bp, Homo sapiens
cttaatcaagatttttttcct

SEQ ID NO: 1679451 - DNA, 22 bp, Homo sapiens
cttaatcaagatttttttcctg

SEQ ID NO: 1679452 - DNA, 14 bp, Homo sapiens
cttaatcattttca

SEQ ID NO: 1679453 - DNA, 22 bp, Homo sapiens
cttaatcattttttatatatat

SEQ ID NO: 1679454 - DNA, 17 bp, Homo sapiens
cttaatccattaaaaag

SEQ ID NO: 1679455 - DNA, 13 bp, Homo sapiens
cttaatcttgctt

SEQ ID NO: 1679456 - DNA, 18 bp, Homo sapiens
cttaatcttgctttcttt

SEQ ID NO: 1679457 - DNA, 21 bp, Homo sapiens
cttaatgaatgagtctgttgt

SEQ ID NO: 1679458 - DNA, 12 bp, Homo sapiens
cttaatgagata

SEQ ID NO: 1679459 - DNA, 14 bp, Homo sapiens
cttaatgagatagt

SEQ ID NO: 1679460 - DNA, 18 bp, Homo sapiens
cttaatgagatatttgta

SEQ ID NO: 1679461 - DNA, 21 bp, Homo sapiens
cttaatgatccgttccattgc

SEQ ID NO: 1679462 - DNA, 16 bp, Homo sapiens
cttttcactgctggct

SEQ ID NO: 1679463 - DNA, 19 bp, Homo sapiens
cttttcagaagtgagcttt

SEQ ID NO: 1679464 - DNA, 15 bp, Homo sapiens
cttttcagcttgttt

SEQ ID NO: 1679465 - DNA, 19 bp, Homo sapiens
cttttcagcttgtttctat

SEQ ID NO: 1679466 - DNA, 16 bp, Homo sapiens
cttttcaggaagctct

SEQ ID NO: 1679467 - DNA, 16 bp, Homo sapiens
cttttcatccttcccc

SEQ ID NO: 1679468 - DNA, 18 bp, Homo sapiens
cttttcattagcagttgc

SEQ ID NO: 1679469 - DNA, 16 bp, Homo sapiens
cttttccaaataaaca

SEQ ID NO: 1679470 - DNA, 19 bp, Homo sapiens
cttttccaatatgtgattt

SEQ ID NO: 1679471 - DNA, 11 bp, Homo sapiens
cttttccaatg

SEQ ID NO: 1679472 - DNA, 17 bp, Homo sapiens
cttttccacaaggaatc

SEQ ID NO: 1679473 - DNA, 18 bp, Homo sapiens
cttttccactcctatgga

SEQ ID NO: 1679474 - DNA, 16 bp, Homo sapiens
cttttccaggatcctg

SEQ ID NO: 1679475 - DNA, 21 bp, Homo sapiens
cttttccattgaccagctctc

SEQ ID NO: 1679476 - DNA, 18 bp, Homo sapiens
cttttcccactgtttaag

SEQ ID NO: 1679477 - DNA, 17 bp, Homo sapiens
cttttcccaggaatatc

SEQ ID NO: 1679478 - DNA, 20 bp, Homo sapiens
cttttcccaggaatatccca

SEQ ID NO: 1679479 - DNA, 17 bp, Homo sapiens
cttttcccatttgtaat

SEQ ID NO: 1679480 - DNA, 23 bp, Homo sapiens
cttttcccccttcccatttcttc

SEQ ID NO: 1679481 - DNA, 18 bp, Homo sapiens
cttttcccctttcctgtc

SEQ ID NO: 1679482 - DNA, 20 bp, Homo sapiens
cttttccctgcttccaggaa

SEQ ID NO: 1679483 - DNA, 17 bp, Homo sapiens
cttttcccttgctgtac

SEQ ID NO: 1679484 - DNA, 19 bp, Homo sapiens
cttttccctttgtgagtca

SEQ ID NO: 1679485 - DNA, 14 bp, Homo sapiens
cttttcctcaagca

SEQ ID NO: 1679486 - DNA, 22 bp, Homo sapiens
cttttcctgataaagcacagct

SEQ ID NO: 1679487 - DNA, 18 bp, Homo sapiens
cttttcctgttaaggcag

SEQ ID NO: 1679488 - DNA, 16 bp, Homo sapiens
cttttcctttcttcta

SEQ ID NO: 1679489 - DNA, 17 bp, Homo sapiens
cttttcgccccctgcct

SEQ ID NO: 1679490 - DNA, 22 bp, Homo sapiens
cttttctaaatgttattacttg

SEQ ID NO: 1679491 - DNA, 19 bp, Homo sapiens
cttttctaagaaaagcatt

SEQ ID NO: 1679492 - DNA, 13 bp, Homo sapiens
cttttctattttg

SEQ ID NO: 1679493 - DNA, 15 bp, Homo sapiens
cttttctcacaaaaa

SEQ ID NO: 1679494 - DNA, 18 bp, Homo sapiens
cttttctcctttaccagt

SEQ ID NO: 1679495 - DNA, 21 bp, Homo sapiens
cttttctctttgggtttcttg

SEQ ID NO: 1679496 - DNA, 13 bp, Homo sapiens
cttttctcttttc

SEQ ID NO: 1679497 - DNA, 20 bp, Homo sapiens
cttttctcttttctttctgt

SEQ ID NO: 1679498 - DNA, 15 bp, Homo sapiens
cttttctgcagaggg

SEQ ID NO: 1679499 - DNA, 23 bp, Homo sapiens
cttttctgcatcatctgtagata

SEQ ID NO: 1679500 - DNA, 16 bp, Homo sapiens
cttttctgccactcca

SEQ ID NO: 1679501 - DNA, 17 bp, Homo sapiens
cttttctgccactccat

SEQ ID NO: 1679502 - DNA, 11 bp, Homo sapiens
cttttctgctg

SEQ ID NO: 1679503 - DNA, 14 bp, Homo sapiens
cttttctgtaattc

SEQ ID NO: 1679504 - DNA, 15 bp, Homo sapiens
cttttctgtaattca

SEQ ID NO: 1679505 - DNA, 16 bp, Homo sapiens
cttttctgtaattcag

SEQ ID NO: 1679506 - DNA, 14 bp, Homo sapiens
cttttctgtcacca

SEQ ID NO: 1679507 - DNA, 15 bp, Homo sapiens
cttttctgtcaccaa

SEQ ID NO: 1679508 - DNA, 18 bp, Homo sapiens
cttttctgtcaccaaatt

SEQ ID NO: 1679509 - DNA, 14 bp, Homo sapiens
cttttctgtcctgg

SEQ ID NO: 1679510 - DNA, 16 bp, Homo sapiens
cttttctgtcctgggc

SEQ ID NO: 1679511 - DNA, 14 bp, Homo sapiens
cttttctgttgtac

SEQ ID NO: 1679512 - DNA, 16 bp, Homo sapiens
cttttcttaaaccttc

SEQ ID NO: 1679513 - DNA, 17 bp, Homo sapiens
cttttcttatttttgta

SEQ ID NO: 1679514 - DNA, 20 bp, Homo sapiens
cttttcttggaactgtccca

SEQ ID NO: 1679515 - DNA, 21 bp, Homo sapiens
cttttcttggaactgtcccag

SEQ ID NO: 1679516 - DNA, 15 bp, Homo sapiens
cttttctttaacttt

SEQ ID NO: 1679517 - DNA, 17 bp, Homo sapiens
cttttcttttctaccct

SEQ ID NO: 1679518 - DNA, 19 bp, Homo sapiens
cttttgaaaaaaaagtttt

SEQ ID NO: 1679519 - DNA, 23 bp, Homo sapiens
cttttgaaaaaaaagtttttaat

SEQ ID NO: 1679520 - DNA, 17 bp, Homo sapiens
cttttgaaaagaccaag

SEQ ID NO: 1679521 - DNA, 18 bp, Homo sapiens
cttttgaaaagttgaaat

SEQ ID NO: 1679522 - DNA, 22 bp, Homo sapiens
cttttgaaaagttgaaatgtgt

SEQ ID NO: 1679523 - DNA, 13 bp, Homo sapiens
cttttgaaccttg

SEQ ID NO: 1679524 - DNA, 20 bp, Homo sapiens
cttttgaatacatttgtatt

SEQ ID NO: 1679525 - DNA, 21 bp, Homo sapiens
cttttgaatccatgcttgggt

SEQ ID NO: 1679526 - DNA, 17 bp, Homo sapiens
cttttgaattcttgata

SEQ ID NO: 1679527 - DNA, 17 bp, Homo sapiens
cttttgacactgctcta

SEQ ID NO: 1679528 - DNA, 19 bp, Homo sapiens
cttttgaggagctggaggg

SEQ ID NO: 1679529 - DNA, 21 bp, Homo sapiens
cttttgaggagctggaggggt

SEQ ID NO: 1679530 - DNA, 16 bp, Homo sapiens
cttttgaggcttctcc

SEQ ID NO: 1679531 - DNA, 15 bp, Homo sapiens
cttttgagtgtgtgt

SEQ ID NO: 1679532 - DNA, 14 bp, Homo sapiens
cttttgatagttct

SEQ ID NO: 1679533 - DNA, 14 bp, Homo sapiens
cttttgatggggag

SEQ ID NO: 1679534 - DNA, 16 bp, Homo sapiens
cttttgatggggagaa

SEQ ID NO: 1679535 - DNA, 19 bp, Homo sapiens
cttttgatggggagaaagg

SEQ ID NO: 1679536 - DNA, 21 bp, Homo sapiens
cttttgatttataaaactttg

SEQ ID NO: 1679537 - DNA, 15 bp, Homo sapiens
cttttgcaaccagga

SEQ ID NO: 1679538 - DNA, 24 bp, Homo sapiens
cttttgcaaccaggaacagcaaat

SEQ ID NO: 1679539 - DNA, 16 bp, Homo sapiens
cttttgcacccctccc

SEQ ID NO: 1679540 - DNA, 19 bp, Homo sapiens
cttttgccactttggcttc

SEQ ID NO: 1679541 - DNA, 20 bp, Homo sapiens
cttttgccactttggcttct

SEQ ID NO: 1679542 - DNA, 17 bp, Homo sapiens
cttttgccattaaactt

SEQ ID NO: 1679543 - DNA, 16 bp, Homo sapiens
cttttgcccacacact

SEQ ID NO: 1679544 - DNA, 18 bp, Homo sapiens
cttttgcccgttgaggta

SEQ ID NO: 1679545 - DNA, 13 bp, Homo sapiens
cttttgcctggct

SEQ ID NO: 1679546 - DNA, 14 bp, Homo sapiens
cttttgcctggctg

SEQ ID NO: 1679547 - DNA, 22 bp, Homo sapiens
cttttgctcttagctgtctgct

SEQ ID NO: 1679548 - DNA, 13 bp, Homo sapiens
cttttgctgtgca

SEQ ID NO: 1679549 - DNA, 16 bp, Homo sapiens
cttttgctttccctga

SEQ ID NO: 1679550 - DNA, 24 bp, Homo sapiens
cttttgctttctgtttcttaaggg

SEQ ID NO: 1679551 - DNA, 11 bp, Homo sapiens
cttttgctttt

SEQ ID NO: 1679552 - DNA, 17 bp, Homo sapiens
cttttgcttttggcaaa

SEQ ID NO: 1679553 - DNA, 19 bp, Homo sapiens
cttttggaagttttgctag

SEQ ID NO: 1679554 - DNA, 15 bp, Homo sapiens
cttttggcactgaga

SEQ ID NO: 1679555 - DNA, 14 bp, Homo sapiens
cttttggcttccat

SEQ ID NO: 1679556 - DNA, 15 bp, Homo sapiens
cttttggcttccatg

SEQ ID NO: 1679557 - DNA, 18 bp, Homo sapiens
cttttgggctcaaagccc

SEQ ID NO: 1679558 - DNA, 17 bp, Homo sapiens
cttttggttaatatgtc

SEQ ID NO: 1679559 - DNA, 10 bp, Homo sapiens
cttttgtaag

SEQ ID NO: 1679560 - DNA, 20 bp, Homo sapiens
cttttgtaattgtgtaaaaa

SEQ ID NO: 1679561 - DNA, 17 bp, Homo sapiens
cttttgtacccaatact

SEQ ID NO: 1679562 - DNA, 17 bp, Homo sapiens
cttttgtactgaatttt

SEQ ID NO: 1679563 - DNA, 23 bp, Homo sapiens
cttttgtagatggcgatgtgtta

SEQ ID NO: 1679564 - DNA, 23 bp, Homo sapiens
cttttgtgatgaacatattcatg

SEQ ID NO: 1679565 - DNA, 15 bp, Homo sapiens
cttttgtggtgtctt

SEQ ID NO: 1679566 - DNA, 19 bp, Homo sapiens
cttttgtgtaataagaaag

SEQ ID NO: 1679567 - DNA, 19 bp, Homo sapiens
cttttgtgtgaattgacta

SEQ ID NO: 1679568 - DNA, 18 bp, Homo sapiens
cttttgttaaaagttatt

SEQ ID NO: 1679569 - DNA, 21 bp, Homo sapiens
cttttgttagggctgcttttc

SEQ ID NO: 1679570 - DNA, 22 bp, Homo sapiens
cttttgttcagggctgtgatcg

SEQ ID NO: 1679571 - DNA, 13 bp, Homo sapiens
cttttgttctaga

SEQ ID NO: 1679572 - DNA, 16 bp, Homo sapiens
cttttgtttccttttt

SEQ ID NO: 1679573 - DNA, 14 bp, Homo sapiens
cttttgtttcttaa

SEQ ID NO: 1679574 - DNA, 23 bp, Homo sapiens
gaaaaataatcaagattttaggg

SEQ ID NO: 1679575 - DNA, 12 bp, Homo sapiens
gaaaaatagtaa

SEQ ID NO: 1679576 - DNA, 15 bp, Homo sapiens
gaaaaatagtaaaca

SEQ ID NO: 1679577 - DNA, 21 bp, Homo sapiens
gaaaaatatgttgagtgttca

SEQ ID NO: 1679578 - DNA, 15 bp, Homo sapiens
gaaaaatatttaatg

SEQ ID NO: 1679579 - DNA, 19 bp, Homo sapiens
gaaaaatcacatcctggcc

SEQ ID NO: 1679580 - DNA, 17 bp, Homo sapiens
gaaaaatccagaaagaa

SEQ ID NO: 1679581 - DNA, 14 bp, Homo sapiens
gaaaaatcttgtgc

SEQ ID NO: 1679582 - DNA, 22 bp, Homo sapiens
gaaaaatcttgtgctagaatac

SEQ ID NO: 1679583 - DNA, 19 bp, Homo sapiens
gaaaaatgaggaatccaaa

SEQ ID NO: 1679584 - DNA, 11 bp, Homo sapiens
gaaaaatggag

SEQ ID NO: 1679585 - DNA, 17 bp, Homo sapiens
gaaaatggctaataaac

SEQ ID NO: 1679586 - DNA, 22 bp, Homo sapiens
gaaaatggctaataaactgtat

SEQ ID NO: 1679587 - DNA, 23 bp, Homo sapiens
gaaaatggctaataaactgtatt

SEQ ID NO: 1679588 - DNA, 23 bp, Homo sapiens
gaaaatggtccaattagtttcct

SEQ ID NO: 1679589 - DNA, 22 bp, Homo sapiens
gaaaatggtcgagaaagaggca

SEQ ID NO: 1679590 - DNA, 15 bp, Homo sapiens
gaaaatgtatgtgta

SEQ ID NO: 1679591 - DNA, 15 bp, Homo sapiens
gaaaatgtccaggaa

SEQ ID NO: 1679592 - DNA, 16 bp, Homo sapiens
gaaaatgtgaagctga

SEQ ID NO: 1679593 - DNA, 22 bp, Homo sapiens
gaaaatgttacggcatcacact

SEQ ID NO: 1679594 - DNA, 22 bp, Homo sapiens
gaaaattacagtccaaaatact

SEQ ID NO: 1679595 - DNA, 14 bp, Homo sapiens
gaaaattatgcaaa

SEQ ID NO: 1679596 - DNA, 23 bp, Homo sapiens
gaaaattattttgttcatacata

SEQ ID NO: 1679597 - DNA, 18 bp, Homo sapiens
gaaaattccagaaaggat

SEQ ID NO: 1679598 - DNA, 20 bp, Homo sapiens
gaaaattccagaaaggatat

SEQ ID NO: 1679599 - DNA, 10 bp, Homo sapiens
gaaagagacc

SEQ ID NO: 1679600 - DNA, 14 bp, Homo sapiens
gaaagagagaagcc

SEQ ID NO: 1679601 - DNA, 16 bp, Homo sapiens
gaaagagagaagccag

SEQ ID NO: 1679602 - DNA, 17 bp, Homo sapiens
gaaagagctgcctggat

SEQ ID NO: 1679603 - DNA, 16 bp, Homo sapiens
gaaagaggcaccagga

SEQ ID NO: 1679604 - DNA, 22 bp, Homo sapiens
gaaagaggctgaggcctggact

SEQ ID NO: 1679605 - DNA, 14 bp, Homo sapiens
gaaagataactagg

SEQ ID NO: 1679606 - DNA, 16 bp, Homo sapiens
gaaagatacagacatt

SEQ ID NO: 1679607 - DNA, 16 bp, Homo sapiens
gaaagatcaaaaggtt

SEQ ID NO: 1679608 - DNA, 15 bp, Homo sapiens
gaaagatgaaactga

SEQ ID NO: 1679609 - DNA, 19 bp, Homo sapiens
gaaagatggaaattctgaa

SEQ ID NO: 1679610 - DNA, 14 bp, Homo sapiens
gaaagatggataaa

SEQ ID NO: 1679611 - DNA, 15 bp, Homo sapiens
gaaagatgtgttttt

SEQ ID NO: 1679612 - DNA, 22 bp, Homo sapiens
gaaagatgtgtttttgggaaga

SEQ ID NO: 1679613 - DNA, 20 bp, Homo sapiens
gaaagatttgttactgtatt

SEQ ID NO: 1679614 - DNA, 13 bp, Homo sapiens
gaaagattttatt

SEQ ID NO: 1679615 - DNA, 15 bp, Homo sapiens
gaaagatttttacta

SEQ ID NO: 1679616 - DNA, 23 bp, Homo sapiens
gaaagatttttactaatatatat

SEQ ID NO: 1679617 - DNA, 19 bp, Homo sapiens
gaaagcacttaaacagaag

SEQ ID NO: 1679618 - DNA, 18 bp, Homo sapiens
gaaagcaggagcagctgt

SEQ ID NO: 1679619 - DNA, 18 bp, Homo sapiens
gaaagcataaagctcaaa

SEQ ID NO: 1679620 - DNA, 13 bp, Homo sapiens
gaaagcccaaggt

SEQ ID NO: 1679621 - DNA, 20 bp, Homo sapiens
gaaagcctctctctccctcc

SEQ ID NO: 1679622 - DNA, 14 bp, Homo sapiens
gaaagcctttcatt

SEQ ID NO: 1679623 - DNA, 17 bp, Homo sapiens
gaaagcctttcattttg

SEQ ID NO: 1679624 - DNA, 21 bp, Homo sapiens
gaaagcctttcattttgcttt

SEQ ID NO: 1679625 - DNA, 13 bp, Homo sapiens
gaaagctctagaa

SEQ ID NO: 1679626 - DNA, 23 bp, Homo sapiens
gaaagctgattactgtcaataaa

SEQ ID NO: 1679627 - DNA, 17 bp, Homo sapiens
gaaagctgcctggtata

SEQ ID NO: 1679628 - DNA, 17 bp, Homo sapiens
gaaagctggactgacca

SEQ ID NO: 1679629 - DNA, 15 bp, Homo sapiens
gaaagctgtgtttat

SEQ ID NO: 1679630 - DNA, 15 bp, Homo sapiens
gaaagctgtttattt

SEQ ID NO: 1679631 - DNA, 21 bp, Homo sapiens
gaaagctgtttatttattcac

SEQ ID NO: 1679632 - DNA, 20 bp, Homo sapiens
gaaagcttcaaagtttatat

SEQ ID NO: 1679633 - DNA, 14 bp, Homo sapiens
gaaaggaaaagaaa

SEQ ID NO: 1679634 - DNA, 11 bp, Homo sapiens
gaaaggagact

SEQ ID NO: 1679635 - DNA, 12 bp, Homo sapiens
gaaaggagatgt

SEQ ID NO: 1679636 - DNA, 20 bp, Homo sapiens
gaaaggaggcatgcctctga

SEQ ID NO: 1679637 - DNA, 21 bp, Homo sapiens
gaaaggaggcatgcctctgat

SEQ ID NO: 1679638 - DNA, 21 bp, Homo sapiens
gaaaggaggccctgttccctg

SEQ ID NO: 1679639 - DNA, 15 bp, Homo sapiens
gaaaggagtagaaaa

SEQ ID NO: 1679640 - DNA, 16 bp, Homo sapiens
gaaaggagtagaaaaa

SEQ ID NO: 1679641 - DNA, 17 bp, Homo sapiens
gaaaggatatttaagaa

SEQ ID NO: 1679642 - DNA, 14 bp, Homo sapiens
gaaaggatctgtga

SEQ ID NO: 1679643 - DNA, 15 bp, Homo sapiens
gaaaggatgtggaag

SEQ ID NO: 1679644 - DNA, 12 bp, Homo sapiens
gaaaggatttta

SEQ ID NO: 1679645 - DNA, 13 bp, Homo sapiens
gaaaggattttac

SEQ ID NO: 1679646 - DNA, 17 bp, Homo sapiens
gaaaggattttaccaaa

SEQ ID NO: 1679647 - DNA, 24 bp, Homo sapiens
gaaaggattttaccaaagcatcaa

SEQ ID NO: 1679648 - DNA, 14 bp, Homo sapiens
gaaaggcaagcttg

SEQ ID NO: 1679649 - DNA, 18 bp, Homo sapiens
gaaaggcagccctcacct

SEQ ID NO: 1679650 - DNA, 21 bp, Homo sapiens
gaaaggcagccctcacctctg

SEQ ID NO: 1679651 - DNA, 16 bp, Homo sapiens
gaaaggcattctctga

SEQ ID NO: 1679652 - DNA, 19 bp, Homo sapiens
gaaaggccttcagacacat

SEQ ID NO: 1679653 - DNA, 16 bp, Homo sapiens
gaaaggctcatttaaa

SEQ ID NO: 1679654 - DNA, 22 bp, Homo sapiens
gaaaggctcatttaaaacaggc

SEQ ID NO: 1679655 - DNA, 17 bp, Homo sapiens
gaaaggctctgaaagcc

SEQ ID NO: 1679656 - DNA, 22 bp, Homo sapiens
gaaagggagctatcaggaacag

SEQ ID NO: 1679657 - DNA, 18 bp, Homo sapiens
gaaagggattgctgaggc

SEQ ID NO: 1679658 - DNA, 16 bp, Homo sapiens
gaaaggggacaaggaa

SEQ ID NO: 1679659 - DNA, 18 bp, Homo sapiens
gaaaggggacaaggaagg

SEQ ID NO: 1679660 - DNA, 20 bp, Homo sapiens
gaaaggggagagcctgctgg

SEQ ID NO: 1679661 - DNA, 16 bp, Homo sapiens
gaaaggggagcccact

SEQ ID NO: 1679662 - DNA, 18 bp, Homo sapiens
gaaagggggtcccagtgg

SEQ ID NO: 1679663 - DNA, 21 bp, Homo sapiens
gaaagggtttgtaatacttta

SEQ ID NO: 1679664 - DNA, 13 bp, Homo sapiens
gaaaggtcagccc

SEQ ID NO: 1679665 - DNA, 14 bp, Homo sapiens
gaaaggtttacatt

SEQ ID NO: 1679666 - DNA, 13 bp, Homo sapiens
gaaagtacatttt

SEQ ID NO: 1679667 - DNA, 16 bp, Homo sapiens
gaaagtagctgctagt

SEQ ID NO: 1679668 - DNA, 20 bp, Homo sapiens
gaaagtcagatgcccagagg

SEQ ID NO: 1679669 - DNA, 22 bp, Homo sapiens
gaaagtgacatttgctttcggt

SEQ ID NO: 1679670 - DNA, 21 bp, Homo sapiens
gaaagtgatatcccccagcct

SEQ ID NO: 1679671 - DNA, 13 bp, Homo sapiens
gaaagtgcctgac

SEQ ID NO: 1679672 - DNA, 21 bp, Homo sapiens
gaaagtgggaggtcaggaaac

SEQ ID NO: 1679673 - DNA, 19 bp, Homo sapiens
gaaagtgtataataagaaa

SEQ ID NO: 1679674 - DNA, 21 bp, Homo sapiens
gaaagtgtgagctcttccctt

SEQ ID NO: 1679675 - DNA, 23 bp, Homo sapiens
gaaagtgtgtgtagttttacttt

SEQ ID NO: 1679676 - DNA, 14 bp, Homo sapiens
gaaagttactgtaa

SEQ ID NO: 1679677 - DNA, 21 bp, Homo sapiens
gaaagttagggggttcttatt

SEQ ID NO: 1679678 - DNA, 21 bp, Homo sapiens
gaaagttgggcccctgaggag

SEQ ID NO: 1679679 - DNA, 18 bp, Homo sapiens
gaaagttgtatccattaa

SEQ ID NO: 1679680 - DNA, 17 bp, Homo sapiens
gaaagttttgtaaaaga

SEQ ID NO: 1679681 - DNA, 11 bp, Homo sapiens
gaaagtttttt

SEQ ID NO: 1679682 - DNA, 14 bp, Homo sapiens
gaaataaactgtgc

SEQ ID NO: 1679683 - DNA, 11 bp, Homo sapiens
gaaataaagcg

SEQ ID NO: 1679684 - DNA, 14 bp, Homo sapiens
gaaataaagcgtcc

SEQ ID NO: 1679685 - DNA, 12 bp, Homo sapiens
gaaataaatgta

SEQ ID NO: 1679686 - DNA, 22 bp, Homo sapiens
gaaataaattctgacttatgaa

SEQ ID NO: 1679687 - DNA, 14 bp, Homo sapiens
gaaataagaaaaat

SEQ ID NO: 1679688 - DNA, 18 bp, Homo sapiens
gaaataagaaaaatcatg

SEQ ID NO: 1679689 - DNA, 23 bp, Homo sapiens
gaaataatgctacaattttaaga

SEQ ID NO: 1679690 - DNA, 19 bp, Homo sapiens
gaaataatgtacatctggc

SEQ ID NO: 1679691 - DNA, 11 bp, Homo sapiens
gaaatacaaaa

SEQ ID NO: 1679692 - DNA, 14 bp, Homo sapiens
gaaatactatttaa

SEQ ID NO: 1679693 - DNA, 19 bp, Homo sapiens
gaacctacagactccatct

SEQ ID NO: 1679694 - DNA, 18 bp, Homo sapiens
gaacctacagttttaact

SEQ ID NO: 1679695 - DNA, 21 bp, Homo sapiens
gaacctacagttttaactgtg

SEQ ID NO: 1679696 - DNA, 23 bp, Homo sapiens
gaacctacagttttaactgtgga

SEQ ID NO: 1679697 - DNA, 19 bp, Homo sapiens
gaacctattttcatttgta

SEQ ID NO: 1679698 - DNA, 18 bp, Homo sapiens
gaacctcagattcttcat

SEQ ID NO: 1679699 - DNA, 11 bp, Homo sapiens
gaacctcaggc

SEQ ID NO: 1679700 - DNA, 14 bp, Homo sapiens
gaacctcaggcttc

SEQ ID NO: 1679701 - DNA, 18 bp, Homo sapiens
gaacctcaggcttccttg

SEQ ID NO: 1679702 - DNA, 20 bp, Homo sapiens
gaacctctcgccatgatcag

SEQ ID NO: 1679703 - DNA, 15 bp, Homo sapiens
gaacctgcacacagg

SEQ ID NO: 1679704 - DNA, 21 bp, Homo sapiens
gaacctgcacacaggacagcg

SEQ ID NO: 1679705 - DNA, 11 bp, Homo sapiens
gaacctggatc

SEQ ID NO: 1679706 - DNA, 22 bp, Homo sapiens
gaacctgggaaagagatttaaa

SEQ ID NO: 1679707 - DNA, 15 bp, Homo sapiens
gaacctgggaggcag

SEQ ID NO: 1679708 - DNA, 16 bp, Homo sapiens
gaacctgggaggcaga

SEQ ID NO: 1679709 - DNA, 17 bp, Homo sapiens
gaacctgggaggcagag

SEQ ID NO: 1679710 - DNA, 18 bp, Homo sapiens
gaacctggtgtgtttctt

SEQ ID NO: 1679711 - DNA, 20 bp, Homo sapiens
gaacctgtccttgcacactc

SEQ ID NO: 1679712 - DNA, 12 bp, Homo sapiens
gaacctgtgtcc

SEQ ID NO: 1679713 - DNA, 17 bp, Homo sapiens
gaaccttgaggggctag

SEQ ID NO: 1679714 - DNA, 20 bp, Homo sapiens
gaaccttggaccactcctgt

SEQ ID NO: 1679715 - DNA, 14 bp, Homo sapiens
gaacctttctgtgt

SEQ ID NO: 1679716 - DNA, 14 bp, Homo sapiens
gaacgagcactggc

SEQ ID NO: 1679717 - DNA, 17 bp, Homo sapiens
gaacgagcactggccag

SEQ ID NO: 1679718 - DNA, 18 bp, Homo sapiens
gaacgagcactggccaga

SEQ ID NO: 1679719 - DNA, 21 bp, Homo sapiens
gaacgatatgtagcagaaagg

SEQ ID NO: 1679720 - DNA, 15 bp, Homo sapiens
gaacgccagtctccc

SEQ ID NO: 1679721 - DNA, 16 bp, Homo sapiens
gaacgccagtctccca

SEQ ID NO: 1679722 - DNA, 20 bp, Homo sapiens
gaacgcgtgtgtacacggga

SEQ ID NO: 1679723 - DNA, 13 bp, Homo sapiens
gaacgctcttagc

SEQ ID NO: 1679724 - DNA, 22 bp, Homo sapiens
gaagagtggcagctataggaaa

SEQ ID NO: 1679725 - DNA, 23 bp, Homo sapiens
gaagagttctatccccaagctgg

SEQ ID NO: 1679726 - DNA, 20 bp, Homo sapiens
gaagataggctctgcacaga

SEQ ID NO: 1679727 - DNA, 16 bp, Homo sapiens
gaagatcggaacagct

SEQ ID NO: 1679728 - DNA, 18 bp, Homo sapiens
gaagatcgttagtatcta

SEQ ID NO: 1679729 - DNA, 20 bp, Homo sapiens
gaagatgaaagattcagtga

SEQ ID NO: 1679730 - DNA, 14 bp, Homo sapiens
gaagatgaatcaat

SEQ ID NO: 1679731 - DNA, 22 bp, Homo sapiens
gaagatgaatggtctggcaata

SEQ ID NO: 1679732 - DNA, 12 bp, Homo sapiens
gaagatgctgcc

SEQ ID NO: 1679733 - DNA, 18 bp, Homo sapiens
gaagatggactctgaaaa

SEQ ID NO: 1679734 - DNA, 21 bp, Homo sapiens
gaagatggagacaccctctgg

SEQ ID NO: 1679735 - DNA, 22 bp, Homo sapiens
gaagatggagacaccctctggg

SEQ ID NO: 1679736 - DNA, 15 bp, Homo sapiens
gaagatgtgtaaaca

SEQ ID NO: 1679737 - DNA, 17 bp, Homo sapiens
gaagattctcctgtgct

SEQ ID NO: 1679738 - DNA, 12 bp, Homo sapiens
gaagatttacct

SEQ ID NO: 1679739 - DNA, 12 bp, Homo sapiens
gaagcaaggctg

SEQ ID NO: 1679740 - DNA, 13 bp, Homo sapiens
gaagcaaggctgg

SEQ ID NO: 1679741 - DNA, 15 bp, Homo sapiens
gaagcaataaagctc

SEQ ID NO: 1679742 - DNA, 15 bp, Homo sapiens
gaagcacagaatatt

SEQ ID NO: 1679743 - DNA, 17 bp, Homo sapiens
gaagcacagaatatttt

SEQ ID NO: 1679744 - DNA, 23 bp, Homo sapiens
gaagcacagcaccgggggagagg

SEQ ID NO: 1679745 - DNA, 13 bp, Homo sapiens
gaagcacatgtgt

SEQ ID NO: 1679746 - DNA, 12 bp, Homo sapiens
gaagcagagcaa

SEQ ID NO: 1679747 - DNA, 22 bp, Homo sapiens
gaagcagagcaaaatgctcttg

SEQ ID NO: 1679748 - DNA, 19 bp, Homo sapiens
gaagcagcaaatgaaagaa

SEQ ID NO: 1679749 - DNA, 18 bp, Homo sapiens
gaagcagccccctgtggc

SEQ ID NO: 1679750 - DNA, 18 bp, Homo sapiens
gaagcagcctcagagtgg

SEQ ID NO: 1679751 - DNA, 12 bp, Homo sapiens
gaagcagcctct

SEQ ID NO: 1679752 - DNA, 12 bp, Homo sapiens
gaagcaggtgct

SEQ ID NO: 1679753 - DNA, 17 bp, Homo sapiens
gaagcaggttcttgatg

SEQ ID NO: 1679754 - DNA, 18 bp, Homo sapiens
gaagcaggttgaggggct

SEQ ID NO: 1679755 - DNA, 22 bp, Homo sapiens
gaagcaggttgaggggctcctg

SEQ ID NO: 1679756 - DNA, 16 bp, Homo sapiens
gaagcagtgagccgca

SEQ ID NO: 1679757 - DNA, 22 bp, Homo sapiens
gaagcagtgcctcgaggcaccg

SEQ ID NO: 1679758 - DNA, 13 bp, Homo sapiens
gaagcatgaaaaa

SEQ ID NO: 1679759 - DNA, 16 bp, Homo sapiens
gaagcatgaaaaagca

SEQ ID NO: 1679760 - DNA, 19 bp, Homo sapiens
gaagcatgctttgctgcta

SEQ ID NO: 1679761 - DNA, 16 bp, Homo sapiens
gaagcatgtaggagaa

SEQ ID NO: 1679762 - DNA, 15 bp, Homo sapiens
gaagcattctcccca

SEQ ID NO: 1679763 - DNA, 20 bp, Homo sapiens
gaagcatttcaaagccctgc

SEQ ID NO: 1679764 - DNA, 13 bp, Homo sapiens
gaaggcagggaaa

SEQ ID NO: 1679765 - DNA, 15 bp, Homo sapiens
gaaggcagggcagag

SEQ ID NO: 1679766 - DNA, 17 bp, Homo sapiens
gaaggcagggcagaggg

SEQ ID NO: 1679767 - DNA, 19 bp, Homo sapiens
gaaggcagtggcaggggag

SEQ ID NO: 1679768 - DNA, 17 bp, Homo sapiens
gaaggcatcagtcccta

SEQ ID NO: 1679769 - DNA, 14 bp, Homo sapiens
gaaggcatgagaaa

SEQ ID NO: 1679770 - DNA, 19 bp, Homo sapiens
gaaggcatttgcagggtcc

SEQ ID NO: 1679771 - DNA, 19 bp, Homo sapiens
gaaggccaaaatcaagagt

SEQ ID NO: 1679772 - DNA, 23 bp, Homo sapiens
gaaggccacctcccactcctgct

SEQ ID NO: 1679773 - DNA, 20 bp, Homo sapiens
gaaggccagccctccctggc

SEQ ID NO: 1679774 - DNA, 18 bp, Homo sapiens
gaaggccccagagagacc

SEQ ID NO: 1679775 - DNA, 13 bp, Homo sapiens
gaaggccccttcc

SEQ ID NO: 1679776 - DNA, 20 bp, Homo sapiens
gaaggcctccctagccagca

SEQ ID NO: 1679777 - DNA, 19 bp, Homo sapiens
gaaggccttacagaaaatt

SEQ ID NO: 1679778 - DNA, 15 bp, Homo sapiens
gaaggcctttcttct

SEQ ID NO: 1679779 - DNA, 13 bp, Homo sapiens
gaaggcgaggaga

SEQ ID NO: 1679780 - DNA, 14 bp, Homo sapiens
gaaggctggctgag

SEQ ID NO: 1679781 - DNA, 15 bp, Homo sapiens
gaaggctggctgagt

SEQ ID NO: 1679782 - DNA, 16 bp, Homo sapiens
gaaggctggctgggca

SEQ ID NO: 1679783 - DNA, 13 bp, Homo sapiens
gaaggcttctctc

SEQ ID NO: 1679784 - DNA, 19 bp, Homo sapiens
gaaggctttagttctgctt

SEQ ID NO: 1679785 - DNA, 16 bp, Homo sapiens
gaagggaaacaaagaa

SEQ ID NO: 1679786 - DNA, 18 bp, Homo sapiens
gaagggaaacaaagaagt

SEQ ID NO: 1679787 - DNA, 20 bp, Homo sapiens
gaagggaatcctcctccagg

SEQ ID NO: 1679788 - DNA, 17 bp, Homo sapiens
gaagggacagctgctgg

SEQ ID NO: 1679789 - DNA, 20 bp, Homo sapiens
gaagggaccaaggcaaggca

SEQ ID NO: 1679790 - DNA, 22 bp, Homo sapiens
gaagggaccaaggcaaggcagg

SEQ ID NO: 1679791 - DNA, 16 bp, Homo sapiens
gaagggagagccagct

SEQ ID NO: 1679792 - DNA, 18 bp, Homo sapiens
gaagggaggaaggccttt

SEQ ID NO: 1679793 - DNA, 15 bp, Homo sapiens
gaagggatccctaac

SEQ ID NO: 1679794 - DNA, 13 bp, Homo sapiens
gaagggatctgag

SEQ ID NO: 1679795 - DNA, 18 bp, Homo sapiens
gaagggcatcatgcatct

SEQ ID NO: 1679796 - DNA, 13 bp, Homo sapiens
gaagggccagagc

SEQ ID NO: 1679797 - DNA, 17 bp, Homo sapiens
gaagggccagagccagg

SEQ ID NO: 1679798 - DNA, 18 bp, Homo sapiens
gaagggccagagccaggg

SEQ ID NO: 1679799 - DNA, 14 bp, Homo sapiens
gaagggccagtcct

SEQ ID NO: 1679800 - DNA, 18 bp, Homo sapiens
gaagggccagtcctgcct

SEQ ID NO: 1679801 - DNA, 18 bp, Homo sapiens
gaagggccagtctgggct

SEQ ID NO: 1679802 - DNA, 20 bp, Homo sapiens
gaagggccagtctgggctgc

SEQ ID NO: 1679803 - DNA, 16 bp, Homo sapiens
gaagggccggcttctg

SEQ ID NO: 1679804 - DNA, 22 bp, Homo sapiens
gaagggccggcttctgcctggg

SEQ ID NO: 1679805 - DNA, 16 bp, Homo sapiens
gaagggcgttctaggt

SEQ ID NO: 1679806 - DNA, 18 bp, Homo sapiens
gaagggctgcatgatgtt

SEQ ID NO: 1679807 - DNA, 23 bp, Homo sapiens
gaagggctggggccggggctgag

SEQ ID NO: 1679808 - DNA, 23 bp, Homo sapiens
gaaggggcacaccactgccctgc

SEQ ID NO: 1679809 - DNA, 18 bp, Homo sapiens
gaaggggcagcaggagga

SEQ ID NO: 1679810 - DNA, 20 bp, Homo sapiens
gaaggggccccggggctggc

SEQ ID NO: 1679811 - DNA, 19 bp, Homo sapiens
gaagggggacgtttctgga

SEQ ID NO: 1679812 - DNA, 13 bp, Homo sapiens
gaagggggagaca

SEQ ID NO: 1679813 - DNA, 14 bp, Homo sapiens
gaagggggccctgc

SEQ ID NO: 1679814 - DNA, 23 bp, Homo sapiens
gaaggggggccgccgctgaccct

SEQ ID NO: 1679815 - DNA, 12 bp, Homo sapiens
gaagggggtggt

SEQ ID NO: 1679816 - DNA, 13 bp, Homo sapiens
gaagggtcctgcc

SEQ ID NO: 1679817 - DNA, 19 bp, Homo sapiens
gaagggtctctctccaggt

SEQ ID NO: 1679818 - DNA, 23 bp, Homo sapiens
gaagggtctctctccaggtcagc

SEQ ID NO: 1679819 - DNA, 21 bp, Homo sapiens
gaagggtggatgacagggcag

SEQ ID NO: 1679820 - DNA, 22 bp, Homo sapiens
gaagggtggcctgttccctaga

SEQ ID NO: 1679821 - DNA, 23 bp, Homo sapiens
gaagggtggcctgttccctagag

SEQ ID NO: 1679822 - DNA, 15 bp, Homo sapiens
gaagggttctgccct

SEQ ID NO: 1679823 - DNA, 17 bp, Homo sapiens
gaagggttctgccctgc

SEQ ID NO: 1679824 - DNA, 21 bp, Homo sapiens
gaagggttctgccctgcctga

SEQ ID NO: 1679825 - DNA, 15 bp, Homo sapiens
gaagggtttgtggct

SEQ ID NO: 1679826 - DNA, 21 bp, Homo sapiens
gaagggtttgtggctgggggc

SEQ ID NO: 1679827 - DNA, 13 bp, Homo sapiens
gaaggtaaaattg

SEQ ID NO: 1679828 - DNA, 19 bp, Homo sapiens
gaaggtagcattctttgga

SEQ ID NO: 1679829 - DNA, 16 bp, Homo sapiens
gaaggtagcccagcac

SEQ ID NO: 1679830 - DNA, 22 bp, Homo sapiens
gaaggtagcccagcactgtgaa

SEQ ID NO: 1679831 - DNA, 14 bp, Homo sapiens
gaaggtctccaagg

SEQ ID NO: 1679832 - DNA, 23 bp, Homo sapiens
gaaggtgataagggaaaagataa

SEQ ID NO: 1679833 - DNA, 21 bp, Homo sapiens
gaataccattaaaactgcttt

SEQ ID NO: 1679834 - DNA, 13 bp, Homo sapiens
gaatacctgctca

SEQ ID NO: 1679835 - DNA, 16 bp, Homo sapiens
gaatactcttgaaagg

SEQ ID NO: 1679836 - DNA, 17 bp, Homo sapiens
gaatactgcatttacag

SEQ ID NO: 1679837 - DNA, 21 bp, Homo sapiens
gaatactgcatttacagtgta

SEQ ID NO: 1679838 - DNA, 17 bp, Homo sapiens
gaatacttactataatt

SEQ ID NO: 1679839 - DNA, 14 bp, Homo sapiens
gaatacttgaagaa

SEQ ID NO: 1679840 - DNA, 15 bp, Homo sapiens
gaatactttttaaaa

SEQ ID NO: 1679841 - DNA, 13 bp, Homo sapiens
gaatagagctgcc

SEQ ID NO: 1679842 - DNA, 14 bp, Homo sapiens
gaatagagctgcca

SEQ ID NO: 1679843 - DNA, 16 bp, Homo sapiens
gaatagagctgccact

SEQ ID NO: 1679844 - DNA, 19 bp, Homo sapiens
gaatagatatgaaagctga

SEQ ID NO: 1679845 - DNA, 12 bp, Homo sapiens
gaatagatgtct

SEQ ID NO: 1679846 - DNA, 15 bp, Homo sapiens
gaatagatgtgatca

SEQ ID NO: 1679847 - DNA, 19 bp, Homo sapiens
gaatagatgtgatcactga

SEQ ID NO: 1679848 - DNA, 18 bp, Homo sapiens
gaatagcagagagccaaa

SEQ ID NO: 1679849 - DNA, 19 bp, Homo sapiens
gaatagctttaaaagggaa

SEQ ID NO: 1679850 - DNA, 16 bp, Homo sapiens
gaataggtagtatcat

SEQ ID NO: 1679851 - DNA, 17 bp, Homo sapiens
gaatagtgcttgctggc

SEQ ID NO: 1679852 - DNA, 14 bp, Homo sapiens
gaatagttctgtat

SEQ ID NO: 1679853 - DNA, 12 bp, Homo sapiens
gaatataattat

SEQ ID NO: 1679854 - DNA, 18 bp, Homo sapiens
gaatataccttatttatt

SEQ ID NO: 1679855 - DNA, 21 bp, Homo sapiens
gaatatagttattattgctgt

SEQ ID NO: 1679856 - DNA, 16 bp, Homo sapiens
gaatatccatgaccta

SEQ ID NO: 1679857 - DNA, 19 bp, Homo sapiens
gaatatcctttaaaattta

SEQ ID NO: 1679858 - DNA, 17 bp, Homo sapiens
gaatatctattaatata

SEQ ID NO: 1679859 - DNA, 14 bp, Homo sapiens
gaatatgacagctg

SEQ ID NO: 1679860 - DNA, 17 bp, Homo sapiens
gaatatgacggaagaac

SEQ ID NO: 1679861 - DNA, 15 bp, Homo sapiens
gaatatgtatgtata

SEQ ID NO: 1679862 - DNA, 15 bp, Homo sapiens
gaatatgttcaatgc

SEQ ID NO: 1679863 - DNA, 21 bp, Homo sapiens
gaatattagctttactgtttg

SEQ ID NO: 1679864 - DNA, 10 bp, Homo sapiens
gaatatttat

SEQ ID NO: 1679865 - DNA, 12 bp, Homo sapiens
gaatatttatta

SEQ ID NO: 1679866 - DNA, 15 bp, Homo sapiens
gaatatttattacct

SEQ ID NO: 1679867 - DNA, 14 bp, Homo sapiens
gaatatttatttaa

SEQ ID NO: 1679868 - DNA, 22 bp, Homo sapiens
gaatatttgttatgtagataac

SEQ ID NO: 1679869 - DNA, 14 bp, Homo sapiens
gaatattttatcct

SEQ ID NO: 1679870 - DNA, 15 bp, Homo sapiens
gaatattttcaaaat

SEQ ID NO: 1679871 - DNA, 20 bp, Homo sapiens
gaatattttcattaaaagct

SEQ ID NO: 1679872 - DNA, 21 bp, Homo sapiens
gaatattttcattaaaagcta

SEQ ID NO: 1679873 - DNA, 20 bp, Homo sapiens
gaatatttttatatttcctt

SEQ ID NO: 1679874 - DNA, 12 bp, Homo sapiens
gaatatttttgt

SEQ ID NO: 1679875 - DNA, 13 bp, Homo sapiens
gaatcaaaactct

SEQ ID NO: 1679876 - DNA, 17 bp, Homo sapiens
gaatcaaatactcattt

SEQ ID NO: 1679877 - DNA, 14 bp, Homo sapiens
gaatcaatcctggg

SEQ ID NO: 1679878 - DNA, 19 bp, Homo sapiens
gaatcacctgaaccccaga

SEQ ID NO: 1679879 - DNA, 22 bp, Homo sapiens
gaatcacctgaaccccagaggc

SEQ ID NO: 1679880 - DNA, 17 bp, Homo sapiens
gaatcactgtgctcagc

SEQ ID NO: 1679881 - DNA, 13 bp, Homo sapiens
gaatcagaaacag

SEQ ID NO: 1679882 - DNA, 15 bp, Homo sapiens
gaatcagaagaaagg

SEQ ID NO: 1679883 - DNA, 18 bp, Homo sapiens
gaatcagaccctacccca

SEQ ID NO: 1679884 - DNA, 23 bp, Homo sapiens
gaatcagaccctaccccaccacg

SEQ ID NO: 1679885 - DNA, 21 bp, Homo sapiens
gaatcaggaatattttccaaa

SEQ ID NO: 1679886 - DNA, 18 bp, Homo sapiens
gaatcatgagcctgctgg

SEQ ID NO: 1679887 - DNA, 20 bp, Homo sapiens
gaatcatgagcctgctggaa

SEQ ID NO: 1679888 - DNA, 18 bp, Homo sapiens
gaatcattcagaaatgtt

SEQ ID NO: 1679889 - DNA, 22 bp, Homo sapiens
gaatccaaaagacaaaaatcaa

SEQ ID NO: 1679890 - DNA, 18 bp, Homo sapiens
gaatccaaatctgtcctc

SEQ ID NO: 1679891 - DNA, 20 bp, Homo sapiens
gaatccaaatctgtcctctg

SEQ ID NO: 1679892 - DNA, 21 bp, Homo sapiens
gaatccaaatctgtcctctgt

SEQ ID NO: 1679893 - DNA, 22 bp, Homo sapiens
gaatccaaatctgtcctctgta

SEQ ID NO: 1679894 - DNA, 17 bp, Homo sapiens
gaatccaagtgaacact

SEQ ID NO: 1679895 - DNA, 18 bp, Homo sapiens
gaatccacatttctaaaa

SEQ ID NO: 1679896 - DNA, 16 bp, Homo sapiens
gaatccataaatgtgt

SEQ ID NO: 1679897 - DNA, 14 bp, Homo sapiens
gaatccattgaaag

SEQ ID NO: 1679898 - DNA, 17 bp, Homo sapiens
gaatcccactgtatgat

SEQ ID NO: 1679899 - DNA, 22 bp, Homo sapiens
gaatcccagcagcagagaacca

SEQ ID NO: 1679900 - DNA, 13 bp, Homo sapiens
gaatccctgggag

SEQ ID NO: 1679901 - DNA, 16 bp, Homo sapiens
gaatcccttaacagtt

SEQ ID NO: 1679902 - DNA, 14 bp, Homo sapiens
gaatcctcccttcc

SEQ ID NO: 1679903 - DNA, 19 bp, Homo sapiens
gaatcctcccttcccagga

SEQ ID NO: 1679904 - DNA, 19 bp, Homo sapiens
gaatcctggcaagaaagct

SEQ ID NO: 1679905 - DNA, 12 bp, Homo sapiens
gaatcctggcag

SEQ ID NO: 1679906 - DNA, 13 bp, Homo sapiens
gaatcctggcagc

SEQ ID NO: 1679907 - DNA, 15 bp, Homo sapiens
gaatccttactgata

SEQ ID NO: 1679908 - DNA, 17 bp, Homo sapiens
gaatccttactgatatt

SEQ ID NO: 1679909 - DNA, 23 bp, Homo sapiens
gaatccttactgatatttataga

SEQ ID NO: 1679910 - DNA, 17 bp, Homo sapiens
gaatcgaagtgtttatg

SEQ ID NO: 1679911 - DNA, 16 bp, Homo sapiens
gaatcgcaaggcctgt

SEQ ID NO: 1679912 - DNA, 21 bp, Homo sapiens
gaatctaaacgtggtcacctt

SEQ ID NO: 1679913 - DNA, 22 bp, Homo sapiens
gaatctaaggataatgaaataa

SEQ ID NO: 1679914 - DNA, 14 bp, Homo sapiens
gaatctacatttgt

SEQ ID NO: 1679915 - DNA, 12 bp, Homo sapiens
gaatctagaaat

SEQ ID NO: 1679916 - DNA, 17 bp, Homo sapiens
gaatctagaaatgttca

SEQ ID NO: 1679917 - DNA, 16 bp, Homo sapiens
gaatctagaagatgtg

SEQ ID NO: 1679918 - DNA, 19 bp, Homo sapiens
gaatctataagtagtaaat

SEQ ID NO: 1679919 - DNA, 21 bp, Homo sapiens
gaatctataagtagtaaatca

SEQ ID NO: 1679920 - DNA, 21 bp, Homo sapiens
gaatctatctgcttatgcagt

SEQ ID NO: 1679921 - DNA, 19 bp, Homo sapiens
gaatctatgccaaagatca

SEQ ID NO: 1679922 - DNA, 15 bp, Homo sapiens
gaatctcaaaattag

SEQ ID NO: 1679923 - DNA, 16 bp, Homo sapiens
gaatctcaaataacta

SEQ ID NO: 1679924 - DNA, 16 bp, Homo sapiens
gaatctcataattgga

SEQ ID NO: 1679925 - DNA, 14 bp, Homo sapiens
gaatctcatccctc

SEQ ID NO: 1679926 - DNA, 15 bp, Homo sapiens
gaatctcatccctca

SEQ ID NO: 1679927 - DNA, 12 bp, Homo sapiens
gaatctcccctc

SEQ ID NO: 1679928 - DNA, 14 bp, Homo sapiens
gaatctcccctcct

SEQ ID NO: 1679929 - DNA, 20 bp, Homo sapiens
gaatctccgtagaattttgc

SEQ ID NO: 1679930 - DNA, 12 bp, Homo sapiens
gaatctctgagc

SEQ ID NO: 1679931 - DNA, 17 bp, Homo sapiens
gaatctcttcatgcttg

SEQ ID NO: 1679932 - DNA, 12 bp, Homo sapiens
gaatctctttcc

SEQ ID NO: 1679933 - DNA, 13 bp, Homo sapiens
gaatctctttccc

SEQ ID NO: 1679934 - DNA, 15 bp, Homo sapiens
gaatctgcaattcaa

SEQ ID NO: 1679935 - DNA, 21 bp, Homo sapiens
gaatctgcaattcaaaagttc

SEQ ID NO: 1679936 - DNA, 19 bp, Homo sapiens
gaatctgcctgtggccttg

SEQ ID NO: 1679937 - DNA, 15 bp, Homo sapiens
gaatctgctcacttt

SEQ ID NO: 1679938 - DNA, 12 bp, Homo sapiens
gaatctggagac

SEQ ID NO: 1679939 - DNA, 18 bp, Homo sapiens
gaatctggagaccaggga

SEQ ID NO: 1679940 - DNA, 22 bp, Homo sapiens
gaatctggagaccagggagcct

SEQ ID NO: 1679941 - DNA, 20 bp, Homo sapiens
gaatctgtgggtctgggagt

SEQ ID NO: 1679942 - DNA, 13 bp, Homo sapiens
gaatctgtttctc

SEQ ID NO: 1679943 - DNA, 20 bp, Homo sapiens
gaatcttaatgcttgtaatt

SEQ ID NO: 1679944 - DNA, 16 bp, Homo sapiens
gaatcttaatttatta

SEQ ID NO: 1679945 - DNA, 22 bp, Homo sapiens
gaatcttcacgacaatgttgag

SEQ ID NO: 1679946 - DNA, 21 bp, Homo sapiens
gaattcccttgaattgtgtat

SEQ ID NO: 1679947 - DNA, 15 bp, Homo sapiens
gaattcccttttaat

SEQ ID NO: 1679948 - DNA, 15 bp, Homo sapiens
gaattccttcgaaag

SEQ ID NO: 1679949 - DNA, 21 bp, Homo sapiens
gaattccttcgaaaggccttc

SEQ ID NO: 1679950 - DNA, 22 bp, Homo sapiens
gaattcgaaggctctctctttc

SEQ ID NO: 1679951 - DNA, 18 bp, Homo sapiens
gaattcggtgtgctgcca

SEQ ID NO: 1679952 - DNA, 15 bp, Homo sapiens
gaattctactggaaa

SEQ ID NO: 1679953 - DNA, 23 bp, Homo sapiens
gaattctgcaactagccaaggct

SEQ ID NO: 1679954 - DNA, 18 bp, Homo sapiens
gaattctgctacctcact

SEQ ID NO: 1679955 - DNA, 19 bp, Homo sapiens
gaattcttacatgttttct

SEQ ID NO: 1679956 - DNA, 22 bp, Homo sapiens
gaattcttacatgttttctttg

SEQ ID NO: 1679957 - DNA, 12 bp, Homo sapiens
gaattcttctgc

SEQ ID NO: 1679958 - DNA, 23 bp, Homo sapiens
gaattcttgaaggaaaatgatac

SEQ ID NO: 1679959 - DNA, 17 bp, Homo sapiens
gaattctttctgttgaa

SEQ ID NO: 1679960 - DNA, 13 bp, Homo sapiens
gaattgaaaaaca

SEQ ID NO: 1679961 - DNA, 14 bp, Homo sapiens
gaattgaaaaacaa

SEQ ID NO: 1679962 - DNA, 15 bp, Homo sapiens
gaattgaacccagga

SEQ ID NO: 1679963 - DNA, 16 bp, Homo sapiens
gaattgagtaatggtg

SEQ ID NO: 1679964 - DNA, 14 bp, Homo sapiens
gaattgataaaaga

SEQ ID NO: 1679965 - DNA, 20 bp, Homo sapiens
gaattgataaaagagttccc

SEQ ID NO: 1679966 - DNA, 14 bp, Homo sapiens
gaattgcagtcatt

SEQ ID NO: 1679967 - DNA, 23 bp, Homo sapiens
gaattgccaggggcgaggccctt

SEQ ID NO: 1679968 - DNA, 17 bp, Homo sapiens
gaattggaagggaaaaa

SEQ ID NO: 1679969 - DNA, 16 bp, Homo sapiens
gaattggccatcttaa

SEQ ID NO: 1679970 - DNA, 13 bp, Homo sapiens
gaattggtgaata

SEQ ID NO: 1679971 - DNA, 19 bp, Homo sapiens
gaattggtgaataaaacct

SEQ ID NO: 1679972 - DNA, 16 bp, Homo sapiens
gaattgtcaaatgatg

SEQ ID NO: 1679973 - DNA, 14 bp, Homo sapiens
gaattgtccccagt

SEQ ID NO: 1679974 - DNA, 23 bp, Homo sapiens
gaattgtccccagtttgcagaaa

SEQ ID NO: 1679975 - DNA, 19 bp, Homo sapiens
gaattgtgctttcaccaga

SEQ ID NO: 1679976 - DNA, 18 bp, Homo sapiens
gaattgtgtattgatgca

SEQ ID NO: 1679977 - DNA, 20 bp, Homo sapiens
gaattgttacctgtcatttt

SEQ ID NO: 1679978 - DNA, 22 bp, Homo sapiens
gaattgtttttgaatttaaata

SEQ ID NO: 1679979 - DNA, 22 bp, Homo sapiens
gaatttaaaaggtgtcaacttt

SEQ ID NO: 1679980 - DNA, 21 bp, Homo sapiens
gaatttaaaattaagtagaac

SEQ ID NO: 1679981 - DNA, 14 bp, Homo sapiens
gaatttaaatataa

SEQ ID NO: 1679982 - DNA, 15 bp, Homo sapiens
gaatttaaatataat

SEQ ID NO: 1679983 - DNA, 22 bp, Homo sapiens
gaatttaaatataattctgtaa

SEQ ID NO: 1679984 - DNA, 16 bp, Homo sapiens
gaatttactttcttca

SEQ ID NO: 1679985 - DNA, 20 bp, Homo sapiens
gaatttatcacacttctgtg

SEQ ID NO: 1679986 - DNA, 15 bp, Homo sapiens
gaatttatctttacc

SEQ ID NO: 1679987 - DNA, 12 bp, Homo sapiens
gaatttcacaag

SEQ ID NO: 1679988 - DNA, 17 bp, Homo sapiens
gaatttcacctgtaaac

SEQ ID NO: 1679989 - DNA, 14 bp, Homo sapiens
gaatttccctctct

SEQ ID NO: 1679990 - DNA, 21 bp, Homo sapiens
gaatttcctctattgatgtac

SEQ ID NO: 1679991 - DNA, 17 bp, Homo sapiens
gaatttctaaaaaacag

SEQ ID NO: 1679992 - DNA, 16 bp, Homo sapiens
gaatttctaaatgttg

SEQ ID NO: 1679993 - DNA, 13 bp, Homo sapiens
gaatttcttaact

SEQ ID NO: 1679994 - DNA, 11 bp, Homo sapiens
gaatttgcacc

SEQ ID NO: 1679995 - DNA, 16 bp, Homo sapiens
gaattttattttgctg

SEQ ID NO: 1679996 - DNA, 17 bp, Homo sapiens
gaattttattttgctga

SEQ ID NO: 1679997 - DNA, 15 bp, Homo sapiens
gaattttcaaggcct

SEQ ID NO: 1679998 - DNA, 20 bp, Homo sapiens
gaattttcaaggccttcagt

SEQ ID NO: 1679999 - DNA, 19 bp, Homo sapiens
gaattttccgggaactttg

SEQ ID NO: 1680000 - DNA, 21 bp, Homo sapiens
gaattttgcaaagatttaatc

SEQ ID NO: 1680001 - DNA, 18 bp, Homo sapiens
gaattttgttctctggga

SEQ ID NO: 1680002 - DNA, 15 bp, Homo sapiens
gaattttgttgctgt

SEQ ID NO: 1680003 - DNA, 21 bp, Homo sapiens
gaatttttatttctttttaat

SEQ ID NO: 1680004 - DNA, 13 bp, Homo sapiens
gaatttttcttcc

SEQ ID NO: 1680005 - DNA, 22 bp, Homo sapiens
gaatttttttcatcttctctgg

SEQ ID NO: 1680006 - DNA, 15 bp, Homo sapiens
gaattttttttaaca

SEQ ID NO: 1680007 - DNA, 18 bp, Homo sapiens
gacaaggaaggaaaagaa

SEQ ID NO: 1680008 - DNA, 18 bp, Homo sapiens
gacaagggattctgggaa

SEQ ID NO: 1680009 - DNA, 12 bp, Homo sapiens
gacaagggctga

SEQ ID NO: 1680010 - DNA, 19 bp, Homo sapiens
gacaagggctgacctgcct

SEQ ID NO: 1680011 - DNA, 21 bp, Homo sapiens
gacaagggctgacctgcctct

SEQ ID NO: 1680012 - DNA, 22 bp, Homo sapiens
gacaagggctgacctgcctctc

SEQ ID NO: 1680013 - DNA, 22 bp, Homo sapiens
gacaaggttcttcccttttaca

SEQ ID NO: 1680014 - DNA, 23 bp, Homo sapiens
gacaagtatgaatattactctca

SEQ ID NO: 1680015 - DNA, 19 bp, Homo sapiens
gacaagtgactgtatctgt

SEQ ID NO: 1680016 - DNA, 17 bp, Homo sapiens
gacaataattacattgg

SEQ ID NO: 1680017 - DNA, 22 bp, Homo sapiens
gacaataattacattggcacaa

SEQ ID NO: 1680018 - DNA, 16 bp, Homo sapiens
gacaataattctacat

SEQ ID NO: 1680019 - DNA, 19 bp, Homo sapiens
gacaataatttcaggtttt

SEQ ID NO: 1680020 - DNA, 21 bp, Homo sapiens
gacaatcatgaaatatgcatc

SEQ ID NO: 1680021 - DNA, 15 bp, Homo sapiens
gacaatgaagggaaa

SEQ ID NO: 1680022 - DNA, 15 bp, Homo sapiens
gacaatggcagctag

SEQ ID NO: 1680023 - DNA, 16 bp, Homo sapiens
gacaatgttgagaagt

SEQ ID NO: 1680024 - DNA, 16 bp, Homo sapiens
gacaattactcaggtt

SEQ ID NO: 1680025 - DNA, 23 bp, Homo sapiens
gacaattcctagataaaaagatg

SEQ ID NO: 1680026 - DNA, 21 bp, Homo sapiens
gacaattttgtcttaagtgtt

SEQ ID NO: 1680027 - DNA, 22 bp, Homo sapiens
gacaattttgtcttaagtgttt

SEQ ID NO: 1680028 - DNA, 20 bp, Homo sapiens
gacacaaaggtggaataaac

SEQ ID NO: 1680029 - DNA, 22 bp, Homo sapiens
gacacaacagcagtctccttca

SEQ ID NO: 1680030 - DNA, 14 bp, Homo sapiens
gacacaagcacttt

SEQ ID NO: 1680031 - DNA, 19 bp, Homo sapiens
gacacaaggtgatttcaga

SEQ ID NO: 1680032 - DNA, 20 bp, Homo sapiens
gacacaatttcatttccagc

SEQ ID NO: 1680033 - DNA, 18 bp, Homo sapiens
gacacacacacgcacgca

SEQ ID NO: 1680034 - DNA, 20 bp, Homo sapiens
gacacacacacgcacgcaca

SEQ ID NO: 1680035 - DNA, 13 bp, Homo sapiens
gacacacagcact

SEQ ID NO: 1680036 - DNA, 22 bp, Homo sapiens
gacacacgtatttatatttgga

SEQ ID NO: 1680037 - DNA, 15 bp, Homo sapiens
gacacagacattttg

SEQ ID NO: 1680038 - DNA, 22 bp, Homo sapiens
gacacagattatgttcctgctg

SEQ ID NO: 1680039 - DNA, 19 bp, Homo sapiens
gacacagcacaagggcaca

SEQ ID NO: 1680040 - DNA, 12 bp, Homo sapiens
gacacagctctt

SEQ ID NO: 1680041 - DNA, 13 bp, Homo sapiens
gacacaggccctc

SEQ ID NO: 1680042 - DNA, 22 bp, Homo sapiens
gacacaggtgcctcacgcctgt

SEQ ID NO: 1680043 - DNA, 22 bp, Homo sapiens
gacacagtgatgaatgtactat

SEQ ID NO: 1680044 - DNA, 15 bp, Homo sapiens
gacacatacagagtg

SEQ ID NO: 1680045 - DNA, 17 bp, Homo sapiens
gacacatatacatatga

SEQ ID NO: 1680046 - DNA, 22 bp, Homo sapiens
gacacatatgcaccttgtgtct

SEQ ID NO: 1680047 - DNA, 17 bp, Homo sapiens
gacacatcccggcctct

SEQ ID NO: 1680048 - DNA, 21 bp, Homo sapiens
gacacatctattgcagagact

SEQ ID NO: 1680049 - DNA, 15 bp, Homo sapiens
gacacatgctatgtt

SEQ ID NO: 1680050 - DNA, 18 bp, Homo sapiens
gacacattaatgataaac

SEQ ID NO: 1680051 - DNA, 13 bp, Homo sapiens
gacacattgcctt

SEQ ID NO: 1680052 - DNA, 15 bp, Homo sapiens
gacaccaaagttcta

SEQ ID NO: 1680053 - DNA, 18 bp, Homo sapiens
gacaccaataaatgtttg

SEQ ID NO: 1680054 - DNA, 13 bp, Homo sapiens
gacaccactaaga

SEQ ID NO: 1680055 - DNA, 20 bp, Homo sapiens
gacaccagcctttctcccag

SEQ ID NO: 1680056 - DNA, 22 bp, Homo sapiens
gacaccagcctttctcccaggc

SEQ ID NO: 1680057 - DNA, 18 bp, Homo sapiens
gacaccatcctgagccag

SEQ ID NO: 1680058 - DNA, 20 bp, Homo sapiens
gacacccaggctggagtgca

SEQ ID NO: 1680059 - DNA, 16 bp, Homo sapiens
gacaccctctgggggt

SEQ ID NO: 1680060 - DNA, 21 bp, Homo sapiens
gacaccctggcctgaactgag

SEQ ID NO: 1680061 - DNA, 20 bp, Homo sapiens
gacaccctggtcctgacttc

SEQ ID NO: 1680062 - DNA, 17 bp, Homo sapiens
gacaccgtttgtccccc

SEQ ID NO: 1680063 - DNA, 23 bp, Homo sapiens
gacacctaactcttttctatttt

SEQ ID NO: 1680064 - DNA, 16 bp, Homo sapiens
gacacctaccatgctg

SEQ ID NO: 1680065 - DNA, 18 bp, Homo sapiens
gacacctaccatgctgct

SEQ ID NO: 1680066 - DNA, 19 bp, Homo sapiens
gacacctaccatgctgctt

SEQ ID NO: 1680067 - DNA, 23 bp, Homo sapiens
gacacctccccctttcacactgg

SEQ ID NO: 1680068 - DNA, 17 bp, Homo sapiens
gacacctgaaccctcca

SEQ ID NO: 1680069 - DNA, 13 bp, Homo sapiens
gacacctgcacct

SEQ ID NO: 1680070 - DNA, 22 bp, Homo sapiens
gacacctgcacctccccccact

SEQ ID NO: 1680071 - DNA, 12 bp, Homo sapiens
gacacctgggag

SEQ ID NO: 1680072 - DNA, 16 bp, Homo sapiens
gacacctgtacattct

SEQ ID NO: 1680073 - DNA, 15 bp, Homo sapiens
gaccaccctgagccg

SEQ ID NO: 1680074 - DNA, 20 bp, Homo sapiens
gaccacctgcttctgaactc

SEQ ID NO: 1680075 - DNA, 22 bp, Homo sapiens
gaccacgcccgtcctgcctgtg

SEQ ID NO: 1680076 - DNA, 18 bp, Homo sapiens
gaccactgaattcactcc

SEQ ID NO: 1680077 - DNA, 17 bp, Homo sapiens
gaccactgggtgagaga

SEQ ID NO: 1680078 - DNA, 17 bp, Homo sapiens
gaccacttgaggcctga

SEQ ID NO: 1680079 - DNA, 21 bp, Homo sapiens
gaccagaaatcaaaaagggaa

SEQ ID NO: 1680080 - DNA, 16 bp, Homo sapiens
gaccagaatgaaaact

SEQ ID NO: 1680081 - DNA, 16 bp, Homo sapiens
gaccagagccagatgc

SEQ ID NO: 1680082 - DNA, 21 bp, Homo sapiens
gaccagagccccacacggagg

SEQ ID NO: 1680083 - DNA, 19 bp, Homo sapiens
gaccagatctttctcttcc

SEQ ID NO: 1680084 - DNA, 23 bp, Homo sapiens
gaccagatctttctcttccctga

SEQ ID NO: 1680085 - DNA, 16 bp, Homo sapiens
gaccagatgtccgtct

SEQ ID NO: 1680086 - DNA, 15 bp, Homo sapiens
gaccagcagacagag

SEQ ID NO: 1680087 - DNA, 19 bp, Homo sapiens
gaccagcagacagagccag

SEQ ID NO: 1680088 - DNA, 19 bp, Homo sapiens
gaccagcctgtaccttgct

SEQ ID NO: 1680089 - DNA, 19 bp, Homo sapiens
gaccagcctgtccaacatg

SEQ ID NO: 1680090 - DNA, 13 bp, Homo sapiens
gaccagctctctt

SEQ ID NO: 1680091 - DNA, 16 bp, Homo sapiens
gaccagctctcttcct

SEQ ID NO: 1680092 - DNA, 20 bp, Homo sapiens
gaccagctgctccgaggacc

SEQ ID NO: 1680093 - DNA, 21 bp, Homo sapiens
gaccagctgctccgaggaccc

SEQ ID NO: 1680094 - DNA, 13 bp, Homo sapiens
gaccagctggggc

SEQ ID NO: 1680095 - DNA, 16 bp, Homo sapiens
gaccaggacaggacca

SEQ ID NO: 1680096 - DNA, 17 bp, Homo sapiens
gaccaggactccctcct

SEQ ID NO: 1680097 - DNA, 19 bp, Homo sapiens
gaccaggactccctcctca

SEQ ID NO: 1680098 - DNA, 21 bp, Homo sapiens
gaccaggactccctcctcacc

SEQ ID NO: 1680099 - DNA, 10 bp, Homo sapiens
gaccaggagc

SEQ ID NO: 1680100 - DNA, 15 bp, Homo sapiens
gaccaggagctagcc

SEQ ID NO: 1680101 - DNA, 12 bp, Homo sapiens
gaccaggatccc

SEQ ID NO: 1680102 - DNA, 16 bp, Homo sapiens
gaccccagctgggagg

SEQ ID NO: 1680103 - DNA, 17 bp, Homo sapiens
gaccccaggacctcttc

SEQ ID NO: 1680104 - DNA, 23 bp, Homo sapiens
gaccccagtcgtgatgtggagga

SEQ ID NO: 1680105 - DNA, 12 bp, Homo sapiens
gaccccatctct

SEQ ID NO: 1680106 - DNA, 19 bp, Homo sapiens
gacccccaagcttccacct

SEQ ID NO: 1680107 - DNA, 23 bp, Homo sapiens
gacccccactctcattccccagg

SEQ ID NO: 1680108 - DNA, 11 bp, Homo sapiens
gacccccaggc

SEQ ID NO: 1680109 - DNA, 20 bp, Homo sapiens
gacccccatccagcctccag

SEQ ID NO: 1680110 - DNA, 12 bp, Homo sapiens
gaccccccaccc

SEQ ID NO: 1680111 - DNA, 15 bp, Homo sapiens
gacccccgtggggca

SEQ ID NO: 1680112 - DNA, 17 bp, Homo sapiens
gaccccctggccctgcc

SEQ ID NO: 1680113 - DNA, 15 bp, Homo sapiens
gaccccgcacccggc

SEQ ID NO: 1680114 - DNA, 20 bp, Homo sapiens
gaccccgcacccggctcgtg

SEQ ID NO: 1680115 - DNA, 17 bp, Homo sapiens
gaccccgcaggatccct

SEQ ID NO: 1680116 - DNA, 20 bp, Homo sapiens
gaccccgcaggatccctcct

SEQ ID NO: 1680117 - DNA, 22 bp, Homo sapiens
gaccccgcaggatccctcctga

SEQ ID NO: 1680118 - DNA, 23 bp, Homo sapiens
gacccctcccctcccacccacag

SEQ ID NO: 1680119 - DNA, 16 bp, Homo sapiens
gacccctctggccagg

SEQ ID NO: 1680120 - DNA, 11 bp, Homo sapiens
gacccctgcct

SEQ ID NO: 1680121 - DNA, 13 bp, Homo sapiens
gacccctgcctgg

SEQ ID NO: 1680122 - DNA, 23 bp, Homo sapiens
gacccctgctcagtaaagcactt

SEQ ID NO: 1680123 - DNA, 14 bp, Homo sapiens
gacccctgggagct

SEQ ID NO: 1680124 - DNA, 19 bp, Homo sapiens
gaccccttttagtcaggag

SEQ ID NO: 1680125 - DNA, 23 bp, Homo sapiens
gacccgccagccccgctcccacc

SEQ ID NO: 1680126 - DNA, 16 bp, Homo sapiens
gacccggcggccctgc

SEQ ID NO: 1680127 - DNA, 14 bp, Homo sapiens
gacccgggaaggaa

SEQ ID NO: 1680128 - DNA, 17 bp, Homo sapiens
gacccggggtctcctgg

SEQ ID NO: 1680129 - DNA, 15 bp, Homo sapiens
gaccctaaatctgag

SEQ ID NO: 1680130 - DNA, 17 bp, Homo sapiens
gaccctaaatctgagga

SEQ ID NO: 1680131 - DNA, 11 bp, Homo sapiens
gaccctacccc

SEQ ID NO: 1680132 - DNA, 16 bp, Homo sapiens
gaccctaccccaccac

SEQ ID NO: 1680133 - DNA, 18 bp, Homo sapiens
gaccctatgggtctagga

SEQ ID NO: 1680134 - DNA, 20 bp, Homo sapiens
gaccctatgggtctaggaca

SEQ ID NO: 1680135 - DNA, 22 bp, Homo sapiens
gaccctcaggaattcagtgcct

SEQ ID NO: 1680136 - DNA, 20 bp, Homo sapiens
gaccctcatggcccccaggg

SEQ ID NO: 1680137 - DNA, 15 bp, Homo sapiens
gaccctccagtgctg

SEQ ID NO: 1680138 - DNA, 13 bp, Homo sapiens
gaccctcccatgg

SEQ ID NO: 1680139 - DNA, 15 bp, Homo sapiens
gaccctccccgcacc

SEQ ID NO: 1680140 - DNA, 19 bp, Homo sapiens
gaccctcctcctcccccag

SEQ ID NO: 1680141 - DNA, 22 bp, Homo sapiens
gaccctcctcctcccccagagg

SEQ ID NO: 1680142 - DNA, 20 bp, Homo sapiens
gaccctctgaccctagctct

SEQ ID NO: 1680143 - DNA, 16 bp, Homo sapiens
gaccctctttcttgtt

SEQ ID NO: 1680144 - DNA, 16 bp, Homo sapiens
gaccctgaaggggcca

SEQ ID NO: 1680145 - DNA, 20 bp, Homo sapiens
gaccctgacctccgcccctg

SEQ ID NO: 1680146 - DNA, 16 bp, Homo sapiens
gaccctgagactccag

SEQ ID NO: 1680147 - DNA, 17 bp, Homo sapiens
gaccctgagactccaga

SEQ ID NO: 1680148 - DNA, 16 bp, Homo sapiens
gaccctgcctgagccc

SEQ ID NO: 1680149 - DNA, 17 bp, Homo sapiens
gaccctgcctgagccca

SEQ ID NO: 1680150 - DNA, 22 bp, Homo sapiens
gaccctgcgaaggggccctggt

SEQ ID NO: 1680151 - DNA, 23 bp, Homo sapiens
gaccctggaattcagcaccctgg

SEQ ID NO: 1680152 - DNA, 20 bp, Homo sapiens
gaccctgggcaaacagagct

SEQ ID NO: 1680153 - DNA, 17 bp, Homo sapiens
gaccctgggcagggact

SEQ ID NO: 1680154 - DNA, 20 bp, Homo sapiens
gaccctggtgggctgttcag

SEQ ID NO: 1680155 - DNA, 18 bp, Homo sapiens
gaccctggtggtacctgt

SEQ ID NO: 1680156 - DNA, 23 bp, Homo sapiens
gaccctgtccggcccagtgccac

SEQ ID NO: 1680157 - DNA, 17 bp, Homo sapiens
gaccctgtcttctgggc

SEQ ID NO: 1680158 - DNA, 20 bp, Homo sapiens
gaccctgtgacatggtgcct

SEQ ID NO: 1680159 - DNA, 17 bp, Homo sapiens
gacccttataaaatcct

SEQ ID NO: 1680160 - DNA, 17 bp, Homo sapiens
gacccttccagacatac

SEQ ID NO: 1680161 - DNA, 23 bp, Homo sapiens
gacccttcccaatcagcactgaa

SEQ ID NO: 1680162 - DNA, 20 bp, Homo sapiens
gaccctttccttccttccct

SEQ ID NO: 1680163 - DNA, 23 bp, Homo sapiens
gaccgaaatctgtattctgtttg

SEQ ID NO: 1680164 - DNA, 16 bp, Homo sapiens
gaccgagcccagcaga

SEQ ID NO: 1680165 - DNA, 17 bp, Homo sapiens
gaccgagccctggagag

SEQ ID NO: 1680166 - DNA, 18 bp, Homo sapiens
gaccgaggacacagtgga

SEQ ID NO: 1680167 - DNA, 14 bp, Homo sapiens
gaccgccccagggc

SEQ ID NO: 1680168 - DNA, 12 bp, Homo sapiens
gaccgcgcaggc

SEQ ID NO: 1680169 - DNA, 17 bp, Homo sapiens
gaccgcttcacccctgc

SEQ ID NO: 1680170 - DNA, 19 bp, Homo sapiens
gaccgcttcacccctgcac

SEQ ID NO: 1680171 - DNA, 17 bp, Homo sapiens
gaccggacttttctgca

SEQ ID NO: 1680172 - DNA, 20 bp, Homo sapiens
gaccgggacccggcggccct

SEQ ID NO: 1680173 - DNA, 15 bp, Homo sapiens
gaccgggtgggcctg

SEQ ID NO: 1680174 - DNA, 14 bp, Homo sapiens
gaccgtggacaggc

SEQ ID NO: 1680175 - DNA, 17 bp, Homo sapiens
gaccgtggccctgccct

SEQ ID NO: 1680176 - DNA, 16 bp, Homo sapiens
gaccgtgtcccaagga

SEQ ID NO: 1680177 - DNA, 14 bp, Homo sapiens
gaccgttaaaaaat

SEQ ID NO: 1680178 - DNA, 19 bp, Homo sapiens
gacctaaatccattttcta

SEQ ID NO: 1680179 - DNA, 17 bp, Homo sapiens
gacctacagacctggct

SEQ ID NO: 1680180 - DNA, 19 bp, Homo sapiens
gacctacctgcagtgggaa

SEQ ID NO: 1680181 - DNA, 19 bp, Homo sapiens
gacctagctctttgggcct

SEQ ID NO: 1680182 - DNA, 14 bp, Homo sapiens
gacctaggcaagtt

SEQ ID NO: 1680183 - DNA, 20 bp, Homo sapiens
gacctagggatgttctggcc

SEQ ID NO: 1680184 - DNA, 23 bp, Homo sapiens
gacctagggatgttctggccctc

SEQ ID NO: 1680185 - DNA, 18 bp, Homo sapiens
gacctagtcccctttcct

SEQ ID NO: 1680186 - DNA, 23 bp, Homo sapiens
gacctataaatcattaagacaac

SEQ ID NO: 1680187 - DNA, 23 bp, Homo sapiens
gacctatgtcctaaggacacact

SEQ ID NO: 1680188 - DNA, 16 bp, Homo sapiens
gacctcacagtgaccc

SEQ ID NO: 1680189 - DNA, 16 bp, Homo sapiens
gacctcacctaggaag

SEQ ID NO: 1680190 - DNA, 16 bp, Homo sapiens
gacctcactgtcctgt

SEQ ID NO: 1680191 - DNA, 18 bp, Homo sapiens
gacctcactgtcctgtga

SEQ ID NO: 1680192 - DNA, 16 bp, Homo sapiens
gacctcactgtgacct

SEQ ID NO: 1680193 - DNA, 12 bp, Homo sapiens
gacctcagcctg

SEQ ID NO: 1680194 - DNA, 16 bp, Homo sapiens
gacctcagcctgtgct

SEQ ID NO: 1680195 - DNA, 15 bp, Homo sapiens
gacctcagctgcaca

SEQ ID NO: 1680196 - DNA, 19 bp, Homo sapiens
gacctcagctgcacattcc

SEQ ID NO: 1680197 - DNA, 20 bp, Homo sapiens
gacctcatcattaataagtg

SEQ ID NO: 1680198 - DNA, 12 bp, Homo sapiens
gacctcatgccc

SEQ ID NO: 1680199 - DNA, 16 bp, Homo sapiens
gacctcatgcccagct

SEQ ID NO: 1680200 - DNA, 17 bp, Homo sapiens
gacctcatgcccagctc

SEQ ID NO: 1680201 - DNA, 19 bp, Homo sapiens
gacctcatgcccagctctc

SEQ ID NO: 1680202 - DNA, 13 bp, Homo sapiens
gacctccagtgag

SEQ ID NO: 1680203 - DNA, 18 bp, Homo sapiens
gacctccagtgagtacct

SEQ ID NO: 1680204 - DNA, 19 bp, Homo sapiens
gacctccagtgagtacctg

SEQ ID NO: 1680205 - DNA, 13 bp, Homo sapiens
gacctccccaccc

SEQ ID NO: 1680206 - DNA, 19 bp, Homo sapiens
gacctccccacccgctccc

SEQ ID NO: 1680207 - DNA, 18 bp, Homo sapiens
gacctccgcccctgcccc

SEQ ID NO: 1680208 - DNA, 20 bp, Homo sapiens
gacctccttagccctgtctg

SEQ ID NO: 1680209 - DNA, 15 bp, Homo sapiens
gacctcgtcctcccc

SEQ ID NO: 1680210 - DNA, 20 bp, Homo sapiens
gacctctcagcatagcctgc

SEQ ID NO: 1680211 - DNA, 22 bp, Homo sapiens
gacctctcagcatagcctgcct

SEQ ID NO: 1680212 - DNA, 23 bp, Homo sapiens
gacctctcagcatagcctgcctg

SEQ ID NO: 1680213 - DNA, 21 bp, Homo sapiens
gacctctgcttttgcacacct

SEQ ID NO: 1680214 - DNA, 15 bp, Homo sapiens
gacctcttccctctg

SEQ ID NO: 1680215 - DNA, 18 bp, Homo sapiens
gacctctttactctctcc

SEQ ID NO: 1680216 - DNA, 17 bp, Homo sapiens
gacctgaaattccaaag

SEQ ID NO: 1680217 - DNA, 19 bp, Homo sapiens
gacctgaaattccaaagtc

SEQ ID NO: 1680218 - DNA, 21 bp, Homo sapiens
gacctgaatgcttctgagagc

SEQ ID NO: 1680219 - DNA, 17 bp, Homo sapiens
gacctgagagcatctca

SEQ ID NO: 1680220 - DNA, 16 bp, Homo sapiens
gacctgagatgtgtga

SEQ ID NO: 1680221 - DNA, 14 bp, Homo sapiens
gacctgaggctgtg

SEQ ID NO: 1680222 - DNA, 12 bp, Homo sapiens
gacctgagtatt

SEQ ID NO: 1680223 - DNA, 14 bp, Homo sapiens
gacctgagtatttt

SEQ ID NO: 1680224 - DNA, 19 bp, Homo sapiens
gacctgagtattttttata

SEQ ID NO: 1680225 - DNA, 16 bp, Homo sapiens
gacctgagtcggcccc

SEQ ID NO: 1680226 - DNA, 18 bp, Homo sapiens
gacctgatcctggaggcc

SEQ ID NO: 1680227 - DNA, 13 bp, Homo sapiens
gacctgcaggcca

SEQ ID NO: 1680228 - DNA, 19 bp, Homo sapiens
gacctgcatccttcctggg

SEQ ID NO: 1680229 - DNA, 22 bp, Homo sapiens
gacctgcatccttcctggggac

SEQ ID NO: 1680230 - DNA, 15 bp, Homo sapiens
gacctgccaggcagg

SEQ ID NO: 1680231 - DNA, 16 bp, Homo sapiens
gacctgccaggcaggg

SEQ ID NO: 1680232 - DNA, 20 bp, Homo sapiens
gacctgccaggcaggggtgg

SEQ ID NO: 1680233 - DNA, 21 bp, Homo sapiens
gacctgccaggcaggggtggg

SEQ ID NO: 1680234 - DNA, 13 bp, Homo sapiens
gacctgcctcctg

SEQ ID NO: 1680235 - DNA, 16 bp, Homo sapiens
gacctgcctcctgcct

SEQ ID NO: 1680236 - DNA, 23 bp, Homo sapiens
gacctgcctcctgcctgcccctc

SEQ ID NO: 1680237 - DNA, 18 bp, Homo sapiens
gacctgcctgcataggag

SEQ ID NO: 1680238 - DNA, 21 bp, Homo sapiens
gacctgctgagggaccagcca

SEQ ID NO: 1680239 - DNA, 11 bp, Homo sapiens
gacctgctgct

SEQ ID NO: 1680240 - DNA, 22 bp, Homo sapiens
gacctgctgctccatggatgca

SEQ ID NO: 1680241 - DNA, 17 bp, Homo sapiens
gacctgcttagctgcct

SEQ ID NO: 1680242 - DNA, 17 bp, Homo sapiens
gacctggaaccagagcc

SEQ ID NO: 1680243 - DNA, 14 bp, Homo sapiens
gacctggagcccct

SEQ ID NO: 1680244 - DNA, 15 bp, Homo sapiens
gacctggagcccctg

SEQ ID NO: 1680245 - DNA, 17 bp, Homo sapiens
gacctggagcccctggg

SEQ ID NO: 1680246 - DNA, 15 bp, Homo sapiens
gacctggcagctctg

SEQ ID NO: 1680247 - DNA, 20 bp, Homo sapiens
gacctggcatctaattctga

SEQ ID NO: 1680248 - DNA, 17 bp, Homo sapiens
gacctggcgtgctcaga

SEQ ID NO: 1680249 - DNA, 19 bp, Homo sapiens
gacctggtaccctcctggc

SEQ ID NO: 1680250 - DNA, 20 bp, Homo sapiens
gacctggttggccgtggtcc

SEQ ID NO: 1680251 - DNA, 17 bp, Homo sapiens
gacctgtaacttttgta

SEQ ID NO: 1680252 - DNA, 21 bp, Homo sapiens
gacctgtatatttgtaaagct

SEQ ID NO: 1680253 - DNA, 23 bp, Homo sapiens
gacctgtatatttgtaaagctat

SEQ ID NO: 1680254 - DNA, 19 bp, Homo sapiens
gacctgtcatgcccccctc

SEQ ID NO: 1680255 - DNA, 12 bp, Homo sapiens
gacctgtgacca

SEQ ID NO: 1680256 - DNA, 19 bp, Homo sapiens
gacctgtgctagttttaca

SEQ ID NO: 1680257 - DNA, 17 bp, Homo sapiens
gacctgtttatgagatg

SEQ ID NO: 1680258 - DNA, 21 bp, Homo sapiens
gaccttagaaatcattgtaga

SEQ ID NO: 1680259 - DNA, 18 bp, Homo sapiens
gaccttcatgcccttctg

SEQ ID NO: 1680260 - DNA, 22 bp, Homo sapiens
gaccttccataatgctactgtc

SEQ ID NO: 1680261 - DNA, 16 bp, Homo sapiens
gaccttccctccgcct

SEQ ID NO: 1680262 - DNA, 23 bp, Homo sapiens
gaccttccctccgccttctccca

SEQ ID NO: 1680263 - DNA, 23 bp, Homo sapiens
gaccttcctcatccaccccatcc

SEQ ID NO: 1680264 - DNA, 18 bp, Homo sapiens
gaccttcgggctgtgccc

SEQ ID NO: 1680265 - DNA, 16 bp, Homo sapiens
gaccttgacagagcag

SEQ ID NO: 1680266 - DNA, 16 bp, Homo sapiens
gaccttggagagacac

SEQ ID NO: 1680267 - DNA, 18 bp, Homo sapiens
gaccttggagagacacag

SEQ ID NO: 1680268 - DNA, 17 bp, Homo sapiens
gaccttgggcacatctg

SEQ ID NO: 1680269 - DNA, 18 bp, Homo sapiens
gaccttgggcacatctgc

SEQ ID NO: 1680270 - DNA, 21 bp, Homo sapiens
gacctttcatcgtaaagtgct

SEQ ID NO: 1680271 - DNA, 15 bp, Homo sapiens
gaccttttcccttgc

SEQ ID NO: 1680272 - DNA, 17 bp, Homo sapiens
gaccttttcccttgctg

SEQ ID NO: 1680273 - DNA, 21 bp, Homo sapiens
gacgaagcggagagagccaag

SEQ ID NO: 1680274 - DNA, 14 bp, Homo sapiens
gacgacctttacct

SEQ ID NO: 1680275 - DNA, 24 bp, Homo sapiens
gacgagacccccatccagcctcca

SEQ ID NO: 1680276 - DNA, 18 bp, Homo sapiens
gacgagagggctgtgagc

SEQ ID NO: 1680277 - DNA, 13 bp, Homo sapiens
gacgaggcagggg

SEQ ID NO: 1680278 - DNA, 15 bp, Homo sapiens
gacgaggcaggggct

SEQ ID NO: 1680279 - DNA, 20 bp, Homo sapiens
gacgaggcaggggctctgct

SEQ ID NO: 1680280 - DNA, 18 bp, Homo sapiens
gacgaggggtgtcttggg

SEQ ID NO: 1680281 - DNA, 12 bp, Homo sapiens
gacgcagcagct

SEQ ID NO: 1680282 - DNA, 18 bp, Homo sapiens
gacgcatctcaaaacaga

SEQ ID NO: 1680283 - DNA, 14 bp, Homo sapiens
gacgcccagctccg

SEQ ID NO: 1680284 - DNA, 22 bp, Homo sapiens
gacgcccccgcccgcacagctc

SEQ ID NO: 1680285 - DNA, 23 bp, Homo sapiens
gacgcctgatggtgctgctcagg

SEQ ID NO: 1680286 - DNA, 16 bp, Homo sapiens
gacgccttccaggtca

SEQ ID NO: 1680287 - DNA, 17 bp, Homo sapiens
gacgccttccaggtcag

SEQ ID NO: 1680288 - DNA, 16 bp, Homo sapiens
gacgcttgtgacagtg

SEQ ID NO: 1680289 - DNA, 13 bp, Homo sapiens
gacgctttgtctg

SEQ ID NO: 1680290 - DNA, 15 bp, Homo sapiens
gacggaagtaaatta

SEQ ID NO: 1680291 - DNA, 14 bp, Homo sapiens
gacggacatccagg

SEQ ID NO: 1680292 - DNA, 19 bp, Homo sapiens
gacggcacgcacttgcctg

SEQ ID NO: 1680293 - DNA, 20 bp, Homo sapiens
gacggcaggctcactgccag

SEQ ID NO: 1680294 - DNA, 23 bp, Homo sapiens
gacggcctgatgctccctcccct

SEQ ID NO: 1680295 - DNA, 17 bp, Homo sapiens
gacggcgcccccagtgt

SEQ ID NO: 1680296 - DNA, 12 bp, Homo sapiens
gacggcggccag

SEQ ID NO: 1680297 - DNA, 13 bp, Homo sapiens
gacggcggccagg

SEQ ID NO: 1680298 - DNA, 14 bp, Homo sapiens
gacggcggccaggc

SEQ ID NO: 1680299 - DNA, 20 bp, Homo sapiens
gacggctgtgacgcagccgg

SEQ ID NO: 1680300 - DNA, 14 bp, Homo sapiens
gacggctgtggacc

SEQ ID NO: 1680301 - DNA, 23 bp, Homo sapiens
gacggctgtggaccgtggacagg

SEQ ID NO: 1680302 - DNA, 10 bp, Homo sapiens
gacgggcaca

SEQ ID NO: 1680303 - DNA, 13 bp, Homo sapiens
gacgggcacagac

SEQ ID NO: 1680304 - DNA, 19 bp, Homo sapiens
gacgggccacacgtggctg

SEQ ID NO: 1680305 - DNA, 13 bp, Homo sapiens
gacggggctcagc

SEQ ID NO: 1680306 - DNA, 17 bp, Homo sapiens
gacgggtattgttggga

SEQ ID NO: 1680307 - DNA, 22 bp, Homo sapiens
gacgggtgcccgtaatcccagc

SEQ ID NO: 1680308 - DNA, 22 bp, Homo sapiens
gacgggttcaccatgttgccca

SEQ ID NO: 1680309 - DNA, 21 bp, Homo sapiens
gacggtattaaaatggagcga

SEQ ID NO: 1680310 - DNA, 18 bp, Homo sapiens
gacggtgccaagggcccc

SEQ ID NO: 1680311 - DNA, 23 bp, Homo sapiens
gacggtgcccaagccagaggctg

SEQ ID NO: 1680312 - DNA, 20 bp, Homo sapiens
gacggtgttaattttgctaa

SEQ ID NO: 1680313 - DNA, 23 bp, Homo sapiens
gacggtgttttgccatgttggcc

SEQ ID NO: 1680314 - DNA, 17 bp, Homo sapiens
gacggttaacttgtata

SEQ ID NO: 1680315 - DNA, 20 bp, Homo sapiens
gacggttaacttgtatattc

SEQ ID NO: 1680316 - DNA, 15 bp, Homo sapiens
gacggttcaccagcc

SEQ ID NO: 1680317 - DNA, 14 bp, Homo sapiens
gacggttttgcttt

SEQ ID NO: 1680318 - DNA, 17 bp, Homo sapiens
gacgtcagcctcttacc

SEQ ID NO: 1680319 - DNA, 22 bp, Homo sapiens
gacgtcagtagtttgagaccag

SEQ ID NO: 1680320 - DNA, 19 bp, Homo sapiens
gacgtctggggtgtgggga

SEQ ID NO: 1680321 - DNA, 11 bp, Homo sapiens
gacgtgaaata

SEQ ID NO: 1680322 - DNA, 13 bp, Homo sapiens
gacgtgaaatact

SEQ ID NO: 1680323 - DNA, 19 bp, Homo sapiens
gacgtgaaatacttcgatg

SEQ ID NO: 1680324 - DNA, 11 bp, Homo sapiens
gacgtgcactg

SEQ ID NO: 1680325 - DNA, 22 bp, Homo sapiens
gacgtgcactgtgaatcctggc

SEQ ID NO: 1680326 - DNA, 17 bp, Homo sapiens
gacgtggacatgcctca

SEQ ID NO: 1680327 - DNA, 15 bp, Homo sapiens
gacgtggactcctct

SEQ ID NO: 1680328 - DNA, 18 bp, Homo sapiens
gacgtgggaatttcaatg

SEQ ID NO: 1680329 - DNA, 20 bp, Homo sapiens
gacgtggtcagggcagggct

SEQ ID NO: 1680330 - DNA, 16 bp, Homo sapiens
gacgtgtgtggctggg

SEQ ID NO: 1680331 - DNA, 19 bp, Homo sapiens
gacgtgtgtggctgggacc

SEQ ID NO: 1680332 - DNA, 13 bp, Homo sapiens
gacgtttccatca

SEQ ID NO: 1680333 - DNA, 13 bp, Homo sapiens
gacgtttctggaa

SEQ ID NO: 1680334 - DNA, 18 bp, Homo sapiens
gactacacccaagcctga

SEQ ID NO: 1680335 - DNA, 21 bp, Homo sapiens
gactaccccagtcccagggaa

SEQ ID NO: 1680336 - DNA, 15 bp, Homo sapiens
gactaccgcaggccc

SEQ ID NO: 1680337 - DNA, 17 bp, Homo sapiens
gactactgctcctgtgg

SEQ ID NO: 1680338 - DNA, 18 bp, Homo sapiens
gactactgctcctgtggc

SEQ ID NO: 1680339 - DNA, 14 bp, Homo sapiens
gactactgttcagc

SEQ ID NO: 1680340 - DNA, 19 bp, Homo sapiens
gactagaagattagaaact

SEQ ID NO: 1680341 - DNA, 15 bp, Homo sapiens
gactagaagggccag

SEQ ID NO: 1680342 - DNA, 15 bp, Homo sapiens
gactagaggcaggga

SEQ ID NO: 1680343 - DNA, 16 bp, Homo sapiens
gactagaggcagggag

SEQ ID NO: 1680344 - DNA, 17 bp, Homo sapiens
gactagaggcagggagg

SEQ ID NO: 1680345 - DNA, 16 bp, Homo sapiens
gactagaggcttgcat

SEQ ID NO: 1680346 - DNA, 17 bp, Homo sapiens
gactagatgtagtattt

SEQ ID NO: 1680347 - DNA, 19 bp, Homo sapiens
gactagcctggccaacatg

SEQ ID NO: 1680348 - DNA, 20 bp, Homo sapiens
gactagggattcaggctgct

SEQ ID NO: 1680349 - DNA, 15 bp, Homo sapiens
gactataaagctgtt

SEQ ID NO: 1680350 - DNA, 19 bp, Homo sapiens
gactatatatataaatgta

SEQ ID NO: 1680351 - DNA, 17 bp, Homo sapiens
gactatgcagaggcctg

SEQ ID NO: 1680352 - DNA, 18 bp, Homo sapiens
gactatgccgtcttctgc

SEQ ID NO: 1680353 - DNA, 15 bp, Homo sapiens
gactatggagctgag

SEQ ID NO: 1680354 - DNA, 22 bp, Homo sapiens
gactattcaaacagtctcagga

SEQ ID NO: 1680355 - DNA, 18 bp, Homo sapiens
gactattccttttctgta

SEQ ID NO: 1680356 - DNA, 20 bp, Homo sapiens
gactattgtgccaactgcca

SEQ ID NO: 1680357 - DNA, 15 bp, Homo sapiens
gactcaaatgttcta

SEQ ID NO: 1680358 - DNA, 16 bp, Homo sapiens
gactcaaatgttctaa

SEQ ID NO: 1680359 - DNA, 17 bp, Homo sapiens
gactcaaatgttctaag

SEQ ID NO: 1680360 - DNA, 18 bp, Homo sapiens
gactcaaatgttctaagt

SEQ ID NO: 1680361 - DNA, 23 bp, Homo sapiens
gactcaaatgttctaagtttcta

SEQ ID NO: 1680362 - DNA, 20 bp, Homo sapiens
gactcaagaagtgaagaatg

SEQ ID NO: 1680363 - DNA, 23 bp, Homo sapiens
gactcaagaggaatctgtttctc

SEQ ID NO: 1680364 - DNA, 14 bp, Homo sapiens
gactcaagtaccca

SEQ ID NO: 1680365 - DNA, 19 bp, Homo sapiens
gactcaagtacccattctg

SEQ ID NO: 1680366 - DNA, 22 bp, Homo sapiens
gactcaagtacccattctgttt

SEQ ID NO: 1680367 - DNA, 23 bp, Homo sapiens
gactcacacctgaactgaacacc

SEQ ID NO: 1680368 - DNA, 20 bp, Homo sapiens
gactcaccaacttgccacat

SEQ ID NO: 1680369 - DNA, 12 bp, Homo sapiens
gactcacctctg

SEQ ID NO: 1680370 - DNA, 14 bp, Homo sapiens
gactcacctctgcc

SEQ ID NO: 1680371 - DNA, 15 bp, Homo sapiens
gactcacctctgcct

SEQ ID NO: 1680372 - DNA, 17 bp, Homo sapiens
gactcacctctgcctca

SEQ ID NO: 1680373 - DNA, 18 bp, Homo sapiens
gactcacctctgcctcaa

SEQ ID NO: 1680374 - DNA, 15 bp, Homo sapiens
gactcagaaactcca

SEQ ID NO: 1680375 - DNA, 16 bp, Homo sapiens
gactcagaaactccat

SEQ ID NO: 1680376 - DNA, 15 bp, Homo sapiens
gactcagccctgagg

SEQ ID NO: 1680377 - DNA, 20 bp, Homo sapiens
gactcaggagtctgccactt

SEQ ID NO: 1680378 - DNA, 16 bp, Homo sapiens
gactcaggatgcccag

SEQ ID NO: 1680379 - DNA, 18 bp, Homo sapiens
gactcaggatgcccaggg

SEQ ID NO: 1680380 - DNA, 23 bp, Homo sapiens
gactcaggatttaaaaactggaa

SEQ ID NO: 1680381 - DNA, 22 bp, Homo sapiens
gactcagggaccggtgctgcag

SEQ ID NO: 1680382 - DNA, 24 bp, Homo sapiens
gactcagggaccggtgctgcagga

SEQ ID NO: 1680383 - DNA, 21 bp, Homo sapiens
gactcagggccatgcctgccc

SEQ ID NO: 1680384 - DNA, 14 bp, Homo sapiens
gactcagggcccca

SEQ ID NO: 1680385 - DNA, 17 bp, Homo sapiens
gactcagggccccagca

SEQ ID NO: 1680386 - DNA, 20 bp, Homo sapiens
gactcaggtgggccctctga

SEQ ID NO: 1680387 - DNA, 15 bp, Homo sapiens
gactcagtgagctgg

SEQ ID NO: 1680388 - DNA, 20 bp, Homo sapiens
gactcagtgcagatggagag

SEQ ID NO: 1680389 - DNA, 12 bp, Homo sapiens
gactcagtgttc

SEQ ID NO: 1680390 - DNA, 23 bp, Homo sapiens
gactcatcctgatttttactatc

SEQ ID NO: 1680391 - DNA, 12 bp, Homo sapiens
gactcatggcag

SEQ ID NO: 1680392 - DNA, 21 bp, Homo sapiens
gactcattttaaaaaatggaa

SEQ ID NO: 1680393 - DNA, 18 bp, Homo sapiens
gactccagaatctgctgt

SEQ ID NO: 1680394 - DNA, 19 bp, Homo sapiens
gactccagaatctgctgtt

SEQ ID NO: 1680395 - DNA, 12 bp, Homo sapiens
gactccagagtc

SEQ ID NO: 1680396 - DNA, 14 bp, Homo sapiens
gactccagagtctg

SEQ ID NO: 1680397 - DNA, 20 bp, Homo sapiens
gactccagagtctgagcccc

SEQ ID NO: 1680398 - DNA, 12 bp, Homo sapiens
gactccaggccc

SEQ ID NO: 1680399 - DNA, 17 bp, Homo sapiens
gactccaggcctgacca

SEQ ID NO: 1680400 - DNA, 12 bp, Homo sapiens
gactccatctca

SEQ ID NO: 1680401 - DNA, 12 bp, Homo sapiens
gactccatctct

SEQ ID NO: 1680402 - DNA, 15 bp, Homo sapiens
gactccatctcttct

SEQ ID NO: 1680403 - DNA, 15 bp, Homo sapiens
gactcccaaccctgg

SEQ ID NO: 1680404 - DNA, 17 bp, Homo sapiens
gactcccaagtttccat

SEQ ID NO: 1680405 - DNA, 12 bp, Homo sapiens
gactcccctccc

SEQ ID NO: 1680406 - DNA, 13 bp, Homo sapiens
gactccctcctca

SEQ ID NO: 1680407 - DNA, 23 bp, Homo sapiens
gactccctcctcacctctggact

SEQ ID NO: 1680408 - DNA, 19 bp, Homo sapiens
gactccgggaccattgacc

SEQ ID NO: 1680409 - DNA, 14 bp, Homo sapiens
gactcctgccctgt

SEQ ID NO: 1680410 - DNA, 12 bp, Homo sapiens
gactcctgctgg

SEQ ID NO: 1680411 - DNA, 16 bp, Homo sapiens
gactcctgtgcaactt

SEQ ID NO: 1680412 - DNA, 14 bp, Homo sapiens
gactcctgtggaga

SEQ ID NO: 1680413 - DNA, 22 bp, Homo sapiens
gactcctgtggagatgacttgg

SEQ ID NO: 1680414 - DNA, 22 bp, Homo sapiens
gactcctgttgccatggattca

SEQ ID NO: 1680415 - DNA, 13 bp, Homo sapiens
gactcgactctgt

SEQ ID NO: 1680416 - DNA, 13 bp, Homo sapiens
gactcggtttctc

SEQ ID NO: 1680417 - DNA, 19 bp, Homo sapiens
gactctacctcatatcagt

SEQ ID NO: 1680418 - DNA, 16 bp, Homo sapiens
gactctagagtccaag

SEQ ID NO: 1680419 - DNA, 12 bp, Homo sapiens
gactctcaggga

SEQ ID NO: 1680420 - DNA, 15 bp, Homo sapiens
gactctcccaggcct

SEQ ID NO: 1680421 - DNA, 13 bp, Homo sapiens
gactctcctcctc

SEQ ID NO: 1680422 - DNA, 16 bp, Homo sapiens
gactctcctcctcccc

SEQ ID NO: 1680423 - DNA, 18 bp, Homo sapiens
gactctcctcctcccctc

SEQ ID NO: 1680424 - DNA, 20 bp, Homo sapiens
gactctcctcctcccctcct

SEQ ID NO: 1680425 - DNA, 14 bp, Homo sapiens
gactctctgtgacc

SEQ ID NO: 1680426 - DNA, 20 bp, Homo sapiens
gactctgaaaaacattccag

SEQ ID NO: 1680427 - DNA, 20 bp, Homo sapiens
gactctgaggactcctgagg

SEQ ID NO: 1680428 - DNA, 22 bp, Homo sapiens
gactctgaggctctttctgggc

SEQ ID NO: 1680429 - DNA, 14 bp, Homo sapiens
gactctgcacatga

SEQ ID NO: 1680430 - DNA, 21 bp, Homo sapiens
gactctgcacccgcctcgacc

SEQ ID NO: 1680431 - DNA, 12 bp, Homo sapiens
gactctgggcag

SEQ ID NO: 1680432 - DNA, 16 bp, Homo sapiens
gactctgtccagctcc

SEQ ID NO: 1680433 - DNA, 16 bp, Homo sapiens
gactctgtctcaaaaa

SEQ ID NO: 1680434 - DNA, 17 bp, Homo sapiens
gactctgtggggccttg

SEQ ID NO: 1680435 - DNA, 22 bp, Homo sapiens
gactcttctaaaaatgaagatg

SEQ ID NO: 1680436 - DNA, 20 bp, Homo sapiens
gacttagcgtcaagacattt

SEQ ID NO: 1680437 - DNA, 16 bp, Homo sapiens
gacttaggttctagat

SEQ ID NO: 1680438 - DNA, 17 bp, Homo sapiens
gacttattatgcataaa

SEQ ID NO: 1680439 - DNA, 19 bp, Homo sapiens
gacttatttctgctctgga

SEQ ID NO: 1680440 - DNA, 22 bp, Homo sapiens
gagaaatgcaataactctggga

SEQ ID NO: 1680441 - DNA, 23 bp, Homo sapiens
gagaaatgtgtagctgcaaaaat

SEQ ID NO: 1680442 - DNA, 13 bp, Homo sapiens
gagaaatttttat

SEQ ID NO: 1680443 - DNA, 19 bp, Homo sapiens
gagaaatttttatttttga

SEQ ID NO: 1680444 - DNA, 17 bp, Homo sapiens
gagaacaagtcacagct

SEQ ID NO: 1680445 - DNA, 20 bp, Homo sapiens
gagaacaagtcacagctgca

SEQ ID NO: 1680446 - DNA, 17 bp, Homo sapiens
gagaacaagttgttaaa

SEQ ID NO: 1680447 - DNA, 18 bp, Homo sapiens
gagaacaggtggttttta

SEQ ID NO: 1680448 - DNA, 20 bp, Homo sapiens
gagaacagtggttgcctggg

SEQ ID NO: 1680449 - DNA, 15 bp, Homo sapiens
gagaaccaaaccgca

SEQ ID NO: 1680450 - DNA, 17 bp, Homo sapiens
gagaaccaaatctggaa

SEQ ID NO: 1680451 - DNA, 19 bp, Homo sapiens
gagaaccactacatgcagc

SEQ ID NO: 1680452 - DNA, 15 bp, Homo sapiens
gagaaccctgagcag

SEQ ID NO: 1680453 - DNA, 17 bp, Homo sapiens
gagaaccctgagcaggg

SEQ ID NO: 1680454 - DNA, 22 bp, Homo sapiens
gagaaccgagcaaagatcaaaa

SEQ ID NO: 1680455 - DNA, 18 bp, Homo sapiens
gagaacctaagtttcagt

SEQ ID NO: 1680456 - DNA, 15 bp, Homo sapiens
gagaacgccagtctc

SEQ ID NO: 1680457 - DNA, 22 bp, Homo sapiens
gagaacgccagtctcccaggcc

SEQ ID NO: 1680458 - DNA, 20 bp, Homo sapiens
gagaactcgcgctcagtaaa

SEQ ID NO: 1680459 - DNA, 21 bp, Homo sapiens
gagaactgaattttgggactt

SEQ ID NO: 1680460 - DNA, 14 bp, Homo sapiens
gagaactgaggagc

SEQ ID NO: 1680461 - DNA, 22 bp, Homo sapiens
gagaactgaggagcggactcac

SEQ ID NO: 1680462 - DNA, 22 bp, Homo sapiens
gagaactggggttcaagcccag

SEQ ID NO: 1680463 - DNA, 15 bp, Homo sapiens
gagaagaaaaatgga

SEQ ID NO: 1680464 - DNA, 15 bp, Homo sapiens
gagaagaaatagact

SEQ ID NO: 1680465 - DNA, 20 bp, Homo sapiens
gagaagaaatagcagagcct

SEQ ID NO: 1680466 - DNA, 21 bp, Homo sapiens
gagaagaattttcagacccca

SEQ ID NO: 1680467 - DNA, 21 bp, Homo sapiens
gagaagagggcccagcccaga

SEQ ID NO: 1680468 - DNA, 14 bp, Homo sapiens
gagaagagtatttt

SEQ ID NO: 1680469 - DNA, 20 bp, Homo sapiens
gagaagcaaaccgccctgca

SEQ ID NO: 1680470 - DNA, 12 bp, Homo sapiens
gagaagcaggca

SEQ ID NO: 1680471 - DNA, 18 bp, Homo sapiens
gagaagccaaaagattgg

SEQ ID NO: 1680472 - DNA, 17 bp, Homo sapiens
gagaagccacaggcctg

SEQ ID NO: 1680473 - DNA, 13 bp, Homo sapiens
gagaagccacctt

SEQ ID NO: 1680474 - DNA, 13 bp, Homo sapiens
gagaagccagcca

SEQ ID NO: 1680475 - DNA, 14 bp, Homo sapiens
gagaagccagccac

SEQ ID NO: 1680476 - DNA, 15 bp, Homo sapiens
gagaagccagccaca

SEQ ID NO: 1680477 - DNA, 23 bp, Homo sapiens
gagaagccaggaatttcccagga

SEQ ID NO: 1680478 - DNA, 14 bp, Homo sapiens
gagaagcccgtgtg

SEQ ID NO: 1680479 - DNA, 20 bp, Homo sapiens
gagaagcggtggataactag

SEQ ID NO: 1680480 - DNA, 13 bp, Homo sapiens
gagaagctcctgc

SEQ ID NO: 1680481 - DNA, 22 bp, Homo sapiens
gagaagctcctgctacttcccc

SEQ ID NO: 1680482 - DNA, 12 bp, Homo sapiens
gagaagctgaaa

SEQ ID NO: 1680483 - DNA, 17 bp, Homo sapiens
gagaagctgatccagtt

SEQ ID NO: 1680484 - DNA, 14 bp, Homo sapiens
gagaagctgcatcc

SEQ ID NO: 1680485 - DNA, 17 bp, Homo sapiens
gagaagctgctgaccaa

SEQ ID NO: 1680486 - DNA, 15 bp, Homo sapiens
gagaaggaagatagg

SEQ ID NO: 1680487 - DNA, 12 bp, Homo sapiens
gagaaggcagga

SEQ ID NO: 1680488 - DNA, 13 bp, Homo sapiens
gagaaggcaggaa

SEQ ID NO: 1680489 - DNA, 18 bp, Homo sapiens
gagaaggcatgagaaaga

SEQ ID NO: 1680490 - DNA, 20 bp, Homo sapiens
gagaaggccttacagaaaat

SEQ ID NO: 1680491 - DNA, 15 bp, Homo sapiens
gagaagggagggtgg

SEQ ID NO: 1680492 - DNA, 21 bp, Homo sapiens
gagaagggggacgtttctgga

SEQ ID NO: 1680493 - DNA, 17 bp, Homo sapiens
gagaagggggctctgcc

SEQ ID NO: 1680494 - DNA, 20 bp, Homo sapiens
gagaagggggctctgcccca

SEQ ID NO: 1680495 - DNA, 21 bp, Homo sapiens
gagaagggggctctgccccag

SEQ ID NO: 1680496 - DNA, 13 bp, Homo sapiens
gagaagggttctg

SEQ ID NO: 1680497 - DNA, 17 bp, Homo sapiens
gagaagggttctgccct

SEQ ID NO: 1680498 - DNA, 18 bp, Homo sapiens
gagaagggttctgccctg

SEQ ID NO: 1680499 - DNA, 19 bp, Homo sapiens
gagaagggttctgccctgc

SEQ ID NO: 1680500 - DNA, 19 bp, Homo sapiens
gagaaggtattagcaaagc

SEQ ID NO: 1680501 - DNA, 15 bp, Homo sapiens
gagaaggtttattgt

SEQ ID NO: 1680502 - DNA, 22 bp, Homo sapiens
gagaagtcactcacactggcca

SEQ ID NO: 1680503 - DNA, 21 bp, Homo sapiens
gagaagtctcagctaagctca

SEQ ID NO: 1680504 - DNA, 20 bp, Homo sapiens
gagaagtgaatgctgggact

SEQ ID NO: 1680505 - DNA, 15 bp, Homo sapiens
gagaagtgctccctg

SEQ ID NO: 1680506 - DNA, 19 bp, Homo sapiens
gagaagtgctccctggagg

SEQ ID NO: 1680507 - DNA, 20 bp, Homo sapiens
gagaataaaattcctatctc

SEQ ID NO: 1680508 - DNA, 20 bp, Homo sapiens
gagaataaattgatttttat

SEQ ID NO: 1680509 - DNA, 18 bp, Homo sapiens
gagaatagagctgccact

SEQ ID NO: 1680510 - DNA, 20 bp, Homo sapiens
gagaatagagctgccactgg

SEQ ID NO: 1680511 - DNA, 14 bp, Homo sapiens
gagaatagcagaga

SEQ ID NO: 1680512 - DNA, 24 bp, Homo sapiens
gagaatagcagagagccaaatctg

SEQ ID NO: 1680513 - DNA, 16 bp, Homo sapiens
gagaatagcttttact

SEQ ID NO: 1680514 - DNA, 12 bp, Homo sapiens
gagaatatatac

SEQ ID NO: 1680515 - DNA, 19 bp, Homo sapiens
gagaatatgtatgcctgca

SEQ ID NO: 1680516 - DNA, 20 bp, Homo sapiens
gagaatcacctgaaccccag

SEQ ID NO: 1680517 - DNA, 15 bp, Homo sapiens
gagaatcatgtttct

SEQ ID NO: 1680518 - DNA, 17 bp, Homo sapiens
gagaatcatgtttcttt

SEQ ID NO: 1680519 - DNA, 20 bp, Homo sapiens
gagaatcatgtttctttgat

SEQ ID NO: 1680520 - DNA, 18 bp, Homo sapiens
gagaatcctcccttccca

SEQ ID NO: 1680521 - DNA, 15 bp, Homo sapiens
gagaatctatattta

SEQ ID NO: 1680522 - DNA, 22 bp, Homo sapiens
gagaatctatatttaacaagat

SEQ ID NO: 1680523 - DNA, 13 bp, Homo sapiens
gagaatctgatca

SEQ ID NO: 1680524 - DNA, 13 bp, Homo sapiens
gagaatgagggtc

SEQ ID NO: 1680525 - DNA, 14 bp, Homo sapiens
gagaatggagacag

SEQ ID NO: 1680526 - DNA, 21 bp, Homo sapiens
gagaatggtgtgaacccggga

SEQ ID NO: 1680527 - DNA, 19 bp, Homo sapiens
gagaattagacaaatttgt

SEQ ID NO: 1680528 - DNA, 16 bp, Homo sapiens
gagaattcagtatttt

SEQ ID NO: 1680529 - DNA, 16 bp, Homo sapiens
gagaattcttacatgt

SEQ ID NO: 1680530 - DNA, 14 bp, Homo sapiens
gagaattgggggct

SEQ ID NO: 1680531 - DNA, 15 bp, Homo sapiens
gagaattgtatcatt

SEQ ID NO: 1680532 - DNA, 22 bp, Homo sapiens
gagacaaacacctcccaggaga

SEQ ID NO: 1680533 - DNA, 18 bp, Homo sapiens
gagacaagaaaggcagac

SEQ ID NO: 1680534 - DNA, 15 bp, Homo sapiens
gagacaagccctggc

SEQ ID NO: 1680535 - DNA, 13 bp, Homo sapiens
gagacacattgcc

SEQ ID NO: 1680536 - DNA, 17 bp, Homo sapiens
gagacaccatcctgagc

SEQ ID NO: 1680537 - DNA, 20 bp, Homo sapiens
gagacacctgcacctccccc

SEQ ID NO: 1680538 - DNA, 15 bp, Homo sapiens
gagacactggcccct

SEQ ID NO: 1680539 - DNA, 20 bp, Homo sapiens
gagacagacagagaaggcag

SEQ ID NO: 1680540 - DNA, 21 bp, Homo sapiens
gagacagaccacttgccacgc

SEQ ID NO: 1680541 - DNA, 22 bp, Homo sapiens
gagacagaccacttgccacgct

SEQ ID NO: 1680542 - DNA, 11 bp, Homo sapiens
gagacagcagc

SEQ ID NO: 1680543 - DNA, 17 bp, Homo sapiens
gagacagcagcctgtat

SEQ ID NO: 1680544 - DNA, 18 bp, Homo sapiens
gagacagcagcctgtatg

SEQ ID NO: 1680545 - DNA, 19 bp, Homo sapiens
gagacagcagcctgtatgt

SEQ ID NO: 1680546 - DNA, 17 bp, Homo sapiens
gagacaggacagaatgt

SEQ ID NO: 1680547 - DNA, 23 bp, Homo sapiens
gagacaggacagaatgtgttctt

SEQ ID NO: 1680548 - DNA, 22 bp, Homo sapiens
gagacaggtggcctagcaggca

SEQ ID NO: 1680549 - DNA, 18 bp, Homo sapiens
gagacagtgatgcctgcc

SEQ ID NO: 1680550 - DNA, 15 bp, Homo sapiens
gagacagttctctgt

SEQ ID NO: 1680551 - DNA, 21 bp, Homo sapiens
gagacatacttgaagggccag

SEQ ID NO: 1680552 - DNA, 11 bp, Homo sapiens
gagacatccag

SEQ ID NO: 1680553 - DNA, 17 bp, Homo sapiens
gagaccaagtcctggct

SEQ ID NO: 1680554 - DNA, 15 bp, Homo sapiens
gagaccagctcagag

SEQ ID NO: 1680555 - DNA, 22 bp, Homo sapiens
gagaccagctcagaggcccagg

SEQ ID NO: 1680556 - DNA, 12 bp, Homo sapiens
gagaggcaggca

SEQ ID NO: 1680557 - DNA, 17 bp, Homo sapiens
gagaggccaaaggctgg

SEQ ID NO: 1680558 - DNA, 15 bp, Homo sapiens
gagaggccttttgga

SEQ ID NO: 1680559 - DNA, 18 bp, Homo sapiens
gagaggcgggagaactga

SEQ ID NO: 1680560 - DNA, 17 bp, Homo sapiens
gagaggctctccgtgca

SEQ ID NO: 1680561 - DNA, 16 bp, Homo sapiens
gagaggctgcctcagc

SEQ ID NO: 1680562 - DNA, 20 bp, Homo sapiens
gagagggacactcctcctcg

SEQ ID NO: 1680563 - DNA, 19 bp, Homo sapiens
gagagggacagcccactga

SEQ ID NO: 1680564 - DNA, 15 bp, Homo sapiens
gagagggactcaagg

SEQ ID NO: 1680565 - DNA, 14 bp, Homo sapiens
gagagggagagaga

SEQ ID NO: 1680566 - DNA, 23 bp, Homo sapiens
gagagggaggtcactggaaaggg

SEQ ID NO: 1680567 - DNA, 15 bp, Homo sapiens
gagagggcccagctg

SEQ ID NO: 1680568 - DNA, 16 bp, Homo sapiens
gagagggcccagctgt

SEQ ID NO: 1680569 - DNA, 17 bp, Homo sapiens
gagagggcccagctgta

SEQ ID NO: 1680570 - DNA, 17 bp, Homo sapiens
gagagggcctctgcctg

SEQ ID NO: 1680571 - DNA, 18 bp, Homo sapiens
gagagggcctctgcctgg

SEQ ID NO: 1680572 - DNA, 20 bp, Homo sapiens
gagagggcctctgcctggga

SEQ ID NO: 1680573 - DNA, 15 bp, Homo sapiens
gagagggctggtcct

SEQ ID NO: 1680574 - DNA, 17 bp, Homo sapiens
gagaggggaagggccag

SEQ ID NO: 1680575 - DNA, 18 bp, Homo sapiens
gagaggggaagggccagt

SEQ ID NO: 1680576 - DNA, 22 bp, Homo sapiens
gagaggggacaaaacccacctt

SEQ ID NO: 1680577 - DNA, 15 bp, Homo sapiens
gagaggggctgctct

SEQ ID NO: 1680578 - DNA, 16 bp, Homo sapiens
gagagggggctctcca

SEQ ID NO: 1680579 - DNA, 22 bp, Homo sapiens
gagagtagccgagagcctgctc

SEQ ID NO: 1680580 - DNA, 14 bp, Homo sapiens
gagagtcaaagctg

SEQ ID NO: 1680581 - DNA, 16 bp, Homo sapiens
gagagtcaaagctgac

SEQ ID NO: 1680582 - DNA, 19 bp, Homo sapiens
gagagtcccagagcaggag

SEQ ID NO: 1680583 - DNA, 17 bp, Homo sapiens
gagagtctgaatatttt

SEQ ID NO: 1680584 - DNA, 22 bp, Homo sapiens
gagagtggcaggtgggctgcct

SEQ ID NO: 1680585 - DNA, 16 bp, Homo sapiens
gagagtgtgtgggcag

SEQ ID NO: 1680586 - DNA, 18 bp, Homo sapiens
gagagtgtgtgggcaggg

SEQ ID NO: 1680587 - DNA, 21 bp, Homo sapiens
gagagttggctcaggcagaca

SEQ ID NO: 1680588 - DNA, 13 bp, Homo sapiens
gagagtttcaaaa

SEQ ID NO: 1680589 - DNA, 22 bp, Homo sapiens
gagataaaacagaatcttctgg

SEQ ID NO: 1680590 - DNA, 23 bp, Homo sapiens
gagataaaacagaatcttctggg

SEQ ID NO: 1680591 - DNA, 17 bp, Homo sapiens
gagataaaagcaattct

SEQ ID NO: 1680592 - DNA, 20 bp, Homo sapiens
gagataaaccaataaatcca

SEQ ID NO: 1680593 - DNA, 21 bp, Homo sapiens
gagataaagtcaaatgccaaa

SEQ ID NO: 1680594 - DNA, 16 bp, Homo sapiens
gagataagaaaagcct

SEQ ID NO: 1680595 - DNA, 14 bp, Homo sapiens
gagataaggtttta

SEQ ID NO: 1680596 - DNA, 18 bp, Homo sapiens
gagataatatctgtgagg

SEQ ID NO: 1680597 - DNA, 18 bp, Homo sapiens
gagataattactgccttg

SEQ ID NO: 1680598 - DNA, 13 bp, Homo sapiens
gagatagcagagg

SEQ ID NO: 1680599 - DNA, 19 bp, Homo sapiens
gagatagcagaggggctcc

SEQ ID NO: 1680600 - DNA, 12 bp, Homo sapiens
gagatatatttt

SEQ ID NO: 1680601 - DNA, 15 bp, Homo sapiens
gagatatatttttaa

SEQ ID NO: 1680602 - DNA, 18 bp, Homo sapiens
gagatatctgagggagga

SEQ ID NO: 1680603 - DNA, 22 bp, Homo sapiens
gagatatctgagggaggaggcc

SEQ ID NO: 1680604 - DNA, 16 bp, Homo sapiens
gagatatggcagcgaa

SEQ ID NO: 1680605 - DNA, 19 bp, Homo sapiens
gagatattataagggagag

SEQ ID NO: 1680606 - DNA, 11 bp, Homo sapiens
gagatatttac

SEQ ID NO: 1680607 - DNA, 21 bp, Homo sapiens
gagatcacgccactgcactcc

SEQ ID NO: 1680608 - DNA, 17 bp, Homo sapiens
gagatcccgcctcttct

SEQ ID NO: 1680609 - DNA, 15 bp, Homo sapiens
gagatcgaagaggcc

SEQ ID NO: 1680610 - DNA, 22 bp, Homo sapiens
gagatcgacaccatcctggcta

SEQ ID NO: 1680611 - DNA, 21 bp, Homo sapiens
gagatcgagaccatcctggct

SEQ ID NO: 1680612 - DNA, 18 bp, Homo sapiens
gagatcgcttttctcaga

SEQ ID NO: 1680613 - DNA, 15 bp, Homo sapiens
gagatcgggaagcag

SEQ ID NO: 1680614 - DNA, 17 bp, Homo sapiens
gagatcgggaagcagaa

SEQ ID NO: 1680615 - DNA, 21 bp, Homo sapiens
gagatcgtgccgttactctcc

SEQ ID NO: 1680616 - DNA, 17 bp, Homo sapiens
gagatctacacatgttg

SEQ ID NO: 1680617 - DNA, 17 bp, Homo sapiens
gagatctggggaggcag

SEQ ID NO: 1680618 - DNA, 15 bp, Homo sapiens
gagatctgtgtggct

SEQ ID NO: 1680619 - DNA, 21 bp, Homo sapiens
gagatctgtgtggctcctggg

SEQ ID NO: 1680620 - DNA, 18 bp, Homo sapiens
gagatctttctttccaaa

SEQ ID NO: 1680621 - DNA, 21 bp, Homo sapiens
gagatctttctttccaaaaca

SEQ ID NO: 1680622 - DNA, 18 bp, Homo sapiens
gagatgaccagggatgct

SEQ ID NO: 1680623 - DNA, 16 bp, Homo sapiens
gagatgactgagtcct

SEQ ID NO: 1680624 - DNA, 18 bp, Homo sapiens
gagatgagaaatgatgaa

SEQ ID NO: 1680625 - DNA, 16 bp, Homo sapiens
gagatgaggagtaaaa

SEQ ID NO: 1680626 - DNA, 16 bp, Homo sapiens
gagatgcatggcctct

SEQ ID NO: 1680627 - DNA, 23 bp, Homo sapiens
gagatgcctccaccgctgcctaa

SEQ ID NO: 1680628 - DNA, 16 bp, Homo sapiens
gagatgctgagggtgt

SEQ ID NO: 1680629 - DNA, 21 bp, Homo sapiens
gagatgcttggagcaatcaga

SEQ ID NO: 1680630 - DNA, 16 bp, Homo sapiens
gagatggagggcttgg

SEQ ID NO: 1680631 - DNA, 22 bp, Homo sapiens
gagatggcgctattgcactcca

SEQ ID NO: 1680632 - DNA, 12 bp, Homo sapiens
gagatgggaagg

SEQ ID NO: 1680633 - DNA, 12 bp, Homo sapiens
gagatgggatgc

SEQ ID NO: 1680634 - DNA, 21 bp, Homo sapiens
gagatgggctgaactgagcct

SEQ ID NO: 1680635 - DNA, 13 bp, Homo sapiens
gagatggtgaggc

SEQ ID NO: 1680636 - DNA, 17 bp, Homo sapiens
gagatgtaaaaggtatt

SEQ ID NO: 1680637 - DNA, 23 bp, Homo sapiens
gagatgtatgaaggcttttggtc

SEQ ID NO: 1680638 - DNA, 20 bp, Homo sapiens
gagatgtgacccaccagtgc

SEQ ID NO: 1680639 - DNA, 14 bp, Homo sapiens
gagattacaggcat

SEQ ID NO: 1680640 - DNA, 21 bp, Homo sapiens
gagattctggatctcctgctg

SEQ ID NO: 1680641 - DNA, 20 bp, Homo sapiens
gagattctttaaggagatag

SEQ ID NO: 1680642 - DNA, 21 bp, Homo sapiens
gagattctttaaggagataga

SEQ ID NO: 1680643 - DNA, 23 bp, Homo sapiens
gagattctttaaggagatagacg

SEQ ID NO: 1680644 - DNA, 17 bp, Homo sapiens
gagattgcgccactgca

SEQ ID NO: 1680645 - DNA, 17 bp, Homo sapiens
gagattggttttcctgt

SEQ ID NO: 1680646 - DNA, 20 bp, Homo sapiens
gagatttcatctgctctcct

SEQ ID NO: 1680647 - DNA, 12 bp, Homo sapiens
gagatttcttag

SEQ ID NO: 1680648 - DNA, 18 bp, Homo sapiens
gagatttcttgttgctca

SEQ ID NO: 1680649 - DNA, 14 bp, Homo sapiens
gagatttgccagca

SEQ ID NO: 1680650 - DNA, 22 bp, Homo sapiens
gagatttgccagcacaggggcc

SEQ ID NO: 1680651 - DNA, 13 bp, Homo sapiens
gagcaaaactccg

SEQ ID NO: 1680652 - DNA, 13 bp, Homo sapiens
gagcaaacccaga

SEQ ID NO: 1680653 - DNA, 16 bp, Homo sapiens
gagcaaatgagggagg

SEQ ID NO: 1680654 - DNA, 20 bp, Homo sapiens
gagcaacagagtgagaccct

SEQ ID NO: 1680655 - DNA, 21 bp, Homo sapiens
gagcaacccctgtacccagct

SEQ ID NO: 1680656 - DNA, 13 bp, Homo sapiens
gagcaactgcgac

SEQ ID NO: 1680657 - DNA, 14 bp, Homo sapiens
gagcaagaaggaaa

SEQ ID NO: 1680658 - DNA, 15 bp, Homo sapiens
gagcaagacagagac

SEQ ID NO: 1680659 - DNA, 22 bp, Homo sapiens
gattttgggagtgactcaagaa

SEQ ID NO: 1680660 - DNA, 17 bp, Homo sapiens
gattttgtaagaagttt

SEQ ID NO: 1680661 - DNA, 12 bp, Homo sapiens
gattttgtagtt

SEQ ID NO: 1680662 - DNA, 17 bp, Homo sapiens
gatttttaaaaaatatt

SEQ ID NO: 1680663 - DNA, 21 bp, Homo sapiens
gatttttaaaaaatattttct

SEQ ID NO: 1680664 - DNA, 14 bp, Homo sapiens
gatttttaaattat

SEQ ID NO: 1680665 - DNA, 16 bp, Homo sapiens
gatttttactaatata

SEQ ID NO: 1680666 - DNA, 20 bp, Homo sapiens
gatttttactaatatatatt

SEQ ID NO: 1680667 - DNA, 15 bp, Homo sapiens
gatttttagaattaa

SEQ ID NO: 1680668 - DNA, 11 bp, Homo sapiens
gatttttctct

SEQ ID NO: 1680669 - DNA, 22 bp, Homo sapiens
gatttttctcttttttaaaaac

SEQ ID NO: 1680670 - DNA, 13 bp, Homo sapiens
gatttttctttaa

SEQ ID NO: 1680671 - DNA, 13 bp, Homo sapiens
gatttttgtttga

SEQ ID NO: 1680672 - DNA, 16 bp, Homo sapiens
gattttttcccttttt

SEQ ID NO: 1680673 - DNA, 23 bp, Homo sapiens
gattttttttcccatttagaatg

SEQ ID NO: 1680674 - DNA, 15 bp, Homo sapiens
gatttttttttcata

SEQ ID NO: 1680675 - DNA, 16 bp, Homo sapiens
gcaaaaaaagcctcca

SEQ ID NO: 1680676 - DNA, 17 bp, Homo sapiens
gcaaaaaaagcctccaa

SEQ ID NO: 1680677 - DNA, 20 bp, Homo sapiens
gcaaaaactacattttgcaa

SEQ ID NO: 1680678 - DNA, 20 bp, Homo sapiens
gcaaaaagcaagggagaaaa

SEQ ID NO: 1680679 - DNA, 17 bp, Homo sapiens
gcaaaaataaccaagtc

SEQ ID NO: 1680680 - DNA, 17 bp, Homo sapiens
gcaaaactctacttaat

SEQ ID NO: 1680681 - DNA, 12 bp, Homo sapiens
gcaaaagaaaaa

SEQ ID NO: 1680682 - DNA, 12 bp, Homo sapiens
gcaaaagagaaa

SEQ ID NO: 1680683 - DNA, 13 bp, Homo sapiens
gcaaaaggctgag

SEQ ID NO: 1680684 - DNA, 23 bp, Homo sapiens
gcaaaagtgctgcagggctttaa

SEQ ID NO: 1680685 - DNA, 20 bp, Homo sapiens
gcaaaatcttgttaatgtca

SEQ ID NO: 1680686 - DNA, 20 bp, Homo sapiens
gcaaaatgatagttttctag

SEQ ID NO: 1680687 - DNA, 17 bp, Homo sapiens
gcaaaattgatgtgttt

SEQ ID NO: 1680688 - DNA, 13 bp, Homo sapiens
gcaaaattgtttt

SEQ ID NO: 1680689 - DNA, 17 bp, Homo sapiens
gcaaacacacaaaggta

SEQ ID NO: 1680690 - DNA, 13 bp, Homo sapiens
gcaaacagagcta

SEQ ID NO: 1680691 - DNA, 21 bp, Homo sapiens
gcaaacagagctactgagact

SEQ ID NO: 1680692 - DNA, 13 bp, Homo sapiens
gcaaacagcaaga

SEQ ID NO: 1680693 - DNA, 18 bp, Homo sapiens
gcaaacatggagaaatct

SEQ ID NO: 1680694 - DNA, 16 bp, Homo sapiens
gcaaaccatttttaaa

SEQ ID NO: 1680695 - DNA, 17 bp, Homo sapiens
gcaaacccagaggtgga

SEQ ID NO: 1680696 - DNA, 22 bp, Homo sapiens
gcaaacccagaggtggatgtta

SEQ ID NO: 1680697 - DNA, 19 bp, Homo sapiens
gcaaacctgacccctgctc

SEQ ID NO: 1680698 - DNA, 21 bp, Homo sapiens
gcaaacgtctattttgtatat

SEQ ID NO: 1680699 - DNA, 17 bp, Homo sapiens
gcaaactatttgcgact

SEQ ID NO: 1680700 - DNA, 23 bp, Homo sapiens
gcaaactttgtatgtcatttcct

SEQ ID NO: 1680701 - DNA, 14 bp, Homo sapiens
gcaaagatcaaaat

SEQ ID NO: 1680702 - DNA, 16 bp, Homo sapiens
gcaaagatcaaaataa

SEQ ID NO: 1680703 - DNA, 18 bp, Homo sapiens
gcaaagatcaaaataaaa

SEQ ID NO: 1680704 - DNA, 20 bp, Homo sapiens
gcaaagatctgtcctcagcc

SEQ ID NO: 1680705 - DNA, 11 bp, Homo sapiens
gcaaagatgca

SEQ ID NO: 1680706 - DNA, 19 bp, Homo sapiens
gcaaagatggtaaaaagaa

SEQ ID NO: 1680707 - DNA, 23 bp, Homo sapiens
gcaaagcactgacttctaagtaa

SEQ ID NO: 1680708 - DNA, 21 bp, Homo sapiens
gcaaagcgcccacccaggtcc

SEQ ID NO: 1680709 - DNA, 11 bp, Homo sapiens
gcaaagcttgt

SEQ ID NO: 1680710 - DNA, 17 bp, Homo sapiens
gcaaagctttggctgag

SEQ ID NO: 1680711 - DNA, 21 bp, Homo sapiens
gcaaagcttttgcctgcaaga

SEQ ID NO: 1680712 - DNA, 23 bp, Homo sapiens
gcaaaggaaactttgcagatgtg

SEQ ID NO: 1680713 - DNA, 14 bp, Homo sapiens
gcaaaggagaagca

SEQ ID NO: 1680714 - DNA, 20 bp, Homo sapiens
gcaaagggagcactgggttg

SEQ ID NO: 1680715 - DNA, 14 bp, Homo sapiens
gcaaaggggacagc

SEQ ID NO: 1680716 - DNA, 22 bp, Homo sapiens
gcaaaggtgggaggatcatttg

SEQ ID NO: 1680717 - DNA, 19 bp, Homo sapiens
gcaaaggttccaactgtat

SEQ ID NO: 1680718 - DNA, 21 bp, Homo sapiens
gcaaaggttccaactgtatat

SEQ ID NO: 1680719 - DNA, 15 bp, Homo sapiens
gcaaaggttgggtct

SEQ ID NO: 1680720 - DNA, 14 bp, Homo sapiens
gcaaagtcgccagt

SEQ ID NO: 1680721 - DNA, 21 bp, Homo sapiens
gcaaagtcgccagtcactgct

SEQ ID NO: 1680722 - DNA, 23 bp, Homo sapiens
gcaaagtcgccagtcactgctgc

SEQ ID NO: 1680723 - DNA, 23 bp, Homo sapiens
gcaaagtgctgtacccttccacc

SEQ ID NO: 1680724 - DNA, 14 bp, Homo sapiens
gcaaagtttacaga

SEQ ID NO: 1680725 - DNA, 15 bp, Homo sapiens
gcaaataaggacagc

SEQ ID NO: 1680726 - DNA, 16 bp, Homo sapiens
gcaaataaggacagca

SEQ ID NO: 1680727 - DNA, 19 bp, Homo sapiens
gcaaataaggacagcagct

SEQ ID NO: 1680728 - DNA, 21 bp, Homo sapiens
gcaaatagccacaattatata

SEQ ID NO: 1680729 - DNA, 17 bp, Homo sapiens
gcaaatagtagacattt

SEQ ID NO: 1680730 - DNA, 16 bp, Homo sapiens
gcaaatagtttcaaat

SEQ ID NO: 1680731 - DNA, 19 bp, Homo sapiens
gcaaatataagctgggaaa

SEQ ID NO: 1680732 - DNA, 16 bp, Homo sapiens
gcaaatgacagatttc

SEQ ID NO: 1680733 - DNA, 21 bp, Homo sapiens
gcaaatgtcagatacaatgta

SEQ ID NO: 1680734 - DNA, 19 bp, Homo sapiens
gcaaatgttgggaaagtat

SEQ ID NO: 1680735 - DNA, 20 bp, Homo sapiens
gcaaatgttgggaaagtatt

SEQ ID NO: 1680736 - DNA, 14 bp, Homo sapiens
gcaaattattctag

SEQ ID NO: 1680737 - DNA, 22 bp, Homo sapiens
gcaaattattctagtcaactgc

SEQ ID NO: 1680738 - DNA, 13 bp, Homo sapiens
gcaaattttaaaa

SEQ ID NO: 1680739 - DNA, 14 bp, Homo sapiens
gcaacaaaatacat

SEQ ID NO: 1680740 - DNA, 19 bp, Homo sapiens
gcaacaaacctcactgaga

SEQ ID NO: 1680741 - DNA, 17 bp, Homo sapiens
gcaacaaagattgagaa

SEQ ID NO: 1680742 - DNA, 22 bp, Homo sapiens
gcaacaagaccaccacttcgaa

SEQ ID NO: 1680743 - DNA, 15 bp, Homo sapiens
gcaacacagccacta

SEQ ID NO: 1680744 - DNA, 16 bp, Homo sapiens
gcaacacagcctgggc

SEQ ID NO: 1680745 - DNA, 14 bp, Homo sapiens
gcaacactgctgtc

SEQ ID NO: 1680746 - DNA, 16 bp, Homo sapiens
gcaacactgctgtcca

SEQ ID NO: 1680747 - DNA, 13 bp, Homo sapiens
gcaacagacaagt

SEQ ID NO: 1680748 - DNA, 14 bp, Homo sapiens
gcaacagatctgga

SEQ ID NO: 1680749 - DNA, 17 bp, Homo sapiens
gcaacagatctggaacc

SEQ ID NO: 1680750 - DNA, 20 bp, Homo sapiens
gcaacagatctggaacctca

SEQ ID NO: 1680751 - DNA, 13 bp, Homo sapiens
gcaacagcttcag

SEQ ID NO: 1680752 - DNA, 15 bp, Homo sapiens
gcaacagggagcacc

SEQ ID NO: 1680753 - DNA, 20 bp, Homo sapiens
gcaacaggggaggaaaaaag

SEQ ID NO: 1680754 - DNA, 20 bp, Homo sapiens
gcaacaggttttataatttt

SEQ ID NO: 1680755 - DNA, 19 bp, Homo sapiens
gcaacatctcgagccccct

SEQ ID NO: 1680756 - DNA, 14 bp, Homo sapiens
gcaacattcattgc

SEQ ID NO: 1680757 - DNA, 19 bp, Homo sapiens
gcaacattccacagctgcc

SEQ ID NO: 1680758 - DNA, 24 bp, Homo sapiens
gcaacattccacagctgccctggc

SEQ ID NO: 1680759 - DNA, 20 bp, Homo sapiens
gcaacatttgacaaaactaa

SEQ ID NO: 1680760 - DNA, 15 bp, Homo sapiens
gcaaccaagtcacac

SEQ ID NO: 1680761 - DNA, 11 bp, Homo sapiens
gcaaccaggaa

SEQ ID NO: 1680762 - DNA, 21 bp, Homo sapiens
gcaacccacagctcagctgcc

SEQ ID NO: 1680763 - DNA, 21 bp, Homo sapiens
gcaacccttaccccttagcct

SEQ ID NO: 1680764 - DNA, 23 bp, Homo sapiens
gcaaccgtctgttatgctgtgac

SEQ ID NO: 1680765 - DNA, 23 bp, Homo sapiens
gcaacctctgcctcccaggttcc

SEQ ID NO: 1680766 - DNA, 14 bp, Homo sapiens
gcaacgaagaaaaa

SEQ ID NO: 1680767 - DNA, 22 bp, Homo sapiens
gcaacggtctcctgactggtgc

SEQ ID NO: 1680768 - DNA, 23 bp, Homo sapiens
gcaacgtgcgtgtctctgccatg

SEQ ID NO: 1680769 - DNA, 16 bp, Homo sapiens
gcaactagccaaggct

SEQ ID NO: 1680770 - DNA, 22 bp, Homo sapiens
gcaactcaaggactttgcagcc

SEQ ID NO: 1680771 - DNA, 14 bp, Homo sapiens
gcaactctggctcc

SEQ ID NO: 1680772 - DNA, 21 bp, Homo sapiens
gcaactctggctccaggcaga

SEQ ID NO: 1680773 - DNA, 17 bp, Homo sapiens
gcaactcttttaagtgc

SEQ ID NO: 1680774 - DNA, 17 bp, Homo sapiens
gcaactgcccttccagg

SEQ ID NO: 1680775 - DNA, 17 bp, Homo sapiens
gcaacttccgctgaggg

SEQ ID NO: 1680776 - DNA, 18 bp, Homo sapiens
gcaacttccgctgagggg

SEQ ID NO: 1680777 - DNA, 20 bp, Homo sapiens
gcaacttcttctccatccct

SEQ ID NO: 1680778 - DNA, 19 bp, Homo sapiens
gcaacttgtctttttctgg

SEQ ID NO: 1680779 - DNA, 20 bp, Homo sapiens
gcaacttttgtgtaatgaaa

SEQ ID NO: 1680780 - DNA, 11 bp, Homo sapiens
gcaagaaacag

SEQ ID NO: 1680781 - DNA, 20 bp, Homo sapiens
gcaagaaagcttgagtctca

SEQ ID NO: 1680782 - DNA, 23 bp, Homo sapiens
gcaagaaatggcgtctgctctgg

SEQ ID NO: 1680783 - DNA, 21 bp, Homo sapiens
gcaagaacccaagtgcctcac

SEQ ID NO: 1680784 - DNA, 17 bp, Homo sapiens
gcaagaagattctaaaa

SEQ ID NO: 1680785 - DNA, 18 bp, Homo sapiens
gcaagaagattctaaaac

SEQ ID NO: 1680786 - DNA, 14 bp, Homo sapiens
gcaagaaggaaaga

SEQ ID NO: 1680787 - DNA, 16 bp, Homo sapiens
gcaagacagaaaagtg

SEQ ID NO: 1680788 - DNA, 21 bp, Homo sapiens
gcaagacagaaaagtgcctga

SEQ ID NO: 1680789 - DNA, 16 bp, Homo sapiens
gaacttttgtactgaa

SEQ ID NO: 1680790 - DNA, 20 bp, Homo sapiens
gaacttttgtactgaatttt

SEQ ID NO: 1680791 - DNA, 21 bp, Homo sapiens
gaacttttgtactgaattttt

SEQ ID NO: 1680792 - DNA, 14 bp, Homo sapiens
gaactttttgtagg

SEQ ID NO: 1680793 - DNA, 16 bp, Homo sapiens
gaagaaaacaaagttc

SEQ ID NO: 1680794 - DNA, 17 bp, Homo sapiens
gaagaaaacactgttat

SEQ ID NO: 1680795 - DNA, 14 bp, Homo sapiens
gaagaaaacatcta

SEQ ID NO: 1680796 - DNA, 22 bp, Homo sapiens
gaagaaaacatctattctctcc

SEQ ID NO: 1680797 - DNA, 13 bp, Homo sapiens
gaagaaaatactt

SEQ ID NO: 1680798 - DNA, 19 bp, Homo sapiens
gaagaaaatacttaaatgt

SEQ ID NO: 1680799 - DNA, 20 bp, Homo sapiens
gaagaaaatacttaaatgtt

SEQ ID NO: 1680800 - DNA, 17 bp, Homo sapiens
gaagaaaattgctgtgc

SEQ ID NO: 1680801 - DNA, 15 bp, Homo sapiens
gaagaaacagatctc

SEQ ID NO: 1680802 - DNA, 17 bp, Homo sapiens
gaagaaagatttgttac

SEQ ID NO: 1680803 - DNA, 21 bp, Homo sapiens
gaagaaagatttgttactgta

SEQ ID NO: 1680804 - DNA, 18 bp, Homo sapiens
gaagaaatcacagaatca

SEQ ID NO: 1680805 - DNA, 20 bp, Homo sapiens
gaagaaattcaggtacagaa

SEQ ID NO: 1680806 - DNA, 13 bp, Homo sapiens
gaagaacacagca

SEQ ID NO: 1680807 - DNA, 16 bp, Homo sapiens
gaagaacacagcatgt

SEQ ID NO: 1680808 - DNA, 18 bp, Homo sapiens
gaagaacacagcatgtgc

SEQ ID NO: 1680809 - DNA, 23 bp, Homo sapiens
gaagaacacagcatgtgccaaga

SEQ ID NO: 1680810 - DNA, 16 bp, Homo sapiens
gaagaacatccaagga

SEQ ID NO: 1680811 - DNA, 17 bp, Homo sapiens
gaagaaccaaatacctc

SEQ ID NO: 1680812 - DNA, 20 bp, Homo sapiens
gaagaaccaaatacctcaat

SEQ ID NO: 1680813 - DNA, 13 bp, Homo sapiens
gaagaaccagtcc

SEQ ID NO: 1680814 - DNA, 13 bp, Homo sapiens
gaagaacggggct

SEQ ID NO: 1680815 - DNA, 12 bp, Homo sapiens
gaagaagacaaa

SEQ ID NO: 1680816 - DNA, 16 bp, Homo sapiens
gaagaagagaagctgc

SEQ ID NO: 1680817 - DNA, 23 bp, Homo sapiens
gaagaaggaggaatgctggactg

SEQ ID NO: 1680818 - DNA, 16 bp, Homo sapiens
gaagaagggcacccta

SEQ ID NO: 1680819 - DNA, 24 bp, Homo sapiens
gaagaagggggtggggggagtttg

SEQ ID NO: 1680820 - DNA, 15 bp, Homo sapiens
gaagaatacatcaga

SEQ ID NO: 1680821 - DNA, 13 bp, Homo sapiens
gaagaatagaggt

SEQ ID NO: 1680822 - DNA, 15 bp, Homo sapiens
gaagaatgaagacca

SEQ ID NO: 1680823 - DNA, 17 bp, Homo sapiens
gaagaatggctttcaat

SEQ ID NO: 1680824 - DNA, 14 bp, Homo sapiens
gaagaattatgtaa

SEQ ID NO: 1680825 - DNA, 14 bp, Homo sapiens
gcacctattctgta

SEQ ID NO: 1680826 - DNA, 16 bp, Homo sapiens
gcacctcagcctgcac

SEQ ID NO: 1680827 - DNA, 18 bp, Homo sapiens
gcacctcagcctgcacag

SEQ ID NO: 1680828 - DNA, 15 bp, Homo sapiens
gcacctccaggcagg

SEQ ID NO: 1680829 - DNA, 13 bp, Homo sapiens
gcactgatgctgc

SEQ ID NO: 1680830 - DNA, 19 bp, Homo sapiens
gcactgatttcacaacaga

SEQ ID NO: 1680831 - DNA, 17 bp, Homo sapiens
gcactgcattcctgtgc

SEQ ID NO: 1680832 - DNA, 22 bp, Homo sapiens
gcactgcattcctgtgccctag

SEQ ID NO: 1680833 - DNA, 13 bp, Homo sapiens
gcactgccactgg

SEQ ID NO: 1680834 - DNA, 19 bp, Homo sapiens
gcactgctcacgtctctgc

SEQ ID NO: 1680835 - DNA, 23 bp, Homo sapiens
gcactgctcacgtctctgccgcc

SEQ ID NO: 1680836 - DNA, 11 bp, Homo sapiens
gcactgctgtt

SEQ ID NO: 1680837 - DNA, 12 bp, Homo sapiens
gcactgctgttc

SEQ ID NO: 1680838 - DNA, 22 bp, Homo sapiens
gcactgctgttcctgctccatg

SEQ ID NO: 1680839 - DNA, 18 bp, Homo sapiens
gcactggaggggcccacc

SEQ ID NO: 1680840 - DNA, 14 bp, Homo sapiens
gcactggagtccag

SEQ ID NO: 1680841 - DNA, 17 bp, Homo sapiens
gcactggagtccagtct

SEQ ID NO: 1680842 - DNA, 20 bp, Homo sapiens
gcactggccagagagggccc

SEQ ID NO: 1680843 - DNA, 15 bp, Homo sapiens
gcactgggctccgga

SEQ ID NO: 1680844 - DNA, 18 bp, Homo sapiens
gcactggggagcccgtct

SEQ ID NO: 1680845 - DNA, 22 bp, Homo sapiens
gcactggggagcccgtctcagt

SEQ ID NO: 1680846 - DNA, 19 bp, Homo sapiens
gcactggtaggttgggaca

SEQ ID NO: 1680847 - DNA, 22 bp, Homo sapiens
gcactggtaggttgggacacca

SEQ ID NO: 1680848 - DNA, 23 bp, Homo sapiens
gcactggtgaactgagctgggca

SEQ ID NO: 1680849 - DNA, 14 bp, Homo sapiens
gcactggtggcccg

SEQ ID NO: 1680850 - DNA, 23 bp, Homo sapiens
gcactggtggcccgacagcctgg

SEQ ID NO: 1680851 - DNA, 11 bp, Homo sapiens
gcactggtggg

SEQ ID NO: 1680852 - DNA, 20 bp, Homo sapiens
gcactggtgtgaactcaccc

SEQ ID NO: 1680853 - DNA, 12 bp, Homo sapiens
gcactgtaaaat

SEQ ID NO: 1680854 - DNA, 14 bp, Homo sapiens
gcactgtaaaatgt

SEQ ID NO: 1680855 - DNA, 16 bp, Homo sapiens
gcactgtatgctggac

SEQ ID NO: 1680856 - DNA, 15 bp, Homo sapiens
gcactgtcaagatga

SEQ ID NO: 1680857 - DNA, 16 bp, Homo sapiens
gcactgtcaggaatgg

SEQ ID NO: 1680858 - DNA, 17 bp, Homo sapiens
gcactgtcccttgcctc

SEQ ID NO: 1680859 - DNA, 18 bp, Homo sapiens
gcactgtcccttgcctca

SEQ ID NO: 1680860 - DNA, 21 bp, Homo sapiens
gcactgtgaagacccagcagg

SEQ ID NO: 1680861 - DNA, 17 bp, Homo sapiens
gcactgtggtttcagat

SEQ ID NO: 1680862 - DNA, 17 bp, Homo sapiens
gcactgttaatacacag

SEQ ID NO: 1680863 - DNA, 19 bp, Homo sapiens
gcacttaagtcttccttaa

SEQ ID NO: 1680864 - DNA, 22 bp, Homo sapiens
gcacttactggtaggaccaagc

SEQ ID NO: 1680865 - DNA, 15 bp, Homo sapiens
gcacttagcaggcac

SEQ ID NO: 1680866 - DNA, 18 bp, Homo sapiens
gcacttattgaccatttt

SEQ ID NO: 1680867 - DNA, 20 bp, Homo sapiens
gcacttcccagagcatcttg

SEQ ID NO: 1680868 - DNA, 13 bp, Homo sapiens
gcacttcccagga

SEQ ID NO: 1680869 - DNA, 20 bp, Homo sapiens
gcacttcctctcgcggccct

SEQ ID NO: 1680870 - DNA, 22 bp, Homo sapiens
gcacttcctctcgcggccctca

SEQ ID NO: 1680871 - DNA, 22 bp, Homo sapiens
gcacttcctgttttataatgaa

SEQ ID NO: 1680872 - DNA, 12 bp, Homo sapiens
gcacttgagttt

SEQ ID NO: 1680873 - DNA, 17 bp, Homo sapiens
gcacttgatgtgtagac

SEQ ID NO: 1680874 - DNA, 14 bp, Homo sapiens
gcacttgcctgggt

SEQ ID NO: 1680875 - DNA, 18 bp, Homo sapiens
gcacttgcctgttggctg

SEQ ID NO: 1680876 - DNA, 21 bp, Homo sapiens
gcacttgcctgttggctgctg

SEQ ID NO: 1680877 - DNA, 18 bp, Homo sapiens
gcacttgcgtcctgcaga

SEQ ID NO: 1680878 - DNA, 13 bp, Homo sapiens
gcacttggagcca

SEQ ID NO: 1680879 - DNA, 21 bp, Homo sapiens
gcacttggcaaaaagaatccc

SEQ ID NO: 1680880 - DNA, 10 bp, Homo sapiens
gcacttgtat

SEQ ID NO: 1680881 - DNA, 11 bp, Homo sapiens
gcacttgtatt

SEQ ID NO: 1680882 - DNA, 16 bp, Homo sapiens
gcactttaatggcctg

SEQ ID NO: 1680883 - DNA, 15 bp, Homo sapiens
gcactttcccccttc

SEQ ID NO: 1680884 - DNA, 19 bp, Homo sapiens
gcactttgagaggctgagg

SEQ ID NO: 1680885 - DNA, 12 bp, Homo sapiens
gcactttgcact

SEQ ID NO: 1680886 - DNA, 13 bp, Homo sapiens
gcactttgcactt

SEQ ID NO: 1680887 - DNA, 16 bp, Homo sapiens
gcactttgggaggcag

SEQ ID NO: 1680888 - DNA, 18 bp, Homo sapiens
gcacttttaaaaaaattt

SEQ ID NO: 1680889 - DNA, 16 bp, Homo sapiens
gcagaaaacagggtct

SEQ ID NO: 1680890 - DNA, 16 bp, Homo sapiens
gcagaaaacccttggg

SEQ ID NO: 1680891 - DNA, 19 bp, Homo sapiens
gcagaaaagaggagaccct

SEQ ID NO: 1680892 - DNA, 18 bp, Homo sapiens
gcagaaaagcacctgccg

SEQ ID NO: 1680893 - DNA, 20 bp, Homo sapiens
gcagaaaagcacctgccgac

SEQ ID NO: 1680894 - DNA, 21 bp, Homo sapiens
gcagaaaagcacctgccgacc

SEQ ID NO: 1680895 - DNA, 17 bp, Homo sapiens
gcagaaacgaagccatc

SEQ ID NO: 1680896 - DNA, 19 bp, Homo sapiens
gcagaaagggccacccatg

SEQ ID NO: 1680897 - DNA, 17 bp, Homo sapiens
gcagaaattctgttttt

SEQ ID NO: 1680898 - DNA, 17 bp, Homo sapiens
gcagaacaaatgtgttt

SEQ ID NO: 1680899 - DNA, 21 bp, Homo sapiens
gcagaacaaatgtgtttttct

SEQ ID NO: 1680900 - DNA, 23 bp, Homo sapiens
gcagaacagccgctcctgtctgc

SEQ ID NO: 1680901 - DNA, 18 bp, Homo sapiens
gcagaacccccaggtggc

SEQ ID NO: 1680902 - DNA, 19 bp, Homo sapiens
gcagaacccccaggtggcc

SEQ ID NO: 1680903 - DNA, 19 bp, Homo sapiens
gcagaacctgcacacagga

SEQ ID NO: 1680904 - DNA, 21 bp, Homo sapiens
gcagaactaaactcatttata

SEQ ID NO: 1680905 - DNA, 20 bp, Homo sapiens
gcagaactttccagggatcc

SEQ ID NO: 1680906 - DNA, 21 bp, Homo sapiens
gcagaagaattgaacccagga

SEQ ID NO: 1680907 - DNA, 24 bp, Homo sapiens
gcagaagagagtggggcctgccct

SEQ ID NO: 1680908 - DNA, 22 bp, Homo sapiens
gcagaagcattgcctggactga

SEQ ID NO: 1680909 - DNA, 13 bp, Homo sapiens
gcagaagctctcg

SEQ ID NO: 1680910 - DNA, 23 bp, Homo sapiens
gcagaagctctcgatggacaatg

SEQ ID NO: 1680911 - DNA, 22 bp, Homo sapiens
gcagaaggaaagaagggggccc

SEQ ID NO: 1680912 - DNA, 21 bp, Homo sapiens
gcagaagtctggctttgctct

SEQ ID NO: 1680913 - DNA, 17 bp, Homo sapiens
gcagaagtgctctttgt

SEQ ID NO: 1680914 - DNA, 18 bp, Homo sapiens
gcagaatgtaagtgggcc

SEQ ID NO: 1680915 - DNA, 21 bp, Homo sapiens
gcagaattgtttagattttgt

SEQ ID NO: 1680916 - DNA, 17 bp, Homo sapiens
gcagaattttaatgtga

SEQ ID NO: 1680917 - DNA, 18 bp, Homo sapiens
gcagaattttaatgtgaa

SEQ ID NO: 1680918 - DNA, 20 bp, Homo sapiens
gcagacaaagccctgtcctt

SEQ ID NO: 1680919 - DNA, 16 bp, Homo sapiens
gcagacaagagctgct

SEQ ID NO: 1680920 - DNA, 18 bp, Homo sapiens
gcagacaagagctgctgt

SEQ ID NO: 1680921 - DNA, 13 bp, Homo sapiens
gcagacagagcca

SEQ ID NO: 1680922 - DNA, 14 bp, Homo sapiens
gcagacagagccag

SEQ ID NO: 1680923 - DNA, 16 bp, Homo sapiens
gcagacagagccagga

SEQ ID NO: 1680924 - DNA, 23 bp, Homo sapiens
gcagacagagccaggagaagctc

SEQ ID NO: 1680925 - DNA, 15 bp, Homo sapiens
gcagacagaggggat

SEQ ID NO: 1680926 - DNA, 16 bp, Homo sapiens
gcagacagcagctcag

SEQ ID NO: 1680927 - DNA, 17 bp, Homo sapiens
gcagacagcagctcagg

SEQ ID NO: 1680928 - DNA, 21 bp, Homo sapiens
gcagacagcagctcaggcaca

SEQ ID NO: 1680929 - DNA, 14 bp, Homo sapiens
gcagacagccatgc

SEQ ID NO: 1680930 - DNA, 22 bp, Homo sapiens
gcagacagtctgttatgcactg

SEQ ID NO: 1680931 - DNA, 20 bp, Homo sapiens
gcagaccacgcccgtcctgc

SEQ ID NO: 1680932 - DNA, 22 bp, Homo sapiens
gcagaccatgaagtaaattatg

SEQ ID NO: 1680933 - DNA, 21 bp, Homo sapiens
gcagacctaagccctgccccg

SEQ ID NO: 1680934 - DNA, 19 bp, Homo sapiens
gcagacctacctgcagtgg

SEQ ID NO: 1680935 - DNA, 18 bp, Homo sapiens
gcagacgcagcagctggg

SEQ ID NO: 1680936 - DNA, 14 bp, Homo sapiens
gcagacgtccatca

SEQ ID NO: 1680937 - DNA, 19 bp, Homo sapiens
gcagacgtctgccttggca

SEQ ID NO: 1680938 - DNA, 13 bp, Homo sapiens
gcagactcagctg

SEQ ID NO: 1680939 - DNA, 16 bp, Homo sapiens
gcagactcagctgcta

SEQ ID NO: 1680940 - DNA, 20 bp, Homo sapiens
gcagactggggcatcctgtg

SEQ ID NO: 1680941 - DNA, 18 bp, Homo sapiens
gcagacttcccagctagg

SEQ ID NO: 1680942 - DNA, 22 bp, Homo sapiens
gcagacttcttaaaaggagctc

SEQ ID NO: 1680943 - DNA, 12 bp, Homo sapiens
gcagccaaggcc

SEQ ID NO: 1680944 - DNA, 11 bp, Homo sapiens
gcagccaccca

SEQ ID NO: 1680945 - DNA, 20 bp, Homo sapiens
gcagccacccaagcctgctg

SEQ ID NO: 1680946 - DNA, 17 bp, Homo sapiens
gcagccagagctgtgcc

SEQ ID NO: 1680947 - DNA, 19 bp, Homo sapiens
gcagccagcaccacctaca

SEQ ID NO: 1680948 - DNA, 12 bp, Homo sapiens
gcagccagccag

SEQ ID NO: 1680949 - DNA, 17 bp, Homo sapiens
gcagccagccagtcttg

SEQ ID NO: 1680950 - DNA, 13 bp, Homo sapiens
gcagccagcccag

SEQ ID NO: 1680951 - DNA, 15 bp, Homo sapiens
gcagccagcccagcc

SEQ ID NO: 1680952 - DNA, 15 bp, Homo sapiens
gcagccagctctcag

SEQ ID NO: 1680953 - DNA, 13 bp, Homo sapiens
gcagccaggctgc

SEQ ID NO: 1680954 - DNA, 19 bp, Homo sapiens
gcagccaggctgcacagca

SEQ ID NO: 1680955 - DNA, 15 bp, Homo sapiens
gcagccagggacccc

SEQ ID NO: 1680956 - DNA, 16 bp, Homo sapiens
gcagccagggaccccc

SEQ ID NO: 1680957 - DNA, 13 bp, Homo sapiens
gcagccagtctca

SEQ ID NO: 1680958 - DNA, 21 bp, Homo sapiens
gcagccagtctcagagaccag

SEQ ID NO: 1680959 - DNA, 13 bp, Homo sapiens
gcagccatatatg

SEQ ID NO: 1680960 - DNA, 14 bp, Homo sapiens
gcagccatgcctca

SEQ ID NO: 1680961 - DNA, 16 bp, Homo sapiens
gcagccatgcctcatg

SEQ ID NO: 1680962 - DNA, 17 bp, Homo sapiens
gcagccatgcctcatgc

SEQ ID NO: 1680963 - DNA, 21 bp, Homo sapiens
gcagcccaaaacccagggcaa

SEQ ID NO: 1680964 - DNA, 16 bp, Homo sapiens
gcagcccaacagcact

SEQ ID NO: 1680965 - DNA, 15 bp, Homo sapiens
gcagcccaagcttcc

SEQ ID NO: 1680966 - DNA, 13 bp, Homo sapiens
gcagcccaccctg

SEQ ID NO: 1680967 - DNA, 22 bp, Homo sapiens
gcagcccagagactttgtagat

SEQ ID NO: 1680968 - DNA, 13 bp, Homo sapiens
gcagcccagcttc

SEQ ID NO: 1680969 - DNA, 17 bp, Homo sapiens
gcagcccagcttcctgg

SEQ ID NO: 1680970 - DNA, 19 bp, Homo sapiens
gcagcccagcttcctggtg

SEQ ID NO: 1680971 - DNA, 12 bp, Homo sapiens
gcagcccagggc

SEQ ID NO: 1680972 - DNA, 13 bp, Homo sapiens
gcagcccatgccc

SEQ ID NO: 1680973 - DNA, 23 bp, Homo sapiens
gcagccccacttcacccccaact

SEQ ID NO: 1680974 - DNA, 19 bp, Homo sapiens
gcagcccccacccccaagg

SEQ ID NO: 1680975 - DNA, 15 bp, Homo sapiens
gcagccccctgtggc

SEQ ID NO: 1680976 - DNA, 23 bp, Homo sapiens
gcagccccgcgcctccttccttg

SEQ ID NO: 1680977 - DNA, 15 bp, Homo sapiens
gcagcccgcctgccg

SEQ ID NO: 1680978 - DNA, 16 bp, Homo sapiens
gcagcccgcctgccgt

SEQ ID NO: 1680979 - DNA, 15 bp, Homo sapiens
gcagcccgtgaagca

SEQ ID NO: 1680980 - DNA, 24 bp, Homo sapiens
gcagccctaaggatctctcaggag

SEQ ID NO: 1680981 - DNA, 13 bp, Homo sapiens
gcagccctcacct

SEQ ID NO: 1680982 - DNA, 22 bp, Homo sapiens
gcagccctccacttctggtata

SEQ ID NO: 1680983 - DNA, 12 bp, Homo sapiens
gcagccctctcc

SEQ ID NO: 1680984 - DNA, 16 bp, Homo sapiens
gcagccctcttgcccg

SEQ ID NO: 1680985 - DNA, 13 bp, Homo sapiens
gcagccctgcttt

SEQ ID NO: 1680986 - DNA, 19 bp, Homo sapiens
gcagccctggcagggggca

SEQ ID NO: 1680987 - DNA, 14 bp, Homo sapiens
gcagccgagctcgt

SEQ ID NO: 1680988 - DNA, 14 bp, Homo sapiens
gcagccgaggcctg

SEQ ID NO: 1680989 - DNA, 15 bp, Homo sapiens
gcagccgaggcctgg

SEQ ID NO: 1680990 - DNA, 18 bp, Homo sapiens
gcagccgaggcctggcca

SEQ ID NO: 1680991 - DNA, 14 bp, Homo sapiens
gcagccgccagctg

SEQ ID NO: 1680992 - DNA, 20 bp, Homo sapiens
gcagccgccttaagctgatc

SEQ ID NO: 1680993 - DNA, 18 bp, Homo sapiens
gcagccggcacagggtct

SEQ ID NO: 1680994 - DNA, 19 bp, Homo sapiens
gcagccggcacagggtctg

SEQ ID NO: 1680995 - DNA, 23 bp, Homo sapiens
gcagccgtcccaggccaccccca

SEQ ID NO: 1680996 - DNA, 14 bp, Homo sapiens
gcagccgtgccttc

SEQ ID NO: 1680997 - DNA, 17 bp, Homo sapiens
gcagccgtgccttcagc

SEQ ID NO: 1680998 - DNA, 18 bp, Homo sapiens
gcagccgtgccttcagct

SEQ ID NO: 1680999 - DNA, 15 bp, Homo sapiens
gcagcctcagagtgg

SEQ ID NO: 1681000 - DNA, 23 bp, Homo sapiens
gcagcctccagagccagcctggg

SEQ ID NO: 1681001 - DNA, 17 bp, Homo sapiens
gcagcctccctgtcact

SEQ ID NO: 1681002 - DNA, 12 bp, Homo sapiens
gcagcctccttt

SEQ ID NO: 1681003 - DNA, 16 bp, Homo sapiens
gcagcctctccccagg

SEQ ID NO: 1681004 - DNA, 19 bp, Homo sapiens
gcagcctctccgactctgc

SEQ ID NO: 1681005 - DNA, 15 bp, Homo sapiens
gcagcctctctgcta

SEQ ID NO: 1681006 - DNA, 15 bp, Homo sapiens
gcagcctctgccagg

SEQ ID NO: 1681007 - DNA, 18 bp, Homo sapiens
gcagcctctgccaggcct

SEQ ID NO: 1681008 - DNA, 14 bp, Homo sapiens
gcagcctgaacact

SEQ ID NO: 1681009 - DNA, 14 bp, Homo sapiens
gcagcctgaagcct

SEQ ID NO: 1681010 - DNA, 16 bp, Homo sapiens
gcagcctgaagcctgg

SEQ ID NO: 1681011 - DNA, 13 bp, Homo sapiens
gcagcctgatggc

SEQ ID NO: 1681012 - DNA, 18 bp, Homo sapiens
gcagcctgatggccaagg

SEQ ID NO: 1681013 - DNA, 20 bp, Homo sapiens
gcagcctgatggccaagggg

SEQ ID NO: 1681014 - DNA, 21 bp, Homo sapiens
gcagcctgatggccaaggggg

SEQ ID NO: 1681015 - DNA, 23 bp, Homo sapiens
gcagcctgcgccaccgcccagag

SEQ ID NO: 1681016 - DNA, 20 bp, Homo sapiens
gcagcctggctcccaggaca

SEQ ID NO: 1681017 - DNA, 14 bp, Homo sapiens
gcagcctgtatgtg

SEQ ID NO: 1681018 - DNA, 13 bp, Homo sapiens
gcagcctgtggct

SEQ ID NO: 1681019 - DNA, 14 bp, Homo sapiens
gcagcgaccccagg

SEQ ID NO: 1681020 - DNA, 16 bp, Homo sapiens
gcagcgaccgccccct

SEQ ID NO: 1681021 - DNA, 14 bp, Homo sapiens
gcagcgcgcaggcc

SEQ ID NO: 1681022 - DNA, 17 bp, Homo sapiens
gcagcgcggggagcccg

SEQ ID NO: 1681023 - DNA, 21 bp, Homo sapiens
gcagcggattgctctggagca

SEQ ID NO: 1681024 - DNA, 12 bp, Homo sapiens
gcagcggcagag

SEQ ID NO: 1681025 - DNA, 15 bp, Homo sapiens
gcagcgggcggaggg

SEQ ID NO: 1681026 - DNA, 20 bp, Homo sapiens
gcagcgtcccccgccgcgcc

SEQ ID NO: 1681027 - DNA, 18 bp, Homo sapiens
gcagctaagatagaaagc

SEQ ID NO: 1681028 - DNA, 23 bp, Homo sapiens
gcagctaagatagaaagctggac

SEQ ID NO: 1681029 - DNA, 17 bp, Homo sapiens
gcagctagactggagtg

SEQ ID NO: 1681030 - DNA, 20 bp, Homo sapiens
gcagctaggactgaggagtg

SEQ ID NO: 1681031 - DNA, 13 bp, Homo sapiens
gcagctaggcgcg

SEQ ID NO: 1681032 - DNA, 12 bp, Homo sapiens
gcagctagtgcc

SEQ ID NO: 1681033 - DNA, 17 bp, Homo sapiens
gcagctcaacctaccct

SEQ ID NO: 1681034 - DNA, 17 bp, Homo sapiens
gcagctcccgcagggct

SEQ ID NO: 1681035 - DNA, 14 bp, Homo sapiens
gcagctccctcctg

SEQ ID NO: 1681036 - DNA, 15 bp, Homo sapiens
gcagctccctcctgc

SEQ ID NO: 1681037 - DNA, 17 bp, Homo sapiens
gcagctcctctccttgg

SEQ ID NO: 1681038 - DNA, 19 bp, Homo sapiens
gcagctcctctccttgggc

SEQ ID NO: 1681039 - DNA, 13 bp, Homo sapiens
gcagctctctttc

SEQ ID NO: 1681040 - DNA, 15 bp, Homo sapiens
gcagctcttgccctt

SEQ ID NO: 1681041 - DNA, 16 bp, Homo sapiens
gcagctcttgcccttc

SEQ ID NO: 1681042 - DNA, 19 bp, Homo sapiens
gcagctcttgcccttccct

SEQ ID NO: 1681043 - DNA, 23 bp, Homo sapiens
gcagctcttgcccttccctgtcc

SEQ ID NO: 1681044 - DNA, 12 bp, Homo sapiens
gcagctgaaatt

SEQ ID NO: 1681045 - DNA, 14 bp, Homo sapiens
gcagctgacctctg

SEQ ID NO: 1681046 - DNA, 14 bp, Homo sapiens
gcagctgagagccc

SEQ ID NO: 1681047 - DNA, 15 bp, Homo sapiens
gcagctgagagccct

SEQ ID NO: 1681048 - DNA, 17 bp, Homo sapiens
gcagctgagatgtggac

SEQ ID NO: 1681049 - DNA, 16 bp, Homo sapiens
gcagctgatccatagg

SEQ ID NO: 1681050 - DNA, 15 bp, Homo sapiens
gcagtcggcatgcca

SEQ ID NO: 1681051 - DNA, 18 bp, Homo sapiens
gcagtcgggggctggcct

SEQ ID NO: 1681052 - DNA, 20 bp, Homo sapiens
gcagtcgggggctggcctag

SEQ ID NO: 1681053 - DNA, 18 bp, Homo sapiens
gcagtcgtgcctgtgtcc

SEQ ID NO: 1681054 - DNA, 19 bp, Homo sapiens
gcagtcgtggctttggcag

SEQ ID NO: 1681055 - DNA, 16 bp, Homo sapiens
gcagtctccttcagca

SEQ ID NO: 1681056 - DNA, 19 bp, Homo sapiens
gcagtctgaacccttgtgc

SEQ ID NO: 1681057 - DNA, 17 bp, Homo sapiens
gcagtctgataaactga

SEQ ID NO: 1681058 - DNA, 14 bp, Homo sapiens
gcagtctgcctgga

SEQ ID NO: 1681059 - DNA, 16 bp, Homo sapiens
gcagtctggcctgggc

SEQ ID NO: 1681060 - DNA, 18 bp, Homo sapiens
gcagtctggcctgggcga

SEQ ID NO: 1681061 - DNA, 22 bp, Homo sapiens
gcagtcttctctctggctcagg

SEQ ID NO: 1681062 - DNA, 12 bp, Homo sapiens
gcagtcttgctc

SEQ ID NO: 1681063 - DNA, 19 bp, Homo sapiens
gcagtctttgctcagtgga

SEQ ID NO: 1681064 - DNA, 21 bp, Homo sapiens
gcagtctttgctcagtggatc

SEQ ID NO: 1681065 - DNA, 16 bp, Homo sapiens
gcagtgactggcaggt

SEQ ID NO: 1681066 - DNA, 15 bp, Homo sapiens
gcagtgagctgagat

SEQ ID NO: 1681067 - DNA, 18 bp, Homo sapiens
gcagtgatgacttgctgt

SEQ ID NO: 1681068 - DNA, 14 bp, Homo sapiens
gcagtgatggcgcg

SEQ ID NO: 1681069 - DNA, 18 bp, Homo sapiens
gcagtgattcagcaggcc

SEQ ID NO: 1681070 - DNA, 13 bp, Homo sapiens
gcagtgcatgtga

SEQ ID NO: 1681071 - DNA, 22 bp, Homo sapiens
gcagtgcatgtgaagcatgctt

SEQ ID NO: 1681072 - DNA, 12 bp, Homo sapiens
gcagtgccagct

SEQ ID NO: 1681073 - DNA, 13 bp, Homo sapiens
gcagtgccctttg

SEQ ID NO: 1681074 - DNA, 15 bp, Homo sapiens
gcagtgccttccata

SEQ ID NO: 1681075 - DNA, 16 bp, Homo sapiens
gcagtgccttccataa

SEQ ID NO: 1681076 - DNA, 13 bp, Homo sapiens
gcagtgctgggac

SEQ ID NO: 1681077 - DNA, 16 bp, Homo sapiens
gcagtgctgggaccag

SEQ ID NO: 1681078 - DNA, 23 bp, Homo sapiens
gcagtggacatcgtaggcagcca

SEQ ID NO: 1681079 - DNA, 18 bp, Homo sapiens
gcagtggaggctgctgtg

SEQ ID NO: 1681080 - DNA, 18 bp, Homo sapiens
gcagtggcaggggagcag

SEQ ID NO: 1681081 - DNA, 18 bp, Homo sapiens
gcagtggccaggcaggga

SEQ ID NO: 1681082 - DNA, 14 bp, Homo sapiens
gcagtggcctggcc

SEQ ID NO: 1681083 - DNA, 12 bp, Homo sapiens
gcagtggcctta

SEQ ID NO: 1681084 - DNA, 19 bp, Homo sapiens
gcagtggcgcattctaggc

SEQ ID NO: 1681085 - DNA, 18 bp, Homo sapiens
gcagtggcgcgatctcag

SEQ ID NO: 1681086 - DNA, 22 bp, Homo sapiens
gcagtggcgtgatctcagctca

SEQ ID NO: 1681087 - DNA, 14 bp, Homo sapiens
gcagtggcttttca

SEQ ID NO: 1681088 - DNA, 22 bp, Homo sapiens
gcagtggcttttcatggccctt

SEQ ID NO: 1681089 - DNA, 12 bp, Homo sapiens
gcagtgggcagg

SEQ ID NO: 1681090 - DNA, 18 bp, Homo sapiens
gcagtggtgtggagaagc

SEQ ID NO: 1681091 - DNA, 18 bp, Homo sapiens
gcagtgtcatcagaagat

SEQ ID NO: 1681092 - DNA, 17 bp, Homo sapiens
gcagtgtcccctgcccc

SEQ ID NO: 1681093 - DNA, 18 bp, Homo sapiens
gcagtgtcccttttgcta

SEQ ID NO: 1681094 - DNA, 14 bp, Homo sapiens
gcagtgtcttccat

SEQ ID NO: 1681095 - DNA, 15 bp, Homo sapiens
gcagtgtcttccata

SEQ ID NO: 1681096 - DNA, 16 bp, Homo sapiens
gcagtgtcttccataa

SEQ ID NO: 1681097 - DNA, 20 bp, Homo sapiens
gcagtgtcttccataatgta

SEQ ID NO: 1681098 - DNA, 13 bp, Homo sapiens
gcagtgtgccccc

SEQ ID NO: 1681099 - DNA, 14 bp, Homo sapiens
gcagtgtgcccccc

SEQ ID NO: 1681100 - DNA, 22 bp, Homo sapiens
gcagtgtgccccccagccccgg

SEQ ID NO: 1681101 - DNA, 18 bp, Homo sapiens
gcagtgtggcctcttggc

SEQ ID NO: 1681102 - DNA, 18 bp, Homo sapiens
gcagtgttacttgcaggt

SEQ ID NO: 1681103 - DNA, 18 bp, Homo sapiens
gcagtgttggagtgagga

SEQ ID NO: 1681104 - DNA, 19 bp, Homo sapiens
gcagttatggtgatgactt

SEQ ID NO: 1681105 - DNA, 13 bp, Homo sapiens
gcagttcacctgc

SEQ ID NO: 1681106 - DNA, 20 bp, Homo sapiens
gcagttcagaatggcagtcc

SEQ ID NO: 1681107 - DNA, 19 bp, Homo sapiens
gcagttcagcaccacccta

SEQ ID NO: 1681108 - DNA, 18 bp, Homo sapiens
gcagttcatccgcactgt

SEQ ID NO: 1681109 - DNA, 19 bp, Homo sapiens
gcagttcatccgcactgta

SEQ ID NO: 1681110 - DNA, 12 bp, Homo sapiens
gcagttcctggc

SEQ ID NO: 1681111 - DNA, 13 bp, Homo sapiens
gcagttctagaag

SEQ ID NO: 1681112 - DNA, 16 bp, Homo sapiens
gcagttcttaacccag

SEQ ID NO: 1681113 - DNA, 15 bp, Homo sapiens
gcagttgaaaagact

SEQ ID NO: 1681114 - DNA, 21 bp, Homo sapiens
gcagttgaaaagactccaaag

SEQ ID NO: 1681115 - DNA, 22 bp, Homo sapiens
gcagttgaaaagactccaaaga

SEQ ID NO: 1681116 - DNA, 20 bp, Homo sapiens
gcagttgtgatttctgtgga

SEQ ID NO: 1681117 - DNA, 15 bp, Homo sapiens
gcagtttaacaaaat

SEQ ID NO: 1681118 - DNA, 17 bp, Homo sapiens
gcagtttcttttcacat

SEQ ID NO: 1681119 - DNA, 13 bp, Homo sapiens
gcagtttgcaaaa

SEQ ID NO: 1681120 - DNA, 21 bp, Homo sapiens
gcagtttgcctggtgcagtgg

SEQ ID NO: 1681121 - DNA, 15 bp, Homo sapiens
gcagtttggccctgg

SEQ ID NO: 1681122 - DNA, 16 bp, Homo sapiens
gcagtttggccctgga

SEQ ID NO: 1681123 - DNA, 18 bp, Homo sapiens
gcagtttggccctggagc

SEQ ID NO: 1681124 - DNA, 14 bp, Homo sapiens
gcagtttgggaggt

SEQ ID NO: 1681125 - DNA, 13 bp, Homo sapiens
gcagttttaagaa

SEQ ID NO: 1681126 - DNA, 21 bp, Homo sapiens
gcagttttgttttaaaactgg

SEQ ID NO: 1681127 - DNA, 14 bp, Homo sapiens
gcagtttttcagga

SEQ ID NO: 1681128 - DNA, 14 bp, Homo sapiens
gcataaaagatcac

SEQ ID NO: 1681129 - DNA, 19 bp, Homo sapiens
gcataaagctcaaatgaaa

SEQ ID NO: 1681130 - DNA, 18 bp, Homo sapiens
gcataacaaggtccaaga

SEQ ID NO: 1681131 - DNA, 18 bp, Homo sapiens
gcataagattaaaggaag

SEQ ID NO: 1681132 - DNA, 19 bp, Homo sapiens
gcataataagccatggctg

SEQ ID NO: 1681133 - DNA, 12 bp, Homo sapiens
gcatacaaaata

SEQ ID NO: 1681134 - DNA, 15 bp, Homo sapiens
gcatacaaaatattt

SEQ ID NO: 1681135 - DNA, 16 bp, Homo sapiens
gcatacaaaatattta

SEQ ID NO: 1681136 - DNA, 21 bp, Homo sapiens
gcatacaaaatatttaagtga

SEQ ID NO: 1681137 - DNA, 13 bp, Homo sapiens
gcatacaatctga

SEQ ID NO: 1681138 - DNA, 18 bp, Homo sapiens
gcatacacacatgccctc

SEQ ID NO: 1681139 - DNA, 21 bp, Homo sapiens
gcatacacccccacctcctgc

SEQ ID NO: 1681140 - DNA, 23 bp, Homo sapiens
gcataccaggttttacacttgca

SEQ ID NO: 1681141 - DNA, 18 bp, Homo sapiens
gcatacccaaaccaggtg

SEQ ID NO: 1681142 - DNA, 13 bp, Homo sapiens
gcatactttttaa

SEQ ID NO: 1681143 - DNA, 16 bp, Homo sapiens
gcatagaggcttctcc

SEQ ID NO: 1681144 - DNA, 19 bp, Homo sapiens
gcatagataatattgtttg

SEQ ID NO: 1681145 - DNA, 18 bp, Homo sapiens
gcatgattgcagaattgt

SEQ ID NO: 1681146 - DNA, 17 bp, Homo sapiens
gcatgcacacggctggt

SEQ ID NO: 1681147 - DNA, 16 bp, Homo sapiens
gcatgcacagctgctt

SEQ ID NO: 1681148 - DNA, 19 bp, Homo sapiens
gcatgcacatgctgtctgg

SEQ ID NO: 1681149 - DNA, 23 bp, Homo sapiens
gcatgcacgggcatgcacacggc

SEQ ID NO: 1681150 - DNA, 24 bp, Homo sapiens
gcatgcacgggcatgcacacggct

SEQ ID NO: 1681151 - DNA, 12 bp, Homo sapiens
gcatgcagtgtt

SEQ ID NO: 1681152 - DNA, 22 bp, Homo sapiens
gcatgccaggacccgccagccc

SEQ ID NO: 1681153 - DNA, 11 bp, Homo sapiens
gcatgcctctg

SEQ ID NO: 1681154 - DNA, 21 bp, Homo sapiens
gcatgcctgtaatcccagaac

SEQ ID NO: 1681155 - DNA, 14 bp, Homo sapiens
gcatgcgcagaggc

SEQ ID NO: 1681156 - DNA, 18 bp, Homo sapiens
gcatgcgcagaggccagt

SEQ ID NO: 1681157 - DNA, 18 bp, Homo sapiens
gcatgctctctgcagcca

SEQ ID NO: 1681158 - DNA, 13 bp, Homo sapiens
gcatgctctggaa

SEQ ID NO: 1681159 - DNA, 20 bp, Homo sapiens
gcatgctctggaagcctgga

SEQ ID NO: 1681160 - DNA, 13 bp, Homo sapiens
gcatgctgcccag

SEQ ID NO: 1681161 - DNA, 15 bp, Homo sapiens
gcatgctgcccagcc

SEQ ID NO: 1681162 - DNA, 14 bp, Homo sapiens
gcatgctgtagctg

SEQ ID NO: 1681163 - DNA, 14 bp, Homo sapiens
gcatgcttcctttc

SEQ ID NO: 1681164 - DNA, 15 bp, Homo sapiens
gcatgcttcctttct

SEQ ID NO: 1681165 - DNA, 19 bp, Homo sapiens
gcatgcttcctttctctcc

SEQ ID NO: 1681166 - DNA, 23 bp, Homo sapiens
gcatgcttcctttctctcctggc

SEQ ID NO: 1681167 - DNA, 16 bp, Homo sapiens
gcatgcttcttctcaa

SEQ ID NO: 1681168 - DNA, 15 bp, Homo sapiens
gcatgcttgggctga

SEQ ID NO: 1681169 - DNA, 23 bp, Homo sapiens
gcatggaaaaatggttgatggaa

SEQ ID NO: 1681170 - DNA, 19 bp, Homo sapiens
gcatggacaccttgtgttt

SEQ ID NO: 1681171 - DNA, 17 bp, Homo sapiens
gcattctttggtaattt

SEQ ID NO: 1681172 - DNA, 20 bp, Homo sapiens
gcattctttggtaatttttt

SEQ ID NO: 1681173 - DNA, 17 bp, Homo sapiens
gcattgccatgtggaag

SEQ ID NO: 1681174 - DNA, 15 bp, Homo sapiens
gcattgcctggactg

SEQ ID NO: 1681175 - DNA, 12 bp, Homo sapiens
gcattgctgtgt

SEQ ID NO: 1681176 - DNA, 15 bp, Homo sapiens
gcattgctttccact

SEQ ID NO: 1681177 - DNA, 13 bp, Homo sapiens
gcattgctttctg

SEQ ID NO: 1681178 - DNA, 15 bp, Homo sapiens
gcattggcctggcct

SEQ ID NO: 1681179 - DNA, 20 bp, Homo sapiens
gcattgggctgacacctacc

SEQ ID NO: 1681180 - DNA, 10 bp, Homo sapiens
gcattgtaaa

SEQ ID NO: 1681181 - DNA, 16 bp, Homo sapiens
gcattgtaaatgtgct

SEQ ID NO: 1681182 - DNA, 16 bp, Homo sapiens
gcattgtctttgctgt

SEQ ID NO: 1681183 - DNA, 20 bp, Homo sapiens
gcattgtgtcagaaacatga

SEQ ID NO: 1681184 - DNA, 17 bp, Homo sapiens
gcattgttattgtggaa

SEQ ID NO: 1681185 - DNA, 13 bp, Homo sapiens
gcattgttattta

SEQ ID NO: 1681186 - DNA, 13 bp, Homo sapiens
gcatttaaaatac

SEQ ID NO: 1681187 - DNA, 18 bp, Homo sapiens
gcatttaaaatggaaaat

SEQ ID NO: 1681188 - DNA, 12 bp, Homo sapiens
gcatttaataaa

SEQ ID NO: 1681189 - DNA, 13 bp, Homo sapiens
gcatttaataaag

SEQ ID NO: 1681190 - DNA, 17 bp, Homo sapiens
gcatttaataaagatga

SEQ ID NO: 1681191 - DNA, 20 bp, Homo sapiens
gcatttaataaagatgagtt

SEQ ID NO: 1681192 - DNA, 15 bp, Homo sapiens
gcatttaggagaata

SEQ ID NO: 1681193 - DNA, 19 bp, Homo sapiens
gcatttagtgaagttgtgc

SEQ ID NO: 1681194 - DNA, 20 bp, Homo sapiens
gcatttcaaagccctgcctc

SEQ ID NO: 1681195 - DNA, 12 bp, Homo sapiens
gcatttcagaaa

SEQ ID NO: 1681196 - DNA, 12 bp, Homo sapiens
gcatttccaaac

SEQ ID NO: 1681197 - DNA, 21 bp, Homo sapiens
gcatttccaacaccacagaca

SEQ ID NO: 1681198 - DNA, 17 bp, Homo sapiens
gcatttctcttcctaaa

SEQ ID NO: 1681199 - DNA, 19 bp, Homo sapiens
gcatttctcttcctaaatt

SEQ ID NO: 1681200 - DNA, 20 bp, Homo sapiens
gcatttcttgatgttgctta

SEQ ID NO: 1681201 - DNA, 21 bp, Homo sapiens
gcatttcttgatgttgcttag

SEQ ID NO: 1681202 - DNA, 13 bp, Homo sapiens
gcagctggcccac

SEQ ID NO: 1681203 - DNA, 20 bp, Homo sapiens
gcagctgggacccctcccaa

SEQ ID NO: 1681204 - DNA, 12 bp, Homo sapiens
gcagctgggccc

SEQ ID NO: 1681205 - DNA, 18 bp, Homo sapiens
gcagctgggccccaccta

SEQ ID NO: 1681206 - DNA, 18 bp, Homo sapiens
gcagctgggccccatgct

SEQ ID NO: 1681207 - DNA, 20 bp, Homo sapiens
gcagctgggccccatgctct

SEQ ID NO: 1681208 - DNA, 21 bp, Homo sapiens
gcagctgggccccatgctctg

SEQ ID NO: 1681209 - DNA, 22 bp, Homo sapiens
gcagctgggccccatgctctgc

SEQ ID NO: 1681210 - DNA, 20 bp, Homo sapiens
gcagctggggagcagctgag

SEQ ID NO: 1681211 - DNA, 15 bp, Homo sapiens
gcagctggtgcccca

SEQ ID NO: 1681212 - DNA, 22 bp, Homo sapiens
gcagctggtgccccacctgcct

SEQ ID NO: 1681213 - DNA, 16 bp, Homo sapiens
gcagctgtgctgcacc

SEQ ID NO: 1681214 - DNA, 15 bp, Homo sapiens
gcagctgtttctcat

SEQ ID NO: 1681215 - DNA, 14 bp, Homo sapiens
gcagcttcaccaga

SEQ ID NO: 1681216 - DNA, 15 bp, Homo sapiens
gcagcttccttctgg

SEQ ID NO: 1681217 - DNA, 17 bp, Homo sapiens
gcagcttctaagagcga

SEQ ID NO: 1681218 - DNA, 15 bp, Homo sapiens
gcagcttctagacag

SEQ ID NO: 1681219 - DNA, 15 bp, Homo sapiens
gcagcttgagagggc

SEQ ID NO: 1681220 - DNA, 16 bp, Homo sapiens
gcagctttaaaaaaat

SEQ ID NO: 1681221 - DNA, 14 bp, Homo sapiens
gcagctttatgttc

SEQ ID NO: 1681222 - DNA, 22 bp, Homo sapiens
gcagcttttggtctccttgggc

SEQ ID NO: 1681223 - DNA, 21 bp, Homo sapiens
gcaggaaagtttacccatgaa

SEQ ID NO: 1681224 - DNA, 16 bp, Homo sapiens
gcaggaacaaacaggg

SEQ ID NO: 1681225 - DNA, 16 bp, Homo sapiens
gcaggaacgagcactg

SEQ ID NO: 1681226 - DNA, 21 bp, Homo sapiens
gcaggaacgagcactggccag

SEQ ID NO: 1681227 - DNA, 23 bp, Homo sapiens
gcaggaacgagcactggccagag

SEQ ID NO: 1681228 - DNA, 15 bp, Homo sapiens
gcaggaagaggccca

SEQ ID NO: 1681229 - DNA, 17 bp, Homo sapiens
gcaggaagaggcccact

SEQ ID NO: 1681230 - DNA, 16 bp, Homo sapiens
gcaggaagccaggctg

SEQ ID NO: 1681231 - DNA, 20 bp, Homo sapiens
gcaggaagccaggctgagtg

SEQ ID NO: 1681232 - DNA, 13 bp, Homo sapiens
gcaggaaggagag

SEQ ID NO: 1681233 - DNA, 16 bp, Homo sapiens
gcaggaaggagagcct

SEQ ID NO: 1681234 - DNA, 17 bp, Homo sapiens
gcaggaaggagagcctg

SEQ ID NO: 1681235 - DNA, 21 bp, Homo sapiens
gcaggaatatatgtgtgccta

SEQ ID NO: 1681236 - DNA, 10 bp, Homo sapiens
gcaggaatgg

SEQ ID NO: 1681237 - DNA, 19 bp, Homo sapiens
gcaggaattggtggcagat

SEQ ID NO: 1681238 - DNA, 15 bp, Homo sapiens
gcaggacagctcttg

SEQ ID NO: 1681239 - DNA, 13 bp, Homo sapiens
gcaggacaggagg

SEQ ID NO: 1681240 - DNA, 14 bp, Homo sapiens
gcaggacaggaggc

SEQ ID NO: 1681241 - DNA, 19 bp, Homo sapiens
gcaggacaggaggcggccc

SEQ ID NO: 1681242 - DNA, 23 bp, Homo sapiens
gcaggacaggaggcggcccggcc

SEQ ID NO: 1681243 - DNA, 22 bp, Homo sapiens
gcaggaccagccagcagcagcc

SEQ ID NO: 1681244 - DNA, 22 bp, Homo sapiens
gcaggactccaggcccaaggct

SEQ ID NO: 1681245 - DNA, 23 bp, Homo sapiens
gcaggactccaggcccaaggctc

SEQ ID NO: 1681246 - DNA, 18 bp, Homo sapiens
gcaggactgaggacaggc

SEQ ID NO: 1681247 - DNA, 20 bp, Homo sapiens
gcaggactgaggacaggccc

SEQ ID NO: 1681248 - DNA, 15 bp, Homo sapiens
gcaggactgttgtgg

SEQ ID NO: 1681249 - DNA, 22 bp, Homo sapiens
gcaggagaatcacttgcactcc

SEQ ID NO: 1681250 - DNA, 17 bp, Homo sapiens
gcaggagaatcagcctg

SEQ ID NO: 1681251 - DNA, 20 bp, Homo sapiens
gcaggagagactgagcagcc

SEQ ID NO: 1681252 - DNA, 21 bp, Homo sapiens
gcaggagagtgtgtgggcagg

SEQ ID NO: 1681253 - DNA, 22 bp, Homo sapiens
gcaggagagtgtgtgggcaggg

SEQ ID NO: 1681254 - DNA, 23 bp, Homo sapiens
gcaggagagtgtgtgggcagggt

SEQ ID NO: 1681255 - DNA, 15 bp, Homo sapiens
gcaggagcagctgtg

SEQ ID NO: 1681256 - DNA, 17 bp, Homo sapiens
gcaggagcagctgtgct

SEQ ID NO: 1681257 - DNA, 15 bp, Homo sapiens
gcaggagcccctggg

SEQ ID NO: 1681258 - DNA, 21 bp, Homo sapiens
gcaggagccttcctttctcct

SEQ ID NO: 1681259 - DNA, 22 bp, Homo sapiens
gcaggagccttcctttctcctg

SEQ ID NO: 1681260 - DNA, 23 bp, Homo sapiens
gcaggagccttcctttctcctgc

SEQ ID NO: 1681261 - DNA, 20 bp, Homo sapiens
gcaggagctagttctcagct

SEQ ID NO: 1681262 - DNA, 14 bp, Homo sapiens
gcaggagctcctgg

SEQ ID NO: 1681263 - DNA, 17 bp, Homo sapiens
gcaggagctcctggaag

SEQ ID NO: 1681264 - DNA, 17 bp, Homo sapiens
gcaggaggccccaggct

SEQ ID NO: 1681265 - DNA, 22 bp, Homo sapiens
gcaggagggccctacctgattg

SEQ ID NO: 1681266 - DNA, 14 bp, Homo sapiens
gcaggaggtggaga

SEQ ID NO: 1681267 - DNA, 13 bp, Homo sapiens
gcaggagtgccag

SEQ ID NO: 1681268 - DNA, 14 bp, Homo sapiens
gcaggagtgccagg

SEQ ID NO: 1681269 - DNA, 18 bp, Homo sapiens
gcaggagtgccaggacca

SEQ ID NO: 1681270 - DNA, 21 bp, Homo sapiens
gcaggagtgccaggaccagcc

SEQ ID NO: 1681271 - DNA, 14 bp, Homo sapiens
gcaggatccctcct

SEQ ID NO: 1681272 - DNA, 22 bp, Homo sapiens
gcaggatccctcctgagctcgg

SEQ ID NO: 1681273 - DNA, 18 bp, Homo sapiens
gcaggatccgctgccacc

SEQ ID NO: 1681274 - DNA, 16 bp, Homo sapiens
gcaggcaccgccacgt

SEQ ID NO: 1681275 - DNA, 23 bp, Homo sapiens
gcaggcaccgccacgtcccagca

SEQ ID NO: 1681276 - DNA, 20 bp, Homo sapiens
gcaggcacgggtggtccccg

SEQ ID NO: 1681277 - DNA, 22 bp, Homo sapiens
gcaggcagataagttggagcag

SEQ ID NO: 1681278 - DNA, 22 bp, Homo sapiens
gcaggcaggaacaaacagggct

SEQ ID NO: 1681279 - DNA, 19 bp, Homo sapiens
gcaggcaggtggactgact

SEQ ID NO: 1681280 - DNA, 23 bp, Homo sapiens
gcaggcaggtggactgactgtgt

SEQ ID NO: 1681281 - DNA, 17 bp, Homo sapiens
gcaggcagttctagaag

SEQ ID NO: 1681282 - DNA, 16 bp, Homo sapiens
gcaggcatggccctgg

SEQ ID NO: 1681283 - DNA, 19 bp, Homo sapiens
gcaggcatggccctgggcg

SEQ ID NO: 1681284 - DNA, 16 bp, Homo sapiens
gcaggcatgtcctgga

SEQ ID NO: 1681285 - DNA, 19 bp, Homo sapiens
gcaggccaaggccttctcc

SEQ ID NO: 1681286 - DNA, 20 bp, Homo sapiens
gcaggccaaggccttctcct

SEQ ID NO: 1681287 - DNA, 21 bp, Homo sapiens
gcaggccagcccggacctctg

SEQ ID NO: 1681288 - DNA, 19 bp, Homo sapiens
gcaggccaggctgcctcgg

SEQ ID NO: 1681289 - DNA, 17 bp, Homo sapiens
gcaggcccactccccag

SEQ ID NO: 1681290 - DNA, 18 bp, Homo sapiens
gcaggcccactccccagc

SEQ ID NO: 1681291 - DNA, 14 bp, Homo sapiens
gcaggcccagcatg

SEQ ID NO: 1681292 - DNA, 22 bp, Homo sapiens
gcaggcccagcatgcaggtggt

SEQ ID NO: 1681293 - DNA, 12 bp, Homo sapiens
gcaggccctggc

SEQ ID NO: 1681294 - DNA, 13 bp, Homo sapiens
gcaggcccttccc

SEQ ID NO: 1681295 - DNA, 15 bp, Homo sapiens
gcaggcctaagacat

SEQ ID NO: 1681296 - DNA, 20 bp, Homo sapiens
gcaggcctccaacgcccctg

SEQ ID NO: 1681297 - DNA, 21 bp, Homo sapiens
gcaggcctccaacgcccctgt

SEQ ID NO: 1681298 - DNA, 15 bp, Homo sapiens
gcaggcctgagaatg

SEQ ID NO: 1681299 - DNA, 19 bp, Homo sapiens
gcaggcctgggacccagct

SEQ ID NO: 1681300 - DNA, 20 bp, Homo sapiens
gcaggcgggggctgctcagc

SEQ ID NO: 1681301 - DNA, 15 bp, Homo sapiens
gcaggctcactgcca

SEQ ID NO: 1681302 - DNA, 18 bp, Homo sapiens
gcaggctccatgcacctc

SEQ ID NO: 1681303 - DNA, 17 bp, Homo sapiens
gccactgaagctgggat

SEQ ID NO: 1681304 - DNA, 14 bp, Homo sapiens
gccactgaggagac

SEQ ID NO: 1681305 - DNA, 18 bp, Homo sapiens
gccactgaggagacagaa

SEQ ID NO: 1681306 - DNA, 19 bp, Homo sapiens
gccactgcactccagcctg

SEQ ID NO: 1681307 - DNA, 20 bp, Homo sapiens
gccactgcactccagcctgg

SEQ ID NO: 1681308 - DNA, 21 bp, Homo sapiens
gccactgcactccagcctggg

SEQ ID NO: 1681309 - DNA, 16 bp, Homo sapiens
gccactgccaggcacc

SEQ ID NO: 1681310 - DNA, 22 bp, Homo sapiens
gccactgccaggcacctggcct

SEQ ID NO: 1681311 - DNA, 22 bp, Homo sapiens
gccactgccccccgaggctgct

SEQ ID NO: 1681312 - DNA, 16 bp, Homo sapiens
gccactggaaggagca

SEQ ID NO: 1681313 - DNA, 16 bp, Homo sapiens
gccactgggacagctg

SEQ ID NO: 1681314 - DNA, 18 bp, Homo sapiens
gccactgggacagctggc

SEQ ID NO: 1681315 - DNA, 15 bp, Homo sapiens
gccactgggcacctg

SEQ ID NO: 1681316 - DNA, 17 bp, Homo sapiens
gccactgggcacctgcg

SEQ ID NO: 1681317 - DNA, 17 bp, Homo sapiens
gccactgggtctcactc

SEQ ID NO: 1681318 - DNA, 19 bp, Homo sapiens
gccactggtttctcagaat

SEQ ID NO: 1681319 - DNA, 15 bp, Homo sapiens
gccactgtggccaga

SEQ ID NO: 1681320 - DNA, 17 bp, Homo sapiens
gccactgtggccagagc

SEQ ID NO: 1681321 - DNA, 21 bp, Homo sapiens
gccactgtggccagagctgga

SEQ ID NO: 1681322 - DNA, 12 bp, Homo sapiens
gccactgtgtct

SEQ ID NO: 1681323 - DNA, 16 bp, Homo sapiens
gccacttaatgtatgt

SEQ ID NO: 1681324 - DNA, 18 bp, Homo sapiens
gccacttaatgtatgtta

SEQ ID NO: 1681325 - DNA, 19 bp, Homo sapiens
gccacttaatgtatgttac

SEQ ID NO: 1681326 - DNA, 21 bp, Homo sapiens
gccacttccccctcttcttct

SEQ ID NO: 1681327 - DNA, 23 bp, Homo sapiens
gccacttctcactcaccactacc

SEQ ID NO: 1681328 - DNA, 12 bp, Homo sapiens
gccacttctggc

SEQ ID NO: 1681329 - DNA, 15 bp, Homo sapiens
gccacttgaaatgtt

SEQ ID NO: 1681330 - DNA, 15 bp, Homo sapiens
gccacttgacattcc

SEQ ID NO: 1681331 - DNA, 17 bp, Homo sapiens
gccacttgacattcctt

SEQ ID NO: 1681332 - DNA, 16 bp, Homo sapiens
gccactttcaagctgc

SEQ ID NO: 1681333 - DNA, 23 bp, Homo sapiens
gccactttcagagcccccagccc

SEQ ID NO: 1681334 - DNA, 16 bp, Homo sapiens
gccactttggcttctc

SEQ ID NO: 1681335 - DNA, 22 bp, Homo sapiens
gccactttggtacatggccagt

SEQ ID NO: 1681336 - DNA, 12 bp, Homo sapiens
gccagaaataaa

SEQ ID NO: 1681337 - DNA, 19 bp, Homo sapiens
gccagaagcctctgcctcc

SEQ ID NO: 1681338 - DNA, 14 bp, Homo sapiens
gccagaaggagggc

SEQ ID NO: 1681339 - DNA, 15 bp, Homo sapiens
gccagaaggagggca

SEQ ID NO: 1681340 - DNA, 15 bp, Homo sapiens
gccagacactctgct

SEQ ID NO: 1681341 - DNA, 19 bp, Homo sapiens
gccagacactctgctctgc

SEQ ID NO: 1681342 - DNA, 18 bp, Homo sapiens
gccagacatgccacaagg

SEQ ID NO: 1681343 - DNA, 18 bp, Homo sapiens
gccagaccagcaggctgg

SEQ ID NO: 1681344 - DNA, 16 bp, Homo sapiens
gccagaccccacgctg

SEQ ID NO: 1681345 - DNA, 19 bp, Homo sapiens
gccagactggcacagtttt

SEQ ID NO: 1681346 - DNA, 12 bp, Homo sapiens
gccagagaggag

SEQ ID NO: 1681347 - DNA, 14 bp, Homo sapiens
gccagagagggccc

SEQ ID NO: 1681348 - DNA, 16 bp, Homo sapiens
gccagagagggcccag

SEQ ID NO: 1681349 - DNA, 17 bp, Homo sapiens
gccagagagggcccagc

SEQ ID NO: 1681350 - DNA, 20 bp, Homo sapiens
gccagagatccaaaagaagc

SEQ ID NO: 1681351 - DNA, 17 bp, Homo sapiens
gccagagccaacctgga

SEQ ID NO: 1681352 - DNA, 23 bp, Homo sapiens
gccagagccaacctggacttcct

SEQ ID NO: 1681353 - DNA, 20 bp, Homo sapiens
gccagagcccttcactgcca

SEQ ID NO: 1681354 - DNA, 11 bp, Homo sapiens
gccagagctga

SEQ ID NO: 1681355 - DNA, 14 bp, Homo sapiens
gccagagctgaacc

SEQ ID NO: 1681356 - DNA, 14 bp, Homo sapiens
gccagagctggaag

SEQ ID NO: 1681357 - DNA, 18 bp, Homo sapiens
gccagagctggaaggcag

SEQ ID NO: 1681358 - DNA, 21 bp, Homo sapiens
gccagagctggaaggcagggc

SEQ ID NO: 1681359 - DNA, 23 bp, Homo sapiens
gccagagctggaaggcagggcag

SEQ ID NO: 1681360 - DNA, 15 bp, Homo sapiens
gccagagctgtgcct

SEQ ID NO: 1681361 - DNA, 16 bp, Homo sapiens
gccagagctgtgcctg

SEQ ID NO: 1681362 - DNA, 23 bp, Homo sapiens
gccagagctgtgcctgctcagca

SEQ ID NO: 1681363 - DNA, 18 bp, Homo sapiens
gccagaggaatcctggca

SEQ ID NO: 1681364 - DNA, 19 bp, Homo sapiens
gccagaggatgctctttcc

SEQ ID NO: 1681365 - DNA, 15 bp, Homo sapiens
gccagagggccagca

SEQ ID NO: 1681366 - DNA, 17 bp, Homo sapiens
gccagagggccagcagg

SEQ ID NO: 1681367 - DNA, 19 bp, Homo sapiens
gccagagggccagcaggct

SEQ ID NO: 1681368 - DNA, 19 bp, Homo sapiens
gccagaggtgcttcaccct

SEQ ID NO: 1681369 - DNA, 17 bp, Homo sapiens
gccagaggtgggcaggt

SEQ ID NO: 1681370 - DNA, 17 bp, Homo sapiens
gccagagtggcctggcc

SEQ ID NO: 1681371 - DNA, 23 bp, Homo sapiens
gccagagtggcctggccaggagc

SEQ ID NO: 1681372 - DNA, 24 bp, Homo sapiens
gccagagtggcctggccaggagct

SEQ ID NO: 1681373 - DNA, 23 bp, Homo sapiens
gccagagttaggttgtctccagg

SEQ ID NO: 1681374 - DNA, 13 bp, Homo sapiens
gccagagttcctg

SEQ ID NO: 1681375 - DNA, 20 bp, Homo sapiens
gccagagtttttaaagcctt

SEQ ID NO: 1681376 - DNA, 21 bp, Homo sapiens
gccagagtttttaaagccttc

SEQ ID NO: 1681377 - DNA, 18 bp, Homo sapiens
gccagcccggacctctgg

SEQ ID NO: 1681378 - DNA, 21 bp, Homo sapiens
gccagcccggccgctccacca

SEQ ID NO: 1681379 - DNA, 14 bp, Homo sapiens
gccagccctccctg

SEQ ID NO: 1681380 - DNA, 24 bp, Homo sapiens
gccagccctccctggctgtgagca

SEQ ID NO: 1681381 - DNA, 21 bp, Homo sapiens
gccagccctccctgtcctcct

SEQ ID NO: 1681382 - DNA, 15 bp, Homo sapiens
gccagccctgcagcc

SEQ ID NO: 1681383 - DNA, 16 bp, Homo sapiens
gccagccctgcagccc

SEQ ID NO: 1681384 - DNA, 17 bp, Homo sapiens
gccagccctgcagccca

SEQ ID NO: 1681385 - DNA, 15 bp, Homo sapiens
gccagccggtgcctg

SEQ ID NO: 1681386 - DNA, 21 bp, Homo sapiens
gccagccgtgatgctcaggct

SEQ ID NO: 1681387 - DNA, 13 bp, Homo sapiens
gccagcctcagaa

SEQ ID NO: 1681388 - DNA, 23 bp, Homo sapiens
gccagcctcagaaggccccagag

SEQ ID NO: 1681389 - DNA, 12 bp, Homo sapiens
gccagcctcagt

SEQ ID NO: 1681390 - DNA, 19 bp, Homo sapiens
gccagcctcagtgccactt

SEQ ID NO: 1681391 - DNA, 12 bp, Homo sapiens
gccagcctcctc

SEQ ID NO: 1681392 - DNA, 13 bp, Homo sapiens
gccagcctcctct

SEQ ID NO: 1681393 - DNA, 12 bp, Homo sapiens
gccagcctggct

SEQ ID NO: 1681394 - DNA, 15 bp, Homo sapiens
gccagcctggctctg

SEQ ID NO: 1681395 - DNA, 20 bp, Homo sapiens
gccagccttgagccctggct

SEQ ID NO: 1681396 - DNA, 12 bp, Homo sapiens
gccagccttggg

SEQ ID NO: 1681397 - DNA, 15 bp, Homo sapiens
gccagcggctccaac

SEQ ID NO: 1681398 - DNA, 16 bp, Homo sapiens
gccagcgggcacaggg

SEQ ID NO: 1681399 - DNA, 17 bp, Homo sapiens
gccagcgggcacagggc

SEQ ID NO: 1681400 - DNA, 13 bp, Homo sapiens
gccagctccccac

SEQ ID NO: 1681401 - DNA, 19 bp, Homo sapiens
gccagctcctgggcagctt

SEQ ID NO: 1681402 - DNA, 14 bp, Homo sapiens
gccagctctcagcc

SEQ ID NO: 1681403 - DNA, 13 bp, Homo sapiens
gccagctctgagg

SEQ ID NO: 1681404 - DNA, 14 bp, Homo sapiens
gccagctctgaggg

SEQ ID NO: 1681405 - DNA, 13 bp, Homo sapiens
gccagctctggag

SEQ ID NO: 1681406 - DNA, 18 bp, Homo sapiens
gccagctgacatcttgaa

SEQ ID NO: 1681407 - DNA, 21 bp, Homo sapiens
gccagctgccctatgggcctg

SEQ ID NO: 1681408 - DNA, 13 bp, Homo sapiens
gccagctgccgca

SEQ ID NO: 1681409 - DNA, 19 bp, Homo sapiens
gccagctgccgcaccagcc

SEQ ID NO: 1681410 - DNA, 14 bp, Homo sapiens
gccagctgccttcc

SEQ ID NO: 1681411 - DNA, 15 bp, Homo sapiens
gccagctgccttcct

SEQ ID NO: 1681412 - DNA, 11 bp, Homo sapiens
gccagctgctt

SEQ ID NO: 1681413 - DNA, 13 bp, Homo sapiens
gccagctggagaa

SEQ ID NO: 1681414 - DNA, 13 bp, Homo sapiens
gccagcttaaacc

SEQ ID NO: 1681415 - DNA, 20 bp, Homo sapiens
gccagcttaaacccatacaa

SEQ ID NO: 1681416 - DNA, 13 bp, Homo sapiens
gccagcttctctc

SEQ ID NO: 1681417 - DNA, 19 bp, Homo sapiens
gccagcttctctctccagg

SEQ ID NO: 1681418 - DNA, 15 bp, Homo sapiens
gccagctttccctgc

SEQ ID NO: 1681419 - DNA, 22 bp, Homo sapiens
gccaggaacctgtcctaaggaa

SEQ ID NO: 1681420 - DNA, 19 bp, Homo sapiens
gccaggaatttcccaggac

SEQ ID NO: 1681421 - DNA, 21 bp, Homo sapiens
gccaggaatttcccaggaccc

SEQ ID NO: 1681422 - DNA, 22 bp, Homo sapiens
gccaggaatttcccaggaccct

SEQ ID NO: 1681423 - DNA, 19 bp, Homo sapiens
gccaggacccgccagcccc

SEQ ID NO: 1681424 - DNA, 20 bp, Homo sapiens
gccaggacccgccagccccg

SEQ ID NO: 1681425 - DNA, 15 bp, Homo sapiens
gccaggagaagctca

SEQ ID NO: 1681426 - DNA, 20 bp, Homo sapiens
gccaggagccgggcctccca

SEQ ID NO: 1681427 - DNA, 13 bp, Homo sapiens
gccaggagctggg

SEQ ID NO: 1681428 - DNA, 22 bp, Homo sapiens
gccaggagctgggcagaaggcc

SEQ ID NO: 1681429 - DNA, 17 bp, Homo sapiens
gccaggagtctgtgctc

SEQ ID NO: 1681430 - DNA, 14 bp, Homo sapiens
gccaggatggaatg

SEQ ID NO: 1681431 - DNA, 13 bp, Homo sapiens
gccaggcacctgg

SEQ ID NO: 1681432 - DNA, 15 bp, Homo sapiens
gccaggcacctggcc

SEQ ID NO: 1681433 - DNA, 17 bp, Homo sapiens
gccaggcacctggcctg

SEQ ID NO: 1681434 - DNA, 18 bp, Homo sapiens
gccaggcacctggcctgc

SEQ ID NO: 1681435 - DNA, 16 bp, Homo sapiens
gccaggcactgccctt

SEQ ID NO: 1681436 - DNA, 23 bp, Homo sapiens
gccaggcactgcccttttcagga

SEQ ID NO: 1681437 - DNA, 22 bp, Homo sapiens
gccaggcagagctgagggccct

SEQ ID NO: 1681438 - DNA, 23 bp, Homo sapiens
gccaggcagagctgagggccctg

SEQ ID NO: 1681439 - DNA, 12 bp, Homo sapiens
gccaggcagagg

SEQ ID NO: 1681440 - DNA, 14 bp, Homo sapiens
gccaggcagatctg

SEQ ID NO: 1681441 - DNA, 19 bp, Homo sapiens
gccaggcaggcgggcgcca

SEQ ID NO: 1681442 - DNA, 21 bp, Homo sapiens
gccaggcagggagtgtctgca

SEQ ID NO: 1681443 - DNA, 16 bp, Homo sapiens
gccaggcaggggtggg

SEQ ID NO: 1681444 - DNA, 17 bp, Homo sapiens
gccaggcaggggtgggg

SEQ ID NO: 1681445 - DNA, 17 bp, Homo sapiens
gccaggcaggtccacag

SEQ ID NO: 1681446 - DNA, 22 bp, Homo sapiens
gccaggccaatgttgctgatgg

SEQ ID NO: 1681447 - DNA, 19 bp, Homo sapiens
gccaggcccatctcaggtg

SEQ ID NO: 1681448 - DNA, 16 bp, Homo sapiens
gccaggcctgtatgag

SEQ ID NO: 1681449 - DNA, 17 bp, Homo sapiens
gccaggcgctgcagggc

SEQ ID NO: 1681450 - DNA, 18 bp, Homo sapiens
gccaggcgttggtgccac

SEQ ID NO: 1681451 - DNA, 20 bp, Homo sapiens
gccaggcgttggtgccactt

SEQ ID NO: 1681452 - DNA, 21 bp, Homo sapiens
gccaggcgttggtgccacttc

SEQ ID NO: 1681453 - DNA, 22 bp, Homo sapiens
gccaggctcactcacagagtca

SEQ ID NO: 1681454 - DNA, 16 bp, Homo sapiens
gccaggctcctacctg

SEQ ID NO: 1681455 - DNA, 14 bp, Homo sapiens
gccaggctccttcc

SEQ ID NO: 1681456 - DNA, 15 bp, Homo sapiens
gccaggctccttcct

SEQ ID NO: 1681457 - DNA, 18 bp, Homo sapiens
gccaggctccttcctgtc

SEQ ID NO: 1681458 - DNA, 21 bp, Homo sapiens
gccaggctgagtgagccacag

SEQ ID NO: 1681459 - DNA, 15 bp, Homo sapiens
gccaggctgcacagc

SEQ ID NO: 1681460 - DNA, 20 bp, Homo sapiens
gccaggctgcctcctgccct

SEQ ID NO: 1681461 - DNA, 14 bp, Homo sapiens
gccaggctgcctcg

SEQ ID NO: 1681462 - DNA, 17 bp, Homo sapiens
gccagggaacagcccca

SEQ ID NO: 1681463 - DNA, 23 bp, Homo sapiens
gccagggacccaggtgtgcctgt

SEQ ID NO: 1681464 - DNA, 14 bp, Homo sapiens
gccagggagaagct

SEQ ID NO: 1681465 - DNA, 19 bp, Homo sapiens
gccagggagactttctgaa

SEQ ID NO: 1681466 - DNA, 14 bp, Homo sapiens
gccagggagcgagt

SEQ ID NO: 1681467 - DNA, 15 bp, Homo sapiens
gccagggcagaggaa

SEQ ID NO: 1681468 - DNA, 11 bp, Homo sapiens
gccagggcagc

SEQ ID NO: 1681469 - DNA, 21 bp, Homo sapiens
gccagggcagcaagggacctg

SEQ ID NO: 1681470 - DNA, 24 bp, Homo sapiens
gccagggcagcaagggacctgctc

SEQ ID NO: 1681471 - DNA, 22 bp, Homo sapiens
gccagggcccctcaccctgcct

SEQ ID NO: 1681472 - DNA, 16 bp, Homo sapiens
gccagggccctgcaga

SEQ ID NO: 1681473 - DNA, 19 bp, Homo sapiens
gccagggccctgcagaggg

SEQ ID NO: 1681474 - DNA, 13 bp, Homo sapiens
gccagggcctctc

SEQ ID NO: 1681475 - DNA, 22 bp, Homo sapiens
gccagggcctctccaaccactg

SEQ ID NO: 1681476 - DNA, 14 bp, Homo sapiens
gccagggctgcccc

SEQ ID NO: 1681477 - DNA, 15 bp, Homo sapiens
gccagggctgcccct

SEQ ID NO: 1681478 - DNA, 15 bp, Homo sapiens
gccagggctggggac

SEQ ID NO: 1681479 - DNA, 18 bp, Homo sapiens
gccaggggcttgagaagg

SEQ ID NO: 1681480 - DNA, 21 bp, Homo sapiens
gccaggggggtgaggagctgg

SEQ ID NO: 1681481 - DNA, 17 bp, Homo sapiens
gccagggtagacttgga

SEQ ID NO: 1681482 - DNA, 22 bp, Homo sapiens
gccagggtagacttggagctgt

SEQ ID NO: 1681483 - DNA, 23 bp, Homo sapiens
gccagggtagacttggagctgtc

SEQ ID NO: 1681484 - DNA, 17 bp, Homo sapiens
gccagggtgggaagaga

SEQ ID NO: 1681485 - DNA, 19 bp, Homo sapiens
gccagggtgggaagagaag

SEQ ID NO: 1681486 - DNA, 14 bp, Homo sapiens
gccagggtgtggcc

SEQ ID NO: 1681487 - DNA, 20 bp, Homo sapiens
gccagggtgtggccctgcca

SEQ ID NO: 1681488 - DNA, 23 bp, Homo sapiens
gccagggtgtggccctgccatct

SEQ ID NO: 1681489 - DNA, 18 bp, Homo sapiens
gccagggttgtgctttct

SEQ ID NO: 1681490 - DNA, 22 bp, Homo sapiens
gccaggtacaggagaggcagca

SEQ ID NO: 1681491 - DNA, 21 bp, Homo sapiens
gccaggtactgcattctctcc

SEQ ID NO: 1681492 - DNA, 21 bp, Homo sapiens
gccaggtcaccctttgctgtg

SEQ ID NO: 1681493 - DNA, 22 bp, Homo sapiens
gccaggtccctggaccagcctc

SEQ ID NO: 1681494 - DNA, 21 bp, Homo sapiens
gccaggtgcaatctactggaa

SEQ ID NO: 1681495 - DNA, 20 bp, Homo sapiens
gccaggtggttgtcttattg

SEQ ID NO: 1681496 - DNA, 22 bp, Homo sapiens
gccaggttagcctttgccctgt

SEQ ID NO: 1681497 - DNA, 16 bp, Homo sapiens
gccaggttgcagctgc

SEQ ID NO: 1681498 - DNA, 18 bp, Homo sapiens
gccaggttgggggcagtg

SEQ ID NO: 1681499 - DNA, 19 bp, Homo sapiens
gccagtaacgcgtcttcct

SEQ ID NO: 1681500 - DNA, 21 bp, Homo sapiens
gccagtaacgcgtcttcctga

SEQ ID NO: 1681501 - DNA, 22 bp, Homo sapiens
gccagtaacgcgtcttcctgag

SEQ ID NO: 1681502 - DNA, 20 bp, Homo sapiens
gccagtaccagtgagtggcc

SEQ ID NO: 1681503 - DNA, 23 bp, Homo sapiens
gccagtagttttgacacttccca

SEQ ID NO: 1681504 - DNA, 14 bp, Homo sapiens
gccagtatttttta

SEQ ID NO: 1681505 - DNA, 12 bp, Homo sapiens
gccagtcactgc

SEQ ID NO: 1681506 - DNA, 15 bp, Homo sapiens
gccagtcactgctgc

SEQ ID NO: 1681507 - DNA, 13 bp, Homo sapiens
gccagtccaggct

SEQ ID NO: 1681508 - DNA, 13 bp, Homo sapiens
gccagtcccaggg

SEQ ID NO: 1681509 - DNA, 16 bp, Homo sapiens
gccagtcccaggggca

SEQ ID NO: 1681510 - DNA, 15 bp, Homo sapiens
gccagtccccgagga

SEQ ID NO: 1681511 - DNA, 23 bp, Homo sapiens
gccagtccccgaggagctgggcc

SEQ ID NO: 1681512 - DNA, 14 bp, Homo sapiens
gccagtccccgcta

SEQ ID NO: 1681513 - DNA, 15 bp, Homo sapiens
gccagtctagttcct

SEQ ID NO: 1681514 - DNA, 15 bp, Homo sapiens
gccagtctcagagac

SEQ ID NO: 1681515 - DNA, 13 bp, Homo sapiens
gccagtctcagat

SEQ ID NO: 1681516 - DNA, 14 bp, Homo sapiens
gccagtctcccagg

SEQ ID NO: 1681517 - DNA, 13 bp, Homo sapiens
gccagtctgggct

SEQ ID NO: 1681518 - DNA, 15 bp, Homo sapiens
gccagtctgggctgc

SEQ ID NO: 1681519 - DNA, 17 bp, Homo sapiens
gccagtctgggctgccg

SEQ ID NO: 1681520 - DNA, 12 bp, Homo sapiens
gccagtctgtgg

SEQ ID NO: 1681521 - DNA, 13 bp, Homo sapiens
gccagtcttgtgt

SEQ ID NO: 1681522 - DNA, 19 bp, Homo sapiens
gccagtgactttttctgag

SEQ ID NO: 1681523 - DNA, 15 bp, Homo sapiens
gccagtgagggcagt

SEQ ID NO: 1681524 - DNA, 17 bp, Homo sapiens
gccagtgccttacctcc

SEQ ID NO: 1681525 - DNA, 23 bp, Homo sapiens
gccagtgccttacctcctgccca

SEQ ID NO: 1681526 - DNA, 21 bp, Homo sapiens
gccagtggggatgaggtcacc

SEQ ID NO: 1681527 - DNA, 20 bp, Homo sapiens
gccagtgtgatcccaagtgc

SEQ ID NO: 1681528 - DNA, 17 bp, Homo sapiens
gccagtgtttaaaactt

SEQ ID NO: 1681529 - DNA, 21 bp, Homo sapiens
gccagttaaagtagatcacct

SEQ ID NO: 1681530 - DNA, 23 bp, Homo sapiens
gccagttaaagtagatcacctcc

SEQ ID NO: 1681531 - DNA, 22 bp, Homo sapiens
gccagttcaaagtgtatattta

SEQ ID NO: 1681532 - DNA, 12 bp, Homo sapiens
gccagttcctgt

SEQ ID NO: 1681533 - DNA, 19 bp, Homo sapiens
gccagttggacacaggtga

SEQ ID NO: 1681534 - DNA, 19 bp, Homo sapiens
gccatagacctacagacct

SEQ ID NO: 1681535 - DNA, 13 bp, Homo sapiens
gccatagaggccc

SEQ ID NO: 1681536 - DNA, 16 bp, Homo sapiens
gccatagaggcccagg

SEQ ID NO: 1681537 - DNA, 18 bp, Homo sapiens
gccatagaggcccaggca

SEQ ID NO: 1681538 - DNA, 16 bp, Homo sapiens
gccatagtcacatggc

SEQ ID NO: 1681539 - DNA, 19 bp, Homo sapiens
gccatataagtttgaagga

SEQ ID NO: 1681540 - DNA, 23 bp, Homo sapiens
gccatataagtttgaaggaaaca

SEQ ID NO: 1681541 - DNA, 22 bp, Homo sapiens
gccatatgacaagcctttgtgc

SEQ ID NO: 1681542 - DNA, 15 bp, Homo sapiens
gccatcaactaaagt

SEQ ID NO: 1681543 - DNA, 15 bp, Homo sapiens
gccatcaagcacttc

SEQ ID NO: 1681544 - DNA, 17 bp, Homo sapiens
gccatcacttctccccg

SEQ ID NO: 1681545 - DNA, 18 bp, Homo sapiens
gccatcacttctccccgc

SEQ ID NO: 1681546 - DNA, 12 bp, Homo sapiens
gccatcatcctc

SEQ ID NO: 1681547 - DNA, 15 bp, Homo sapiens
gccatcatgcccagc

SEQ ID NO: 1681548 - DNA, 13 bp, Homo sapiens
gccatccactgtg

SEQ ID NO: 1681549 - DNA, 20 bp, Homo sapiens
gccatcccttcggagccaac

SEQ ID NO: 1681550 - DNA, 23 bp, Homo sapiens
gccatccttcaccagagcccatg

SEQ ID NO: 1681551 - DNA, 17 bp, Homo sapiens
gccatccttctgtgtac

SEQ ID NO: 1681552 - DNA, 18 bp, Homo sapiens
gccatccttgctgcagct

SEQ ID NO: 1681553 - DNA, 19 bp, Homo sapiens
gccatctaatgcttgttta

SEQ ID NO: 1681554 - DNA, 15 bp, Homo sapiens
gccatctcaggagat

SEQ ID NO: 1681555 - DNA, 14 bp, Homo sapiens
gccatctgcccagg

SEQ ID NO: 1681556 - DNA, 20 bp, Homo sapiens
gccatctgcccaggggtgcc

SEQ ID NO: 1681557 - DNA, 16 bp, Homo sapiens
gccatctgttttcaac

SEQ ID NO: 1681558 - DNA, 19 bp, Homo sapiens
gccatcttaaaaagcgggt

SEQ ID NO: 1681559 - DNA, 11 bp, Homo sapiens
gccatcttcag

SEQ ID NO: 1681560 - DNA, 13 bp, Homo sapiens
gccatcttctccc

SEQ ID NO: 1681561 - DNA, 15 bp, Homo sapiens
gccatcttctccccg

SEQ ID NO: 1681562 - DNA, 23 bp, Homo sapiens
gccatcttctccccgaggctgcc

SEQ ID NO: 1681563 - DNA, 17 bp, Homo sapiens
gccatcttcttccctta

SEQ ID NO: 1681564 - DNA, 16 bp, Homo sapiens
gccatcttggcagggt

SEQ ID NO: 1681565 - DNA, 20 bp, Homo sapiens
gccatgaacaaattctttag

SEQ ID NO: 1681566 - DNA, 12 bp, Homo sapiens
gccatgaatgag

SEQ ID NO: 1681567 - DNA, 15 bp, Homo sapiens
gccatgatagctggg

SEQ ID NO: 1681568 - DNA, 20 bp, Homo sapiens
gccatgatcgagccactgca

SEQ ID NO: 1681569 - DNA, 19 bp, Homo sapiens
gccatgatttcccactgca

SEQ ID NO: 1681570 - DNA, 23 bp, Homo sapiens
gccatgatttcccactgcactcc

SEQ ID NO: 1681571 - DNA, 14 bp, Homo sapiens
gccatgatttgtcc

SEQ ID NO: 1681572 - DNA, 16 bp, Homo sapiens
gccatgatttgtccca

SEQ ID NO: 1681573 - DNA, 18 bp, Homo sapiens
gccatgatttgtcccagc

SEQ ID NO: 1681574 - DNA, 20 bp, Homo sapiens
gccatgatttgtcccagcct

SEQ ID NO: 1681575 - DNA, 14 bp, Homo sapiens
gccatgcagacctc

SEQ ID NO: 1681576 - DNA, 19 bp, Homo sapiens
gccatgcaggaagaggccc

SEQ ID NO: 1681577 - DNA, 17 bp, Homo sapiens
gccatgcaggaggtgga

SEQ ID NO: 1681578 - DNA, 21 bp, Homo sapiens
gccatgcaggaggtggagaaa

SEQ ID NO: 1681579 - DNA, 12 bp, Homo sapiens
gccatgccactg

SEQ ID NO: 1681580 - DNA, 17 bp, Homo sapiens
gccatgccactgccagg

SEQ ID NO: 1681581 - DNA, 18 bp, Homo sapiens
gccatgccactgccaggc

SEQ ID NO: 1681582 - DNA, 21 bp, Homo sapiens
gccatgccactgccaggcacc

SEQ ID NO: 1681583 - DNA, 17 bp, Homo sapiens
gccatgcctcatgccac

SEQ ID NO: 1681584 - DNA, 12 bp, Homo sapiens
gccatgcctgct

SEQ ID NO: 1681585 - DNA, 15 bp, Homo sapiens
gccatgcctgctccc

SEQ ID NO: 1681586 - DNA, 18 bp, Homo sapiens
gccatgcctgctccctgt

SEQ ID NO: 1681587 - DNA, 20 bp, Homo sapiens
gccatgcgccccctccgccc

SEQ ID NO: 1681588 - DNA, 15 bp, Homo sapiens
gccatgctgggccac

SEQ ID NO: 1681589 - DNA, 17 bp, Homo sapiens
gccatgctgggccactg

SEQ ID NO: 1681590 - DNA, 14 bp, Homo sapiens
gccatggatctgat

SEQ ID NO: 1681591 - DNA, 14 bp, Homo sapiens
gccatggcctctgc

SEQ ID NO: 1681592 - DNA, 13 bp, Homo sapiens
gccatggctcagg

SEQ ID NO: 1681593 - DNA, 14 bp, Homo sapiens
gccatggctcaggc

SEQ ID NO: 1681594 - DNA, 15 bp, Homo sapiens
gccatggctcaggca

SEQ ID NO: 1681595 - DNA, 22 bp, Homo sapiens
gccatggctcaggcaagcccct

SEQ ID NO: 1681596 - DNA, 17 bp, Homo sapiens
gccatggctcagggtgg

SEQ ID NO: 1681597 - DNA, 23 bp, Homo sapiens
gccatggctcagggtggtctctt

SEQ ID NO: 1681598 - DNA, 12 bp, Homo sapiens
gccatggctggg

SEQ ID NO: 1681599 - DNA, 13 bp, Homo sapiens
gccatgggcctgg

SEQ ID NO: 1681600 - DNA, 15 bp, Homo sapiens
gccatgggcctgggc

SEQ ID NO: 1681601 - DNA, 19 bp, Homo sapiens
gccatgggtggaaagtgct

SEQ ID NO: 1681602 - DNA, 19 bp, Homo sapiens
gccatgtaaggttgtgcag

SEQ ID NO: 1681603 - DNA, 22 bp, Homo sapiens
gccatgtctgcagtgtgccccc

SEQ ID NO: 1681604 - DNA, 14 bp, Homo sapiens
gccatgtgagccac

SEQ ID NO: 1681605 - DNA, 22 bp, Homo sapiens
gccattcacttcataatccagt

SEQ ID NO: 1681606 - DNA, 19 bp, Homo sapiens
gccattcatgtatgtcaga

SEQ ID NO: 1681607 - DNA, 14 bp, Homo sapiens
gccattccaacagc

SEQ ID NO: 1681608 - DNA, 13 bp, Homo sapiens
gccattcccagcg

SEQ ID NO: 1681609 - DNA, 15 bp, Homo sapiens
gccattcccttggaa

SEQ ID NO: 1681610 - DNA, 20 bp, Homo sapiens
gccattcctggtacccagcc

SEQ ID NO: 1681611 - DNA, 22 bp, Homo sapiens
gccattcctggtacccagccat

SEQ ID NO: 1681612 - DNA, 20 bp, Homo sapiens
gccattctcctgcctcagcc

SEQ ID NO: 1681613 - DNA, 22 bp, Homo sapiens
gccattctgccgccccctcctg

SEQ ID NO: 1681614 - DNA, 12 bp, Homo sapiens
gccattctgtgt

SEQ ID NO: 1681615 - DNA, 19 bp, Homo sapiens
gccattgcactccagcctg

SEQ ID NO: 1681616 - DNA, 19 bp, Homo sapiens
gccattgccaccaggagaa

SEQ ID NO: 1681617 - DNA, 17 bp, Homo sapiens
gccattggagagctgtc

SEQ ID NO: 1681618 - DNA, 23 bp, Homo sapiens
gccattggagagctgtcttcctg

SEQ ID NO: 1681619 - DNA, 18 bp, Homo sapiens
gccattgggaccctccag

SEQ ID NO: 1681620 - DNA, 22 bp, Homo sapiens
gccattgggaccctccagtgct

SEQ ID NO: 1681621 - DNA, 15 bp, Homo sapiens
gccattgtactccag

SEQ ID NO: 1681622 - DNA, 18 bp, Homo sapiens
gccattgtactccagcct

SEQ ID NO: 1681623 - DNA, 18 bp, Homo sapiens
gccatttaaaaagttgta

SEQ ID NO: 1681624 - DNA, 13 bp, Homo sapiens
gccatttatttat

SEQ ID NO: 1681625 - DNA, 20 bp, Homo sapiens
gccatttccaagaggctgta

SEQ ID NO: 1681626 - DNA, 18 bp, Homo sapiens
gccatttccccctcctca

SEQ ID NO: 1681627 - DNA, 17 bp, Homo sapiens
gccatttgatttttcta

SEQ ID NO: 1681628 - DNA, 20 bp, Homo sapiens
gccatttgcaccctccgcct

SEQ ID NO: 1681629 - DNA, 23 bp, Homo sapiens
gccatttgcaccctccgccttca

SEQ ID NO: 1681630 - DNA, 17 bp, Homo sapiens
gccatttttctataaat

SEQ ID NO: 1681631 - DNA, 15 bp, Homo sapiens
gccatttttctgggg

SEQ ID NO: 1681632 - DNA, 18 bp, Homo sapiens
gcccaaaaatatggttga

SEQ ID NO: 1681633 - DNA, 16 bp, Homo sapiens
gcccaaaacccagggc

SEQ ID NO: 1681634 - DNA, 15 bp, Homo sapiens
gcccaaaatttattt

SEQ ID NO: 1681635 - DNA, 21 bp, Homo sapiens
gcccaaaatttattttataag

SEQ ID NO: 1681636 - DNA, 21 bp, Homo sapiens
gcccaaagagaaatcacaggg

SEQ ID NO: 1681637 - DNA, 13 bp, Homo sapiens
gcccaaagtgggg

SEQ ID NO: 1681638 - DNA, 16 bp, Homo sapiens
gcccaaagtggggagg

SEQ ID NO: 1681639 - DNA, 19 bp, Homo sapiens
gcccaaatgtcagggttct

SEQ ID NO: 1681640 - DNA, 14 bp, Homo sapiens
gcccaacctcctga

SEQ ID NO: 1681641 - DNA, 19 bp, Homo sapiens
gcccaagacagatgcccca

SEQ ID NO: 1681642 - DNA, 21 bp, Homo sapiens
gcccaagacagatgccccaga

SEQ ID NO: 1681643 - DNA, 19 bp, Homo sapiens
gcccaagagccctgtggcc

SEQ ID NO: 1681644 - DNA, 22 bp, Homo sapiens
gcccaagaggactgagactggc

SEQ ID NO: 1681645 - DNA, 21 bp, Homo sapiens
gcccaagaggtctgagccctg

SEQ ID NO: 1681646 - DNA, 13 bp, Homo sapiens
gcccaagagtggg

SEQ ID NO: 1681647 - DNA, 15 bp, Homo sapiens
gcccaagccagaggc

SEQ ID NO: 1681648 - DNA, 18 bp, Homo sapiens
gcccaagcttccctccat

SEQ ID NO: 1681649 - DNA, 23 bp, Homo sapiens
gcccaaggagcttacccaagctg

SEQ ID NO: 1681650 - DNA, 13 bp, Homo sapiens
gcccaagtccctg

SEQ ID NO: 1681651 - DNA, 15 bp, Homo sapiens
gcccaagtccctgtt

SEQ ID NO: 1681652 - DNA, 18 bp, Homo sapiens
gcccaatattataatttt

SEQ ID NO: 1681653 - DNA, 14 bp, Homo sapiens
gcccaatgaattat

SEQ ID NO: 1681654 - DNA, 20 bp, Homo sapiens
gcccaatgagactctagggt

SEQ ID NO: 1681655 - DNA, 19 bp, Homo sapiens
gcccacaaccttcggctcc

SEQ ID NO: 1681656 - DNA, 12 bp, Homo sapiens
gcccacacctgg

SEQ ID NO: 1681657 - DNA, 14 bp, Homo sapiens
gcccacatcccagg

SEQ ID NO: 1681658 - DNA, 14 bp, Homo sapiens
gcccacatttgatg

SEQ ID NO: 1681659 - DNA, 15 bp, Homo sapiens
gcccacatttgggct

SEQ ID NO: 1681660 - DNA, 17 bp, Homo sapiens
gcccacatttgggctca

SEQ ID NO: 1681661 - DNA, 21 bp, Homo sapiens
gcccacatttgggctcagggt

SEQ ID NO: 1681662 - DNA, 21 bp, Homo sapiens
gcccaccaacatcccattgcc

SEQ ID NO: 1681663 - DNA, 14 bp, Homo sapiens
gcccacccaggtcc

SEQ ID NO: 1681664 - DNA, 15 bp, Homo sapiens
gcccacccaggtccc

SEQ ID NO: 1681665 - DNA, 22 bp, Homo sapiens
gcccacccagtccatgctccag

SEQ ID NO: 1681666 - DNA, 23 bp, Homo sapiens
gcccacccagtccatgctccagg

SEQ ID NO: 1681667 - DNA, 16 bp, Homo sapiens
gcccaccccctgccct

SEQ ID NO: 1681668 - DNA, 17 bp, Homo sapiens
gcccaccccctgccctg

SEQ ID NO: 1681669 - DNA, 20 bp, Homo sapiens
gcccaccccctgccctgcac

SEQ ID NO: 1681670 - DNA, 13 bp, Homo sapiens
gcccacccctcac

SEQ ID NO: 1681671 - DNA, 18 bp, Homo sapiens
gcccacccctcactcccc

SEQ ID NO: 1681672 - DNA, 23 bp, Homo sapiens
gcccacccctcactccccaggga

SEQ ID NO: 1681673 - DNA, 13 bp, Homo sapiens
gcccacccgcccg

SEQ ID NO: 1681674 - DNA, 23 bp, Homo sapiens
gcccacccgtcttcaatctctgt

SEQ ID NO: 1681675 - DNA, 16 bp, Homo sapiens
gcccaccctgctgctg

SEQ ID NO: 1681676 - DNA, 17 bp, Homo sapiens
gcccaccctgctgctgg

SEQ ID NO: 1681677 - DNA, 19 bp, Homo sapiens
gcccaccctgctgctggtg

SEQ ID NO: 1681678 - DNA, 20 bp, Homo sapiens
gcccaccctgctgctggtgc

SEQ ID NO: 1681679 - DNA, 22 bp, Homo sapiens
gcccaccctgggctccacacag

SEQ ID NO: 1681680 - DNA, 22 bp, Homo sapiens
gcccaccgtgggcagtgccacc

SEQ ID NO: 1681681 - DNA, 23 bp, Homo sapiens
gcccaccgtgggcagtgccaccc

SEQ ID NO: 1681682 - DNA, 13 bp, Homo sapiens
gcccacctgccca

SEQ ID NO: 1681683 - DNA, 18 bp, Homo sapiens
gcccacctggccacctga

SEQ ID NO: 1681684 - DNA, 20 bp, Homo sapiens
gcccacctggccacctgagg

SEQ ID NO: 1681685 - DNA, 16 bp, Homo sapiens
gcccacgatcccctcc

SEQ ID NO: 1681686 - DNA, 17 bp, Homo sapiens
gcccacgatcccctccc

SEQ ID NO: 1681687 - DNA, 23 bp, Homo sapiens
gcccacgcacgacgtcagcctct

SEQ ID NO: 1681688 - DNA, 18 bp, Homo sapiens
gcccacgccctccctctc

SEQ ID NO: 1681689 - DNA, 17 bp, Homo sapiens
gcccactagagggccca

SEQ ID NO: 1681690 - DNA, 21 bp, Homo sapiens
gcccactaggatcccactggc

SEQ ID NO: 1681691 - DNA, 15 bp, Homo sapiens
gcccactccccagcc

SEQ ID NO: 1681692 - DNA, 16 bp, Homo sapiens
gcccactccctgccta

SEQ ID NO: 1681693 - DNA, 19 bp, Homo sapiens
gcccactgcccaccccctc

SEQ ID NO: 1681694 - DNA, 20 bp, Homo sapiens
gcccactgcccaccccctca

SEQ ID NO: 1681695 - DNA, 18 bp, Homo sapiens
gcccactgcctgcctccc

SEQ ID NO: 1681696 - DNA, 14 bp, Homo sapiens
gcccactgctggct

SEQ ID NO: 1681697 - DNA, 15 bp, Homo sapiens
gcccactgtcctggg

SEQ ID NO: 1681698 - DNA, 17 bp, Homo sapiens
gcccactgtcctgggcc

SEQ ID NO: 1681699 - DNA, 18 bp, Homo sapiens
gcccactgtcctgggcct

SEQ ID NO: 1681700 - DNA, 23 bp, Homo sapiens
gcccactgtcctgggcctgcaga

SEQ ID NO: 1681701 - DNA, 16 bp, Homo sapiens
gcccactgtgcctcag

SEQ ID NO: 1681702 - DNA, 20 bp, Homo sapiens
gcccactgtgcctcagagac

SEQ ID NO: 1681703 - DNA, 21 bp, Homo sapiens
gcccacttagccgtccatggc

SEQ ID NO: 1681704 - DNA, 23 bp, Homo sapiens
gcccacttagccgtccatggcac

SEQ ID NO: 1681705 - DNA, 17 bp, Homo sapiens
gcccacttgattgagaa

SEQ ID NO: 1681706 - DNA, 18 bp, Homo sapiens
gcccactttcctgagctg

SEQ ID NO: 1681707 - DNA, 20 bp, Homo sapiens
gcccagaaagcctctctctc

SEQ ID NO: 1681708 - DNA, 19 bp, Homo sapiens
gcccagaattgcagttcag

SEQ ID NO: 1681709 - DNA, 21 bp, Homo sapiens
gcccagacaccatgtgcaata

SEQ ID NO: 1681710 - DNA, 19 bp, Homo sapiens
gcccagacccctctggcca

SEQ ID NO: 1681711 - DNA, 20 bp, Homo sapiens
gcccagacccctctggccag

SEQ ID NO: 1681712 - DNA, 22 bp, Homo sapiens
gcccagagaagctggaagcctg

SEQ ID NO: 1681713 - DNA, 19 bp, Homo sapiens
gcccagagacccaagctgc

SEQ ID NO: 1681714 - DNA, 20 bp, Homo sapiens
gcccagagatgcctccaccg

SEQ ID NO: 1681715 - DNA, 16 bp, Homo sapiens
gcccagagccacctgg

SEQ ID NO: 1681716 - DNA, 13 bp, Homo sapiens
gcccagagcccag

SEQ ID NO: 1681717 - DNA, 16 bp, Homo sapiens
gcccagaggactccca

SEQ ID NO: 1681718 - DNA, 21 bp, Homo sapiens
gcccagaggactcccaaccct

SEQ ID NO: 1681719 - DNA, 18 bp, Homo sapiens
gcccagaggagccaagtc

SEQ ID NO: 1681720 - DNA, 13 bp, Homo sapiens
gcccagagggccc

SEQ ID NO: 1681721 - DNA, 18 bp, Homo sapiens
gcccagagggtggcaaga

SEQ ID NO: 1681722 - DNA, 23 bp, Homo sapiens
gcccagagttgctgggagctgaa

SEQ ID NO: 1681723 - DNA, 17 bp, Homo sapiens
gcccagatgaactgact

SEQ ID NO: 1681724 - DNA, 19 bp, Homo sapiens
gcccagattcccctgtgtc

SEQ ID NO: 1681725 - DNA, 21 bp, Homo sapiens
gcccagattcccctgtgtcat

SEQ ID NO: 1681726 - DNA, 13 bp, Homo sapiens
gcccagcacctgc

SEQ ID NO: 1681727 - DNA, 15 bp, Homo sapiens
gcccagcacctgctc

SEQ ID NO: 1681728 - DNA, 18 bp, Homo sapiens
gcccagcacctgctccca

SEQ ID NO: 1681729 - DNA, 16 bp, Homo sapiens
gcccagcacctggagg

SEQ ID NO: 1681730 - DNA, 10 bp, Homo sapiens
gcccagcagg

SEQ ID NO: 1681731 - DNA, 23 bp, Homo sapiens
gcccagcaggagagactgagcag

SEQ ID NO: 1681732 - DNA, 17 bp, Homo sapiens
gcccagcaggcccagca

SEQ ID NO: 1681733 - DNA, 14 bp, Homo sapiens
gcccagcattgctg

SEQ ID NO: 1681734 - DNA, 23 bp, Homo sapiens
gcccagccacggacgctggctcc

SEQ ID NO: 1681735 - DNA, 13 bp, Homo sapiens
gcccagccaggag

SEQ ID NO: 1681736 - DNA, 17 bp, Homo sapiens
gcccagccaggagcaga

SEQ ID NO: 1681737 - DNA, 17 bp, Homo sapiens
gcccagccaggccaaca

SEQ ID NO: 1681738 - DNA, 12 bp, Homo sapiens
gcccagcccaga

SEQ ID NO: 1681739 - DNA, 13 bp, Homo sapiens
gcccagcccagag

SEQ ID NO: 1681740 - DNA, 16 bp, Homo sapiens
gcccagcccagagcca

SEQ ID NO: 1681741 - DNA, 16 bp, Homo sapiens
gcccagcccagctggt

SEQ ID NO: 1681742 - DNA, 13 bp, Homo sapiens
gcccagcccagga

SEQ ID NO: 1681743 - DNA, 17 bp, Homo sapiens
gcccagcccctactgct

SEQ ID NO: 1681744 - DNA, 21 bp, Homo sapiens
gcccagcccctactgctgtga

SEQ ID NO: 1681745 - DNA, 16 bp, Homo sapiens
gcccagcccctccagc

SEQ ID NO: 1681746 - DNA, 13 bp, Homo sapiens
gcccagcccctgc

SEQ ID NO: 1681747 - DNA, 14 bp, Homo sapiens
gcccagcccctgcc

SEQ ID NO: 1681748 - DNA, 15 bp, Homo sapiens
gcccagccggcctct

SEQ ID NO: 1681749 - DNA, 16 bp, Homo sapiens
gcccagccggcctctc

SEQ ID NO: 1681750 - DNA, 21 bp, Homo sapiens
gcccagccggcctctctggcc

SEQ ID NO: 1681751 - DNA, 22 bp, Homo sapiens
gcccagccggcctctctggcct

SEQ ID NO: 1681752 - DNA, 15 bp, Homo sapiens
gcccagcctgggagc

SEQ ID NO: 1681753 - DNA, 16 bp, Homo sapiens
gcccagcctgggagcc

SEQ ID NO: 1681754 - DNA, 19 bp, Homo sapiens
gcccagcctgggagcccag

SEQ ID NO: 1681755 - DNA, 15 bp, Homo sapiens
gcccagcgccaagta

SEQ ID NO: 1681756 - DNA, 14 bp, Homo sapiens
gcccagcgcggcca

SEQ ID NO: 1681757 - DNA, 15 bp, Homo sapiens
gcccagcgcggccag

SEQ ID NO: 1681758 - DNA, 17 bp, Homo sapiens
gcccagcgcggccagcg

SEQ ID NO: 1681759 - DNA, 16 bp, Homo sapiens
gcccagcgctctcctg

SEQ ID NO: 1681760 - DNA, 17 bp, Homo sapiens
gcccagcgctctcctgg

SEQ ID NO: 1681761 - DNA, 23 bp, Homo sapiens
gcccagcggcccctcccacacac

SEQ ID NO: 1681762 - DNA, 15 bp, Homo sapiens
gcccagcgggcagat

SEQ ID NO: 1681763 - DNA, 18 bp, Homo sapiens
gcccagcgggcagatggg

SEQ ID NO: 1681764 - DNA, 18 bp, Homo sapiens
gcccagctacattcctca

SEQ ID NO: 1681765 - DNA, 23 bp, Homo sapiens
gcccagctacattcctcagctgc

SEQ ID NO: 1681766 - DNA, 12 bp, Homo sapiens
gcccagctccaa

SEQ ID NO: 1681767 - DNA, 15 bp, Homo sapiens
gcccagctccagggc

SEQ ID NO: 1681768 - DNA, 11 bp, Homo sapiens
gcccagctccg

SEQ ID NO: 1681769 - DNA, 19 bp, Homo sapiens
gcccagctccgcctgctgg

SEQ ID NO: 1681770 - DNA, 11 bp, Homo sapiens
gcccagctctt

SEQ ID NO: 1681771 - DNA, 12 bp, Homo sapiens
gcccagctcttg

SEQ ID NO: 1681772 - DNA, 18 bp, Homo sapiens
gcccagctgcacctgcca

SEQ ID NO: 1681773 - DNA, 13 bp, Homo sapiens
gcccagctggcca

SEQ ID NO: 1681774 - DNA, 14 bp, Homo sapiens
gcccagctggccac

SEQ ID NO: 1681775 - DNA, 14 bp, Homo sapiens
gcccagctgggctc

SEQ ID NO: 1681776 - DNA, 15 bp, Homo sapiens
gcccagctgtagcca

SEQ ID NO: 1681777 - DNA, 18 bp, Homo sapiens
gcccagctgtagccatgg

SEQ ID NO: 1681778 - DNA, 21 bp, Homo sapiens
gcccagctgtagccatggctc

SEQ ID NO: 1681779 - DNA, 13 bp, Homo sapiens
gcccagcttcctg

SEQ ID NO: 1681780 - DNA, 14 bp, Homo sapiens
gcccagcttcctgg

SEQ ID NO: 1681781 - DNA, 17 bp, Homo sapiens
gcccagcttcctggtgt

SEQ ID NO: 1681782 - DNA, 22 bp, Homo sapiens
gcccagcttgggcccagctggg

SEQ ID NO: 1681783 - DNA, 23 bp, Homo sapiens
gcccaggaattagagaagctgaa

SEQ ID NO: 1681784 - DNA, 10 bp, Homo sapiens
gcccaggaga

SEQ ID NO: 1681785 - DNA, 11 bp, Homo sapiens
gcccaggagac

SEQ ID NO: 1681786 - DNA, 22 bp, Homo sapiens
gcccaggagacagaccacttgc

SEQ ID NO: 1681787 - DNA, 20 bp, Homo sapiens
gcccaggagacctccagcta

SEQ ID NO: 1681788 - DNA, 20 bp, Homo sapiens
gcccaggagctgagtcacct

SEQ ID NO: 1681789 - DNA, 22 bp, Homo sapiens
gcccaggagtttgaggctgcag

SEQ ID NO: 1681790 - DNA, 15 bp, Homo sapiens
gcccaggatactggc

SEQ ID NO: 1681791 - DNA, 17 bp, Homo sapiens
gcccaggatactggcac

SEQ ID NO: 1681792 - DNA, 14 bp, Homo sapiens
gcccaggatgctgc

SEQ ID NO: 1681793 - DNA, 23 bp, Homo sapiens
gcccaggcaccaccaggagcagc

SEQ ID NO: 1681794 - DNA, 24 bp, Homo sapiens
gcccaggcaccaccaggagcagca

SEQ ID NO: 1681795 - DNA, 14 bp, Homo sapiens
gcccaggcaggcca

SEQ ID NO: 1681796 - DNA, 19 bp, Homo sapiens
gcccaggcaggtctgcaag

SEQ ID NO: 1681797 - DNA, 14 bp, Homo sapiens
gcccaggcccttgg

SEQ ID NO: 1681798 - DNA, 18 bp, Homo sapiens
gcccaggcccttggctgc

SEQ ID NO: 1681799 - DNA, 21 bp, Homo sapiens
gcccaggccggggtggagcat

SEQ ID NO: 1681800 - DNA, 22 bp, Homo sapiens
gcccaggccggggtggagcatg

SEQ ID NO: 1681801 - DNA, 23 bp, Homo sapiens
gcccaggccgttccccttggctt

SEQ ID NO: 1681802 - DNA, 15 bp, Homo sapiens
gcccaggctggagtg

SEQ ID NO: 1681803 - DNA, 13 bp, Homo sapiens
gcccaggctggga

SEQ ID NO: 1681804 - DNA, 14 bp, Homo sapiens
gcccaggcttcctg

SEQ ID NO: 1681805 - DNA, 15 bp, Homo sapiens
gcccagggccactct

SEQ ID NO: 1681806 - DNA, 15 bp, Homo sapiens
gcccagggccagtgg

SEQ ID NO: 1681807 - DNA, 19 bp, Homo sapiens
gcccagggcccagagccca

SEQ ID NO: 1681808 - DNA, 21 bp, Homo sapiens
gcccagggcccagagcccagc

SEQ ID NO: 1681809 - DNA, 23 bp, Homo sapiens
gcccagggcccagagcccagctc

SEQ ID NO: 1681810 - DNA, 13 bp, Homo sapiens
gcccagggctcag

SEQ ID NO: 1681811 - DNA, 15 bp, Homo sapiens
gcccagggctcagcc

SEQ ID NO: 1681812 - DNA, 15 bp, Homo sapiens
gcccagggctcctgc

SEQ ID NO: 1681813 - DNA, 17 bp, Homo sapiens
gcccagggctgggagga

SEQ ID NO: 1681814 - DNA, 20 bp, Homo sapiens
gcccagggctgggaggaagg

SEQ ID NO: 1681815 - DNA, 12 bp, Homo sapiens
gcccaggggctg

SEQ ID NO: 1681816 - DNA, 14 bp, Homo sapiens
gcccagggggcctg

SEQ ID NO: 1681817 - DNA, 20 bp, Homo sapiens
gcccaggggtgccccctcct

SEQ ID NO: 1681818 - DNA, 22 bp, Homo sapiens
gcccagtacctagctggctctg

SEQ ID NO: 1681819 - DNA, 15 bp, Homo sapiens
gcccagtccctggag

SEQ ID NO: 1681820 - DNA, 18 bp, Homo sapiens
gcccagtccctggagctg

SEQ ID NO: 1681821 - DNA, 19 bp, Homo sapiens
gcccagtccctggagctgt

SEQ ID NO: 1681822 - DNA, 23 bp, Homo sapiens
gcccagtcctctcccaagtccac

SEQ ID NO: 1681823 - DNA, 14 bp, Homo sapiens
gcccagtgaagcct

SEQ ID NO: 1681824 - DNA, 17 bp, Homo sapiens
gcccagtgaagcctctg

SEQ ID NO: 1681825 - DNA, 15 bp, Homo sapiens
gcccagtgcactgaa

SEQ ID NO: 1681826 - DNA, 21 bp, Homo sapiens
gcccagtgcatggtggccaga

SEQ ID NO: 1681827 - DNA, 15 bp, Homo sapiens
gcccagtgccactgc

SEQ ID NO: 1681828 - DNA, 20 bp, Homo sapiens
gcccagtggagcctgccgcc

SEQ ID NO: 1681829 - DNA, 17 bp, Homo sapiens
gcccagtgttgtttgta

SEQ ID NO: 1681830 - DNA, 22 bp, Homo sapiens
gcccataatagttagccctcag

SEQ ID NO: 1681831 - DNA, 20 bp, Homo sapiens
gcccatacccgtgacagtgg

SEQ ID NO: 1681832 - DNA, 13 bp, Homo sapiens
gcccatcacaggg

SEQ ID NO: 1681833 - DNA, 19 bp, Homo sapiens
gcccatccattaggccagc

SEQ ID NO: 1681834 - DNA, 20 bp, Homo sapiens
gcccatccattaggccagca

SEQ ID NO: 1681835 - DNA, 22 bp, Homo sapiens
gcccatccattaggccagcaac

SEQ ID NO: 1681836 - DNA, 16 bp, Homo sapiens
gcccatcccagtccct

SEQ ID NO: 1681837 - DNA, 17 bp, Homo sapiens
gcccatcccagtccctc

SEQ ID NO: 1681838 - DNA, 15 bp, Homo sapiens
gcccatcctgactga

SEQ ID NO: 1681839 - DNA, 13 bp, Homo sapiens
gcccatgaatttg

SEQ ID NO: 1681840 - DNA, 13 bp, Homo sapiens
gcccatgcccacc

SEQ ID NO: 1681841 - DNA, 15 bp, Homo sapiens
gcccatgcccacctg

SEQ ID NO: 1681842 - DNA, 20 bp, Homo sapiens
gcccatgctcaaccactgtg

SEQ ID NO: 1681843 - DNA, 15 bp, Homo sapiens
gcccatggcccccaa

SEQ ID NO: 1681844 - DNA, 16 bp, Homo sapiens
gcccatggcccccaat

SEQ ID NO: 1681845 - DNA, 18 bp, Homo sapiens
gcccatggcccccaataa

SEQ ID NO: 1681846 - DNA, 23 bp, Homo sapiens
gcccatggcccccaataaaggca

SEQ ID NO: 1681847 - DNA, 15 bp, Homo sapiens
gcccatggctgggaa

SEQ ID NO: 1681848 - DNA, 19 bp, Homo sapiens
gcccatgggagccaggccc

SEQ ID NO: 1681849 - DNA, 20 bp, Homo sapiens
gcccatgggagctggttaga

SEQ ID NO: 1681850 - DNA, 18 bp, Homo sapiens
gcccatgtgtacattctg

SEQ ID NO: 1681851 - DNA, 15 bp, Homo sapiens
gcccattaggtccct

SEQ ID NO: 1681852 - DNA, 17 bp, Homo sapiens
gcccattcagagctatg

SEQ ID NO: 1681853 - DNA, 20 bp, Homo sapiens
gcccattcgtctgtcccaga

SEQ ID NO: 1681854 - DNA, 21 bp, Homo sapiens
gcccattctctctcctgtcca

SEQ ID NO: 1681855 - DNA, 15 bp, Homo sapiens
gcccattgctgccaa

SEQ ID NO: 1681856 - DNA, 17 bp, Homo sapiens
gcccattgtcctccttt

SEQ ID NO: 1681857 - DNA, 18 bp, Homo sapiens
gcccattgtcctcctttt

SEQ ID NO: 1681858 - DNA, 16 bp, Homo sapiens
gcccatttgggctctg

SEQ ID NO: 1681859 - DNA, 14 bp, Homo sapiens
gccccaacactgtc

SEQ ID NO: 1681860 - DNA, 15 bp, Homo sapiens
gccccaacctgctga

SEQ ID NO: 1681861 - DNA, 22 bp, Homo sapiens
gccccaactcctggaagctgtg

SEQ ID NO: 1681862 - DNA, 13 bp, Homo sapiens
gccccaagcagcc

SEQ ID NO: 1681863 - DNA, 15 bp, Homo sapiens
gccccaagcagccag

SEQ ID NO: 1681864 - DNA, 21 bp, Homo sapiens
gccccaagcagccagccagtc

SEQ ID NO: 1681865 - DNA, 16 bp, Homo sapiens
gccccaagctgggccg

SEQ ID NO: 1681866 - DNA, 18 bp, Homo sapiens
gccccaagctgggccgag

SEQ ID NO: 1681867 - DNA, 16 bp, Homo sapiens
gccccaagggcccaga

SEQ ID NO: 1681868 - DNA, 14 bp, Homo sapiens
gccccaagtcctca

SEQ ID NO: 1681869 - DNA, 15 bp, Homo sapiens
gccccaagtcctgaa

SEQ ID NO: 1681870 - DNA, 21 bp, Homo sapiens
gccccaagtcctgaagaggcg

SEQ ID NO: 1681871 - DNA, 18 bp, Homo sapiens
gccccaatccctttatta

SEQ ID NO: 1681872 - DNA, 21 bp, Homo sapiens
gccccaatcgggtccagagac

SEQ ID NO: 1681873 - DNA, 22 bp, Homo sapiens
gccccaatgtatgtgtggctgt

SEQ ID NO: 1681874 - DNA, 19 bp, Homo sapiens
gccccacagagcaggaagc

SEQ ID NO: 1681875 - DNA, 15 bp, Homo sapiens
gccccacatgtccag

SEQ ID NO: 1681876 - DNA, 16 bp, Homo sapiens
gccccaccccacctca

SEQ ID NO: 1681877 - DNA, 22 bp, Homo sapiens
gccccaccccatccagccagac

SEQ ID NO: 1681878 - DNA, 23 bp, Homo sapiens
gccccacccctaagtgcccaaag

SEQ ID NO: 1681879 - DNA, 15 bp, Homo sapiens
gccccaccctgggcc

SEQ ID NO: 1681880 - DNA, 14 bp, Homo sapiens
gccccaccggccag

SEQ ID NO: 1681881 - DNA, 15 bp, Homo sapiens
gccccactccagcct

SEQ ID NO: 1681882 - DNA, 19 bp, Homo sapiens
gccccactccagcctgggg

SEQ ID NO: 1681883 - DNA, 20 bp, Homo sapiens
gccccactccagcctgggga

SEQ ID NO: 1681884 - DNA, 17 bp, Homo sapiens
gccccactgacacccag

SEQ ID NO: 1681885 - DNA, 14 bp, Homo sapiens
gccccactgccagc

SEQ ID NO: 1681886 - DNA, 17 bp, Homo sapiens
gccccactgccagcagc

SEQ ID NO: 1681887 - DNA, 18 bp, Homo sapiens
gccccacttcacccccaa

SEQ ID NO: 1681888 - DNA, 19 bp, Homo sapiens
gccccacttcacccccaac

SEQ ID NO: 1681889 - DNA, 21 bp, Homo sapiens
gccccacttcacccccaactt

SEQ ID NO: 1681890 - DNA, 14 bp, Homo sapiens
gccccagaaaatga

SEQ ID NO: 1681891 - DNA, 12 bp, Homo sapiens
gccccagactga

SEQ ID NO: 1681892 - DNA, 15 bp, Homo sapiens
gccccagactgagct

SEQ ID NO: 1681893 - DNA, 21 bp, Homo sapiens
gccccagactgagctctccag

SEQ ID NO: 1681894 - DNA, 22 bp, Homo sapiens
gccccagactgagctctccagg

SEQ ID NO: 1681895 - DNA, 23 bp, Homo sapiens
gccccagactgagctctccaggc

SEQ ID NO: 1681896 - DNA, 24 bp, Homo sapiens
gccccagactgagctctccaggcc

SEQ ID NO: 1681897 - DNA, 16 bp, Homo sapiens
gccccagactgggccc

SEQ ID NO: 1681898 - DNA, 20 bp, Homo sapiens
gccccagactgggcccaggc

SEQ ID NO: 1681899 - DNA, 17 bp, Homo sapiens
gcccggcgcccctgcca

SEQ ID NO: 1681900 - DNA, 23 bp, Homo sapiens
gcccggctgagccccccatgccc

SEQ ID NO: 1681901 - DNA, 14 bp, Homo sapiens
gcccggctggtttt

SEQ ID NO: 1681902 - DNA, 23 bp, Homo sapiens
gcccggctgtgattgctgccagg

SEQ ID NO: 1681903 - DNA, 14 bp, Homo sapiens
gcccgggcccagag

SEQ ID NO: 1681904 - DNA, 15 bp, Homo sapiens
gcccgggcccagagg

SEQ ID NO: 1681905 - DNA, 15 bp, Homo sapiens
gcccgggctgcctgg

SEQ ID NO: 1681906 - DNA, 23 bp, Homo sapiens
gcccgggctgcctgggctgttgg

SEQ ID NO: 1681907 - DNA, 15 bp, Homo sapiens
gcccggtgggtccgc

SEQ ID NO: 1681908 - DNA, 18 bp, Homo sapiens
gcccggtggtttgccatg

SEQ ID NO: 1681909 - DNA, 18 bp, Homo sapiens
gcccgtaatcccagctac

SEQ ID NO: 1681910 - DNA, 18 bp, Homo sapiens
gcccgtcatgttcctcaa

SEQ ID NO: 1681911 - DNA, 18 bp, Homo sapiens
gcccgtcctgcctgtggc

SEQ ID NO: 1681912 - DNA, 19 bp, Homo sapiens
gcccgtcgcgctggacagc

SEQ ID NO: 1681913 - DNA, 21 bp, Homo sapiens
gcccgtcgcgctggacagctt

SEQ ID NO: 1681914 - DNA, 13 bp, Homo sapiens
gcccgtcggagct

SEQ ID NO: 1681915 - DNA, 14 bp, Homo sapiens
gcccgtcggagctg

SEQ ID NO: 1681916 - DNA, 17 bp, Homo sapiens
gcccgtcggagctgcct

SEQ ID NO: 1681917 - DNA, 23 bp, Homo sapiens
gcccgtcggagctgcctgcagca

SEQ ID NO: 1681918 - DNA, 14 bp, Homo sapiens
gcccgtctcagtgt

SEQ ID NO: 1681919 - DNA, 14 bp, Homo sapiens
gcccgtcttcagcc

SEQ ID NO: 1681920 - DNA, 15 bp, Homo sapiens
gcccgtcttcagcct

SEQ ID NO: 1681921 - DNA, 16 bp, Homo sapiens
gcccgtcttcagccta

SEQ ID NO: 1681922 - DNA, 18 bp, Homo sapiens
gcccgtgaagcagtgcct

SEQ ID NO: 1681923 - DNA, 20 bp, Homo sapiens
gcccgtgaagcagtgcctcg

SEQ ID NO: 1681924 - DNA, 16 bp, Homo sapiens
gcccgtgcccgcagga

SEQ ID NO: 1681925 - DNA, 22 bp, Homo sapiens
gcccgtggtggcggtggctgcc

SEQ ID NO: 1681926 - DNA, 22 bp, Homo sapiens
gcccgtgtgtgtgtatgtgtgt

SEQ ID NO: 1681927 - DNA, 20 bp, Homo sapiens
gcccgttgtctaggagacag

SEQ ID NO: 1681928 - DNA, 15 bp, Homo sapiens
gcccgtttcagaagg

SEQ ID NO: 1681929 - DNA, 18 bp, Homo sapiens
gccctaaccccttccaga

SEQ ID NO: 1681930 - DNA, 15 bp, Homo sapiens
gccctaacctgacag

SEQ ID NO: 1681931 - DNA, 15 bp, Homo sapiens
gccctaagcccccag

SEQ ID NO: 1681932 - DNA, 17 bp, Homo sapiens
gccctaagcccccaggg

SEQ ID NO: 1681933 - DNA, 18 bp, Homo sapiens
gccctaagcccccagggc

SEQ ID NO: 1681934 - DNA, 23 bp, Homo sapiens
gccctaagcccccagggcctcca

SEQ ID NO: 1681935 - DNA, 18 bp, Homo sapiens
gccctaagtggctgcctt

SEQ ID NO: 1681936 - DNA, 21 bp, Homo sapiens
gccctaagtggctgccttctt

SEQ ID NO: 1681937 - DNA, 20 bp, Homo sapiens
gccctacagagctgtggagg

SEQ ID NO: 1681938 - DNA, 21 bp, Homo sapiens
gccctaccagcgcccgctggg

SEQ ID NO: 1681939 - DNA, 22 bp, Homo sapiens
gccctaccagcgcccgctgggc

SEQ ID NO: 1681940 - DNA, 15 bp, Homo sapiens
gccctactccactgc

SEQ ID NO: 1681941 - DNA, 16 bp, Homo sapiens
gccctactccactgcc

SEQ ID NO: 1681942 - DNA, 21 bp, Homo sapiens
gccctactccactgccctggc

SEQ ID NO: 1681943 - DNA, 13 bp, Homo sapiens
gccctagagcaca

SEQ ID NO: 1681944 - DNA, 20 bp, Homo sapiens
gccctagaggcgagccaggc

SEQ ID NO: 1681945 - DNA, 22 bp, Homo sapiens
gccctagaggcgagccaggcaa

SEQ ID NO: 1681946 - DNA, 20 bp, Homo sapiens
gccctaggcccctcctagac

SEQ ID NO: 1681947 - DNA, 14 bp, Homo sapiens
gccctatgctgtgc

SEQ ID NO: 1681948 - DNA, 16 bp, Homo sapiens
gccctatgtctcagga

SEQ ID NO: 1681949 - DNA, 17 bp, Homo sapiens
gccctatgtctcaggag

SEQ ID NO: 1681950 - DNA, 19 bp, Homo sapiens
gccctcaaagaagtcggaa

SEQ ID NO: 1681951 - DNA, 12 bp, Homo sapiens
gccctcaccacc

SEQ ID NO: 1681952 - DNA, 17 bp, Homo sapiens
gccctcaccacccactt

SEQ ID NO: 1681953 - DNA, 14 bp, Homo sapiens
gccctcacctctga

SEQ ID NO: 1681954 - DNA, 22 bp, Homo sapiens
gccctcactcttgaagtccagg

SEQ ID NO: 1681955 - DNA, 14 bp, Homo sapiens
gccctcagaagaaa

SEQ ID NO: 1681956 - DNA, 21 bp, Homo sapiens
gccctcagtcagttcccggag

SEQ ID NO: 1681957 - DNA, 16 bp, Homo sapiens
gccctcatggcccctc

SEQ ID NO: 1681958 - DNA, 12 bp, Homo sapiens
gccctccaggcc

SEQ ID NO: 1681959 - DNA, 18 bp, Homo sapiens
gccctccaggcctgcagg

SEQ ID NO: 1681960 - DNA, 16 bp, Homo sapiens
gccctccatgggctag

SEQ ID NO: 1681961 - DNA, 13 bp, Homo sapiens
gccctcccacagc

SEQ ID NO: 1681962 - DNA, 15 bp, Homo sapiens
gccctcccacagcct

SEQ ID NO: 1681963 - DNA, 18 bp, Homo sapiens
gccctcccacagcctcct

SEQ ID NO: 1681964 - DNA, 19 bp, Homo sapiens
gccctcccacagcctcctt

SEQ ID NO: 1681965 - DNA, 19 bp, Homo sapiens
gccctcccagcccattgct

SEQ ID NO: 1681966 - DNA, 18 bp, Homo sapiens
gccctccccatggagcca

SEQ ID NO: 1681967 - DNA, 22 bp, Homo sapiens
gccctcccctccggactggtgc

SEQ ID NO: 1681968 - DNA, 16 bp, Homo sapiens
gccctccccttcccct

SEQ ID NO: 1681969 - DNA, 15 bp, Homo sapiens
gccctccctctccca

SEQ ID NO: 1681970 - DNA, 15 bp, Homo sapiens
gccctccctgcccct

SEQ ID NO: 1681971 - DNA, 13 bp, Homo sapiens
gccctccctggct

SEQ ID NO: 1681972 - DNA, 22 bp, Homo sapiens
gccctccctgttccccagagaa

SEQ ID NO: 1681973 - DNA, 23 bp, Homo sapiens
gccctcccttggaaacctgccct

SEQ ID NO: 1681974 - DNA, 18 bp, Homo sapiens
gccctccgaccctcatgg

SEQ ID NO: 1681975 - DNA, 13 bp, Homo sapiens
gccctcctcaccc

SEQ ID NO: 1681976 - DNA, 14 bp, Homo sapiens
gccctcctcacccc

SEQ ID NO: 1681977 - DNA, 13 bp, Homo sapiens
gccctcctcgggc

SEQ ID NO: 1681978 - DNA, 19 bp, Homo sapiens
gccctcctgagcacccgct

SEQ ID NO: 1681979 - DNA, 10 bp, Homo sapiens
gccctcctgg

SEQ ID NO: 1681980 - DNA, 21 bp, Homo sapiens
gccctcggaggtccagctggg

SEQ ID NO: 1681981 - DNA, 14 bp, Homo sapiens
gccctcggcctccg

SEQ ID NO: 1681982 - DNA, 22 bp, Homo sapiens
gccctcgtgcctgggggagaga

SEQ ID NO: 1681983 - DNA, 15 bp, Homo sapiens
gccctcgtggccagc

SEQ ID NO: 1681984 - DNA, 16 bp, Homo sapiens
gccctcgtggccagcc

SEQ ID NO: 1681985 - DNA, 18 bp, Homo sapiens
gccctcgtggccagcccg

SEQ ID NO: 1681986 - DNA, 19 bp, Homo sapiens
gccctcgtggccagcccgg

SEQ ID NO: 1681987 - DNA, 16 bp, Homo sapiens
gccctctatttattag

SEQ ID NO: 1681988 - DNA, 17 bp, Homo sapiens
gccctctatttattagc

SEQ ID NO: 1681989 - DNA, 23 bp, Homo sapiens
gccctctatttattagccaactg

SEQ ID NO: 1681990 - DNA, 14 bp, Homo sapiens
gccctctctgctcc

SEQ ID NO: 1681991 - DNA, 16 bp, Homo sapiens
gccctctctgctcctt

SEQ ID NO: 1681992 - DNA, 11 bp, Homo sapiens
gccctctcttc

SEQ ID NO: 1681993 - DNA, 17 bp, Homo sapiens
gccctctgaacttgcct

SEQ ID NO: 1681994 - DNA, 13 bp, Homo sapiens
gccctctgcccca

SEQ ID NO: 1681995 - DNA, 15 bp, Homo sapiens
gccctctgcctgcac

SEQ ID NO: 1681996 - DNA, 22 bp, Homo sapiens
gccctctgcctgcactccctgg

SEQ ID NO: 1681997 - DNA, 23 bp, Homo sapiens
gccctctgcctgcactccctggc

SEQ ID NO: 1681998 - DNA, 14 bp, Homo sapiens
gccctctgctctgc

SEQ ID NO: 1681999 - DNA, 18 bp, Homo sapiens
gccctctgctctgcctgg

SEQ ID NO: 1682000 - DNA, 20 bp, Homo sapiens
gccctctgctctgcctggag

SEQ ID NO: 1682001 - DNA, 20 bp, Homo sapiens
gccctctgggtccctcctct

SEQ ID NO: 1682002 - DNA, 15 bp, Homo sapiens
gccctctgtagctcc

SEQ ID NO: 1682003 - DNA, 23 bp, Homo sapiens
gccctctgtagctccctcctccc

SEQ ID NO: 1682004 - DNA, 14 bp, Homo sapiens
gccctctgtccaca

SEQ ID NO: 1682005 - DNA, 22 bp, Homo sapiens
gccctgagacctctagagaaaa

SEQ ID NO: 1682006 - DNA, 23 bp, Homo sapiens
gccctgagagagaatagagctgc

SEQ ID NO: 1682007 - DNA, 13 bp, Homo sapiens
gccctgagctcgg

SEQ ID NO: 1682008 - DNA, 16 bp, Homo sapiens
gccctgagctcggtgg

SEQ ID NO: 1682009 - DNA, 22 bp, Homo sapiens
gccctgagctcggtggacccag

SEQ ID NO: 1682010 - DNA, 20 bp, Homo sapiens
gccctgaggcctagactctg

SEQ ID NO: 1682011 - DNA, 22 bp, Homo sapiens
gccctgaggtgtgggggctgca

SEQ ID NO: 1682012 - DNA, 15 bp, Homo sapiens
gccctgagtcctggt

SEQ ID NO: 1682013 - DNA, 16 bp, Homo sapiens
gccctgagtgtcccaa

SEQ ID NO: 1682014 - DNA, 19 bp, Homo sapiens
gccctgatgcgtctaccca

SEQ ID NO: 1682015 - DNA, 13 bp, Homo sapiens
gcccttggctgca

SEQ ID NO: 1682016 - DNA, 15 bp, Homo sapiens
gcccttggctgcagg

SEQ ID NO: 1682017 - DNA, 15 bp, Homo sapiens
gcccttggcttctgt

SEQ ID NO: 1682018 - DNA, 13 bp, Homo sapiens
gcccttgggccac

SEQ ID NO: 1682019 - DNA, 20 bp, Homo sapiens
gcccttggggcctggcttgc

SEQ ID NO: 1682020 - DNA, 17 bp, Homo sapiens
gcccttgtcctgccagc

SEQ ID NO: 1682021 - DNA, 18 bp, Homo sapiens
gcccttgtcctgccagct

SEQ ID NO: 1682022 - DNA, 21 bp, Homo sapiens
gccctttccccgacgcccacc

SEQ ID NO: 1682023 - DNA, 15 bp, Homo sapiens
gccctttcctcctca

SEQ ID NO: 1682024 - DNA, 20 bp, Homo sapiens
gccctttgagatctggggag

SEQ ID NO: 1682025 - DNA, 13 bp, Homo sapiens
gccctttggcttc

SEQ ID NO: 1682026 - DNA, 17 bp, Homo sapiens
gccctttgggaggctga

SEQ ID NO: 1682027 - DNA, 16 bp, Homo sapiens
gcccttttccagcctc

SEQ ID NO: 1682028 - DNA, 15 bp, Homo sapiens
gccctttttcccttc

SEQ ID NO: 1682029 - DNA, 12 bp, Homo sapiens
gccgaagctctg

SEQ ID NO: 1682030 - DNA, 12 bp, Homo sapiens
gccgaaggtgcc

SEQ ID NO: 1682031 - DNA, 19 bp, Homo sapiens
gccgaaggtgcctcagact

SEQ ID NO: 1682032 - DNA, 16 bp, Homo sapiens
gccgaatggggcagca

SEQ ID NO: 1682033 - DNA, 14 bp, Homo sapiens
gccgacatccctcc

SEQ ID NO: 1682034 - DNA, 17 bp, Homo sapiens
gccgaccagagccccac

SEQ ID NO: 1682035 - DNA, 12 bp, Homo sapiens
gccgaccagagg

SEQ ID NO: 1682036 - DNA, 23 bp, Homo sapiens
gccgaccaggctggacaccctct

SEQ ID NO: 1682037 - DNA, 12 bp, Homo sapiens
gccgacctcagc

SEQ ID NO: 1682038 - DNA, 13 bp, Homo sapiens
gccgacctcagcc

SEQ ID NO: 1682039 - DNA, 14 bp, Homo sapiens
gccgactctggccc

SEQ ID NO: 1682040 - DNA, 15 bp, Homo sapiens
gccgactctggccct

SEQ ID NO: 1682041 - DNA, 17 bp, Homo sapiens
gccgactctggccctgg

SEQ ID NO: 1682042 - DNA, 18 bp, Homo sapiens
gccgactctggccctggc

SEQ ID NO: 1682043 - DNA, 15 bp, Homo sapiens
gccgacttggagact

SEQ ID NO: 1682044 - DNA, 23 bp, Homo sapiens
gccgagactcgactctgtgcctc

SEQ ID NO: 1682045 - DNA, 12 bp, Homo sapiens
gccgagagcctg

SEQ ID NO: 1682046 - DNA, 16 bp, Homo sapiens
gccgagagcctgctcc

SEQ ID NO: 1682047 - DNA, 17 bp, Homo sapiens
gccgagagcctgctccc

SEQ ID NO: 1682048 - DNA, 15 bp, Homo sapiens
gccgagatcacacca

SEQ ID NO: 1682049 - DNA, 22 bp, Homo sapiens
gccgagctcgtgtatcctgggg

SEQ ID NO: 1682050 - DNA, 15 bp, Homo sapiens
gccgaggcccagcgg

SEQ ID NO: 1682051 - DNA, 17 bp, Homo sapiens
gccgaggcccagcgggc

SEQ ID NO: 1682052 - DNA, 13 bp, Homo sapiens
gccgtagggtggc

SEQ ID NO: 1682053 - DNA, 20 bp, Homo sapiens
gccgtccatggcaccagccc

SEQ ID NO: 1682054 - DNA, 15 bp, Homo sapiens
gccgtcccaggccac

SEQ ID NO: 1682055 - DNA, 19 bp, Homo sapiens
gccgtcccgcgttcaagac

SEQ ID NO: 1682056 - DNA, 15 bp, Homo sapiens
gccgtccctcccagg

SEQ ID NO: 1682057 - DNA, 16 bp, Homo sapiens
gccgtccctcccaggt

SEQ ID NO: 1682058 - DNA, 18 bp, Homo sapiens
gccgtcctcccgggccct

SEQ ID NO: 1682059 - DNA, 20 bp, Homo sapiens
gccgtcctcccgggccctcc

SEQ ID NO: 1682060 - DNA, 21 bp, Homo sapiens
gccgtctaggattgggcctcc

SEQ ID NO: 1682061 - DNA, 13 bp, Homo sapiens
gccgtctcctccc

SEQ ID NO: 1682062 - DNA, 16 bp, Homo sapiens
gccgtctgactccaga

SEQ ID NO: 1682063 - DNA, 22 bp, Homo sapiens
gccgtctgtgtggtggagccag

SEQ ID NO: 1682064 - DNA, 14 bp, Homo sapiens
gccgtcttctgccc

SEQ ID NO: 1682065 - DNA, 17 bp, Homo sapiens
gccgtgcatggctcctg

SEQ ID NO: 1682066 - DNA, 13 bp, Homo sapiens
gccgtgcccttgc

SEQ ID NO: 1682067 - DNA, 20 bp, Homo sapiens
gccgtgcccttgcccttgga

SEQ ID NO: 1682068 - DNA, 18 bp, Homo sapiens
gccgtggatggccgtgga

SEQ ID NO: 1682069 - DNA, 11 bp, Homo sapiens
gccgtggcttc

SEQ ID NO: 1682070 - DNA, 22 bp, Homo sapiens
gccgtggcttcccgctcagccc

SEQ ID NO: 1682071 - DNA, 20 bp, Homo sapiens
gccgtgtcccgcggtgctga

SEQ ID NO: 1682072 - DNA, 23 bp, Homo sapiens
gccgtgtcccgcggtgctgactg

SEQ ID NO: 1682073 - DNA, 21 bp, Homo sapiens
gccgtgtctcagcctctgcca

SEQ ID NO: 1682074 - DNA, 16 bp, Homo sapiens
gccgtgttactgttgc

SEQ ID NO: 1682075 - DNA, 15 bp, Homo sapiens
gccgttactctccaa

SEQ ID NO: 1682076 - DNA, 14 bp, Homo sapiens
gccgttcagcctgt

SEQ ID NO: 1682077 - DNA, 19 bp, Homo sapiens
gccgttctgttccaacctc

SEQ ID NO: 1682078 - DNA, 23 bp, Homo sapiens
gcctaaaacgaatggtctttgct

SEQ ID NO: 1682079 - DNA, 15 bp, Homo sapiens
gcctaaaagtaaaca

SEQ ID NO: 1682080 - DNA, 15 bp, Homo sapiens
gcctaaacctcagtt

SEQ ID NO: 1682081 - DNA, 15 bp, Homo sapiens
gcctaaagggcaggg

SEQ ID NO: 1682082 - DNA, 15 bp, Homo sapiens
gcctaaatccaaaga

SEQ ID NO: 1682083 - DNA, 16 bp, Homo sapiens
gcctaagaagctctgg

SEQ ID NO: 1682084 - DNA, 15 bp, Homo sapiens
gcctaagacatgtga

SEQ ID NO: 1682085 - DNA, 19 bp, Homo sapiens
gcctaagacatgtgaggag

SEQ ID NO: 1682086 - DNA, 22 bp, Homo sapiens
gcctaaggttgtctacgggggc

SEQ ID NO: 1682087 - DNA, 22 bp, Homo sapiens
gcctaatctcatacctctgacc

SEQ ID NO: 1682088 - DNA, 16 bp, Homo sapiens
gcctaatggagaagac

SEQ ID NO: 1682089 - DNA, 18 bp, Homo sapiens
gcctacaaagagatgctt

SEQ ID NO: 1682090 - DNA, 14 bp, Homo sapiens
gcctacagctgtct

SEQ ID NO: 1682091 - DNA, 20 bp, Homo sapiens
gcctaccgctggccctgccg

SEQ ID NO: 1682092 - DNA, 16 bp, Homo sapiens
gcctacctcagcctcc

SEQ ID NO: 1682093 - DNA, 15 bp, Homo sapiens
gcctactcttcaggg

SEQ ID NO: 1682094 - DNA, 21 bp, Homo sapiens
gcctactttggggaaataaag

SEQ ID NO: 1682095 - DNA, 22 bp, Homo sapiens
gcctagaccagcagacagagcc

SEQ ID NO: 1682096 - DNA, 13 bp, Homo sapiens
gcctagactctgt

SEQ ID NO: 1682097 - DNA, 23 bp, Homo sapiens
gcctagatccacacacagaggaa

SEQ ID NO: 1682098 - DNA, 20 bp, Homo sapiens
gcctagattaggtagacttt

SEQ ID NO: 1682099 - DNA, 18 bp, Homo sapiens
gcctagcaggcacaggac

SEQ ID NO: 1682100 - DNA, 14 bp, Homo sapiens
gcctagccacctcc

SEQ ID NO: 1682101 - DNA, 15 bp, Homo sapiens
gcctagccctgggac

SEQ ID NO: 1682102 - DNA, 16 bp, Homo sapiens
gcctagccgacctcag

SEQ ID NO: 1682103 - DNA, 17 bp, Homo sapiens
gcctagccgacctcagc

SEQ ID NO: 1682104 - DNA, 19 bp, Homo sapiens
gcctagccgacctcagcct

SEQ ID NO: 1682105 - DNA, 17 bp, Homo sapiens
gcctagcgatctctcct

SEQ ID NO: 1682106 - DNA, 20 bp, Homo sapiens
gcctagcgatctctcctggc

SEQ ID NO: 1682107 - DNA, 22 bp, Homo sapiens
gcctagcgatctctcctggcct

SEQ ID NO: 1682108 - DNA, 18 bp, Homo sapiens
gcctagcggagcccagcc

SEQ ID NO: 1682109 - DNA, 19 bp, Homo sapiens
gcctagcggagcccagcct

SEQ ID NO: 1682110 - DNA, 22 bp, Homo sapiens
gcctagcggagcccagcctggg

SEQ ID NO: 1682111 - DNA, 22 bp, Homo sapiens
gcctagctaccttctctaccca

SEQ ID NO: 1682112 - DNA, 16 bp, Homo sapiens
gcctagctcctgccac

SEQ ID NO: 1682113 - DNA, 23 bp, Homo sapiens
gcctagctcctgccacatggagc

SEQ ID NO: 1682114 - DNA, 11 bp, Homo sapiens
gcctaggagat

SEQ ID NO: 1682115 - DNA, 13 bp, Homo sapiens
gcctaggagctgg

SEQ ID NO: 1682116 - DNA, 19 bp, Homo sapiens
gcctaggagctggctggca

SEQ ID NO: 1682117 - DNA, 16 bp, Homo sapiens
gcctaggattctaaaa

SEQ ID NO: 1682118 - DNA, 22 bp, Homo sapiens
gcctaggcacctccccgctctc

SEQ ID NO: 1682119 - DNA, 19 bp, Homo sapiens
gcctaggccaaatgcacaa

SEQ ID NO: 1682120 - DNA, 11 bp, Homo sapiens
gcctagggagc

SEQ ID NO: 1682121 - DNA, 12 bp, Homo sapiens
gcctagggcaga

SEQ ID NO: 1682122 - DNA, 20 bp, Homo sapiens
gcctagggtcttgggggtca

SEQ ID NO: 1682123 - DNA, 15 bp, Homo sapiens
gcctagtgggagtta

SEQ ID NO: 1682124 - DNA, 18 bp, Homo sapiens
gcctagtggggtctccct

SEQ ID NO: 1682125 - DNA, 16 bp, Homo sapiens
gcctagtttactgttt

SEQ ID NO: 1682126 - DNA, 17 bp, Homo sapiens
gcctataatcccagcta

SEQ ID NO: 1682127 - DNA, 20 bp, Homo sapiens
gcctataatcccagctactg

SEQ ID NO: 1682128 - DNA, 13 bp, Homo sapiens
gcctatatcagtc

SEQ ID NO: 1682129 - DNA, 20 bp, Homo sapiens
gcctatcaacctaagcaaca

SEQ ID NO: 1682130 - DNA, 20 bp, Homo sapiens
gcctatcagagttgctgcaa

SEQ ID NO: 1682131 - DNA, 15 bp, Homo sapiens
gcctatgatcccagc

SEQ ID NO: 1682132 - DNA, 14 bp, Homo sapiens
gcctatgcacatat

SEQ ID NO: 1682133 - DNA, 18 bp, Homo sapiens
gcctatgtggtctaaggt

SEQ ID NO: 1682134 - DNA, 15 bp, Homo sapiens
gcctattatattaaa

SEQ ID NO: 1682135 - DNA, 21 bp, Homo sapiens
gcctattccaggaattcctct

SEQ ID NO: 1682136 - DNA, 17 bp, Homo sapiens
gcctcgacctccccacc

SEQ ID NO: 1682137 - DNA, 15 bp, Homo sapiens
gcctcgaggcaccgg

SEQ ID NO: 1682138 - DNA, 21 bp, Homo sapiens
gcctcgaggcaccggcgctgc

SEQ ID NO: 1682139 - DNA, 23 bp, Homo sapiens
gcctcgaggcaccggcgctgcag

SEQ ID NO: 1682140 - DNA, 13 bp, Homo sapiens
gcctcgcacaggc

SEQ ID NO: 1682141 - DNA, 16 bp, Homo sapiens
gcctcgcacaggccct

SEQ ID NO: 1682142 - DNA, 15 bp, Homo sapiens
gcctcgctcccttca

SEQ ID NO: 1682143 - DNA, 14 bp, Homo sapiens
gcctcggagcctca

SEQ ID NO: 1682144 - DNA, 17 bp, Homo sapiens
gcctcggagcctcatcc

SEQ ID NO: 1682145 - DNA, 15 bp, Homo sapiens
gcctcggcctcccaa

SEQ ID NO: 1682146 - DNA, 18 bp, Homo sapiens
gcctcggctaggggtcct

SEQ ID NO: 1682147 - DNA, 21 bp, Homo sapiens
gcctcggtatctggcttccct

SEQ ID NO: 1682148 - DNA, 15 bp, Homo sapiens
gcctcgtgaggggca

SEQ ID NO: 1682149 - DNA, 18 bp, Homo sapiens
gcctcgtgaggggcaagc

SEQ ID NO: 1682150 - DNA, 19 bp, Homo sapiens
gcctcgtgaggggcaagct

SEQ ID NO: 1682151 - DNA, 16 bp, Homo sapiens
gcctcgtgccagcagc

SEQ ID NO: 1682152 - DNA, 17 bp, Homo sapiens
gcctcgtgccagcagcc

SEQ ID NO: 1682153 - DNA, 19 bp, Homo sapiens
gcctcgtgccagcagcctc

SEQ ID NO: 1682154 - DNA, 22 bp, Homo sapiens
gcctcgtgccagcagcctcgca

SEQ ID NO: 1682155 - DNA, 19 bp, Homo sapiens
gcctcgttggagagcagca

SEQ ID NO: 1682156 - DNA, 18 bp, Homo sapiens
gcctctcaagtagctggg

SEQ ID NO: 1682157 - DNA, 13 bp, Homo sapiens
gcctctcacacac

SEQ ID NO: 1682158 - DNA, 22 bp, Homo sapiens
gcctctccaaccactgtgccac

SEQ ID NO: 1682159 - DNA, 15 bp, Homo sapiens
gcctctcccatcact

SEQ ID NO: 1682160 - DNA, 20 bp, Homo sapiens
gcctctccccaggtccagct

SEQ ID NO: 1682161 - DNA, 13 bp, Homo sapiens
gcctctcccgcac

SEQ ID NO: 1682162 - DNA, 16 bp, Homo sapiens
gcctctcccgcaccag

SEQ ID NO: 1682163 - DNA, 14 bp, Homo sapiens
gcctctcccggctg

SEQ ID NO: 1682164 - DNA, 22 bp, Homo sapiens
gcctctcccggctgcctgccgc

SEQ ID NO: 1682165 - DNA, 17 bp, Homo sapiens
gcctctcccgtcagggc

SEQ ID NO: 1682166 - DNA, 18 bp, Homo sapiens
gcctctcccgtcagggcc

SEQ ID NO: 1682167 - DNA, 24 bp, Homo sapiens
gcctctccctgcactccctcctgg

SEQ ID NO: 1682168 - DNA, 15 bp, Homo sapiens
gcctctccctggccc

SEQ ID NO: 1682169 - DNA, 23 bp, Homo sapiens
gcctctccgactctgcacccgcc

SEQ ID NO: 1682170 - DNA, 22 bp, Homo sapiens
gcctctcctgccctctgctctg

SEQ ID NO: 1682171 - DNA, 12 bp, Homo sapiens
gcctctctctgc

SEQ ID NO: 1682172 - DNA, 15 bp, Homo sapiens
gcctctctctgcctg

SEQ ID NO: 1682173 - DNA, 16 bp, Homo sapiens
gcctctctggcctccc

SEQ ID NO: 1682174 - DNA, 19 bp, Homo sapiens
gcctctctggcctcccacc

SEQ ID NO: 1682175 - DNA, 15 bp, Homo sapiens
gcctctgacagtcca

SEQ ID NO: 1682176 - DNA, 15 bp, Homo sapiens
gcctctgatatggga

SEQ ID NO: 1682177 - DNA, 19 bp, Homo sapiens
gcctctgatatgggactga

SEQ ID NO: 1682178 - DNA, 22 bp, Homo sapiens
gcctctgcaactgctcagctct

SEQ ID NO: 1682179 - DNA, 13 bp, Homo sapiens
gcctctgcagaag

SEQ ID NO: 1682180 - DNA, 17 bp, Homo sapiens
gcctctgcagtctcatt

SEQ ID NO: 1682181 - DNA, 18 bp, Homo sapiens
gcctctgcagtctcattt

SEQ ID NO: 1682182 - DNA, 21 bp, Homo sapiens
gcctctgcagtctcatttctc

SEQ ID NO: 1682183 - DNA, 16 bp, Homo sapiens
gcctctgccagcgcca

SEQ ID NO: 1682184 - DNA, 12 bp, Homo sapiens
gcctctgccagg

SEQ ID NO: 1682185 - DNA, 13 bp, Homo sapiens
gcctctgccaggc

SEQ ID NO: 1682186 - DNA, 14 bp, Homo sapiens
gcctctgccaggcc

SEQ ID NO: 1682187 - DNA, 13 bp, Homo sapiens
gcctctgccctgg

SEQ ID NO: 1682188 - DNA, 15 bp, Homo sapiens
gcctctgccctggat

SEQ ID NO: 1682189 - DNA, 17 bp, Homo sapiens
gcctctgccctggattg

SEQ ID NO: 1682190 - DNA, 13 bp, Homo sapiens
gcctctgcctgct

SEQ ID NO: 1682191 - DNA, 13 bp, Homo sapiens
gcctctgcctggg

SEQ ID NO: 1682192 - DNA, 12 bp, Homo sapiens
gcctctgctccc

SEQ ID NO: 1682193 - DNA, 14 bp, Homo sapiens
gcctctgctccctc

SEQ ID NO: 1682194 - DNA, 12 bp, Homo sapiens
gcctctgctgaa

SEQ ID NO: 1682195 - DNA, 14 bp, Homo sapiens
gcctctggatctag

SEQ ID NO: 1682196 - DNA, 13 bp, Homo sapiens
gcctctggctaga

SEQ ID NO: 1682197 - DNA, 21 bp, Homo sapiens
gcctctggctagaggccagcc

SEQ ID NO: 1682198 - DNA, 23 bp, Homo sapiens
gcctctggctagaggccagcccc

SEQ ID NO: 1682199 - DNA, 12 bp, Homo sapiens
gcctctgggcag

SEQ ID NO: 1682200 - DNA, 17 bp, Homo sapiens
gcctctgggcagtgtgg

SEQ ID NO: 1682201 - DNA, 16 bp, Homo sapiens
gcctctgtcaggcctt

SEQ ID NO: 1682202 - DNA, 19 bp, Homo sapiens
gcctctgtgcacagtggct

SEQ ID NO: 1682203 - DNA, 22 bp, Homo sapiens
gcctctgtgcacagtggcttct

SEQ ID NO: 1682204 - DNA, 20 bp, Homo sapiens
gcctctgttcctttctctgg

SEQ ID NO: 1682205 - DNA, 16 bp, Homo sapiens
gcctcttagtgattgt

SEQ ID NO: 1682206 - DNA, 20 bp, Homo sapiens
gcctcttattccaggagaag

SEQ ID NO: 1682207 - DNA, 21 bp, Homo sapiens
gcctcttcttcttcagaagac

SEQ ID NO: 1682208 - DNA, 13 bp, Homo sapiens
gcctcttctttgt

SEQ ID NO: 1682209 - DNA, 13 bp, Homo sapiens
gcctcttgaccag

SEQ ID NO: 1682210 - DNA, 15 bp, Homo sapiens
gcctcttgaccaggc

SEQ ID NO: 1682211 - DNA, 17 bp, Homo sapiens
gcctcttgaccaggctg

SEQ ID NO: 1682212 - DNA, 19 bp, Homo sapiens
gcctcttgagcagtggctg

SEQ ID NO: 1682213 - DNA, 21 bp, Homo sapiens
gcctcttggctatttctgtgt

SEQ ID NO: 1682214 - DNA, 16 bp, Homo sapiens
gcctcttgtcttccta

SEQ ID NO: 1682215 - DNA, 16 bp, Homo sapiens
gcctcttgtgctcacg

SEQ ID NO: 1682216 - DNA, 20 bp, Homo sapiens
gcctcttgtgctcacgctcc

SEQ ID NO: 1682217 - DNA, 22 bp, Homo sapiens
gcctcttgtgtaactaatttgt

SEQ ID NO: 1682218 - DNA, 13 bp, Homo sapiens
gcctgaaaacctt

SEQ ID NO: 1682219 - DNA, 16 bp, Homo sapiens
gcctgaaagaggctga

SEQ ID NO: 1682220 - DNA, 14 bp, Homo sapiens
gcctgaaagataca

SEQ ID NO: 1682221 - DNA, 15 bp, Homo sapiens
gcctgaacagaagct

SEQ ID NO: 1682222 - DNA, 21 bp, Homo sapiens
gcctgaacatccttccttccc

SEQ ID NO: 1682223 - DNA, 15 bp, Homo sapiens
gcctgaactgaggag

SEQ ID NO: 1682224 - DNA, 16 bp, Homo sapiens
gcctgaactgaggcct

SEQ ID NO: 1682225 - DNA, 18 bp, Homo sapiens
gcctgaatcatgagcctg

SEQ ID NO: 1682226 - DNA, 19 bp, Homo sapiens
gcctgaatcatgagcctgc

SEQ ID NO: 1682227 - DNA, 21 bp, Homo sapiens
gcctgaatcatgagcctgctg

SEQ ID NO: 1682228 - DNA, 21 bp, Homo sapiens
gcctgacaaccactggtctgt

SEQ ID NO: 1682229 - DNA, 22 bp, Homo sapiens
gcctgacacactaaccaagctg

SEQ ID NO: 1682230 - DNA, 16 bp, Homo sapiens
gcctgacaccccctcc

SEQ ID NO: 1682231 - DNA, 23 bp, Homo sapiens
gcctgaccctacttcttttgctc

SEQ ID NO: 1682232 - DNA, 15 bp, Homo sapiens
gcctgactgctcaga

SEQ ID NO: 1682233 - DNA, 16 bp, Homo sapiens
gcctgacttctgctgg

SEQ ID NO: 1682234 - DNA, 19 bp, Homo sapiens
gcctgacttctgctggcat

SEQ ID NO: 1682235 - DNA, 19 bp, Homo sapiens
gcctgagaatgagtgggaa

SEQ ID NO: 1682236 - DNA, 13 bp, Homo sapiens
gcctgagaggcag

SEQ ID NO: 1682237 - DNA, 12 bp, Homo sapiens
gcctgagattct

SEQ ID NO: 1682238 - DNA, 16 bp, Homo sapiens
gcctgagatttcatct

SEQ ID NO: 1682239 - DNA, 23 bp, Homo sapiens
gcctgagatttcatctgctctcc

SEQ ID NO: 1682240 - DNA, 13 bp, Homo sapiens
gcctgagcaacat

SEQ ID NO: 1682241 - DNA, 21 bp, Homo sapiens
gcctgagcaacatctcgggag

SEQ ID NO: 1682242 - DNA, 19 bp, Homo sapiens
gcctgagcacctcccagcc

SEQ ID NO: 1682243 - DNA, 23 bp, Homo sapiens
gcctgagcacctcccagcccctg

SEQ ID NO: 1682244 - DNA, 22 bp, Homo sapiens
gcctgagccctactccctgcag

SEQ ID NO: 1682245 - DNA, 22 bp, Homo sapiens
gcctgagcgctcctgccgcaga

SEQ ID NO: 1682246 - DNA, 18 bp, Homo sapiens
gcctgaggaggaggacac

SEQ ID NO: 1682247 - DNA, 19 bp, Homo sapiens
gcctgaggaggaggacaca

SEQ ID NO: 1682248 - DNA, 18 bp, Homo sapiens
gcctgaggatgagctgga

SEQ ID NO: 1682249 - DNA, 22 bp, Homo sapiens
gcctgctgtgattccactacac

SEQ ID NO: 1682250 - DNA, 21 bp, Homo sapiens
gcctgctgttggtcctctctc

SEQ ID NO: 1682251 - DNA, 12 bp, Homo sapiens
gcctgcttcccc

SEQ ID NO: 1682252 - DNA, 23 bp, Homo sapiens
gcctgcttggcccggccggcctg

SEQ ID NO: 1682253 - DNA, 17 bp, Homo sapiens
gcctgcttttccaggat

SEQ ID NO: 1682254 - DNA, 16 bp, Homo sapiens
gcctgctttttggaaa

SEQ ID NO: 1682255 - DNA, 21 bp, Homo sapiens
gcctgctttttggaaagtcag

SEQ ID NO: 1682256 - DNA, 23 bp, Homo sapiens
gcctggaacaccagcagcactgg

SEQ ID NO: 1682257 - DNA, 24 bp, Homo sapiens
gcctggaacaccagcagcactgga

SEQ ID NO: 1682258 - DNA, 15 bp, Homo sapiens
gcctggaaccaggga

SEQ ID NO: 1682259 - DNA, 21 bp, Homo sapiens
gcctggacagtatcccacatc

SEQ ID NO: 1682260 - DNA, 14 bp, Homo sapiens
gcctggacctgcct

SEQ ID NO: 1682261 - DNA, 16 bp, Homo sapiens
gcctggacctgcctcc

SEQ ID NO: 1682262 - DNA, 18 bp, Homo sapiens
gcctggacctgcctcctg

SEQ ID NO: 1682263 - DNA, 19 bp, Homo sapiens
gcctggacctgcctcctgc

SEQ ID NO: 1682264 - DNA, 15 bp, Homo sapiens
gcctggacctgggat

SEQ ID NO: 1682265 - DNA, 19 bp, Homo sapiens
gcctggactctaagctgga

SEQ ID NO: 1682266 - DNA, 21 bp, Homo sapiens
gctggcctcacccacccctgc

SEQ ID NO: 1682267 - DNA, 15 bp, Homo sapiens
gctggcctctctagc

SEQ ID NO: 1682268 - DNA, 12 bp, Homo sapiens
gctggcctgtgg

SEQ ID NO: 1682269 - DNA, 17 bp, Homo sapiens
gctggcgcagccaaggc

SEQ ID NO: 1682270 - DNA, 20 bp, Homo sapiens
gctggcgcagccaaggccga

SEQ ID NO: 1682271 - DNA, 20 bp, Homo sapiens
gctggcgcatattaagcact

SEQ ID NO: 1682272 - DNA, 16 bp, Homo sapiens
gctggcggctactcag

SEQ ID NO: 1682273 - DNA, 21 bp, Homo sapiens
gctggcggctactcagcagcc

SEQ ID NO: 1682274 - DNA, 16 bp, Homo sapiens
gctggctactgtctat

SEQ ID NO: 1682275 - DNA, 14 bp, Homo sapiens
gctggctccctggg

SEQ ID NO: 1682276 - DNA, 15 bp, Homo sapiens
gctggctctgagaat

SEQ ID NO: 1682277 - DNA, 13 bp, Homo sapiens
gctggctctgagc

SEQ ID NO: 1682278 - DNA, 21 bp, Homo sapiens
gctggctgaagaatgaagacc

SEQ ID NO: 1682279 - DNA, 19 bp, Homo sapiens
gctggctgcccagacccct

SEQ ID NO: 1682280 - DNA, 11 bp, Homo sapiens
gctggctgcct

SEQ ID NO: 1682281 - DNA, 14 bp, Homo sapiens
gctggctgccttag

SEQ ID NO: 1682282 - DNA, 14 bp, Homo sapiens
gctggctggcaggt

SEQ ID NO: 1682283 - DNA, 13 bp, Homo sapiens
gctggctgggcct

SEQ ID NO: 1682284 - DNA, 17 bp, Homo sapiens
gctggctgggccttcac

SEQ ID NO: 1682285 - DNA, 19 bp, Homo sapiens
gctggcttgtttgatttca

SEQ ID NO: 1682286 - DNA, 13 bp, Homo sapiens
gctggctttctct

SEQ ID NO: 1682287 - DNA, 18 bp, Homo sapiens
gctggctttctctctggc

SEQ ID NO: 1682288 - DNA, 16 bp, Homo sapiens
gctgggaactgacata

SEQ ID NO: 1682289 - DNA, 23 bp, Homo sapiens
gctgggaagagaagagggcccag

SEQ ID NO: 1682290 - DNA, 14 bp, Homo sapiens
gctgggaagagctc

SEQ ID NO: 1682291 - DNA, 16 bp, Homo sapiens
gctgggaagagctccc

SEQ ID NO: 1682292 - DNA, 22 bp, Homo sapiens
gctgggaagctgtactcagagc

SEQ ID NO: 1682293 - DNA, 18 bp, Homo sapiens
gctgggaatggggacacg

SEQ ID NO: 1682294 - DNA, 21 bp, Homo sapiens
gctgggaccagagccagatgc

SEQ ID NO: 1682295 - DNA, 14 bp, Homo sapiens
gctgggacccacct

SEQ ID NO: 1682296 - DNA, 22 bp, Homo sapiens
gctgggacccctcccaacctca

SEQ ID NO: 1682297 - DNA, 17 bp, Homo sapiens
gctgggactacaggtgc

SEQ ID NO: 1682298 - DNA, 15 bp, Homo sapiens
gctgggactcagcct

SEQ ID NO: 1682299 - DNA, 16 bp, Homo sapiens
gctgggactcagcctt

SEQ ID NO: 1682300 - DNA, 19 bp, Homo sapiens
gctgggactcagccttcag

SEQ ID NO: 1682301 - DNA, 14 bp, Homo sapiens
gctgggactggcca

SEQ ID NO: 1682302 - DNA, 20 bp, Homo sapiens
gctgggagaccctccccaca

SEQ ID NO: 1682303 - DNA, 13 bp, Homo sapiens
gctgggagctcca

SEQ ID NO: 1682304 - DNA, 20 bp, Homo sapiens
gctgggagctccactctgct

SEQ ID NO: 1682305 - DNA, 21 bp, Homo sapiens
gctgggagctccactctgctt

SEQ ID NO: 1682306 - DNA, 17 bp, Homo sapiens
gctgggaggagggagag

SEQ ID NO: 1682307 - DNA, 18 bp, Homo sapiens
gctgggaggagggagagg

SEQ ID NO: 1682308 - DNA, 22 bp, Homo sapiens
gctgggaggagggagagggagg

SEQ ID NO: 1682309 - DNA, 16 bp, Homo sapiens
gctgggaggcaagagg

SEQ ID NO: 1682310 - DNA, 17 bp, Homo sapiens
gctgggattacagggat

SEQ ID NO: 1682311 - DNA, 13 bp, Homo sapiens
gctgggcagaagg

SEQ ID NO: 1682312 - DNA, 13 bp, Homo sapiens
gctgggcaggaag

SEQ ID NO: 1682313 - DNA, 13 bp, Homo sapiens
gctgggcatactt

SEQ ID NO: 1682314 - DNA, 18 bp, Homo sapiens
gctgggccactggggact

SEQ ID NO: 1682315 - DNA, 15 bp, Homo sapiens
gctgggccagggaaa

SEQ ID NO: 1682316 - DNA, 20 bp, Homo sapiens
gctgggccatgtccaaagag

SEQ ID NO: 1682317 - DNA, 14 bp, Homo sapiens
gctgggccccatgc

SEQ ID NO: 1682318 - DNA, 22 bp, Homo sapiens
gctgggccccatgctctgcccc

SEQ ID NO: 1682319 - DNA, 15 bp, Homo sapiens
gctgggcccctgcac

SEQ ID NO: 1682320 - DNA, 17 bp, Homo sapiens
gctgggccctctttccc

SEQ ID NO: 1682321 - DNA, 17 bp, Homo sapiens
gctgggcctcccctggg

SEQ ID NO: 1682322 - DNA, 16 bp, Homo sapiens
gctgggcctcctgcct

SEQ ID NO: 1682323 - DNA, 22 bp, Homo sapiens
gctgggcctcctgcctccgggc

SEQ ID NO: 1682324 - DNA, 15 bp, Homo sapiens
gctgggcctccttct

SEQ ID NO: 1682325 - DNA, 17 bp, Homo sapiens
gctgggcgtgtgtgaca

SEQ ID NO: 1682326 - DNA, 13 bp, Homo sapiens
gctgggctctcca

SEQ ID NO: 1682327 - DNA, 14 bp, Homo sapiens
gctgggctctccac

SEQ ID NO: 1682328 - DNA, 20 bp, Homo sapiens
gctgggctctccacctcagc

SEQ ID NO: 1682329 - DNA, 15 bp, Homo sapiens
gctgggctctgccac

SEQ ID NO: 1682330 - DNA, 15 bp, Homo sapiens
gctgggctctgcctt

SEQ ID NO: 1682331 - DNA, 13 bp, Homo sapiens
gctgggctgagcc

SEQ ID NO: 1682332 - DNA, 14 bp, Homo sapiens
gctgggctgagccc

SEQ ID NO: 1682333 - DNA, 18 bp, Homo sapiens
gctgggctgagcccctac

SEQ ID NO: 1682334 - DNA, 15 bp, Homo sapiens
gctggtgtcctgacc

SEQ ID NO: 1682335 - DNA, 16 bp, Homo sapiens
gctggtgtcctgacca

SEQ ID NO: 1682336 - DNA, 14 bp, Homo sapiens
gctggttagaaatg

SEQ ID NO: 1682337 - DNA, 16 bp, Homo sapiens
gctggttgttgccagg

SEQ ID NO: 1682338 - DNA, 18 bp, Homo sapiens
gctggttgttgccaggtt

SEQ ID NO: 1682339 - DNA, 20 bp, Homo sapiens
gctggttgttgccaggttgc

SEQ ID NO: 1682340 - DNA, 21 bp, Homo sapiens
gctggttgttgccaggttgca

SEQ ID NO: 1682341 - DNA, 14 bp, Homo sapiens
gctggttttcctaa

SEQ ID NO: 1682342 - DNA, 20 bp, Homo sapiens
gctggttttgtaagatgctg

SEQ ID NO: 1682343 - DNA, 21 bp, Homo sapiens
gctggttttgtaagatgctgg

SEQ ID NO: 1682344 - DNA, 15 bp, Homo sapiens
gctgtaactgctgag

SEQ ID NO: 1682345 - DNA, 17 bp, Homo sapiens
gctgtaactgctgagcc

SEQ ID NO: 1682346 - DNA, 19 bp, Homo sapiens
gctgtaactgctgagccac

SEQ ID NO: 1682347 - DNA, 22 bp, Homo sapiens
gctgtaactggtagtgttcagt

SEQ ID NO: 1682348 - DNA, 16 bp, Homo sapiens
gctgtaagaagagact

SEQ ID NO: 1682349 - DNA, 24 bp, Homo sapiens
gctgtaagaagagactgggaagat

SEQ ID NO: 1682350 - DNA, 17 bp, Homo sapiens
gctgtaaggctctagat

SEQ ID NO: 1682351 - DNA, 23 bp, Homo sapiens
gctgtaaggctctagatcataag

SEQ ID NO: 1682352 - DNA, 18 bp, Homo sapiens
gctgtaagggcagtgccc

SEQ ID NO: 1682353 - DNA, 22 bp, Homo sapiens
gctgtaatctatgaattctaag

SEQ ID NO: 1682354 - DNA, 12 bp, Homo sapiens
gctgtaatgttt

SEQ ID NO: 1682355 - DNA, 21 bp, Homo sapiens
gctgtaatttcgccttaaact

SEQ ID NO: 1682356 - DNA, 22 bp, Homo sapiens
gctgtaatttcgccttaaactc

SEQ ID NO: 1682357 - DNA, 15 bp, Homo sapiens
gctgtacccttccac

SEQ ID NO: 1682358 - DNA, 15 bp, Homo sapiens
gctgtactataagta

SEQ ID NO: 1682359 - DNA, 18 bp, Homo sapiens
gctgtactataagtagtt

SEQ ID NO: 1682360 - DNA, 14 bp, Homo sapiens
gctgtactcagagc

SEQ ID NO: 1682361 - DNA, 16 bp, Homo sapiens
gctgtactcagagcag

SEQ ID NO: 1682362 - DNA, 20 bp, Homo sapiens
gctgtactcagagcagagca

SEQ ID NO: 1682363 - DNA, 17 bp, Homo sapiens
gctgtactcttgctgat

SEQ ID NO: 1682364 - DNA, 22 bp, Homo sapiens
gctgtactcttgctgatggctg

SEQ ID NO: 1682365 - DNA, 20 bp, Homo sapiens
gctgtagacatttgctatga

SEQ ID NO: 1682366 - DNA, 16 bp, Homo sapiens
gctgtagatcaggttt

SEQ ID NO: 1682367 - DNA, 20 bp, Homo sapiens
gctgtagatggtgacctggg

SEQ ID NO: 1682368 - DNA, 14 bp, Homo sapiens
gctgtagccatggc

SEQ ID NO: 1682369 - DNA, 17 bp, Homo sapiens
gctgtagccatggctca

SEQ ID NO: 1682370 - DNA, 14 bp, Homo sapiens
gctgtataagttat

SEQ ID NO: 1682371 - DNA, 16 bp, Homo sapiens
gctgtatcttgttttt

SEQ ID NO: 1682372 - DNA, 15 bp, Homo sapiens
gctgtatgctgatca

SEQ ID NO: 1682373 - DNA, 15 bp, Homo sapiens
gctgtattgtctgaa

SEQ ID NO: 1682374 - DNA, 19 bp, Homo sapiens
gctgtatttcctgcttccc

SEQ ID NO: 1682375 - DNA, 21 bp, Homo sapiens
gctgtatttcctgcttccctg

SEQ ID NO: 1682376 - DNA, 18 bp, Homo sapiens
gctgtattttaacacttt

SEQ ID NO: 1682377 - DNA, 13 bp, Homo sapiens
gctgtcacaggcg

SEQ ID NO: 1682378 - DNA, 17 bp, Homo sapiens
gctgtcaccaaggaaac

SEQ ID NO: 1682379 - DNA, 17 bp, Homo sapiens
gctgtcaccacgtgcag

SEQ ID NO: 1682380 - DNA, 19 bp, Homo sapiens
gctgtcaccacgtgcagta

SEQ ID NO: 1682381 - DNA, 17 bp, Homo sapiens
gctgtcagatgtcacat

SEQ ID NO: 1682382 - DNA, 16 bp, Homo sapiens
gctgtccctccccctt

SEQ ID NO: 1682383 - DNA, 18 bp, Homo sapiens
gctgtccctgcagggcca

SEQ ID NO: 1682384 - DNA, 14 bp, Homo sapiens
gctgtccctgtcac

SEQ ID NO: 1682385 - DNA, 14 bp, Homo sapiens
gctgtcctaggcca

SEQ ID NO: 1682386 - DNA, 16 bp, Homo sapiens
gctgtcctaggccaca

SEQ ID NO: 1682387 - DNA, 23 bp, Homo sapiens
gctgtcctctcagaactcctgtg

SEQ ID NO: 1682388 - DNA, 21 bp, Homo sapiens
gctgtcctctcatttgcagtc

SEQ ID NO: 1682389 - DNA, 13 bp, Homo sapiens
gctgtcctgcagt

SEQ ID NO: 1682390 - DNA, 16 bp, Homo sapiens
gctgtcctggaggggc

SEQ ID NO: 1682391 - DNA, 15 bp, Homo sapiens
gctgtcctggtggct

SEQ ID NO: 1682392 - DNA, 16 bp, Homo sapiens
gctgtcgctgcctcca

SEQ ID NO: 1682393 - DNA, 21 bp, Homo sapiens
gctgtcgctgcctccatggca

SEQ ID NO: 1682394 - DNA, 13 bp, Homo sapiens
gctgtcggcacca

SEQ ID NO: 1682395 - DNA, 17 bp, Homo sapiens
gctgtctacagtagctg

SEQ ID NO: 1682396 - DNA, 14 bp, Homo sapiens
gctgtctagaatgt

SEQ ID NO: 1682397 - DNA, 16 bp, Homo sapiens
gctgtggtctgaagtg

SEQ ID NO: 1682398 - DNA, 20 bp, Homo sapiens
gctgtgtaagctcacatcca

SEQ ID NO: 1682399 - DNA, 17 bp, Homo sapiens
gctgtgtacaatgtgag

SEQ ID NO: 1682400 - DNA, 19 bp, Homo sapiens
gctgtgtcctaaggcccat

SEQ ID NO: 1682401 - DNA, 14 bp, Homo sapiens
gctgtgtccttgca

SEQ ID NO: 1682402 - DNA, 19 bp, Homo sapiens
gctgtgtccttgcacctgc

SEQ ID NO: 1682403 - DNA, 14 bp, Homo sapiens
gctgtgtctgccaa

SEQ ID NO: 1682404 - DNA, 21 bp, Homo sapiens
gctgtgtctgcccaatgaata

SEQ ID NO: 1682405 - DNA, 17 bp, Homo sapiens
gctgtgtcttcattttc

SEQ ID NO: 1682406 - DNA, 18 bp, Homo sapiens
gctgtgtgaatacctgct

SEQ ID NO: 1682407 - DNA, 23 bp, Homo sapiens
gctgtgtgaatccaggaggcagt

SEQ ID NO: 1682408 - DNA, 20 bp, Homo sapiens
gctgtgtgacagaatcttgt

SEQ ID NO: 1682409 - DNA, 18 bp, Homo sapiens
gctgtgtgaccctgggca

SEQ ID NO: 1682410 - DNA, 23 bp, Homo sapiens
gctgtgtgagtgagcacacccgt

SEQ ID NO: 1682411 - DNA, 18 bp, Homo sapiens
gctgtgtgccccactcca

SEQ ID NO: 1682412 - DNA, 22 bp, Homo sapiens
gctgtgtgccccactccagcct

SEQ ID NO: 1682413 - DNA, 15 bp, Homo sapiens
gctgtgtgtcccagg

SEQ ID NO: 1682414 - DNA, 16 bp, Homo sapiens
gctgtgtgtcccaggc

SEQ ID NO: 1682415 - DNA, 18 bp, Homo sapiens
gctgtgtgtcccaggcag

SEQ ID NO: 1682416 - DNA, 20 bp, Homo sapiens
gctgtgtgtcccaggcaggg

SEQ ID NO: 1682417 - DNA, 22 bp, Homo sapiens
gctgtgtgttagttcccaacat

SEQ ID NO: 1682418 - DNA, 18 bp, Homo sapiens
gctgtgtttgcagcctgc

SEQ ID NO: 1682419 - DNA, 14 bp, Homo sapiens
gctgttaaagacat

SEQ ID NO: 1682420 - DNA, 23 bp, Homo sapiens
gctgttaaatacaggaaacagtt

SEQ ID NO: 1682421 - DNA, 15 bp, Homo sapiens
gctgttaccattcac

SEQ ID NO: 1682422 - DNA, 22 bp, Homo sapiens
gctgttagggctgaatcttctg

SEQ ID NO: 1682423 - DNA, 21 bp, Homo sapiens
gctgttattatatttgacatg

SEQ ID NO: 1682424 - DNA, 19 bp, Homo sapiens
gctgttatttcttccctgc

SEQ ID NO: 1682425 - DNA, 12 bp, Homo sapiens
gctgttccagac

SEQ ID NO: 1682426 - DNA, 13 bp, Homo sapiens
gctgttcctgaga

SEQ ID NO: 1682427 - DNA, 16 bp, Homo sapiens
gctgttctgcactgaa

SEQ ID NO: 1682428 - DNA, 20 bp, Homo sapiens
gctgttcttctgttctgcag

SEQ ID NO: 1682429 - DNA, 18 bp, Homo sapiens
gctgttgagctgttttcc

SEQ ID NO: 1682430 - DNA, 19 bp, Homo sapiens
gctgttgagggccaagaga

SEQ ID NO: 1682431 - DNA, 16 bp, Homo sapiens
gctgttgaggtggctg

SEQ ID NO: 1682432 - DNA, 21 bp, Homo sapiens
gctgttgctgattttattctt

SEQ ID NO: 1682433 - DNA, 21 bp, Homo sapiens
gctgttggacagctgcttgtg

SEQ ID NO: 1682434 - DNA, 23 bp, Homo sapiens
gctgttggcccctctgctgtcct

SEQ ID NO: 1682435 - DNA, 15 bp, Homo sapiens
gctgttgtgagcttt

SEQ ID NO: 1682436 - DNA, 18 bp, Homo sapiens
gctgttgttccattgaag

SEQ ID NO: 1682437 - DNA, 22 bp, Homo sapiens
gctgtttaaagtcacatccctg

SEQ ID NO: 1682438 - DNA, 23 bp, Homo sapiens
gctgtttaaagtcacatccctgt

SEQ ID NO: 1682439 - DNA, 21 bp, Homo sapiens
gctgtttactgcttttcatta

SEQ ID NO: 1682440 - DNA, 22 bp, Homo sapiens
gctgtttatggcctcagctgcc

SEQ ID NO: 1682441 - DNA, 12 bp, Homo sapiens
gctgtttctaag

SEQ ID NO: 1682442 - DNA, 13 bp, Homo sapiens
gctgtttgcgtga

SEQ ID NO: 1682443 - DNA, 20 bp, Homo sapiens
gctgtttgtttgacaaagaa

SEQ ID NO: 1682444 - DNA, 16 bp, Homo sapiens
gctgttttaaacatta

SEQ ID NO: 1682445 - DNA, 19 bp, Homo sapiens
gctgttttatgtcatactc

SEQ ID NO: 1682446 - DNA, 21 bp, Homo sapiens
gctgttttatgtcatactctg

SEQ ID NO: 1682447 - DNA, 19 bp, Homo sapiens
gctgttttgtggatttttg

SEQ ID NO: 1682448 - DNA, 13 bp, Homo sapiens
gcttaaaaaataa

SEQ ID NO: 1682449 - DNA, 15 bp, Homo sapiens
gcttaaaaatcattg

SEQ ID NO: 1682450 - DNA, 17 bp, Homo sapiens
gcttaaaataagcaggt

SEQ ID NO: 1682451 - DNA, 19 bp, Homo sapiens
gcttaaacccatacaatgt

SEQ ID NO: 1682452 - DNA, 23 bp, Homo sapiens
gcttaaaggcagtattttgtgtc

SEQ ID NO: 1682453 - DNA, 15 bp, Homo sapiens
gcttaaagggatgga

SEQ ID NO: 1682454 - DNA, 17 bp, Homo sapiens
gcttaaattgcttttgt

SEQ ID NO: 1682455 - DNA, 13 bp, Homo sapiens
gcttaaattttaa

SEQ ID NO: 1682456 - DNA, 23 bp, Homo sapiens
gcttgtggattgagggtaggagg

SEQ ID NO: 1682457 - DNA, 18 bp, Homo sapiens
gcttgtggtgttcctgaa

SEQ ID NO: 1682458 - DNA, 22 bp, Homo sapiens
gcttgtggtgttcctgaagcaa

SEQ ID NO: 1682459 - DNA, 12 bp, Homo sapiens
gcttgtgttaag

SEQ ID NO: 1682460 - DNA, 12 bp, Homo sapiens
gcttgtgttctg

SEQ ID NO: 1682461 - DNA, 13 bp, Homo sapiens
gcttgttaatgct

SEQ ID NO: 1682462 - DNA, 18 bp, Homo sapiens
gcttgttgggattcctga

SEQ ID NO: 1682463 - DNA, 20 bp, Homo sapiens
gcttgttgggattcctgacc

SEQ ID NO: 1682464 - DNA, 23 bp, Homo sapiens
gcttgtttaacggcagtgtcatt

SEQ ID NO: 1682465 - DNA, 16 bp, Homo sapiens
gcttgtttacctttct

SEQ ID NO: 1682466 - DNA, 11 bp, Homo sapiens
gcttgtttcta

SEQ ID NO: 1682467 - DNA, 18 bp, Homo sapiens
gcttgtttctatactgtt

SEQ ID NO: 1682468 - DNA, 20 bp, Homo sapiens
gcttgttttataaaattttg

SEQ ID NO: 1682469 - DNA, 23 bp, Homo sapiens
gcttgttttataaaattttgctt

SEQ ID NO: 1682470 - DNA, 23 bp, Homo sapiens
gcttgttttcttgccaatgaggt

SEQ ID NO: 1682471 - DNA, 23 bp, Homo sapiens
gctttaaaaccacagctgggcag

SEQ ID NO: 1682472 - DNA, 16 bp, Homo sapiens
gctttaaacacccttc

SEQ ID NO: 1682473 - DNA, 15 bp, Homo sapiens
gctttaatcaatcat

SEQ ID NO: 1682474 - DNA, 13 bp, Homo sapiens
gctttaatcagaa

SEQ ID NO: 1682475 - DNA, 11 bp, Homo sapiens
gctttaatgag

SEQ ID NO: 1682476 - DNA, 19 bp, Homo sapiens
gctttaatgagtgcacctg

SEQ ID NO: 1682477 - DNA, 21 bp, Homo sapiens
gctttaatgagtgcacctgcc

SEQ ID NO: 1682478 - DNA, 20 bp, Homo sapiens
gctttaattccatgaatgtt

SEQ ID NO: 1682479 - DNA, 15 bp, Homo sapiens
gctttaattgtataa

SEQ ID NO: 1682480 - DNA, 20 bp, Homo sapiens
gctttaattgtataagtcaa

SEQ ID NO: 1682481 - DNA, 20 bp, Homo sapiens
gctttacatgctgtgctctt

SEQ ID NO: 1682482 - DNA, 20 bp, Homo sapiens
gctttaccaggttgtcctca

SEQ ID NO: 1682483 - DNA, 18 bp, Homo sapiens
gctttaccttctaaaagt

SEQ ID NO: 1682484 - DNA, 15 bp, Homo sapiens
gctttagaccctggg

SEQ ID NO: 1682485 - DNA, 21 bp, Homo sapiens
gctttagtggccatcatttct

SEQ ID NO: 1682486 - DNA, 19 bp, Homo sapiens
gctttagttaggtcatttt

SEQ ID NO: 1682487 - DNA, 14 bp, Homo sapiens
gctttatcaaaggg

SEQ ID NO: 1682488 - DNA, 20 bp, Homo sapiens
gctttatgataatagattct

SEQ ID NO: 1682489 - DNA, 17 bp, Homo sapiens
gctttatgcaaatacaa

SEQ ID NO: 1682490 - DNA, 23 bp, Homo sapiens
gctttatgttcatttgtttgttt

SEQ ID NO: 1682491 - DNA, 13 bp, Homo sapiens
gctttattcttca

SEQ ID NO: 1682492 - DNA, 22 bp, Homo sapiens
gctttattcttcagatacaaac

SEQ ID NO: 1682493 - DNA, 18 bp, Homo sapiens
gctttattttgagatgta

SEQ ID NO: 1682494 - DNA, 17 bp, Homo sapiens
gctttattttttaagta

SEQ ID NO: 1682495 - DNA, 19 bp, Homo sapiens
gctttattttttaagtatt

SEQ ID NO: 1682496 - DNA, 23 bp, Homo sapiens
gctttattttttaagtatttata

SEQ ID NO: 1682497 - DNA, 20 bp, Homo sapiens
gctttcaagacccctgtctt

SEQ ID NO: 1682498 - DNA, 14 bp, Homo sapiens
gctttcacaaatat

SEQ ID NO: 1682499 - DNA, 15 bp, Homo sapiens
gctttcacatttaaa

SEQ ID NO: 1682500 - DNA, 19 bp, Homo sapiens
gctttcactatttccttta

SEQ ID NO: 1682501 - DNA, 19 bp, Homo sapiens
gctttcagagccagcctgg

SEQ ID NO: 1682502 - DNA, 23 bp, Homo sapiens
gctttcagagccagcctggctct

SEQ ID NO: 1682503 - DNA, 12 bp, Homo sapiens
gctttcatgatt

SEQ ID NO: 1682504 - DNA, 16 bp, Homo sapiens
gctttccatgttgctg

SEQ ID NO: 1682505 - DNA, 19 bp, Homo sapiens
gctttccatgttgctgcca

SEQ ID NO: 1682506 - DNA, 16 bp, Homo sapiens
gctttcccaggagaaa

SEQ ID NO: 1682507 - DNA, 12 bp, Homo sapiens
gctttcccctgt

SEQ ID NO: 1682508 - DNA, 16 bp, Homo sapiens
gctttcccctgtgggg

SEQ ID NO: 1682509 - DNA, 14 bp, Homo sapiens
gctttccctgaagc

SEQ ID NO: 1682510 - DNA, 13 bp, Homo sapiens
gctttccctgagg

SEQ ID NO: 1682511 - DNA, 15 bp, Homo sapiens
gctttccctgcctct

SEQ ID NO: 1682512 - DNA, 23 bp, Homo sapiens
gctttccgtttttttctttcctg

SEQ ID NO: 1682513 - DNA, 18 bp, Homo sapiens
gctttcctcaaaaagcag

SEQ ID NO: 1682514 - DNA, 19 bp, Homo sapiens
gctttcctcatcaggccat

SEQ ID NO: 1682515 - DNA, 11 bp, Homo sapiens
gctttcctgaa

SEQ ID NO: 1682516 - DNA, 14 bp, Homo sapiens
gctttcctgcccca

SEQ ID NO: 1682517 - DNA, 19 bp, Homo sapiens
gctttcgtgtaaattatgt

SEQ ID NO: 1682518 - DNA, 18 bp, Homo sapiens
gctttctccggggtctgt

SEQ ID NO: 1682519 - DNA, 17 bp, Homo sapiens
gctttctctctggcttc

SEQ ID NO: 1682520 - DNA, 14 bp, Homo sapiens
ggaaaagttaaact

SEQ ID NO: 1682521 - DNA, 17 bp, Homo sapiens
ggaaaatatttcctgac

SEQ ID NO: 1682522 - DNA, 16 bp, Homo sapiens
ggaaaatggccatgca

SEQ ID NO: 1682523 - DNA, 22 bp, Homo sapiens
ggaaaattaaaccaatgaagaa

SEQ ID NO: 1682524 - DNA, 21 bp, Homo sapiens
ggaaacaaagtttacattgtc

SEQ ID NO: 1682525 - DNA, 15 bp, Homo sapiens
ggaaacaacatttat

SEQ ID NO: 1682526 - DNA, 20 bp, Homo sapiens
ggaaacagaccaatagacat

SEQ ID NO: 1682527 - DNA, 12 bp, Homo sapiens
ggaaacagcatg

SEQ ID NO: 1682528 - DNA, 13 bp, Homo sapiens
ggaaacagcatga

SEQ ID NO: 1682529 - DNA, 15 bp, Homo sapiens
ggaaaccaagccaat

SEQ ID NO: 1682530 - DNA, 19 bp, Homo sapiens
ggaaaccaagtggtcagga

SEQ ID NO: 1682531 - DNA, 13 bp, Homo sapiens
ggaaacccacctc

SEQ ID NO: 1682532 - DNA, 18 bp, Homo sapiens
ggaaaccttccacccagt

SEQ ID NO: 1682533 - DNA, 13 bp, Homo sapiens
ggaaaccttggag

SEQ ID NO: 1682534 - DNA, 16 bp, Homo sapiens
ggaaaccttggagagg

SEQ ID NO: 1682535 - DNA, 19 bp, Homo sapiens
ggaaaccttggagaggaga

SEQ ID NO: 1682536 - DNA, 18 bp, Homo sapiens
ggaaacgaaacccactct

SEQ ID NO: 1682537 - DNA, 23 bp, Homo sapiens
ggaaacgctacctctctgtccct

SEQ ID NO: 1682538 - DNA, 18 bp, Homo sapiens
ggaaactcacactcccct

SEQ ID NO: 1682539 - DNA, 18 bp, Homo sapiens
ggaaactccacatctgcc

SEQ ID NO: 1682540 - DNA, 21 bp, Homo sapiens
ggaaactccacatctgcctta

SEQ ID NO: 1682541 - DNA, 16 bp, Homo sapiens
ggaaagaaagaaggaa

SEQ ID NO: 1682542 - DNA, 19 bp, Homo sapiens
ggaaagaagggggccctgc

SEQ ID NO: 1682543 - DNA, 21 bp, Homo sapiens
ggaaagaagggggccctgcta

SEQ ID NO: 1682544 - DNA, 15 bp, Homo sapiens
ggaaagacactgcct

SEQ ID NO: 1682545 - DNA, 15 bp, Homo sapiens
ggaaagatggataaa

SEQ ID NO: 1682546 - DNA, 17 bp, Homo sapiens
ggaaagatgttaagcat

SEQ ID NO: 1682547 - DNA, 20 bp, Homo sapiens
ggaaagatgttaagcattta

SEQ ID NO: 1682548 - DNA, 15 bp, Homo sapiens
ggaaagcaataaatg

SEQ ID NO: 1682549 - DNA, 18 bp, Homo sapiens
ggaaagcagcattctgga

SEQ ID NO: 1682550 - DNA, 18 bp, Homo sapiens
ggaaagcatttaggagaa

SEQ ID NO: 1682551 - DNA, 12 bp, Homo sapiens
ggaaagcctctg

SEQ ID NO: 1682552 - DNA, 16 bp, Homo sapiens
ggaaagcctctgctgc

SEQ ID NO: 1682553 - DNA, 13 bp, Homo sapiens
ggaaagcctctgg

SEQ ID NO: 1682554 - DNA, 20 bp, Homo sapiens
ggaaagctgatgatgtctct

SEQ ID NO: 1682555 - DNA, 13 bp, Homo sapiens
ggaaaggacccac

SEQ ID NO: 1682556 - DNA, 16 bp, Homo sapiens
ggaaaggatattttct

SEQ ID NO: 1682557 - DNA, 15 bp, Homo sapiens
ggaaaggcaagcttg

SEQ ID NO: 1682558 - DNA, 20 bp, Homo sapiens
ggaaaggctcagtctcagga

SEQ ID NO: 1682559 - DNA, 15 bp, Homo sapiens
ggaaaggctctgaaa

SEQ ID NO: 1682560 - DNA, 15 bp, Homo sapiens
ggaaaggcttggctg

SEQ ID NO: 1682561 - DNA, 12 bp, Homo sapiens
ggaaagggagga

SEQ ID NO: 1682562 - DNA, 15 bp, Homo sapiens
ggaaagggcctggcc

SEQ ID NO: 1682563 - DNA, 17 bp, Homo sapiens
ggaaagggcctggccag

SEQ ID NO: 1682564 - DNA, 20 bp, Homo sapiens
ggacatcgtaggcagccacg

SEQ ID NO: 1682565 - DNA, 11 bp, Homo sapiens
ggacatgaagg

SEQ ID NO: 1682566 - DNA, 13 bp, Homo sapiens
ggacatgaaggaa

SEQ ID NO: 1682567 - DNA, 22 bp, Homo sapiens
ggacatgcaataaaatttaaaa

SEQ ID NO: 1682568 - DNA, 15 bp, Homo sapiens
ggacatgccctgtgt

SEQ ID NO: 1682569 - DNA, 13 bp, Homo sapiens
ggacatgtgggtg

SEQ ID NO: 1682570 - DNA, 15 bp, Homo sapiens
ggacattgtatgcag

SEQ ID NO: 1682571 - DNA, 21 bp, Homo sapiens
ggacattgtatgcagggagca

SEQ ID NO: 1682572 - DNA, 22 bp, Homo sapiens
ggacattgttctttccggccaa

SEQ ID NO: 1682573 - DNA, 18 bp, Homo sapiens
ggacattttctggattct

SEQ ID NO: 1682574 - DNA, 17 bp, Homo sapiens
ggaccaaggcaaggcag

SEQ ID NO: 1682575 - DNA, 22 bp, Homo sapiens
ggaccaaggcaaggcaggtgcc

SEQ ID NO: 1682576 - DNA, 21 bp, Homo sapiens
ggaccaattctggacagacag

SEQ ID NO: 1682577 - DNA, 22 bp, Homo sapiens
ggaccacaaaaatgaaagcatg

SEQ ID NO: 1682578 - DNA, 21 bp, Homo sapiens
ggaccacacctccctgaacca

SEQ ID NO: 1682579 - DNA, 21 bp, Homo sapiens
ggaccacagtgggtggcacct

SEQ ID NO: 1682580 - DNA, 14 bp, Homo sapiens
ggaccacattttat

SEQ ID NO: 1682581 - DNA, 15 bp, Homo sapiens
ggaccaccctgagcc

SEQ ID NO: 1682582 - DNA, 18 bp, Homo sapiens
ggaccaccctgagccggc

SEQ ID NO: 1682583 - DNA, 21 bp, Homo sapiens
ggaccactcctgtccctgtag

SEQ ID NO: 1682584 - DNA, 19 bp, Homo sapiens
ggaccactgggtacaagag

SEQ ID NO: 1682585 - DNA, 21 bp, Homo sapiens
ggaccactgggtacaagagat

SEQ ID NO: 1682586 - DNA, 15 bp, Homo sapiens
ggaccagagccagat

SEQ ID NO: 1682587 - DNA, 23 bp, Homo sapiens
ggaccagccagcagcagcccaag

SEQ ID NO: 1682588 - DNA, 13 bp, Homo sapiens
ggaccagctcacg

SEQ ID NO: 1682589 - DNA, 16 bp, Homo sapiens
ggaccagggccaccgc

SEQ ID NO: 1682590 - DNA, 23 bp, Homo sapiens
ggactggtgcgaccccccacccc

SEQ ID NO: 1682591 - DNA, 19 bp, Homo sapiens
ggactggtggcccctgcct

SEQ ID NO: 1682592 - DNA, 13 bp, Homo sapiens
ggactgtaaacat

SEQ ID NO: 1682593 - DNA, 18 bp, Homo sapiens
ggactgtagggagggcgg

SEQ ID NO: 1682594 - DNA, 20 bp, Homo sapiens
ggactgtagggagggcggca

SEQ ID NO: 1682595 - DNA, 14 bp, Homo sapiens
ggactgtcagctga

SEQ ID NO: 1682596 - DNA, 22 bp, Homo sapiens
ggactgtcctgaggagccctga

SEQ ID NO: 1682597 - DNA, 19 bp, Homo sapiens
ggactgtggcacttgcctg

SEQ ID NO: 1682598 - DNA, 22 bp, Homo sapiens
ggactgtggcgactctgcagag

SEQ ID NO: 1682599 - DNA, 17 bp, Homo sapiens
ggacttaacggctccag

SEQ ID NO: 1682600 - DNA, 19 bp, Homo sapiens
ggacttacaaaatgccaag

SEQ ID NO: 1682601 - DNA, 12 bp, Homo sapiens
ggacttaggaag

SEQ ID NO: 1682602 - DNA, 11 bp, Homo sapiens
ggacttcctgt

SEQ ID NO: 1682603 - DNA, 18 bp, Homo sapiens
ggacttcctgtccagctc

SEQ ID NO: 1682604 - DNA, 21 bp, Homo sapiens
ggacttcctgtccagctccaa

SEQ ID NO: 1682605 - DNA, 21 bp, Homo sapiens
ggacttgatgttccttccaga

SEQ ID NO: 1682606 - DNA, 19 bp, Homo sapiens
ggacttgctaaagcacttt

SEQ ID NO: 1682607 - DNA, 14 bp, Homo sapiens
ggacttgtatattt

SEQ ID NO: 1682608 - DNA, 19 bp, Homo sapiens
ggacttgtatatttgtaca

SEQ ID NO: 1682609 - DNA, 20 bp, Homo sapiens
ggacttgtcacacggacctc

SEQ ID NO: 1682610 - DNA, 19 bp, Homo sapiens
ggacttgtttagagagcct

SEQ ID NO: 1682611 - DNA, 17 bp, Homo sapiens
ggactttatttatttct

SEQ ID NO: 1682612 - DNA, 20 bp, Homo sapiens
ggactttccttccctctcct

SEQ ID NO: 1682613 - DNA, 16 bp, Homo sapiens
ggactttgcagccggc

SEQ ID NO: 1682614 - DNA, 12 bp, Homo sapiens
ggactttgtaca

SEQ ID NO: 1682615 - DNA, 19 bp, Homo sapiens
ggacttttaatcagtgaag

SEQ ID NO: 1682616 - DNA, 18 bp, Homo sapiens
ggacttttcgttaacatt

SEQ ID NO: 1682617 - DNA, 13 bp, Homo sapiens
ggacttttctgca

SEQ ID NO: 1682618 - DNA, 20 bp, Homo sapiens
ggagaaaaaaaaccttgtaa

SEQ ID NO: 1682619 - DNA, 13 bp, Homo sapiens
ggagaaaacactt

SEQ ID NO: 1682620 - DNA, 15 bp, Homo sapiens
ggagaaaagagaaac

SEQ ID NO: 1682621 - DNA, 17 bp, Homo sapiens
ggagaaaatccaggtca

SEQ ID NO: 1682622 - DNA, 13 bp, Homo sapiens
ggagaaacagaga

SEQ ID NO: 1682623 - DNA, 13 bp, Homo sapiens
ggagaaaccctaa

SEQ ID NO: 1682624 - DNA, 23 bp, Homo sapiens
ggagaaatgcatccattcctcag

SEQ ID NO: 1682625 - DNA, 18 bp, Homo sapiens
ggagaacagtggttgcct

SEQ ID NO: 1682626 - DNA, 19 bp, Homo sapiens
ggagaagaacaagaaatgg

SEQ ID NO: 1682627 - DNA, 18 bp, Homo sapiens
ggagaagaagaattggcc

SEQ ID NO: 1682628 - DNA, 18 bp, Homo sapiens
ggagaagcacagctcctg

SEQ ID NO: 1682629 - DNA, 15 bp, Homo sapiens
ggagaagcagtgagc

SEQ ID NO: 1682630 - DNA, 13 bp, Homo sapiens
ggagaagcatgaa

SEQ ID NO: 1682631 - DNA, 14 bp, Homo sapiens
ggagaagccacctt

SEQ ID NO: 1682632 - DNA, 12 bp, Homo sapiens
ggagaagctctg

SEQ ID NO: 1682633 - DNA, 15 bp, Homo sapiens
ggagaagctgatcca

SEQ ID NO: 1682634 - DNA, 17 bp, Homo sapiens
ggagaaggaaggagact

SEQ ID NO: 1682635 - DNA, 21 bp, Homo sapiens
ggagaaggatcattcaaaagt

SEQ ID NO: 1682636 - DNA, 16 bp, Homo sapiens
ggagaaggccgctgcc

SEQ ID NO: 1682637 - DNA, 17 bp, Homo sapiens
ggagaagggaagttgaa

SEQ ID NO: 1682638 - DNA, 13 bp, Homo sapiens
ggagaagggaggg

SEQ ID NO: 1682639 - DNA, 17 bp, Homo sapiens
ggagaagggagggtggc

SEQ ID NO: 1682640 - DNA, 21 bp, Homo sapiens
ggagaagggatggaggtcaca

SEQ ID NO: 1682641 - DNA, 20 bp, Homo sapiens
ggagaagggggtctctgtta

SEQ ID NO: 1682642 - DNA, 20 bp, Homo sapiens
ggagaagtattcctgttgct

SEQ ID NO: 1682643 - DNA, 13 bp, Homo sapiens
ggagaagtctcag

SEQ ID NO: 1682644 - DNA, 21 bp, Homo sapiens
ggagaagttcttgattcagcc

SEQ ID NO: 1682645 - DNA, 12 bp, Homo sapiens
ggagaatcactt

SEQ ID NO: 1682646 - DNA, 18 bp, Homo sapiens
ggagaatcatgtttcttt

SEQ ID NO: 1682647 - DNA, 22 bp, Homo sapiens
ggagaattgactgaagcacagc

SEQ ID NO: 1682648 - DNA, 16 bp, Homo sapiens
ggagacaaggtgctaa

SEQ ID NO: 1682649 - DNA, 17 bp, Homo sapiens
ggagacacgacagcaca

SEQ ID NO: 1682650 - DNA, 19 bp, Homo sapiens
ggagacacgacagcacaca

SEQ ID NO: 1682651 - DNA, 16 bp, Homo sapiens
ggagacagcagcctgt

SEQ ID NO: 1682652 - DNA, 17 bp, Homo sapiens
ggagacagcatcagggt

SEQ ID NO: 1682653 - DNA, 18 bp, Homo sapiens
ggagacagcatcagggtt

SEQ ID NO: 1682654 - DNA, 13 bp, Homo sapiens
ggagacagtgatc

SEQ ID NO: 1682655 - DNA, 17 bp, Homo sapiens
ggagaccaaggcgggag

SEQ ID NO: 1682656 - DNA, 14 bp, Homo sapiens
ggagaccagctcag

SEQ ID NO: 1682657 - DNA, 12 bp, Homo sapiens
ggagaccctgga

SEQ ID NO: 1682658 - DNA, 20 bp, Homo sapiens
ggagaccgcttcacccctgc

SEQ ID NO: 1682659 - DNA, 21 bp, Homo sapiens
ggagacggtttccagggaggg

SEQ ID NO: 1682660 - DNA, 17 bp, Homo sapiens
ggagactcacctctgcc

SEQ ID NO: 1682661 - DNA, 19 bp, Homo sapiens
ggagactcacctctgcctc

SEQ ID NO: 1682662 - DNA, 21 bp, Homo sapiens
ggagactcacctctgcctcaa

SEQ ID NO: 1682663 - DNA, 12 bp, Homo sapiens
ggagactcctgc

SEQ ID NO: 1682664 - DNA, 17 bp, Homo sapiens
ggagactcctggtctgt

SEQ ID NO: 1682665 - DNA, 13 bp, Homo sapiens
ggagactctgtgg

SEQ ID NO: 1682666 - DNA, 16 bp, Homo sapiens
ggagactctgtggggc

SEQ ID NO: 1682667 - DNA, 11 bp, Homo sapiens
ggagactgccc

SEQ ID NO: 1682668 - DNA, 14 bp, Homo sapiens
ggagactgcttccc

SEQ ID NO: 1682669 - DNA, 18 bp, Homo sapiens
ggagactgcttcccatcc

SEQ ID NO: 1682670 - DNA, 23 bp, Homo sapiens
ggagactgcttcccatcctaccc

SEQ ID NO: 1682671 - DNA, 16 bp, Homo sapiens
ggagactgtctcaaga

SEQ ID NO: 1682672 - DNA, 12 bp, Homo sapiens
ggagactgtggt

SEQ ID NO: 1682673 - DNA, 22 bp, Homo sapiens
ggagactgtggtaggggcaggg

SEQ ID NO: 1682674 - DNA, 10 bp, Homo sapiens
ggagagaaaa

SEQ ID NO: 1682675 - DNA, 12 bp, Homo sapiens
ggagagaaaaaa

SEQ ID NO: 1682676 - DNA, 14 bp, Homo sapiens
ggagagaagaaagt

SEQ ID NO: 1682677 - DNA, 15 bp, Homo sapiens
ggagagaagaaagtg

SEQ ID NO: 1682678 - DNA, 12 bp, Homo sapiens
ggagagacagct

SEQ ID NO: 1682679 - DNA, 17 bp, Homo sapiens
ggagagacccctcccct

SEQ ID NO: 1682680 - DNA, 21 bp, Homo sapiens
ggagagacccctcccctccca

SEQ ID NO: 1682681 - DNA, 13 bp, Homo sapiens
ggagagacgtgca

SEQ ID NO: 1682682 - DNA, 18 bp, Homo sapiens
ggagagactgaaagcagc

SEQ ID NO: 1682683 - DNA, 19 bp, Homo sapiens
ggagagactgaaagcagca

SEQ ID NO: 1682684 - DNA, 22 bp, Homo sapiens
ggagagactgaaagcagcagct

SEQ ID NO: 1682685 - DNA, 18 bp, Homo sapiens
ggcagatcaccagaggtc

SEQ ID NO: 1682686 - DNA, 16 bp, Homo sapiens
ggcagatccaggacta

SEQ ID NO: 1682687 - DNA, 13 bp, Homo sapiens
ggcagatggagac

SEQ ID NO: 1682688 - DNA, 13 bp, Homo sapiens
ggcagatggagcc

SEQ ID NO: 1682689 - DNA, 16 bp, Homo sapiens
ggcagatgtggggctg

SEQ ID NO: 1682690 - DNA, 15 bp, Homo sapiens
ggcagattcccactg

SEQ ID NO: 1682691 - DNA, 16 bp, Homo sapiens
ggcagggctgtgcttg

SEQ ID NO: 1682692 - DNA, 21 bp, Homo sapiens
ggcaggggaattttctctcca

SEQ ID NO: 1682693 - DNA, 18 bp, Homo sapiens
ggcaggggagacaggagc

SEQ ID NO: 1682694 - DNA, 19 bp, Homo sapiens
ggcaggggagacaggagcc

SEQ ID NO: 1682695 - DNA, 12 bp, Homo sapiens
ggcaggggcgga

SEQ ID NO: 1682696 - DNA, 11 bp, Homo sapiens
ggcaggggctc

SEQ ID NO: 1682697 - DNA, 23 bp, Homo sapiens
ggcagggggccccgccagggctg

SEQ ID NO: 1682698 - DNA, 15 bp, Homo sapiens
ggcagggggccctgc

SEQ ID NO: 1682699 - DNA, 18 bp, Homo sapiens
ggcagggggccctgcccc

SEQ ID NO: 1682700 - DNA, 23 bp, Homo sapiens
ggcagggggccctgccccacccc

SEQ ID NO: 1682701 - DNA, 17 bp, Homo sapiens
ggcagggtcaggagagg

SEQ ID NO: 1682702 - DNA, 14 bp, Homo sapiens
ggcagggtgaccct

SEQ ID NO: 1682703 - DNA, 16 bp, Homo sapiens
ggcagggtgggatgga

SEQ ID NO: 1682704 - DNA, 20 bp, Homo sapiens
ggcagggtggggagggagcc

SEQ ID NO: 1682705 - DNA, 15 bp, Homo sapiens
ggcaggtcactgtca

SEQ ID NO: 1682706 - DNA, 20 bp, Homo sapiens
ggcaggtctgcaagggccca

SEQ ID NO: 1682707 - DNA, 16 bp, Homo sapiens
ggcaggtgcctccagg

SEQ ID NO: 1682708 - DNA, 20 bp, Homo sapiens
ggcaggtgcctccaggtgtg

SEQ ID NO: 1682709 - DNA, 13 bp, Homo sapiens
ggcaggtggactg

SEQ ID NO: 1682710 - DNA, 13 bp, Homo sapiens
ggcaggtggccac

SEQ ID NO: 1682711 - DNA, 16 bp, Homo sapiens
ggcaggtgggctgcct

SEQ ID NO: 1682712 - DNA, 17 bp, Homo sapiens
ggcaggtggtggcactg

SEQ ID NO: 1682713 - DNA, 19 bp, Homo sapiens
ggcaggtgtgggatctggg

SEQ ID NO: 1682714 - DNA, 18 bp, Homo sapiens
ggcaggtgttgggacctg

SEQ ID NO: 1682715 - DNA, 21 bp, Homo sapiens
ggcagtagaactccaggccct

SEQ ID NO: 1682716 - DNA, 19 bp, Homo sapiens
ggcagtattttgtgtcctc

SEQ ID NO: 1682717 - DNA, 15 bp, Homo sapiens
ggcagtccagccagc

SEQ ID NO: 1682718 - DNA, 20 bp, Homo sapiens
ggcagtccagccagctcctg

SEQ ID NO: 1682719 - DNA, 12 bp, Homo sapiens
ggcagtcctgga

SEQ ID NO: 1682720 - DNA, 15 bp, Homo sapiens
ggcagtcctggaggc

SEQ ID NO: 1682721 - DNA, 18 bp, Homo sapiens
ggcagtcctggaggcagg

SEQ ID NO: 1682722 - DNA, 14 bp, Homo sapiens
ggcagtcgggggct

SEQ ID NO: 1682723 - DNA, 19 bp, Homo sapiens
ggcagtcgggggctggcct

SEQ ID NO: 1682724 - DNA, 23 bp, Homo sapiens
ggcagtcgggggctggcctagga

SEQ ID NO: 1682725 - DNA, 19 bp, Homo sapiens
ggcagtctgaatttttaaa

SEQ ID NO: 1682726 - DNA, 14 bp, Homo sapiens
ggcagtgactggca

SEQ ID NO: 1682727 - DNA, 16 bp, Homo sapiens
ggcagtgactggcagg

SEQ ID NO: 1682728 - DNA, 20 bp, Homo sapiens
ggcagtgactggcaggtgca

SEQ ID NO: 1682729 - DNA, 23 bp, Homo sapiens
ggcagtgatgacttgctgtccag

SEQ ID NO: 1682730 - DNA, 21 bp, Homo sapiens
ggcagtgatggttgccaggac

SEQ ID NO: 1682731 - DNA, 17 bp, Homo sapiens
ggcagtgcaatgcttgt

SEQ ID NO: 1682732 - DNA, 15 bp, Homo sapiens
ggcagtggccaggca

SEQ ID NO: 1682733 - DNA, 19 bp, Homo sapiens
ggcagtggccaggcaggga

SEQ ID NO: 1682734 - DNA, 21 bp, Homo sapiens
ggcagtggcccctattgagaa

SEQ ID NO: 1682735 - DNA, 21 bp, Homo sapiens
ggcagtgggacagggcatggc

SEQ ID NO: 1682736 - DNA, 20 bp, Homo sapiens
ggcagtgggtggaggaccgg

SEQ ID NO: 1682737 - DNA, 12 bp, Homo sapiens
ggcagtgtggcc

SEQ ID NO: 1682738 - DNA, 16 bp, Homo sapiens
ggcagtgtggcctctt

SEQ ID NO: 1682739 - DNA, 17 bp, Homo sapiens
ggcagtgtggcctcttg

SEQ ID NO: 1682740 - DNA, 13 bp, Homo sapiens
ggcagttctagaa

SEQ ID NO: 1682741 - DNA, 17 bp, Homo sapiens
ggcataactaaaattaa

SEQ ID NO: 1682742 - DNA, 14 bp, Homo sapiens
ggcatactttctct

SEQ ID NO: 1682743 - DNA, 15 bp, Homo sapiens
ggcatagctctgggg

SEQ ID NO: 1682744 - DNA, 14 bp, Homo sapiens
ggcataggcctggg

SEQ ID NO: 1682745 - DNA, 17 bp, Homo sapiens
ggcataggcctgggtgc

SEQ ID NO: 1682746 - DNA, 21 bp, Homo sapiens
ggcatcaagaggtgggagggc

SEQ ID NO: 1682747 - DNA, 12 bp, Homo sapiens
ggcatcaggcac

SEQ ID NO: 1682748 - DNA, 14 bp, Homo sapiens
ggcatcaggcactg

SEQ ID NO: 1682749 - DNA, 15 bp, Homo sapiens
ggcatcaggcactgg

SEQ ID NO: 1682750 - DNA, 15 bp, Homo sapiens
ggcatccacccagtg

SEQ ID NO: 1682751 - DNA, 20 bp, Homo sapiens
ggcatccacccagtgctgcc

SEQ ID NO: 1682752 - DNA, 18 bp, Homo sapiens
ggcatcgcaccattctga

SEQ ID NO: 1682753 - DNA, 18 bp, Homo sapiens
ggcatctacacagcctgg

SEQ ID NO: 1682754 - DNA, 17 bp, Homo sapiens
ggcatctcccctagctc

SEQ ID NO: 1682755 - DNA, 15 bp, Homo sapiens
ggcatctcctgtcct

SEQ ID NO: 1682756 - DNA, 16 bp, Homo sapiens
ggcatctcctgtgcat

SEQ ID NO: 1682757 - DNA, 15 bp, Homo sapiens
ggcatctgcaccctc

SEQ ID NO: 1682758 - DNA, 22 bp, Homo sapiens
ggcatcttttctagagacacat

SEQ ID NO: 1682759 - DNA, 14 bp, Homo sapiens
ggcatcttttgtat

SEQ ID NO: 1682760 - DNA, 14 bp, Homo sapiens
ggcatgaagctgca

SEQ ID NO: 1682761 - DNA, 22 bp, Homo sapiens
ggcatgataagccgaggaggca

SEQ ID NO: 1682762 - DNA, 15 bp, Homo sapiens
ggcatgcacacggct

SEQ ID NO: 1682763 - DNA, 14 bp, Homo sapiens
ggcatgcacgggca

SEQ ID NO: 1682764 - DNA, 22 bp, Homo sapiens
ggcatgcatggaggactctcct

SEQ ID NO: 1682765 - DNA, 16 bp, Homo sapiens
ggcatgctggggcaag

SEQ ID NO: 1682766 - DNA, 14 bp, Homo sapiens
ggcatggcaggctg

SEQ ID NO: 1682767 - DNA, 14 bp, Homo sapiens
ggcatggctgggaa

SEQ ID NO: 1682768 - DNA, 15 bp, Homo sapiens
ggcatgggtggaggg

SEQ ID NO: 1682769 - DNA, 23 bp, Homo sapiens
ggcatggtggcacacgcctgtag

SEQ ID NO: 1682770 - DNA, 22 bp, Homo sapiens
ggcatggtggcgcaagcctgta

SEQ ID NO: 1682771 - DNA, 18 bp, Homo sapiens
ggcatggttttgtgccat

SEQ ID NO: 1682772 - DNA, 22 bp, Homo sapiens
ggcatggttttgtgccatctgt

SEQ ID NO: 1682773 - DNA, 17 bp, Homo sapiens
ggcatgtattggcctgg

SEQ ID NO: 1682774 - DNA, 21 bp, Homo sapiens
ggcatgtattggcctggaggt

SEQ ID NO: 1682775 - DNA, 20 bp, Homo sapiens
ggcatgtcccacccacccgc

SEQ ID NO: 1682776 - DNA, 21 bp, Homo sapiens
ggcatgtgcctatagtcccag

SEQ ID NO: 1682777 - DNA, 14 bp, Homo sapiens
ggcatgtggagaca

SEQ ID NO: 1682778 - DNA, 15 bp, Homo sapiens
ggcatgtggcctgtg

SEQ ID NO: 1682779 - DNA, 17 bp, Homo sapiens
ggcatgtggcctgtggc

SEQ ID NO: 1682780 - DNA, 19 bp, Homo sapiens
ggcatgtggcctgtggcct

SEQ ID NO: 1682781 - DNA, 19 bp, Homo sapiens
ggcatgtgtgcctgtggca

SEQ ID NO: 1682782 - DNA, 17 bp, Homo sapiens
ggcattaatgtttctat

SEQ ID NO: 1682783 - DNA, 20 bp, Homo sapiens
ggcattagaattatttaaac

SEQ ID NO: 1682784 - DNA, 12 bp, Homo sapiens
ggcattctctga

SEQ ID NO: 1682785 - DNA, 19 bp, Homo sapiens
ggcattgagtattgtttaa

SEQ ID NO: 1682786 - DNA, 18 bp, Homo sapiens
ggcattgctcagcccgct

SEQ ID NO: 1682787 - DNA, 21 bp, Homo sapiens
ggcattgctcagcccgcttgg

SEQ ID NO: 1682788 - DNA, 13 bp, Homo sapiens
ggcattgctttcc

SEQ ID NO: 1682789 - DNA, 17 bp, Homo sapiens
ggcattgtccaaagttt

SEQ ID NO: 1682790 - DNA, 15 bp, Homo sapiens
ggcattgttagttta

SEQ ID NO: 1682791 - DNA, 12 bp, Homo sapiens
ggcatttcaatc

SEQ ID NO: 1682792 - DNA, 13 bp, Homo sapiens
ggcatttccaaac

SEQ ID NO: 1682793 - DNA, 22 bp, Homo sapiens
ggcatttctatactttacagga

SEQ ID NO: 1682794 - DNA, 12 bp, Homo sapiens
ggcatttctatt

SEQ ID NO: 1682795 - DNA, 22 bp, Homo sapiens
ggcatttggtgagagtcaaagc

SEQ ID NO: 1682796 - DNA, 12 bp, Homo sapiens
ggccaaagataa

SEQ ID NO: 1682797 - DNA, 13 bp, Homo sapiens
ggccaaagcacag

SEQ ID NO: 1682798 - DNA, 20 bp, Homo sapiens
ggccaaccagcccgacagtg

SEQ ID NO: 1682799 - DNA, 18 bp, Homo sapiens
ggccaagaatacttgaag

SEQ ID NO: 1682800 - DNA, 14 bp, Homo sapiens
ggccaagcagaaaa

SEQ ID NO: 1682801 - DNA, 13 bp, Homo sapiens
ggccaaggcaggt

SEQ ID NO: 1682802 - DNA, 22 bp, Homo sapiens
ggccaaggctatgaagggacag

SEQ ID NO: 1682803 - DNA, 16 bp, Homo sapiens
ggccaaggtcctgctc

SEQ ID NO: 1682804 - DNA, 16 bp, Homo sapiens
ggccaaggtgccacca

SEQ ID NO: 1682805 - DNA, 16 bp, Homo sapiens
ggccaagtccgcagaa

SEQ ID NO: 1682806 - DNA, 23 bp, Homo sapiens
ggccaagtccgcagaagccctga

SEQ ID NO: 1682807 - DNA, 17 bp, Homo sapiens
ggccaatggtgcttccc

SEQ ID NO: 1682808 - DNA, 14 bp, Homo sapiens
ggccagtccaggct

SEQ ID NO: 1682809 - DNA, 15 bp, Homo sapiens
ggccagtccaggctg

SEQ ID NO: 1682810 - DNA, 21 bp, Homo sapiens
ggccagtcctgcctggccagg

SEQ ID NO: 1682811 - DNA, 15 bp, Homo sapiens
ggccagtctgggctg

SEQ ID NO: 1682812 - DNA, 14 bp, Homo sapiens
ggccagtctgtgga

SEQ ID NO: 1682813 - DNA, 20 bp, Homo sapiens
ggccatagaggcccaggcac

SEQ ID NO: 1682814 - DNA, 21 bp, Homo sapiens
ggccatagaggcccaggcacc

SEQ ID NO: 1682815 - DNA, 13 bp, Homo sapiens
ggccatccactgt

SEQ ID NO: 1682816 - DNA, 16 bp, Homo sapiens
ggccatccttctgtgt

SEQ ID NO: 1682817 - DNA, 17 bp, Homo sapiens
ggccatccttctgtgta

SEQ ID NO: 1682818 - DNA, 15 bp, Homo sapiens
ggccatctcaggaga

SEQ ID NO: 1682819 - DNA, 17 bp, Homo sapiens
ggccatctcaggagatg

SEQ ID NO: 1682820 - DNA, 22 bp, Homo sapiens
ggccatctgactgccaagccag

SEQ ID NO: 1682821 - DNA, 15 bp, Homo sapiens
ggccatgatggcaac

SEQ ID NO: 1682822 - DNA, 12 bp, Homo sapiens
ggccatgcagac

SEQ ID NO: 1682823 - DNA, 14 bp, Homo sapiens
ggccatgcagacct

SEQ ID NO: 1682824 - DNA, 15 bp, Homo sapiens
ggccatgcagacctc

SEQ ID NO: 1682825 - DNA, 13 bp, Homo sapiens
ggccatgcctgcc

SEQ ID NO: 1682826 - DNA, 13 bp, Homo sapiens
ggccatggcagaa

SEQ ID NO: 1682827 - DNA, 16 bp, Homo sapiens
ggccatggcctctgca

SEQ ID NO: 1682828 - DNA, 14 bp, Homo sapiens
ggccatggctcagg

SEQ ID NO: 1682829 - DNA, 15 bp, Homo sapiens
ggccatgtccaaaga

SEQ ID NO: 1682830 - DNA, 22 bp, Homo sapiens
ggccatgtccaaagaggctgcc

SEQ ID NO: 1682831 - DNA, 15 bp, Homo sapiens
ggccatgtgagccac

SEQ ID NO: 1682832 - DNA, 23 bp, Homo sapiens
ggccatgtgagccaccgctgcca

SEQ ID NO: 1682833 - DNA, 19 bp, Homo sapiens
ggccatgttatgctggtgg

SEQ ID NO: 1682834 - DNA, 17 bp, Homo sapiens
ggccattatgcctggct

SEQ ID NO: 1682835 - DNA, 19 bp, Homo sapiens
ggccatttaataccctgca

SEQ ID NO: 1682836 - DNA, 20 bp, Homo sapiens
ggccatttagattaggaagg

SEQ ID NO: 1682837 - DNA, 15 bp, Homo sapiens
ggcccaaatgatgga

SEQ ID NO: 1682838 - DNA, 17 bp, Homo sapiens
ggcccaagagccctgtg

SEQ ID NO: 1682839 - DNA, 16 bp, Homo sapiens
ggcccaagccccatct

SEQ ID NO: 1682840 - DNA, 22 bp, Homo sapiens
ggcccaagccccatctcatcct

SEQ ID NO: 1682841 - DNA, 13 bp, Homo sapiens
ggcccaaggagct

SEQ ID NO: 1682842 - DNA, 22 bp, Homo sapiens
ggcccaagtccctgttttctga

SEQ ID NO: 1682843 - DNA, 14 bp, Homo sapiens
ggcccacacctggt

SEQ ID NO: 1682844 - DNA, 17 bp, Homo sapiens
ggcccacacctggtgga

SEQ ID NO: 1682845 - DNA, 17 bp, Homo sapiens
ggcccacagctcccacc

SEQ ID NO: 1682846 - DNA, 19 bp, Homo sapiens
ggcccacagctcccacccc

SEQ ID NO: 1682847 - DNA, 20 bp, Homo sapiens
ggcccacagctcccacccca

SEQ ID NO: 1682848 - DNA, 14 bp, Homo sapiens
ggcccacccacatg

SEQ ID NO: 1682849 - DNA, 15 bp, Homo sapiens
ggcccacccacatga

SEQ ID NO: 1682850 - DNA, 20 bp, Homo sapiens
ggcccacccggtgggacccc

SEQ ID NO: 1682851 - DNA, 15 bp, Homo sapiens
ggcccacctggccac

SEQ ID NO: 1682852 - DNA, 17 bp, Homo sapiens
ggcccacctggccacct

SEQ ID NO: 1682853 - DNA, 22 bp, Homo sapiens
ggcccacctggccacctgaggt

SEQ ID NO: 1682854 - DNA, 21 bp, Homo sapiens
ggcccaccttccccagaacca

SEQ ID NO: 1682855 - DNA, 17 bp, Homo sapiens
ggcccacgtggttgggg

SEQ ID NO: 1682856 - DNA, 20 bp, Homo sapiens
ggcccactagagggcccatc

SEQ ID NO: 1682857 - DNA, 23 bp, Homo sapiens
ggcccactagagggcccatcagg

SEQ ID NO: 1682858 - DNA, 13 bp, Homo sapiens
ggcccactgctcg

SEQ ID NO: 1682859 - DNA, 16 bp, Homo sapiens
ggcccactgctggctg

SEQ ID NO: 1682860 - DNA, 17 bp, Homo sapiens
ggcccactgtgcctcag

SEQ ID NO: 1682861 - DNA, 17 bp, Homo sapiens
ggcccagaaagcctctc

SEQ ID NO: 1682862 - DNA, 12 bp, Homo sapiens
ggcccagaccct

SEQ ID NO: 1682863 - DNA, 23 bp, Homo sapiens
ggcccagaccctgggcaaacaga

SEQ ID NO: 1682864 - DNA, 18 bp, Homo sapiens
ggcccagaccggcttctc

SEQ ID NO: 1682865 - DNA, 23 bp, Homo sapiens
ggcccagcacatggccatagagg

SEQ ID NO: 1682866 - DNA, 13 bp, Homo sapiens
ggcccagcatgca

SEQ ID NO: 1682867 - DNA, 15 bp, Homo sapiens
ggcccagcattgctg

SEQ ID NO: 1682868 - DNA, 14 bp, Homo sapiens
ggcccagccaggag

SEQ ID NO: 1682869 - DNA, 14 bp, Homo sapiens
ggcccagcccagag

SEQ ID NO: 1682870 - DNA, 15 bp, Homo sapiens
ggcccagcccagagc

SEQ ID NO: 1682871 - DNA, 16 bp, Homo sapiens
ggcccagcccagagcc

SEQ ID NO: 1682872 - DNA, 22 bp, Homo sapiens
ggcccagcccagagccacctgg

SEQ ID NO: 1682873 - DNA, 12 bp, Homo sapiens
ggcccagccggc

SEQ ID NO: 1682874 - DNA, 12 bp, Homo sapiens
ggcccagcgcgg

SEQ ID NO: 1682875 - DNA, 17 bp, Homo sapiens
ggcccagcgcggccagc

SEQ ID NO: 1682876 - DNA, 18 bp, Homo sapiens
ggcccagcggcccctccc

SEQ ID NO: 1682877 - DNA, 23 bp, Homo sapiens
ggcccagcggcccctcccacaca

SEQ ID NO: 1682878 - DNA, 15 bp, Homo sapiens
ggcccagcgggcaga

SEQ ID NO: 1682879 - DNA, 14 bp, Homo sapiens
ggcccagctgggct

SEQ ID NO: 1682880 - DNA, 17 bp, Homo sapiens
ggcccagctgggctctg

SEQ ID NO: 1682881 - DNA, 15 bp, Homo sapiens
ggcccagctgtagcc

SEQ ID NO: 1682882 - DNA, 19 bp, Homo sapiens
ggcccagctgtagccatgg

SEQ ID NO: 1682883 - DNA, 20 bp, Homo sapiens
ggcccagctgtagccatggc

SEQ ID NO: 1682884 - DNA, 21 bp, Homo sapiens
ggcccagctgtagccatggct

SEQ ID NO: 1682885 - DNA, 16 bp, Homo sapiens
ggcccaggaccagctg

SEQ ID NO: 1682886 - DNA, 17 bp, Homo sapiens
ggcccaggaccagctgg

SEQ ID NO: 1682887 - DNA, 16 bp, Homo sapiens
ggcccaggagctctgc

SEQ ID NO: 1682888 - DNA, 18 bp, Homo sapiens
ggcccaggagctctgcgc

SEQ ID NO: 1682889 - DNA, 18 bp, Homo sapiens
ggcccaggcaccaccagg

SEQ ID NO: 1682890 - DNA, 19 bp, Homo sapiens
ggcccaggcaccaccagga

SEQ ID NO: 1682891 - DNA, 20 bp, Homo sapiens
ggcccaggcaggtctgcaag

SEQ ID NO: 1682892 - DNA, 11 bp, Homo sapiens
ggcccaggcct

SEQ ID NO: 1682893 - DNA, 14 bp, Homo sapiens
ggcccaggctggga

SEQ ID NO: 1682894 - DNA, 14 bp, Homo sapiens
ggcccagggcccag

SEQ ID NO: 1682895 - DNA, 18 bp, Homo sapiens
ggcccagggcccagagcc

SEQ ID NO: 1682896 - DNA, 21 bp, Homo sapiens
ggcccagggcccagagcccag

SEQ ID NO: 1682897 - DNA, 22 bp, Homo sapiens
ggcccagggcccagagcccagc

SEQ ID NO: 1682898 - DNA, 17 bp, Homo sapiens
ggcccagggggcctgga

SEQ ID NO: 1682899 - DNA, 18 bp, Homo sapiens
ggcccagggggcctggag

SEQ ID NO: 1682900 - DNA, 14 bp, Homo sapiens
ggcccagggtgttt

SEQ ID NO: 1682901 - DNA, 20 bp, Homo sapiens
ggccctgccatcttcccagc

SEQ ID NO: 1682902 - DNA, 15 bp, Homo sapiens
ggccctgcccagccc

SEQ ID NO: 1682903 - DNA, 16 bp, Homo sapiens
ggccctgccccacccc

SEQ ID NO: 1682904 - DNA, 22 bp, Homo sapiens
ggccctgcccctaggatgctgc

SEQ ID NO: 1682905 - DNA, 20 bp, Homo sapiens
ggccctgctgagtcatctgt

SEQ ID NO: 1682906 - DNA, 18 bp, Homo sapiens
ggccctgcttcctgcttg

SEQ ID NO: 1682907 - DNA, 14 bp, Homo sapiens
ggccctggagccag

SEQ ID NO: 1682908 - DNA, 12 bp, Homo sapiens
ggccctggaggt

SEQ ID NO: 1682909 - DNA, 16 bp, Homo sapiens
ggccctggcaccccca

SEQ ID NO: 1682910 - DNA, 22 bp, Homo sapiens
ggccctggcacccccacaagct

SEQ ID NO: 1682911 - DNA, 15 bp, Homo sapiens
ggccctggcctgctg

SEQ ID NO: 1682912 - DNA, 22 bp, Homo sapiens
ggccctggcctgctgggctctc

SEQ ID NO: 1682913 - DNA, 12 bp, Homo sapiens
ggccctggcttg

SEQ ID NO: 1682914 - DNA, 12 bp, Homo sapiens
ggccctggtcct

SEQ ID NO: 1682915 - DNA, 17 bp, Homo sapiens
ggccctggtcctggcct

SEQ ID NO: 1682916 - DNA, 18 bp, Homo sapiens
ggccctggtcctggcctc

SEQ ID NO: 1682917 - DNA, 15 bp, Homo sapiens
ggccctggtccttcc

SEQ ID NO: 1682918 - DNA, 17 bp, Homo sapiens
ggccctggtccttccag

SEQ ID NO: 1682919 - DNA, 18 bp, Homo sapiens
ggccctggtgtcaggcag

SEQ ID NO: 1682920 - DNA, 22 bp, Homo sapiens
ggccctggttcctgctgtcctg

SEQ ID NO: 1682921 - DNA, 15 bp, Homo sapiens
ggccctgtcagagcc

SEQ ID NO: 1682922 - DNA, 21 bp, Homo sapiens
ggccctgtcagagccgccact

SEQ ID NO: 1682923 - DNA, 13 bp, Homo sapiens
ggccctgtgccct

SEQ ID NO: 1682924 - DNA, 17 bp, Homo sapiens
ggccctgtgccttggtg

SEQ ID NO: 1682925 - DNA, 21 bp, Homo sapiens
ggccctgtggagtccagctct

SEQ ID NO: 1682926 - DNA, 14 bp, Homo sapiens
ggccctgttctcct

SEQ ID NO: 1682927 - DNA, 20 bp, Homo sapiens
ggcccttacttgcttctcta

SEQ ID NO: 1682928 - DNA, 18 bp, Homo sapiens
ggcctggccaggagctct

SEQ ID NO: 1682929 - DNA, 23 bp, Homo sapiens
ggcctggccaggagctcttcagg

SEQ ID NO: 1682930 - DNA, 16 bp, Homo sapiens
ggcctggccagtcttc

SEQ ID NO: 1682931 - DNA, 13 bp, Homo sapiens
ggcctggccctca

SEQ ID NO: 1682932 - DNA, 14 bp, Homo sapiens
ggcctggcctccag

SEQ ID NO: 1682933 - DNA, 17 bp, Homo sapiens
ggcctggcctccagctc

SEQ ID NO: 1682934 - DNA, 20 bp, Homo sapiens
ggcctggcctccagctccca

SEQ ID NO: 1682935 - DNA, 11 bp, Homo sapiens
ggcctggcctg

SEQ ID NO: 1682936 - DNA, 14 bp, Homo sapiens
ggcctggctggtgg

SEQ ID NO: 1682937 - DNA, 16 bp, Homo sapiens
ggcctggctggtggga

SEQ ID NO: 1682938 - DNA, 20 bp, Homo sapiens
ggcctggctggtgggaaggc

SEQ ID NO: 1682939 - DNA, 17 bp, Homo sapiens
ggcctggcttgctccag

SEQ ID NO: 1682940 - DNA, 19 bp, Homo sapiens
ggcctggcttgctccaggg

SEQ ID NO: 1682941 - DNA, 15 bp, Homo sapiens
ggcctgggacccagc

SEQ ID NO: 1682942 - DNA, 16 bp, Homo sapiens
ggcctgggacccagct

SEQ ID NO: 1682943 - DNA, 20 bp, Homo sapiens
ggcctgggacccagctactc

SEQ ID NO: 1682944 - DNA, 17 bp, Homo sapiens
ggcctgggacttccatg

SEQ ID NO: 1682945 - DNA, 22 bp, Homo sapiens
ggcctgggagggttcccctggc

SEQ ID NO: 1682946 - DNA, 23 bp, Homo sapiens
ggcctggggatgtaaccaagctg

SEQ ID NO: 1682947 - DNA, 15 bp, Homo sapiens
ggcctgggggcagtg

SEQ ID NO: 1682948 - DNA, 20 bp, Homo sapiens
ggcctgggggcagtgactgg

SEQ ID NO: 1682949 - DNA, 18 bp, Homo sapiens
ggcctgggtctccctggt

SEQ ID NO: 1682950 - DNA, 18 bp, Homo sapiens
ggcctggtccctggtcct

SEQ ID NO: 1682951 - DNA, 20 bp, Homo sapiens
ggcctggtccctggtccttc

SEQ ID NO: 1682952 - DNA, 15 bp, Homo sapiens
ggcctgtatgaggct

SEQ ID NO: 1682953 - DNA, 16 bp, Homo sapiens
ggcctgtccaccctgc

SEQ ID NO: 1682954 - DNA, 15 bp, Homo sapiens
ggcctgtgcagcagc

SEQ ID NO: 1682955 - DNA, 15 bp, Homo sapiens
ggcctgtgctgggcc

SEQ ID NO: 1682956 - DNA, 20 bp, Homo sapiens
ggcctgtgggagcctgcaaa

SEQ ID NO: 1682957 - DNA, 18 bp, Homo sapiens
ggcctgtggtggctcccc

SEQ ID NO: 1682958 - DNA, 18 bp, Homo sapiens
ggcctgtgtccagcagct

SEQ ID NO: 1682959 - DNA, 20 bp, Homo sapiens
ggcctgtgtccagcagctgc

SEQ ID NO: 1682960 - DNA, 20 bp, Homo sapiens
ggcctgtgtcccatgaccca

SEQ ID NO: 1682961 - DNA, 13 bp, Homo sapiens
ggcctgttcccta

SEQ ID NO: 1682962 - DNA, 15 bp, Homo sapiens
ggcctgttccctaga

SEQ ID NO: 1682963 - DNA, 16 bp, Homo sapiens
ggcctgttccctagag

SEQ ID NO: 1682964 - DNA, 17 bp, Homo sapiens
ggcctgttccctagaga

SEQ ID NO: 1682965 - DNA, 12 bp, Homo sapiens
ggcctgttcctt

SEQ ID NO: 1682966 - DNA, 20 bp, Homo sapiens
ggcctgttctcttggctgca

SEQ ID NO: 1682967 - DNA, 22 bp, Homo sapiens
ggcctgttctcttggctgcaaa

SEQ ID NO: 1682968 - DNA, 15 bp, Homo sapiens
ggcctgttgctatag

SEQ ID NO: 1682969 - DNA, 17 bp, Homo sapiens
ggcctgtttggcctctc

SEQ ID NO: 1682970 - DNA, 19 bp, Homo sapiens
ggccttaacacactggcca

SEQ ID NO: 1682971 - DNA, 23 bp, Homo sapiens
ggccttcagacacatgctatgtt

SEQ ID NO: 1682972 - DNA, 16 bp, Homo sapiens
ggccttccagctgctg

SEQ ID NO: 1682973 - DNA, 21 bp, Homo sapiens
ggccttccccttttgcctggc

SEQ ID NO: 1682974 - DNA, 18 bp, Homo sapiens
ggccttgaagacagagca

SEQ ID NO: 1682975 - DNA, 16 bp, Homo sapiens
ggccttgcccagagat

SEQ ID NO: 1682976 - DNA, 13 bp, Homo sapiens
ggccttgcccgtc

SEQ ID NO: 1682977 - DNA, 15 bp, Homo sapiens
ggccttgcctggcct

SEQ ID NO: 1682978 - DNA, 17 bp, Homo sapiens
ggccttgcctggcctga

SEQ ID NO: 1682979 - DNA, 20 bp, Homo sapiens
ggccttgggccttggggctc

SEQ ID NO: 1682980 - DNA, 17 bp, Homo sapiens
ggccttggtggagcagc

SEQ ID NO: 1682981 - DNA, 19 bp, Homo sapiens
ggccttggtggagcagcca

SEQ ID NO: 1682982 - DNA, 20 bp, Homo sapiens
ggccttggtggagcagccag

SEQ ID NO: 1682983 - DNA, 23 bp, Homo sapiens
ggccttggtggagcagccagagc

SEQ ID NO: 1682984 - DNA, 13 bp, Homo sapiens
ggccttttctgtg

SEQ ID NO: 1682985 - DNA, 15 bp, Homo sapiens
ggcctttttcattta

SEQ ID NO: 1682986 - DNA, 17 bp, Homo sapiens
ggcgaatctcaaaatta

SEQ ID NO: 1682987 - DNA, 23 bp, Homo sapiens
ggcgacaagagtgagactccacc

SEQ ID NO: 1682988 - DNA, 18 bp, Homo sapiens
ggcgacagttttccttct

SEQ ID NO: 1682989 - DNA, 13 bp, Homo sapiens
ggcgactgtcatg

SEQ ID NO: 1682990 - DNA, 17 bp, Homo sapiens
ggcgactgtcatgtggc

SEQ ID NO: 1682991 - DNA, 20 bp, Homo sapiens
ggcgagcatgggggctgcca

SEQ ID NO: 1682992 - DNA, 14 bp, Homo sapiens
ggcgagccaggcaa

SEQ ID NO: 1682993 - DNA, 22 bp, Homo sapiens
ggcgagcccctccttctcccct

SEQ ID NO: 1682994 - DNA, 18 bp, Homo sapiens
ggcgaggcccttcctctt

SEQ ID NO: 1682995 - DNA, 16 bp, Homo sapiens
ggcgagtcactgcctc

SEQ ID NO: 1682996 - DNA, 19 bp, Homo sapiens
ggcgagttctctttggaaa

SEQ ID NO: 1682997 - DNA, 14 bp, Homo sapiens
ggcgcaagcctgta

SEQ ID NO: 1682998 - DNA, 17 bp, Homo sapiens
ggcgcaatctcggctca

SEQ ID NO: 1682999 - DNA, 22 bp, Homo sapiens
ggcgcaatctcggctcactgca

SEQ ID NO: 1683000 - DNA, 14 bp, Homo sapiens
ggcgcagagccctc

SEQ ID NO: 1683001 - DNA, 20 bp, Homo sapiens
ggcgcagagccctccaggcc

SEQ ID NO: 1683002 - DNA, 14 bp, Homo sapiens
ggcgcagccaaggc

SEQ ID NO: 1683003 - DNA, 21 bp, Homo sapiens
ggcgcaggtgccatgcctgct

SEQ ID NO: 1683004 - DNA, 22 bp, Homo sapiens
ggcgcaggtgccatgcctgctc

SEQ ID NO: 1683005 - DNA, 21 bp, Homo sapiens
ggcgcagtggctcacgcctgt

SEQ ID NO: 1683006 - DNA, 13 bp, Homo sapiens
ggcgcccaccctg

SEQ ID NO: 1683007 - DNA, 15 bp, Homo sapiens
ggcgcccaccctggg

SEQ ID NO: 1683008 - DNA, 18 bp, Homo sapiens
ggcgcccaccctgggctc

SEQ ID NO: 1683009 - DNA, 22 bp, Homo sapiens
ggcgcccaccctgggctccaca

SEQ ID NO: 1683010 - DNA, 21 bp, Homo sapiens
ggcgcccatcctagtgggcac

SEQ ID NO: 1683011 - DNA, 21 bp, Homo sapiens
ggcgcccattcgtctgtccca

SEQ ID NO: 1683012 - DNA, 15 bp, Homo sapiens
ggcgcccctgccacc

SEQ ID NO: 1683013 - DNA, 22 bp, Homo sapiens
ggcgcccctgccacctccctga

SEQ ID NO: 1683014 - DNA, 18 bp, Homo sapiens
ggcgccttctcggagctg

SEQ ID NO: 1683015 - DNA, 22 bp, Homo sapiens
ggcgcgcacctgtaatcccagc

SEQ ID NO: 1683016 - DNA, 22 bp, Homo sapiens
ggcgctattgcactccagtctg

SEQ ID NO: 1683017 - DNA, 19 bp, Homo sapiens
ggcgctcagacggcggcca

SEQ ID NO: 1683018 - DNA, 22 bp, Homo sapiens
ggcgctcagacggcggccaggc

SEQ ID NO: 1683019 - DNA, 15 bp, Homo sapiens
ggcgctcaggaccca

SEQ ID NO: 1683020 - DNA, 19 bp, Homo sapiens
ggcgctcaggacccaggcc

SEQ ID NO: 1683021 - DNA, 14 bp, Homo sapiens
ggcgctcgctcagg

SEQ ID NO: 1683022 - DNA, 14 bp, Homo sapiens
ggcgctgcagcctc

SEQ ID NO: 1683023 - DNA, 12 bp, Homo sapiens
ggcgctggccca

SEQ ID NO: 1683024 - DNA, 13 bp, Homo sapiens
ggcggagccggcc

SEQ ID NO: 1683025 - DNA, 21 bp, Homo sapiens
ggcggaggggatccagccact

SEQ ID NO: 1683026 - DNA, 20 bp, Homo sapiens
ggcggaggttccagtgagcc

SEQ ID NO: 1683027 - DNA, 20 bp, Homo sapiens
ggcggatcatctaattctct

SEQ ID NO: 1683028 - DNA, 17 bp, Homo sapiens
ggcggcacgtccttggg

SEQ ID NO: 1683029 - DNA, 15 bp, Homo sapiens
ggcggcagccccact

SEQ ID NO: 1683030 - DNA, 12 bp, Homo sapiens
ggcggccaggca

SEQ ID NO: 1683031 - DNA, 14 bp, Homo sapiens
ggcggccaggcaca

SEQ ID NO: 1683032 - DNA, 15 bp, Homo sapiens
ggcggccaggcacag

SEQ ID NO: 1683033 - DNA, 21 bp, Homo sapiens
ggcggccaggcacagggcccg

SEQ ID NO: 1683034 - DNA, 18 bp, Homo sapiens
ggcggcccaagcccgact

SEQ ID NO: 1683035 - DNA, 17 bp, Homo sapiens
ggcggcccggccagcgg

SEQ ID NO: 1683036 - DNA, 23 bp, Homo sapiens
ggcggcccggccagcgggcacag

SEQ ID NO: 1683037 - DNA, 20 bp, Homo sapiens
ggcggcccttctgactgttt

SEQ ID NO: 1683038 - DNA, 23 bp, Homo sapiens
ggcggctactcagcagccctcct

SEQ ID NO: 1683039 - DNA, 14 bp, Homo sapiens
ggcgggagaactga

SEQ ID NO: 1683040 - DNA, 16 bp, Homo sapiens
ggcgggagcatctctt

SEQ ID NO: 1683041 - DNA, 22 bp, Homo sapiens
ggcgggcacctatagtcccagc

SEQ ID NO: 1683042 - DNA, 13 bp, Homo sapiens
ggcgggcacctgt

SEQ ID NO: 1683043 - DNA, 17 bp, Homo sapiens
ggcgggcagagggctgg

SEQ ID NO: 1683044 - DNA, 14 bp, Homo sapiens
ggcgggccagccag

SEQ ID NO: 1683045 - DNA, 15 bp, Homo sapiens
ggcgggccagccagg

SEQ ID NO: 1683046 - DNA, 11 bp, Homo sapiens
ggcgggccagg

SEQ ID NO: 1683047 - DNA, 12 bp, Homo sapiens
ggcggggcagga

SEQ ID NO: 1683048 - DNA, 12 bp, Homo sapiens
ggcggggcccag

SEQ ID NO: 1683049 - DNA, 20 bp, Homo sapiens
ggcgggtggatcacgaggtc

SEQ ID NO: 1683050 - DNA, 23 bp, Homo sapiens
ggcggtcacagcatggaggagga

SEQ ID NO: 1683051 - DNA, 23 bp, Homo sapiens
ggcggtgcccacaccggggacag

SEQ ID NO: 1683052 - DNA, 15 bp, Homo sapiens
ggcgtaatgggcctg

SEQ ID NO: 1683053 - DNA, 16 bp, Homo sapiens
ggcgtaatgggcctgc

SEQ ID NO: 1683054 - DNA, 18 bp, Homo sapiens
ggcgtaatgggcctgccc

SEQ ID NO: 1683055 - DNA, 19 bp, Homo sapiens
ggcgtaatgggcctgccca

SEQ ID NO: 1683056 - DNA, 23 bp, Homo sapiens
ggcgtctctaatgtctgcagctc

SEQ ID NO: 1683057 - DNA, 16 bp, Homo sapiens
ggcgtctgagctgggg

SEQ ID NO: 1683058 - DNA, 13 bp, Homo sapiens
ggcgtctgctctg

SEQ ID NO: 1683059 - DNA, 17 bp, Homo sapiens
ggcgtgactcacccaag

SEQ ID NO: 1683060 - DNA, 18 bp, Homo sapiens
ggcgtgagacccagtgca

SEQ ID NO: 1683061 - DNA, 22 bp, Homo sapiens
ggcgtgcccccctcctccagta

SEQ ID NO: 1683062 - DNA, 14 bp, Homo sapiens
ggcgtgctcagacc

SEQ ID NO: 1683063 - DNA, 16 bp, Homo sapiens
ggcgtgctcagaccca

SEQ ID NO: 1683064 - DNA, 13 bp, Homo sapiens
ggcgtgctccttt

SEQ ID NO: 1683065 - DNA, 16 bp, Homo sapiens
ggcgtggagccaggga

SEQ ID NO: 1683066 - DNA, 15 bp, Homo sapiens
ggcgtggagggaggc

SEQ ID NO: 1683067 - DNA, 15 bp, Homo sapiens
ggcgttagtgggcag

SEQ ID NO: 1683068 - DNA, 20 bp, Homo sapiens
ggcgttagtgggcaggtggc

SEQ ID NO: 1683069 - DNA, 23 bp, Homo sapiens
ggcgttctgctgcccctgcagtt

SEQ ID NO: 1683070 - DNA, 15 bp, Homo sapiens
ggcgttggtgccact

SEQ ID NO: 1683071 - DNA, 14 bp, Homo sapiens
ggctaactggaagc

SEQ ID NO: 1683072 - DNA, 18 bp, Homo sapiens
ggctaataaactgtatta

SEQ ID NO: 1683073 - DNA, 13 bp, Homo sapiens
ggctaatttaaca

SEQ ID NO: 1683074 - DNA, 19 bp, Homo sapiens
ggctacatcccagcctgtg

SEQ ID NO: 1683075 - DNA, 18 bp, Homo sapiens
ggctactcagcagccctc

SEQ ID NO: 1683076 - DNA, 21 bp, Homo sapiens
ggctactcagcagccctcctc

SEQ ID NO: 1683077 - DNA, 13 bp, Homo sapiens
ggctactggcagc

SEQ ID NO: 1683078 - DNA, 17 bp, Homo sapiens
ggctagactagtctcaa

SEQ ID NO: 1683079 - DNA, 19 bp, Homo sapiens
ggctagagccgaggggaga

SEQ ID NO: 1683080 - DNA, 23 bp, Homo sapiens
ggatgggcattgggctgacacct

SEQ ID NO: 1683081 - DNA, 17 bp, Homo sapiens
ggcacactccctctcct

SEQ ID NO: 1683082 - DNA, 15 bp, Homo sapiens
ggctcctggctgcca

SEQ ID NO: 1683083 - DNA, 20 bp, Homo sapiens
ggctcctggctgccaggcgt

SEQ ID NO: 1683084 - DNA, 22 bp, Homo sapiens
ggctcctggctgtgcccagcag

SEQ ID NO: 1683085 - DNA, 23 bp, Homo sapiens
ggctcctggctgtgcccagcagg

SEQ ID NO: 1683086 - DNA, 18 bp, Homo sapiens
ggctcctgtggcagctgc

SEQ ID NO: 1683087 - DNA, 15 bp, Homo sapiens
ggctcctgttttgca

SEQ ID NO: 1683088 - DNA, 20 bp, Homo sapiens
ggctccttcccatcgctgtc

SEQ ID NO: 1683089 - DNA, 14 bp, Homo sapiens
ggctccttcccctg

SEQ ID NO: 1683090 - DNA, 16 bp, Homo sapiens
ggctccttcccctgca

SEQ ID NO: 1683091 - DNA, 17 bp, Homo sapiens
ggctcctttctccagcc

SEQ ID NO: 1683092 - DNA, 13 bp, Homo sapiens
ggctcgaatctct

SEQ ID NO: 1683093 - DNA, 17 bp, Homo sapiens
ggctcgaatctctgtgc

SEQ ID NO: 1683094 - DNA, 18 bp, Homo sapiens
ggctcgaatctctgtgcc

SEQ ID NO: 1683095 - DNA, 19 bp, Homo sapiens
ggctcgaatctctgtgcct

SEQ ID NO: 1683096 - DNA, 17 bp, Homo sapiens
ggctcgccatgccgggg

SEQ ID NO: 1683097 - DNA, 18 bp, Homo sapiens
ggctcgcccatacccgtg

SEQ ID NO: 1683098 - DNA, 22 bp, Homo sapiens
ggctcgctccctgtagctctgc

SEQ ID NO: 1683099 - DNA, 23 bp, Homo sapiens
ggctcgctccctgtagctctgcc

SEQ ID NO: 1683100 - DNA, 18 bp, Homo sapiens
ggctcgggagccatgtca

SEQ ID NO: 1683101 - DNA, 22 bp, Homo sapiens
ggctcgggagccatgtcatgtg

SEQ ID NO: 1683102 - DNA, 22 bp, Homo sapiens
ggctcggggtaaaaagtggctg

SEQ ID NO: 1683103 - DNA, 13 bp, Homo sapiens
ggctcgtggcctt

SEQ ID NO: 1683104 - DNA, 14 bp, Homo sapiens
ggctcgtttggatc

SEQ ID NO: 1683105 - DNA, 19 bp, Homo sapiens
ggctctaccctgtctgtcc

SEQ ID NO: 1683106 - DNA, 22 bp, Homo sapiens
ggctctagatcataaggcttca

SEQ ID NO: 1683107 - DNA, 19 bp, Homo sapiens
ggctctccaaaggggctgc

SEQ ID NO: 1683108 - DNA, 19 bp, Homo sapiens
ggctctccaagtgccagag

SEQ ID NO: 1683109 - DNA, 16 bp, Homo sapiens
ggctctccacctcagc

SEQ ID NO: 1683110 - DNA, 20 bp, Homo sapiens
ggctctcctcagaagaaaga

SEQ ID NO: 1683111 - DNA, 17 bp, Homo sapiens
ggctctctgtaggcaca

SEQ ID NO: 1683112 - DNA, 14 bp, Homo sapiens
ggctctgaaagcca

SEQ ID NO: 1683113 - DNA, 17 bp, Homo sapiens
ggctctgaaataaaatg

SEQ ID NO: 1683114 - DNA, 14 bp, Homo sapiens
ggctctgagcgcct

SEQ ID NO: 1683115 - DNA, 15 bp, Homo sapiens
ggctctgagcgcctc

SEQ ID NO: 1683116 - DNA, 17 bp, Homo sapiens
ggctctgaggtgcctgt

SEQ ID NO: 1683117 - DNA, 19 bp, Homo sapiens
ggctctgaggtgcctgtcc

SEQ ID NO: 1683118 - DNA, 19 bp, Homo sapiens
ggctctgatctaacaaaat

SEQ ID NO: 1683119 - DNA, 19 bp, Homo sapiens
ggctctgcacagacaagca

SEQ ID NO: 1683120 - DNA, 20 bp, Homo sapiens
ggctctgcacagacaagcag

SEQ ID NO: 1683121 - DNA, 19 bp, Homo sapiens
ggctctgccaccctacctg

SEQ ID NO: 1683122 - DNA, 12 bp, Homo sapiens
ggctctgcccca

SEQ ID NO: 1683123 - DNA, 19 bp, Homo sapiens
ggctctgccccctccccca

SEQ ID NO: 1683124 - DNA, 13 bp, Homo sapiens
ggctctgccctgc

SEQ ID NO: 1683125 - DNA, 22 bp, Homo sapiens
ggctgcaaataaggacagcagc

SEQ ID NO: 1683126 - DNA, 24 bp, Homo sapiens
ggctgcaaataaggacagcagctg

SEQ ID NO: 1683127 - DNA, 21 bp, Homo sapiens
ggctgcaattgcagctcactg

SEQ ID NO: 1683128 - DNA, 22 bp, Homo sapiens
ggctgcaattgcagctcactgc

SEQ ID NO: 1683129 - DNA, 16 bp, Homo sapiens
ggctgcacctctggct

SEQ ID NO: 1683130 - DNA, 18 bp, Homo sapiens
ggctgcagaggccagagg

SEQ ID NO: 1683131 - DNA, 19 bp, Homo sapiens
ggctgcagagtctgcccca

SEQ ID NO: 1683132 - DNA, 19 bp, Homo sapiens
ggctgcagcaggtgctggg

SEQ ID NO: 1683133 - DNA, 22 bp, Homo sapiens
ggctgcagcctccacttccctc

SEQ ID NO: 1683134 - DNA, 22 bp, Homo sapiens
ggctgcagcgcccggtgctctg

SEQ ID NO: 1683135 - DNA, 13 bp, Homo sapiens
ggctgcaggaaga

SEQ ID NO: 1683136 - DNA, 20 bp, Homo sapiens
ggctgcaggtgttctgctga

SEQ ID NO: 1683137 - DNA, 15 bp, Homo sapiens
ggctgcagtgagcca

SEQ ID NO: 1683138 - DNA, 19 bp, Homo sapiens
ggctgcatgctctggaagc

SEQ ID NO: 1683139 - DNA, 21 bp, Homo sapiens
ggctgcatttgcctgtcatgc

SEQ ID NO: 1683140 - DNA, 15 bp, Homo sapiens
ggctgccagcgtctg

SEQ ID NO: 1683141 - DNA, 19 bp, Homo sapiens
ggctgccagcgtctgttgt

SEQ ID NO: 1683142 - DNA, 20 bp, Homo sapiens
ggctgccaggttcctgtact

SEQ ID NO: 1683143 - DNA, 18 bp, Homo sapiens
ggctgccatgtgaagagg

SEQ ID NO: 1683144 - DNA, 14 bp, Homo sapiens
ggctgcccaggaga

SEQ ID NO: 1683145 - DNA, 16 bp, Homo sapiens
ggctgccccaggccgg

SEQ ID NO: 1683146 - DNA, 21 bp, Homo sapiens
ggctgccccgggtccccagct

SEQ ID NO: 1683147 - DNA, 22 bp, Homo sapiens
ggctgccccgggtccccagctc

SEQ ID NO: 1683148 - DNA, 20 bp, Homo sapiens
ggctgccctggccctgaggt

SEQ ID NO: 1683149 - DNA, 21 bp, Homo sapiens
ggctgcccttgttgcctgcac

SEQ ID NO: 1683150 - DNA, 19 bp, Homo sapiens
ggctgcctcggactccatg

SEQ ID NO: 1683151 - DNA, 11 bp, Homo sapiens
ggctgcctgcc

SEQ ID NO: 1683152 - DNA, 14 bp, Homo sapiens
ggctgcctgctgtg

SEQ ID NO: 1683153 - DNA, 14 bp, Homo sapiens
ggctgcctgggctg

SEQ ID NO: 1683154 - DNA, 19 bp, Homo sapiens
ggctgcctgtgggcttccc

SEQ ID NO: 1683155 - DNA, 13 bp, Homo sapiens
ggctgccttcttt

SEQ ID NO: 1683156 - DNA, 17 bp, Homo sapiens
ggctgcggcgtctgtct

SEQ ID NO: 1683157 - DNA, 22 bp, Homo sapiens
ggctgcggtgtttggcaatgct

SEQ ID NO: 1683158 - DNA, 11 bp, Homo sapiens
ggctgctcccc

SEQ ID NO: 1683159 - DNA, 13 bp, Homo sapiens
ggctgctccccac

SEQ ID NO: 1683160 - DNA, 13 bp, Homo sapiens
ggctgctcctcca

SEQ ID NO: 1683161 - DNA, 23 bp, Homo sapiens
ggctgctcctccagggccacgtg

SEQ ID NO: 1683162 - DNA, 15 bp, Homo sapiens
ggctgctctgcctgt

SEQ ID NO: 1683163 - DNA, 17 bp, Homo sapiens
ggctgctgcccccaccc

SEQ ID NO: 1683164 - DNA, 21 bp, Homo sapiens
ggctgctgccggaatcacttc

SEQ ID NO: 1683165 - DNA, 13 bp, Homo sapiens
ggctgctgcctgc

SEQ ID NO: 1683166 - DNA, 23 bp, Homo sapiens
ggctgctgctgatgtaggagctg

SEQ ID NO: 1683167 - DNA, 21 bp, Homo sapiens
ggctgctggggcatgtgtgcc

SEQ ID NO: 1683168 - DNA, 13 bp, Homo sapiens
ggctgcttcctcc

SEQ ID NO: 1683169 - DNA, 17 bp, Homo sapiens
ggctgcttcctcctgga

SEQ ID NO: 1683170 - DNA, 18 bp, Homo sapiens
ggctgcttcctcctggaa

SEQ ID NO: 1683171 - DNA, 12 bp, Homo sapiens
ggctgcttctcc

SEQ ID NO: 1683172 - DNA, 16 bp, Homo sapiens
ggcttctcctgaccca

SEQ ID NO: 1683173 - DNA, 15 bp, Homo sapiens
ggcttctctccacag

SEQ ID NO: 1683174 - DNA, 21 bp, Homo sapiens
ggcttctctcttttcctcctc

SEQ ID NO: 1683175 - DNA, 14 bp, Homo sapiens
ggcttctgcaccct

SEQ ID NO: 1683176 - DNA, 13 bp, Homo sapiens
ggcttctggagcc

SEQ ID NO: 1683177 - DNA, 20 bp, Homo sapiens
ggcttctggagcccttgggt

SEQ ID NO: 1683178 - DNA, 18 bp, Homo sapiens
ggcttctgtgatgagctg

SEQ ID NO: 1683179 - DNA, 12 bp, Homo sapiens
ggcttgaagcca

SEQ ID NO: 1683180 - DNA, 13 bp, Homo sapiens
ggcttgaagctgt

SEQ ID NO: 1683181 - DNA, 14 bp, Homo sapiens
ggcttgaaggactg

SEQ ID NO: 1683182 - DNA, 17 bp, Homo sapiens
ggcttgactcaggattt

SEQ ID NO: 1683183 - DNA, 22 bp, Homo sapiens
ggcttgctccagggtcttgggc

SEQ ID NO: 1683184 - DNA, 17 bp, Homo sapiens
ggcttggacttcctggg

SEQ ID NO: 1683185 - DNA, 16 bp, Homo sapiens
ggcttggaggcttggc

SEQ ID NO: 1683186 - DNA, 17 bp, Homo sapiens
ggcttggatcctgggct

SEQ ID NO: 1683187 - DNA, 16 bp, Homo sapiens
ggcttggctgccctgt

SEQ ID NO: 1683188 - DNA, 17 bp, Homo sapiens
ggcttgggccctgcaca

SEQ ID NO: 1683189 - DNA, 22 bp, Homo sapiens
ggcttggggctcacacacctgt

SEQ ID NO: 1683190 - DNA, 21 bp, Homo sapiens
ggcttgtcactagcagctgca

SEQ ID NO: 1683191 - DNA, 16 bp, Homo sapiens
ggctttaatacaaaaa

SEQ ID NO: 1683192 - DNA, 19 bp, Homo sapiens
ggctttaattgtataagtc

SEQ ID NO: 1683193 - DNA, 18 bp, Homo sapiens
ggctttcacatttaaatg

SEQ ID NO: 1683194 - DNA, 21 bp, Homo sapiens
ggctttcagagccagcctggc

SEQ ID NO: 1683195 - DNA, 22 bp, Homo sapiens
ggctttcattattagtactgct

SEQ ID NO: 1683196 - DNA, 22 bp, Homo sapiens
ggctttcccacttcccaccctg

SEQ ID NO: 1683197 - DNA, 19 bp, Homo sapiens
ggctttcctggttctgtct

SEQ ID NO: 1683198 - DNA, 20 bp, Homo sapiens
ggctttctctctggcttctc

SEQ ID NO: 1683199 - DNA, 12 bp, Homo sapiens
ggctttctcttc

SEQ ID NO: 1683200 - DNA, 20 bp, Homo sapiens
ggctttctcttccccttcct

SEQ ID NO: 1683201 - DNA, 21 bp, Homo sapiens
ggctttctcttccccttcctg

SEQ ID NO: 1683202 - DNA, 22 bp, Homo sapiens
ggctttctcttccccttcctgt

SEQ ID NO: 1683203 - DNA, 12 bp, Homo sapiens
ggctttctggag

SEQ ID NO: 1683204 - DNA, 17 bp, Homo sapiens
ggctttgcaggctctgg

SEQ ID NO: 1683205 - DNA, 19 bp, Homo sapiens
ggctttgcaggctctgggc

SEQ ID NO: 1683206 - DNA, 20 bp, Homo sapiens
ggctttgcaggctctgggct

SEQ ID NO: 1683207 - DNA, 15 bp, Homo sapiens
ggctttgcccacccc

SEQ ID NO: 1683208 - DNA, 17 bp, Homo sapiens
ggctttgcccacccctc

SEQ ID NO: 1683209 - DNA, 13 bp, Homo sapiens
ggctttgcctctt

SEQ ID NO: 1683210 - DNA, 21 bp, Homo sapiens
ggctttgggaacactggcctg

SEQ ID NO: 1683211 - DNA, 14 bp, Homo sapiens
ggcttttcactgct

SEQ ID NO: 1683212 - DNA, 17 bp, Homo sapiens
ggcttttcccaccagct

SEQ ID NO: 1683213 - DNA, 16 bp, Homo sapiens
ggcttttgctttccct

SEQ ID NO: 1683214 - DNA, 15 bp, Homo sapiens
ggcttttttgtgggg

SEQ ID NO: 1683215 - DNA, 21 bp, Homo sapiens
gggaaaaaaaatgtagcgaca

SEQ ID NO: 1683216 - DNA, 23 bp, Homo sapiens
gggaaaaagaggatctggagaac

SEQ ID NO: 1683217 - DNA, 13 bp, Homo sapiens
gggaaaaatggga

SEQ ID NO: 1683218 - DNA, 22 bp, Homo sapiens
gggaaaactgccaatatagaaa

SEQ ID NO: 1683219 - DNA, 23 bp, Homo sapiens
gggaaaagcatttttcaatatat

SEQ ID NO: 1683220 - DNA, 22 bp, Homo sapiens
gggaaaatggccatgcaggagg

SEQ ID NO: 1683221 - DNA, 16 bp, Homo sapiens
gggaaaatgtgaagct

SEQ ID NO: 1683222 - DNA, 17 bp, Homo sapiens
gggaaaccttggagagg

SEQ ID NO: 1683223 - DNA, 16 bp, Homo sapiens
gggaaactgggaaact

SEQ ID NO: 1683224 - DNA, 13 bp, Homo sapiens
gggaaagacactg

SEQ ID NO: 1683225 - DNA, 13 bp, Homo sapiens
gggaaagctccac

SEQ ID NO: 1683226 - DNA, 16 bp, Homo sapiens
gggaaaggacccaccc

SEQ ID NO: 1683227 - DNA, 23 bp, Homo sapiens
gggaaaggaggcatgcctctgat

SEQ ID NO: 1683228 - DNA, 22 bp, Homo sapiens
gggaaaggcctgtggggagccg

SEQ ID NO: 1683229 - DNA, 22 bp, Homo sapiens
gggaaaggctctgaaagccagc

SEQ ID NO: 1683230 - DNA, 12 bp, Homo sapiens
gggaaaggggac

SEQ ID NO: 1683231 - DNA, 21 bp, Homo sapiens
gggaaagtattctcttttcaa

SEQ ID NO: 1683232 - DNA, 17 bp, Homo sapiens
gggaaatactactcctg

SEQ ID NO: 1683233 - DNA, 19 bp, Homo sapiens
gggacaagggattctggga

SEQ ID NO: 1683234 - DNA, 22 bp, Homo sapiens
gggacacaacacagataatttt

SEQ ID NO: 1683235 - DNA, 20 bp, Homo sapiens
gggacaccctggttcccacc

SEQ ID NO: 1683236 - DNA, 15 bp, Homo sapiens
gggacactgggcagc

SEQ ID NO: 1683237 - DNA, 20 bp, Homo sapiens
gggacactgggcagcaaggc

SEQ ID NO: 1683238 - DNA, 18 bp, Homo sapiens
gggacagagacacctgca

SEQ ID NO: 1683239 - DNA, 20 bp, Homo sapiens
gggacagagacacctgcacc

SEQ ID NO: 1683240 - DNA, 19 bp, Homo sapiens
gggacagcccagagcctgg

SEQ ID NO: 1683241 - DNA, 13 bp, Homo sapiens
gggacagccttca

SEQ ID NO: 1683242 - DNA, 15 bp, Homo sapiens
gggacagctgctggg

SEQ ID NO: 1683243 - DNA, 16 bp, Homo sapiens
gggacagctggctggg

SEQ ID NO: 1683244 - DNA, 15 bp, Homo sapiens
gggacagttggcaga

SEQ ID NO: 1683245 - DNA, 18 bp, Homo sapiens
gggacatcacagggtggg

SEQ ID NO: 1683246 - DNA, 17 bp, Homo sapiens
gggaccaaggcaaggca

SEQ ID NO: 1683247 - DNA, 19 bp, Homo sapiens
gggaccaaggcaaggcagg

SEQ ID NO: 1683248 - DNA, 16 bp, Homo sapiens
gggaccacagctgctg

SEQ ID NO: 1683249 - DNA, 19 bp, Homo sapiens
gggaccaccctgagccggc

SEQ ID NO: 1683250 - DNA, 20 bp, Homo sapiens
gggaccagagccagatgcag

SEQ ID NO: 1683251 - DNA, 13 bp, Homo sapiens
gggaccaggagct

SEQ ID NO: 1683252 - DNA, 17 bp, Homo sapiens
gggaccagtcccacacc

SEQ ID NO: 1683253 - DNA, 16 bp, Homo sapiens
gggaccataagaggag

SEQ ID NO: 1683254 - DNA, 21 bp, Homo sapiens
gggacccaatgtaggagctgc

SEQ ID NO: 1683255 - DNA, 16 bp, Homo sapiens
gggacccacctccccc

SEQ ID NO: 1683256 - DNA, 21 bp, Homo sapiens
gggacccagctactctgtcca

SEQ ID NO: 1683257 - DNA, 22 bp, Homo sapiens
gggacccagctactctgtccag

SEQ ID NO: 1683258 - DNA, 16 bp, Homo sapiens
gggacccagtgcagaa

SEQ ID NO: 1683259 - DNA, 21 bp, Homo sapiens
gggaccccactccctgctcta

SEQ ID NO: 1683260 - DNA, 13 bp, Homo sapiens
gggaccccacttc

SEQ ID NO: 1683261 - DNA, 18 bp, Homo sapiens
gggaccccctcaccatcc

SEQ ID NO: 1683262 - DNA, 18 bp, Homo sapiens
gggaccggtgctgcagga

SEQ ID NO: 1683263 - DNA, 13 bp, Homo sapiens
gggaccttagaaa

SEQ ID NO: 1683264 - DNA, 21 bp, Homo sapiens
gggaccttctttattctgtgt

SEQ ID NO: 1683265 - DNA, 14 bp, Homo sapiens
gggacctttaactt

SEQ ID NO: 1683266 - DNA, 17 bp, Homo sapiens
gggacgggggctgcttc

SEQ ID NO: 1683267 - DNA, 17 bp, Homo sapiens
gggacggtgcccaagcc

SEQ ID NO: 1683268 - DNA, 14 bp, Homo sapiens
gggacgtggtcagg

SEQ ID NO: 1683269 - DNA, 15 bp, Homo sapiens
gggacgtggtcaggg

SEQ ID NO: 1683270 - DNA, 20 bp, Homo sapiens
gggactacaggctcatgcca

SEQ ID NO: 1683271 - DNA, 20 bp, Homo sapiens
gggactatctttgctgcaga

SEQ ID NO: 1683272 - DNA, 16 bp, Homo sapiens
gggactcagccctgag

SEQ ID NO: 1683273 - DNA, 20 bp, Homo sapiens
gggactcggtgagccggggc

SEQ ID NO: 1683274 - DNA, 14 bp, Homo sapiens
gggactgagccagt

SEQ ID NO: 1683275 - DNA, 11 bp, Homo sapiens
gggactgatgt

SEQ ID NO: 1683276 - DNA, 21 bp, Homo sapiens
gggactgggtttggaccccag

SEQ ID NO: 1683277 - DNA, 15 bp, Homo sapiens
gggactgtctcagaa

SEQ ID NO: 1683278 - DNA, 15 bp, Homo sapiens
gggacttgtgtctgc

SEQ ID NO: 1683279 - DNA, 20 bp, Homo sapiens
gggacttgtttagagagcct

SEQ ID NO: 1683280 - DNA, 20 bp, Homo sapiens
gggactttccttccctctcc

SEQ ID NO: 1683281 - DNA, 10 bp, Homo sapiens
gggagaaaac

SEQ ID NO: 1683282 - DNA, 20 bp, Homo sapiens
gggagaaaatcatcaagaag

SEQ ID NO: 1683283 - DNA, 16 bp, Homo sapiens
gggagaacctcaggct

SEQ ID NO: 1683284 - DNA, 12 bp, Homo sapiens
gggagaagagaa

SEQ ID NO: 1683285 - DNA, 12 bp, Homo sapiens
gggagaagctcc

SEQ ID NO: 1683286 - DNA, 21 bp, Homo sapiens
gggagaaggcatgagaaagaa

SEQ ID NO: 1683287 - DNA, 17 bp, Homo sapiens
gggagaagtagctagta

SEQ ID NO: 1683288 - DNA, 21 bp, Homo sapiens
gggagaagtgatatggtgaag

SEQ ID NO: 1683289 - DNA, 19 bp, Homo sapiens
gggagaatgtcagtatgtg

SEQ ID NO: 1683290 - DNA, 18 bp, Homo sapiens
gggagacaggagcctagc

SEQ ID NO: 1683291 - DNA, 16 bp, Homo sapiens
gggaggggaagggctg

SEQ ID NO: 1683292 - DNA, 12 bp, Homo sapiens
gggaggggaggc

SEQ ID NO: 1683293 - DNA, 14 bp, Homo sapiens
gggaggggcaggct

SEQ ID NO: 1683294 - DNA, 17 bp, Homo sapiens
gggaggggcaggctgac

SEQ ID NO: 1683295 - DNA, 17 bp, Homo sapiens
gggaggggccggccctg

SEQ ID NO: 1683296 - DNA, 20 bp, Homo sapiens
gggaggggcgctggcccagc

SEQ ID NO: 1683297 - DNA, 21 bp, Homo sapiens
gggaggggcgctggcccagcc

SEQ ID NO: 1683298 - DNA, 15 bp, Homo sapiens
gggagggggatccga

SEQ ID NO: 1683299 - DNA, 19 bp, Homo sapiens
gggagggttcccctggcct

SEQ ID NO: 1683300 - DNA, 15 bp, Homo sapiens
gggaggtcactggaa

SEQ ID NO: 1683301 - DNA, 14 bp, Homo sapiens
gggaggtcattttg

SEQ ID NO: 1683302 - DNA, 15 bp, Homo sapiens
gggaggtccaagcag

SEQ ID NO: 1683303 - DNA, 15 bp, Homo sapiens
gggaggtcgaggtag

SEQ ID NO: 1683304 - DNA, 23 bp, Homo sapiens
gggaggtggaagaagggagaaga

SEQ ID NO: 1683305 - DNA, 23 bp, Homo sapiens
gggaggttttattctgacttcct

SEQ ID NO: 1683306 - DNA, 17 bp, Homo sapiens
gggagtacctgctgccc

SEQ ID NO: 1683307 - DNA, 23 bp, Homo sapiens
gggagtacctgctgccccagctg

SEQ ID NO: 1683308 - DNA, 20 bp, Homo sapiens
gggagtcttaataaaataaa

SEQ ID NO: 1683309 - DNA, 19 bp, Homo sapiens
gggagtgagacagaagtaa

SEQ ID NO: 1683310 - DNA, 17 bp, Homo sapiens
gggagtgtgggctgccc

SEQ ID NO: 1683311 - DNA, 19 bp, Homo sapiens
gggagtgtgggctgccctt

SEQ ID NO: 1683312 - DNA, 15 bp, Homo sapiens
gggagttaagacctg

SEQ ID NO: 1683313 - DNA, 16 bp, Homo sapiens
gggagttaagacctgg

SEQ ID NO: 1683314 - DNA, 17 bp, Homo sapiens
gggagttaagacctggc

SEQ ID NO: 1683315 - DNA, 20 bp, Homo sapiens
gggagttaagacctggcagc

SEQ ID NO: 1683316 - DNA, 22 bp, Homo sapiens
gggagttagggagagagaagca

SEQ ID NO: 1683317 - DNA, 19 bp, Homo sapiens
gggatacagatctcagggc

SEQ ID NO: 1683318 - DNA, 23 bp, Homo sapiens
gggatacttagtggtatgtctct

SEQ ID NO: 1683319 - DNA, 14 bp, Homo sapiens
gggatagatgtgtg

SEQ ID NO: 1683320 - DNA, 22 bp, Homo sapiens
gggatcactggctggcctgagc

SEQ ID NO: 1683321 - DNA, 17 bp, Homo sapiens
gggatcccaggccaggg

SEQ ID NO: 1683322 - DNA, 22 bp, Homo sapiens
gggatccccgcctggccaggag

SEQ ID NO: 1683323 - DNA, 23 bp, Homo sapiens
gggatccccgcctggccaggagc

SEQ ID NO: 1683324 - DNA, 20 bp, Homo sapiens
gggatccctcccccccatgc

SEQ ID NO: 1683325 - DNA, 22 bp, Homo sapiens
gggatcctccacagagaggagg

SEQ ID NO: 1683326 - DNA, 14 bp, Homo sapiens
gggatcctgcctgc

SEQ ID NO: 1683327 - DNA, 13 bp, Homo sapiens
gggatctgaaatc

SEQ ID NO: 1683328 - DNA, 21 bp, Homo sapiens
gggatctgaaatccataaact

SEQ ID NO: 1683329 - DNA, 12 bp, Homo sapiens
gggatctgagaa

SEQ ID NO: 1683330 - DNA, 19 bp, Homo sapiens
gggatctgttttctggaag

SEQ ID NO: 1683331 - DNA, 20 bp, Homo sapiens
gggatgactaaaatatttat

SEQ ID NO: 1683332 - DNA, 17 bp, Homo sapiens
gggatgactagaggcag

SEQ ID NO: 1683333 - DNA, 23 bp, Homo sapiens
gggatgactagaggcagggaggg

SEQ ID NO: 1683334 - DNA, 18 bp, Homo sapiens
gggatgatggcagagcca

SEQ ID NO: 1683335 - DNA, 22 bp, Homo sapiens
gggatgatggcagagccaggct

SEQ ID NO: 1683336 - DNA, 19 bp, Homo sapiens
gggatgccgttctgttcca

SEQ ID NO: 1683337 - DNA, 16 bp, Homo sapiens
gggatgcggatcctgc

SEQ ID NO: 1683338 - DNA, 22 bp, Homo sapiens
gggatggcatttggtctcaggc

SEQ ID NO: 1683339 - DNA, 16 bp, Homo sapiens
gggatgggcagcccaa

SEQ ID NO: 1683340 - DNA, 15 bp, Homo sapiens
gggatggtcctgggg

SEQ ID NO: 1683341 - DNA, 14 bp, Homo sapiens
gggattaagaaacc

SEQ ID NO: 1683342 - DNA, 14 bp, Homo sapiens
gggattaagggcaa

SEQ ID NO: 1683343 - DNA, 15 bp, Homo sapiens
gggccagcaggctcc

SEQ ID NO: 1683344 - DNA, 15 bp, Homo sapiens
gggccagccaggcgg

SEQ ID NO: 1683345 - DNA, 17 bp, Homo sapiens
gggccagccaggcgggc

SEQ ID NO: 1683346 - DNA, 20 bp, Homo sapiens
gggccagcgatttttgagga

SEQ ID NO: 1683347 - DNA, 16 bp, Homo sapiens
gggccaggacaggccc

SEQ ID NO: 1683348 - DNA, 18 bp, Homo sapiens
gggccagggccctgcaga

SEQ ID NO: 1683349 - DNA, 18 bp, Homo sapiens
gggccagggtgggaagag

SEQ ID NO: 1683350 - DNA, 18 bp, Homo sapiens
gggccagtcctgcctggc

SEQ ID NO: 1683351 - DNA, 20 bp, Homo sapiens
gggccagtcctgcctggcca

SEQ ID NO: 1683352 - DNA, 15 bp, Homo sapiens
gggccagtctgggct

SEQ ID NO: 1683353 - DNA, 14 bp, Homo sapiens
gggccatccactgt

SEQ ID NO: 1683354 - DNA, 16 bp, Homo sapiens
gggccatccactgtga

SEQ ID NO: 1683355 - DNA, 17 bp, Homo sapiens
gggccatctgactgcca

SEQ ID NO: 1683356 - DNA, 22 bp, Homo sapiens
gggccatgatggcaacagatct

SEQ ID NO: 1683357 - DNA, 15 bp, Homo sapiens
gggccatgctgaggc

SEQ ID NO: 1683358 - DNA, 14 bp, Homo sapiens
gggccatgtccaaa

SEQ ID NO: 1683359 - DNA, 18 bp, Homo sapiens
gggcccaagccccatctc

SEQ ID NO: 1683360 - DNA, 20 bp, Homo sapiens
gggcccaagtccctgttttc

SEQ ID NO: 1683361 - DNA, 14 bp, Homo sapiens
gggcccacacctgg

SEQ ID NO: 1683362 - DNA, 18 bp, Homo sapiens
gggcccacctggccacct

SEQ ID NO: 1683363 - DNA, 19 bp, Homo sapiens
gggcccacctggccacctg

SEQ ID NO: 1683364 - DNA, 17 bp, Homo sapiens
gggcccagaccctgggc

SEQ ID NO: 1683365 - DNA, 18 bp, Homo sapiens
gggcccagaccctgggca

SEQ ID NO: 1683366 - DNA, 13 bp, Homo sapiens
gggcccagagccc

SEQ ID NO: 1683367 - DNA, 16 bp, Homo sapiens
gggcccagagcccagc

SEQ ID NO: 1683368 - DNA, 18 bp, Homo sapiens
gggcccagccaggagcag

SEQ ID NO: 1683369 - DNA, 21 bp, Homo sapiens
gggcccagccaggagcagatg

SEQ ID NO: 1683370 - DNA, 12 bp, Homo sapiens
gggcccagccca

SEQ ID NO: 1683371 - DNA, 20 bp, Homo sapiens
gggcccagctgtagccatgg

SEQ ID NO: 1683372 - DNA, 14 bp, Homo sapiens
gggcccaggaccag

SEQ ID NO: 1683373 - DNA, 17 bp, Homo sapiens
gggcccaggcaggtctg

SEQ ID NO: 1683374 - DNA, 22 bp, Homo sapiens
gggcccagtgcatggtggccag

SEQ ID NO: 1683375 - DNA, 22 bp, Homo sapiens
gggccccaaacgggctgccctg

SEQ ID NO: 1683376 - DNA, 22 bp, Homo sapiens
gggccccacctacttgtgactg

SEQ ID NO: 1683377 - DNA, 18 bp, Homo sapiens
gggccccagaaggcaggg

SEQ ID NO: 1683378 - DNA, 13 bp, Homo sapiens
gggccccagatct

SEQ ID NO: 1683379 - DNA, 17 bp, Homo sapiens
gggccccagatctgcct

SEQ ID NO: 1683380 - DNA, 11 bp, Homo sapiens
gggccccagct

SEQ ID NO: 1683381 - DNA, 13 bp, Homo sapiens
gggccccaggggc

SEQ ID NO: 1683382 - DNA, 15 bp, Homo sapiens
gggccccaggggcag

SEQ ID NO: 1683383 - DNA, 21 bp, Homo sapiens
gggccccaggggcagcaaggc

SEQ ID NO: 1683384 - DNA, 21 bp, Homo sapiens
gggccccatcctcatccctga

SEQ ID NO: 1683385 - DNA, 19 bp, Homo sapiens
gggccccatgctctgcccc

SEQ ID NO: 1683386 - DNA, 15 bp, Homo sapiens
gggccccgccagggc

SEQ ID NO: 1683387 - DNA, 19 bp, Homo sapiens
gggccccgccagggctggg

SEQ ID NO: 1683388 - DNA, 15 bp, Homo sapiens
gggccccggggctgg

SEQ ID NO: 1683389 - DNA, 23 bp, Homo sapiens
gggcccctcacctggtacctgga

SEQ ID NO: 1683390 - DNA, 16 bp, Homo sapiens
gggcccctccctctgc

SEQ ID NO: 1683391 - DNA, 18 bp, Homo sapiens
gggcccctccctctgccc

SEQ ID NO: 1683392 - DNA, 15 bp, Homo sapiens
gggcccctctgccca

SEQ ID NO: 1683393 - DNA, 16 bp, Homo sapiens
gggcccctctgcccag

SEQ ID NO: 1683394 - DNA, 12 bp, Homo sapiens
gggcccctgagg

SEQ ID NO: 1683395 - DNA, 11 bp, Homo sapiens
gggcccctggc

SEQ ID NO: 1683396 - DNA, 21 bp, Homo sapiens
gggcccgcctcacaccccagt

SEQ ID NO: 1683397 - DNA, 14 bp, Homo sapiens
gggccctcccttgg

SEQ ID NO: 1683398 - DNA, 14 bp, Homo sapiens
gggccctctcttct

SEQ ID NO: 1683399 - DNA, 13 bp, Homo sapiens
gggccctctttcc

SEQ ID NO: 1683400 - DNA, 21 bp, Homo sapiens
gggccctgcattggcctggcc

SEQ ID NO: 1683401 - DNA, 23 bp, Homo sapiens
gggccctgcattggcctggcctc

SEQ ID NO: 1683402 - DNA, 22 bp, Homo sapiens
gggccctgcccctaggatgctg

SEQ ID NO: 1683403 - DNA, 19 bp, Homo sapiens
gggccctggtccttccagg

SEQ ID NO: 1683404 - DNA, 16 bp, Homo sapiens
gggcccttggggcctg

SEQ ID NO: 1683405 - DNA, 17 bp, Homo sapiens
gggcccttggggcctgg

SEQ ID NO: 1683406 - DNA, 20 bp, Homo sapiens
gggcccttggggcctggctt

SEQ ID NO: 1683407 - DNA, 18 bp, Homo sapiens
gggccgaatcccctccct

SEQ ID NO: 1683408 - DNA, 20 bp, Homo sapiens
gggccgaccagaggagcctt

SEQ ID NO: 1683409 - DNA, 16 bp, Homo sapiens
gggccgaggcccagcg

SEQ ID NO: 1683410 - DNA, 18 bp, Homo sapiens
gggccgccacggcctggc

SEQ ID NO: 1683411 - DNA, 21 bp, Homo sapiens
gttaaaaatggctcaagtaga

SEQ ID NO: 1683412 - DNA, 23 bp, Homo sapiens
gttaaaacaaccagttaaagcca

SEQ ID NO: 1683413 - DNA, 18 bp, Homo sapiens
gttaaaactgtacattta

SEQ ID NO: 1683414 - DNA, 21 bp, Homo sapiens
gttaaaagactgcagctgctg

SEQ ID NO: 1683415 - DNA, 22 bp, Homo sapiens
gttaaaagactgcagctgctga

SEQ ID NO: 1683416 - DNA, 16 bp, Homo sapiens
gttaaaagatgaaaat

SEQ ID NO: 1683417 - DNA, 17 bp, Homo sapiens
gttaaaagatggttgta

SEQ ID NO: 1683418 - DNA, 14 bp, Homo sapiens
gttaaaatgtttac

SEQ ID NO: 1683419 - DNA, 19 bp, Homo sapiens
gttaaaatgtttactgtaa

SEQ ID NO: 1683420 - DNA, 15 bp, Homo sapiens
gttaaaattccatcc

SEQ ID NO: 1683421 - DNA, 12 bp, Homo sapiens
gttaaacaaatg

SEQ ID NO: 1683422 - DNA, 14 bp, Homo sapiens
gttaaacaaatgat

SEQ ID NO: 1683423 - DNA, 19 bp, Homo sapiens
gttaaacattaatatttac

SEQ ID NO: 1683424 - DNA, 15 bp, Homo sapiens
gttaaactaaaaaaa

SEQ ID NO: 1683425 - DNA, 15 bp, Homo sapiens
gttaaagagaatgag

SEQ ID NO: 1683426 - DNA, 12 bp, Homo sapiens
gttaaagatgca

SEQ ID NO: 1683427 - DNA, 11 bp, Homo sapiens
gttaaagccac

SEQ ID NO: 1683428 - DNA, 16 bp, Homo sapiens
gttaaagggaagaaaa

SEQ ID NO: 1683429 - DNA, 21 bp, Homo sapiens
gttaaatattttgctaactgg

SEQ ID NO: 1683430 - DNA, 18 bp, Homo sapiens
gttaaatgtttacaagta

SEQ ID NO: 1683431 - DNA, 13 bp, Homo sapiens
gttaacaaatgag

SEQ ID NO: 1683432 - DNA, 15 bp, Homo sapiens
gttaacaaggaatgc

SEQ ID NO: 1683433 - DNA, 19 bp, Homo sapiens
gttaacaaggaatgcctgt

SEQ ID NO: 1683434 - DNA, 22 bp, Homo sapiens
gttaacaaggaatgcctgtgcc

SEQ ID NO: 1683435 - DNA, 23 bp, Homo sapiens
gttaacaaggaatgcctgtgcca

SEQ ID NO: 1683436 - DNA, 20 bp, Homo sapiens
gttaacacaatgtgaatttc

SEQ ID NO: 1683437 - DNA, 22 bp, Homo sapiens
gttaacacatcaaatatttctt

SEQ ID NO: 1683438 - DNA, 17 bp, Homo sapiens
gttaacccattccagta

SEQ ID NO: 1683439 - DNA, 17 bp, Homo sapiens
gttaactgatttgcaat

SEQ ID NO: 1683440 - DNA, 15 bp, Homo sapiens
gttaacttggtcaga

SEQ ID NO: 1683441 - DNA, 15 bp, Homo sapiens
gttaagaaaataaat

SEQ ID NO: 1683442 - DNA, 15 bp, Homo sapiens
gttaagaaagcactt

SEQ ID NO: 1683443 - DNA, 15 bp, Homo sapiens
gttaagaatgtcgat

SEQ ID NO: 1683444 - DNA, 11 bp, Homo sapiens
gttaagactga

SEQ ID NO: 1683445 - DNA, 22 bp, Homo sapiens
gttaaggaccgtggccctgccc

SEQ ID NO: 1683446 - DNA, 16 bp, Homo sapiens
gttaatacaaggtata

SEQ ID NO: 1683447 - DNA, 15 bp, Homo sapiens
gttaatatgtctttt

SEQ ID NO: 1683448 - DNA, 16 bp, Homo sapiens
gttaatgaaaatgtca

SEQ ID NO: 1683449 - DNA, 23 bp, Homo sapiens
gttaatgtcattgctaaaaaata

SEQ ID NO: 1683450 - DNA, 23 bp, Homo sapiens
gttaattgtaattgcatgacaaa

SEQ ID NO: 1683451 - DNA, 14 bp, Homo sapiens
gttaatttatttag

SEQ ID NO: 1683452 - DNA, 18 bp, Homo sapiens
gttaatttgtgtgttttt

SEQ ID NO: 1683453 - DNA, 20 bp, Homo sapiens
gttaattttgctaactgggt

SEQ ID NO: 1683454 - DNA, 20 bp, Homo sapiens
gttaatttttcctgcatgtt

SEQ ID NO: 1683455 - DNA, 23 bp, Homo sapiens
gttaatttttcctgcatgttctg

SEQ ID NO: 1683456 - DNA, 19 bp, Homo sapiens
gttacaaaagaaaaaagca

SEQ ID NO: 1683457 - DNA, 9 bp, Homo sapiens
gttacaaac

SEQ ID NO: 1683458 - DNA, 15 bp, Homo sapiens
gttacaaactgcaat

SEQ ID NO: 1683459 - DNA, 16 bp, Homo sapiens
gttacaaactgcaata

SEQ ID NO: 1683460 - DNA, 19 bp, Homo sapiens
gttacaaactgcaatagag

SEQ ID NO: 1683461 - DNA, 23 bp, Homo sapiens
gttacaaactgcaatagagactg

SEQ ID NO: 1683462 - DNA, 15 bp, Homo sapiens
gttacaaattataat

SEQ ID NO: 1683463 - DNA, 17 bp, Homo sapiens
gttacaacttgtatttc

SEQ ID NO: 1683464 - DNA, 13 bp, Homo sapiens
gttacaagtgttc

SEQ ID NO: 1683465 - DNA, 12 bp, Homo sapiens
gttacaataaag

SEQ ID NO: 1683466 - DNA, 19 bp, Homo sapiens
gttacaataaagtttacaa

SEQ ID NO: 1683467 - DNA, 22 bp, Homo sapiens
gttacacagaaatgctgctggc

SEQ ID NO: 1683468 - DNA, 17 bp, Homo sapiens
gttacagtgcagacagg

SEQ ID NO: 1683469 - DNA, 14 bp, Homo sapiens
gttacagtgtttta

SEQ ID NO: 1683470 - DNA, 14 bp, Homo sapiens
gttacagttctgtg

SEQ ID NO: 1683471 - DNA, 15 bp, Homo sapiens
gttacagttctgtgg

SEQ ID NO: 1683472 - DNA, 16 bp, Homo sapiens
gttacagtttgcacaa

SEQ ID NO: 1683473 - DNA, 20 bp, Homo sapiens
gttacatgcagccacttagg

SEQ ID NO: 1683474 - DNA, 13 bp, Homo sapiens
gttacattaatgt

SEQ ID NO: 1683475 - DNA, 16 bp, Homo sapiens
gttacattaatgttaa

SEQ ID NO: 1683476 - DNA, 16 bp, Homo sapiens
gttacccactgccatg

SEQ ID NO: 1683477 - DNA, 17 bp, Homo sapiens
gttaccctcctgtaaat

SEQ ID NO: 1683478 - DNA, 15 bp, Homo sapiens
gttacctcctataaa

SEQ ID NO: 1683479 - DNA, 18 bp, Homo sapiens
gttaccttatagttactg

SEQ ID NO: 1683480 - DNA, 23 bp, Homo sapiens
gttacgcacacgtacttaaatga

SEQ ID NO: 1683481 - DNA, 22 bp, Homo sapiens
gttacggcatcacacttatatt

SEQ ID NO: 1683482 - DNA, 22 bp, Homo sapiens
gttactaaatagaaaacctaat

SEQ ID NO: 1683483 - DNA, 13 bp, Homo sapiens
gttactaagaaga

SEQ ID NO: 1683484 - DNA, 14 bp, Homo sapiens
gttactaagaagaa

SEQ ID NO: 1683485 - DNA, 15 bp, Homo sapiens
gttactcagccctgg

SEQ ID NO: 1683486 - DNA, 19 bp, Homo sapiens
gttactcagtgttagagaa

SEQ ID NO: 1683487 - DNA, 23 bp, Homo sapiens
gttactccattactgtgatttct

SEQ ID NO: 1683488 - DNA, 20 bp, Homo sapiens
gttactccctgttttagttt

SEQ ID NO: 1683489 - DNA, 14 bp, Homo sapiens
gttactctccaacc

SEQ ID NO: 1683490 - DNA, 23 bp, Homo sapiens
gttactgacttggatcccaaagc

SEQ ID NO: 1683491 - DNA, 22 bp, Homo sapiens
gttactgcctaggagttaatga

SEQ ID NO: 1683492 - DNA, 16 bp, Homo sapiens
gttactgctgattctt

SEQ ID NO: 1683493 - DNA, 17 bp, Homo sapiens
gttacttacctaaacag

SEQ ID NO: 1683494 - DNA, 13 bp, Homo sapiens
gttacttcctact

SEQ ID NO: 1683495 - DNA, 17 bp, Homo sapiens
gttacttgcttcagtgg

SEQ ID NO: 1683496 - DNA, 21 bp, Homo sapiens
gttactttatgtttgtctttt

SEQ ID NO: 1683497 - DNA, 16 bp, Homo sapiens
gttagaaaatgactta

SEQ ID NO: 1683498 - DNA, 19 bp, Homo sapiens
gttagaaatgcagaatcct

SEQ ID NO: 1683499 - DNA, 23 bp, Homo sapiens
gttagagattttacaaaatgctg

SEQ ID NO: 1683500 - DNA, 13 bp, Homo sapiens
gttagaggaaggc

SEQ ID NO: 1683501 - DNA, 21 bp, Homo sapiens
gttagatctttgtaaatgcat

SEQ ID NO: 1683502 - DNA, 11 bp, Homo sapiens
gttagcaaaga

SEQ ID NO: 1683503 - DNA, 17 bp, Homo sapiens
gttagcatccaggctgg

SEQ ID NO: 1683504 - DNA, 21 bp, Homo sapiens
gttagcatccaggctggccag

SEQ ID NO: 1683505 - DNA, 22 bp, Homo sapiens
gttagcatgcgcgctgtgggca

SEQ ID NO: 1683506 - DNA, 19 bp, Homo sapiens
gttagcatgtatgaatgta

SEQ ID NO: 1683507 - DNA, 15 bp, Homo sapiens
gttagccctcagtca

SEQ ID NO: 1683508 - DNA, 12 bp, Homo sapiens
gttagctcctgt

SEQ ID NO: 1683509 - DNA, 16 bp, Homo sapiens
gttagctcctgtggcc

SEQ ID NO: 1683510 - DNA, 20 bp, Homo sapiens
gttagctcctgtggccccac

SEQ ID NO: 1683511 - DNA, 16 bp, Homo sapiens
gttagctgacagtcag

SEQ ID NO: 1683512 - DNA, 20 bp, Homo sapiens
gttagctgacagtcagctgt

SEQ ID NO: 1683513 - DNA, 17 bp, Homo sapiens
gttaggaataacactgc

SEQ ID NO: 1683514 - DNA, 21 bp, Homo sapiens
gttaggactctccactcaatg

SEQ ID NO: 1683515 - DNA, 14 bp, Homo sapiens
gttaggattcagat

SEQ ID NO: 1683516 - DNA, 15 bp, Homo sapiens
gttaggatttaacag

SEQ ID NO: 1683517 - DNA, 13 bp, Homo sapiens
gttagggaggggt

SEQ ID NO: 1683518 - DNA, 17 bp, Homo sapiens
gttagggtgtgtgttca

SEQ ID NO: 1683519 - DNA, 18 bp, Homo sapiens
gttaggtagagggagttg

SEQ ID NO: 1683520 - DNA, 21 bp, Homo sapiens
gttaggtagagggagttgtca

SEQ ID NO: 1683521 - DNA, 12 bp, Homo sapiens
gttagtcatttg

SEQ ID NO: 1683522 - DNA, 12 bp, Homo sapiens
gttctaaagttc

SEQ ID NO: 1683523 - DNA, 13 bp, Homo sapiens
gttctaaagttct

SEQ ID NO: 1683524 - DNA, 18 bp, Homo sapiens
gttctaaagttctaagat

SEQ ID NO: 1683525 - DNA, 21 bp, Homo sapiens
gttctaaagttctaagattct

SEQ ID NO: 1683526 - DNA, 22 bp, Homo sapiens
gttctaacagtgaagttttact

SEQ ID NO: 1683527 - DNA, 17 bp, Homo sapiens
gttctaagactcaaatg

SEQ ID NO: 1683528 - DNA, 22 bp, Homo sapiens
gttctaagatgtgatattctaa

SEQ ID NO: 1683529 - DNA, 11 bp, Homo sapiens
gttctaaggcc

SEQ ID NO: 1683530 - DNA, 13 bp, Homo sapiens
gttctaaggctct

SEQ ID NO: 1683531 - DNA, 17 bp, Homo sapiens
gttctaaggctctgaga

SEQ ID NO: 1683532 - DNA, 17 bp, Homo sapiens
gttctaagtttctaaga

SEQ ID NO: 1683533 - DNA, 21 bp, Homo sapiens
gttctaagtttctaagattct

SEQ ID NO: 1683534 - DNA, 17 bp, Homo sapiens
gttctaataatttctaa

SEQ ID NO: 1683535 - DNA, 21 bp, Homo sapiens
gttctaccgtggatttgtact

SEQ ID NO: 1683536 - DNA, 19 bp, Homo sapiens
gttctacggatcatcaaca

SEQ ID NO: 1683537 - DNA, 17 bp, Homo sapiens
gttctactgacccaact

SEQ ID NO: 1683538 - DNA, 23 bp, Homo sapiens
gttctactgacccaactgggggc

SEQ ID NO: 1683539 - DNA, 21 bp, Homo sapiens
gttctagacatggaggttcta

SEQ ID NO: 1683540 - DNA, 23 bp, Homo sapiens
gttctagacatggaggttctaag

SEQ ID NO: 1683541 - DNA, 18 bp, Homo sapiens
gttctagacctctggtta

SEQ ID NO: 1683542 - DNA, 17 bp, Homo sapiens
gttctagacttccccat

SEQ ID NO: 1683543 - DNA, 19 bp, Homo sapiens
gttctagacttccccatcc

SEQ ID NO: 1683544 - DNA, 21 bp, Homo sapiens
gttctagacttccccatcccg

SEQ ID NO: 1683545 - DNA, 19 bp, Homo sapiens
gttctagcatggcatattt

SEQ ID NO: 1683546 - DNA, 22 bp, Homo sapiens
gttctaggcactgtagttctaa

SEQ ID NO: 1683547 - DNA, 19 bp, Homo sapiens
gttctaggtttcaaagatg

SEQ ID NO: 1683548 - DNA, 21 bp, Homo sapiens
gttctataagaataaggcttt

SEQ ID NO: 1683549 - DNA, 17 bp, Homo sapiens
gttctatccccaagctg

SEQ ID NO: 1683550 - DNA, 17 bp, Homo sapiens
gttctatgctaaactgt

SEQ ID NO: 1683551 - DNA, 15 bp, Homo sapiens
gttctatttctatct

SEQ ID NO: 1683552 - DNA, 15 bp, Homo sapiens
gttctcactgggaag

SEQ ID NO: 1683553 - DNA, 23 bp, Homo sapiens
gttctcagaactgttggctgctc

SEQ ID NO: 1683554 - DNA, 23 bp, Homo sapiens
gttctcagaatcccttaacagtt

SEQ ID NO: 1683555 - DNA, 16 bp, Homo sapiens
gttctcagacctccag

SEQ ID NO: 1683556 - DNA, 22 bp, Homo sapiens
gttctcatgataccacctttac

SEQ ID NO: 1683557 - DNA, 23 bp, Homo sapiens
gttctcatgataccacctttact

SEQ ID NO: 1683558 - DNA, 21 bp, Homo sapiens
gttctccaacatcacagccca

SEQ ID NO: 1683559 - DNA, 23 bp, Homo sapiens
gttctccaacatcacagcccagc

SEQ ID NO: 1683560 - DNA, 21 bp, Homo sapiens
gttctccgttagctcctgtgg

SEQ ID NO: 1683561 - DNA, 13 bp, Homo sapiens
gttctcctgtccc

SEQ ID NO: 1683562 - DNA, 17 bp, Homo sapiens
gttctcctgtccctcca

SEQ ID NO: 1683563 - DNA, 20 bp, Homo sapiens
gttctctcatcggaggccca

SEQ ID NO: 1683564 - DNA, 16 bp, Homo sapiens
gttctctccaggaagg

SEQ ID NO: 1683565 - DNA, 17 bp, Homo sapiens
gttctctctgcctgtga

SEQ ID NO: 1683566 - DNA, 13 bp, Homo sapiens
gttctctgggaga

SEQ ID NO: 1683567 - DNA, 15 bp, Homo sapiens
gttctctgggagaaa

SEQ ID NO: 1683568 - DNA, 16 bp, Homo sapiens
gttctctgggagaaaa

SEQ ID NO: 1683569 - DNA, 14 bp, Homo sapiens
gttctcttggctgc

SEQ ID NO: 1683570 - DNA, 15 bp, Homo sapiens
gttctcttggctgca

SEQ ID NO: 1683571 - DNA, 16 bp, Homo sapiens
gttctgaaaggagaca

SEQ ID NO: 1683572 - DNA, 19 bp, Homo sapiens
gttctgagccgggcaagtc

SEQ ID NO: 1683573 - DNA, 14 bp, Homo sapiens
gttctgagtgtttt

SEQ ID NO: 1683574 - DNA, 13 bp, Homo sapiens
gttctgcactgaa

SEQ ID NO: 1683575 - DNA, 10 bp, Homo sapiens
gttctgcagc

SEQ ID NO: 1683576 - DNA, 18 bp, Homo sapiens
gttctgcagcggcagagc

SEQ ID NO: 1683577 - DNA, 19 bp, Homo sapiens
gttctgcagcggcagagca

SEQ ID NO: 1683578 - DNA, 20 bp, Homo sapiens
gttctgccctgcctgaggag

SEQ ID NO: 1683579 - DNA, 17 bp, Homo sapiens
gttctgcctgccagctg

SEQ ID NO: 1683580 - DNA, 19 bp, Homo sapiens
gttctgcctgccagctgca

SEQ ID NO: 1683581 - DNA, 23 bp, Homo sapiens
gttctgcctgccagctgcactga

SEQ ID NO: 1683582 - DNA, 19 bp, Homo sapiens
gttctgctaaatttcaaat

SEQ ID NO: 1683583 - DNA, 12 bp, Homo sapiens
gttctgctcctg

SEQ ID NO: 1683584 - DNA, 14 bp, Homo sapiens
gttctgctcctgct

SEQ ID NO: 1683585 - DNA, 21 bp, Homo sapiens
gttctgctgatatcaacagct

SEQ ID NO: 1683586 - DNA, 15 bp, Homo sapiens
gttctggccctcacc

SEQ ID NO: 1683587 - DNA, 21 bp, Homo sapiens
gttctggccctcacccctgcc

SEQ ID NO: 1683588 - DNA, 14 bp, Homo sapiens
gttctgggcctctg

SEQ ID NO: 1683589 - DNA, 14 bp, Homo sapiens
gttctggttccatt

SEQ ID NO: 1683590 - DNA, 21 bp, Homo sapiens
gttctgtaatggaactgaccc

SEQ ID NO: 1683591 - DNA, 15 bp, Homo sapiens
gttctgtgaagagga

SEQ ID NO: 1683592 - DNA, 19 bp, Homo sapiens
gttctgtgacatcctgctt

SEQ ID NO: 1683593 - DNA, 23 bp, Homo sapiens
gttctgtgggggtcatcagggag

SEQ ID NO: 1683594 - DNA, 19 bp, Homo sapiens
gttctgtggttttcccctc

SEQ ID NO: 1683595 - DNA, 15 bp, Homo sapiens
gttctgtgtgtctgg

SEQ ID NO: 1683596 - DNA, 19 bp, Homo sapiens
gttctgttacccagggctc

SEQ ID NO: 1683597 - DNA, 18 bp, Homo sapiens
gttctgttgatcccactt

SEQ ID NO: 1683598 - DNA, 20 bp, Homo sapiens
gttctgttgatcccacttca

SEQ ID NO: 1683599 - DNA, 20 bp, Homo sapiens
gttctgtttggcacttgtat

SEQ ID NO: 1683600 - DNA, 22 bp, Homo sapiens
gttctgtttgttaaaactggca

SEQ ID NO: 1683601 - DNA, 17 bp, Homo sapiens
gttctgttttgttttgt

SEQ ID NO: 1683602 - DNA, 16 bp, Homo sapiens
gttcttaaaaaaataa

SEQ ID NO: 1683603 - DNA, 15 bp, Homo sapiens
gttcttaaaaaggaa

SEQ ID NO: 1683604 - DNA, 22 bp, Homo sapiens
gttcttacctgtatgtctccag

SEQ ID NO: 1683605 - DNA, 21 bp, Homo sapiens
gttcttaggctccatcctgtt

SEQ ID NO: 1683606 - DNA, 19 bp, Homo sapiens
gttcttaggtttactgtga

SEQ ID NO: 1683607 - DNA, 15 bp, Homo sapiens
gttcttatgaggagg

SEQ ID NO: 1683608 - DNA, 20 bp, Homo sapiens
gttcttatgaggaggggagg

SEQ ID NO: 1683609 - DNA, 15 bp, Homo sapiens
gttcttattttagta

SEQ ID NO: 1683610 - DNA, 21 bp, Homo sapiens
gttcttattttgcattccaga

SEQ ID NO: 1683611 - DNA, 17 bp, Homo sapiens
gttcttatttttataac

SEQ ID NO: 1683612 - DNA, 21 bp, Homo sapiens
gttcttcagtgtaatgtgact

SEQ ID NO: 1683613 - DNA, 12 bp, Homo sapiens
gttcttcatgat

SEQ ID NO: 1683614 - DNA, 13 bp, Homo sapiens
gttcttccccaca

SEQ ID NO: 1683615 - DNA, 22 bp, Homo sapiens
gttcttcccccacttcccctcc

SEQ ID NO: 1683616 - DNA, 21 bp, Homo sapiens
gttcttcccttctcttcacta

SEQ ID NO: 1683617 - DNA, 14 bp, Homo sapiens
gttcttcgaggtgg

SEQ ID NO: 1683618 - DNA, 21 bp, Homo sapiens
gttcttgaagaatagtcataa

SEQ ID NO: 1683619 - DNA, 23 bp, Homo sapiens
gttcttgaagcatttcaaagccc

SEQ ID NO: 1683620 - DNA, 12 bp, Homo sapiens
gttcttgaatcc

SEQ ID NO: 1683621 - DNA, 19 bp, Homo sapiens
gttcttgaatcctctatta

SEQ ID NO: 1683622 - DNA, 15 bp, Homo sapiens
gttcttgatgtcatg

SEQ ID NO: 1683623 - DNA, 16 bp, Homo sapiens
gttcttggtaactgat

SEQ ID NO: 1683624 - DNA, 18 bp, Homo sapiens
gttcttgtttttaagttt

SEQ ID NO: 1683625 - DNA, 15 bp, Homo sapiens
gttctttcatctccc

SEQ ID NO: 1683626 - DNA, 15 bp, Homo sapiens
gttctttccggccaa

SEQ ID NO: 1683627 - DNA, 14 bp, Homo sapiens
gttctttcctcttt

SEQ ID NO: 1683628 - DNA, 13 bp, Homo sapiens
gttgggcccagat

SEQ ID NO: 1683629 - DNA, 16 bp, Homo sapiens
gttgggcccagatctg

SEQ ID NO: 1683630 - DNA, 17 bp, Homo sapiens
gttgggcccagatctgg

SEQ ID NO: 1683631 - DNA, 19 bp, Homo sapiens
gttgggcccctgaggagct

SEQ ID NO: 1683632 - DNA, 18 bp, Homo sapiens
gttggggaagggcctgcc

SEQ ID NO: 1683633 - DNA, 22 bp, Homo sapiens
gttgggggagggaagaccagaa

SEQ ID NO: 1683634 - DNA, 15 bp, Homo sapiens
gttgggggctcctgt

SEQ ID NO: 1683635 - DNA, 17 bp, Homo sapiens
gttggtagcaattggca

SEQ ID NO: 1683636 - DNA, 22 bp, Homo sapiens
gttggtcaaggccacctctgcc

SEQ ID NO: 1683637 - DNA, 16 bp, Homo sapiens
gttggtcctctctctg

SEQ ID NO: 1683638 - DNA, 22 bp, Homo sapiens
gttggtgaattttcaaggcctt

SEQ ID NO: 1683639 - DNA, 11 bp, Homo sapiens
gttggtgactg

SEQ ID NO: 1683640 - DNA, 17 bp, Homo sapiens
gttggttcacttcaaag

SEQ ID NO: 1683641 - DNA, 22 bp, Homo sapiens
gttggttccaagtctttgctat

SEQ ID NO: 1683642 - DNA, 20 bp, Homo sapiens
gttgtaaatatttatgtaaa

SEQ ID NO: 1683643 - DNA, 19 bp, Homo sapiens
gttgtaaatgctcgtgtga

SEQ ID NO: 1683644 - DNA, 22 bp, Homo sapiens
gttgtaacttatattgaagaca

SEQ ID NO: 1683645 - DNA, 14 bp, Homo sapiens
gttgtaatgctgca

SEQ ID NO: 1683646 - DNA, 14 bp, Homo sapiens
gttgtaccaagtga

SEQ ID NO: 1683647 - DNA, 15 bp, Homo sapiens
gttgtacttaaatgg

SEQ ID NO: 1683648 - DNA, 15 bp, Homo sapiens
gttgtagacaaagta

SEQ ID NO: 1683649 - DNA, 15 bp, Homo sapiens
gttgtatcatactct

SEQ ID NO: 1683650 - DNA, 21 bp, Homo sapiens
gttgtattgcatgcaatttga

SEQ ID NO: 1683651 - DNA, 21 bp, Homo sapiens
gttgtatttctatatttattt

SEQ ID NO: 1683652 - DNA, 15 bp, Homo sapiens
gttgtcaatattaaa

SEQ ID NO: 1683653 - DNA, 16 bp, Homo sapiens
gttgtcaatattaaat

SEQ ID NO: 1683654 - DNA, 21 bp, Homo sapiens
gttgtcaatattaaatacaga

SEQ ID NO: 1683655 - DNA, 14 bp, Homo sapiens
gttgtccaatttgt

SEQ ID NO: 1683656 - DNA, 19 bp, Homo sapiens
gttgtcctatggacaactt

SEQ ID NO: 1683657 - DNA, 16 bp, Homo sapiens
gttgtcctccccttgg

SEQ ID NO: 1683658 - DNA, 20 bp, Homo sapiens
gttgtctaggagacagagcc

SEQ ID NO: 1683659 - DNA, 18 bp, Homo sapiens
gttgtctattctgagcct

SEQ ID NO: 1683660 - DNA, 18 bp, Homo sapiens
gttgtctctagagcaggg

SEQ ID NO: 1683661 - DNA, 19 bp, Homo sapiens
gttgtctgaagtcactgca

SEQ ID NO: 1683662 - DNA, 19 bp, Homo sapiens
gttgtctgcgcctgaaaag

SEQ ID NO: 1683663 - DNA, 20 bp, Homo sapiens
gttgtctgcgcctgaaaagg

SEQ ID NO: 1683664 - DNA, 22 bp, Homo sapiens
gttgtcttatgtgaaaaattaa

SEQ ID NO: 1683665 - DNA, 23 bp, Homo sapiens
gttgtcttatgtgaaaaattaac

SEQ ID NO: 1683666 - DNA, 15 bp, Homo sapiens
gttgtcttattgcac

SEQ ID NO: 1683667 - DNA, 13 bp, Homo sapiens
gttgtgaataatt

SEQ ID NO: 1683668 - DNA, 14 bp, Homo sapiens
gttgtgaatgttgt

SEQ ID NO: 1683669 - DNA, 20 bp, Homo sapiens
gttgtgatttctgtggatcc

SEQ ID NO: 1683670 - DNA, 13 bp, Homo sapiens
gttgtgcttgagc

SEQ ID NO: 1683671 - DNA, 20 bp, Homo sapiens
gttgtggaaagtagctgcta

SEQ ID NO: 1683672 - DNA, 14 bp, Homo sapiens
gttgtggatatcag

SEQ ID NO: 1683673 - DNA, 12 bp, Homo sapiens
gttgtgggcttt

SEQ ID NO: 1683674 - DNA, 14 bp, Homo sapiens
gttgtgtatagatg

SEQ ID NO: 1683675 - DNA, 20 bp, Homo sapiens
gttgtgtctaggctggaaga

SEQ ID NO: 1683676 - DNA, 16 bp, Homo sapiens
gttgtgtgtgggagtg

SEQ ID NO: 1683677 - DNA, 16 bp, Homo sapiens
gttgtgttcctggctg

SEQ ID NO: 1683678 - DNA, 14 bp, Homo sapiens
gttgtgttgtcacc

SEQ ID NO: 1683679 - DNA, 21 bp, Homo sapiens
gttgtgtttctcgtgctgcat

SEQ ID NO: 1683680 - DNA, 21 bp, Homo sapiens
gttgttaattttattgcaaag

SEQ ID NO: 1683681 - DNA, 21 bp, Homo sapiens
gttgttgccaggttgcagctg

SEQ ID NO: 1683682 - DNA, 12 bp, Homo sapiens
gttgttgctgct

SEQ ID NO: 1683683 - DNA, 13 bp, Homo sapiens
gttgttgttcttt

SEQ ID NO: 1683684 - DNA, 15 bp, Homo sapiens
gttgtttctgaccca

SEQ ID NO: 1683685 - DNA, 17 bp, Homo sapiens
gttgtttgtaaatgcct

SEQ ID NO: 1683686 - DNA, 21 bp, Homo sapiens
gttgttttctactttgcccct

SEQ ID NO: 1683687 - DNA, 16 bp, Homo sapiens
gttgttttttgttcaa

SEQ ID NO: 1683688 - DNA, 11 bp, Homo sapiens
gtttaaaactt

SEQ ID NO: 1683689 - DNA, 13 bp, Homo sapiens
gtttaaaatgtaa

SEQ ID NO: 1683690 - DNA, 13 bp, Homo sapiens
gtttaaaatgtgt

SEQ ID NO: 1683691 - DNA, 17 bp, Homo sapiens
gtttaaacccaagtgct

SEQ ID NO: 1683692 - DNA, 21 bp, Homo sapiens
gtttaaactgattcataataa

SEQ ID NO: 1683693 - DNA, 17 bp, Homo sapiens
gtttaaagaaagtgtat

SEQ ID NO: 1683694 - DNA, 18 bp, Homo sapiens
gtttaaagaaagtgtatt

SEQ ID NO: 1683695 - DNA, 17 bp, Homo sapiens
gtttaaagagtctagat

SEQ ID NO: 1683696 - DNA, 18 bp, Homo sapiens
gtttaaagagtctagatt

SEQ ID NO: 1683697 - DNA, 19 bp, Homo sapiens
gtttaaatatttcaagaca

SEQ ID NO: 1683698 - DNA, 13 bp, Homo sapiens
gtttaaccttaaa

SEQ ID NO: 1683699 - DNA, 15 bp, Homo sapiens
gtttaatagactgag

SEQ ID NO: 1683700 - DNA, 16 bp, Homo sapiens
gtttaatcccagcact

SEQ ID NO: 1683701 - DNA, 14 bp, Homo sapiens
gtttaatctgttat

SEQ ID NO: 1683702 - DNA, 19 bp, Homo sapiens
gtttaatcttttttttaaa

SEQ ID NO: 1683703 - DNA, 18 bp, Homo sapiens
gtttaattaataatatgt

SEQ ID NO: 1683704 - DNA, 21 bp, Homo sapiens
gtttaattaataatatgtact

SEQ ID NO: 1683705 - DNA, 22 bp, Homo sapiens
gtttaattaataatatgtacta

SEQ ID NO: 1683706 - DNA, 15 bp, Homo sapiens
gtttaattctgtctt

SEQ ID NO: 1683707 - DNA, 15 bp, Homo sapiens
gtttaattgtttgtc

SEQ ID NO: 1683708 - DNA, 16 bp, Homo sapiens
gtttacactctttgta

SEQ ID NO: 1683709 - DNA, 20 bp, Homo sapiens
gtttacactgcggaagccaa

SEQ ID NO: 1683710 - DNA, 14 bp, Homo sapiens
gtttacagaaaaat

SEQ ID NO: 1683711 - DNA, 17 bp, Homo sapiens
gtttacataagagaaag

SEQ ID NO: 1683712 - DNA, 16 bp, Homo sapiens
gtttacccatgaagat

SEQ ID NO: 1683713 - DNA, 22 bp, Homo sapiens
gtttacctgaataaatggtagt

SEQ ID NO: 1683714 - DNA, 15 bp, Homo sapiens
gtttacctggggatc

SEQ ID NO: 1683715 - DNA, 23 bp, Homo sapiens
gtttaccttttaattaatgaaat

SEQ ID NO: 1683716 - DNA, 15 bp, Homo sapiens
gtttactgtgaagag

SEQ ID NO: 1683717 - DNA, 24 bp, Homo sapiens
gtttactgtgaagagaatgtattc

SEQ ID NO: 1683718 - DNA, 23 bp, Homo sapiens
gtttactgttttgaaatcaatgc

SEQ ID NO: 1683719 - DNA, 13 bp, Homo sapiens
gtttactttaact

SEQ ID NO: 1683720 - DNA, 16 bp, Homo sapiens
gtttagaagaagtgtg

SEQ ID NO: 1683721 - DNA, 22 bp, Homo sapiens
gtttagaatggaggaagaacaa

SEQ ID NO: 1683722 - DNA, 22 bp, Homo sapiens
gtttagatcccatgtcacctca

SEQ ID NO: 1683723 - DNA, 23 bp, Homo sapiens
gtttagatcccatgtcacctcag

SEQ ID NO: 1683724 - DNA, 14 bp, Homo sapiens
gtttagattttgtg

SEQ ID NO: 1683725 - DNA, 22 bp, Homo sapiens
gtttagattttgtgtttattct

SEQ ID NO: 1683726 - DNA, 13 bp, Homo sapiens
gtttagcagtata

SEQ ID NO: 1683727 - DNA, 12 bp, Homo sapiens
gtttagcctgga

SEQ ID NO: 1683728 - DNA, 13 bp, Homo sapiens
gtttagctttgga

SEQ ID NO: 1683729 - DNA, 15 bp, Homo sapiens
gtttaggctatttgt

SEQ ID NO: 1683730 - DNA, 16 bp, Homo sapiens
gtttagggttctggtg

SEQ ID NO: 1683731 - DNA, 13 bp, Homo sapiens
gtttagtaagttt

SEQ ID NO: 1683732 - DNA, 14 bp, Homo sapiens
gtttagttctgttg

SEQ ID NO: 1683733 - DNA, 19 bp, Homo sapiens
gtttagtttctagaggcct

SEQ ID NO: 1683734 - DNA, 14 bp, Homo sapiens
gtttataattggct

SEQ ID NO: 1683735 - DNA, 15 bp, Homo sapiens
gtttatacactgtgt

SEQ ID NO: 1683736 - DNA, 19 bp, Homo sapiens
gtttatacactgtgtaaat

SEQ ID NO: 1683737 - DNA, 13 bp, Homo sapiens
gtttatacagtgt

SEQ ID NO: 1683738 - DNA, 18 bp, Homo sapiens
gtttatacagtgtacatg

SEQ ID NO: 1683739 - DNA, 22 bp, Homo sapiens
gtttataggagaaagcaaaata

SEQ ID NO: 1683740 - DNA, 19 bp, Homo sapiens
gtttatatggaagaaagta

SEQ ID NO: 1683741 - DNA, 23 bp, Homo sapiens
gtttatcaacttcgctagaaaaa

SEQ ID NO: 1683742 - DNA, 23 bp, Homo sapiens
gtttatgaaatgccactgggaca

SEQ ID NO: 1683743 - DNA, 13 bp, Homo sapiens
gtttatgagccag

SEQ ID NO: 1683744 - DNA, 15 bp, Homo sapiens
gtttatgatatttct

SEQ ID NO: 1683745 - DNA, 17 bp, Homo sapiens
gtttatgatatttcttg

SEQ ID NO: 1683746 - DNA, 21 bp, Homo sapiens
gtttatgatatttcttgcttt

SEQ ID NO: 1683747 - DNA, 19 bp, Homo sapiens
gtttatggatatgctgctt

SEQ ID NO: 1683748 - DNA, 14 bp, Homo sapiens
gtttatggcagaag

SEQ ID NO: 1683749 - DNA, 15 bp, Homo sapiens
gtttatggcctcagc

SEQ ID NO: 1683750 - DNA, 19 bp, Homo sapiens
gtttatgtaaacaaatctt

SEQ ID NO: 1683751 - DNA, 13 bp, Homo sapiens
gtttatgtgtgtg

SEQ ID NO: 1683752 - DNA, 18 bp, Homo sapiens
gtttatgtgttatgaaca

SEQ ID NO: 1683753 - DNA, 15 bp, Homo sapiens
gtttattaaatgctt

SEQ ID NO: 1683754 - DNA, 23 bp, Homo sapiens
gtttattaacaaattatgttaca

SEQ ID NO: 1683755 - DNA, 18 bp, Homo sapiens
gtttattaatcttagtgt

SEQ ID NO: 1683756 - DNA, 17 bp, Homo sapiens
gtttattaatgcctctc

SEQ ID NO: 1683757 - DNA, 14 bp, Homo sapiens
gtttattcaaactg

SEQ ID NO: 1683758 - DNA, 17 bp, Homo sapiens
gtttattcttccagaat

SEQ ID NO: 1683759 - DNA, 19 bp, Homo sapiens
gtttattcttctagagttc

SEQ ID NO: 1683760 - DNA, 15 bp, Homo sapiens
gtttctttcttcctc

SEQ ID NO: 1683761 - DNA, 18 bp, Homo sapiens
gtttctttttacagcatt

SEQ ID NO: 1683762 - DNA, 24 bp, Homo sapiens
gtttctttttacagcattgtcttt

SEQ ID NO: 1683763 - DNA, 13 bp, Homo sapiens
gtttctttttgaa

SEQ ID NO: 1683764 - DNA, 16 bp, Homo sapiens
gtttctttttgaatct

SEQ ID NO: 1683765 - DNA, 21 bp, Homo sapiens
gtttgaaaattagagatcatg

SEQ ID NO: 1683766 - DNA, 23 bp, Homo sapiens
gtttgaagacacagcctcccccg

SEQ ID NO: 1683767 - DNA, 15 bp, Homo sapiens
gtttgaaggaaacag

SEQ ID NO: 1683768 - DNA, 15 bp, Homo sapiens
gtttgaattcagtaa

SEQ ID NO: 1683769 - DNA, 17 bp, Homo sapiens
gtttgagacaagccctg

SEQ ID NO: 1683770 - DNA, 18 bp, Homo sapiens
gtttgagacaagccctgg

SEQ ID NO: 1683771 - DNA, 15 bp, Homo sapiens
gtttgagaccaggct

SEQ ID NO: 1683772 - DNA, 15 bp, Homo sapiens
gtttgagctgccttc

SEQ ID NO: 1683773 - DNA, 16 bp, Homo sapiens
gtttgaggctgcagcg

SEQ ID NO: 1683774 - DNA, 14 bp, Homo sapiens
gtttgagtccctcc

SEQ ID NO: 1683775 - DNA, 18 bp, Homo sapiens
gtttgagtccctccaaag

SEQ ID NO: 1683776 - DNA, 22 bp, Homo sapiens
gtttgagttaatgtgctgagca

SEQ ID NO: 1683777 - DNA, 15 bp, Homo sapiens
gtttgatgtatgtgt

SEQ ID NO: 1683778 - DNA, 18 bp, Homo sapiens
gtttgatgtatgtgtgaa

SEQ ID NO: 1683779 - DNA, 21 bp, Homo sapiens
gtttgatgtatgtgtgaaaca

SEQ ID NO: 1683780 - DNA, 15 bp, Homo sapiens
gtttgattattatgt

SEQ ID NO: 1683781 - DNA, 13 bp, Homo sapiens
gtttgattggctt

SEQ ID NO: 1683782 - DNA, 13 bp, Homo sapiens
gtttgatttcaac

SEQ ID NO: 1683783 - DNA, 18 bp, Homo sapiens
gtttgcaaattaaaaagg

SEQ ID NO: 1683784 - DNA, 20 bp, Homo sapiens
gggcctggcttgctccaggg

SEQ ID NO: 1683785 - DNA, 12 bp, Homo sapiens
gggcctgggcct

SEQ ID NO: 1683786 - DNA, 13 bp, Homo sapiens
gggcctgggcctc

SEQ ID NO: 1683787 - DNA, 20 bp, Homo sapiens
gggcctgtcgtgccagtcct

SEQ ID NO: 1683788 - DNA, 12 bp, Homo sapiens
gggcctgtgcag

SEQ ID NO: 1683789 - DNA, 14 bp, Homo sapiens
gggcctgtgcagca

SEQ ID NO: 1683790 - DNA, 21 bp, Homo sapiens
gggcctgtgcagcagcccagc

SEQ ID NO: 1683791 - DNA, 20 bp, Homo sapiens
gggcctgttctcttggctgc

SEQ ID NO: 1683792 - DNA, 17 bp, Homo sapiens
gggccttagggcactgg

SEQ ID NO: 1683793 - DNA, 23 bp, Homo sapiens
gggccttatcgggctccagccat

SEQ ID NO: 1683794 - DNA, 15 bp, Homo sapiens
gggccttgcccagag

SEQ ID NO: 1683795 - DNA, 23 bp, Homo sapiens
gggccttggatcgctaagctggc

SEQ ID NO: 1683796 - DNA, 15 bp, Homo sapiens
gggcctttgcaagat

SEQ ID NO: 1683797 - DNA, 20 bp, Homo sapiens
gggcctttgttctgggggga

SEQ ID NO: 1683798 - DNA, 14 bp, Homo sapiens
gggccttttctgtg

SEQ ID NO: 1683799 - DNA, 22 bp, Homo sapiens
gggcgagcggcaaaggcccggc

SEQ ID NO: 1683800 - DNA, 14 bp, Homo sapiens
gggcgccctggaag

SEQ ID NO: 1683801 - DNA, 20 bp, Homo sapiens
gggcgctcagacggcggcca

SEQ ID NO: 1683802 - DNA, 22 bp, Homo sapiens
gggcgctcagacggcggccagg

SEQ ID NO: 1683803 - DNA, 23 bp, Homo sapiens
gggcgctcagacggcggccaggc

SEQ ID NO: 1683804 - DNA, 16 bp, Homo sapiens
gggcgctgcagcctcc

SEQ ID NO: 1683805 - DNA, 15 bp, Homo sapiens
gggcgctggcccagc

SEQ ID NO: 1683806 - DNA, 19 bp, Homo sapiens
gggcgctggcccagccggc

SEQ ID NO: 1683807 - DNA, 19 bp, Homo sapiens
gggcggcatccctgcagag

SEQ ID NO: 1683808 - DNA, 12 bp, Homo sapiens
gggcggccaggc

SEQ ID NO: 1683809 - DNA, 15 bp, Homo sapiens
gggcggcggccacgc

SEQ ID NO: 1683810 - DNA, 17 bp, Homo sapiens
gggcgggcagagggctg

SEQ ID NO: 1683811 - DNA, 12 bp, Homo sapiens
gggcgtcagaga

SEQ ID NO: 1683812 - DNA, 15 bp, Homo sapiens
gggcgtctgagctgg

SEQ ID NO: 1683813 - DNA, 20 bp, Homo sapiens
gggcgtggatcgagtgtagc

SEQ ID NO: 1683814 - DNA, 23 bp, Homo sapiens
gggctaagagctagcgctgccgc

SEQ ID NO: 1683815 - DNA, 22 bp, Homo sapiens
gggctacaggatggtgggcagg

SEQ ID NO: 1683816 - DNA, 10 bp, Homo sapiens
gggctaccat

SEQ ID NO: 1683817 - DNA, 12 bp, Homo sapiens
gggctaccatct

SEQ ID NO: 1683818 - DNA, 13 bp, Homo sapiens
gggctactggcag

SEQ ID NO: 1683819 - DNA, 17 bp, Homo sapiens
gggctactggcagctcc

SEQ ID NO: 1683820 - DNA, 18 bp, Homo sapiens
gggctactggcagctcct

SEQ ID NO: 1683821 - DNA, 19 bp, Homo sapiens
gggctactggcagctcctc

SEQ ID NO: 1683822 - DNA, 22 bp, Homo sapiens
gggctagtcttcccttacctca

SEQ ID NO: 1683823 - DNA, 19 bp, Homo sapiens
gggctagtgtgagtggcag

SEQ ID NO: 1683824 - DNA, 22 bp, Homo sapiens
gggctagtgtgagtggcagcca

SEQ ID NO: 1683825 - DNA, 23 bp, Homo sapiens
gggctagtgtgagtggcagccat

SEQ ID NO: 1683826 - DNA, 16 bp, Homo sapiens
gggctatattcctgac

SEQ ID NO: 1683827 - DNA, 22 bp, Homo sapiens
gggctatcaacttaataagata

SEQ ID NO: 1683828 - DNA, 17 bp, Homo sapiens
gggctatggcaaggggg

SEQ ID NO: 1683829 - DNA, 13 bp, Homo sapiens
gggctatttctct

SEQ ID NO: 1683830 - DNA, 16 bp, Homo sapiens
gggctatttctctccc

SEQ ID NO: 1683831 - DNA, 22 bp, Homo sapiens
gggctatttctctccccactga

SEQ ID NO: 1683832 - DNA, 14 bp, Homo sapiens
gggctcacacacct

SEQ ID NO: 1683833 - DNA, 20 bp, Homo sapiens
gggctcactgtgctggggca

SEQ ID NO: 1683834 - DNA, 15 bp, Homo sapiens
gggctcacttctaat

SEQ ID NO: 1683835 - DNA, 12 bp, Homo sapiens
gggctcagggct

SEQ ID NO: 1683836 - DNA, 16 bp, Homo sapiens
gggctccagcatccag

SEQ ID NO: 1683837 - DNA, 22 bp, Homo sapiens
gggctccagcatccagcctgtg

SEQ ID NO: 1683838 - DNA, 13 bp, Homo sapiens
gggctcccagggc

SEQ ID NO: 1683839 - DNA, 14 bp, Homo sapiens
gggctcccaggggt

SEQ ID NO: 1683840 - DNA, 23 bp, Homo sapiens
gggctcccaggggtctccctggc

SEQ ID NO: 1683841 - DNA, 13 bp, Homo sapiens
gggctccctctct

SEQ ID NO: 1683842 - DNA, 13 bp, Homo sapiens
gggctcccttcat

SEQ ID NO: 1683843 - DNA, 22 bp, Homo sapiens
gggctccgaaattccaaggccc

SEQ ID NO: 1683844 - DNA, 11 bp, Homo sapiens
gggctcctgca

SEQ ID NO: 1683845 - DNA, 18 bp, Homo sapiens
gggctcctgcacttactt

SEQ ID NO: 1683846 - DNA, 22 bp, Homo sapiens
gggctcctgcacttacttgctt

SEQ ID NO: 1683847 - DNA, 20 bp, Homo sapiens
gggctcctggaaaggctcag

SEQ ID NO: 1683848 - DNA, 23 bp, Homo sapiens
gggctcctggaaaggctcagtct

SEQ ID NO: 1683849 - DNA, 20 bp, Homo sapiens
gggctcctggctgccaggcg

SEQ ID NO: 1683850 - DNA, 19 bp, Homo sapiens
gggctcctgtggcagctgc

SEQ ID NO: 1683851 - DNA, 23 bp, Homo sapiens
gggctccttcccctgcacctggc

SEQ ID NO: 1683852 - DNA, 18 bp, Homo sapiens
gggctcctttctccagcc

SEQ ID NO: 1683853 - DNA, 22 bp, Homo sapiens
gggctcctttctccagccagca

SEQ ID NO: 1683854 - DNA, 18 bp, Homo sapiens
gggctcgaggggtgggct

SEQ ID NO: 1683855 - DNA, 21 bp, Homo sapiens
gggctctccaaaggggctgct

SEQ ID NO: 1683856 - DNA, 22 bp, Homo sapiens
gggctctccaaaggggctgctg

SEQ ID NO: 1683857 - DNA, 13 bp, Homo sapiens
gggctctccacct

SEQ ID NO: 1683858 - DNA, 19 bp, Homo sapiens
gggctctccacctcagcct

SEQ ID NO: 1683859 - DNA, 12 bp, Homo sapiens
gggctctgaccc

SEQ ID NO: 1683860 - DNA, 15 bp, Homo sapiens
gtttgcacacttgtg

SEQ ID NO: 1683861 - DNA, 18 bp, Homo sapiens
gtttgcaccgcctgccct

SEQ ID NO: 1683862 - DNA, 19 bp, Homo sapiens
gtttgcaccgcctgccctc

SEQ ID NO: 1683863 - DNA, 21 bp, Homo sapiens
gtttgcactcaaatcttaaga

SEQ ID NO: 1683864 - DNA, 23 bp, Homo sapiens
gtttgcactcaaatcttaagaaa

SEQ ID NO: 1683865 - DNA, 19 bp, Homo sapiens
gtttgcactgtatgctgga

SEQ ID NO: 1683866 - DNA, 14 bp, Homo sapiens
gtttgcacttcctc

SEQ ID NO: 1683867 - DNA, 19 bp, Homo sapiens
gtttgcagaaaagcacctg

SEQ ID NO: 1683868 - DNA, 11 bp, Homo sapiens
gtttgcaggcc

SEQ ID NO: 1683869 - DNA, 17 bp, Homo sapiens
gtttgccagtgaagact

SEQ ID NO: 1683870 - DNA, 23 bp, Homo sapiens
gtttgcccaaaatttattttata

SEQ ID NO: 1683871 - DNA, 15 bp, Homo sapiens
gtttgccggatacaa

SEQ ID NO: 1683872 - DNA, 18 bp, Homo sapiens
gtttgccttctactttta

SEQ ID NO: 1683873 - DNA, 16 bp, Homo sapiens
gtttgcttcataaatg

SEQ ID NO: 1683874 - DNA, 17 bp, Homo sapiens
gtttgcttcataaatga

SEQ ID NO: 1683875 - DNA, 19 bp, Homo sapiens
gtttggaaaccacagtcag

SEQ ID NO: 1683876 - DNA, 13 bp, Homo sapiens
gtttggaaggagc

SEQ ID NO: 1683877 - DNA, 16 bp, Homo sapiens
gtttggaccccagctg

SEQ ID NO: 1683878 - DNA, 21 bp, Homo sapiens
gtttggagcactagtttgatt

SEQ ID NO: 1683879 - DNA, 13 bp, Homo sapiens
gtttggaggcccc

SEQ ID NO: 1683880 - DNA, 20 bp, Homo sapiens
gtttggattcttatgtagca

SEQ ID NO: 1683881 - DNA, 14 bp, Homo sapiens
gtttggcaaggaaa

SEQ ID NO: 1683882 - DNA, 14 bp, Homo sapiens
gtttggcacttgta

SEQ ID NO: 1683883 - DNA, 15 bp, Homo sapiens
gtttggcacttgtat

SEQ ID NO: 1683884 - DNA, 17 bp, Homo sapiens
gtttggcacttgtattt

SEQ ID NO: 1683885 - DNA, 14 bp, Homo sapiens
gtttggccctggag

SEQ ID NO: 1683886 - DNA, 16 bp, Homo sapiens
gtttggccctggagcc

SEQ ID NO: 1683887 - DNA, 13 bp, Homo sapiens
gtttggggagaaa

SEQ ID NO: 1683888 - DNA, 20 bp, Homo sapiens
gtttggggatcgatgtgctc

SEQ ID NO: 1683889 - DNA, 21 bp, Homo sapiens
gtttgggggcgccctctctgc

SEQ ID NO: 1683890 - DNA, 15 bp, Homo sapiens
gtttggtttcttcat

SEQ ID NO: 1683891 - DNA, 20 bp, Homo sapiens
gtttgtaaaattgttcctga

SEQ ID NO: 1683892 - DNA, 22 bp, Homo sapiens
gtttgtaaaattgttcctgaat

SEQ ID NO: 1683893 - DNA, 15 bp, Homo sapiens
gtttgtaaataagag

SEQ ID NO: 1683894 - DNA, 17 bp, Homo sapiens
gtttgtaaataagagat

SEQ ID NO: 1683895 - DNA, 15 bp, Homo sapiens
gtttgtaaatgcctc

SEQ ID NO: 1683896 - DNA, 16 bp, Homo sapiens
gtttgtaatactttac

SEQ ID NO: 1683897 - DNA, 16 bp, Homo sapiens
gtttgtagtaaaagtg

SEQ ID NO: 1683898 - DNA, 22 bp, Homo sapiens
gtttgtagtgccactgttgttt

SEQ ID NO: 1683899 - DNA, 20 bp, Homo sapiens
gtttgtatgagatggttaaa

SEQ ID NO: 1683900 - DNA, 14 bp, Homo sapiens
gtttgtatttttta

SEQ ID NO: 1683901 - DNA, 21 bp, Homo sapiens
gtttgtattttttatttacat

SEQ ID NO: 1683902 - DNA, 13 bp, Homo sapiens
gtttgtcagcatc

SEQ ID NO: 1683903 - DNA, 23 bp, Homo sapiens
gtttgtcagcatctgaccatctg

SEQ ID NO: 1683904 - DNA, 17 bp, Homo sapiens
gtttgtcccccggggca

SEQ ID NO: 1683905 - DNA, 16 bp, Homo sapiens
gtttgtctattttaaa

SEQ ID NO: 1683906 - DNA, 12 bp, Homo sapiens
gtttgtggcctc

SEQ ID NO: 1683907 - DNA, 20 bp, Homo sapiens
gtttgtggctgggggcagga

SEQ ID NO: 1683908 - DNA, 21 bp, Homo sapiens
gtttgtgtcaaaactggttta

SEQ ID NO: 1683909 - DNA, 17 bp, Homo sapiens
gtttgtgtgtatttgta

SEQ ID NO: 1683910 - DNA, 16 bp, Homo sapiens
gtttgttaaaaataaa

SEQ ID NO: 1683911 - DNA, 19 bp, Homo sapiens
gtttgttaaaaataaatcc

SEQ ID NO: 1683912 - DNA, 13 bp, Homo sapiens
gtttgttaaaact

SEQ ID NO: 1683913 - DNA, 13 bp, Homo sapiens
gtttgttatttac

SEQ ID NO: 1683914 - DNA, 15 bp, Homo sapiens
gtttgttatttacac

SEQ ID NO: 1683915 - DNA, 17 bp, Homo sapiens
gtttgttatttacactg

SEQ ID NO: 1683916 - DNA, 17 bp, Homo sapiens
gtttgttcataataaaa

SEQ ID NO: 1683917 - DNA, 18 bp, Homo sapiens
gtttgttcttgtttttaa

SEQ ID NO: 1683918 - DNA, 22 bp, Homo sapiens
gtttgtttaaacacttatcttc

SEQ ID NO: 1683919 - DNA, 21 bp, Homo sapiens
gtttgtttctccccctgggct

SEQ ID NO: 1683920 - DNA, 11 bp, Homo sapiens
gtttgtttgtc

SEQ ID NO: 1683921 - DNA, 14 bp, Homo sapiens
gtttgtttttgcgt

SEQ ID NO: 1683922 - DNA, 15 bp, Homo sapiens
gtttgtttttttgcc

SEQ ID NO: 1683923 - DNA, 15 bp, Homo sapiens
gttttaaaaagccag

SEQ ID NO: 1683924 - DNA, 14 bp, Homo sapiens
gttttaaaattaaa

SEQ ID NO: 1683925 - DNA, 19 bp, Homo sapiens
gttttaaacatagaaagtt

SEQ ID NO: 1683926 - DNA, 16 bp, Homo sapiens
gttttaaactttcaat

SEQ ID NO: 1683927 - DNA, 16 bp, Homo sapiens
gttttaaatctgcttt

SEQ ID NO: 1683928 - DNA, 20 bp, Homo sapiens
gttttaaccgcacatgcaca

SEQ ID NO: 1683929 - DNA, 16 bp, Homo sapiens
gttttaactcttttgg

SEQ ID NO: 1683930 - DNA, 18 bp, Homo sapiens
gttttaagctaaaatgtt

SEQ ID NO: 1683931 - DNA, 20 bp, Homo sapiens
gttttaagctaaaatgttac

SEQ ID NO: 1683932 - DNA, 19 bp, Homo sapiens
gttttaatacttgtaattc

SEQ ID NO: 1683933 - DNA, 12 bp, Homo sapiens
gttttaatctta

SEQ ID NO: 1683934 - DNA, 19 bp, Homo sapiens
gttttacagagaggataca

SEQ ID NO: 1683935 - DNA, 15 bp, Homo sapiens
gttttactgtctatt

SEQ ID NO: 1683936 - DNA, 18 bp, Homo sapiens
gttttagcatttgtataa

SEQ ID NO: 1683937 - DNA, 16 bp, Homo sapiens
gttttaggtagaaaaa

SEQ ID NO: 1683938 - DNA, 17 bp, Homo sapiens
gttttaggtagaaaaac

SEQ ID NO: 1683939 - DNA, 12 bp, Homo sapiens
gttttaggttct

SEQ ID NO: 1683940 - DNA, 13 bp, Homo sapiens
gttttagtgtctg

SEQ ID NO: 1683941 - DNA, 17 bp, Homo sapiens
gttttagtgtctgacct

SEQ ID NO: 1683942 - DNA, 21 bp, Homo sapiens
gttttagttgcagaaacattt

SEQ ID NO: 1683943 - DNA, 14 bp, Homo sapiens
gttttataaaatag

SEQ ID NO: 1683944 - DNA, 21 bp, Homo sapiens
gttttataatttaataaaaag

SEQ ID NO: 1683945 - DNA, 15 bp, Homo sapiens
gttttatactgaagg

SEQ ID NO: 1683946 - DNA, 22 bp, Homo sapiens
gttttatctgggtacaaataaa

SEQ ID NO: 1683947 - DNA, 19 bp, Homo sapiens
gttttatttacttctgtat

SEQ ID NO: 1683948 - DNA, 12 bp, Homo sapiens
gttttatttcat

SEQ ID NO: 1683949 - DNA, 22 bp, Homo sapiens
taaaaagagtaatttcatttaa

SEQ ID NO: 1683950 - DNA, 18 bp, Homo sapiens
taaaaagattgaagtatt

SEQ ID NO: 1683951 - DNA, 18 bp, Homo sapiens
taaaaagcagaattttaa

SEQ ID NO: 1683952 - DNA, 15 bp, Homo sapiens
taaaaaggaaatttg

SEQ ID NO: 1683953 - DNA, 18 bp, Homo sapiens
taaaaaggaattttgtaa

SEQ ID NO: 1683954 - DNA, 19 bp, Homo sapiens
taaaaaggccaaagataaa

SEQ ID NO: 1683955 - DNA, 16 bp, Homo sapiens
taaaaataaaaaagat

SEQ ID NO: 1683956 - DNA, 17 bp, Homo sapiens
taaaaataaaaaagatc

SEQ ID NO: 1683957 - DNA, 19 bp, Homo sapiens
taaaaataaaatctgtaaa

SEQ ID NO: 1683958 - DNA, 18 bp, Homo sapiens
taaaaataaaatgcattt

SEQ ID NO: 1683959 - DNA, 19 bp, Homo sapiens
taaaaataaaatgcattta

SEQ ID NO: 1683960 - DNA, 14 bp, Homo sapiens
taaaaataaattca

SEQ ID NO: 1683961 - DNA, 15 bp, Homo sapiens
taaaaataactgtaa

SEQ ID NO: 1683962 - DNA, 19 bp, Homo sapiens
taaaaataagtcaacagta

SEQ ID NO: 1683963 - DNA, 20 bp, Homo sapiens
taaaaatacacatgaaaaca

SEQ ID NO: 1683964 - DNA, 19 bp, Homo sapiens
taaaaatagaatacatttt

SEQ ID NO: 1683965 - DNA, 14 bp, Homo sapiens
taaaaatagacagt

SEQ ID NO: 1683966 - DNA, 23 bp, Homo sapiens
taaaaatagatcaataaatgtca

SEQ ID NO: 1683967 - DNA, 18 bp, Homo sapiens
taaaaatatccttgatgt

SEQ ID NO: 1683968 - DNA, 22 bp, Homo sapiens
taaaaatattgtgttgtgaatg

SEQ ID NO: 1683969 - DNA, 13 bp, Homo sapiens
taaaaatatttca

SEQ ID NO: 1683970 - DNA, 21 bp, Homo sapiens
taaaaatatttcagatatcaa

SEQ ID NO: 1683971 - DNA, 22 bp, Homo sapiens
taaaaatctaagcagcttattg

SEQ ID NO: 1683972 - DNA, 15 bp, Homo sapiens
taaaaatctcttttc

SEQ ID NO: 1683973 - DNA, 11 bp, Homo sapiens
taaaaatgaag

SEQ ID NO: 1683974 - DNA, 13 bp, Homo sapiens
taaaaatgctttt

SEQ ID NO: 1683975 - DNA, 17 bp, Homo sapiens
taaaaatgggtgttatt

SEQ ID NO: 1683976 - DNA, 20 bp, Homo sapiens
taaaaatgtaaatattctat

SEQ ID NO: 1683977 - DNA, 15 bp, Homo sapiens
taaaaattaatagtt

SEQ ID NO: 1683978 - DNA, 20 bp, Homo sapiens
taaaaattacctttaatttt

SEQ ID NO: 1683979 - DNA, 14 bp, Homo sapiens
taaaaattatcaaa

SEQ ID NO: 1683980 - DNA, 22 bp, Homo sapiens
taaaaattgaatgtggctgaag

SEQ ID NO: 1683981 - DNA, 17 bp, Homo sapiens
taaaaattgtgatcaga

SEQ ID NO: 1683982 - DNA, 15 bp, Homo sapiens
taaaaatttactaca

SEQ ID NO: 1683983 - DNA, 19 bp, Homo sapiens
taaaaatttactacaatat

SEQ ID NO: 1683984 - DNA, 21 bp, Homo sapiens
taaaacaaaatttgactaatt

SEQ ID NO: 1683985 - DNA, 17 bp, Homo sapiens
taaaacaaaatttgttt

SEQ ID NO: 1683986 - DNA, 23 bp, Homo sapiens
taaaacaaagattgattgatttt

SEQ ID NO: 1683987 - DNA, 17 bp, Homo sapiens
taaaacaagggaaaaat

SEQ ID NO: 1683988 - DNA, 19 bp, Homo sapiens
taaaacaagggaaaaattt

SEQ ID NO: 1683989 - DNA, 19 bp, Homo sapiens
taaaacaataaatgaatga

SEQ ID NO: 1683990 - DNA, 14 bp, Homo sapiens
taaaacaatattgt

SEQ ID NO: 1683991 - DNA, 17 bp, Homo sapiens
taaaacaatgccatgaa

SEQ ID NO: 1683992 - DNA, 23 bp, Homo sapiens
taaaacaatgccatgaacaaatt

SEQ ID NO: 1683993 - DNA, 21 bp, Homo sapiens
taaaacaattctgtgacatac

SEQ ID NO: 1683994 - DNA, 14 bp, Homo sapiens
taaaacacacaggt

SEQ ID NO: 1683995 - DNA, 21 bp, Homo sapiens
taaaacacacctaagagaaaa

SEQ ID NO: 1683996 - DNA, 18 bp, Homo sapiens
taaaacagacactggcat

SEQ ID NO: 1683997 - DNA, 21 bp, Homo sapiens
taaaacatggtgcctatatct

SEQ ID NO: 1683998 - DNA, 14 bp, Homo sapiens
taaaacatgtaata

SEQ ID NO: 1683999 - DNA, 13 bp, Homo sapiens
taaaaccacagca

SEQ ID NO: 1684000 - DNA, 14 bp, Homo sapiens
taaaaccacagcag

SEQ ID NO: 1684001 - DNA, 18 bp, Homo sapiens
taaaaccacagctgggca

SEQ ID NO: 1684002 - DNA, 19 bp, Homo sapiens
taaaacgaatggtctttgc

SEQ ID NO: 1684003 - DNA, 22 bp, Homo sapiens
taaaactatggttcccaataaa

SEQ ID NO: 1684004 - DNA, 12 bp, Homo sapiens
taaaactcagaa

SEQ ID NO: 1684005 - DNA, 17 bp, Homo sapiens
taaaactcagaatataa

SEQ ID NO: 1684006 - DNA, 18 bp, Homo sapiens
taaaactcagttaaaatg

SEQ ID NO: 1684007 - DNA, 16 bp, Homo sapiens
taaaactggcatctga

SEQ ID NO: 1684008 - DNA, 18 bp, Homo sapiens
taaaactgggtcatcatt

SEQ ID NO: 1684009 - DNA, 16 bp, Homo sapiens
taaaacttaaaaacaa

SEQ ID NO: 1684010 - DNA, 18 bp, Homo sapiens
taaaacttatgctagttt

SEQ ID NO: 1684011 - DNA, 22 bp, Homo sapiens
taaaacttgatgtgttatctct

SEQ ID NO: 1684012 - DNA, 15 bp, Homo sapiens
taaaactttcctcgc

SEQ ID NO: 1684013 - DNA, 16 bp, Homo sapiens
taaaactttggtgcat

SEQ ID NO: 1684014 - DNA, 13 bp, Homo sapiens
taaaagaatattt

SEQ ID NO: 1684015 - DNA, 20 bp, Homo sapiens
taaaagaatttttttgtctt

SEQ ID NO: 1684016 - DNA, 16 bp, Homo sapiens
taaaagagagagagag

SEQ ID NO: 1684017 - DNA, 19 bp, Homo sapiens
taaaagagagagagagaaa

SEQ ID NO: 1684018 - DNA, 16 bp, Homo sapiens
taaaagagatttcaag

SEQ ID NO: 1684019 - DNA, 20 bp, Homo sapiens
taaaagagatttcaagagat

SEQ ID NO: 1684020 - DNA, 19 bp, Homo sapiens
taaaagagctcagacattt

SEQ ID NO: 1684021 - DNA, 23 bp, Homo sapiens
taaaagataacaagatctttcag

SEQ ID NO: 1684022 - DNA, 14 bp, Homo sapiens
taaaagatcctttt

SEQ ID NO: 1684023 - DNA, 20 bp, Homo sapiens
taaaagattcatttttaatc

SEQ ID NO: 1684024 - DNA, 15 bp, Homo sapiens
taaaagcaaaagaga

SEQ ID NO: 1684025 - DNA, 14 bp, Homo sapiens
taaaagcctgctca

SEQ ID NO: 1684026 - DNA, 16 bp, Homo sapiens
taaaagccttattcta

SEQ ID NO: 1684027 - DNA, 19 bp, Homo sapiens
taaaagccttggcctcaga

SEQ ID NO: 1684028 - DNA, 21 bp, Homo sapiens
taaaatacacactcaaatcaa

SEQ ID NO: 1684029 - DNA, 23 bp, Homo sapiens
taaaatacagctgcactgaggca

SEQ ID NO: 1684030 - DNA, 20 bp, Homo sapiens
taaaatacctctaataaaca

SEQ ID NO: 1684031 - DNA, 15 bp, Homo sapiens
taaaatactattgcc

SEQ ID NO: 1684032 - DNA, 20 bp, Homo sapiens
taaaatacttttactctgcc

SEQ ID NO: 1684033 - DNA, 14 bp, Homo sapiens
taaaatagaaaaag

SEQ ID NO: 1684034 - DNA, 22 bp, Homo sapiens
taaaatagaaatatagccaaaa

SEQ ID NO: 1684035 - DNA, 18 bp, Homo sapiens
taaaatagaataattctt

SEQ ID NO: 1684036 - DNA, 22 bp, Homo sapiens
taaaatagaataattcttttct

SEQ ID NO: 1684037 - DNA, 23 bp, Homo sapiens
taaaatagagtgtagtttacaga

SEQ ID NO: 1684038 - DNA, 21 bp, Homo sapiens
taaaatagcaacactctatat

SEQ ID NO: 1684039 - DNA, 14 bp, Homo sapiens
taaaatataaacaa

SEQ ID NO: 1684040 - DNA, 15 bp, Homo sapiens
taaaatatattgctg

SEQ ID NO: 1684041 - DNA, 15 bp, Homo sapiens
taaaatatcataaag

SEQ ID NO: 1684042 - DNA, 16 bp, Homo sapiens
taaaatatcctcaggg

SEQ ID NO: 1684043 - DNA, 13 bp, Homo sapiens
taaaatattcact

SEQ ID NO: 1684044 - DNA, 14 bp, Homo sapiens
taaaatattcactc

SEQ ID NO: 1684045 - DNA, 18 bp, Homo sapiens
taaaatattcactctcca

SEQ ID NO: 1684046 - DNA, 19 bp, Homo sapiens
taaaatattcactctccat

SEQ ID NO: 1684047 - DNA, 23 bp, Homo sapiens
taaaatatttaaacctttttctt

SEQ ID NO: 1684048 - DNA, 15 bp, Homo sapiens
taaaatatttatgaa

SEQ ID NO: 1684049 - DNA, 18 bp, Homo sapiens
taaaatatttatgaagaa

SEQ ID NO: 1684050 - DNA, 21 bp, Homo sapiens
taaaatatttatgaagaaaat

SEQ ID NO: 1684051 - DNA, 22 bp, Homo sapiens
taaaatatttatgaagaaaata

SEQ ID NO: 1684052 - DNA, 17 bp, Homo sapiens
taaaatatttgcctttt

SEQ ID NO: 1684053 - DNA, 21 bp, Homo sapiens
taaaatatttgtctttaaaca

SEQ ID NO: 1684054 - DNA, 13 bp, Homo sapiens
taaaatattttca

SEQ ID NO: 1684055 - DNA, 20 bp, Homo sapiens
taaaatatttttttcctatg

SEQ ID NO: 1684056 - DNA, 17 bp, Homo sapiens
taaaatcaaatgtaaat

SEQ ID NO: 1684057 - DNA, 20 bp, Homo sapiens
taaaatcagctattttgtga

SEQ ID NO: 1684058 - DNA, 12 bp, Homo sapiens
taaaatcatgaa

SEQ ID NO: 1684059 - DNA, 18 bp, Homo sapiens
taaaatcatttctgcatc

SEQ ID NO: 1684060 - DNA, 20 bp, Homo sapiens
taaaatctgaattttgcaat

SEQ ID NO: 1684061 - DNA, 13 bp, Homo sapiens
taaaatcttaaac

SEQ ID NO: 1684062 - DNA, 17 bp, Homo sapiens
taaaatcttatagttct

SEQ ID NO: 1684063 - DNA, 19 bp, Homo sapiens
taaaatcttatagttctag

SEQ ID NO: 1684064 - DNA, 14 bp, Homo sapiens
taaaatgaaagatt

SEQ ID NO: 1684065 - DNA, 23 bp, Homo sapiens
taaaatgaacatctcttgaaacc

SEQ ID NO: 1684066 - DNA, 13 bp, Homo sapiens
taaaatgcaaaaa

SEQ ID NO: 1684067 - DNA, 19 bp, Homo sapiens
taaaatgcaaaaaatctta

SEQ ID NO: 1684068 - DNA, 20 bp, Homo sapiens
taaaatgcaaaaaatcttaa

SEQ ID NO: 1684069 - DNA, 16 bp, Homo sapiens
taaaatgccatagttt

SEQ ID NO: 1684070 - DNA, 20 bp, Homo sapiens
taaaatgccatagtttgtga

SEQ ID NO: 1684071 - DNA, 12 bp, Homo sapiens
taaaatggaaaa

SEQ ID NO: 1684072 - DNA, 23 bp, Homo sapiens
taaaatggggataataatactga

SEQ ID NO: 1684073 - DNA, 21 bp, Homo sapiens
taaaatgtaatttaaatgaaa

SEQ ID NO: 1684074 - DNA, 20 bp, Homo sapiens
taaaatgtcggatttatctt

SEQ ID NO: 1684075 - DNA, 17 bp, Homo sapiens
taaaatgtgatgttcta

SEQ ID NO: 1684076 - DNA, 22 bp, Homo sapiens
taaaatgtgatgttctaaggct

SEQ ID NO: 1684077 - DNA, 19 bp, Homo sapiens
taaaatgtgatttttctga

SEQ ID NO: 1684078 - DNA, 20 bp, Homo sapiens
taaaatgtgggattatgggt

SEQ ID NO: 1684079 - DNA, 23 bp, Homo sapiens
taaaatgtgggattatgggtcac

SEQ ID NO: 1684080 - DNA, 14 bp, Homo sapiens
taaaatgtgtacag

SEQ ID NO: 1684081 - DNA, 21 bp, Homo sapiens
taaaatgtgtatttttcaagg

SEQ ID NO: 1684082 - DNA, 16 bp, Homo sapiens
taaaatgtttactgta

SEQ ID NO: 1684083 - DNA, 19 bp, Homo sapiens
taaaatgtttactgtaaat

SEQ ID NO: 1684084 - DNA, 14 bp, Homo sapiens
taaaattaaagcta

SEQ ID NO: 1684085 - DNA, 19 bp, Homo sapiens
taaaattaagtatatatat

SEQ ID NO: 1684086 - DNA, 18 bp, Homo sapiens
taaaattaagttgaaaaa

SEQ ID NO: 1684087 - DNA, 21 bp, Homo sapiens
taaaattagtcttttgtaata

SEQ ID NO: 1684088 - DNA, 13 bp, Homo sapiens
taaaattatttca

SEQ ID NO: 1684089 - DNA, 22 bp, Homo sapiens
taaaattcaaaaacaaaattag

SEQ ID NO: 1684090 - DNA, 15 bp, Homo sapiens
taaaattcaacaaat

SEQ ID NO: 1684091 - DNA, 14 bp, Homo sapiens
taaaattcagtttt

SEQ ID NO: 1684092 - DNA, 22 bp, Homo sapiens
taaaattcagtttttttccagt

SEQ ID NO: 1684093 - DNA, 12 bp, Homo sapiens
taaaattctagt

SEQ ID NO: 1684094 - DNA, 20 bp, Homo sapiens
taaaattctagtctctgatt

SEQ ID NO: 1684095 - DNA, 15 bp, Homo sapiens
taaaattctcttcca

SEQ ID NO: 1684096 - DNA, 20 bp, Homo sapiens
taaaattctgatgtttctgt

SEQ ID NO: 1684097 - DNA, 13 bp, Homo sapiens
taaaattgatttt

SEQ ID NO: 1684098 - DNA, 14 bp, Homo sapiens
taaaattggcacca

SEQ ID NO: 1684099 - DNA, 17 bp, Homo sapiens
taaaattggcaccatgt

SEQ ID NO: 1684100 - DNA, 15 bp, Homo sapiens
taaaattgtgatgtg

SEQ ID NO: 1684101 - DNA, 17 bp, Homo sapiens
taaaatttacatttaat

SEQ ID NO: 1684102 - DNA, 18 bp, Homo sapiens
taaaatttccttcaggtt

SEQ ID NO: 1684103 - DNA, 15 bp, Homo sapiens
taaacataattcttg

SEQ ID NO: 1684104 - DNA, 19 bp, Homo sapiens
taaacataattgtggatta

SEQ ID NO: 1684105 - DNA, 20 bp, Homo sapiens
taaacatatttttatacttt

SEQ ID NO: 1684106 - DNA, 16 bp, Homo sapiens
taaacatcacacacac

SEQ ID NO: 1684107 - DNA, 17 bp, Homo sapiens
taaacattaaacactgt

SEQ ID NO: 1684108 - DNA, 20 bp, Homo sapiens
taaacattaatagcagcctt

SEQ ID NO: 1684109 - DNA, 19 bp, Homo sapiens
taaacattaatatttacca

SEQ ID NO: 1684110 - DNA, 18 bp, Homo sapiens
taaacattaattttgtgc

SEQ ID NO: 1684111 - DNA, 20 bp, Homo sapiens
taaacattaattttgtgcat

SEQ ID NO: 1684112 - DNA, 21 bp, Homo sapiens
taaacattcaattccagagaa

SEQ ID NO: 1684113 - DNA, 16 bp, Homo sapiens
taaacatttgttcctg

SEQ ID NO: 1684114 - DNA, 18 bp, Homo sapiens
taaacatttgttcctgga

SEQ ID NO: 1684115 - DNA, 21 bp, Homo sapiens
taaaccatttttgctgaattc

SEQ ID NO: 1684116 - DNA, 13 bp, Homo sapiens
taaacccatacaa

SEQ ID NO: 1684117 - DNA, 14 bp, Homo sapiens
taaacccatacaat

SEQ ID NO: 1684118 - DNA, 16 bp, Homo sapiens
taaacccatacaatgt

SEQ ID NO: 1684119 - DNA, 18 bp, Homo sapiens
taaacccatacaatgtat

SEQ ID NO: 1684120 - DNA, 20 bp, Homo sapiens
taaacccgaatcattgtttt

SEQ ID NO: 1684121 - DNA, 14 bp, Homo sapiens
taaacctaatattc

SEQ ID NO: 1684122 - DNA, 15 bp, Homo sapiens
taaacctaatattca

SEQ ID NO: 1684123 - DNA, 18 bp, Homo sapiens
taaacctcaaaatgtcta

SEQ ID NO: 1684124 - DNA, 19 bp, Homo sapiens
taaacctcaaaatgtctaa

SEQ ID NO: 1684125 - DNA, 18 bp, Homo sapiens
taaacctgggctcagcct

SEQ ID NO: 1684126 - DNA, 19 bp, Homo sapiens
taaacctgtttttttttca

SEQ ID NO: 1684127 - DNA, 21 bp, Homo sapiens
taaacctgtttttttttcatt

SEQ ID NO: 1684128 - DNA, 15 bp, Homo sapiens
taaaccttaagtaag

SEQ ID NO: 1684129 - DNA, 16 bp, Homo sapiens
taaaccttagtactga

SEQ ID NO: 1684130 - DNA, 14 bp, Homo sapiens
taaacctttttctt

SEQ ID NO: 1684131 - DNA, 16 bp, Homo sapiens
taaacctttttcttga

SEQ ID NO: 1684132 - DNA, 17 bp, Homo sapiens
taaacctttttcttgat

SEQ ID NO: 1684133 - DNA, 21 bp, Homo sapiens
taaacctttttcttgatctta

SEQ ID NO: 1684134 - DNA, 22 bp, Homo sapiens
taaacctttttcttgatcttaa

SEQ ID NO: 1684135 - DNA, 22 bp, Homo sapiens
taaacgtgatgatcagctgttt

SEQ ID NO: 1684136 - DNA, 20 bp, Homo sapiens
taaactaaaatctgttacca

SEQ ID NO: 1684137 - DNA, 18 bp, Homo sapiens
taaactacaaagtaaaat

SEQ ID NO: 1684138 - DNA, 22 bp, Homo sapiens
taaactatcttggtgaattttt

SEQ ID NO: 1684139 - DNA, 23 bp, Homo sapiens
taaactatgttcctaacaaaatg

SEQ ID NO: 1684140 - DNA, 18 bp, Homo sapiens
taaactattagagtattt

SEQ ID NO: 1684141 - DNA, 23 bp, Homo sapiens
taaactattagagtatttccctt

SEQ ID NO: 1684142 - DNA, 13 bp, Homo sapiens
taaactatttata

SEQ ID NO: 1684143 - DNA, 17 bp, Homo sapiens
taaactatttatatcac

SEQ ID NO: 1684144 - DNA, 14 bp, Homo sapiens
taaactcaaaatat

SEQ ID NO: 1684145 - DNA, 16 bp, Homo sapiens
taaactcaaaatattt

SEQ ID NO: 1684146 - DNA, 19 bp, Homo sapiens
taaactcaaaatatttgta

SEQ ID NO: 1684147 - DNA, 23 bp, Homo sapiens
taaactcaaaatatttgtacata

SEQ ID NO: 1684148 - DNA, 15 bp, Homo sapiens
taaactcagatctga

SEQ ID NO: 1684149 - DNA, 21 bp, Homo sapiens
taaactccttcctggcctgag

SEQ ID NO: 1684150 - DNA, 12 bp, Homo sapiens
taaactctcccc

SEQ ID NO: 1684151 - DNA, 21 bp, Homo sapiens
taaactctgaatttatctttg

SEQ ID NO: 1684152 - DNA, 18 bp, Homo sapiens
taaactctggacactcta

SEQ ID NO: 1684153 - DNA, 22 bp, Homo sapiens
taaactgaaacatgcacatttt

SEQ ID NO: 1684154 - DNA, 19 bp, Homo sapiens
taaactgactttttccccc

SEQ ID NO: 1684155 - DNA, 20 bp, Homo sapiens
taaactgactttttcccccc

SEQ ID NO: 1684156 - DNA, 12 bp, Homo sapiens
taaactgagcct

SEQ ID NO: 1684157 - DNA, 16 bp, Homo sapiens
taaactgcattagaaa

SEQ ID NO: 1684158 - DNA, 21 bp, Homo sapiens
taaactggaaaggatctgtga

SEQ ID NO: 1684159 - DNA, 19 bp, Homo sapiens
taaactgtgaaaaatcaga

SEQ ID NO: 1684160 - DNA, 15 bp, Homo sapiens
taaactgtgtacata

SEQ ID NO: 1684161 - DNA, 12 bp, Homo sapiens
taaactgttttc

SEQ ID NO: 1684162 - DNA, 19 bp, Homo sapiens
taaacttagaggaaaatga

SEQ ID NO: 1684163 - DNA, 22 bp, Homo sapiens
taaacttagtgcggacaagttt

SEQ ID NO: 1684164 - DNA, 13 bp, Homo sapiens
taaacttccaaag

SEQ ID NO: 1684165 - DNA, 17 bp, Homo sapiens
taaacttccaaagaaag

SEQ ID NO: 1684166 - DNA, 13 bp, Homo sapiens
taaacttgaaata

SEQ ID NO: 1684167 - DNA, 14 bp, Homo sapiens
taaacttgaaatat

SEQ ID NO: 1684168 - DNA, 18 bp, Homo sapiens
taaacttgaaatatataa

SEQ ID NO: 1684169 - DNA, 14 bp, Homo sapiens
taaacttgtcagaa

SEQ ID NO: 1684170 - DNA, 17 bp, Homo sapiens
taaacttgtttgctgtg

SEQ ID NO: 1684171 - DNA, 20 bp, Homo sapiens
taaacttgtttgctgtgaac

SEQ ID NO: 1684172 - DNA, 18 bp, Homo sapiens
taaactttagagtagcat

SEQ ID NO: 1684173 - DNA, 16 bp, Homo sapiens
taaactttatcactta

SEQ ID NO: 1684174 - DNA, 12 bp, Homo sapiens
taaactttattt

SEQ ID NO: 1684175 - DNA, 16 bp, Homo sapiens
taaagtgattaaacgt

SEQ ID NO: 1684176 - DNA, 18 bp, Homo sapiens
taaagtgattaaacgtgc

SEQ ID NO: 1684177 - DNA, 15 bp, Homo sapiens
taaagtgctaaggtt

SEQ ID NO: 1684178 - DNA, 20 bp, Homo sapiens
taaagtgctaaggttctaag

SEQ ID NO: 1684179 - DNA, 22 bp, Homo sapiens
taaagtgctaaggttctaaggc

SEQ ID NO: 1684180 - DNA, 13 bp, Homo sapiens
taaagtgtgtgat

SEQ ID NO: 1684181 - DNA, 17 bp, Homo sapiens
taaagtgtgtttctatg

SEQ ID NO: 1684182 - DNA, 20 bp, Homo sapiens
taaagtgttctgccagatct

SEQ ID NO: 1684183 - DNA, 17 bp, Homo sapiens
taaagttacttgaattt

SEQ ID NO: 1684184 - DNA, 16 bp, Homo sapiens
taaagttactttgtca

SEQ ID NO: 1684185 - DNA, 20 bp, Homo sapiens
taaagttagtatcttttgat

SEQ ID NO: 1684186 - DNA, 14 bp, Homo sapiens
taaagttccttaag

SEQ ID NO: 1684187 - DNA, 20 bp, Homo sapiens
taaagttccttaagcatctg

SEQ ID NO: 1684188 - DNA, 17 bp, Homo sapiens
taaagttctaagattct

SEQ ID NO: 1684189 - DNA, 19 bp, Homo sapiens
taaagttctaagattctga

SEQ ID NO: 1684190 - DNA, 22 bp, Homo sapiens
taaagttctaagattctgattt

SEQ ID NO: 1684191 - DNA, 20 bp, Homo sapiens
taaagttggttcacttcaaa

SEQ ID NO: 1684192 - DNA, 16 bp, Homo sapiens
taaagttgtactttaa

SEQ ID NO: 1684193 - DNA, 22 bp, Homo sapiens
taaagttgtactttaaaaattt

SEQ ID NO: 1684194 - DNA, 16 bp, Homo sapiens
taaagttgtttcccac

SEQ ID NO: 1684195 - DNA, 11 bp, Homo sapiens
taaagtttaca

SEQ ID NO: 1684196 - DNA, 14 bp, Homo sapiens
taaagtttccatta

SEQ ID NO: 1684197 - DNA, 16 bp, Homo sapiens
taaagtttctagaatt

SEQ ID NO: 1684198 - DNA, 20 bp, Homo sapiens
taaagtttctagaattttat

SEQ ID NO: 1684199 - DNA, 13 bp, Homo sapiens
taaagtttctcag

SEQ ID NO: 1684200 - DNA, 14 bp, Homo sapiens
taaagtttctcaga

SEQ ID NO: 1684201 - DNA, 14 bp, Homo sapiens
taaagttttagggt

SEQ ID NO: 1684202 - DNA, 14 bp, Homo sapiens
taaataaaaactaa

SEQ ID NO: 1684203 - DNA, 19 bp, Homo sapiens
taaataaaaatatgtaatt

SEQ ID NO: 1684204 - DNA, 15 bp, Homo sapiens
taaataaaaatgtct

SEQ ID NO: 1684205 - DNA, 22 bp, Homo sapiens
taaataaaagcacaagtacttt

SEQ ID NO: 1684206 - DNA, 18 bp, Homo sapiens
taaataaaatcatgtagt

SEQ ID NO: 1684207 - DNA, 14 bp, Homo sapiens
taaataaaatgtgt

SEQ ID NO: 1684208 - DNA, 17 bp, Homo sapiens
taaataaaatgtgtaca

SEQ ID NO: 1684209 - DNA, 21 bp, Homo sapiens
taaataaaatgtgtacagtga

SEQ ID NO: 1684210 - DNA, 22 bp, Homo sapiens
taaataaacctcaaaatgtcta

SEQ ID NO: 1684211 - DNA, 22 bp, Homo sapiens
taaataaatgtatcttattcac

SEQ ID NO: 1684212 - DNA, 18 bp, Homo sapiens
taaataacaaaactgtgc

SEQ ID NO: 1684213 - DNA, 22 bp, Homo sapiens
taaataaccttcatcaagaaat

SEQ ID NO: 1684214 - DNA, 14 bp, Homo sapiens
taaataactggaaa

SEQ ID NO: 1684215 - DNA, 15 bp, Homo sapiens
taaataactggaaaa

SEQ ID NO: 1684216 - DNA, 14 bp, Homo sapiens
taaataactgtgtg

SEQ ID NO: 1684217 - DNA, 15 bp, Homo sapiens
taaataagagatttg

SEQ ID NO: 1684218 - DNA, 20 bp, Homo sapiens
taaataagtttgcaatttgg

SEQ ID NO: 1684219 - DNA, 21 bp, Homo sapiens
taaataattgcatcagttcat

SEQ ID NO: 1684220 - DNA, 14 bp, Homo sapiens
taaataatttctac

SEQ ID NO: 1684221 - DNA, 14 bp, Homo sapiens
taaatacaaaaatg

SEQ ID NO: 1684222 - DNA, 16 bp, Homo sapiens
taaatacaacacatct

SEQ ID NO: 1684223 - DNA, 17 bp, Homo sapiens
taaatacaacacatcta

SEQ ID NO: 1684224 - DNA, 19 bp, Homo sapiens
taaatacacatagcatgta

SEQ ID NO: 1684225 - DNA, 23 bp, Homo sapiens
taaatacaccacctcactcctgt

SEQ ID NO: 1684226 - DNA, 16 bp, Homo sapiens
taaatacagacactaa

SEQ ID NO: 1684227 - DNA, 18 bp, Homo sapiens
taaatacagacactaagt

SEQ ID NO: 1684228 - DNA, 22 bp, Homo sapiens
taaatacagacactaagttata

SEQ ID NO: 1684229 - DNA, 16 bp, Homo sapiens
taaatacagcatactt

SEQ ID NO: 1684230 - DNA, 17 bp, Homo sapiens
taaataccagacacgta

SEQ ID NO: 1684231 - DNA, 19 bp, Homo sapiens
taaatactctacttacagt

SEQ ID NO: 1684232 - DNA, 22 bp, Homo sapiens
taaatactgcaaatcaggcttt

SEQ ID NO: 1684233 - DNA, 13 bp, Homo sapiens
taaatactggact

SEQ ID NO: 1684234 - DNA, 18 bp, Homo sapiens
taaatactggactcagga

SEQ ID NO: 1684235 - DNA, 15 bp, Homo sapiens
taaatactgtgaaat

SEQ ID NO: 1684236 - DNA, 18 bp, Homo sapiens
taaatactttccatgttt

SEQ ID NO: 1684237 - DNA, 18 bp, Homo sapiens
taaatagagtttgctatt

SEQ ID NO: 1684238 - DNA, 21 bp, Homo sapiens
taaataggaatcattcagaaa

SEQ ID NO: 1684239 - DNA, 23 bp, Homo sapiens
taaatagggaagatggagacacc

SEQ ID NO: 1684240 - DNA, 18 bp, Homo sapiens
taaatagtgtcatataaa

SEQ ID NO: 1684241 - DNA, 23 bp, Homo sapiens
taaatagtgtcatataaactcat

SEQ ID NO: 1684242 - DNA, 13 bp, Homo sapiens
taaatagttctat

SEQ ID NO: 1684243 - DNA, 15 bp, Homo sapiens
taaatataaatagct

SEQ ID NO: 1684244 - DNA, 13 bp, Homo sapiens
taaatataacact

SEQ ID NO: 1684245 - DNA, 15 bp, Homo sapiens
taaatataattctgt

SEQ ID NO: 1684246 - DNA, 19 bp, Homo sapiens
taaatataattctgtaaat

SEQ ID NO: 1684247 - DNA, 22 bp, Homo sapiens
taaatatagatgtaatttttca

SEQ ID NO: 1684248 - DNA, 23 bp, Homo sapiens
taaatatatatggtcatatacat

SEQ ID NO: 1684249 - DNA, 16 bp, Homo sapiens
taaatatatatgtcaa

SEQ ID NO: 1684250 - DNA, 18 bp, Homo sapiens
taaatatcagtattctga

SEQ ID NO: 1684251 - DNA, 18 bp, Homo sapiens
taaatatccatttatctt

SEQ ID NO: 1684252 - DNA, 19 bp, Homo sapiens
taaatatccatttatcttt

SEQ ID NO: 1684253 - DNA, 23 bp, Homo sapiens
taaatatgaatctgctcacttta

SEQ ID NO: 1684254 - DNA, 14 bp, Homo sapiens
taaatatgaatgaa

SEQ ID NO: 1684255 - DNA, 13 bp, Homo sapiens
taaatatgtatta

SEQ ID NO: 1684256 - DNA, 13 bp, Homo sapiens
taaatattctata

SEQ ID NO: 1684257 - DNA, 15 bp, Homo sapiens
taaatattctatatg

SEQ ID NO: 1684258 - DNA, 12 bp, Homo sapiens
taaatatttcaa

SEQ ID NO: 1684259 - DNA, 13 bp, Homo sapiens
taaatattttccg

SEQ ID NO: 1684260 - DNA, 17 bp, Homo sapiens
taaatattttgctaact

SEQ ID NO: 1684261 - DNA, 19 bp, Homo sapiens
taaatattttgctaactgg

SEQ ID NO: 1684262 - DNA, 21 bp, Homo sapiens
taaatattttgctaactggtt

SEQ ID NO: 1684263 - DNA, 22 bp, Homo sapiens
taaatatttttttctttctttg

SEQ ID NO: 1684264 - DNA, 12 bp, Homo sapiens
taaatcaaggaa

SEQ ID NO: 1684265 - DNA, 14 bp, Homo sapiens
taaatcaatgtcac

SEQ ID NO: 1684266 - DNA, 14 bp, Homo sapiens
taaatcacttcatt

SEQ ID NO: 1684267 - DNA, 12 bp, Homo sapiens
taaatcagaaag

SEQ ID NO: 1684268 - DNA, 14 bp, Homo sapiens
taaatcagtatttt

SEQ ID NO: 1684269 - DNA, 14 bp, Homo sapiens
taaatcagttggag

SEQ ID NO: 1684270 - DNA, 15 bp, Homo sapiens
taaatcataaagtca

SEQ ID NO: 1684271 - DNA, 17 bp, Homo sapiens
taaatcataaagtcagt

SEQ ID NO: 1684272 - DNA, 14 bp, Homo sapiens
taaatcattaatac

SEQ ID NO: 1684273 - DNA, 12 bp, Homo sapiens
taaatccaaaga

SEQ ID NO: 1684274 - DNA, 17 bp, Homo sapiens
taaatccattttctaaa

SEQ ID NO: 1684275 - DNA, 20 bp, Homo sapiens
taaatccattttctaaactg

SEQ ID NO: 1684276 - DNA, 21 bp, Homo sapiens
taaatccattttctaaactgt

SEQ ID NO: 1684277 - DNA, 13 bp, Homo sapiens
taaatcccctcac

SEQ ID NO: 1684278 - DNA, 21 bp, Homo sapiens
taaatccgacttgaatattcc

SEQ ID NO: 1684279 - DNA, 12 bp, Homo sapiens
taaatcctccag

SEQ ID NO: 1684280 - DNA, 24 bp, Homo sapiens
taaatctagagtttatacagtgta

SEQ ID NO: 1684281 - DNA, 17 bp, Homo sapiens
taaatctaggatgtgat

SEQ ID NO: 1684282 - DNA, 12 bp, Homo sapiens
taaatctgccac

SEQ ID NO: 1684283 - DNA, 18 bp, Homo sapiens
taaatctgtctgattcta

SEQ ID NO: 1684284 - DNA, 20 bp, Homo sapiens
taaatctgtctgattctatg

SEQ ID NO: 1684285 - DNA, 21 bp, Homo sapiens
taaatctgtctgattctatgc

SEQ ID NO: 1684286 - DNA, 15 bp, Homo sapiens
taaatctgtgatgat

SEQ ID NO: 1684287 - DNA, 18 bp, Homo sapiens
taaatcttaaacaatgta

SEQ ID NO: 1684288 - DNA, 20 bp, Homo sapiens
taaatcttaaacaatgtata

SEQ ID NO: 1684289 - DNA, 14 bp, Homo sapiens
taaatcttccttgt

SEQ ID NO: 1684290 - DNA, 17 bp, Homo sapiens
taaatcttgaccaacag

SEQ ID NO: 1684291 - DNA, 23 bp, Homo sapiens
taaatgaagcagctttaaacaaa

SEQ ID NO: 1684292 - DNA, 12 bp, Homo sapiens
taaatgaatgaa

SEQ ID NO: 1684293 - DNA, 13 bp, Homo sapiens
taaatgaatgttt

SEQ ID NO: 1684294 - DNA, 15 bp, Homo sapiens
taaatgagctcctgc

SEQ ID NO: 1684295 - DNA, 12 bp, Homo sapiens
taaatgagcttt

SEQ ID NO: 1684296 - DNA, 15 bp, Homo sapiens
taaatgataaatgta

SEQ ID NO: 1684297 - DNA, 17 bp, Homo sapiens
taaatgattcttagtga

SEQ ID NO: 1684298 - DNA, 16 bp, Homo sapiens
taaatgattttatgtt

SEQ ID NO: 1684299 - DNA, 16 bp, Homo sapiens
taaatgcaccaagaaa

SEQ ID NO: 1684300 - DNA, 16 bp, Homo sapiens
taaatgcagttttaag

SEQ ID NO: 1684301 - DNA, 16 bp, Homo sapiens
taaatgcataaatgca

SEQ ID NO: 1684302 - DNA, 20 bp, Homo sapiens
taaatgcataatttatggtc

SEQ ID NO: 1684303 - DNA, 17 bp, Homo sapiens
taaatgccagagccaac

SEQ ID NO: 1684304 - DNA, 15 bp, Homo sapiens
taaatgccctcttct

SEQ ID NO: 1684305 - DNA, 19 bp, Homo sapiens
taaatgcctcttaaattat

SEQ ID NO: 1684306 - DNA, 18 bp, Homo sapiens
taaatgccttgcttgtat

SEQ ID NO: 1684307 - DNA, 16 bp, Homo sapiens
taaatgccttgtataa

SEQ ID NO: 1684308 - DNA, 17 bp, Homo sapiens
taaatgccttgtataaa

SEQ ID NO: 1684309 - DNA, 18 bp, Homo sapiens
taaatgctctaactggac

SEQ ID NO: 1684310 - DNA, 20 bp, Homo sapiens
taaatgctgtagaagtgagt

SEQ ID NO: 1684311 - DNA, 22 bp, Homo sapiens
taaatggaattattttgaatgt

SEQ ID NO: 1684312 - DNA, 14 bp, Homo sapiens
taaatggattaatt

SEQ ID NO: 1684313 - DNA, 22 bp, Homo sapiens
taaatggcctcatgtggctgga

SEQ ID NO: 1684314 - DNA, 16 bp, Homo sapiens
taaatggttctgtgct

SEQ ID NO: 1684315 - DNA, 16 bp, Homo sapiens
taaatgtaaagatatt

SEQ ID NO: 1684316 - DNA, 23 bp, Homo sapiens
taaatgtactggtaattgtacaa

SEQ ID NO: 1684317 - DNA, 17 bp, Homo sapiens
taaatgtagacagatat

SEQ ID NO: 1684318 - DNA, 19 bp, Homo sapiens
taaatgtatcttattcaca

SEQ ID NO: 1684319 - DNA, 14 bp, Homo sapiens
taaatgtgaatttt

SEQ ID NO: 1684320 - DNA, 16 bp, Homo sapiens
taaatgtgccttcatt

SEQ ID NO: 1684321 - DNA, 16 bp, Homo sapiens
taaatgtgcttttaaa

SEQ ID NO: 1684322 - DNA, 13 bp, Homo sapiens
taaatgtgttcct

SEQ ID NO: 1684323 - DNA, 15 bp, Homo sapiens
taaatgttatgtata

SEQ ID NO: 1684324 - DNA, 13 bp, Homo sapiens
taaatgttattat

SEQ ID NO: 1684325 - DNA, 18 bp, Homo sapiens
taaatgtttaaatataaa

SEQ ID NO: 1684326 - DNA, 19 bp, Homo sapiens
taaatgtttcttttccctt

SEQ ID NO: 1684327 - DNA, 20 bp, Homo sapiens
taaatgtttgttatttacac

SEQ ID NO: 1684328 - DNA, 14 bp, Homo sapiens
taaattagaatgaa

SEQ ID NO: 1684329 - DNA, 22 bp, Homo sapiens
taaattagatttggcatctcct

SEQ ID NO: 1684330 - DNA, 14 bp, Homo sapiens
taaattaggaataa

SEQ ID NO: 1684331 - DNA, 13 bp, Homo sapiens
taaattatatatt

SEQ ID NO: 1684332 - DNA, 17 bp, Homo sapiens
taaattattagagattt

SEQ ID NO: 1684333 - DNA, 19 bp, Homo sapiens
taaattattagagattttc

SEQ ID NO: 1684334 - DNA, 18 bp, Homo sapiens
taaattcaactttgtaaa

SEQ ID NO: 1684335 - DNA, 13 bp, Homo sapiens
taaattcagacaa

SEQ ID NO: 1684336 - DNA, 17 bp, Homo sapiens
taaattcagacaacatt

SEQ ID NO: 1684337 - DNA, 18 bp, Homo sapiens
taaattcagacaacatta

SEQ ID NO: 1684338 - DNA, 20 bp, Homo sapiens
taaattcagacaacattatg

SEQ ID NO: 1684339 - DNA, 23 bp, Homo sapiens
taaattcagatatatttttcaca

SEQ ID NO: 1684340 - DNA, 18 bp, Homo sapiens
taaattccatatgctcca

SEQ ID NO: 1684341 - DNA, 21 bp, Homo sapiens
taaattccatatgctccagga

SEQ ID NO: 1684342 - DNA, 18 bp, Homo sapiens
taaattcccgttttgtca

SEQ ID NO: 1684343 - DNA, 19 bp, Homo sapiens
taaattcgtgattttcaag

SEQ ID NO: 1684344 - DNA, 19 bp, Homo sapiens
taaattgcagaattcaaaa

SEQ ID NO: 1684345 - DNA, 12 bp, Homo sapiens
taaattgcatca

SEQ ID NO: 1684346 - DNA, 18 bp, Homo sapiens
taaattgcatcactgtat

SEQ ID NO: 1684347 - DNA, 23 bp, Homo sapiens
taaattgcttttgttgtgacttt

SEQ ID NO: 1684348 - DNA, 17 bp, Homo sapiens
taaattggattattttc

SEQ ID NO: 1684349 - DNA, 21 bp, Homo sapiens
taaattgggcttcaatcactg

SEQ ID NO: 1684350 - DNA, 13 bp, Homo sapiens
taaattgtaaaac

SEQ ID NO: 1684351 - DNA, 16 bp, Homo sapiens
taaatttaactgcata

SEQ ID NO: 1684352 - DNA, 18 bp, Homo sapiens
taaatttaactgcatata

SEQ ID NO: 1684353 - DNA, 14 bp, Homo sapiens
taaatttaatacca

SEQ ID NO: 1684354 - DNA, 19 bp, Homo sapiens
taaatttaatatactgcat

SEQ ID NO: 1684355 - DNA, 20 bp, Homo sapiens
taaatttaatatactgcata

SEQ ID NO: 1684356 - DNA, 16 bp, Homo sapiens
taaatttatttgaaaa

SEQ ID NO: 1684357 - DNA, 15 bp, Homo sapiens
taaatttcaaatgca

SEQ ID NO: 1684358 - DNA, 18 bp, Homo sapiens
taaatttcttatgtgaca

SEQ ID NO: 1684359 - DNA, 22 bp, Homo sapiens
taaatttcttatgtgacattaa

SEQ ID NO: 1684360 - DNA, 14 bp, Homo sapiens
taaatttgaatgtt

SEQ ID NO: 1684361 - DNA, 13 bp, Homo sapiens
taaatttgtacta

SEQ ID NO: 1684362 - DNA, 12 bp, Homo sapiens
taaattttaaag

SEQ ID NO: 1684363 - DNA, 16 bp, Homo sapiens
taaattttaaagccat

SEQ ID NO: 1684364 - DNA, 14 bp, Homo sapiens
taaattttatatct

SEQ ID NO: 1684365 - DNA, 20 bp, Homo sapiens
taaattttatgtcatagaaa

SEQ ID NO: 1684366 - DNA, 17 bp, Homo sapiens
taaattttcatgaatgt

SEQ ID NO: 1684367 - DNA, 20 bp, Homo sapiens
taaattttgtctttaactca

SEQ ID NO: 1684368 - DNA, 14 bp, Homo sapiens
taaatttttttcct

SEQ ID NO: 1684369 - DNA, 19 bp, Homo sapiens
taaattttttttggtcaaa

SEQ ID NO: 1684370 - DNA, 20 bp, Homo sapiens
taaattttttttggtcaaat

SEQ ID NO: 1684371 - DNA, 21 bp, Homo sapiens
taaattttttttggtcaaatt

SEQ ID NO: 1684372 - DNA, 20 bp, Homo sapiens
taacaaaaaaatatatttaa

SEQ ID NO: 1684373 - DNA, 17 bp, Homo sapiens
taacaaaaaataaattt

SEQ ID NO: 1684374 - DNA, 16 bp, Homo sapiens
taacaaaactgtgcca

SEQ ID NO: 1684375 - DNA, 14 bp, Homo sapiens
taacaaaatgagat

SEQ ID NO: 1684376 - DNA, 12 bp, Homo sapiens
taacaaataaaa

SEQ ID NO: 1684377 - DNA, 21 bp, Homo sapiens
taacaaataaaaaagctcttt

SEQ ID NO: 1684378 - DNA, 12 bp, Homo sapiens
taacaaatgaac

SEQ ID NO: 1684379 - DNA, 11 bp, Homo sapiens
taacaaatgag

SEQ ID NO: 1684380 - DNA, 22 bp, Homo sapiens
taacaaatgagccatccccagg

SEQ ID NO: 1684381 - DNA, 15 bp, Homo sapiens
taacaactgcccagt

SEQ ID NO: 1684382 - DNA, 16 bp, Homo sapiens
taacaagatctttcag

SEQ ID NO: 1684383 - DNA, 18 bp, Homo sapiens
taacaagatctttcagga

SEQ ID NO: 1684384 - DNA, 11 bp, Homo sapiens
taacaaggaat

SEQ ID NO: 1684385 - DNA, 20 bp, Homo sapiens
taacaaggaatgcctgtgcc

SEQ ID NO: 1684386 - DNA, 23 bp, Homo sapiens
taacaaggagctcaccctgcccg

SEQ ID NO: 1684387 - DNA, 24 bp, Homo sapiens
taacaagggctgcaatgccctcat

SEQ ID NO: 1684388 - DNA, 23 bp, Homo sapiens
taacaaggtgccctttagccaga

SEQ ID NO: 1684389 - DNA, 13 bp, Homo sapiens
taacaagtataaa

SEQ ID NO: 1684390 - DNA, 14 bp, Homo sapiens
taacaataataaaa

SEQ ID NO: 1684391 - DNA, 13 bp, Homo sapiens
taacaatacaaat

SEQ ID NO: 1684392 - DNA, 17 bp, Homo sapiens
taacaatacaaatggat

SEQ ID NO: 1684393 - DNA, 15 bp, Homo sapiens
taacaatagttctta

SEQ ID NO: 1684394 - DNA, 21 bp, Homo sapiens
taacaatctaacaataatatt

SEQ ID NO: 1684395 - DNA, 19 bp, Homo sapiens
taacaatgacaagatgttc

SEQ ID NO: 1684396 - DNA, 22 bp, Homo sapiens
taacaatgatatatggataatg

SEQ ID NO: 1684397 - DNA, 18 bp, Homo sapiens
taacaattttaatgctat

SEQ ID NO: 1684398 - DNA, 15 bp, Homo sapiens
taacacactggccat

SEQ ID NO: 1684399 - DNA, 12 bp, Homo sapiens
taacacagagag

SEQ ID NO: 1684400 - DNA, 17 bp, Homo sapiens
taacacagcatgtgtat

SEQ ID NO: 1684401 - DNA, 23 bp, Homo sapiens
taatattaatattcccattttat

SEQ ID NO: 1684402 - DNA, 18 bp, Homo sapiens
taatattatataggatat

SEQ ID NO: 1684403 - DNA, 18 bp, Homo sapiens
taatattcagccagctta

SEQ ID NO: 1684404 - DNA, 19 bp, Homo sapiens
taatattcccattttatta

SEQ ID NO: 1684405 - DNA, 17 bp, Homo sapiens
taatattgaaaattgaa

SEQ ID NO: 1684406 - DNA, 14 bp, Homo sapiens
taatattgtaaata

SEQ ID NO: 1684407 - DNA, 21 bp, Homo sapiens
taatattgtttggtaaatgtt

SEQ ID NO: 1684408 - DNA, 13 bp, Homo sapiens
taatatttaacat

SEQ ID NO: 1684409 - DNA, 13 bp, Homo sapiens
taatatttactgt

SEQ ID NO: 1684410 - DNA, 14 bp, Homo sapiens
taatatttctaaaa

SEQ ID NO: 1684411 - DNA, 13 bp, Homo sapiens
taatattttgcac

SEQ ID NO: 1684412 - DNA, 14 bp, Homo sapiens
taatcaaaattgtc

SEQ ID NO: 1684413 - DNA, 22 bp, Homo sapiens
taatcaactgtaggttatttaa

SEQ ID NO: 1684414 - DNA, 18 bp, Homo sapiens
taatcaagagaaacttca

SEQ ID NO: 1684415 - DNA, 17 bp, Homo sapiens
taatcaagttgtaactt

SEQ ID NO: 1684416 - DNA, 15 bp, Homo sapiens
taatcaccatgtaag

SEQ ID NO: 1684417 - DNA, 20 bp, Homo sapiens
taatcaccatgtaagcactc

SEQ ID NO: 1684418 - DNA, 13 bp, Homo sapiens
taatcactaattt

SEQ ID NO: 1684419 - DNA, 19 bp, Homo sapiens
taatcagggaggtcatttt

SEQ ID NO: 1684420 - DNA, 13 bp, Homo sapiens
taatcagtaaata

SEQ ID NO: 1684421 - DNA, 15 bp, Homo sapiens
taatcagtgactgaa

SEQ ID NO: 1684422 - DNA, 21 bp, Homo sapiens
taatcagtgactgaaaccatt

SEQ ID NO: 1684423 - DNA, 23 bp, Homo sapiens
taatcagtgactgaaaccatttt

SEQ ID NO: 1684424 - DNA, 22 bp, Homo sapiens
taatcatacaaactctcaccat

SEQ ID NO: 1684425 - DNA, 20 bp, Homo sapiens
taatcatataataaatgtac

SEQ ID NO: 1684426 - DNA, 17 bp, Homo sapiens
taatcatctataaagaa

SEQ ID NO: 1684427 - DNA, 18 bp, Homo sapiens
taatcatgaaattactta

SEQ ID NO: 1684428 - DNA, 15 bp, Homo sapiens
taatcatgaaccaat

SEQ ID NO: 1684429 - DNA, 17 bp, Homo sapiens
taatcatgaatgtgtaa

SEQ ID NO: 1684430 - DNA, 13 bp, Homo sapiens
taatcatgtgaaa

SEQ ID NO: 1684431 - DNA, 18 bp, Homo sapiens
taatcatgtgaaatgttt

SEQ ID NO: 1684432 - DNA, 21 bp, Homo sapiens
taatcatgtgggtgagccagt

SEQ ID NO: 1684433 - DNA, 17 bp, Homo sapiens
taatcattagttttaga

SEQ ID NO: 1684434 - DNA, 13 bp, Homo sapiens
taatcatttgttt

SEQ ID NO: 1684435 - DNA, 14 bp, Homo sapiens
taatcatttgttta

SEQ ID NO: 1684436 - DNA, 14 bp, Homo sapiens
taatcattttcatt

SEQ ID NO: 1684437 - DNA, 17 bp, Homo sapiens
taatcattttcattcct

SEQ ID NO: 1684438 - DNA, 12 bp, Homo sapiens
taatcatttttt

SEQ ID NO: 1684439 - DNA, 23 bp, Homo sapiens
taatccaaagcttattttgtaag

SEQ ID NO: 1684440 - DNA, 20 bp, Homo sapiens
taatccaatattttgccttt

SEQ ID NO: 1684441 - DNA, 22 bp, Homo sapiens
taatccacatctttactcaggc

SEQ ID NO: 1684442 - DNA, 19 bp, Homo sapiens
taatccaggcacagctgag

SEQ ID NO: 1684443 - DNA, 17 bp, Homo sapiens
taatccaggcagatcca

SEQ ID NO: 1684444 - DNA, 18 bp, Homo sapiens
taatccaggcagatccag

SEQ ID NO: 1684445 - DNA, 19 bp, Homo sapiens
taatccaggcagatccagg

SEQ ID NO: 1684446 - DNA, 23 bp, Homo sapiens
taatccaggcagatccaggacta

SEQ ID NO: 1684447 - DNA, 19 bp, Homo sapiens
taatccagttataagaaga

SEQ ID NO: 1684448 - DNA, 14 bp, Homo sapiens
taatcccagcactt

SEQ ID NO: 1684449 - DNA, 20 bp, Homo sapiens
taatcccagctactcaggag

SEQ ID NO: 1684450 - DNA, 16 bp, Homo sapiens
taatccccatcattac

SEQ ID NO: 1684451 - DNA, 17 bp, Homo sapiens
taatccccatcattact

SEQ ID NO: 1684452 - DNA, 22 bp, Homo sapiens
taatccccatcattactggtaa

SEQ ID NO: 1684453 - DNA, 15 bp, Homo sapiens
taatccccttctccc

SEQ ID NO: 1684454 - DNA, 14 bp, Homo sapiens
taatccctgctttt

SEQ ID NO: 1684455 - DNA, 19 bp, Homo sapiens
taatccctgggcattgctt

SEQ ID NO: 1684456 - DNA, 20 bp, Homo sapiens
taatccctgggcattgcttt

SEQ ID NO: 1684457 - DNA, 22 bp, Homo sapiens
taatcctattaaaacacagctt

SEQ ID NO: 1684458 - DNA, 19 bp, Homo sapiens
taatccttctagtttccca

SEQ ID NO: 1684459 - DNA, 20 bp, Homo sapiens
taatcctttgttttctgact

SEQ ID NO: 1684460 - DNA, 22 bp, Homo sapiens
taatcctttgttttctgactaa

SEQ ID NO: 1684461 - DNA, 15 bp, Homo sapiens
taatccttttcctta

SEQ ID NO: 1684462 - DNA, 17 bp, Homo sapiens
taatccttttccttatt

SEQ ID NO: 1684463 - DNA, 20 bp, Homo sapiens
taatccttttccttatttgc

SEQ ID NO: 1684464 - DNA, 18 bp, Homo sapiens
taatcgcttaaagatgtt

SEQ ID NO: 1684465 - DNA, 15 bp, Homo sapiens
taatcggcccacagc

SEQ ID NO: 1684466 - DNA, 18 bp, Homo sapiens
taatctacaccaatgaaa

SEQ ID NO: 1684467 - DNA, 19 bp, Homo sapiens
taatctacaccaatgaaaa

SEQ ID NO: 1684468 - DNA, 20 bp, Homo sapiens
taatctacaccaatgaaaac

SEQ ID NO: 1684469 - DNA, 22 bp, Homo sapiens
taatctacaccaatgaaaacat

SEQ ID NO: 1684470 - DNA, 14 bp, Homo sapiens
taatctaccagtgg

SEQ ID NO: 1684471 - DNA, 22 bp, Homo sapiens
taatctaccagtggtgctcaat

SEQ ID NO: 1684472 - DNA, 22 bp, Homo sapiens
taatctagaacacaggcaaaat

SEQ ID NO: 1684473 - DNA, 20 bp, Homo sapiens
taatctagtttacagaaaaa

SEQ ID NO: 1684474 - DNA, 19 bp, Homo sapiens
taatgaaagactgtacaaa

SEQ ID NO: 1684475 - DNA, 19 bp, Homo sapiens
taatgaaagggaaagtcag

SEQ ID NO: 1684476 - DNA, 14 bp, Homo sapiens
taatgaaataatca

SEQ ID NO: 1684477 - DNA, 13 bp, Homo sapiens
taatgaagagaaa

SEQ ID NO: 1684478 - DNA, 12 bp, Homo sapiens
taatgaatgact

SEQ ID NO: 1684479 - DNA, 14 bp, Homo sapiens
taatgaattataac

SEQ ID NO: 1684480 - DNA, 16 bp, Homo sapiens
taatgaattataacag

SEQ ID NO: 1684481 - DNA, 13 bp, Homo sapiens
taatgacaaaaga

SEQ ID NO: 1684482 - DNA, 14 bp, Homo sapiens
taatgacaaaagat

SEQ ID NO: 1684483 - DNA, 22 bp, Homo sapiens
taatgacaaaagatacaaaagc

SEQ ID NO: 1684484 - DNA, 16 bp, Homo sapiens
taatgacacaccttgg

SEQ ID NO: 1684485 - DNA, 15 bp, Homo sapiens
taatgacgtgtgtgg

SEQ ID NO: 1684486 - DNA, 13 bp, Homo sapiens
taatgagaataga

SEQ ID NO: 1684487 - DNA, 13 bp, Homo sapiens
taatgagagcaaa

SEQ ID NO: 1684488 - DNA, 15 bp, Homo sapiens
taatgagagcaaatg

SEQ ID NO: 1684489 - DNA, 17 bp, Homo sapiens
taatgagagcaaatgca

SEQ ID NO: 1684490 - DNA, 20 bp, Homo sapiens
taatgagatgttattactgt

SEQ ID NO: 1684491 - DNA, 17 bp, Homo sapiens
taatgaggaaaaaatgg

SEQ ID NO: 1684492 - DNA, 15 bp, Homo sapiens
taatgagtgcacctg

SEQ ID NO: 1684493 - DNA, 12 bp, Homo sapiens
taatgataaact

SEQ ID NO: 1684494 - DNA, 19 bp, Homo sapiens
taatgataagtaaatgcta

SEQ ID NO: 1684495 - DNA, 11 bp, Homo sapiens
taatgatgttt

SEQ ID NO: 1684496 - DNA, 15 bp, Homo sapiens
taatgcacagtgcat

SEQ ID NO: 1684497 - DNA, 16 bp, Homo sapiens
taatgcagaagtattc

SEQ ID NO: 1684498 - DNA, 17 bp, Homo sapiens
taatgcagttgcttact

SEQ ID NO: 1684499 - DNA, 18 bp, Homo sapiens
taatgcagtttttaaaaa

SEQ ID NO: 1684500 - DNA, 20 bp, Homo sapiens
taatgcagtttttaaaaacc

SEQ ID NO: 1684501 - DNA, 22 bp, Homo sapiens
taatgcatcatcatagaaaaac

SEQ ID NO: 1684502 - DNA, 15 bp, Homo sapiens
taatgccttactctt

SEQ ID NO: 1684503 - DNA, 14 bp, Homo sapiens
taatgctaagaaat

SEQ ID NO: 1684504 - DNA, 17 bp, Homo sapiens
taatgctcccatctcct

SEQ ID NO: 1684505 - DNA, 14 bp, Homo sapiens
taatgctgttgcct

SEQ ID NO: 1684506 - DNA, 19 bp, Homo sapiens
taatgctgtttctaagaaa

SEQ ID NO: 1684507 - DNA, 16 bp, Homo sapiens
taatgcttcaagtgtt

SEQ ID NO: 1684508 - DNA, 14 bp, Homo sapiens
taatgcttcattca

SEQ ID NO: 1684509 - DNA, 20 bp, Homo sapiens
taatgcttcattcaatattg

SEQ ID NO: 1684510 - DNA, 16 bp, Homo sapiens
taatgctttgttaaat

SEQ ID NO: 1684511 - DNA, 14 bp, Homo sapiens
taatggaaaaatag

SEQ ID NO: 1684512 - DNA, 23 bp, Homo sapiens
taatggacatgagataatgttag

SEQ ID NO: 1684513 - DNA, 20 bp, Homo sapiens
taatggagaacaagttgtta

SEQ ID NO: 1684514 - DNA, 12 bp, Homo sapiens
taatggagaaga

SEQ ID NO: 1684515 - DNA, 13 bp, Homo sapiens
taatggagaagac

SEQ ID NO: 1684516 - DNA, 18 bp, Homo sapiens
taatggatcatagaattg

SEQ ID NO: 1684517 - DNA, 14 bp, Homo sapiens
taatggatttttga

SEQ ID NO: 1684518 - DNA, 17 bp, Homo sapiens
taatggcagctagtgcc

SEQ ID NO: 1684519 - DNA, 16 bp, Homo sapiens
taatggcatgtcagac

SEQ ID NO: 1684520 - DNA, 20 bp, Homo sapiens
taatgggggtagcagctgga

SEQ ID NO: 1684521 - DNA, 19 bp, Homo sapiens
taatggtactgactttgct

SEQ ID NO: 1684522 - DNA, 14 bp, Homo sapiens
taatggtcccatcc

SEQ ID NO: 1684523 - DNA, 16 bp, Homo sapiens
taatggtcccatccag

SEQ ID NO: 1684524 - DNA, 15 bp, Homo sapiens
taatggtttcaaaga

SEQ ID NO: 1684525 - DNA, 19 bp, Homo sapiens
taatgtaaaattcatagca

SEQ ID NO: 1684526 - DNA, 17 bp, Homo sapiens
taatgtaagctctactg

SEQ ID NO: 1684527 - DNA, 15 bp, Homo sapiens
taatgtacatctggc

SEQ ID NO: 1684528 - DNA, 22 bp, Homo sapiens
taatgtacgctgctgcaggaca

SEQ ID NO: 1684529 - DNA, 15 bp, Homo sapiens
taatgtactcacata

SEQ ID NO: 1684530 - DNA, 20 bp, Homo sapiens
taatgtactcacatataaca

SEQ ID NO: 1684531 - DNA, 18 bp, Homo sapiens
taatgtattagtatggtt

SEQ ID NO: 1684532 - DNA, 16 bp, Homo sapiens
taatgtattatgagcc

SEQ ID NO: 1684533 - DNA, 16 bp, Homo sapiens
taatgtattcatattt

SEQ ID NO: 1684534 - DNA, 15 bp, Homo sapiens
taatgtcaccacctt

SEQ ID NO: 1684535 - DNA, 15 bp, Homo sapiens
taatgtcagaacaga

SEQ ID NO: 1684536 - DNA, 15 bp, Homo sapiens
taatgtgaagacatt

SEQ ID NO: 1684537 - DNA, 18 bp, Homo sapiens
taatgtgaagacattttt

SEQ ID NO: 1684538 - DNA, 19 bp, Homo sapiens
taatgtgaggaactcacat

SEQ ID NO: 1684539 - DNA, 22 bp, Homo sapiens
taatgtgcagggatattgcctt

SEQ ID NO: 1684540 - DNA, 18 bp, Homo sapiens
taatgttatatcatatgt

SEQ ID NO: 1684541 - DNA, 16 bp, Homo sapiens
taatgttatcggctct

SEQ ID NO: 1684542 - DNA, 13 bp, Homo sapiens
taatgttattcat

SEQ ID NO: 1684543 - DNA, 17 bp, Homo sapiens
taatgttgaacaaaata

SEQ ID NO: 1684544 - DNA, 22 bp, Homo sapiens
taatgttgaacaaaataaattg

SEQ ID NO: 1684545 - DNA, 19 bp, Homo sapiens
taatgttgataatatatat

SEQ ID NO: 1684546 - DNA, 13 bp, Homo sapiens
taatgttgtccag

SEQ ID NO: 1684547 - DNA, 18 bp, Homo sapiens
taatgttgttatttaaag

SEQ ID NO: 1684548 - DNA, 18 bp, Homo sapiens
taatgtttatgagccaga

SEQ ID NO: 1684549 - DNA, 16 bp, Homo sapiens
taatgtttattaaatg

SEQ ID NO: 1684550 - DNA, 11 bp, Homo sapiens
taatgtttcct

SEQ ID NO: 1684551 - DNA, 22 bp, Homo sapiens
taatgtttctggatttcatact

SEQ ID NO: 1684552 - DNA, 14 bp, Homo sapiens
taatgttttgtaca

SEQ ID NO: 1684553 - DNA, 16 bp, Homo sapiens
taatgttttgtacaat

SEQ ID NO: 1684554 - DNA, 13 bp, Homo sapiens
taatttcaaatgt

SEQ ID NO: 1684555 - DNA, 12 bp, Homo sapiens
taatttcaggaa

SEQ ID NO: 1684556 - DNA, 24 bp, Homo sapiens
taatttcatactatttagattttc

SEQ ID NO: 1684557 - DNA, 13 bp, Homo sapiens
taatttcatttaa

SEQ ID NO: 1684558 - DNA, 11 bp, Homo sapiens
taatttccttt

SEQ ID NO: 1684559 - DNA, 14 bp, Homo sapiens
taatttctcctccc

SEQ ID NO: 1684560 - DNA, 17 bp, Homo sapiens
taatttctttttttcct

SEQ ID NO: 1684561 - DNA, 13 bp, Homo sapiens
taatttgaatgta

SEQ ID NO: 1684562 - DNA, 16 bp, Homo sapiens
taatttgaatgtattt

SEQ ID NO: 1684563 - DNA, 17 bp, Homo sapiens
taatttgaatgtatttg

SEQ ID NO: 1684564 - DNA, 15 bp, Homo sapiens
taatttgacttgaat

SEQ ID NO: 1684565 - DNA, 15 bp, Homo sapiens
taatttgagagaaat

SEQ ID NO: 1684566 - DNA, 18 bp, Homo sapiens
taatttgatgaaagctga

SEQ ID NO: 1684567 - DNA, 19 bp, Homo sapiens
taatttgatgaaagctgat

SEQ ID NO: 1684568 - DNA, 14 bp, Homo sapiens
taatttgatgttta

SEQ ID NO: 1684569 - DNA, 14 bp, Homo sapiens
taatttgtacaatg

SEQ ID NO: 1684570 - DNA, 21 bp, Homo sapiens
taatttgtacatatgtaaaat

SEQ ID NO: 1684571 - DNA, 19 bp, Homo sapiens
taattttaaataatttcta

SEQ ID NO: 1684572 - DNA, 22 bp, Homo sapiens
taattttaaccaaaacatgtct

SEQ ID NO: 1684573 - DNA, 13 bp, Homo sapiens
taattttaagaaa

SEQ ID NO: 1684574 - DNA, 21 bp, Homo sapiens
taattttacatgtttataaat

SEQ ID NO: 1684575 - DNA, 14 bp, Homo sapiens
taattttagttttt

SEQ ID NO: 1684576 - DNA, 18 bp, Homo sapiens
taattttatgaatgtctt

SEQ ID NO: 1684577 - DNA, 17 bp, Homo sapiens
taattttatttataaac

SEQ ID NO: 1684578 - DNA, 18 bp, Homo sapiens
taattttatttataaact

SEQ ID NO: 1684579 - DNA, 21 bp, Homo sapiens
taattttctagattttctact

SEQ ID NO: 1684580 - DNA, 13 bp, Homo sapiens
taattttctatgt

SEQ ID NO: 1684581 - DNA, 18 bp, Homo sapiens
taattttgaagtgctgtt

SEQ ID NO: 1684582 - DNA, 18 bp, Homo sapiens
taattttgatatacattg

SEQ ID NO: 1684583 - DNA, 13 bp, Homo sapiens
taattttgcaaat

SEQ ID NO: 1684584 - DNA, 14 bp, Homo sapiens
taattttgctaact

SEQ ID NO: 1684585 - DNA, 17 bp, Homo sapiens
taattttgctaactggg

SEQ ID NO: 1684586 - DNA, 18 bp, Homo sapiens
taattttgtgcattcttt

SEQ ID NO: 1684587 - DNA, 15 bp, Homo sapiens
taatttttacctaat

SEQ ID NO: 1684588 - DNA, 16 bp, Homo sapiens
taatttttacctaatc

SEQ ID NO: 1684589 - DNA, 14 bp, Homo sapiens
taatttttcaaaat

SEQ ID NO: 1684590 - DNA, 13 bp, Homo sapiens
taatttttccaac

SEQ ID NO: 1684591 - DNA, 16 bp, Homo sapiens
taatttttcctatatt

SEQ ID NO: 1684592 - DNA, 15 bp, Homo sapiens
taatttttgcagaaa

SEQ ID NO: 1684593 - DNA, 22 bp, Homo sapiens
taatttttgctccaatatccat

SEQ ID NO: 1684594 - DNA, 21 bp, Homo sapiens
taatttttggagaaatgtcat

SEQ ID NO: 1684595 - DNA, 17 bp, Homo sapiens
taatttttgtattattt

SEQ ID NO: 1684596 - DNA, 13 bp, Homo sapiens
taattttttacta

SEQ ID NO: 1684597 - DNA, 13 bp, Homo sapiens
taattttttctta

SEQ ID NO: 1684598 - DNA, 21 bp, Homo sapiens
taatttttttatgttttgttt

SEQ ID NO: 1684599 - DNA, 22 bp, Homo sapiens
taatttttttcaatatttatta

SEQ ID NO: 1684600 - DNA, 16 bp, Homo sapiens
taattttttttaatgt

SEQ ID NO: 1684601 - DNA, 15 bp, Homo sapiens
taattttttttgttt

SEQ ID NO: 1684602 - DNA, 13 bp, Homo sapiens
tacaaaaaattag

SEQ ID NO: 1684603 - DNA, 13 bp, Homo sapiens
tacaaaaacacag

SEQ ID NO: 1684604 - DNA, 16 bp, Homo sapiens
tacaaaaacacagcaa

SEQ ID NO: 1684605 - DNA, 14 bp, Homo sapiens
tacaaaaatgaata

SEQ ID NO: 1684606 - DNA, 19 bp, Homo sapiens
tacaaaacctcaaaccagt

SEQ ID NO: 1684607 - DNA, 12 bp, Homo sapiens
tacaaaaccttg

SEQ ID NO: 1684608 - DNA, 16 bp, Homo sapiens
tacaaacaaaatttct

SEQ ID NO: 1684609 - DNA, 22 bp, Homo sapiens
tacaaacaatggaaactgaatg

SEQ ID NO: 1684610 - DNA, 19 bp, Homo sapiens
tacaaaccattacctgtac

SEQ ID NO: 1684611 - DNA, 12 bp, Homo sapiens
tacaaactctca

SEQ ID NO: 1684612 - DNA, 13 bp, Homo sapiens
tacaaactctcac

SEQ ID NO: 1684613 - DNA, 14 bp, Homo sapiens
tacaaactctcacc

SEQ ID NO: 1684614 - DNA, 14 bp, Homo sapiens
tacaaactgcaata

SEQ ID NO: 1684615 - DNA, 17 bp, Homo sapiens
tacaaactgcaatagag

SEQ ID NO: 1684616 - DNA, 20 bp, Homo sapiens
tacaaagagatgcttggagc

SEQ ID NO: 1684617 - DNA, 21 bp, Homo sapiens
tacaaagcgtttctttacttc

SEQ ID NO: 1684618 - DNA, 16 bp, Homo sapiens
tacaaagctttgctac

SEQ ID NO: 1684619 - DNA, 19 bp, Homo sapiens
tacaaagctttgctacaaa

SEQ ID NO: 1684620 - DNA, 21 bp, Homo sapiens
tacaaagctttgctacaaatt

SEQ ID NO: 1684621 - DNA, 20 bp, Homo sapiens
tacaaagggaaagcctctgg

SEQ ID NO: 1684622 - DNA, 22 bp, Homo sapiens
tacaaagggaaagcctctggcc

SEQ ID NO: 1684623 - DNA, 12 bp, Homo sapiens
tacaaataaacc

SEQ ID NO: 1684624 - DNA, 23 bp, Homo sapiens
tacaaatactcttaggaagagaa

SEQ ID NO: 1684625 - DNA, 17 bp, Homo sapiens
tacaaatgaagaaagtc

SEQ ID NO: 1684626 - DNA, 15 bp, Homo sapiens
tacaaattataatgt

SEQ ID NO: 1684627 - DNA, 18 bp, Homo sapiens
tacaaattataatgtatt

SEQ ID NO: 1684628 - DNA, 17 bp, Homo sapiens
tacaaatttatgcattt

SEQ ID NO: 1684629 - DNA, 20 bp, Homo sapiens
tacaaatttatgcatttcat

SEQ ID NO: 1684630 - DNA, 20 bp, Homo sapiens
tacaaatttggccttaagaa

SEQ ID NO: 1684631 - DNA, 16 bp, Homo sapiens
tacaaatttttctgtg

SEQ ID NO: 1684632 - DNA, 16 bp, Homo sapiens
tacaacaaaaggactt

SEQ ID NO: 1684633 - DNA, 21 bp, Homo sapiens
tacaacaacaacaaaaaatac

SEQ ID NO: 1684634 - DNA, 17 bp, Homo sapiens
tacaacacaaagagaaa

SEQ ID NO: 1684635 - DNA, 18 bp, Homo sapiens
tacaacaccaaaaaatat

SEQ ID NO: 1684636 - DNA, 21 bp, Homo sapiens
tacaacagaaaccagaaaagc

SEQ ID NO: 1684637 - DNA, 23 bp, Homo sapiens
tacaacagaaaccagaaaagcaa

SEQ ID NO: 1684638 - DNA, 21 bp, Homo sapiens
tacaacataatctagtttaca

SEQ ID NO: 1684639 - DNA, 23 bp, Homo sapiens
tacaacataatctagtttacaga

SEQ ID NO: 1684640 - DNA, 14 bp, Homo sapiens
tacaaccaagctct

SEQ ID NO: 1684641 - DNA, 20 bp, Homo sapiens
tacaaccaagctctctgcat

SEQ ID NO: 1684642 - DNA, 14 bp, Homo sapiens
tacaaccctaccct

SEQ ID NO: 1684643 - DNA, 21 bp, Homo sapiens
tacaaccctaccctggcaggg

SEQ ID NO: 1684644 - DNA, 15 bp, Homo sapiens
tacaacctccgcctc

SEQ ID NO: 1684645 - DNA, 17 bp, Homo sapiens
tacaactgtatttatta

SEQ ID NO: 1684646 - DNA, 18 bp, Homo sapiens
tacaacttaaataataaa

SEQ ID NO: 1684647 - DNA, 23 bp, Homo sapiens
tacaagagcagcctgtggcatct

SEQ ID NO: 1684648 - DNA, 14 bp, Homo sapiens
tacaagatattatt

SEQ ID NO: 1684649 - DNA, 20 bp, Homo sapiens
tacaagatattattaatttt

SEQ ID NO: 1684650 - DNA, 15 bp, Homo sapiens
tacaagattgaaaat

SEQ ID NO: 1684651 - DNA, 18 bp, Homo sapiens
tacaaggcaagcattttt

SEQ ID NO: 1684652 - DNA, 17 bp, Homo sapiens
tacaagggagaagacaa

SEQ ID NO: 1684653 - DNA, 22 bp, Homo sapiens
tacaagggagaagacaacagaa

SEQ ID NO: 1684654 - DNA, 18 bp, Homo sapiens
tacaagggtctagggaga

SEQ ID NO: 1684655 - DNA, 18 bp, Homo sapiens
tacaaggtataataaaat

SEQ ID NO: 1684656 - DNA, 19 bp, Homo sapiens
tacaaggtataataaaatt

SEQ ID NO: 1684657 - DNA, 19 bp, Homo sapiens
tacaagtaatgtaaagatg

SEQ ID NO: 1684658 - DNA, 11 bp, Homo sapiens
tacaagtgttc

SEQ ID NO: 1684659 - DNA, 14 bp, Homo sapiens
tacaagtgttctta

SEQ ID NO: 1684660 - DNA, 15 bp, Homo sapiens
tacaagttttgtata

SEQ ID NO: 1684661 - DNA, 15 bp, Homo sapiens
tacaataaaaagaaa

SEQ ID NO: 1684662 - DNA, 11 bp, Homo sapiens
tacaataaact

SEQ ID NO: 1684663 - DNA, 13 bp, Homo sapiens
tacaataaataat

SEQ ID NO: 1684664 - DNA, 15 bp, Homo sapiens
tacaataaatattct

SEQ ID NO: 1684665 - DNA, 18 bp, Homo sapiens
tacaataaatattctgca

SEQ ID NO: 1684666 - DNA, 12 bp, Homo sapiens
tacaataatgta

SEQ ID NO: 1684667 - DNA, 16 bp, Homo sapiens
tacaatatgtacattt

SEQ ID NO: 1684668 - DNA, 23 bp, Homo sapiens
tacaatattgattgggaaaacat

SEQ ID NO: 1684669 - DNA, 16 bp, Homo sapiens
tacaatcagttgactt

SEQ ID NO: 1684670 - DNA, 18 bp, Homo sapiens
tacaatcatggtcaagtt

SEQ ID NO: 1684671 - DNA, 13 bp, Homo sapiens
tacaatctggctc

SEQ ID NO: 1684672 - DNA, 15 bp, Homo sapiens
tacaatctggctcac

SEQ ID NO: 1684673 - DNA, 15 bp, Homo sapiens
tacaatgaacactta

SEQ ID NO: 1684674 - DNA, 16 bp, Homo sapiens
tacaatggaataaatt

SEQ ID NO: 1684675 - DNA, 13 bp, Homo sapiens
tacaatggtttat

SEQ ID NO: 1684676 - DNA, 17 bp, Homo sapiens
tacaatggtttattccc

SEQ ID NO: 1684677 - DNA, 20 bp, Homo sapiens
tacaatggtttattcccaag

SEQ ID NO: 1684678 - DNA, 22 bp, Homo sapiens
tacaatgtacaattatgtctct

SEQ ID NO: 1684679 - DNA, 13 bp, Homo sapiens
tacaatgtatctt

SEQ ID NO: 1684680 - DNA, 20 bp, Homo sapiens
tacaatgtatctttattaaa

SEQ ID NO: 1684681 - DNA, 22 bp, Homo sapiens
tacaatgtatctttattaaaac

SEQ ID NO: 1684682 - DNA, 12 bp, Homo sapiens
tacaatgtatgt

SEQ ID NO: 1684683 - DNA, 23 bp, Homo sapiens
tacaatgtatgtaatttgtttcc

SEQ ID NO: 1684684 - DNA, 18 bp, Homo sapiens
tacaatgtatgtacaata

SEQ ID NO: 1684685 - DNA, 17 bp, Homo sapiens
tacaatgtcatatactg

SEQ ID NO: 1684686 - DNA, 19 bp, Homo sapiens
tacaattatatcagtcctc

SEQ ID NO: 1684687 - DNA, 14 bp, Homo sapiens
tacaattatgtctc

SEQ ID NO: 1684688 - DNA, 16 bp, Homo sapiens
tacaattatgtctctt

SEQ ID NO: 1684689 - DNA, 18 bp, Homo sapiens
tacaattatgtctcttga

SEQ ID NO: 1684690 - DNA, 12 bp, Homo sapiens
tacaattcattg

SEQ ID NO: 1684691 - DNA, 22 bp, Homo sapiens
tacaattcattgttttgcaaaa

SEQ ID NO: 1684692 - DNA, 15 bp, Homo sapiens
tacaattgcactgct

SEQ ID NO: 1684693 - DNA, 13 bp, Homo sapiens
tacaatttgtact

SEQ ID NO: 1684694 - DNA, 23 bp, Homo sapiens
tacaatttgtacttttttcttaa

SEQ ID NO: 1684695 - DNA, 18 bp, Homo sapiens
tacaattttaaagttctt

SEQ ID NO: 1684696 - DNA, 21 bp, Homo sapiens
tacaattttaaagttcttatt

SEQ ID NO: 1684697 - DNA, 15 bp, Homo sapiens
tacaattttctgtaa

SEQ ID NO: 1684698 - DNA, 23 bp, Homo sapiens
tacacaaagaacttgctgctgcc

SEQ ID NO: 1684699 - DNA, 16 bp, Homo sapiens
tacacaagtaaacatt

SEQ ID NO: 1684700 - DNA, 13 bp, Homo sapiens
tacacacacacac

SEQ ID NO: 1684701 - DNA, 16 bp, Homo sapiens
tacacacacacacaca

SEQ ID NO: 1684702 - DNA, 14 bp, Homo sapiens
tacacacacagcct

SEQ ID NO: 1684703 - DNA, 16 bp, Homo sapiens
tacacacataccttca

SEQ ID NO: 1684704 - DNA, 18 bp, Homo sapiens
tacacacatgccctcctg

SEQ ID NO: 1684705 - DNA, 17 bp, Homo sapiens
tacacactcaaatcaag

SEQ ID NO: 1684706 - DNA, 20 bp, Homo sapiens
tacacactgtcatgcttcat

SEQ ID NO: 1684707 - DNA, 18 bp, Homo sapiens
tacacagaaacactgcct

SEQ ID NO: 1684708 - DNA, 19 bp, Homo sapiens
tacacagaaatgctgctgg

SEQ ID NO: 1684709 - DNA, 12 bp, Homo sapiens
tacacagagaag

SEQ ID NO: 1684710 - DNA, 13 bp, Homo sapiens
tacacagagaagg

SEQ ID NO: 1684711 - DNA, 22 bp, Homo sapiens
tacacagatcacagcttcagcc

SEQ ID NO: 1684712 - DNA, 21 bp, Homo sapiens
tacacagattctgccttgttt

SEQ ID NO: 1684713 - DNA, 20 bp, Homo sapiens
tacacagcacaccagccgct

SEQ ID NO: 1684714 - DNA, 23 bp, Homo sapiens
tacacagcacaccagccgctgca

SEQ ID NO: 1684715 - DNA, 13 bp, Homo sapiens
tacacagtcagct

SEQ ID NO: 1684716 - DNA, 19 bp, Homo sapiens
tacacagtgggaagatttt

SEQ ID NO: 1684717 - DNA, 11 bp, Homo sapiens
tacacagttgc

SEQ ID NO: 1684718 - DNA, 21 bp, Homo sapiens
tacacataagaccgtgtccca

SEQ ID NO: 1684719 - DNA, 23 bp, Homo sapiens
tacacataagaccgtgtcccaag

SEQ ID NO: 1684720 - DNA, 18 bp, Homo sapiens
tacacatatttgaagggt

SEQ ID NO: 1684721 - DNA, 20 bp, Homo sapiens
tacacatatttgaagggtct

SEQ ID NO: 1684722 - DNA, 22 bp, Homo sapiens
tacacatcagccatcaactaaa

SEQ ID NO: 1684723 - DNA, 14 bp, Homo sapiens
tacacatgaaaaca

SEQ ID NO: 1684724 - DNA, 15 bp, Homo sapiens
tacacatgaaaacaa

SEQ ID NO: 1684725 - DNA, 21 bp, Homo sapiens
tacacatgaaaacaagaaaga

SEQ ID NO: 1684726 - DNA, 15 bp, Homo sapiens
tacacatgttgcctt

SEQ ID NO: 1684727 - DNA, 13 bp, Homo sapiens
tacacattagatt

SEQ ID NO: 1684728 - DNA, 14 bp, Homo sapiens
tacacattagattt

SEQ ID NO: 1684729 - DNA, 20 bp, Homo sapiens
tacaccaactcctaatttta

SEQ ID NO: 1684730 - DNA, 19 bp, Homo sapiens
tacaccaatgaaaacatgt

SEQ ID NO: 1684731 - DNA, 22 bp, Homo sapiens
tacaccaatttggtaaaaatgc

SEQ ID NO: 1684732 - DNA, 24 bp, Homo sapiens
tacaccatgtttgagctcagaccc

SEQ ID NO: 1684733 - DNA, 13 bp, Homo sapiens
tacacccaatttt

SEQ ID NO: 1684734 - DNA, 17 bp, Homo sapiens
tacaccgactagccagg

SEQ ID NO: 1684735 - DNA, 21 bp, Homo sapiens
tacaccgtttagaaaaaacaa

SEQ ID NO: 1684736 - DNA, 15 bp, Homo sapiens
tacacctaaaggtgt

SEQ ID NO: 1684737 - DNA, 13 bp, Homo sapiens
tacacctccctcc

SEQ ID NO: 1684738 - DNA, 17 bp, Homo sapiens
tacacgtatctcttggt

SEQ ID NO: 1684739 - DNA, 17 bp, Homo sapiens
tacacgtctggaccccg

SEQ ID NO: 1684740 - DNA, 22 bp, Homo sapiens
tacactaccaaacactcagtcc

SEQ ID NO: 1684741 - DNA, 16 bp, Homo sapiens
tacactcaggctttca

SEQ ID NO: 1684742 - DNA, 18 bp, Homo sapiens
tacactccagcctgagca

SEQ ID NO: 1684743 - DNA, 20 bp, Homo sapiens
tacactgaaaggaaaaatgt

SEQ ID NO: 1684744 - DNA, 20 bp, Homo sapiens
tacactgaagttaacagaga

SEQ ID NO: 1684745 - DNA, 17 bp, Homo sapiens
tacactgaatatttata

SEQ ID NO: 1684746 - DNA, 14 bp, Homo sapiens
tacactgaggactg

SEQ ID NO: 1684747 - DNA, 15 bp, Homo sapiens
tacactgaggactgt

SEQ ID NO: 1684748 - DNA, 16 bp, Homo sapiens
tacactgcggaagcca

SEQ ID NO: 1684749 - DNA, 19 bp, Homo sapiens
tacactgcggaagccaaag

SEQ ID NO: 1684750 - DNA, 22 bp, Homo sapiens
tacactgcggaagccaaaggca

SEQ ID NO: 1684751 - DNA, 11 bp, Homo sapiens
tacactggtct

SEQ ID NO: 1684752 - DNA, 16 bp, Homo sapiens
tacactggtctaatgt

SEQ ID NO: 1684753 - DNA, 19 bp, Homo sapiens
tacactgtagtttttgaaa

SEQ ID NO: 1684754 - DNA, 23 bp, Homo sapiens
tacactgtagtttttgaaaatta

SEQ ID NO: 1684755 - DNA, 13 bp, Homo sapiens
tacactgtatcta

SEQ ID NO: 1684756 - DNA, 16 bp, Homo sapiens
tacactgtatctaaaa

SEQ ID NO: 1684757 - DNA, 16 bp, Homo sapiens
tacacttacactttat

SEQ ID NO: 1684758 - DNA, 13 bp, Homo sapiens
tacacttggagcc

SEQ ID NO: 1684759 - DNA, 13 bp, Homo sapiens
tacacttggattt

SEQ ID NO: 1684760 - DNA, 17 bp, Homo sapiens
tacacttggatttcatt

SEQ ID NO: 1684761 - DNA, 21 bp, Homo sapiens
tacactttatgccggatgtgc

SEQ ID NO: 1684762 - DNA, 23 bp, Homo sapiens
tacactttatgccggatgtgctt

SEQ ID NO: 1684763 - DNA, 22 bp, Homo sapiens
tacactttgttgcaagatgtga

SEQ ID NO: 1684764 - DNA, 15 bp, Homo sapiens
tacagaaaaatcttg

SEQ ID NO: 1684765 - DNA, 12 bp, Homo sapiens
tacagaaaattg

SEQ ID NO: 1684766 - DNA, 21 bp, Homo sapiens
tacagaaagaaaaatgcatta

SEQ ID NO: 1684767 - DNA, 21 bp, Homo sapiens
tacagaaagatggatgtgctt

SEQ ID NO: 1684768 - DNA, 14 bp, Homo sapiens
tacagaaatgcaaa

SEQ ID NO: 1684769 - DNA, 15 bp, Homo sapiens
tacagaaatgcaaaa

SEQ ID NO: 1684770 - DNA, 17 bp, Homo sapiens
tacagaaattagccggg

SEQ ID NO: 1684771 - DNA, 17 bp, Homo sapiens
tacagaaattctgcaag

SEQ ID NO: 1684772 - DNA, 11 bp, Homo sapiens
tacagaactac

SEQ ID NO: 1684773 - DNA, 13 bp, Homo sapiens
tacagaaggcaaa

SEQ ID NO: 1684774 - DNA, 18 bp, Homo sapiens
tacagaatatttctattg

SEQ ID NO: 1684775 - DNA, 20 bp, Homo sapiens
tacagaattggatacagtac

SEQ ID NO: 1684776 - DNA, 18 bp, Homo sapiens
tacagacaaggttctgcc

SEQ ID NO: 1684777 - DNA, 14 bp, Homo sapiens
tacagacactaagt

SEQ ID NO: 1684778 - DNA, 22 bp, Homo sapiens
tacagacattcaatgaattata

SEQ ID NO: 1684779 - DNA, 20 bp, Homo sapiens
tacagacctggctctcagag

SEQ ID NO: 1684780 - DNA, 17 bp, Homo sapiens
tacagacgctgctgtca

SEQ ID NO: 1684781 - DNA, 14 bp, Homo sapiens
tacagactgtttta

SEQ ID NO: 1684782 - DNA, 16 bp, Homo sapiens
tacagactgttttact

SEQ ID NO: 1684783 - DNA, 20 bp, Homo sapiens
tacagactgttttactgttt

SEQ ID NO: 1684784 - DNA, 16 bp, Homo sapiens
tacagagaaagaaatt

SEQ ID NO: 1684785 - DNA, 23 bp, Homo sapiens
tacagagaagtgaataactgcaa

SEQ ID NO: 1684786 - DNA, 17 bp, Homo sapiens
tacagagaggatacatt

SEQ ID NO: 1684787 - DNA, 21 bp, Homo sapiens
tacagagaggatacatttaat

SEQ ID NO: 1684788 - DNA, 23 bp, Homo sapiens
tacatcttttctaatcacagtgt

SEQ ID NO: 1684789 - DNA, 21 bp, Homo sapiens
tacatgaaacagaaacaaaaa

SEQ ID NO: 1684790 - DNA, 17 bp, Homo sapiens
tacatgagccagtgatt

SEQ ID NO: 1684791 - DNA, 20 bp, Homo sapiens
tacatgaggaactgtagatg

SEQ ID NO: 1684792 - DNA, 23 bp, Homo sapiens
tacatgaggaactgtagatgatg

SEQ ID NO: 1684793 - DNA, 22 bp, Homo sapiens
tacatgcagcccatgcccacct

SEQ ID NO: 1684794 - DNA, 17 bp, Homo sapiens
tacatgcatacaaagag

SEQ ID NO: 1684795 - DNA, 17 bp, Homo sapiens
tacatgctgtgctcttt

SEQ ID NO: 1684796 - DNA, 16 bp, Homo sapiens
tacatggaaaggattt

SEQ ID NO: 1684797 - DNA, 16 bp, Homo sapiens
tacatggcagagtttg

SEQ ID NO: 1684798 - DNA, 16 bp, Homo sapiens
tacatggttgtgacct

SEQ ID NO: 1684799 - DNA, 17 bp, Homo sapiens
tacatgtattaaattac

SEQ ID NO: 1684800 - DNA, 19 bp, Homo sapiens
tacatgtattaaattacat

SEQ ID NO: 1684801 - DNA, 15 bp, Homo sapiens
tacatgtgatacatt

SEQ ID NO: 1684802 - DNA, 17 bp, Homo sapiens
tacatgtgatacatttt

SEQ ID NO: 1684803 - DNA, 20 bp, Homo sapiens
tactttataactaacatgtc

SEQ ID NO: 1684804 - DNA, 22 bp, Homo sapiens
tactttattgtacagactgttt

SEQ ID NO: 1684805 - DNA, 13 bp, Homo sapiens
tactttatttctg

SEQ ID NO: 1684806 - DNA, 23 bp, Homo sapiens
tacagagaggatacatttaataa

SEQ ID NO: 1684807 - DNA, 12 bp, Homo sapiens
tacagagcacat

SEQ ID NO: 1684808 - DNA, 14 bp, Homo sapiens
tacagaggacagta

SEQ ID NO: 1684809 - DNA, 15 bp, Homo sapiens
tacagaggaccctta

SEQ ID NO: 1684810 - DNA, 18 bp, Homo sapiens
tacagaggatgccttttc

SEQ ID NO: 1684811 - DNA, 19 bp, Homo sapiens
tacagaggatgccttttct

SEQ ID NO: 1684812 - DNA, 20 bp, Homo sapiens
tacagaggatgccttttctg

SEQ ID NO: 1684813 - DNA, 16 bp, Homo sapiens
tacagaggtattaaaa

SEQ ID NO: 1684814 - DNA, 23 bp, Homo sapiens
tacagagtgggccccgggctgga

SEQ ID NO: 1684815 - DNA, 13 bp, Homo sapiens
tacagataaatga

SEQ ID NO: 1684816 - DNA, 21 bp, Homo sapiens
tacagataaatgattcaaaaa

SEQ ID NO: 1684817 - DNA, 16 bp, Homo sapiens
tacagataattcattt

SEQ ID NO: 1684818 - DNA, 22 bp, Homo sapiens
tacagataattcatttgtattg

SEQ ID NO: 1684819 - DNA, 24 bp, Homo sapiens
tacagataattcatttgtattgct

SEQ ID NO: 1684820 - DNA, 14 bp, Homo sapiens
tacagatactgtga

SEQ ID NO: 1684821 - DNA, 14 bp, Homo sapiens
tacagatttagttt

SEQ ID NO: 1684822 - DNA, 19 bp, Homo sapiens
tacagatttagtttaccaa

SEQ ID NO: 1684823 - DNA, 19 bp, Homo sapiens
tacagcaaaagatgtgcaa

SEQ ID NO: 1684824 - DNA, 21 bp, Homo sapiens
tacagcaacaggaatctcaga

SEQ ID NO: 1684825 - DNA, 21 bp, Homo sapiens
tacagcacatcacctctttgc

SEQ ID NO: 1684826 - DNA, 15 bp, Homo sapiens
tacagcactactctg

SEQ ID NO: 1684827 - DNA, 21 bp, Homo sapiens
tacagcattacaaattgctta

SEQ ID NO: 1684828 - DNA, 16 bp, Homo sapiens
tagaagttactgaatg

SEQ ID NO: 1684829 - DNA, 19 bp, Homo sapiens
tagaataaaagctataaag

SEQ ID NO: 1684830 - DNA, 17 bp, Homo sapiens
tagaataaggaggagga

SEQ ID NO: 1684831 - DNA, 16 bp, Homo sapiens
tagaataatctattat

SEQ ID NO: 1684832 - DNA, 23 bp, Homo sapiens
tagaatacagttttgagtagagt

SEQ ID NO: 1684833 - DNA, 12 bp, Homo sapiens
tagaatactttt

SEQ ID NO: 1684834 - DNA, 21 bp, Homo sapiens
tagaatacttttttctagttt

SEQ ID NO: 1684835 - DNA, 19 bp, Homo sapiens
tagaggaaataagaaaaat

SEQ ID NO: 1684836 - DNA, 16 bp, Homo sapiens
tagaggagctgcttgt

SEQ ID NO: 1684837 - DNA, 22 bp, Homo sapiens
tagaggatgggcagctgggggg

SEQ ID NO: 1684838 - DNA, 22 bp, Homo sapiens
tagaggcaacaggattgatcat

SEQ ID NO: 1684839 - DNA, 19 bp, Homo sapiens
tagaggcagggaggggact

SEQ ID NO: 1684840 - DNA, 13 bp, Homo sapiens
tagaggccaccta

SEQ ID NO: 1684841 - DNA, 16 bp, Homo sapiens
tagaggccagggcagc

SEQ ID NO: 1684842 - DNA, 12 bp, Homo sapiens
tagaggcccagg

SEQ ID NO: 1684843 - DNA, 13 bp, Homo sapiens
tagaggcccaggc

SEQ ID NO: 1684844 - DNA, 18 bp, Homo sapiens
tagaggcgagccaggcaa

SEQ ID NO: 1684845 - DNA, 19 bp, Homo sapiens
tagaggcgagccaggcaag

SEQ ID NO: 1684846 - DNA, 20 bp, Homo sapiens
tagcagggcatggctgggaa

SEQ ID NO: 1684847 - DNA, 16 bp, Homo sapiens
tagcaggggcaccttc

SEQ ID NO: 1684848 - DNA, 17 bp, Homo sapiens
tagcaggggcaccttcc

SEQ ID NO: 1684849 - DNA, 21 bp, Homo sapiens
tagcagttgctcacatgtctt

SEQ ID NO: 1684850 - DNA, 14 bp, Homo sapiens
tagcatactggctt

SEQ ID NO: 1684851 - DNA, 16 bp, Homo sapiens
tagcatcctcttaatg

SEQ ID NO: 1684852 - DNA, 19 bp, Homo sapiens
tagcatcctgattattgaa

SEQ ID NO: 1684853 - DNA, 23 bp, Homo sapiens
tagcatcctgattattgaatgtt

SEQ ID NO: 1684854 - DNA, 14 bp, Homo sapiens
tagcatctgagaag

SEQ ID NO: 1684855 - DNA, 15 bp, Homo sapiens
tagcatgacatttct

SEQ ID NO: 1684856 - DNA, 16 bp, Homo sapiens
tagcatgacatttctt

SEQ ID NO: 1684857 - DNA, 14 bp, Homo sapiens
tagcatgcttcctt

SEQ ID NO: 1684858 - DNA, 23 bp, Homo sapiens
tagcatgcttcctttctctcctg

SEQ ID NO: 1684859 - DNA, 13 bp, Homo sapiens
tagcatgggaggt

SEQ ID NO: 1684860 - DNA, 16 bp, Homo sapiens
tagcatggggcccctg

SEQ ID NO: 1684861 - DNA, 13 bp, Homo sapiens
tagcattacctaa

SEQ ID NO: 1684862 - DNA, 12 bp, Homo sapiens
tagcatttcttg

SEQ ID NO: 1684863 - DNA, 12 bp, Homo sapiens
tagcatttgtat

SEQ ID NO: 1684864 - DNA, 12 bp, Homo sapiens
tagcatttgttt

SEQ ID NO: 1684865 - DNA, 14 bp, Homo sapiens
tagccaaagccagg

SEQ ID NO: 1684866 - DNA, 17 bp, Homo sapiens
tagccaaagccaggcct

SEQ ID NO: 1684867 - DNA, 22 bp, Homo sapiens
tagccaactgtttccctgctga

SEQ ID NO: 1684868 - DNA, 23 bp, Homo sapiens
tagccaactgtttccctgctgaa

SEQ ID NO: 1684869 - DNA, 17 bp, Homo sapiens
tagccaaggcccggggt

SEQ ID NO: 1684870 - DNA, 21 bp, Homo sapiens
tagccaatgtctcctcccctt

SEQ ID NO: 1684871 - DNA, 17 bp, Homo sapiens
tagccacctcccacccc

SEQ ID NO: 1684872 - DNA, 18 bp, Homo sapiens
tagccacctcccacccca

SEQ ID NO: 1684873 - DNA, 11 bp, Homo sapiens
tagccactggc

SEQ ID NO: 1684874 - DNA, 20 bp, Homo sapiens
tagccagacaaaatttgaga

SEQ ID NO: 1684875 - DNA, 15 bp, Homo sapiens
tagccagacactctg

SEQ ID NO: 1684876 - DNA, 19 bp, Homo sapiens
tagccagagaggagcacct

SEQ ID NO: 1684877 - DNA, 20 bp, Homo sapiens
tagccagagaggagcacctg

SEQ ID NO: 1684878 - DNA, 21 bp, Homo sapiens
tagccagagggtgggagccta

SEQ ID NO: 1684879 - DNA, 19 bp, Homo sapiens
tagccagcattcagcacac

SEQ ID NO: 1684880 - DNA, 21 bp, Homo sapiens
tagccagcattcagcacacac

SEQ ID NO: 1684881 - DNA, 17 bp, Homo sapiens
tagccagccaggtgcat

SEQ ID NO: 1684882 - DNA, 18 bp, Homo sapiens
tagccagcccctcttccc

SEQ ID NO: 1684883 - DNA, 16 bp, Homo sapiens
tagccaggagtctgtg

SEQ ID NO: 1684884 - DNA, 19 bp, Homo sapiens
tagccaggagtctgtgctc

SEQ ID NO: 1684885 - DNA, 21 bp, Homo sapiens
tagccaggagtctgtgctctt

SEQ ID NO: 1684886 - DNA, 16 bp, Homo sapiens
tagccaggatggtctc

SEQ ID NO: 1684887 - DNA, 16 bp, Homo sapiens
tagccaggtactgcat

SEQ ID NO: 1684888 - DNA, 14 bp, Homo sapiens
tagccagtgacttt

SEQ ID NO: 1684889 - DNA, 23 bp, Homo sapiens
tagccagtgactttttctgagct

SEQ ID NO: 1684890 - DNA, 16 bp, Homo sapiens
tagccagttcaaagtg

SEQ ID NO: 1684891 - DNA, 14 bp, Homo sapiens
tagccatggctcag

SEQ ID NO: 1684892 - DNA, 18 bp, Homo sapiens
tagccattcctggtaccc

SEQ ID NO: 1684893 - DNA, 12 bp, Homo sapiens
tagccatttggt

SEQ ID NO: 1684894 - DNA, 20 bp, Homo sapiens
tagcccaagaggtctgagcc

SEQ ID NO: 1684895 - DNA, 14 bp, Homo sapiens
tagcccagcactgt

SEQ ID NO: 1684896 - DNA, 15 bp, Homo sapiens
tagcccagcactgtg

SEQ ID NO: 1684897 - DNA, 19 bp, Homo sapiens
tagcccagcactgtgaaga

SEQ ID NO: 1684898 - DNA, 20 bp, Homo sapiens
tagcccagcactgtgaagac

SEQ ID NO: 1684899 - DNA, 20 bp, Homo sapiens
tagcccagtgttttctttga

SEQ ID NO: 1684900 - DNA, 13 bp, Homo sapiens
tagccccaaatct

SEQ ID NO: 1684901 - DNA, 14 bp, Homo sapiens
tagccccagactgg

SEQ ID NO: 1684902 - DNA, 23 bp, Homo sapiens
tagccccagactgggcccaggca

SEQ ID NO: 1684903 - DNA, 16 bp, Homo sapiens
tagccccctggcctct

SEQ ID NO: 1684904 - DNA, 17 bp, Homo sapiens
tagccccctggcctctg

SEQ ID NO: 1684905 - DNA, 21 bp, Homo sapiens
tagccccttggattcctgcac

SEQ ID NO: 1684906 - DNA, 15 bp, Homo sapiens
tagccctgccctccc

SEQ ID NO: 1684907 - DNA, 17 bp, Homo sapiens
tagccgacctcagcctt

SEQ ID NO: 1684908 - DNA, 18 bp, Homo sapiens
tagccgagagcctgctcc

SEQ ID NO: 1684909 - DNA, 21 bp, Homo sapiens
tagccgcaccctgcacctgct

SEQ ID NO: 1684910 - DNA, 14 bp, Homo sapiens
tagccgccctgaga

SEQ ID NO: 1684911 - DNA, 23 bp, Homo sapiens
tagccgcgtgacggacatccagg

SEQ ID NO: 1684912 - DNA, 15 bp, Homo sapiens
tagccgggcatggtg

SEQ ID NO: 1684913 - DNA, 19 bp, Homo sapiens
tagccgggcatggtggcgc

SEQ ID NO: 1684914 - DNA, 20 bp, Homo sapiens
tagccgtccatggcaccagc

SEQ ID NO: 1684915 - DNA, 15 bp, Homo sapiens
tagcctaaagggcag

SEQ ID NO: 1684916 - DNA, 16 bp, Homo sapiens
tagcctaaagggcagg

SEQ ID NO: 1684917 - DNA, 22 bp, Homo sapiens
tagcctaaagtatacaactgcc

SEQ ID NO: 1684918 - DNA, 20 bp, Homo sapiens
tagcctaaggctcctgtttt

SEQ ID NO: 1684919 - DNA, 12 bp, Homo sapiens
tagcctccctga

SEQ ID NO: 1684920 - DNA, 21 bp, Homo sapiens
tagcctccgtttatgggcctt

SEQ ID NO: 1684921 - DNA, 22 bp, Homo sapiens
tagcctccgtttatgggccttg

SEQ ID NO: 1684922 - DNA, 12 bp, Homo sapiens
tagcctctccca

SEQ ID NO: 1684923 - DNA, 14 bp, Homo sapiens
tagcctctcccacc

SEQ ID NO: 1684924 - DNA, 14 bp, Homo sapiens
tagcctctggatct

SEQ ID NO: 1684925 - DNA, 20 bp, Homo sapiens
tagcctgatctttctagagc

SEQ ID NO: 1684926 - DNA, 13 bp, Homo sapiens
tagcctgatgaga

SEQ ID NO: 1684927 - DNA, 23 bp, Homo sapiens
tagcctgatttggggtttcttca

SEQ ID NO: 1684928 - DNA, 19 bp, Homo sapiens
tagcctggcaacagagcga

SEQ ID NO: 1684929 - DNA, 18 bp, Homo sapiens
tagcctgtgcctctggga

SEQ ID NO: 1684930 - DNA, 20 bp, Homo sapiens
tagcctgtgcctctgggact

SEQ ID NO: 1684931 - DNA, 15 bp, Homo sapiens
tagccttgtgccctg

SEQ ID NO: 1684932 - DNA, 18 bp, Homo sapiens
tagccttgtgccctgccc

SEQ ID NO: 1684933 - DNA, 18 bp, Homo sapiens
tagcctttacctgtgaag

SEQ ID NO: 1684934 - DNA, 16 bp, Homo sapiens
tagcgatctctcctgg

SEQ ID NO: 1684935 - DNA, 20 bp, Homo sapiens
tagcgatgtgcaggaagaaa

SEQ ID NO: 1684936 - DNA, 22 bp, Homo sapiens
tagcgctgccgcaccccagagt

SEQ ID NO: 1684937 - DNA, 13 bp, Homo sapiens
tagcgctgttttt

SEQ ID NO: 1684938 - DNA, 14 bp, Homo sapiens
tagcggagcccagc

SEQ ID NO: 1684939 - DNA, 15 bp, Homo sapiens
tagcgtcaagacatt

SEQ ID NO: 1684940 - DNA, 20 bp, Homo sapiens
tagcgtcaagacatttgctg

SEQ ID NO: 1684941 - DNA, 21 bp, Homo sapiens
tagcgtcaagacatttgctga

SEQ ID NO: 1684942 - DNA, 19 bp, Homo sapiens
tagcgtcctgccctgcccc

SEQ ID NO: 1684943 - DNA, 14 bp, Homo sapiens
tagcgttctggact

SEQ ID NO: 1684944 - DNA, 15 bp, Homo sapiens
tagctaactgtaaat

SEQ ID NO: 1684945 - DNA, 17 bp, Homo sapiens
tagctaactgtaaatca

SEQ ID NO: 1684946 - DNA, 19 bp, Homo sapiens
tagctaatgtaataactgt

SEQ ID NO: 1684947 - DNA, 14 bp, Homo sapiens
tagctacagcttgt

SEQ ID NO: 1684948 - DNA, 15 bp, Homo sapiens
tagctacagcttgtt

SEQ ID NO: 1684949 - DNA, 20 bp, Homo sapiens
tagctacaggaagcacccca

SEQ ID NO: 1684950 - DNA, 23 bp, Homo sapiens
tagctacaggaagcaccccatgc

SEQ ID NO: 1684951 - DNA, 18 bp, Homo sapiens
tagctactgtatgcaaag

SEQ ID NO: 1684952 - DNA, 19 bp, Homo sapiens
tagctagaaatatgatttt

SEQ ID NO: 1684953 - DNA, 14 bp, Homo sapiens
tagctagaagtggg

SEQ ID NO: 1684954 - DNA, 19 bp, Homo sapiens
tagctagaagtgggccagg

SEQ ID NO: 1684955 - DNA, 13 bp, Homo sapiens
tagctagaatatc

SEQ ID NO: 1684956 - DNA, 17 bp, Homo sapiens
tagctagaatatcctat

SEQ ID NO: 1684957 - DNA, 14 bp, Homo sapiens
tagctcaccaggcc

SEQ ID NO: 1684958 - DNA, 19 bp, Homo sapiens
tagctcaccaggcctggcc

SEQ ID NO: 1684959 - DNA, 20 bp, Homo sapiens
tagctcaccaggcctggcct

SEQ ID NO: 1684960 - DNA, 21 bp, Homo sapiens
tagctcaccaggcctggcctc

SEQ ID NO: 1684961 - DNA, 22 bp, Homo sapiens
tagctcaccaggcctggcctct

SEQ ID NO: 1684962 - DNA, 12 bp, Homo sapiens
tagctcactgaa

SEQ ID NO: 1684963 - DNA, 15 bp, Homo sapiens
tagctcaggtgcctt

SEQ ID NO: 1684964 - DNA, 11 bp, Homo sapiens
tagctcagttt

SEQ ID NO: 1684965 - DNA, 20 bp, Homo sapiens
tagctccacaccctctccca

SEQ ID NO: 1684966 - DNA, 11 bp, Homo sapiens
tagctccagcg

SEQ ID NO: 1684967 - DNA, 23 bp, Homo sapiens
tagctccagcgatggtgctgccc

SEQ ID NO: 1684968 - DNA, 14 bp, Homo sapiens
tagctccctcctcc

SEQ ID NO: 1684969 - DNA, 18 bp, Homo sapiens
tagctccctcctcccatc

SEQ ID NO: 1684970 - DNA, 23 bp, Homo sapiens
tagctccctcctcccatctcctt

SEQ ID NO: 1684971 - DNA, 16 bp, Homo sapiens
tagctcctccccttcc

SEQ ID NO: 1684972 - DNA, 21 bp, Homo sapiens
tagctcctgccacatggagcc

SEQ ID NO: 1684973 - DNA, 12 bp, Homo sapiens
tagctcctgtgg

SEQ ID NO: 1684974 - DNA, 13 bp, Homo sapiens
tagctcctgtggc

SEQ ID NO: 1684975 - DNA, 14 bp, Homo sapiens
tagctcctgtggcc

SEQ ID NO: 1684976 - DNA, 22 bp, Homo sapiens
tagctcctgtggccccaccctg

SEQ ID NO: 1684977 - DNA, 17 bp, Homo sapiens
tagctctatgtttacaa

SEQ ID NO: 1684978 - DNA, 13 bp, Homo sapiens
tagctctctaggc

SEQ ID NO: 1684979 - DNA, 17 bp, Homo sapiens
tagctctgcctccctct

SEQ ID NO: 1684980 - DNA, 13 bp, Homo sapiens
tagctctggacgt

SEQ ID NO: 1684981 - DNA, 13 bp, Homo sapiens
tagctctttcctt

SEQ ID NO: 1684982 - DNA, 23 bp, Homo sapiens
tagctgaaaagggcactcccaac

SEQ ID NO: 1684983 - DNA, 17 bp, Homo sapiens
tagctgaagaattgaaa

SEQ ID NO: 1684984 - DNA, 15 bp, Homo sapiens
tagctgacagtcagc

SEQ ID NO: 1684985 - DNA, 19 bp, Homo sapiens
tagctgacagtcagctgtg

SEQ ID NO: 1684986 - DNA, 23 bp, Homo sapiens
tagctgacccagccccttgagaa

SEQ ID NO: 1684987 - DNA, 22 bp, Homo sapiens
tagctgaccccgagaagtgctc

SEQ ID NO: 1684988 - DNA, 11 bp, Homo sapiens
tagctgagtgt

SEQ ID NO: 1684989 - DNA, 14 bp, Homo sapiens
tagctgatgaaact

SEQ ID NO: 1684990 - DNA, 16 bp, Homo sapiens
tagctgccactttcac

SEQ ID NO: 1684991 - DNA, 23 bp, Homo sapiens
tagctgccttcaaggactgtttc

SEQ ID NO: 1684992 - DNA, 23 bp, Homo sapiens
tagctgctagtgaaatggctggg

SEQ ID NO: 1684993 - DNA, 16 bp, Homo sapiens
tagctgggaaagcata

SEQ ID NO: 1684994 - DNA, 23 bp, Homo sapiens
tagctgtaagggcagtgcccatg

SEQ ID NO: 1684995 - DNA, 23 bp, Homo sapiens
tagctgtacttcttgaatataaa

SEQ ID NO: 1684996 - DNA, 14 bp, Homo sapiens
tagctgtcccatgg

SEQ ID NO: 1684997 - DNA, 15 bp, Homo sapiens
tagctgttctggact

SEQ ID NO: 1684998 - DNA, 20 bp, Homo sapiens
tagctgttttaagaaatctg

SEQ ID NO: 1684999 - DNA, 20 bp, Homo sapiens
tagcttacactgaggactgt

SEQ ID NO: 1685000 - DNA, 18 bp, Homo sapiens
tagcttacctgaacagga

SEQ ID NO: 1685001 - DNA, 17 bp, Homo sapiens
tagcttagacctcagcc

SEQ ID NO: 1685002 - DNA, 20 bp, Homo sapiens
tagcttagtgctatgtgtga

SEQ ID NO: 1685003 - DNA, 14 bp, Homo sapiens
tagcttctgtgtgt

SEQ ID NO: 1685004 - DNA, 16 bp, Homo sapiens
tagcttctgtgtgtga

SEQ ID NO: 1685005 - DNA, 19 bp, Homo sapiens
tagcttgataaagggccaa

SEQ ID NO: 1685006 - DNA, 17 bp, Homo sapiens
tagcttgcagaactgta

SEQ ID NO: 1685007 - DNA, 20 bp, Homo sapiens
tagcttgttagtaatgctct

SEQ ID NO: 1685008 - DNA, 17 bp, Homo sapiens
tagctttaaaaccacag

SEQ ID NO: 1685009 - DNA, 19 bp, Homo sapiens
tagctttactgtttgttat

SEQ ID NO: 1685010 - DNA, 14 bp, Homo sapiens
tagctttattcttc

SEQ ID NO: 1685011 - DNA, 22 bp, Homo sapiens
tagctttattttttaagtattt

SEQ ID NO: 1685012 - DNA, 13 bp, Homo sapiens
tagctttccacat

SEQ ID NO: 1685013 - DNA, 18 bp, Homo sapiens
tagctttccacatttgtc

SEQ ID NO: 1685014 - DNA, 14 bp, Homo sapiens
tagctttcctggtc

SEQ ID NO: 1685015 - DNA, 15 bp, Homo sapiens
tagctttttcctgga

SEQ ID NO: 1685016 - DNA, 13 bp, Homo sapiens
taggaaacaagtg

SEQ ID NO: 1685017 - DNA, 20 bp, Homo sapiens
taggaaactgaagcataaag

SEQ ID NO: 1685018 - DNA, 22 bp, Homo sapiens
taggaaatggctttgtgattca

SEQ ID NO: 1685019 - DNA, 14 bp, Homo sapiens
taggaaatttaaga

SEQ ID NO: 1685020 - DNA, 18 bp, Homo sapiens
taggaacaatctttgctg

SEQ ID NO: 1685021 - DNA, 22 bp, Homo sapiens
taggaaccgtggtatgtctgcc

SEQ ID NO: 1685022 - DNA, 18 bp, Homo sapiens
taggaactgctgggcttg

SEQ ID NO: 1685023 - DNA, 22 bp, Homo sapiens
taggaactgtctcaaaaggatg

SEQ ID NO: 1685024 - DNA, 18 bp, Homo sapiens
taggaagggaccaaggca

SEQ ID NO: 1685025 - DNA, 15 bp, Homo sapiens
taggaaggttaatgt

SEQ ID NO: 1685026 - DNA, 17 bp, Homo sapiens
taggaagtgtaacagct

SEQ ID NO: 1685027 - DNA, 19 bp, Homo sapiens
taggaagtgtaacagctga

SEQ ID NO: 1685028 - DNA, 20 bp, Homo sapiens
taggaatcccagaggtggga

SEQ ID NO: 1685029 - DNA, 17 bp, Homo sapiens
taggaatgtacatgaag

SEQ ID NO: 1685030 - DNA, 13 bp, Homo sapiens
taggaatgtccac

SEQ ID NO: 1685031 - DNA, 19 bp, Homo sapiens
taggaatgtccaccatgaa

SEQ ID NO: 1685032 - DNA, 18 bp, Homo sapiens
taggacaatcagtcccct

SEQ ID NO: 1685033 - DNA, 23 bp, Homo sapiens
taggaccatggttaagagtccaa

SEQ ID NO: 1685034 - DNA, 22 bp, Homo sapiens
taggacctgcatccttcctggg

SEQ ID NO: 1685035 - DNA, 21 bp, Homo sapiens
taggacctttccaccacagcc

SEQ ID NO: 1685036 - DNA, 16 bp, Homo sapiens
taggacgtatttataa

SEQ ID NO: 1685037 - DNA, 18 bp, Homo sapiens
taggactaccgcaggccc

SEQ ID NO: 1685038 - DNA, 16 bp, Homo sapiens
taggactctgaggctc

SEQ ID NO: 1685039 - DNA, 20 bp, Homo sapiens
taggagaaccaaatctggaa

SEQ ID NO: 1685040 - DNA, 15 bp, Homo sapiens
taggagaagccagga

SEQ ID NO: 1685041 - DNA, 17 bp, Homo sapiens
taggagaatagcagaga

SEQ ID NO: 1685042 - DNA, 22 bp, Homo sapiens
taggagaattgcttgaacctgg

SEQ ID NO: 1685043 - DNA, 21 bp, Homo sapiens
taggagaccaaggcgggagca

SEQ ID NO: 1685044 - DNA, 22 bp, Homo sapiens
taggagagactgaaagcagcag

SEQ ID NO: 1685045 - DNA, 13 bp, Homo sapiens
taggagctaaggc

SEQ ID NO: 1685046 - DNA, 16 bp, Homo sapiens
taggagctaaggctct

SEQ ID NO: 1685047 - DNA, 18 bp, Homo sapiens
taggagctgccttggctc

SEQ ID NO: 1685048 - DNA, 23 bp, Homo sapiens
taggagctgccttggctcagaca

SEQ ID NO: 1685049 - DNA, 18 bp, Homo sapiens
taggaggaatgtgctttt

SEQ ID NO: 1685050 - DNA, 22 bp, Homo sapiens
taggaggaatgtgcttttccat

SEQ ID NO: 1685051 - DNA, 20 bp, Homo sapiens
taggaggaccagagctactg

SEQ ID NO: 1685052 - DNA, 14 bp, Homo sapiens
taggagggagactg

SEQ ID NO: 1685053 - DNA, 19 bp, Homo sapiens
taggagtggtgatttgaaa

SEQ ID NO: 1685054 - DNA, 17 bp, Homo sapiens
taggagtggttctcatt

SEQ ID NO: 1685055 - DNA, 12 bp, Homo sapiens
tatcttgtgctt

SEQ ID NO: 1685056 - DNA, 14 bp, Homo sapiens
tatcttgtttttcc

SEQ ID NO: 1685057 - DNA, 21 bp, Homo sapiens
tatctttaccaaaaaccatgt

SEQ ID NO: 1685058 - DNA, 22 bp, Homo sapiens
tatctttccatgggagccagct

SEQ ID NO: 1685059 - DNA, 23 bp, Homo sapiens
tatctttcgtgataaactttgct

SEQ ID NO: 1685060 - DNA, 23 bp, Homo sapiens
tatcttttctattgtttattctt

SEQ ID NO: 1685061 - DNA, 19 bp, Homo sapiens
tatgaaaaattggggagga

SEQ ID NO: 1685062 - DNA, 17 bp, Homo sapiens
tatgaaaatatagacat

SEQ ID NO: 1685063 - DNA, 17 bp, Homo sapiens
tatgaaataaattctga

SEQ ID NO: 1685064 - DNA, 19 bp, Homo sapiens
tatgaaattatataagtat

SEQ ID NO: 1685065 - DNA, 17 bp, Homo sapiens
tatgaacagctgtgtct

SEQ ID NO: 1685066 - DNA, 10 bp, Homo sapiens
tatgaacatc

SEQ ID NO: 1685067 - DNA, 15 bp, Homo sapiens
tatgaacctattttc

SEQ ID NO: 1685068 - DNA, 22 bp, Homo sapiens
tatgaacctattttcatttgta

SEQ ID NO: 1685069 - DNA, 23 bp, Homo sapiens
tatgaacctattttcatttgtac

SEQ ID NO: 1685070 - DNA, 22 bp, Homo sapiens
tatgaagaaaatacttaaatgt

SEQ ID NO: 1685071 - DNA, 17 bp, Homo sapiens
tatgaagaactgaggag

SEQ ID NO: 1685072 - DNA, 21 bp, Homo sapiens
tatgaagacttaaaagagctc

SEQ ID NO: 1685073 - DNA, 21 bp, Homo sapiens
tatgaagggacagctgctggg

SEQ ID NO: 1685074 - DNA, 20 bp, Homo sapiens
tatgaagttgctgtttattt

SEQ ID NO: 1685075 - DNA, 18 bp, Homo sapiens
tatgaataaagacaccta

SEQ ID NO: 1685076 - DNA, 15 bp, Homo sapiens
tatgaatattactct

SEQ ID NO: 1685077 - DNA, 12 bp, Homo sapiens
tatgaatcaaat

SEQ ID NO: 1685078 - DNA, 13 bp, Homo sapiens
tatgaatcaaata

SEQ ID NO: 1685079 - DNA, 22 bp, Homo sapiens
tatgaatccaacgtgtaaccag

SEQ ID NO: 1685080 - DNA, 13 bp, Homo sapiens
tatgaatctataa

SEQ ID NO: 1685081 - DNA, 12 bp, Homo sapiens
tatgaatctatt

SEQ ID NO: 1685082 - DNA, 18 bp, Homo sapiens
tatgaatctattatactg

SEQ ID NO: 1685083 - DNA, 23 bp, Homo sapiens
tatgaatctattatactgtatta

SEQ ID NO: 1685084 - DNA, 18 bp, Homo sapiens
tatgaattcaagaaagga

SEQ ID NO: 1685085 - DNA, 23 bp, Homo sapiens
tatgaatttaaatataattctgt

SEQ ID NO: 1685086 - DNA, 11 bp, Homo sapiens
tatgacacagt

SEQ ID NO: 1685087 - DNA, 15 bp, Homo sapiens
tatgacagttatact

SEQ ID NO: 1685088 - DNA, 23 bp, Homo sapiens
tatgacataaaaacaactttata

SEQ ID NO: 1685089 - DNA, 15 bp, Homo sapiens
tatgacctaagtcag

SEQ ID NO: 1685090 - DNA, 21 bp, Homo sapiens
tatgacctaggggtttctgtt

SEQ ID NO: 1685091 - DNA, 23 bp, Homo sapiens
tatgacgcggctcaaaaggaaac

SEQ ID NO: 1685092 - DNA, 20 bp, Homo sapiens
tatgacggaagaacatagaa

SEQ ID NO: 1685093 - DNA, 14 bp, Homo sapiens
tatgactacatttt

SEQ ID NO: 1685094 - DNA, 22 bp, Homo sapiens
tatgagaacaagtcacagctgc

SEQ ID NO: 1685095 - DNA, 19 bp, Homo sapiens
tatgagatggttaaaaagg

SEQ ID NO: 1685096 - DNA, 22 bp, Homo sapiens
tatgagatggttaaaaaggcca

SEQ ID NO: 1685097 - DNA, 20 bp, Homo sapiens
tatgagattggttttcctgt

SEQ ID NO: 1685098 - DNA, 19 bp, Homo sapiens
tatgagccagacaaatgga

SEQ ID NO: 1685099 - DNA, 16 bp, Homo sapiens
tatgagctacaacaaa

SEQ ID NO: 1685100 - DNA, 14 bp, Homo sapiens
tatgagcttcaata

SEQ ID NO: 1685101 - DNA, 21 bp, Homo sapiens
tatgagcttccttctgtgaaa

SEQ ID NO: 1685102 - DNA, 16 bp, Homo sapiens
tatgagctttctttgc

SEQ ID NO: 1685103 - DNA, 20 bp, Homo sapiens
tatgaggggcagtggacagt

SEQ ID NO: 1685104 - DNA, 15 bp, Homo sapiens
tatgagttactgaag

SEQ ID NO: 1685105 - DNA, 12 bp, Homo sapiens
tatgagttcttc

SEQ ID NO: 1685106 - DNA, 18 bp, Homo sapiens
tatgagttgttttcagac

SEQ ID NO: 1685107 - DNA, 17 bp, Homo sapiens
tatgataatagattctc

SEQ ID NO: 1685108 - DNA, 21 bp, Homo sapiens
tatgatagatgacaaattggg

SEQ ID NO: 1685109 - DNA, 14 bp, Homo sapiens
tatgatcacagtga

SEQ ID NO: 1685110 - DNA, 14 bp, Homo sapiens
tatgatcagtgttg

SEQ ID NO: 1685111 - DNA, 17 bp, Homo sapiens
tatgatcagtgttgttg

SEQ ID NO: 1685112 - DNA, 14 bp, Homo sapiens
tatgatctaataaa

SEQ ID NO: 1685113 - DNA, 15 bp, Homo sapiens
tatgatgaaaataat

SEQ ID NO: 1685114 - DNA, 22 bp, Homo sapiens
tatgatgatacaagattagaag

SEQ ID NO: 1685115 - DNA, 17 bp, Homo sapiens
tatgtacatttctaagt

SEQ ID NO: 1685116 - DNA, 15 bp, Homo sapiens
tatgtacttagctgt

SEQ ID NO: 1685117 - DNA, 19 bp, Homo sapiens
tatgtacttagctgtacta

SEQ ID NO: 1685118 - DNA, 15 bp, Homo sapiens
tatgtacttgtttgc

SEQ ID NO: 1685119 - DNA, 21 bp, Homo sapiens
tatgtacttttattttacaca

SEQ ID NO: 1685120 - DNA, 12 bp, Homo sapiens
tatgtagatgtg

SEQ ID NO: 1685121 - DNA, 17 bp, Homo sapiens
tatgtagatgtgcattt

SEQ ID NO: 1685122 - DNA, 17 bp, Homo sapiens
tatgtaggtaagactgt

SEQ ID NO: 1685123 - DNA, 21 bp, Homo sapiens
tatgtaggtaagactgtagat

SEQ ID NO: 1685124 - DNA, 15 bp, Homo sapiens
tatgtagtattaaaa

SEQ ID NO: 1685125 - DNA, 18 bp, Homo sapiens
tatgtagtattaaaagtt

SEQ ID NO: 1685126 - DNA, 12 bp, Homo sapiens
tatgtataaaat

SEQ ID NO: 1685127 - DNA, 14 bp, Homo sapiens
tatgtataatatat

SEQ ID NO: 1685128 - DNA, 16 bp, Homo sapiens
tatgtataatatatat

SEQ ID NO: 1685129 - DNA, 14 bp, Homo sapiens
tatgtatacatgtg

SEQ ID NO: 1685130 - DNA, 14 bp, Homo sapiens
tatgtatatgtata

SEQ ID NO: 1685131 - DNA, 17 bp, Homo sapiens
tatgtatattctatttt

SEQ ID NO: 1685132 - DNA, 22 bp, Homo sapiens
tatgtatgggtagggtaaatca

SEQ ID NO: 1685133 - DNA, 23 bp, Homo sapiens
tatgtatgggtagggtaaatcag

SEQ ID NO: 1685134 - DNA, 13 bp, Homo sapiens
tatgtatgtttac

SEQ ID NO: 1685135 - DNA, 21 bp, Homo sapiens
tatgtattatttataattcct

SEQ ID NO: 1685136 - DNA, 18 bp, Homo sapiens
tatgtattcccttgtatt

SEQ ID NO: 1685137 - DNA, 22 bp, Homo sapiens
tatgtattcccttgtattttgt

SEQ ID NO: 1685138 - DNA, 14 bp, Homo sapiens
tatgtattcttttc

SEQ ID NO: 1685139 - DNA, 21 bp, Homo sapiens
tatgtcagtgtaaatccttgt

SEQ ID NO: 1685140 - DNA, 16 bp, Homo sapiens
tatgtcatactctgtg

SEQ ID NO: 1685141 - DNA, 23 bp, Homo sapiens
tatgtccactgtgtatagaagta

SEQ ID NO: 1685142 - DNA, 23 bp, Homo sapiens
tatgtccagaaattgtgtgtgca

SEQ ID NO: 1685143 - DNA, 21 bp, Homo sapiens
tatgtccccataagacaaaca

SEQ ID NO: 1685144 - DNA, 23 bp, Homo sapiens
tatgtccccataagacaaacact

SEQ ID NO: 1685145 - DNA, 18 bp, Homo sapiens
tatgtctcttgagcatca

SEQ ID NO: 1685146 - DNA, 17 bp, Homo sapiens
tatgtcttggacactgt

SEQ ID NO: 1685147 - DNA, 19 bp, Homo sapiens
tatgtcttggacactgtac

SEQ ID NO: 1685148 - DNA, 14 bp, Homo sapiens
tatgtgaaaaatta

SEQ ID NO: 1685149 - DNA, 17 bp, Homo sapiens
tatgtgaaaggaacatt

SEQ ID NO: 1685150 - DNA, 12 bp, Homo sapiens
tatgtgaatgat

SEQ ID NO: 1685151 - DNA, 18 bp, Homo sapiens
tatgtgaatttttaagct

SEQ ID NO: 1685152 - DNA, 19 bp, Homo sapiens
tatgtgacaattttgtaca

SEQ ID NO: 1685153 - DNA, 22 bp, Homo sapiens
tatgtgagagattctgtgatct

SEQ ID NO: 1685154 - DNA, 15 bp, Homo sapiens
tatgtgaggtaatta

SEQ ID NO: 1685155 - DNA, 20 bp, Homo sapiens
tatgtgaggtaattattgct

SEQ ID NO: 1685156 - DNA, 17 bp, Homo sapiens
tatgtgagtattctcat

SEQ ID NO: 1685157 - DNA, 18 bp, Homo sapiens
tatgtgagtattctcatt

SEQ ID NO: 1685158 - DNA, 14 bp, Homo sapiens
tatgtgcagtcttg

SEQ ID NO: 1685159 - DNA, 16 bp, Homo sapiens
tatgtgccaaagcttt

SEQ ID NO: 1685160 - DNA, 19 bp, Homo sapiens
tatgtgctatacacacaca

SEQ ID NO: 1685161 - DNA, 11 bp, Homo sapiens
tatgtggcagc

SEQ ID NO: 1685162 - DNA, 18 bp, Homo sapiens
tatgtgggatattgaatg

SEQ ID NO: 1685163 - DNA, 19 bp, Homo sapiens
tatgtgggatattgaatgt

SEQ ID NO: 1685164 - DNA, 19 bp, Homo sapiens
tatgtgggggtctgtgtgt

SEQ ID NO: 1685165 - DNA, 20 bp, Homo sapiens
tatgtgggggtctgtgtgtt

SEQ ID NO: 1685166 - DNA, 17 bp, Homo sapiens
tatgtgtaaaatgtgaa

SEQ ID NO: 1685167 - DNA, 12 bp, Homo sapiens
tatgtgtatgta

SEQ ID NO: 1685168 - DNA, 16 bp, Homo sapiens
tatgtgtgaggagctg

SEQ ID NO: 1685169 - DNA, 11 bp, Homo sapiens
tatgtgtgtgt

SEQ ID NO: 1685170 - DNA, 22 bp, Homo sapiens
tatgtgtgtgtgttgtgtgtgg

SEQ ID NO: 1685171 - DNA, 17 bp, Homo sapiens
tatgtgttatgaacatc

SEQ ID NO: 1685172 - DNA, 18 bp, Homo sapiens
tatgtgttatgaacatcc

SEQ ID NO: 1685173 - DNA, 21 bp, Homo sapiens
tatgtgttgtgtttgtagtct

SEQ ID NO: 1685174 - DNA, 14 bp, Homo sapiens
tattaagagtgaaa

SEQ ID NO: 1685175 - DNA, 17 bp, Homo sapiens
tattaagattataattg

SEQ ID NO: 1685176 - DNA, 18 bp, Homo sapiens
tattaagattataattgt

SEQ ID NO: 1685177 - DNA, 17 bp, Homo sapiens
tattaagatttccaagt

SEQ ID NO: 1685178 - DNA, 19 bp, Homo sapiens
tattaagcagtaaaaactg

SEQ ID NO: 1685179 - DNA, 16 bp, Homo sapiens
tattaagctttttgga

SEQ ID NO: 1685180 - DNA, 14 bp, Homo sapiens
tattaagtaaaatc

SEQ ID NO: 1685181 - DNA, 12 bp, Homo sapiens
tattaataaagc

SEQ ID NO: 1685182 - DNA, 15 bp, Homo sapiens
tattaataaagcatt

SEQ ID NO: 1685183 - DNA, 19 bp, Homo sapiens
tattaataaagcattcttt

SEQ ID NO: 1685184 - DNA, 15 bp, Homo sapiens
tattaatactggtat

SEQ ID NO: 1685185 - DNA, 21 bp, Homo sapiens
tattaatataataatgatgat

SEQ ID NO: 1685186 - DNA, 12 bp, Homo sapiens
tattaatatatt

SEQ ID NO: 1685187 - DNA, 17 bp, Homo sapiens
tattaatatcaactctg

SEQ ID NO: 1685188 - DNA, 17 bp, Homo sapiens
tattaatcttagtgtat

SEQ ID NO: 1685189 - DNA, 17 bp, Homo sapiens
tattaatcttattgttt

SEQ ID NO: 1685190 - DNA, 23 bp, Homo sapiens
tattaatgcctttaaagtatgaa

SEQ ID NO: 1685191 - DNA, 17 bp, Homo sapiens
tattaatgttttcaaaa

SEQ ID NO: 1685192 - DNA, 16 bp, Homo sapiens
tattaattttctatgt

SEQ ID NO: 1685193 - DNA, 11 bp, Homo sapiens
tattacaaatc

SEQ ID NO: 1685194 - DNA, 12 bp, Homo sapiens
tattacaatgta

SEQ ID NO: 1685195 - DNA, 19 bp, Homo sapiens
tattacaatgtatctttat

SEQ ID NO: 1685196 - DNA, 13 bp, Homo sapiens
tattacaattttt

SEQ ID NO: 1685197 - DNA, 22 bp, Homo sapiens
tattacaccaccggccccctcc

SEQ ID NO: 1685198 - DNA, 14 bp, Homo sapiens
tattacatctaatg

SEQ ID NO: 1685199 - DNA, 16 bp, Homo sapiens
tattacatctaatgct

SEQ ID NO: 1685200 - DNA, 19 bp, Homo sapiens
tattaccagcaagaataaa

SEQ ID NO: 1685201 - DNA, 15 bp, Homo sapiens
tattaccatgagaag

SEQ ID NO: 1685202 - DNA, 21 bp, Homo sapiens
tattaccccctccttcagaca

SEQ ID NO: 1685203 - DNA, 21 bp, Homo sapiens
tattaccctaagaatgctttg

SEQ ID NO: 1685204 - DNA, 13 bp, Homo sapiens
tattacctctgat

SEQ ID NO: 1685205 - DNA, 14 bp, Homo sapiens
tattacctctgata

SEQ ID NO: 1685206 - DNA, 18 bp, Homo sapiens
tattactaatgatgcttt

SEQ ID NO: 1685207 - DNA, 21 bp, Homo sapiens
tattactgaataatatcaaat

SEQ ID NO: 1685208 - DNA, 23 bp, Homo sapiens
tattactgaataatatcaaataa

SEQ ID NO: 1685209 - DNA, 17 bp, Homo sapiens
tattactgacatttctt

SEQ ID NO: 1685210 - DNA, 14 bp, Homo sapiens
tattactgtcttta

SEQ ID NO: 1685211 - DNA, 17 bp, Homo sapiens
tattactgttttgggcc

SEQ ID NO: 1685212 - DNA, 18 bp, Homo sapiens
tattacttaggttatttt

SEQ ID NO: 1685213 - DNA, 22 bp, Homo sapiens
tattacttaggttattttgctt

SEQ ID NO: 1685214 - DNA, 16 bp, Homo sapiens
tattactttgtctttt

SEQ ID NO: 1685215 - DNA, 20 bp, Homo sapiens
tattactttgtcttttcaat

SEQ ID NO: 1685216 - DNA, 15 bp, Homo sapiens
tattagaaaggctct

SEQ ID NO: 1685217 - DNA, 13 bp, Homo sapiens
tattagacatcaa

SEQ ID NO: 1685218 - DNA, 23 bp, Homo sapiens
tattagacatcaatcctggtaac

SEQ ID NO: 1685219 - DNA, 18 bp, Homo sapiens
tattagagcgccagctcc

SEQ ID NO: 1685220 - DNA, 15 bp, Homo sapiens
tattagagtatttcc

SEQ ID NO: 1685221 - DNA, 16 bp, Homo sapiens
tattagagtatttccc

SEQ ID NO: 1685222 - DNA, 19 bp, Homo sapiens
tattagagtatttcccttc

SEQ ID NO: 1685223 - DNA, 15 bp, Homo sapiens
tattagatgcactta

SEQ ID NO: 1685224 - DNA, 15 bp, Homo sapiens
tattagcatttgttt

SEQ ID NO: 1685225 - DNA, 23 bp, Homo sapiens
tattagccacaaaattgggaaag

SEQ ID NO: 1685226 - DNA, 21 bp, Homo sapiens
tattagccaggtaatgtgaat

SEQ ID NO: 1685227 - DNA, 17 bp, Homo sapiens
tattaggaaaataaaca

SEQ ID NO: 1685228 - DNA, 18 bp, Homo sapiens
tattaggtccattcatta

SEQ ID NO: 1685229 - DNA, 17 bp, Homo sapiens
tattaggtgcaatttca

SEQ ID NO: 1685230 - DNA, 18 bp, Homo sapiens
tattagtgctagtctcag

SEQ ID NO: 1685231 - DNA, 19 bp, Homo sapiens
tattataaacaagaatgaa

SEQ ID NO: 1685232 - DNA, 23 bp, Homo sapiens
tattataaacaagaatgaaggtt

SEQ ID NO: 1685233 - DNA, 15 bp, Homo sapiens
tattataaactataa

SEQ ID NO: 1685234 - DNA, 20 bp, Homo sapiens
tattataacaagtgtgtctt

SEQ ID NO: 1685235 - DNA, 23 bp, Homo sapiens
tattataagggagagctgagcca

SEQ ID NO: 1685236 - DNA, 14 bp, Homo sapiens
tattatacatgtga

SEQ ID NO: 1685237 - DNA, 16 bp, Homo sapiens
tcaatctctgttctgc

SEQ ID NO: 1685238 - DNA, 17 bp, Homo sapiens
tcaatctgtaaactgtg

SEQ ID NO: 1685239 - DNA, 15 bp, Homo sapiens
tcaatcttctacttt

SEQ ID NO: 1685240 - DNA, 14 bp, Homo sapiens
tcaatcttgttact

SEQ ID NO: 1685241 - DNA, 16 bp, Homo sapiens
tcaatgaaccataaat

SEQ ID NO: 1685242 - DNA, 17 bp, Homo sapiens
tcaatgaaccataaatt

SEQ ID NO: 1685243 - DNA, 16 bp, Homo sapiens
tcaatgaacttccatt

SEQ ID NO: 1685244 - DNA, 21 bp, Homo sapiens
tcaatgaacttccatttgtat

SEQ ID NO: 1685245 - DNA, 22 bp, Homo sapiens
tcaatgaacttccatttgtatt

SEQ ID NO: 1685246 - DNA, 16 bp, Homo sapiens
tcaatgaagccagctc

SEQ ID NO: 1685247 - DNA, 20 bp, Homo sapiens
tcaatgaccattcaattagt

SEQ ID NO: 1685248 - DNA, 22 bp, Homo sapiens
tcaatgcaagagtgattgcagc

SEQ ID NO: 1685249 - DNA, 16 bp, Homo sapiens
tcaatgcagtttttat

SEQ ID NO: 1685250 - DNA, 16 bp, Homo sapiens
tcaatgcattgtcttg

SEQ ID NO: 1685251 - DNA, 14 bp, Homo sapiens
tcaatgcatttaaa

SEQ ID NO: 1685252 - DNA, 14 bp, Homo sapiens
tcaatgccctgcca

SEQ ID NO: 1685253 - DNA, 16 bp, Homo sapiens
tcaatgccctgccatt

SEQ ID NO: 1685254 - DNA, 18 bp, Homo sapiens
tcaatgcgttttgttgta

SEQ ID NO: 1685255 - DNA, 20 bp, Homo sapiens
tcaatggatttgatgctgtt

SEQ ID NO: 1685256 - DNA, 22 bp, Homo sapiens
tcaatgggaaatactactcctg

SEQ ID NO: 1685257 - DNA, 23 bp, Homo sapiens
tcaatggtagattcgctgtcccc

SEQ ID NO: 1685258 - DNA, 23 bp, Homo sapiens
tcacagggttgggcccagatctg

SEQ ID NO: 1685259 - DNA, 15 bp, Homo sapiens
tcacagtctctggaa

SEQ ID NO: 1685260 - DNA, 18 bp, Homo sapiens
tcacagtctctttaatct

SEQ ID NO: 1685261 - DNA, 16 bp, Homo sapiens
tcacagtgaagtgcct

SEQ ID NO: 1685262 - DNA, 23 bp, Homo sapiens
tcacagtgaagtgcctttttcct

SEQ ID NO: 1685263 - DNA, 15 bp, Homo sapiens
tcacagtgcccaaga

SEQ ID NO: 1685264 - DNA, 18 bp, Homo sapiens
tcacagtgctcttttctc

SEQ ID NO: 1685265 - DNA, 17 bp, Homo sapiens
tcacagtgctgtgtgcc

SEQ ID NO: 1685266 - DNA, 18 bp, Homo sapiens
tcacagtgcttttaagtg

SEQ ID NO: 1685267 - DNA, 19 bp, Homo sapiens
tcacagtgtttttattgct

SEQ ID NO: 1685268 - DNA, 18 bp, Homo sapiens
tcacagttcctcgccctg

SEQ ID NO: 1685269 - DNA, 22 bp, Homo sapiens
tcacagttctttgggccagaca

SEQ ID NO: 1685270 - DNA, 14 bp, Homo sapiens
tcacataccctccc

SEQ ID NO: 1685271 - DNA, 15 bp, Homo sapiens
tcacataccctcccc

SEQ ID NO: 1685272 - DNA, 20 bp, Homo sapiens
tcacatactgacttcagtgg

SEQ ID NO: 1685273 - DNA, 17 bp, Homo sapiens
tcacatagatgtccctt

SEQ ID NO: 1685274 - DNA, 22 bp, Homo sapiens
tcacatataaatagatgatttc

SEQ ID NO: 1685275 - DNA, 14 bp, Homo sapiens
tcacatataacatg

SEQ ID NO: 1685276 - DNA, 20 bp, Homo sapiens
tcacatataacatgcaaaca

SEQ ID NO: 1685277 - DNA, 22 bp, Homo sapiens
tcacatatctagtatgaaatta

SEQ ID NO: 1685278 - DNA, 14 bp, Homo sapiens
tcacatattctagt

SEQ ID NO: 1685279 - DNA, 12 bp, Homo sapiens
tcacatatttgt

SEQ ID NO: 1685280 - DNA, 23 bp, Homo sapiens
tcacatatttgtagctagaatat

SEQ ID NO: 1685281 - DNA, 22 bp, Homo sapiens
tcacatccctgtaaattgcaga

SEQ ID NO: 1685282 - DNA, 10 bp, Homo sapiens
tcacatcctg

SEQ ID NO: 1685283 - DNA, 15 bp, Homo sapiens
tcacatcctggcctg

SEQ ID NO: 1685284 - DNA, 18 bp, Homo sapiens
tcacatcctggcctggca

SEQ ID NO: 1685285 - DNA, 18 bp, Homo sapiens
tcacatcctgtgtttcta

SEQ ID NO: 1685286 - DNA, 21 bp, Homo sapiens
tcacatcgcttctgtgtatct

SEQ ID NO: 1685287 - DNA, 17 bp, Homo sapiens
tcacatctctggaaatt

SEQ ID NO: 1685288 - DNA, 17 bp, Homo sapiens
tcacatcttaaattcat

SEQ ID NO: 1685289 - DNA, 21 bp, Homo sapiens
tcacatcttaaattcatttct

SEQ ID NO: 1685290 - DNA, 14 bp, Homo sapiens
tcacatctttcaca

SEQ ID NO: 1685291 - DNA, 20 bp, Homo sapiens
tcacatctttcacacttcca

SEQ ID NO: 1685292 - DNA, 18 bp, Homo sapiens
tcacatgagtcaaaacaa

SEQ ID NO: 1685293 - DNA, 13 bp, Homo sapiens
tcacatgatgaaa

SEQ ID NO: 1685294 - DNA, 14 bp, Homo sapiens
tcacatgatgaaaa

SEQ ID NO: 1685295 - DNA, 16 bp, Homo sapiens
tcacatgatgaaaaat

SEQ ID NO: 1685296 - DNA, 19 bp, Homo sapiens
tcacatgctaaagccagga

SEQ ID NO: 1685297 - DNA, 21 bp, Homo sapiens
tcacatggcctatgcacatat

SEQ ID NO: 1685298 - DNA, 18 bp, Homo sapiens
tcacattaatctcaaaga

SEQ ID NO: 1685299 - DNA, 20 bp, Homo sapiens
tcacattaatctcaaagaga

SEQ ID NO: 1685300 - DNA, 13 bp, Homo sapiens
tcacattagaatt

SEQ ID NO: 1685301 - DNA, 15 bp, Homo sapiens
tcacattagataaat

SEQ ID NO: 1685302 - DNA, 20 bp, Homo sapiens
tcacattagataaattacta

SEQ ID NO: 1685303 - DNA, 15 bp, Homo sapiens
tcacattaggctgtt

SEQ ID NO: 1685304 - DNA, 14 bp, Homo sapiens
tcacattcttggct

SEQ ID NO: 1685305 - DNA, 21 bp, Homo sapiens
tcacattcttggcttaatcat

SEQ ID NO: 1685306 - DNA, 18 bp, Homo sapiens
tcacattgtttgctgcta

SEQ ID NO: 1685307 - DNA, 19 bp, Homo sapiens
tcacattgtttgctgctat

SEQ ID NO: 1685308 - DNA, 22 bp, Homo sapiens
tcacatttgatgtacatgtgta

SEQ ID NO: 1685309 - DNA, 12 bp, Homo sapiens
tcacatttgtga

SEQ ID NO: 1685310 - DNA, 15 bp, Homo sapiens
tcacattttattaaa

SEQ ID NO: 1685311 - DNA, 16 bp, Homo sapiens
tcacattttccttttc

SEQ ID NO: 1685312 - DNA, 18 bp, Homo sapiens
tcacattttccttttcaa

SEQ ID NO: 1685313 - DNA, 16 bp, Homo sapiens
tcacattttgtatgga

SEQ ID NO: 1685314 - DNA, 21 bp, Homo sapiens
tcacatttttaaaagaacaat

SEQ ID NO: 1685315 - DNA, 20 bp, Homo sapiens
tcacatttttttatgctctt

SEQ ID NO: 1685316 - DNA, 17 bp, Homo sapiens
tcaccaaaatttctaca

SEQ ID NO: 1685317 - DNA, 17 bp, Homo sapiens
tcaccaaagtatttttt

SEQ ID NO: 1685318 - DNA, 17 bp, Homo sapiens
tcaccaaatagtgtgaa

SEQ ID NO: 1685319 - DNA, 19 bp, Homo sapiens
tcaccaaatcagctgctac

SEQ ID NO: 1685320 - DNA, 19 bp, Homo sapiens
tcaccaaatgatgccactt

SEQ ID NO: 1685321 - DNA, 22 bp, Homo sapiens
tcaccaacacagttgggaccca

SEQ ID NO: 1685322 - DNA, 23 bp, Homo sapiens
tcaccaagcaagtcccttcagac

SEQ ID NO: 1685323 - DNA, 13 bp, Homo sapiens
tcaccaaggaaac

SEQ ID NO: 1685324 - DNA, 16 bp, Homo sapiens
tcaccaagtgcaatag

SEQ ID NO: 1685325 - DNA, 18 bp, Homo sapiens
tcaccacagtaagttcct

SEQ ID NO: 1685326 - DNA, 13 bp, Homo sapiens
tcaccacctctcc

SEQ ID NO: 1685327 - DNA, 20 bp, Homo sapiens
tcaccacgactggccagggc

SEQ ID NO: 1685328 - DNA, 19 bp, Homo sapiens
tcaccactaccagccagcc

SEQ ID NO: 1685329 - DNA, 21 bp, Homo sapiens
tcaccacttcaatagatcaaa

SEQ ID NO: 1685330 - DNA, 19 bp, Homo sapiens
tcaccagagcccatgctca

SEQ ID NO: 1685331 - DNA, 12 bp, Homo sapiens
tcaccagagctt

SEQ ID NO: 1685332 - DNA, 17 bp, Homo sapiens
tcaccagagcttctctg

SEQ ID NO: 1685333 - DNA, 11 bp, Homo sapiens
tcaccagcagc

SEQ ID NO: 1685334 - DNA, 16 bp, Homo sapiens
tcaccagcagcataga

SEQ ID NO: 1685335 - DNA, 19 bp, Homo sapiens
tcaccagccccactgccag

SEQ ID NO: 1685336 - DNA, 21 bp, Homo sapiens
tcaccagccccactgccagca

SEQ ID NO: 1685337 - DNA, 24 bp, Homo sapiens
tcaccagccccactgccagcagca

SEQ ID NO: 1685338 - DNA, 20 bp, Homo sapiens
tcaccagccccccgcgcgcc

SEQ ID NO: 1685339 - DNA, 11 bp, Homo sapiens
tcaccagctgc

SEQ ID NO: 1685340 - DNA, 12 bp, Homo sapiens
tcaccagctgct

SEQ ID NO: 1685341 - DNA, 13 bp, Homo sapiens
tcaccagctgctg

SEQ ID NO: 1685342 - DNA, 22 bp, Homo sapiens
tcaccaggaatgttaaagtcag

SEQ ID NO: 1685343 - DNA, 20 bp, Homo sapiens
tcaccaggcctggcctctgg

SEQ ID NO: 1685344 - DNA, 16 bp, Homo sapiens
tcaccaggggaggagc

SEQ ID NO: 1685345 - DNA, 23 bp, Homo sapiens
tcaccaggggtgctcacctctgc

SEQ ID NO: 1685346 - DNA, 21 bp, Homo sapiens
tcaccagggtccgcaccagct

SEQ ID NO: 1685347 - DNA, 23 bp, Homo sapiens
tcaccagggtccgcaccagctgc

SEQ ID NO: 1685348 - DNA, 21 bp, Homo sapiens
tcaccagtctgtctactgtgg

SEQ ID NO: 1685349 - DNA, 23 bp, Homo sapiens
tcaccagtctgtctactgtggtg

SEQ ID NO: 1685350 - DNA, 19 bp, Homo sapiens
tcaccagtgcgattctgga

SEQ ID NO: 1685351 - DNA, 18 bp, Homo sapiens
tcaccatccaccttccct

SEQ ID NO: 1685352 - DNA, 15 bp, Homo sapiens
tcaccatgtaagcac

SEQ ID NO: 1685353 - DNA, 16 bp, Homo sapiens
tcaccatgtaagcact

SEQ ID NO: 1685354 - DNA, 17 bp, Homo sapiens
tcaccatgtaagcactc

SEQ ID NO: 1685355 - DNA, 19 bp, Homo sapiens
tcaccatgttgcccaggag

SEQ ID NO: 1685356 - DNA, 21 bp, Homo sapiens
tcaccatgttggccaggctgg

SEQ ID NO: 1685357 - DNA, 19 bp, Homo sapiens
tcaagcaatcgagatttgg

SEQ ID NO: 1685358 - DNA, 20 bp, Homo sapiens
tcaagcacaacccaccacaa

SEQ ID NO: 1685359 - DNA, 15 bp, Homo sapiens
tcaagcacactggaa

SEQ ID NO: 1685360 - DNA, 17 bp, Homo sapiens
tcaagcacactggaata

SEQ ID NO: 1685361 - DNA, 13 bp, Homo sapiens
tcaagcacatgta

SEQ ID NO: 1685362 - DNA, 16 bp, Homo sapiens
tcaagcacatgtaata

SEQ ID NO: 1685363 - DNA, 21 bp, Homo sapiens
tcaagcacatgtaataaattc

SEQ ID NO: 1685364 - DNA, 21 bp, Homo sapiens
tcaagcagcgaccgccccctc

SEQ ID NO: 1685365 - DNA, 18 bp, Homo sapiens
tcaagcagtcgtgcctgt

SEQ ID NO: 1685366 - DNA, 23 bp, Homo sapiens
tcaagcagtcgtgcctgtgtcca

SEQ ID NO: 1685367 - DNA, 17 bp, Homo sapiens
tcaagccaatcccctcc

SEQ ID NO: 1685368 - DNA, 20 bp, Homo sapiens
tcaagccaatcccctccttg

SEQ ID NO: 1685369 - DNA, 16 bp, Homo sapiens
tcaagccagactctgc

SEQ ID NO: 1685370 - DNA, 11 bp, Homo sapiens
tcaagcccagg

SEQ ID NO: 1685371 - DNA, 14 bp, Homo sapiens
tcaagcccaggctt

SEQ ID NO: 1685372 - DNA, 15 bp, Homo sapiens
tcaagcccaggcttc

SEQ ID NO: 1685373 - DNA, 17 bp, Homo sapiens
tcaagcccaggcttcct

SEQ ID NO: 1685374 - DNA, 22 bp, Homo sapiens
tcaagcccaggcttcctgggtc

SEQ ID NO: 1685375 - DNA, 12 bp, Homo sapiens
tcaagccctgca

SEQ ID NO: 1685376 - DNA, 17 bp, Homo sapiens
tcaagccgcaagctctc

SEQ ID NO: 1685377 - DNA, 14 bp, Homo sapiens
tcaagcctctggtc

SEQ ID NO: 1685378 - DNA, 14 bp, Homo sapiens
tcaagcctgtggga

SEQ ID NO: 1685379 - DNA, 19 bp, Homo sapiens
tcaagcctttatggctgct

SEQ ID NO: 1685380 - DNA, 22 bp, Homo sapiens
tcaagcgattctcccgcctcag

SEQ ID NO: 1685381 - DNA, 17 bp, Homo sapiens
tcaagctactttatgta

SEQ ID NO: 1685382 - DNA, 19 bp, Homo sapiens
tcaccccatcccacaccct

SEQ ID NO: 1685383 - DNA, 16 bp, Homo sapiens
tcacccccctctgctg

SEQ ID NO: 1685384 - DNA, 17 bp, Homo sapiens
tcacccccctctgctgc

SEQ ID NO: 1685385 - DNA, 19 bp, Homo sapiens
tcacccccctctgctgccg

SEQ ID NO: 1685386 - DNA, 14 bp, Homo sapiens
tcaccccgtctggg

SEQ ID NO: 1685387 - DNA, 13 bp, Homo sapiens
tcacccctccagg

SEQ ID NO: 1685388 - DNA, 14 bp, Homo sapiens
tcacccctccagga

SEQ ID NO: 1685389 - DNA, 18 bp, Homo sapiens
tcacccctccctttctcc

SEQ ID NO: 1685390 - DNA, 21 bp, Homo sapiens
tcacccctggttctcatcttt

SEQ ID NO: 1685391 - DNA, 19 bp, Homo sapiens
tcaccctcataccatctgc

SEQ ID NO: 1685392 - DNA, 12 bp, Homo sapiens
tcaccctgcccg

SEQ ID NO: 1685393 - DNA, 15 bp, Homo sapiens
tcaccctgcccgctc

SEQ ID NO: 1685394 - DNA, 13 bp, Homo sapiens
tcaccctgggagc

SEQ ID NO: 1685395 - DNA, 17 bp, Homo sapiens
tcaccctgggagccagt

SEQ ID NO: 1685396 - DNA, 14 bp, Homo sapiens
tcaccctgtgaaac

SEQ ID NO: 1685397 - DNA, 13 bp, Homo sapiens
tcacccttccctg

SEQ ID NO: 1685398 - DNA, 15 bp, Homo sapiens
tcaccgacagcggcc

SEQ ID NO: 1685399 - DNA, 20 bp, Homo sapiens
tcaccgcccatcagggttct

SEQ ID NO: 1685400 - DNA, 15 bp, Homo sapiens
tcaccggctctcacc

SEQ ID NO: 1685401 - DNA, 14 bp, Homo sapiens
tcaccgtggctacc

SEQ ID NO: 1685402 - DNA, 19 bp, Homo sapiens
tcacctaagtctctgtgaa

SEQ ID NO: 1685403 - DNA, 22 bp, Homo sapiens
tcacctaatgtttatgagccag

SEQ ID NO: 1685404 - DNA, 22 bp, Homo sapiens
tcacctacatatgctgatcttt

SEQ ID NO: 1685405 - DNA, 13 bp, Homo sapiens
tcacctcagagca

SEQ ID NO: 1685406 - DNA, 18 bp, Homo sapiens
tcacctcaggccaggtgc

SEQ ID NO: 1685407 - DNA, 13 bp, Homo sapiens
tcacctcatgccc

SEQ ID NO: 1685408 - DNA, 19 bp, Homo sapiens
tcacctcctccactcactc

SEQ ID NO: 1685409 - DNA, 22 bp, Homo sapiens
tcacctcggagggatggagaaa

SEQ ID NO: 1685410 - DNA, 17 bp, Homo sapiens
tcacctcttccactcct

SEQ ID NO: 1685411 - DNA, 20 bp, Homo sapiens
tcacctcttccactccttct

SEQ ID NO: 1685412 - DNA, 18 bp, Homo sapiens
tcacctgaaccccagagg

SEQ ID NO: 1685413 - DNA, 22 bp, Homo sapiens
tcacctgaaccccagaggcaga

SEQ ID NO: 1685414 - DNA, 17 bp, Homo sapiens
tcacctgaggtcgggag

SEQ ID NO: 1685415 - DNA, 13 bp, Homo sapiens
tcacctgcaagcc

SEQ ID NO: 1685416 - DNA, 23 bp, Homo sapiens
tcacctgcaagccccagggcctg

SEQ ID NO: 1685417 - DNA, 12 bp, Homo sapiens
tcacctgcagcc

SEQ ID NO: 1685418 - DNA, 14 bp, Homo sapiens
tcacctgcctgtta

SEQ ID NO: 1685419 - DNA, 12 bp, Homo sapiens
tcacctgctcca

SEQ ID NO: 1685420 - DNA, 13 bp, Homo sapiens
tcacctgctccag

SEQ ID NO: 1685421 - DNA, 14 bp, Homo sapiens
tcacctgctccaga

SEQ ID NO: 1685422 - DNA, 16 bp, Homo sapiens
tcacctgctccagaag

SEQ ID NO: 1685423 - DNA, 22 bp, Homo sapiens
tcacctgctggttgttgccagg

SEQ ID NO: 1685424 - DNA, 22 bp, Homo sapiens
tcacctggacttaagcatctgg

SEQ ID NO: 1685425 - DNA, 12 bp, Homo sapiens
tcacctggccct

SEQ ID NO: 1685426 - DNA, 14 bp, Homo sapiens
tcacctggccctgc

SEQ ID NO: 1685427 - DNA, 14 bp, Homo sapiens
tcacctggtcctcc

SEQ ID NO: 1685428 - DNA, 16 bp, Homo sapiens
tcacctgtaaacctga

SEQ ID NO: 1685429 - DNA, 19 bp, Homo sapiens
tcacctgtaaacctgagtc

SEQ ID NO: 1685430 - DNA, 14 bp, Homo sapiens
tcacctgtgacaaa

SEQ ID NO: 1685431 - DNA, 20 bp, Homo sapiens
tcacctgtttttaagctgtt

SEQ ID NO: 1685432 - DNA, 22 bp, Homo sapiens
tcacctgtttttaagctgtttc

SEQ ID NO: 1685433 - DNA, 19 bp, Homo sapiens
tcaccttcaaaatgttcta

SEQ ID NO: 1685434 - DNA, 21 bp, Homo sapiens
tcaccttcaaaatgttctatt

SEQ ID NO: 1685435 - DNA, 13 bp, Homo sapiens
tcaccttggaagg

SEQ ID NO: 1685436 - DNA, 16 bp, Homo sapiens
tcaccttggaagggcg

SEQ ID NO: 1685437 - DNA, 19 bp, Homo sapiens
tcaccttggcaccagacac

SEQ ID NO: 1685438 - DNA, 16 bp, Homo sapiens
tcacctttggtgcaga

SEQ ID NO: 1685439 - DNA, 14 bp, Homo sapiens
tcacctttgtaaga

SEQ ID NO: 1685440 - DNA, 23 bp, Homo sapiens
tcacctttgtaagacatttgtat

SEQ ID NO: 1685441 - DNA, 14 bp, Homo sapiens
tcacctttttaata

SEQ ID NO: 1685442 - DNA, 22 bp, Homo sapiens
tcacctttttaataaaaataca

SEQ ID NO: 1685443 - DNA, 12 bp, Homo sapiens
tcacgacaatgt

SEQ ID NO: 1685444 - DNA, 21 bp, Homo sapiens
tcacgatttgcaggattccct

SEQ ID NO: 1685445 - DNA, 22 bp, Homo sapiens
tcacgatttgcaggattccctt

SEQ ID NO: 1685446 - DNA, 18 bp, Homo sapiens
tcacgcaggctgagtcca

SEQ ID NO: 1685447 - DNA, 17 bp, Homo sapiens
tcacgccactgcactcc

SEQ ID NO: 1685448 - DNA, 21 bp, Homo sapiens
tcacgccattgtactccagcc

SEQ ID NO: 1685449 - DNA, 23 bp, Homo sapiens
tcacgccattgtactccagcctg

SEQ ID NO: 1685450 - DNA, 21 bp, Homo sapiens
tcacgccgggagaagccacct

SEQ ID NO: 1685451 - DNA, 21 bp, Homo sapiens
tcacgcctatgatcccagcac

SEQ ID NO: 1685452 - DNA, 20 bp, Homo sapiens
tcacgctcccccgcagtccc

SEQ ID NO: 1685453 - DNA, 17 bp, Homo sapiens
tcacgctctggtgcagt

SEQ ID NO: 1685454 - DNA, 15 bp, Homo sapiens
tcacgctttcctgaa

SEQ ID NO: 1685455 - DNA, 22 bp, Homo sapiens
tcacgggagatttcttgttgct

SEQ ID NO: 1685456 - DNA, 23 bp, Homo sapiens
tcacggggttggctgttccagac

SEQ ID NO: 1685457 - DNA, 23 bp, Homo sapiens
tcacgtacaaaactctgtataag

SEQ ID NO: 1685458 - DNA, 18 bp, Homo sapiens
tcacgtaccccactgggc

SEQ ID NO: 1685459 - DNA, 20 bp, Homo sapiens
tcacgtcctgagaaagctca

SEQ ID NO: 1685460 - DNA, 21 bp, Homo sapiens
tcacgtctctgccgcctgcgt

SEQ ID NO: 1685461 - DNA, 14 bp, Homo sapiens
tcacgtgaaatatt

SEQ ID NO: 1685462 - DNA, 21 bp, Homo sapiens
tcacgtgctttgtgttcagtt

SEQ ID NO: 1685463 - DNA, 23 bp, Homo sapiens
tcacgtggcctccgcagtgtctc

SEQ ID NO: 1685464 - DNA, 16 bp, Homo sapiens
tcactaaagcatgaaa

SEQ ID NO: 1685465 - DNA, 15 bp, Homo sapiens
tcactaaatgtaaaa

SEQ ID NO: 1685466 - DNA, 16 bp, Homo sapiens
tcactaatcttgaatg

SEQ ID NO: 1685467 - DNA, 20 bp, Homo sapiens
tcactaatttggctttcaca

SEQ ID NO: 1685468 - DNA, 16 bp, Homo sapiens
tcactaatttttgtat

SEQ ID NO: 1685469 - DNA, 19 bp, Homo sapiens
tcactacaagtcagctcca

SEQ ID NO: 1685470 - DNA, 23 bp, Homo sapiens
tcactaccctaatagactaaatg

SEQ ID NO: 1685471 - DNA, 16 bp, Homo sapiens
tcactaccctgattct

SEQ ID NO: 1685472 - DNA, 22 bp, Homo sapiens
tcactacgggggggagaaggaa

SEQ ID NO: 1685473 - DNA, 16 bp, Homo sapiens
tcactactcgagccca

SEQ ID NO: 1685474 - DNA, 15 bp, Homo sapiens
tcactactgaacaca

SEQ ID NO: 1685475 - DNA, 17 bp, Homo sapiens
tcactagaagtcctgct

SEQ ID NO: 1685476 - DNA, 13 bp, Homo sapiens
tcactataaatgg

SEQ ID NO: 1685477 - DNA, 22 bp, Homo sapiens
tcactatgaatgggttgttaaa

SEQ ID NO: 1685478 - DNA, 14 bp, Homo sapiens
tcactatgacactg

SEQ ID NO: 1685479 - DNA, 18 bp, Homo sapiens
tcactatgacactgagca

SEQ ID NO: 1685480 - DNA, 19 bp, Homo sapiens
tcactatgacactgagcaa

SEQ ID NO: 1685481 - DNA, 15 bp, Homo sapiens
tcactatgatttctg

SEQ ID NO: 1685482 - DNA, 19 bp, Homo sapiens
tcactatgatttctgaatt

SEQ ID NO: 1685483 - DNA, 19 bp, Homo sapiens
tcactatttcctttataat

SEQ ID NO: 1685484 - DNA, 16 bp, Homo sapiens
tcactcaagaccaggc

SEQ ID NO: 1685485 - DNA, 21 bp, Homo sapiens
tcactccaccatccccacccc

SEQ ID NO: 1685486 - DNA, 13 bp, Homo sapiens
tcactccagtcaa

SEQ ID NO: 1685487 - DNA, 15 bp, Homo sapiens
tcactccagtcaaca

SEQ ID NO: 1685488 - DNA, 19 bp, Homo sapiens
tcactccagtcaacagatt

SEQ ID NO: 1685489 - DNA, 17 bp, Homo sapiens
tcactcccaagggacag

SEQ ID NO: 1685490 - DNA, 19 bp, Homo sapiens
tcactcccaagggacagca

SEQ ID NO: 1685491 - DNA, 14 bp, Homo sapiens
tcactcccagtcca

SEQ ID NO: 1685492 - DNA, 15 bp, Homo sapiens
tcactcctacctggt

SEQ ID NO: 1685493 - DNA, 10 bp, Homo sapiens
tcactcctgt

SEQ ID NO: 1685494 - DNA, 21 bp, Homo sapiens
tcactcgtaggggatgtggag

SEQ ID NO: 1685495 - DNA, 19 bp, Homo sapiens
tcactctacttagcatgtc

SEQ ID NO: 1685496 - DNA, 15 bp, Homo sapiens
tcactctctgctggc

SEQ ID NO: 1685497 - DNA, 19 bp, Homo sapiens
tcactctgccctctgctgc

SEQ ID NO: 1685498 - DNA, 13 bp, Homo sapiens
tcactctgggctg

SEQ ID NO: 1685499 - DNA, 16 bp, Homo sapiens
tcactgaaacctctgc

SEQ ID NO: 1685500 - DNA, 17 bp, Homo sapiens
tcactgaaacctctgcc

SEQ ID NO: 1685501 - DNA, 18 bp, Homo sapiens
tcactgaaacctctgcct

SEQ ID NO: 1685502 - DNA, 20 bp, Homo sapiens
tcactgaaacctctgccttc

SEQ ID NO: 1685503 - DNA, 15 bp, Homo sapiens
tcactgaaatgtttg

SEQ ID NO: 1685504 - DNA, 14 bp, Homo sapiens
tcactgaacaaaac

SEQ ID NO: 1685505 - DNA, 14 bp, Homo sapiens
tcactgaaccactg

SEQ ID NO: 1685506 - DNA, 22 bp, Homo sapiens
tcactgaataatggaattatgt

SEQ ID NO: 1685507 - DNA, 23 bp, Homo sapiens
tcactgaataatggaattatgta

SEQ ID NO: 1685508 - DNA, 16 bp, Homo sapiens
tcactgaccagcggct

SEQ ID NO: 1685509 - DNA, 15 bp, Homo sapiens
tcactgactctgact

SEQ ID NO: 1685510 - DNA, 19 bp, Homo sapiens
tcactgagaggcctggagc

SEQ ID NO: 1685511 - DNA, 22 bp, Homo sapiens
tcactgagtgatactttaagtt

SEQ ID NO: 1685512 - DNA, 20 bp, Homo sapiens
tcactgatattttttataca

SEQ ID NO: 1685513 - DNA, 21 bp, Homo sapiens
tcactgcaacctctgcctccc

SEQ ID NO: 1685514 - DNA, 16 bp, Homo sapiens
tcactgcaaccttcac

SEQ ID NO: 1685515 - DNA, 21 bp, Homo sapiens
tcactgcaacttccgcctcct

SEQ ID NO: 1685516 - DNA, 23 bp, Homo sapiens
tcactgcaacttccgcctcctgt

SEQ ID NO: 1685517 - DNA, 16 bp, Homo sapiens
tcactgcaatgtcaaa

SEQ ID NO: 1685518 - DNA, 18 bp, Homo sapiens
tcactgcagcctccgcct

SEQ ID NO: 1685519 - DNA, 19 bp, Homo sapiens
tcactgcagcctccgcctc

SEQ ID NO: 1685520 - DNA, 15 bp, Homo sapiens
tcactgccacactct

SEQ ID NO: 1685521 - DNA, 20 bp, Homo sapiens
tcactgccacactctccatc

SEQ ID NO: 1685522 - DNA, 16 bp, Homo sapiens
tcactgccaggccagc

SEQ ID NO: 1685523 - DNA, 19 bp, Homo sapiens
tcactgccaggccagcctc

SEQ ID NO: 1685524 - DNA, 20 bp, Homo sapiens
tcactgccaggccagcctcc

SEQ ID NO: 1685525 - DNA, 12 bp, Homo sapiens
tcactgccatga

SEQ ID NO: 1685526 - DNA, 20 bp, Homo sapiens
tcactgccatgatagctggg

SEQ ID NO: 1685527 - DNA, 16 bp, Homo sapiens
tcactgccgacatccc

SEQ ID NO: 1685528 - DNA, 20 bp, Homo sapiens
tcactgccgacatccctccc

SEQ ID NO: 1685529 - DNA, 11 bp, Homo sapiens
tcactgcctct

SEQ ID NO: 1685530 - DNA, 14 bp, Homo sapiens
tcactgcctgtaga

SEQ ID NO: 1685531 - DNA, 15 bp, Homo sapiens
tcactgcctgtagag

SEQ ID NO: 1685532 - DNA, 14 bp, Homo sapiens
tcactgccttcctc

SEQ ID NO: 1685533 - DNA, 12 bp, Homo sapiens
tcactgctggct

SEQ ID NO: 1685534 - DNA, 16 bp, Homo sapiens
tcactgctggctgcct

SEQ ID NO: 1685535 - DNA, 22 bp, Homo sapiens
tcactgctggctgccttagaac

SEQ ID NO: 1685536 - DNA, 19 bp, Homo sapiens
tcactgcttgaactaggct

SEQ ID NO: 1685537 - DNA, 17 bp, Homo sapiens
tcactggaaaggggaga

SEQ ID NO: 1685538 - DNA, 21 bp, Homo sapiens
tcactggaaaggggagagcct

SEQ ID NO: 1685539 - DNA, 15 bp, Homo sapiens
tcactggactgcatg

SEQ ID NO: 1685540 - DNA, 13 bp, Homo sapiens
tcactggagccca

SEQ ID NO: 1685541 - DNA, 15 bp, Homo sapiens
tcactggagcccagg

SEQ ID NO: 1685542 - DNA, 17 bp, Homo sapiens
tcactggagcccaggag

SEQ ID NO: 1685543 - DNA, 19 bp, Homo sapiens
tcactggagttacattaat

SEQ ID NO: 1685544 - DNA, 16 bp, Homo sapiens
tcactggcaatgaaaa

SEQ ID NO: 1685545 - DNA, 15 bp, Homo sapiens
tcactggcagcctgc

SEQ ID NO: 1685546 - DNA, 13 bp, Homo sapiens
tcactggcgcctt

SEQ ID NO: 1685547 - DNA, 17 bp, Homo sapiens
tcactggcgccttctcg

SEQ ID NO: 1685548 - DNA, 14 bp, Homo sapiens
tcactggctctcca

SEQ ID NO: 1685549 - DNA, 15 bp, Homo sapiens
tcactggctctccaa

SEQ ID NO: 1685550 - DNA, 11 bp, Homo sapiens
tcactggctgg

SEQ ID NO: 1685551 - DNA, 16 bp, Homo sapiens
tcactggggtcctggg

SEQ ID NO: 1685552 - DNA, 17 bp, Homo sapiens
tcactggggtcctgggg

SEQ ID NO: 1685553 - DNA, 15 bp, Homo sapiens
tcactgtaaagacaa

SEQ ID NO: 1685554 - DNA, 20 bp, Homo sapiens
tcactgtaaagacaaataaa

SEQ ID NO: 1685555 - DNA, 15 bp, Homo sapiens
tcactgtaacctgat

SEQ ID NO: 1685556 - DNA, 16 bp, Homo sapiens
tcactgtaagtttatt

SEQ ID NO: 1685557 - DNA, 21 bp, Homo sapiens
tcactgtactgcatgtgactt

SEQ ID NO: 1685558 - DNA, 20 bp, Homo sapiens
tcactgtagaatgatttcat

SEQ ID NO: 1685559 - DNA, 22 bp, Homo sapiens
tcactgtagtttagttctgttg

SEQ ID NO: 1685560 - DNA, 15 bp, Homo sapiens
tcactgtatagacat

SEQ ID NO: 1685561 - DNA, 15 bp, Homo sapiens
tcactgtatataaac

SEQ ID NO: 1685562 - DNA, 16 bp, Homo sapiens
tcactgtatataaaca

SEQ ID NO: 1685563 - DNA, 17 bp, Homo sapiens
tcactgtcactgccgac

SEQ ID NO: 1685564 - DNA, 13 bp, Homo sapiens
tcactgtctttga

SEQ ID NO: 1685565 - DNA, 16 bp, Homo sapiens
tcactgtgctcagcca

SEQ ID NO: 1685566 - DNA, 12 bp, Homo sapiens
tcactgtgctcc

SEQ ID NO: 1685567 - DNA, 22 bp, Homo sapiens
tcactgtgtcacccagactgga

SEQ ID NO: 1685568 - DNA, 22 bp, Homo sapiens
tcactgttcgtcactcaaatga

SEQ ID NO: 1685569 - DNA, 18 bp, Homo sapiens
tcactgttgcagtggcct

SEQ ID NO: 1685570 - DNA, 20 bp, Homo sapiens
tcactgttgcagtggcctgg

SEQ ID NO: 1685571 - DNA, 22 bp, Homo sapiens
tcactgttgcagtggcctggcc

SEQ ID NO: 1685572 - DNA, 17 bp, Homo sapiens
tcacttaagtttttcca

SEQ ID NO: 1685573 - DNA, 16 bp, Homo sapiens
tcacttaatctttcta

SEQ ID NO: 1685574 - DNA, 20 bp, Homo sapiens
tcacttagaacctttctgtg

SEQ ID NO: 1685575 - DNA, 21 bp, Homo sapiens
tcacttagaacctttctgtgt

SEQ ID NO: 1685576 - DNA, 13 bp, Homo sapiens
tcacttagccatg

SEQ ID NO: 1685577 - DNA, 20 bp, Homo sapiens
tcacttcaaagctaaaaaat

SEQ ID NO: 1685578 - DNA, 18 bp, Homo sapiens
tcacttcaagctgttatt

SEQ ID NO: 1685579 - DNA, 13 bp, Homo sapiens
tcacttccagtgt

SEQ ID NO: 1685580 - DNA, 22 bp, Homo sapiens
tcacttcgcgtgccctcgctgc

SEQ ID NO: 1685581 - DNA, 16 bp, Homo sapiens
tcacttctaaatgcat

SEQ ID NO: 1685582 - DNA, 18 bp, Homo sapiens
tcacttgaacccgggagg

SEQ ID NO: 1685583 - DNA, 21 bp, Homo sapiens
tcacttgaatccattgaaagt

SEQ ID NO: 1685584 - DNA, 14 bp, Homo sapiens
tcacttgagcccag

SEQ ID NO: 1685585 - DNA, 19 bp, Homo sapiens
tcacttggctgtctgacca

SEQ ID NO: 1685586 - DNA, 14 bp, Homo sapiens
tcacttgtacaaaa

SEQ ID NO: 1685587 - DNA, 15 bp, Homo sapiens
tcacttgtacaaaat

SEQ ID NO: 1685588 - DNA, 17 bp, Homo sapiens
tcacttgtacaaaataa

SEQ ID NO: 1685589 - DNA, 20 bp, Homo sapiens
tcacttgtattgactttatg

SEQ ID NO: 1685590 - DNA, 21 bp, Homo sapiens
tcacttgttgttttactaaag

SEQ ID NO: 1685591 - DNA, 15 bp, Homo sapiens
tcacttgttttattg

SEQ ID NO: 1685592 - DNA, 16 bp, Homo sapiens
tcactttacctgcagg

SEQ ID NO: 1685593 - DNA, 19 bp, Homo sapiens
tcactttacctgcaggctc

SEQ ID NO: 1685594 - DNA, 20 bp, Homo sapiens
tcactttacctgcaggctcc

SEQ ID NO: 1685595 - DNA, 24 bp, Homo sapiens
tcactttacctgcaggctccatgc

SEQ ID NO: 1685596 - DNA, 16 bp, Homo sapiens
tcactttagatgctga

SEQ ID NO: 1685597 - DNA, 12 bp, Homo sapiens
tcactttcataa

SEQ ID NO: 1685598 - DNA, 22 bp, Homo sapiens
tcactttgaaaagttggaagga

SEQ ID NO: 1685599 - DNA, 17 bp, Homo sapiens
tcactttgacacccagg

SEQ ID NO: 1685600 - DNA, 20 bp, Homo sapiens
tcactttgccattatgcaaa

SEQ ID NO: 1685601 - DNA, 15 bp, Homo sapiens
tcacttttcatcctt

SEQ ID NO: 1685602 - DNA, 20 bp, Homo sapiens
tcactttttaaaccactgta

SEQ ID NO: 1685603 - DNA, 22 bp, Homo sapiens
tcactttttatgctatttctgt

SEQ ID NO: 1685604 - DNA, 19 bp, Homo sapiens
tcactttttttttttttcc

SEQ ID NO: 1685605 - DNA, 20 bp, Homo sapiens
tcactttttttttttttccc

SEQ ID NO: 1685606 - DNA, 19 bp, Homo sapiens
tcagaaaataaaatattca

SEQ ID NO: 1685607 - DNA, 22 bp, Homo sapiens
tcagaaaataaaatattcactc

SEQ ID NO: 1685608 - DNA, 19 bp, Homo sapiens
tcagaaaatattatgtgtt

SEQ ID NO: 1685609 - DNA, 17 bp, Homo sapiens
tcagaaacttgtgaagt

SEQ ID NO: 1685610 - DNA, 19 bp, Homo sapiens
tcagaaagctttattttga

SEQ ID NO: 1685611 - DNA, 14 bp, Homo sapiens
tcagaaaggatttt

SEQ ID NO: 1685612 - DNA, 22 bp, Homo sapiens
tcagaaaggggcattttgtact

SEQ ID NO: 1685613 - DNA, 13 bp, Homo sapiens
tcagaaagtaaca

SEQ ID NO: 1685614 - DNA, 19 bp, Homo sapiens
tcagaaagtaacaatctat

SEQ ID NO: 1685615 - DNA, 15 bp, Homo sapiens
tcagaaagtgcctga

SEQ ID NO: 1685616 - DNA, 18 bp, Homo sapiens
tcagaaagtgtataataa

SEQ ID NO: 1685617 - DNA, 19 bp, Homo sapiens
tcagaaatataacacattt

SEQ ID NO: 1685618 - DNA, 21 bp, Homo sapiens
tcagaaatgctgcctgcctgt

SEQ ID NO: 1685619 - DNA, 21 bp, Homo sapiens
tcagaaatttaattcatgttt

SEQ ID NO: 1685620 - DNA, 19 bp, Homo sapiens
tcagaacagcctgcctgtc

SEQ ID NO: 1685621 - DNA, 16 bp, Homo sapiens
tcagaacatactgatt

SEQ ID NO: 1685622 - DNA, 13 bp, Homo sapiens
tcagaacatgtta

SEQ ID NO: 1685623 - DNA, 16 bp, Homo sapiens
tcagaacatgttaaga

SEQ ID NO: 1685624 - DNA, 17 bp, Homo sapiens
tcagaacatgttaagat

SEQ ID NO: 1685625 - DNA, 17 bp, Homo sapiens
tcagaacattcagctct

SEQ ID NO: 1685626 - DNA, 20 bp, Homo sapiens
tcagaacattcagctctgga

SEQ ID NO: 1685627 - DNA, 22 bp, Homo sapiens
tcagaaccatccatagtagtat

SEQ ID NO: 1685628 - DNA, 20 bp, Homo sapiens
tcagaactcctgtgtgtgga

SEQ ID NO: 1685629 - DNA, 18 bp, Homo sapiens
tcagaactgttggctgct

SEQ ID NO: 1685630 - DNA, 22 bp, Homo sapiens
tcagaactgttggctgctcccc

SEQ ID NO: 1685631 - DNA, 19 bp, Homo sapiens
tcagaacttgctgctgtct

SEQ ID NO: 1685632 - DNA, 14 bp, Homo sapiens
tcagaagaaaacaa

SEQ ID NO: 1685633 - DNA, 22 bp, Homo sapiens
tcagaagaaaacaaagttctat

SEQ ID NO: 1685634 - DNA, 12 bp, Homo sapiens
tcagaagaaaga

SEQ ID NO: 1685635 - DNA, 18 bp, Homo sapiens
tcagaagaaaggccaagg

SEQ ID NO: 1685636 - DNA, 15 bp, Homo sapiens
tcagaagcctccaag

SEQ ID NO: 1685637 - DNA, 17 bp, Homo sapiens
tcagaaggaataagcat

SEQ ID NO: 1685638 - DNA, 13 bp, Homo sapiens
tcagaaggagaag

SEQ ID NO: 1685639 - DNA, 14 bp, Homo sapiens
tcagaaggagaagg

SEQ ID NO: 1685640 - DNA, 20 bp, Homo sapiens
tcagaaggccccagagagac

SEQ ID NO: 1685641 - DNA, 14 bp, Homo sapiens
tcagaaggcttcat

SEQ ID NO: 1685642 - DNA, 14 bp, Homo sapiens
tcagaaggtagggg

SEQ ID NO: 1685643 - DNA, 21 bp, Homo sapiens
tcagaaggtaggggccgtgtc

SEQ ID NO: 1685644 - DNA, 22 bp, Homo sapiens
tcagaaggtaggggccgtgtcc

SEQ ID NO: 1685645 - DNA, 14 bp, Homo sapiens
tcagaaggtctgtt

SEQ ID NO: 1685646 - DNA, 15 bp, Homo sapiens
tcagaagtgagcttt

SEQ ID NO: 1685647 - DNA, 19 bp, Homo sapiens
tcagaagtgagctttgctg

SEQ ID NO: 1685648 - DNA, 16 bp, Homo sapiens
tcagaagttactttta

SEQ ID NO: 1685649 - DNA, 16 bp, Homo sapiens
tcagaataactacctc

SEQ ID NO: 1685650 - DNA, 17 bp, Homo sapiens
tcagaataactacctcc

SEQ ID NO: 1685651 - DNA, 17 bp, Homo sapiens
tcagaataggaaaacat

SEQ ID NO: 1685652 - DNA, 18 bp, Homo sapiens
tcagaataggaaaacatt

SEQ ID NO: 1685653 - DNA, 16 bp, Homo sapiens
tcagaatatcatcttt

SEQ ID NO: 1685654 - DNA, 12 bp, Homo sapiens
tcagaatccaaa

SEQ ID NO: 1685655 - DNA, 14 bp, Homo sapiens
tcagaatccaaaga

SEQ ID NO: 1685656 - DNA, 18 bp, Homo sapiens
tcagaatctcaaataact

SEQ ID NO: 1685657 - DNA, 18 bp, Homo sapiens
tcagaatggcagtcctgg

SEQ ID NO: 1685658 - DNA, 20 bp, Homo sapiens
tcagaatggcagtcctggag

SEQ ID NO: 1685659 - DNA, 22 bp, Homo sapiens
tcagaatggcagtcctggaggc

SEQ ID NO: 1685660 - DNA, 14 bp, Homo sapiens
tcagaatgtaaaag

SEQ ID NO: 1685661 - DNA, 18 bp, Homo sapiens
tcagaatgtaaaagaact

SEQ ID NO: 1685662 - DNA, 16 bp, Homo sapiens
tcagaattaagcagaa

SEQ ID NO: 1685663 - DNA, 18 bp, Homo sapiens
tcagaattaagcagaaca

SEQ ID NO: 1685664 - DNA, 16 bp, Homo sapiens
tcagaattatttttaa

SEQ ID NO: 1685665 - DNA, 20 bp, Homo sapiens
tcagaattatttttaaaaag

SEQ ID NO: 1685666 - DNA, 20 bp, Homo sapiens
tcagaattctcagaatctca

SEQ ID NO: 1685667 - DNA, 23 bp, Homo sapiens
tcagacaacattatgatctaata

SEQ ID NO: 1685668 - DNA, 11 bp, Homo sapiens
tcagacaagca

SEQ ID NO: 1685669 - DNA, 13 bp, Homo sapiens
tcagacaagcact

SEQ ID NO: 1685670 - DNA, 18 bp, Homo sapiens
tcagacaataccactggt

SEQ ID NO: 1685671 - DNA, 20 bp, Homo sapiens
tcagacacatgctatgttct

SEQ ID NO: 1685672 - DNA, 17 bp, Homo sapiens
tcagacaccctcaacct

SEQ ID NO: 1685673 - DNA, 23 bp, Homo sapiens
tcagacaccctcaacctcttctg

SEQ ID NO: 1685674 - DNA, 16 bp, Homo sapiens
tcagacaccctctcct

SEQ ID NO: 1685675 - DNA, 17 bp, Homo sapiens
tcagacaccctctcctt

SEQ ID NO: 1685676 - DNA, 19 bp, Homo sapiens
tcagacacctgttcacaga

SEQ ID NO: 1685677 - DNA, 20 bp, Homo sapiens
tcagacacctgttcacagaa

SEQ ID NO: 1685678 - DNA, 15 bp, Homo sapiens
tcagacattttcact

SEQ ID NO: 1685679 - DNA, 17 bp, Homo sapiens
tcagaccccagcggctg

SEQ ID NO: 1685680 - DNA, 12 bp, Homo sapiens
tcagacccccac

SEQ ID NO: 1685681 - DNA, 14 bp, Homo sapiens
tcagacccccactc

SEQ ID NO: 1685682 - DNA, 18 bp, Homo sapiens
tcagacccccactctcat

SEQ ID NO: 1685683 - DNA, 12 bp, Homo sapiens
tcagaccccccc

SEQ ID NO: 1685684 - DNA, 13 bp, Homo sapiens
tcagacctgtctt

SEQ ID NO: 1685685 - DNA, 18 bp, Homo sapiens
tcagacctgtcttccaag

SEQ ID NO: 1685686 - DNA, 16 bp, Homo sapiens
tcagacggcggccagg

SEQ ID NO: 1685687 - DNA, 21 bp, Homo sapiens
tcagacggcggccaggcacag

SEQ ID NO: 1685688 - DNA, 22 bp, Homo sapiens
tcagacggcggccaggcacagg

SEQ ID NO: 1685689 - DNA, 23 bp, Homo sapiens
tcagacgtgtgacctccatactg

SEQ ID NO: 1685690 - DNA, 19 bp, Homo sapiens
tcagactcaagtacccatt

SEQ ID NO: 1685691 - DNA, 13 bp, Homo sapiens
tcagactccgccc

SEQ ID NO: 1685692 - DNA, 15 bp, Homo sapiens
tcagactccgccctc

SEQ ID NO: 1685693 - DNA, 14 bp, Homo sapiens
tcagactctagaaa

SEQ ID NO: 1685694 - DNA, 17 bp, Homo sapiens
tcagactctagaaaaaa

SEQ ID NO: 1685695 - DNA, 18 bp, Homo sapiens
tcagactgacagtttaca

SEQ ID NO: 1685696 - DNA, 13 bp, Homo sapiens
tcagactgcagag

SEQ ID NO: 1685697 - DNA, 15 bp, Homo sapiens
tcagactgcagaggg

SEQ ID NO: 1685698 - DNA, 17 bp, Homo sapiens
tcagactgctctttcat

SEQ ID NO: 1685699 - DNA, 13 bp, Homo sapiens
tcagactgctggg

SEQ ID NO: 1685700 - DNA, 12 bp, Homo sapiens
tcagactggccc

SEQ ID NO: 1685701 - DNA, 23 bp, Homo sapiens
tcagacttccaaatcctggaagg

SEQ ID NO: 1685702 - DNA, 16 bp, Homo sapiens
tcagactttaaagaat

SEQ ID NO: 1685703 - DNA, 23 bp, Homo sapiens
tcagactttaaagaataatatgc

SEQ ID NO: 1685704 - DNA, 13 bp, Homo sapiens
tcagactttgctt

SEQ ID NO: 1685705 - DNA, 22 bp, Homo sapiens
tcagactttgtgttcatttcat

SEQ ID NO: 1685706 - DNA, 22 bp, Homo sapiens
tcagagaaggccttacagaaaa

SEQ ID NO: 1685707 - DNA, 23 bp, Homo sapiens
tcagagaaggccttacagaaaat

SEQ ID NO: 1685708 - DNA, 12 bp, Homo sapiens
tcagagaatttc

SEQ ID NO: 1685709 - DNA, 19 bp, Homo sapiens
tcagagaccagcactcagc

SEQ ID NO: 1685710 - DNA, 20 bp, Homo sapiens
tcagagaccagcactcagcc

SEQ ID NO: 1685711 - DNA, 20 bp, Homo sapiens
tcagagaccagggctccagc

SEQ ID NO: 1685712 - DNA, 18 bp, Homo sapiens
tcagagaccgtgagcgcc

SEQ ID NO: 1685713 - DNA, 19 bp, Homo sapiens
tcagagactcagggcccca

SEQ ID NO: 1685714 - DNA, 20 bp, Homo sapiens
tcagagactcagggccccag

SEQ ID NO: 1685715 - DNA, 11 bp, Homo sapiens
tcagagagacc

SEQ ID NO: 1685716 - DNA, 16 bp, Homo sapiens
tcagagagacctcatc

SEQ ID NO: 1685717 - DNA, 22 bp, Homo sapiens
tcagagaggccttttggaatgt

SEQ ID NO: 1685718 - DNA, 17 bp, Homo sapiens
tcagagaggtctcaggt

SEQ ID NO: 1685719 - DNA, 15 bp, Homo sapiens
tcagagagtgtacat

SEQ ID NO: 1685720 - DNA, 22 bp, Homo sapiens
tcagagatgcaccaccaagcca

SEQ ID NO: 1685721 - DNA, 20 bp, Homo sapiens
tcagagatgcatttggaaca

SEQ ID NO: 1685722 - DNA, 21 bp, Homo sapiens
tcagagcaagttcctgagtgc

SEQ ID NO: 1685723 - DNA, 15 bp, Homo sapiens
tcagagccagtgaag

SEQ ID NO: 1685724 - DNA, 21 bp, Homo sapiens
tcagagccagtgaaggagcca

SEQ ID NO: 1685725 - DNA, 18 bp, Homo sapiens
tcagagcccacatggccg

SEQ ID NO: 1685726 - DNA, 18 bp, Homo sapiens
tcagagcccctacagcat

SEQ ID NO: 1685727 - DNA, 20 bp, Homo sapiens
tcagagcccctacagcattg

SEQ ID NO: 1685728 - DNA, 13 bp, Homo sapiens
tcagagcctagcc

SEQ ID NO: 1685729 - DNA, 14 bp, Homo sapiens
tcagagcctagcca

SEQ ID NO: 1685730 - DNA, 16 bp, Homo sapiens
tcagagcctagccacc

SEQ ID NO: 1685731 - DNA, 17 bp, Homo sapiens
tcagagcctagccacct

SEQ ID NO: 1685732 - DNA, 19 bp, Homo sapiens
tcagagcctagccacctcc

SEQ ID NO: 1685733 - DNA, 20 bp, Homo sapiens
tcagagcctagccacctccc

SEQ ID NO: 1685734 - DNA, 18 bp, Homo sapiens
tcagagctaaactccttc

SEQ ID NO: 1685735 - DNA, 22 bp, Homo sapiens
tcagagctaaactccttcctgg

SEQ ID NO: 1685736 - DNA, 13 bp, Homo sapiens
tcagagctaggcc

SEQ ID NO: 1685737 - DNA, 16 bp, Homo sapiens
tcagagctcttaatgt

SEQ ID NO: 1685738 - DNA, 19 bp, Homo sapiens
tcagagctcttcaagctgt

SEQ ID NO: 1685739 - DNA, 22 bp, Homo sapiens
tcagagctcttcaagctgtccc

SEQ ID NO: 1685740 - DNA, 13 bp, Homo sapiens
tcagaggagaaga

SEQ ID NO: 1685741 - DNA, 13 bp, Homo sapiens
tcagaggcctgct

SEQ ID NO: 1685742 - DNA, 15 bp, Homo sapiens
tcagaggctgaggtg

SEQ ID NO: 1685743 - DNA, 19 bp, Homo sapiens
tcagagggactgtcagctg

SEQ ID NO: 1685744 - DNA, 21 bp, Homo sapiens
tcagagggactgtcagctgag

SEQ ID NO: 1685745 - DNA, 14 bp, Homo sapiens
tcagagggcccaaa

SEQ ID NO: 1685746 - DNA, 23 bp, Homo sapiens
tcagagggctgatggattccaaa

SEQ ID NO: 1685747 - DNA, 22 bp, Homo sapiens
tcagagtatattgttgaagaga

SEQ ID NO: 1685748 - DNA, 16 bp, Homo sapiens
tcagagtgaagaatct

SEQ ID NO: 1685749 - DNA, 13 bp, Homo sapiens
tcagagtgccact

SEQ ID NO: 1685750 - DNA, 13 bp, Homo sapiens
tcagagtggagtt

SEQ ID NO: 1685751 - DNA, 23 bp, Homo sapiens
tcagagtggagttgaaactgcta

SEQ ID NO: 1685752 - DNA, 14 bp, Homo sapiens
tcagatatttctta

SEQ ID NO: 1685753 - DNA, 14 bp, Homo sapiens
tcagatatttgcac

SEQ ID NO: 1685754 - DNA, 22 bp, Homo sapiens
tcagatattttttcagaaatat

SEQ ID NO: 1685755 - DNA, 21 bp, Homo sapiens
tcagatcactgaatttataaa

SEQ ID NO: 1685756 - DNA, 15 bp, Homo sapiens
tcagatccagggaca

SEQ ID NO: 1685757 - DNA, 22 bp, Homo sapiens
tcagatcctgttacttgcttca

SEQ ID NO: 1685758 - DNA, 15 bp, Homo sapiens
tcagatcttgacagt

SEQ ID NO: 1685759 - DNA, 13 bp, Homo sapiens
tcagatgaattga

SEQ ID NO: 1685760 - DNA, 17 bp, Homo sapiens
tcagatgactctctcca

SEQ ID NO: 1685761 - DNA, 18 bp, Homo sapiens
tcagatgactctctccaa

SEQ ID NO: 1685762 - DNA, 18 bp, Homo sapiens
tcagatgaggcaaacagc

SEQ ID NO: 1685763 - DNA, 23 bp, Homo sapiens
tcagatgcaattgctcccatcag

SEQ ID NO: 1685764 - DNA, 20 bp, Homo sapiens
tcagatgccacttctaagaa

SEQ ID NO: 1685765 - DNA, 13 bp, Homo sapiens
tcagatgcctgct

SEQ ID NO: 1685766 - DNA, 13 bp, Homo sapiens
tcagatgcttctg

SEQ ID NO: 1685767 - DNA, 19 bp, Homo sapiens
tcagatgcttgcggcaaaa

SEQ ID NO: 1685768 - DNA, 12 bp, Homo sapiens
tcagatggaaaa

SEQ ID NO: 1685769 - DNA, 19 bp, Homo sapiens
tcagatggaaaattcattt

SEQ ID NO: 1685770 - DNA, 22 bp, Homo sapiens
tcagatggattgataattgcat

SEQ ID NO: 1685771 - DNA, 15 bp, Homo sapiens
tcagatgggaagaca

SEQ ID NO: 1685772 - DNA, 21 bp, Homo sapiens
tcagatgtcttctgcctgtta

SEQ ID NO: 1685773 - DNA, 15 bp, Homo sapiens
tcagatgtgcaataa

SEQ ID NO: 1685774 - DNA, 16 bp, Homo sapiens
tcagattctgtgagac

SEQ ID NO: 1685775 - DNA, 21 bp, Homo sapiens
tcagatttaagccttacaaag

SEQ ID NO: 1685776 - DNA, 13 bp, Homo sapiens
tcagatttctggt

SEQ ID NO: 1685777 - DNA, 19 bp, Homo sapiens
tcagatttctggttgttat

SEQ ID NO: 1685778 - DNA, 18 bp, Homo sapiens
tcagatttttatttatga

SEQ ID NO: 1685779 - DNA, 13 bp, Homo sapiens
tcagcaaagaaaa

SEQ ID NO: 1685780 - DNA, 14 bp, Homo sapiens
tcagcaacaagact

SEQ ID NO: 1685781 - DNA, 23 bp, Homo sapiens
tcagcaacaagactgccaggtgg

SEQ ID NO: 1685782 - DNA, 14 bp, Homo sapiens
tcagcaacttattt

SEQ ID NO: 1685783 - DNA, 19 bp, Homo sapiens
tcagcaacttattttgctt

SEQ ID NO: 1685784 - DNA, 21 bp, Homo sapiens
tcagcaagccctacagagctg

SEQ ID NO: 1685785 - DNA, 20 bp, Homo sapiens
tcagcaaggggctctgccct

SEQ ID NO: 1685786 - DNA, 13 bp, Homo sapiens
tcagcaagtgccc

SEQ ID NO: 1685787 - DNA, 15 bp, Homo sapiens
tcagcaagtgcccag

SEQ ID NO: 1685788 - DNA, 17 bp, Homo sapiens
tcagcaagtgcccagtg

SEQ ID NO: 1685789 - DNA, 19 bp, Homo sapiens
tcagcaagtgcccagtgga

SEQ ID NO: 1685790 - DNA, 16 bp, Homo sapiens
tcagcaatttcagaac

SEQ ID NO: 1685791 - DNA, 12 bp, Homo sapiens
tcagcaccaccc

SEQ ID NO: 1685792 - DNA, 13 bp, Homo sapiens
tcagcaccaccct

SEQ ID NO: 1685793 - DNA, 17 bp, Homo sapiens
tcagcaccccttccatg

SEQ ID NO: 1685794 - DNA, 13 bp, Homo sapiens
tcagcaccctggg

SEQ ID NO: 1685795 - DNA, 17 bp, Homo sapiens
tcagcaccctgggtgcc

SEQ ID NO: 1685796 - DNA, 18 bp, Homo sapiens
tcagcaccttggcccagg

SEQ ID NO: 1685797 - DNA, 19 bp, Homo sapiens
tcagcaccttggcccagga

SEQ ID NO: 1685798 - DNA, 20 bp, Homo sapiens
tcagcaccttggcccaggag

SEQ ID NO: 1685799 - DNA, 23 bp, Homo sapiens
tcagcaccttggcccaggagctc

SEQ ID NO: 1685800 - DNA, 21 bp, Homo sapiens
tcagcactgaaaataccatca

SEQ ID NO: 1685801 - DNA, 19 bp, Homo sapiens
tcagcactgatggaaaata

SEQ ID NO: 1685802 - DNA, 14 bp, Homo sapiens
tcagcactgtccct

SEQ ID NO: 1685803 - DNA, 20 bp, Homo sapiens
tcagcacttaactatgagcc

SEQ ID NO: 1685804 - DNA, 23 bp, Homo sapiens
tcagcactttgggaggctgaggc

SEQ ID NO: 1685805 - DNA, 17 bp, Homo sapiens
tcagcagaaatgaaatc

SEQ ID NO: 1685806 - DNA, 17 bp, Homo sapiens
tcagcagaacctgcaca

SEQ ID NO: 1685807 - DNA, 22 bp, Homo sapiens
tcagcagaacctgcacacagga

SEQ ID NO: 1685808 - DNA, 18 bp, Homo sapiens
tcagcagcaaattttcag

SEQ ID NO: 1685809 - DNA, 13 bp, Homo sapiens
tcagcagcagctc

SEQ ID NO: 1685810 - DNA, 15 bp, Homo sapiens
tcagcagccagtctc

SEQ ID NO: 1685811 - DNA, 20 bp, Homo sapiens
tcagcagccagtctcagaga

SEQ ID NO: 1685812 - DNA, 22 bp, Homo sapiens
tcagcagccagtctcagagacc

SEQ ID NO: 1685813 - DNA, 23 bp, Homo sapiens
tcagcagccagtctcagagacca

SEQ ID NO: 1685814 - DNA, 24 bp, Homo sapiens
tcagcagccagtctcagagaccag

SEQ ID NO: 1685815 - DNA, 12 bp, Homo sapiens
tcagcagccctc

SEQ ID NO: 1685816 - DNA, 15 bp, Homo sapiens
tcagcagccctcctc

SEQ ID NO: 1685817 - DNA, 16 bp, Homo sapiens
tcagcagccctcctca

SEQ ID NO: 1685818 - DNA, 17 bp, Homo sapiens
tcagcagttgacatcca

SEQ ID NO: 1685819 - DNA, 23 bp, Homo sapiens
tcagcatagcctgcctgatccct

SEQ ID NO: 1685820 - DNA, 13 bp, Homo sapiens
tcagcatctgacc

SEQ ID NO: 1685821 - DNA, 14 bp, Homo sapiens
tcagcatctgacca

SEQ ID NO: 1685822 - DNA, 23 bp, Homo sapiens
tcagcatctgaccatctgtgact

SEQ ID NO: 1685823 - DNA, 23 bp, Homo sapiens
tcagcatgggtccttgatgccag

SEQ ID NO: 1685824 - DNA, 12 bp, Homo sapiens
tcagcatgtcta

SEQ ID NO: 1685825 - DNA, 19 bp, Homo sapiens
tcaggtgatcaaaataaag

SEQ ID NO: 1685826 - DNA, 19 bp, Homo sapiens
tcaggtgccactccctgag

SEQ ID NO: 1685827 - DNA, 21 bp, Homo sapiens
tcaggtgccactccctgagct

SEQ ID NO: 1685828 - DNA, 21 bp, Homo sapiens
tcaggtgcttttgatgtgaaa

SEQ ID NO: 1685829 - DNA, 16 bp, Homo sapiens
tcaggtggccagaaga

SEQ ID NO: 1685830 - DNA, 15 bp, Homo sapiens
tcaggtgtcaggccc

SEQ ID NO: 1685831 - DNA, 19 bp, Homo sapiens
tcaggtgttttcaagcaca

SEQ ID NO: 1685832 - DNA, 14 bp, Homo sapiens
tcaggttccatccc

SEQ ID NO: 1685833 - DNA, 13 bp, Homo sapiens
tcaggttcctttt

SEQ ID NO: 1685834 - DNA, 14 bp, Homo sapiens
tcagtaaataatga

SEQ ID NO: 1685835 - DNA, 16 bp, Homo sapiens
tcagtaaataatgaaa

SEQ ID NO: 1685836 - DNA, 21 bp, Homo sapiens
tcagtaacataactgcttctt

SEQ ID NO: 1685837 - DNA, 12 bp, Homo sapiens
tcagtaagaggt

SEQ ID NO: 1685838 - DNA, 19 bp, Homo sapiens
tcagtacgatcaagttgtt

SEQ ID NO: 1685839 - DNA, 14 bp, Homo sapiens
tcagtactgacttt

SEQ ID NO: 1685840 - DNA, 23 bp, Homo sapiens
tcagtacttgtgaaacacagctg

SEQ ID NO: 1685841 - DNA, 18 bp, Homo sapiens
tcagtagaaaaggatcta

SEQ ID NO: 1685842 - DNA, 16 bp, Homo sapiens
tcagtaggtccaaggg

SEQ ID NO: 1685843 - DNA, 17 bp, Homo sapiens
tcagtaggtccaagggc

SEQ ID NO: 1685844 - DNA, 19 bp, Homo sapiens
tcagtaggtccaagggcca

SEQ ID NO: 1685845 - DNA, 20 bp, Homo sapiens
tcagtaggtccaagggccat

SEQ ID NO: 1685846 - DNA, 21 bp, Homo sapiens
tcagtagtttgagaccagcct

SEQ ID NO: 1685847 - DNA, 15 bp, Homo sapiens
tcagtagtttgcatt

SEQ ID NO: 1685848 - DNA, 22 bp, Homo sapiens
tcagtagtttgcatttcagaaa

SEQ ID NO: 1685849 - DNA, 17 bp, Homo sapiens
tcagtatccaggctttg

SEQ ID NO: 1685850 - DNA, 20 bp, Homo sapiens
tcagtatgctttccctgagg

SEQ ID NO: 1685851 - DNA, 22 bp, Homo sapiens
tcagtatgtccccataagacaa

SEQ ID NO: 1685852 - DNA, 14 bp, Homo sapiens
tcagtattctgaca

SEQ ID NO: 1685853 - DNA, 15 bp, Homo sapiens
tcagtattctgacat

SEQ ID NO: 1685854 - DNA, 19 bp, Homo sapiens
tcagtattctgacatgtaa

SEQ ID NO: 1685855 - DNA, 16 bp, Homo sapiens
tcagtattttttttta

SEQ ID NO: 1685856 - DNA, 16 bp, Homo sapiens
tcagtcacacacacat

SEQ ID NO: 1685857 - DNA, 23 bp, Homo sapiens
tcagtcccctcccatctgggagt

SEQ ID NO: 1685858 - DNA, 19 bp, Homo sapiens
tcagtcccctctctctggg

SEQ ID NO: 1685859 - DNA, 22 bp, Homo sapiens
tcagtccgcctggccggctcca

SEQ ID NO: 1685860 - DNA, 17 bp, Homo sapiens
tcagtcgttttagtgtc

SEQ ID NO: 1685861 - DNA, 21 bp, Homo sapiens
tcagtctcacagagaagctcc

SEQ ID NO: 1685862 - DNA, 22 bp, Homo sapiens
tcagtctcacagagaagctcct

SEQ ID NO: 1685863 - DNA, 15 bp, Homo sapiens
tcagtctcagctgct

SEQ ID NO: 1685864 - DNA, 14 bp, Homo sapiens
tcagtctcaggagc

SEQ ID NO: 1685865 - DNA, 17 bp, Homo sapiens
tcagtctgctccaccaa

SEQ ID NO: 1685866 - DNA, 13 bp, Homo sapiens
tcagtctttgctc

SEQ ID NO: 1685867 - DNA, 17 bp, Homo sapiens
tcagtctttgctcagtg

SEQ ID NO: 1685868 - DNA, 20 bp, Homo sapiens
tcagtgaagtacacctgtgt

SEQ ID NO: 1685869 - DNA, 11 bp, Homo sapiens
tcagtgacaga

SEQ ID NO: 1685870 - DNA, 19 bp, Homo sapiens
tcagtgacagagttcacta

SEQ ID NO: 1685871 - DNA, 13 bp, Homo sapiens
tcagtgactcctg

SEQ ID NO: 1685872 - DNA, 15 bp, Homo sapiens
tcagtgactcctgct

SEQ ID NO: 1685873 - DNA, 17 bp, Homo sapiens
tcagtgactcctgctgg

SEQ ID NO: 1685874 - DNA, 21 bp, Homo sapiens
tcagtgaggagggatgtgggt

SEQ ID NO: 1685875 - DNA, 23 bp, Homo sapiens
tcagtgataattggtttgactgt

SEQ ID NO: 1685876 - DNA, 21 bp, Homo sapiens
tcagtgatctatgtttgtgtg

SEQ ID NO: 1685877 - DNA, 18 bp, Homo sapiens
tcagtgattttcaaacct

SEQ ID NO: 1685878 - DNA, 22 bp, Homo sapiens
tcagtgcatttcaaggaacagc

SEQ ID NO: 1685879 - DNA, 15 bp, Homo sapiens
tcagtgccacttgac

SEQ ID NO: 1685880 - DNA, 13 bp, Homo sapiens
tcagtgcccacca

SEQ ID NO: 1685881 - DNA, 22 bp, Homo sapiens
tcagtgcccaccaacatcccat

SEQ ID NO: 1685882 - DNA, 20 bp, Homo sapiens
tcagtgccttctctcagctc

SEQ ID NO: 1685883 - DNA, 23 bp, Homo sapiens
tcagtgctataaatgccagagcc

SEQ ID NO: 1685884 - DNA, 22 bp, Homo sapiens
tcagtgctgtggcctgggcaag

SEQ ID NO: 1685885 - DNA, 21 bp, Homo sapiens
tcagtgctttgttgatttaga

SEQ ID NO: 1685886 - DNA, 20 bp, Homo sapiens
tcagtggaatagatgtctca

SEQ ID NO: 1685887 - DNA, 19 bp, Homo sapiens
tcagtgggaacgtgactgc

SEQ ID NO: 1685888 - DNA, 23 bp, Homo sapiens
tcagtgggacatagccagcattt

SEQ ID NO: 1685889 - DNA, 16 bp, Homo sapiens
tcagtgggagaaaaca

SEQ ID NO: 1685890 - DNA, 16 bp, Homo sapiens
tcagtggggctggcat

SEQ ID NO: 1685891 - DNA, 20 bp, Homo sapiens
tcagtggttatttagggaac

SEQ ID NO: 1685892 - DNA, 21 bp, Homo sapiens
tcagtgtaatgtgacttcatg

SEQ ID NO: 1685893 - DNA, 21 bp, Homo sapiens
tcagtgtatggaaataaatgt

SEQ ID NO: 1685894 - DNA, 22 bp, Homo sapiens
tcagtgtatggaaataaatgta

SEQ ID NO: 1685895 - DNA, 13 bp, Homo sapiens
tcagtgtcccggg

SEQ ID NO: 1685896 - DNA, 17 bp, Homo sapiens
tcagtgtcccgggcccg

SEQ ID NO: 1685897 - DNA, 15 bp, Homo sapiens
tcagtgtcctttcca

SEQ ID NO: 1685898 - DNA, 16 bp, Homo sapiens
tcagtgtgagtcagaa

SEQ ID NO: 1685899 - DNA, 13 bp, Homo sapiens
tcagtgtggagag

SEQ ID NO: 1685900 - DNA, 17 bp, Homo sapiens
tcagtgtggagaggggt

SEQ ID NO: 1685901 - DNA, 16 bp, Homo sapiens
tcagtgttaaaaaatt

SEQ ID NO: 1685902 - DNA, 16 bp, Homo sapiens
tcagtgttacctgtgt

SEQ ID NO: 1685903 - DNA, 18 bp, Homo sapiens
tcagtgttacctgtgtgc

SEQ ID NO: 1685904 - DNA, 19 bp, Homo sapiens
tcagtgttacctgtgtgct

SEQ ID NO: 1685905 - DNA, 20 bp, Homo sapiens
tcagtgttttggactccatc

SEQ ID NO: 1685906 - DNA, 17 bp, Homo sapiens
tcagtgtttttgtgaat

SEQ ID NO: 1685907 - DNA, 17 bp, Homo sapiens
tcagttaattcttagat

SEQ ID NO: 1685908 - DNA, 21 bp, Homo sapiens
tcagttaccaaacattacaaa

SEQ ID NO: 1685909 - DNA, 17 bp, Homo sapiens
tcagttactcagccctg

SEQ ID NO: 1685910 - DNA, 23 bp, Homo sapiens
tcagttcattgacctcatcatta

SEQ ID NO: 1685911 - DNA, 13 bp, Homo sapiens
tcagttccaaagt

SEQ ID NO: 1685912 - DNA, 20 bp, Homo sapiens
tcagttccaaagtcacagga

SEQ ID NO: 1685913 - DNA, 17 bp, Homo sapiens
tcagttcccagctcccc

SEQ ID NO: 1685914 - DNA, 23 bp, Homo sapiens
tcagttcccagctccccccgccc

SEQ ID NO: 1685915 - DNA, 23 bp, Homo sapiens
tcagttcccggagcacagccctg

SEQ ID NO: 1685916 - DNA, 16 bp, Homo sapiens
tcagttcccttggcct

SEQ ID NO: 1685917 - DNA, 18 bp, Homo sapiens
tcagttcccttggcctca

SEQ ID NO: 1685918 - DNA, 19 bp, Homo sapiens
tcagttcccttggcctcag

SEQ ID NO: 1685919 - DNA, 20 bp, Homo sapiens
tcagttcccttggcctcaga

SEQ ID NO: 1685920 - DNA, 22 bp, Homo sapiens
tcagttcccttggcctcagaat

SEQ ID NO: 1685921 - DNA, 23 bp, Homo sapiens
tcagttgagcttcatataccagc

SEQ ID NO: 1685922 - DNA, 18 bp, Homo sapiens
tcagttgctcaaaaagaa

SEQ ID NO: 1685923 - DNA, 20 bp, Homo sapiens
tcagttgctcaaaaagaaat

SEQ ID NO: 1685924 - DNA, 15 bp, Homo sapiens
tcagttgcttgtctt

SEQ ID NO: 1685925 - DNA, 22 bp, Homo sapiens
tcagttgtaataaatctaggat

SEQ ID NO: 1685926 - DNA, 13 bp, Homo sapiens
tcagttgtgtttt

SEQ ID NO: 1685927 - DNA, 17 bp, Homo sapiens
tcatccacattgtttta

SEQ ID NO: 1685928 - DNA, 19 bp, Homo sapiens
tcatccacattgttttaaa

SEQ ID NO: 1685929 - DNA, 12 bp, Homo sapiens
tcatccccaggg

SEQ ID NO: 1685930 - DNA, 20 bp, Homo sapiens
tcatccccaggggtcccagc

SEQ ID NO: 1685931 - DNA, 19 bp, Homo sapiens
tcatcccccctgctgccca

SEQ ID NO: 1685932 - DNA, 14 bp, Homo sapiens
tcatcctcaaagaa

SEQ ID NO: 1685933 - DNA, 17 bp, Homo sapiens
tcatcctcaaagaaagt

SEQ ID NO: 1685934 - DNA, 21 bp, Homo sapiens
tcatcctcaaagaaagtgtat

SEQ ID NO: 1685935 - DNA, 20 bp, Homo sapiens
tcatcctcattgcctcctgt

SEQ ID NO: 1685936 - DNA, 21 bp, Homo sapiens
tcatcctggcacgccctactc

SEQ ID NO: 1685937 - DNA, 20 bp, Homo sapiens
tcatcctttgttctgagcat

SEQ ID NO: 1685938 - DNA, 22 bp, Homo sapiens
tcatcgacttagcctgagtcat

SEQ ID NO: 1685939 - DNA, 20 bp, Homo sapiens
tcatcgattcaaactgctcc

SEQ ID NO: 1685940 - DNA, 21 bp, Homo sapiens
tcatcgccagaggtgcttcac

SEQ ID NO: 1685941 - DNA, 15 bp, Homo sapiens
tcatctaccttttct

SEQ ID NO: 1685942 - DNA, 18 bp, Homo sapiens
tcatctaccttttctggc

SEQ ID NO: 1685943 - DNA, 13 bp, Homo sapiens
tcatctacttttt

SEQ ID NO: 1685944 - DNA, 18 bp, Homo sapiens
tcatgtatttgagcatat

SEQ ID NO: 1685945 - DNA, 17 bp, Homo sapiens
tcatgtcctgtcctggt

SEQ ID NO: 1685946 - DNA, 22 bp, Homo sapiens
tcatgtcctgtcctggtcctga

SEQ ID NO: 1685947 - DNA, 18 bp, Homo sapiens
tcatgtctgaaacagaga

SEQ ID NO: 1685948 - DNA, 19 bp, Homo sapiens
tcatgtctgaaacagagaa

SEQ ID NO: 1685949 - DNA, 20 bp, Homo sapiens
tcatgtctggagtcccctcc

SEQ ID NO: 1685950 - DNA, 20 bp, Homo sapiens
tcatgtctgtatactcctgt

SEQ ID NO: 1685951 - DNA, 15 bp, Homo sapiens
tcatgtgaaatgttt

SEQ ID NO: 1685952 - DNA, 20 bp, Homo sapiens
tcatgtgattcactgccttc

SEQ ID NO: 1685953 - DNA, 20 bp, Homo sapiens
tcatgtgtgcaacagggtat

SEQ ID NO: 1685954 - DNA, 13 bp, Homo sapiens
tcatgtgtgcatg

SEQ ID NO: 1685955 - DNA, 15 bp, Homo sapiens
tcatgtgtgcatgtg

SEQ ID NO: 1685956 - DNA, 15 bp, Homo sapiens
tcatgtgttgcaaat

SEQ ID NO: 1685957 - DNA, 15 bp, Homo sapiens
tcatgttagttacct

SEQ ID NO: 1685958 - DNA, 19 bp, Homo sapiens
tcatgttagttaccttata

SEQ ID NO: 1685959 - DNA, 18 bp, Homo sapiens
tcatgttcatatgtactt

SEQ ID NO: 1685960 - DNA, 17 bp, Homo sapiens
tcatgtttacagaggac

SEQ ID NO: 1685961 - DNA, 15 bp, Homo sapiens
tcatgtttattttga

SEQ ID NO: 1685962 - DNA, 16 bp, Homo sapiens
tcatgtttcttaaatg

SEQ ID NO: 1685963 - DNA, 20 bp, Homo sapiens
tcatgtttgcttcataaatg

SEQ ID NO: 1685964 - DNA, 13 bp, Homo sapiens
tcatgtttgtaaa

SEQ ID NO: 1685965 - DNA, 18 bp, Homo sapiens
tcatgttttagcatttgt

SEQ ID NO: 1685966 - DNA, 16 bp, Homo sapiens
tcatgttttgatgaga

SEQ ID NO: 1685967 - DNA, 22 bp, Homo sapiens
tcattaaaaattacctttaatt

SEQ ID NO: 1685968 - DNA, 20 bp, Homo sapiens
tcattaaaatggaagtggat

SEQ ID NO: 1685969 - DNA, 15 bp, Homo sapiens
tcattaaacttgaag

SEQ ID NO: 1685970 - DNA, 23 bp, Homo sapiens
tcattaatagctgccttcaagga

SEQ ID NO: 1685971 - DNA, 20 bp, Homo sapiens
tcattacaattttctgtaag

SEQ ID NO: 1685972 - DNA, 19 bp, Homo sapiens
tcattacagttctttcctc

SEQ ID NO: 1685973 - DNA, 21 bp, Homo sapiens
tcattacagttctttcctctt

SEQ ID NO: 1685974 - DNA, 18 bp, Homo sapiens
tcattaccaggtttcatt

SEQ ID NO: 1685975 - DNA, 20 bp, Homo sapiens
tcattaccttttttgataaa

SEQ ID NO: 1685976 - DNA, 14 bp, Homo sapiens
tcattactggtaaa

SEQ ID NO: 1685977 - DNA, 15 bp, Homo sapiens
tcattataaacgtga

SEQ ID NO: 1685978 - DNA, 17 bp, Homo sapiens
tcattatcatcaagcag

SEQ ID NO: 1685979 - DNA, 20 bp, Homo sapiens
tcattatctcaaaactgcac

SEQ ID NO: 1685980 - DNA, 23 bp, Homo sapiens
tcattatgcacttttagaaatgc

SEQ ID NO: 1685981 - DNA, 18 bp, Homo sapiens
tcattatgtcaaccaggt

SEQ ID NO: 1685982 - DNA, 16 bp, Homo sapiens
tcattatttgcagaga

SEQ ID NO: 1685983 - DNA, 18 bp, Homo sapiens
tcattcaagcctgtgaat

SEQ ID NO: 1685984 - DNA, 15 bp, Homo sapiens
tcattcaagctattt

SEQ ID NO: 1685985 - DNA, 16 bp, Homo sapiens
tcattcaagctattta

SEQ ID NO: 1685986 - DNA, 15 bp, Homo sapiens
tcattcaatattgac

SEQ ID NO: 1685987 - DNA, 16 bp, Homo sapiens
tcattcaatattgaca

SEQ ID NO: 1685988 - DNA, 13 bp, Homo sapiens
tcattcagaaatg

SEQ ID NO: 1685989 - DNA, 20 bp, Homo sapiens
tcattcagagtcagccagga

SEQ ID NO: 1685990 - DNA, 22 bp, Homo sapiens
tcattcagagtcagccaggacc

SEQ ID NO: 1685991 - DNA, 13 bp, Homo sapiens
tcattcaggaaaa

SEQ ID NO: 1685992 - DNA, 23 bp, Homo sapiens
tcattccaattctaaatccgact

SEQ ID NO: 1685993 - DNA, 14 bp, Homo sapiens
tcattccattgact

SEQ ID NO: 1685994 - DNA, 15 bp, Homo sapiens
tcattcccagagtca

SEQ ID NO: 1685995 - DNA, 12 bp, Homo sapiens
tcattccccagg

SEQ ID NO: 1685996 - DNA, 23 bp, Homo sapiens
tcattcccctttgcactgtaatg

SEQ ID NO: 1685997 - DNA, 18 bp, Homo sapiens
tcattcctaacacagcat

SEQ ID NO: 1685998 - DNA, 20 bp, Homo sapiens
tcattcctgaaagaaacagt

SEQ ID NO: 1685999 - DNA, 13 bp, Homo sapiens
tcattcctgcctg

SEQ ID NO: 1686000 - DNA, 23 bp, Homo sapiens
tcattccttgagaaaaacaatga

SEQ ID NO: 1686001 - DNA, 18 bp, Homo sapiens
tcattcgcctttgtcttg

SEQ ID NO: 1686002 - DNA, 22 bp, Homo sapiens
tcattcgcctttgtcttgtact

SEQ ID NO: 1686003 - DNA, 17 bp, Homo sapiens
tcattcgtggcatgttt

SEQ ID NO: 1686004 - DNA, 13 bp, Homo sapiens
tcattctaaagat

SEQ ID NO: 1686005 - DNA, 22 bp, Homo sapiens
tcattctaaagatagagtaaaa

SEQ ID NO: 1686006 - DNA, 21 bp, Homo sapiens
tcattctcccgcttcctggcc

SEQ ID NO: 1686007 - DNA, 16 bp, Homo sapiens
tcattctgtgccattt

SEQ ID NO: 1686008 - DNA, 14 bp, Homo sapiens
tcattcttgtggga

SEQ ID NO: 1686009 - DNA, 21 bp, Homo sapiens
tcattcttgtgggagacagca

SEQ ID NO: 1686010 - DNA, 15 bp, Homo sapiens
tcattcttttcagct

SEQ ID NO: 1686011 - DNA, 19 bp, Homo sapiens
tcattgaactttaagaagc

SEQ ID NO: 1686012 - DNA, 18 bp, Homo sapiens
tcattgacctcatcatta

SEQ ID NO: 1686013 - DNA, 11 bp, Homo sapiens
tcattgacttt

SEQ ID NO: 1686014 - DNA, 12 bp, Homo sapiens
tcattgactttt

SEQ ID NO: 1686015 - DNA, 14 bp, Homo sapiens
tcattgagagtttt

SEQ ID NO: 1686016 - DNA, 18 bp, Homo sapiens
tcattgagagttttgtct

SEQ ID NO: 1686017 - DNA, 23 bp, Homo sapiens
tcattgccttaactggagcccca

SEQ ID NO: 1686018 - DNA, 16 bp, Homo sapiens
tcattgctaaactgat

SEQ ID NO: 1686019 - DNA, 14 bp, Homo sapiens
tcattgctaccaca

SEQ ID NO: 1686020 - DNA, 19 bp, Homo sapiens
tcattggcagctcaaagac

SEQ ID NO: 1686021 - DNA, 16 bp, Homo sapiens
tcattgtaaatcactt

SEQ ID NO: 1686022 - DNA, 19 bp, Homo sapiens
tcattgtaatgttgtgaat

SEQ ID NO: 1686023 - DNA, 17 bp, Homo sapiens
tcattgtagaaacacag

SEQ ID NO: 1686024 - DNA, 22 bp, Homo sapiens
tcattgtagaaacacagttttg

SEQ ID NO: 1686025 - DNA, 15 bp, Homo sapiens
tcattgtatgttatt

SEQ ID NO: 1686026 - DNA, 23 bp, Homo sapiens
tcattgtctactcctagaagaac

SEQ ID NO: 1686027 - DNA, 22 bp, Homo sapiens
tcattgttatttatacaagatt

SEQ ID NO: 1686028 - DNA, 17 bp, Homo sapiens
tcattgttcaattccca

SEQ ID NO: 1686029 - DNA, 24 bp, Homo sapiens
tcattgtttgtttgtaagtttgaa

SEQ ID NO: 1686030 - DNA, 14 bp, Homo sapiens
tcatttaaaatgat

SEQ ID NO: 1686031 - DNA, 17 bp, Homo sapiens
tcatttaaaatgattag

SEQ ID NO: 1686032 - DNA, 19 bp, Homo sapiens
tcatttaaagctaaatttt

SEQ ID NO: 1686033 - DNA, 16 bp, Homo sapiens
tcatttactcttcttc

SEQ ID NO: 1686034 - DNA, 15 bp, Homo sapiens
tcatttagtgctaaa

SEQ ID NO: 1686035 - DNA, 18 bp, Homo sapiens
tcatttagtgctaaacaa

SEQ ID NO: 1686036 - DNA, 17 bp, Homo sapiens
tcatttatatagattat

SEQ ID NO: 1686037 - DNA, 12 bp, Homo sapiens
tcatttatctta

SEQ ID NO: 1686038 - DNA, 21 bp, Homo sapiens
tcatttcacccctccctttct

SEQ ID NO: 1686039 - DNA, 19 bp, Homo sapiens
tcatttccaactcaggtta

SEQ ID NO: 1686040 - DNA, 22 bp, Homo sapiens
tcatttccaccaagggtatctg

SEQ ID NO: 1686041 - DNA, 12 bp, Homo sapiens
tcatttcctgcc

SEQ ID NO: 1686042 - DNA, 14 bp, Homo sapiens
tcatttcctgccct

SEQ ID NO: 1686043 - DNA, 15 bp, Homo sapiens
tcatttcctgccctt

SEQ ID NO: 1686044 - DNA, 22 bp, Homo sapiens
tcatttcctttgttgtctacat

SEQ ID NO: 1686045 - DNA, 16 bp, Homo sapiens
tcatttctgcatcagc

SEQ ID NO: 1686046 - DNA, 14 bp, Homo sapiens
tcatttcttcactt

SEQ ID NO: 1686047 - DNA, 23 bp, Homo sapiens
tcatttctttttgggagagactt

SEQ ID NO: 1686048 - DNA, 23 bp, Homo sapiens
tcatttgacacaaagcttctaaa

SEQ ID NO: 1686049 - DNA, 23 bp, Homo sapiens
tcatttggaggaaaaaaagcatg

SEQ ID NO: 1686050 - DNA, 13 bp, Homo sapiens
tcatttggtgctg

SEQ ID NO: 1686051 - DNA, 18 bp, Homo sapiens
tcatttgtacaaggtaat

SEQ ID NO: 1686052 - DNA, 16 bp, Homo sapiens
tcatttgtattgctta

SEQ ID NO: 1686053 - DNA, 21 bp, Homo sapiens
tcatttgtggcagtcccttat

SEQ ID NO: 1686054 - DNA, 22 bp, Homo sapiens
tcatttgttaaaattatcaata

SEQ ID NO: 1686055 - DNA, 13 bp, Homo sapiens
tcatttgtttaaa

SEQ ID NO: 1686056 - DNA, 12 bp, Homo sapiens
tcatttgtttac

SEQ ID NO: 1686057 - DNA, 18 bp, Homo sapiens
tcatttgtttacatttga

SEQ ID NO: 1686058 - DNA, 14 bp, Homo sapiens
tcatttgttttgct

SEQ ID NO: 1686059 - DNA, 15 bp, Homo sapiens
tcatttgttttgctt

SEQ ID NO: 1686060 - DNA, 18 bp, Homo sapiens
tcagcattattcttcaga

SEQ ID NO: 1686061 - DNA, 20 bp, Homo sapiens
tcagcattcaaaatagttct

SEQ ID NO: 1686062 - DNA, 21 bp, Homo sapiens
tcagcattcagtccgcctggc

SEQ ID NO: 1686063 - DNA, 13 bp, Homo sapiens
tcagcatttcttt

SEQ ID NO: 1686064 - DNA, 23 bp, Homo sapiens
tcagccaaatgtaattgaataaa

SEQ ID NO: 1686065 - DNA, 18 bp, Homo sapiens
tcagccacactgggcctg

SEQ ID NO: 1686066 - DNA, 22 bp, Homo sapiens
tcagccacactgggcctggagc

SEQ ID NO: 1686067 - DNA, 18 bp, Homo sapiens
tcagccacatgccccagg

SEQ ID NO: 1686068 - DNA, 20 bp, Homo sapiens
tcagccacatgccccaggct

SEQ ID NO: 1686069 - DNA, 22 bp, Homo sapiens
tcagccacatgccccaggctct

SEQ ID NO: 1686070 - DNA, 20 bp, Homo sapiens
tcagccaccctgaggcctct

SEQ ID NO: 1686071 - DNA, 15 bp, Homo sapiens
tcagccactgaggga

SEQ ID NO: 1686072 - DNA, 16 bp, Homo sapiens
tcagccactgtgtctt

SEQ ID NO: 1686073 - DNA, 22 bp, Homo sapiens
tcagccagcccatggcccccaa

SEQ ID NO: 1686074 - DNA, 12 bp, Homo sapiens
tcagccagctta

SEQ ID NO: 1686075 - DNA, 15 bp, Homo sapiens
tcagccagcttaaac

SEQ ID NO: 1686076 - DNA, 16 bp, Homo sapiens
tcagccagcttaaacc

SEQ ID NO: 1686077 - DNA, 18 bp, Homo sapiens
tcagccagtctcagatgc

SEQ ID NO: 1686078 - DNA, 20 bp, Homo sapiens
tcagccagtggcacaggaga

SEQ ID NO: 1686079 - DNA, 21 bp, Homo sapiens
tcagccatgaggagttgctgt

SEQ ID NO: 1686080 - DNA, 21 bp, Homo sapiens
tcagccatttccccctcctca

SEQ ID NO: 1686081 - DNA, 10 bp, Homo sapiens
tcagcccagc

SEQ ID NO: 1686082 - DNA, 17 bp, Homo sapiens
tcagcccagcacctgct

SEQ ID NO: 1686083 - DNA, 16 bp, Homo sapiens
tcagcccagctggcca

SEQ ID NO: 1686084 - DNA, 15 bp, Homo sapiens
tcagcccccaccagg

SEQ ID NO: 1686085 - DNA, 16 bp, Homo sapiens
tcagcccccaccaggg

SEQ ID NO: 1686086 - DNA, 19 bp, Homo sapiens
tcagcccccaccaggggaa

SEQ ID NO: 1686087 - DNA, 19 bp, Homo sapiens
tcagcccccatcacccaag

SEQ ID NO: 1686088 - DNA, 21 bp, Homo sapiens
tcagcccccatcacccaagcc

SEQ ID NO: 1686089 - DNA, 22 bp, Homo sapiens
tcagccccgacttcctgactct

SEQ ID NO: 1686090 - DNA, 16 bp, Homo sapiens
tcagcccctagtgcta

SEQ ID NO: 1686091 - DNA, 12 bp, Homo sapiens
tcagcccctcct

SEQ ID NO: 1686092 - DNA, 20 bp, Homo sapiens
tcagcccctcctctgccacc

SEQ ID NO: 1686093 - DNA, 21 bp, Homo sapiens
tcagcccctcctctgccacct

SEQ ID NO: 1686094 - DNA, 22 bp, Homo sapiens
tcagcccctcctctgccacctc

SEQ ID NO: 1686095 - DNA, 16 bp, Homo sapiens
tcagcccgcttggcca

SEQ ID NO: 1686096 - DNA, 20 bp, Homo sapiens
tcagccctagaggcgagcca

SEQ ID NO: 1686097 - DNA, 23 bp, Homo sapiens
tcagccctagaggcgagccaggc

SEQ ID NO: 1686098 - DNA, 12 bp, Homo sapiens
tcagccctcaga

SEQ ID NO: 1686099 - DNA, 13 bp, Homo sapiens
tcagccctcagaa

SEQ ID NO: 1686100 - DNA, 14 bp, Homo sapiens
tcagccctccctgc

SEQ ID NO: 1686101 - DNA, 18 bp, Homo sapiens
tcagccctgattgtgcca

SEQ ID NO: 1686102 - DNA, 12 bp, Homo sapiens
tcagccctgggc

SEQ ID NO: 1686103 - DNA, 20 bp, Homo sapiens
tcagccgagccgggcctggg

SEQ ID NO: 1686104 - DNA, 22 bp, Homo sapiens
tcagccgagccgggcctggggc

SEQ ID NO: 1686105 - DNA, 22 bp, Homo sapiens
tcagcctaccgctggccctgcc

SEQ ID NO: 1686106 - DNA, 19 bp, Homo sapiens
tcagcctagccgacctcag

SEQ ID NO: 1686107 - DNA, 15 bp, Homo sapiens
tcagcctcatcctga

SEQ ID NO: 1686108 - DNA, 23 bp, Homo sapiens
tcagcctccaaagtggagctggg

SEQ ID NO: 1686109 - DNA, 13 bp, Homo sapiens
tcagcctcccaac

SEQ ID NO: 1686110 - DNA, 17 bp, Homo sapiens
tcagcctcccaacccca

SEQ ID NO: 1686111 - DNA, 22 bp, Homo sapiens
tcagcctcccaaccccagggcc

SEQ ID NO: 1686112 - DNA, 14 bp, Homo sapiens
tcagcctcctgagt

SEQ ID NO: 1686113 - DNA, 21 bp, Homo sapiens
tcagcctcctgagtagctggg

SEQ ID NO: 1686114 - DNA, 20 bp, Homo sapiens
tcagcctctcaagtagctgg

SEQ ID NO: 1686115 - DNA, 17 bp, Homo sapiens
tcagcctcttaccttcc

SEQ ID NO: 1686116 - DNA, 10 bp, Homo sapiens
tcagcctgag

SEQ ID NO: 1686117 - DNA, 13 bp, Homo sapiens
tcagcctgaggct

SEQ ID NO: 1686118 - DNA, 18 bp, Homo sapiens
tcagcctgaggctgagac

SEQ ID NO: 1686119 - DNA, 19 bp, Homo sapiens
tcagcctgagtctcctgtg

SEQ ID NO: 1686120 - DNA, 15 bp, Homo sapiens
tcagcctggccagac

SEQ ID NO: 1686121 - DNA, 17 bp, Homo sapiens
tcagcctggccagacac

SEQ ID NO: 1686122 - DNA, 19 bp, Homo sapiens
tcagcctggccagacacag

SEQ ID NO: 1686123 - DNA, 17 bp, Homo sapiens
tcagcctggtgggcctc

SEQ ID NO: 1686124 - DNA, 12 bp, Homo sapiens
tcagcctgtgct

SEQ ID NO: 1686125 - DNA, 16 bp, Homo sapiens
tcagcctgtgctgccc

SEQ ID NO: 1686126 - DNA, 18 bp, Homo sapiens
tcagcctgttccagaagg

SEQ ID NO: 1686127 - DNA, 18 bp, Homo sapiens
tcagccttcaagaatcag

SEQ ID NO: 1686128 - DNA, 21 bp, Homo sapiens
tcagccttccccctcccaggg

SEQ ID NO: 1686129 - DNA, 22 bp, Homo sapiens
tcagccttccccctcccagggc

SEQ ID NO: 1686130 - DNA, 23 bp, Homo sapiens
tcagccttccccttgcccagggc

SEQ ID NO: 1686131 - DNA, 16 bp, Homo sapiens
tcagccttgccagaga

SEQ ID NO: 1686132 - DNA, 14 bp, Homo sapiens
tcagccttgctgct

SEQ ID NO: 1686133 - DNA, 18 bp, Homo sapiens
tcagccttgctgctctgc

SEQ ID NO: 1686134 - DNA, 21 bp, Homo sapiens
tcagccttgctgctctgcgtg

SEQ ID NO: 1686135 - DNA, 20 bp, Homo sapiens
tcagcgactccgttggccac

SEQ ID NO: 1686136 - DNA, 23 bp, Homo sapiens
tcagcgactccgttggccactcc

SEQ ID NO: 1686137 - DNA, 13 bp, Homo sapiens
tcagcgagaggca

SEQ ID NO: 1686138 - DNA, 15 bp, Homo sapiens
tcagcgggtctcctc

SEQ ID NO: 1686139 - DNA, 22 bp, Homo sapiens
tcagctagttggggagctaagg

SEQ ID NO: 1686140 - DNA, 20 bp, Homo sapiens
tcagctatttactgccaaag

SEQ ID NO: 1686141 - DNA, 18 bp, Homo sapiens
tcagctcaactcacagct

SEQ ID NO: 1686142 - DNA, 20 bp, Homo sapiens
tcagctcaactcacagcttc

SEQ ID NO: 1686143 - DNA, 21 bp, Homo sapiens
tcagctcccctcggagaagag

SEQ ID NO: 1686144 - DNA, 21 bp, Homo sapiens
tcagctcctggggaccccact

SEQ ID NO: 1686145 - DNA, 17 bp, Homo sapiens
tcagctcggggagcctt

SEQ ID NO: 1686146 - DNA, 18 bp, Homo sapiens
tcagctcggggagcctta

SEQ ID NO: 1686147 - DNA, 15 bp, Homo sapiens
tcagctctctgccct

SEQ ID NO: 1686148 - DNA, 13 bp, Homo sapiens
tcagctctggaga

SEQ ID NO: 1686149 - DNA, 17 bp, Homo sapiens
tcagctctggtccaggc

SEQ ID NO: 1686150 - DNA, 15 bp, Homo sapiens
tcagctctttccaaa

SEQ ID NO: 1686151 - DNA, 16 bp, Homo sapiens
tcagctctttccaaat

SEQ ID NO: 1686152 - DNA, 17 bp, Homo sapiens
tcagctctttccaaatt

SEQ ID NO: 1686153 - DNA, 21 bp, Homo sapiens
tcagctgagcttgagctcccc

SEQ ID NO: 1686154 - DNA, 22 bp, Homo sapiens
tcagctgagcttgagctcccct

SEQ ID NO: 1686155 - DNA, 21 bp, Homo sapiens
tcagctgcaaggtactctggt

SEQ ID NO: 1686156 - DNA, 16 bp, Homo sapiens
tcagctgcacattcct

SEQ ID NO: 1686157 - DNA, 17 bp, Homo sapiens
tcagctgcacattcctg

SEQ ID NO: 1686158 - DNA, 20 bp, Homo sapiens
tcagctgcacattcctggcc

SEQ ID NO: 1686159 - DNA, 21 bp, Homo sapiens
tcagctgcatttcacatgcct

SEQ ID NO: 1686160 - DNA, 23 bp, Homo sapiens
tcagctgcatttcacatgccttg

SEQ ID NO: 1686161 - DNA, 12 bp, Homo sapiens
tcagctgcccat

SEQ ID NO: 1686162 - DNA, 22 bp, Homo sapiens
tcagctgcccatcccagtccct

SEQ ID NO: 1686163 - DNA, 23 bp, Homo sapiens
tcagctgcccatcccagtccctc

SEQ ID NO: 1686164 - DNA, 14 bp, Homo sapiens
tcagctgcctcact

SEQ ID NO: 1686165 - DNA, 24 bp, Homo sapiens
tcagctgcctcacttcctacaaga

SEQ ID NO: 1686166 - DNA, 15 bp, Homo sapiens
tcagctgctactact

SEQ ID NO: 1686167 - DNA, 13 bp, Homo sapiens
tcagctgctgaaa

SEQ ID NO: 1686168 - DNA, 21 bp, Homo sapiens
tcagctggctgagacactgaa

SEQ ID NO: 1686169 - DNA, 19 bp, Homo sapiens
tcagctgtcctgcagcaaa

SEQ ID NO: 1686170 - DNA, 12 bp, Homo sapiens
tcagctgtgggg

SEQ ID NO: 1686171 - DNA, 21 bp, Homo sapiens
tccaccctgcattttcctctt

SEQ ID NO: 1686172 - DNA, 22 bp, Homo sapiens
tccaccctgcattttcctcttg

SEQ ID NO: 1686173 - DNA, 23 bp, Homo sapiens
tccaccctgccaagactcctcag

SEQ ID NO: 1686174 - DNA, 16 bp, Homo sapiens
tccaccctgtccccca

SEQ ID NO: 1686175 - DNA, 22 bp, Homo sapiens
tccaccctgtcccccagctctg

SEQ ID NO: 1686176 - DNA, 12 bp, Homo sapiens
tccacccttcca

SEQ ID NO: 1686177 - DNA, 19 bp, Homo sapiens
tccacccttggcctgtctc

SEQ ID NO: 1686178 - DNA, 17 bp, Homo sapiens
tccaccgaccaactgcc

SEQ ID NO: 1686179 - DNA, 19 bp, Homo sapiens
tccaccgaccaactgccct

SEQ ID NO: 1686180 - DNA, 20 bp, Homo sapiens
tccaccgaccaactgcccta

SEQ ID NO: 1686181 - DNA, 15 bp, Homo sapiens
tccaccgctgcctaa

SEQ ID NO: 1686182 - DNA, 11 bp, Homo sapiens
tccacctcagc

SEQ ID NO: 1686183 - DNA, 15 bp, Homo sapiens
tccacctcatcactg

SEQ ID NO: 1686184 - DNA, 12 bp, Homo sapiens
tccacctctggt

SEQ ID NO: 1686185 - DNA, 21 bp, Homo sapiens
tccacctggtactccctctca

SEQ ID NO: 1686186 - DNA, 23 bp, Homo sapiens
tccacctggtactccctctcagg

SEQ ID NO: 1686187 - DNA, 20 bp, Homo sapiens
tccacctgtctcagcctccc

SEQ ID NO: 1686188 - DNA, 20 bp, Homo sapiens
tccacctgtcttggcctccc

SEQ ID NO: 1686189 - DNA, 16 bp, Homo sapiens
tccaccttagtacttt

SEQ ID NO: 1686190 - DNA, 13 bp, Homo sapiens
tccaccttccctt

SEQ ID NO: 1686191 - DNA, 15 bp, Homo sapiens
tccaccttgctcttc

SEQ ID NO: 1686192 - DNA, 20 bp, Homo sapiens
tccacggtgcgtggctgtgg

SEQ ID NO: 1686193 - DNA, 21 bp, Homo sapiens
tccacggtgcgtggctgtggc

SEQ ID NO: 1686194 - DNA, 22 bp, Homo sapiens
tccacggtgcgtggctgtggca

SEQ ID NO: 1686195 - DNA, 16 bp, Homo sapiens
tccacgtccccctggg

SEQ ID NO: 1686196 - DNA, 17 bp, Homo sapiens
tccacgtccccctgggg

SEQ ID NO: 1686197 - DNA, 16 bp, Homo sapiens
tccactacacctggct

SEQ ID NO: 1686198 - DNA, 18 bp, Homo sapiens
tccactacacctggctga

SEQ ID NO: 1686199 - DNA, 23 bp, Homo sapiens
tccactatcccaatcaaagaatt

SEQ ID NO: 1686200 - DNA, 23 bp, Homo sapiens
tccactattttattaaaaataaa

SEQ ID NO: 1686201 - DNA, 15 bp, Homo sapiens
tccactattttcaaa

SEQ ID NO: 1686202 - DNA, 12 bp, Homo sapiens
tccactcactcc

SEQ ID NO: 1686203 - DNA, 15 bp, Homo sapiens
tccactcactccagc

SEQ ID NO: 1686204 - DNA, 17 bp, Homo sapiens
tccaggctgagccatga

SEQ ID NO: 1686205 - DNA, 18 bp, Homo sapiens
tccaggctgagccatgag

SEQ ID NO: 1686206 - DNA, 11 bp, Homo sapiens
tccaggctggt

SEQ ID NO: 1686207 - DNA, 22 bp, Homo sapiens
tccaggctttcccacttcccac

SEQ ID NO: 1686208 - DNA, 23 bp, Homo sapiens
tccagggaagctggccgagggtc

SEQ ID NO: 1686209 - DNA, 20 bp, Homo sapiens
tccagggaatccaagcctcc

SEQ ID NO: 1686210 - DNA, 15 bp, Homo sapiens
tccagggacagaggc

SEQ ID NO: 1686211 - DNA, 17 bp, Homo sapiens
tccagggagcaagacag

SEQ ID NO: 1686212 - DNA, 20 bp, Homo sapiens
tccagggaggcgatgccagc

SEQ ID NO: 1686213 - DNA, 22 bp, Homo sapiens
tccagggaggcgatgccagcct

SEQ ID NO: 1686214 - DNA, 22 bp, Homo sapiens
tccagggaggggccggccctgt

SEQ ID NO: 1686215 - DNA, 13 bp, Homo sapiens
tccagggcagcct

SEQ ID NO: 1686216 - DNA, 20 bp, Homo sapiens
tccagggcattgctcagccc

SEQ ID NO: 1686217 - DNA, 17 bp, Homo sapiens
tccagggccacgtgcca

SEQ ID NO: 1686218 - DNA, 14 bp, Homo sapiens
tccagggctagtga

SEQ ID NO: 1686219 - DNA, 19 bp, Homo sapiens
tccagggctggactgaggc

SEQ ID NO: 1686220 - DNA, 22 bp, Homo sapiens
tccagggctggactgaggcctg

SEQ ID NO: 1686221 - DNA, 23 bp, Homo sapiens
tccagggctggactgaggcctga

SEQ ID NO: 1686222 - DNA, 21 bp, Homo sapiens
tccaggggctgcttcctcctg

SEQ ID NO: 1686223 - DNA, 17 bp, Homo sapiens
tccagggggagaaggaa

SEQ ID NO: 1686224 - DNA, 18 bp, Homo sapiens
tccagggggagaaggaag

SEQ ID NO: 1686225 - DNA, 16 bp, Homo sapiens
tccagggtcctctagc

SEQ ID NO: 1686226 - DNA, 17 bp, Homo sapiens
tccagggtcttgggcta

SEQ ID NO: 1686227 - DNA, 22 bp, Homo sapiens
tccagggtcttgggctactggc

SEQ ID NO: 1686228 - DNA, 14 bp, Homo sapiens
tccaggtcagcctg

SEQ ID NO: 1686229 - DNA, 15 bp, Homo sapiens
tccaggtcagcctgg

SEQ ID NO: 1686230 - DNA, 17 bp, Homo sapiens
tccaggtcagcctggaa

SEQ ID NO: 1686231 - DNA, 18 bp, Homo sapiens
tccaggtcagcctggaag

SEQ ID NO: 1686232 - DNA, 20 bp, Homo sapiens
tccaggtcggagtgcctgga

SEQ ID NO: 1686233 - DNA, 24 bp, Homo sapiens
tccaggtcggagtgcctggagtca

SEQ ID NO: 1686234 - DNA, 17 bp, Homo sapiens
tccaggtgtgcacgtgg

SEQ ID NO: 1686235 - DNA, 18 bp, Homo sapiens
tccaggttccctcccaga

SEQ ID NO: 1686236 - DNA, 13 bp, Homo sapiens
tccagtaacccaa

SEQ ID NO: 1686237 - DNA, 15 bp, Homo sapiens
tccagtaacccaaat

SEQ ID NO: 1686238 - DNA, 14 bp, Homo sapiens
tccagtaacttttt

SEQ ID NO: 1686239 - DNA, 20 bp, Homo sapiens
tccagtaacttttttgtgta

SEQ ID NO: 1686240 - DNA, 21 bp, Homo sapiens
tccagtaacttttttgtgtat

SEQ ID NO: 1686241 - DNA, 22 bp, Homo sapiens
tccagtaccttgcttcttactg

SEQ ID NO: 1686242 - DNA, 17 bp, Homo sapiens
tccagtacctttgtcac

SEQ ID NO: 1686243 - DNA, 18 bp, Homo sapiens
tccagtacgtcccgctgc

SEQ ID NO: 1686244 - DNA, 20 bp, Homo sapiens
tccagtagtggacaacaggt

SEQ ID NO: 1686245 - DNA, 16 bp, Homo sapiens
tcccaaggagccattc

SEQ ID NO: 1686246 - DNA, 21 bp, Homo sapiens
tcccaaggagccattctgtgt

SEQ ID NO: 1686247 - DNA, 14 bp, Homo sapiens
tcccaaggagctga

SEQ ID NO: 1686248 - DNA, 15 bp, Homo sapiens
tcccaaggagctgat

SEQ ID NO: 1686249 - DNA, 17 bp, Homo sapiens
tcccaaggtcctctcag

SEQ ID NO: 1686250 - DNA, 18 bp, Homo sapiens
tcccaaggtcctctcagt

SEQ ID NO: 1686251 - DNA, 17 bp, Homo sapiens
tcccaaggttggagccc

SEQ ID NO: 1686252 - DNA, 20 bp, Homo sapiens
tcccaaggttggagcccagg

SEQ ID NO: 1686253 - DNA, 20 bp, Homo sapiens
tcccaagtagctgggattac

SEQ ID NO: 1686254 - DNA, 22 bp, Homo sapiens
tcccaagtatgccttaagcaga

SEQ ID NO: 1686255 - DNA, 13 bp, Homo sapiens
tcccaagtccaca

SEQ ID NO: 1686256 - DNA, 17 bp, Homo sapiens
tcccaagtgccagtctt

SEQ ID NO: 1686257 - DNA, 19 bp, Homo sapiens
tcccaagtttccatagcaa

SEQ ID NO: 1686258 - DNA, 23 bp, Homo sapiens
tcccaagtttccatagcaacagg

SEQ ID NO: 1686259 - DNA, 11 bp, Homo sapiens
tcccaataaaa

SEQ ID NO: 1686260 - DNA, 13 bp, Homo sapiens
tcccaataaaagt

SEQ ID NO: 1686261 - DNA, 15 bp, Homo sapiens
tcccaataaaagtga

SEQ ID NO: 1686262 - DNA, 18 bp, Homo sapiens
tcccaatcaaagaattac

SEQ ID NO: 1686263 - DNA, 21 bp, Homo sapiens
tcccaatcaaagaattacagt

SEQ ID NO: 1686264 - DNA, 15 bp, Homo sapiens
tcccaatcagcactg

SEQ ID NO: 1686265 - DNA, 22 bp, Homo sapiens
tcccaatcagcttttgttctag

SEQ ID NO: 1686266 - DNA, 23 bp, Homo sapiens
tcccaatcagcttttgttctaga

SEQ ID NO: 1686267 - DNA, 16 bp, Homo sapiens
tcccaatcctctctcc

SEQ ID NO: 1686268 - DNA, 19 bp, Homo sapiens
tcccaattaggaagtgtaa

SEQ ID NO: 1686269 - DNA, 18 bp, Homo sapiens
tcccacaaaatatttcta

SEQ ID NO: 1686270 - DNA, 19 bp, Homo sapiens
tcccacaaaatatttctaa

SEQ ID NO: 1686271 - DNA, 12 bp, Homo sapiens
tcccacacccaa

SEQ ID NO: 1686272 - DNA, 17 bp, Homo sapiens
tcccacacccaaagctg

SEQ ID NO: 1686273 - DNA, 14 bp, Homo sapiens
tcccacaccgctgg

SEQ ID NO: 1686274 - DNA, 18 bp, Homo sapiens
tcccacaccgctggtccc

SEQ ID NO: 1686275 - DNA, 14 bp, Homo sapiens
tcccacacctgcct

SEQ ID NO: 1686276 - DNA, 22 bp, Homo sapiens
tcccacactttgaagcaaatac

SEQ ID NO: 1686277 - DNA, 14 bp, Homo sapiens
tcccacagcctcct

SEQ ID NO: 1686278 - DNA, 17 bp, Homo sapiens
tcccacaggagggccag

SEQ ID NO: 1686279 - DNA, 21 bp, Homo sapiens
tcccacaggcccttcctctcc

SEQ ID NO: 1686280 - DNA, 22 bp, Homo sapiens
tcccacaggcccttcctctcca

SEQ ID NO: 1686281 - DNA, 16 bp, Homo sapiens
tcccacagtgctggga

SEQ ID NO: 1686282 - DNA, 22 bp, Homo sapiens
tcccacatccaactccagcaac

SEQ ID NO: 1686283 - DNA, 13 bp, Homo sapiens
tcccacatgaggc

SEQ ID NO: 1686284 - DNA, 19 bp, Homo sapiens
tcccacatgaggccatctc

SEQ ID NO: 1686285 - DNA, 23 bp, Homo sapiens
tcccacatgaggccatctcagga

SEQ ID NO: 1686286 - DNA, 18 bp, Homo sapiens
tcccaccaactctgcact

SEQ ID NO: 1686287 - DNA, 19 bp, Homo sapiens
tcccaccagagccgggagg

SEQ ID NO: 1686288 - DNA, 19 bp, Homo sapiens
tcccacccacacagctgcc

SEQ ID NO: 1686289 - DNA, 21 bp, Homo sapiens
tcccacccacacagctgccct

SEQ ID NO: 1686290 - DNA, 16 bp, Homo sapiens
tcccacccacatgtga

SEQ ID NO: 1686291 - DNA, 11 bp, Homo sapiens
tcccacccacc

SEQ ID NO: 1686292 - DNA, 14 bp, Homo sapiens
tcccacccacccgc

SEQ ID NO: 1686293 - DNA, 16 bp, Homo sapiens
tcccacccacctcacc

SEQ ID NO: 1686294 - DNA, 12 bp, Homo sapiens
tcccaccccacc

SEQ ID NO: 1686295 - DNA, 21 bp, Homo sapiens
tccctcttagtctaggtcctt

SEQ ID NO: 1686296 - DNA, 18 bp, Homo sapiens
tccctcttcactgtggcc

SEQ ID NO: 1686297 - DNA, 21 bp, Homo sapiens
tccctcttcactgtggccaca

SEQ ID NO: 1686298 - DNA, 18 bp, Homo sapiens
tccctcttccctctccct

SEQ ID NO: 1686299 - DNA, 22 bp, Homo sapiens
tccctcttgtaagtcatctact

SEQ ID NO: 1686300 - DNA, 23 bp, Homo sapiens
tccctctttggctcccctgtacc

SEQ ID NO: 1686301 - DNA, 18 bp, Homo sapiens
tccctgaaaacccagaga

SEQ ID NO: 1686302 - DNA, 20 bp, Homo sapiens
tccctgaacccctggccagc

SEQ ID NO: 1686303 - DNA, 24 bp, Homo sapiens
tccctgaacccctggccagctctg

SEQ ID NO: 1686304 - DNA, 22 bp, Homo sapiens
tccctgaacgttttcttctttc

SEQ ID NO: 1686305 - DNA, 17 bp, Homo sapiens
tccctgaatctgtgcct

SEQ ID NO: 1686306 - DNA, 16 bp, Homo sapiens
tccctgactctctgtg

SEQ ID NO: 1686307 - DNA, 17 bp, Homo sapiens
tccctgactctctgtga

SEQ ID NO: 1686308 - DNA, 14 bp, Homo sapiens
tccctgactggcca

SEQ ID NO: 1686309 - DNA, 14 bp, Homo sapiens
tccctgacttgctt

SEQ ID NO: 1686310 - DNA, 15 bp, Homo sapiens
tccctgacttgcttt

SEQ ID NO: 1686311 - DNA, 16 bp, Homo sapiens
tccctgacttgcttta

SEQ ID NO: 1686312 - DNA, 16 bp, Homo sapiens
tccctgagcaggaaag

SEQ ID NO: 1686313 - DNA, 21 bp, Homo sapiens
tccctgaggactgatttcaga

SEQ ID NO: 1686314 - DNA, 23 bp, Homo sapiens
tccctgaggatgggtcagagcta

SEQ ID NO: 1686315 - DNA, 14 bp, Homo sapiens
tccctgagtcacca

SEQ ID NO: 1686316 - DNA, 17 bp, Homo sapiens
tccctgagtcaccagga

SEQ ID NO: 1686317 - DNA, 15 bp, Homo sapiens
tccctgcaaccaact

SEQ ID NO: 1686318 - DNA, 18 bp, Homo sapiens
tccctgcacaagccaggg

SEQ ID NO: 1686319 - DNA, 17 bp, Homo sapiens
tccctgcacagtgactt

SEQ ID NO: 1686320 - DNA, 20 bp, Homo sapiens
tccctgcacagtgacttctg

SEQ ID NO: 1686321 - DNA, 16 bp, Homo sapiens
tccctgcaccactctc

SEQ ID NO: 1686322 - DNA, 15 bp, Homo sapiens
tccctgcaccctgga

SEQ ID NO: 1686323 - DNA, 16 bp, Homo sapiens
tccctgcagatgccac

SEQ ID NO: 1686324 - DNA, 15 bp, Homo sapiens
tccctgcagggccat

SEQ ID NO: 1686325 - DNA, 10 bp, Homo sapiens
tccctgccaa

SEQ ID NO: 1686326 - DNA, 22 bp, Homo sapiens
tccctgccaagtctcagaagag

SEQ ID NO: 1686327 - DNA, 21 bp, Homo sapiens
tccctgccacttcaaccccca

SEQ ID NO: 1686328 - DNA, 13 bp, Homo sapiens
tccctgccctccc

SEQ ID NO: 1686329 - DNA, 16 bp, Homo sapiens
tccctgccctcccctg

SEQ ID NO: 1686330 - DNA, 17 bp, Homo sapiens
tccctgccctcccctgc

SEQ ID NO: 1686331 - DNA, 17 bp, Homo sapiens
tccctgccgaacacaca

SEQ ID NO: 1686332 - DNA, 23 bp, Homo sapiens
tccctgcctctcatcaactgaat

SEQ ID NO: 1686333 - DNA, 15 bp, Homo sapiens
tccctgcctggcccc

SEQ ID NO: 1686334 - DNA, 11 bp, Homo sapiens
tccctgccttc

SEQ ID NO: 1686335 - DNA, 12 bp, Homo sapiens
tccctgccttca

SEQ ID NO: 1686336 - DNA, 19 bp, Homo sapiens
tccctgccttcactgtgct

SEQ ID NO: 1686337 - DNA, 15 bp, Homo sapiens
tccctgccttgctga

SEQ ID NO: 1686338 - DNA, 15 bp, Homo sapiens
tccctgcgggccagg

SEQ ID NO: 1686339 - DNA, 14 bp, Homo sapiens
tccctgctctctga

SEQ ID NO: 1686340 - DNA, 15 bp, Homo sapiens
tccctgctctctgag

SEQ ID NO: 1686341 - DNA, 12 bp, Homo sapiens
tccctgctgaat

SEQ ID NO: 1686342 - DNA, 21 bp, Homo sapiens
tccctgctgtgccatgctggg

SEQ ID NO: 1686343 - DNA, 14 bp, Homo sapiens
tccctgcttctggc

SEQ ID NO: 1686344 - DNA, 20 bp, Homo sapiens
tccctgcttgcacacttccc

SEQ ID NO: 1686345 - DNA, 15 bp, Homo sapiens
tccctgctttgcatc

SEQ ID NO: 1686346 - DNA, 20 bp, Homo sapiens
tccctggaaaccttccaccc

SEQ ID NO: 1686347 - DNA, 22 bp, Homo sapiens
tccctggaaaccttccacccag

SEQ ID NO: 1686348 - DNA, 20 bp, Homo sapiens
tccctggaactcctggcctt

SEQ ID NO: 1686349 - DNA, 21 bp, Homo sapiens
tccctggaagctctccgagct

SEQ ID NO: 1686350 - DNA, 20 bp, Homo sapiens
tccctggacacagctcttca

SEQ ID NO: 1686351 - DNA, 11 bp, Homo sapiens
tccctggacag

SEQ ID NO: 1686352 - DNA, 17 bp, Homo sapiens
tccctggaccagcctcc

SEQ ID NO: 1686353 - DNA, 18 bp, Homo sapiens
tccctggagcaggagccc

SEQ ID NO: 1686354 - DNA, 23 bp, Homo sapiens
tccctggaggagaagtattcctg

SEQ ID NO: 1686355 - DNA, 14 bp, Homo sapiens
tccctggagtcagg

SEQ ID NO: 1686356 - DNA, 21 bp, Homo sapiens
tccctggcgcaggtgggctgg

SEQ ID NO: 1686357 - DNA, 14 bp, Homo sapiens
tccctggctacttc

SEQ ID NO: 1686358 - DNA, 17 bp, Homo sapiens
tccctggctacttccct

SEQ ID NO: 1686359 - DNA, 20 bp, Homo sapiens
tccctggctacttcccttcc

SEQ ID NO: 1686360 - DNA, 21 bp, Homo sapiens
tccctggctacttcccttcct

SEQ ID NO: 1686361 - DNA, 12 bp, Homo sapiens
tccctggctccc

SEQ ID NO: 1686362 - DNA, 17 bp, Homo sapiens
tccctggctccctcctc

SEQ ID NO: 1686363 - DNA, 15 bp, Homo sapiens
tccctggctctcaga

SEQ ID NO: 1686364 - DNA, 19 bp, Homo sapiens
tccctggctctcagaaggt

SEQ ID NO: 1686365 - DNA, 16 bp, Homo sapiens
tccctggctgccctgg

SEQ ID NO: 1686366 - DNA, 18 bp, Homo sapiens
tccctggctgccctggcc

SEQ ID NO: 1686367 - DNA, 23 bp, Homo sapiens
tccctggctgtgagcagcctcca

SEQ ID NO: 1686368 - DNA, 18 bp, Homo sapiens
tccctggcttgtaactcc

SEQ ID NO: 1686369 - DNA, 19 bp, Homo sapiens
tccctgggctgtgctacct

SEQ ID NO: 1686370 - DNA, 18 bp, Homo sapiens
tccctgggggaagccctg

SEQ ID NO: 1686371 - DNA, 19 bp, Homo sapiens
tccctgggggaagccctgg

SEQ ID NO: 1686372 - DNA, 15 bp, Homo sapiens
tccctgggggcccca

SEQ ID NO: 1686373 - DNA, 17 bp, Homo sapiens
tccctgggggccttggg

SEQ ID NO: 1686374 - DNA, 21 bp, Homo sapiens
tccctgggggccttgggtgag

SEQ ID NO: 1686375 - DNA, 21 bp, Homo sapiens
tccctggtagtgtagctgtgt

SEQ ID NO: 1686376 - DNA, 13 bp, Homo sapiens
tccctggtccctt

SEQ ID NO: 1686377 - DNA, 12 bp, Homo sapiens
tccctggtcctt

SEQ ID NO: 1686378 - DNA, 22 bp, Homo sapiens
tccctggtccttcactggcgcc

SEQ ID NO: 1686379 - DNA, 23 bp, Homo sapiens
tccctggtccttcactggcgcct

SEQ ID NO: 1686380 - DNA, 17 bp, Homo sapiens
tccctggtgcctctgtg

SEQ ID NO: 1686381 - DNA, 14 bp, Homo sapiens
tccctggttcattg

SEQ ID NO: 1686382 - DNA, 22 bp, Homo sapiens
tccctgtcaccaagctcacagt

SEQ ID NO: 1686383 - DNA, 14 bp, Homo sapiens
tccctgtcacgctc

SEQ ID NO: 1686384 - DNA, 19 bp, Homo sapiens
tccctgtcacgctcatgtc

SEQ ID NO: 1686385 - DNA, 18 bp, Homo sapiens
tccctgtcactcagctga

SEQ ID NO: 1686386 - DNA, 14 bp, Homo sapiens
tccctgtcccaggg

SEQ ID NO: 1686387 - DNA, 17 bp, Homo sapiens
tccctgtcccagggccc

SEQ ID NO: 1686388 - DNA, 13 bp, Homo sapiens
tccctgtctccag

SEQ ID NO: 1686389 - DNA, 16 bp, Homo sapiens
tccctgtctccagctg

SEQ ID NO: 1686390 - DNA, 18 bp, Homo sapiens
tccctgtctccagctgcc

SEQ ID NO: 1686391 - DNA, 20 bp, Homo sapiens
tccctgtctccagctgcctg

SEQ ID NO: 1686392 - DNA, 15 bp, Homo sapiens
tccctgtctgtgtcc

SEQ ID NO: 1686393 - DNA, 15 bp, Homo sapiens
tccctgtgctgatcc

SEQ ID NO: 1686394 - DNA, 20 bp, Homo sapiens
tccctgtgctgatcctgctg

SEQ ID NO: 1686395 - DNA, 21 bp, Homo sapiens
tccctgtgctgatcctgctga

SEQ ID NO: 1686396 - DNA, 19 bp, Homo sapiens
tccctgtggggcaggagtg

SEQ ID NO: 1686397 - DNA, 14 bp, Homo sapiens
tccctgttgaagct

SEQ ID NO: 1686398 - DNA, 19 bp, Homo sapiens
tccctgttttagtttctga

SEQ ID NO: 1686399 - DNA, 20 bp, Homo sapiens
tccctgttttagtttctgaa

SEQ ID NO: 1686400 - DNA, 19 bp, Homo sapiens
tccctgttttcccacgagg

SEQ ID NO: 1686401 - DNA, 15 bp, Homo sapiens
tccctgttttctgag

SEQ ID NO: 1686402 - DNA, 19 bp, Homo sapiens
tcccttaaatacagataat

SEQ ID NO: 1686403 - DNA, 18 bp, Homo sapiens
tcccttaagaatgagttt

SEQ ID NO: 1686404 - DNA, 22 bp, Homo sapiens
tcccttaagcagcaacagccta

SEQ ID NO: 1686405 - DNA, 20 bp, Homo sapiens
tcccttaaggggtatcatgt

SEQ ID NO: 1686406 - DNA, 14 bp, Homo sapiens
tccggactggtgcc

SEQ ID NO: 1686407 - DNA, 22 bp, Homo sapiens
tccggagatgaatatgagctca

SEQ ID NO: 1686408 - DNA, 20 bp, Homo sapiens
tccggcccagtgccactgcc

SEQ ID NO: 1686409 - DNA, 13 bp, Homo sapiens
tccgggaactttg

SEQ ID NO: 1686410 - DNA, 16 bp, Homo sapiens
tccggggagcgcccgc

SEQ ID NO: 1686411 - DNA, 21 bp, Homo sapiens
tccggggtctgtgctgtgcct

SEQ ID NO: 1686412 - DNA, 14 bp, Homo sapiens
tccgggtctcgcag

SEQ ID NO: 1686413 - DNA, 18 bp, Homo sapiens
tccggtggcctattccag

SEQ ID NO: 1686414 - DNA, 12 bp, Homo sapiens
tccggtgtgcct

SEQ ID NO: 1686415 - DNA, 15 bp, Homo sapiens
tccggtgtgcctgca

SEQ ID NO: 1686416 - DNA, 16 bp, Homo sapiens
tccggtttctttttgc

SEQ ID NO: 1686417 - DNA, 22 bp, Homo sapiens
tccgtaggtagatgtgtaacct

SEQ ID NO: 1686418 - DNA, 14 bp, Homo sapiens
tccgtagttccctg

SEQ ID NO: 1686419 - DNA, 15 bp, Homo sapiens
tccgtccacccaggc

SEQ ID NO: 1686420 - DNA, 19 bp, Homo sapiens
tccgtccacccttccatca

SEQ ID NO: 1686421 - DNA, 18 bp, Homo sapiens
tccgtctctcttgcttga

SEQ ID NO: 1686422 - DNA, 19 bp, Homo sapiens
tccgtgaattgctttatgg

SEQ ID NO: 1686423 - DNA, 14 bp, Homo sapiens
tccgtgaggctgct

SEQ ID NO: 1686424 - DNA, 15 bp, Homo sapiens
tccgtgaggctgctg

SEQ ID NO: 1686425 - DNA, 20 bp, Homo sapiens
tccgtgagtgaaccatcatt

SEQ ID NO: 1686426 - DNA, 23 bp, Homo sapiens
tccgtgagttgggggagggaaga

SEQ ID NO: 1686427 - DNA, 23 bp, Homo sapiens
tccgtgcccaggcccttggctgc

SEQ ID NO: 1686428 - DNA, 17 bp, Homo sapiens
tccgtgcctccaccacc

SEQ ID NO: 1686429 - DNA, 21 bp, Homo sapiens
tccgtgcctccaccaccactg

SEQ ID NO: 1686430 - DNA, 23 bp, Homo sapiens
tccgtgggacggtgcccaagcca

SEQ ID NO: 1686431 - DNA, 14 bp, Homo sapiens
tccgtggtcagagt

SEQ ID NO: 1686432 - DNA, 20 bp, Homo sapiens
tccgtgtgtcccagatgctg

SEQ ID NO: 1686433 - DNA, 13 bp, Homo sapiens
tccgttggccact

SEQ ID NO: 1686434 - DNA, 15 bp, Homo sapiens
tccgttggccactcc

SEQ ID NO: 1686435 - DNA, 20 bp, Homo sapiens
tccgtttttttttctttttc

SEQ ID NO: 1686436 - DNA, 15 bp, Homo sapiens
tcctaaaacaaatag

SEQ ID NO: 1686437 - DNA, 23 bp, Homo sapiens
tcctaaagaaaaatatcttggcc

SEQ ID NO: 1686438 - DNA, 15 bp, Homo sapiens
tcctaaatgcagtga

SEQ ID NO: 1686439 - DNA, 19 bp, Homo sapiens
tcctaaatgcagtgaattg

SEQ ID NO: 1686440 - DNA, 13 bp, Homo sapiens
tcctaacaaaaga

SEQ ID NO: 1686441 - DNA, 14 bp, Homo sapiens
tcctaacaaaagaa

SEQ ID NO: 1686442 - DNA, 16 bp, Homo sapiens
tcctaacaaaagaact

SEQ ID NO: 1686443 - DNA, 14 bp, Homo sapiens
tcctaacaggatga

SEQ ID NO: 1686444 - DNA, 14 bp, Homo sapiens
tcctaacttttcaa

SEQ ID NO: 1686445 - DNA, 20 bp, Homo sapiens
tcctaagaaagaggagtgct

SEQ ID NO: 1686446 - DNA, 22 bp, Homo sapiens
tcctaagaaagaggagtgcttg

SEQ ID NO: 1686447 - DNA, 16 bp, Homo sapiens
tcctaagagtgctggg

SEQ ID NO: 1686448 - DNA, 17 bp, Homo sapiens
tcctaagcatctaagtt

SEQ ID NO: 1686449 - DNA, 13 bp, Homo sapiens
tcctaaggaacct

SEQ ID NO: 1686450 - DNA, 18 bp, Homo sapiens
tcctaaggacacactaat

SEQ ID NO: 1686451 - DNA, 12 bp, Homo sapiens
tcctaaggcatg

SEQ ID NO: 1686452 - DNA, 17 bp, Homo sapiens
tcctaatggctattttt

SEQ ID NO: 1686453 - DNA, 12 bp, Homo sapiens
tcctaattttga

SEQ ID NO: 1686454 - DNA, 14 bp, Homo sapiens
tcctacaaagatgt

SEQ ID NO: 1686455 - DNA, 19 bp, Homo sapiens
tcctacaacttaatggaaa

SEQ ID NO: 1686456 - DNA, 20 bp, Homo sapiens
tcctacaagatttagaaaaa

SEQ ID NO: 1686457 - DNA, 20 bp, Homo sapiens
tcctacagaaatactgctct

SEQ ID NO: 1686458 - DNA, 23 bp, Homo sapiens
tcctacagaaatactgctctgaa

SEQ ID NO: 1686459 - DNA, 18 bp, Homo sapiens
tcctacatatcccttcca

SEQ ID NO: 1686460 - DNA, 17 bp, Homo sapiens
tcctaccctcgggccca

SEQ ID NO: 1686461 - DNA, 14 bp, Homo sapiens
tcctactgtcctca

SEQ ID NO: 1686462 - DNA, 18 bp, Homo sapiens
tcctagaaccaagcttca

SEQ ID NO: 1686463 - DNA, 19 bp, Homo sapiens
tcctagaaccaagcttcag

SEQ ID NO: 1686464 - DNA, 20 bp, Homo sapiens
tcctagaaccaagcttcaga

SEQ ID NO: 1686465 - DNA, 23 bp, Homo sapiens
tcctagaagaaccaaatacctca

SEQ ID NO: 1686466 - DNA, 18 bp, Homo sapiens
tcctagacaggtgtttat

SEQ ID NO: 1686467 - DNA, 18 bp, Homo sapiens
tcctagaggtgggcagct

SEQ ID NO: 1686468 - DNA, 21 bp, Homo sapiens
tcctagaggtgggcagctggg

SEQ ID NO: 1686469 - DNA, 22 bp, Homo sapiens
tcctagaggtgggcagctgggc

SEQ ID NO: 1686470 - DNA, 15 bp, Homo sapiens
tcctagataaaaaga

SEQ ID NO: 1686471 - DNA, 17 bp, Homo sapiens
tcctagataaaaagatg

SEQ ID NO: 1686472 - DNA, 19 bp, Homo sapiens
tcctagatctgcaggctgc

SEQ ID NO: 1686473 - DNA, 19 bp, Homo sapiens
tcctagatgtgttctaagc

SEQ ID NO: 1686474 - DNA, 17 bp, Homo sapiens
tcctagccactcaggag

SEQ ID NO: 1686475 - DNA, 14 bp, Homo sapiens
tcctagctcctcct

SEQ ID NO: 1686476 - DNA, 21 bp, Homo sapiens
tcctagctcctcctcctgggc

SEQ ID NO: 1686477 - DNA, 17 bp, Homo sapiens
tcctagctgtgtgaata

SEQ ID NO: 1686478 - DNA, 13 bp, Homo sapiens
tcctaggacttaa

SEQ ID NO: 1686479 - DNA, 20 bp, Homo sapiens
tcctagggaaaagttcatag

SEQ ID NO: 1686480 - DNA, 21 bp, Homo sapiens
tcctagggatctgaaatccat

SEQ ID NO: 1686481 - DNA, 21 bp, Homo sapiens
tcctaggggtgcgctcacctg

SEQ ID NO: 1686482 - DNA, 23 bp, Homo sapiens
tcctaggggtgcgctcacctgca

SEQ ID NO: 1686483 - DNA, 14 bp, Homo sapiens
tcctagtcttcaca

SEQ ID NO: 1686484 - DNA, 20 bp, Homo sapiens
tcctataatacaaatacaca

SEQ ID NO: 1686485 - DNA, 18 bp, Homo sapiens
tcctcctgatggagtgtg

SEQ ID NO: 1686486 - DNA, 20 bp, Homo sapiens
tcctcctgatggccaagagc

SEQ ID NO: 1686487 - DNA, 12 bp, Homo sapiens
tcctcctgcaga

SEQ ID NO: 1686488 - DNA, 15 bp, Homo sapiens
tcctcctgcagacca

SEQ ID NO: 1686489 - DNA, 16 bp, Homo sapiens
tcctcctgctcctcac

SEQ ID NO: 1686490 - DNA, 15 bp, Homo sapiens
tcctccttcccctcc

SEQ ID NO: 1686491 - DNA, 23 bp, Homo sapiens
tcctccttgcccagactacaggg

SEQ ID NO: 1686492 - DNA, 24 bp, Homo sapiens
tcctccttgcccagactacagggc

SEQ ID NO: 1686493 - DNA, 16 bp, Homo sapiens
tcctccttggtgcctg

SEQ ID NO: 1686494 - DNA, 14 bp, Homo sapiens
tcctccttttcact

SEQ ID NO: 1686495 - DNA, 16 bp, Homo sapiens
tcctccttttcacttt

SEQ ID NO: 1686496 - DNA, 18 bp, Homo sapiens
tcctcggagagcagcagc

SEQ ID NO: 1686497 - DNA, 19 bp, Homo sapiens
tcctcggagagcagcagca

SEQ ID NO: 1686498 - DNA, 19 bp, Homo sapiens
tcctcggccccctccatcg

SEQ ID NO: 1686499 - DNA, 16 bp, Homo sapiens
tcctcgggccgaggcc

SEQ ID NO: 1686500 - DNA, 15 bp, Homo sapiens
tcctcggtactccca

SEQ ID NO: 1686501 - DNA, 19 bp, Homo sapiens
tcctcggtgggccagagct

SEQ ID NO: 1686502 - DNA, 21 bp, Homo sapiens
tcctcgtggcggggcagcagg

SEQ ID NO: 1686503 - DNA, 19 bp, Homo sapiens
tcctctaactcactgccta

SEQ ID NO: 1686504 - DNA, 22 bp, Homo sapiens
tcctctatactttgttctgttg

SEQ ID NO: 1686505 - DNA, 18 bp, Homo sapiens
tcctctattaattactgt

SEQ ID NO: 1686506 - DNA, 20 bp, Homo sapiens
tcctctattaattactgtgt

SEQ ID NO: 1686507 - DNA, 17 bp, Homo sapiens
tcctctcacctcagcct

SEQ ID NO: 1686508 - DNA, 13 bp, Homo sapiens
tcctctcagagtg

SEQ ID NO: 1686509 - DNA, 16 bp, Homo sapiens
tcctctccactgcctt

SEQ ID NO: 1686510 - DNA, 20 bp, Homo sapiens
tcctctccactgctggacat

SEQ ID NO: 1686511 - DNA, 19 bp, Homo sapiens
tcctctccattttagccca

SEQ ID NO: 1686512 - DNA, 17 bp, Homo sapiens
tcctctcccaagtccac

SEQ ID NO: 1686513 - DNA, 18 bp, Homo sapiens
tcctctcccatccccctg

SEQ ID NO: 1686514 - DNA, 19 bp, Homo sapiens
tcctctcccatccccctgc

SEQ ID NO: 1686515 - DNA, 18 bp, Homo sapiens
tcctctccccagcccaga

SEQ ID NO: 1686516 - DNA, 18 bp, Homo sapiens
tcctctccctgccaagtc

SEQ ID NO: 1686517 - DNA, 14 bp, Homo sapiens
tcctctcctaccca

SEQ ID NO: 1686518 - DNA, 14 bp, Homo sapiens
tcctctccttgggc

SEQ ID NO: 1686519 - DNA, 20 bp, Homo sapiens
tcctctccttgggctcctgg

SEQ ID NO: 1686520 - DNA, 19 bp, Homo sapiens
tcctctctccagatgtttc

SEQ ID NO: 1686521 - DNA, 12 bp, Homo sapiens
tcctctctcccc

SEQ ID NO: 1686522 - DNA, 12 bp, Homo sapiens
tcctctctctca

SEQ ID NO: 1686523 - DNA, 16 bp, Homo sapiens
tcctctctctcttcta

SEQ ID NO: 1686524 - DNA, 11 bp, Homo sapiens
tcctctctctg

SEQ ID NO: 1686525 - DNA, 13 bp, Homo sapiens
tcctctctctgtg

SEQ ID NO: 1686526 - DNA, 17 bp, Homo sapiens
tcctctctgagactgct

SEQ ID NO: 1686527 - DNA, 16 bp, Homo sapiens
tcctctctgagtcaaa

SEQ ID NO: 1686528 - DNA, 23 bp, Homo sapiens
tcctctctgagtcaaatccagtg

SEQ ID NO: 1686529 - DNA, 20 bp, Homo sapiens
tcctctcttaaatgcaagtg

SEQ ID NO: 1686530 - DNA, 14 bp, Homo sapiens
tcctctgagcagcc

SEQ ID NO: 1686531 - DNA, 18 bp, Homo sapiens
tcctctgagttctgtact

SEQ ID NO: 1686532 - DNA, 22 bp, Homo sapiens
tcctctgcaagcttcttgctga

SEQ ID NO: 1686533 - DNA, 12 bp, Homo sapiens
tcctctgcactc

SEQ ID NO: 1686534 - DNA, 20 bp, Homo sapiens
tcctctgcagctgacctctg

SEQ ID NO: 1686535 - DNA, 15 bp, Homo sapiens
tcctctgcagtgcct

SEQ ID NO: 1686536 - DNA, 12 bp, Homo sapiens
tcctctgccacc

SEQ ID NO: 1686537 - DNA, 14 bp, Homo sapiens
tcctctgccacctc

SEQ ID NO: 1686538 - DNA, 22 bp, Homo sapiens
tcctctgccacctcccctatcc

SEQ ID NO: 1686539 - DNA, 13 bp, Homo sapiens
tcctctgcctgcc

SEQ ID NO: 1686540 - DNA, 22 bp, Homo sapiens
tcctctgcctgccccgccccca

SEQ ID NO: 1686541 - DNA, 15 bp, Homo sapiens
tcctctgctccagca

SEQ ID NO: 1686542 - DNA, 16 bp, Homo sapiens
tcctctgctccagcaa

SEQ ID NO: 1686543 - DNA, 20 bp, Homo sapiens
tcctctgctccagcaactgc

SEQ ID NO: 1686544 - DNA, 22 bp, Homo sapiens
tcctctgggtttctaagcagtt

SEQ ID NO: 1686545 - DNA, 15 bp, Homo sapiens
tcctctggttccttt

SEQ ID NO: 1686546 - DNA, 17 bp, Homo sapiens
tcctctggttcctttca

SEQ ID NO: 1686547 - DNA, 19 bp, Homo sapiens
tcctctgtagtatttttta

SEQ ID NO: 1686548 - DNA, 20 bp, Homo sapiens
tcctctgtagtattttttaa

SEQ ID NO: 1686549 - DNA, 13 bp, Homo sapiens
tcctctgtccagg

SEQ ID NO: 1686550 - DNA, 19 bp, Homo sapiens
tcctctgttcaaagctgcc

SEQ ID NO: 1686551 - DNA, 15 bp, Homo sapiens
tcctctgttcacaaa

SEQ ID NO: 1686552 - DNA, 15 bp, Homo sapiens
tcctcttagcctctg

SEQ ID NO: 1686553 - DNA, 16 bp, Homo sapiens
tcctcttagcctctgg

SEQ ID NO: 1686554 - DNA, 17 bp, Homo sapiens
tcctcttagcctctgga

SEQ ID NO: 1686555 - DNA, 20 bp, Homo sapiens
tcctcttcaagtactgtttt

SEQ ID NO: 1686556 - DNA, 15 bp, Homo sapiens
tcctcttcctgccct

SEQ ID NO: 1686557 - DNA, 17 bp, Homo sapiens
tcctcttctgacgtgcc

SEQ ID NO: 1686558 - DNA, 15 bp, Homo sapiens
tcctcttctgctctt

SEQ ID NO: 1686559 - DNA, 17 bp, Homo sapiens
tcctcttctgggcctga

SEQ ID NO: 1686560 - DNA, 17 bp, Homo sapiens
tcctcttgattcctggt

SEQ ID NO: 1686561 - DNA, 21 bp, Homo sapiens
tcctcttgattcctggtttga

SEQ ID NO: 1686562 - DNA, 19 bp, Homo sapiens
tcctctttagtttttggtt

SEQ ID NO: 1686563 - DNA, 12 bp, Homo sapiens
tcctctttctgc

SEQ ID NO: 1686564 - DNA, 15 bp, Homo sapiens
tcctctttctgctct

SEQ ID NO: 1686565 - DNA, 20 bp, Homo sapiens
tcctctttctgctctgccat

SEQ ID NO: 1686566 - DNA, 21 bp, Homo sapiens
tcctcttttgtgctgcttctc

SEQ ID NO: 1686567 - DNA, 16 bp, Homo sapiens
tcctgaaacgctcctt

SEQ ID NO: 1686568 - DNA, 17 bp, Homo sapiens
tcctgaaacgctccttt

SEQ ID NO: 1686569 - DNA, 21 bp, Homo sapiens
tcctgaaacgctcctttgtgt

SEQ ID NO: 1686570 - DNA, 18 bp, Homo sapiens
tcctgaaccgcacagctc

SEQ ID NO: 1686571 - DNA, 19 bp, Homo sapiens
tcctgaaccgcacagctca

SEQ ID NO: 1686572 - DNA, 18 bp, Homo sapiens
tcctgaacctggaaatga

SEQ ID NO: 1686573 - DNA, 16 bp, Homo sapiens
tcctgaagaaccagtc

SEQ ID NO: 1686574 - DNA, 23 bp, Homo sapiens
tcctgaagaaccagtccccccac

SEQ ID NO: 1686575 - DNA, 14 bp, Homo sapiens
tcctgaagaggcgg

SEQ ID NO: 1686576 - DNA, 13 bp, Homo sapiens
tcctgaagctgct

SEQ ID NO: 1686577 - DNA, 15 bp, Homo sapiens
tcctgaagggaacta

SEQ ID NO: 1686578 - DNA, 18 bp, Homo sapiens
tcctgaatatcagtcact

SEQ ID NO: 1686579 - DNA, 19 bp, Homo sapiens
tcctgaatgaaatatcaga

SEQ ID NO: 1686580 - DNA, 17 bp, Homo sapiens
tcctgacagaaggtgcc

SEQ ID NO: 1686581 - DNA, 15 bp, Homo sapiens
tcctgacattgtctc

SEQ ID NO: 1686582 - DNA, 14 bp, Homo sapiens
tcctgaccaccctc

SEQ ID NO: 1686583 - DNA, 15 bp, Homo sapiens
tcctgaccaccctcc

SEQ ID NO: 1686584 - DNA, 19 bp, Homo sapiens
tcctgaccaccctcccctc

SEQ ID NO: 1686585 - DNA, 20 bp, Homo sapiens
tcctgaccaccctcccctct

SEQ ID NO: 1686586 - DNA, 12 bp, Homo sapiens
tcctgacccagg

SEQ ID NO: 1686587 - DNA, 15 bp, Homo sapiens
tcctgacccagtccc

SEQ ID NO: 1686588 - DNA, 13 bp, Homo sapiens
tcctgacgccctg

SEQ ID NO: 1686589 - DNA, 23 bp, Homo sapiens
tcctgacgccctgcgttggagcc

SEQ ID NO: 1686590 - DNA, 18 bp, Homo sapiens
tcctgacgtctgaagctt

SEQ ID NO: 1686591 - DNA, 19 bp, Homo sapiens
tcctgactcaacatgttac

SEQ ID NO: 1686592 - DNA, 13 bp, Homo sapiens
tcctgactggtgc

SEQ ID NO: 1686593 - DNA, 23 bp, Homo sapiens
tcctgacttccctggaggagaag

SEQ ID NO: 1686594 - DNA, 18 bp, Homo sapiens
tcctgagaaggcgaggag

SEQ ID NO: 1686595 - DNA, 20 bp, Homo sapiens
tcctgagaaggcgaggagag

SEQ ID NO: 1686596 - DNA, 22 bp, Homo sapiens
tcctgagccagggaacagcccc

SEQ ID NO: 1686597 - DNA, 18 bp, Homo sapiens
tcctgagccccctgcacc

SEQ ID NO: 1686598 - DNA, 23 bp, Homo sapiens
tcctgagctcggggggctctgcc

SEQ ID NO: 1686599 - DNA, 12 bp, Homo sapiens
tcctgagctgtc

SEQ ID NO: 1686600 - DNA, 13 bp, Homo sapiens
tcctgagctgtcg

SEQ ID NO: 1686601 - DNA, 15 bp, Homo sapiens
tcctgagctgtcgct

SEQ ID NO: 1686602 - DNA, 17 bp, Homo sapiens
tctgctaaatttcaaat

SEQ ID NO: 1686603 - DNA, 22 bp, Homo sapiens
tctgctaacttggagccccagt

SEQ ID NO: 1686604 - DNA, 13 bp, Homo sapiens
tctgctaagttct

SEQ ID NO: 1686605 - DNA, 16 bp, Homo sapiens
tctgctaagttctccc

SEQ ID NO: 1686606 - DNA, 17 bp, Homo sapiens
tctgctacctcactggg

SEQ ID NO: 1686607 - DNA, 13 bp, Homo sapiens
tctgctagactcc

SEQ ID NO: 1686608 - DNA, 19 bp, Homo sapiens
tctgctagactcctcagga

SEQ ID NO: 1686609 - DNA, 20 bp, Homo sapiens
tctgctaggcgctggggaga

SEQ ID NO: 1686610 - DNA, 15 bp, Homo sapiens
tctgctagtagtgtt

SEQ ID NO: 1686611 - DNA, 17 bp, Homo sapiens
tctgctagtgctgtaat

SEQ ID NO: 1686612 - DNA, 15 bp, Homo sapiens
tctgctcaccgccca

SEQ ID NO: 1686613 - DNA, 22 bp, Homo sapiens
tctgctcagacagaacccctac

SEQ ID NO: 1686614 - DNA, 23 bp, Homo sapiens
tctgctcataggacctgcatcct

SEQ ID NO: 1686615 - DNA, 13 bp, Homo sapiens
tctgctcattttg

SEQ ID NO: 1686616 - DNA, 18 bp, Homo sapiens
tctgctcattttgacaaa

SEQ ID NO: 1686617 - DNA, 12 bp, Homo sapiens
tctgctccacca

SEQ ID NO: 1686618 - DNA, 15 bp, Homo sapiens
tctgctccacccttg

SEQ ID NO: 1686619 - DNA, 19 bp, Homo sapiens
tctgctccacccttggcct

SEQ ID NO: 1686620 - DNA, 23 bp, Homo sapiens
tctgctccacccttggcctgtct

SEQ ID NO: 1686621 - DNA, 16 bp, Homo sapiens
tctgctccataccttt

SEQ ID NO: 1686622 - DNA, 20 bp, Homo sapiens
tctgctccataccttttctc

SEQ ID NO: 1686623 - DNA, 19 bp, Homo sapiens
tctgctctagattcataaa

SEQ ID NO: 1686624 - DNA, 12 bp, Homo sapiens
tctgctctagcc

SEQ ID NO: 1686625 - DNA, 15 bp, Homo sapiens
tctgctctagccagg

SEQ ID NO: 1686626 - DNA, 21 bp, Homo sapiens
tctgctctagggaatctggat

SEQ ID NO: 1686627 - DNA, 12 bp, Homo sapiens
tctgctctgcca

SEQ ID NO: 1686628 - DNA, 18 bp, Homo sapiens
tctgctctgccatcttca

SEQ ID NO: 1686629 - DNA, 21 bp, Homo sapiens
tctgctctgccatcttcagga

SEQ ID NO: 1686630 - DNA, 14 bp, Homo sapiens
tctgctctgccctt

SEQ ID NO: 1686631 - DNA, 15 bp, Homo sapiens
tctgctctgcctgga

SEQ ID NO: 1686632 - DNA, 13 bp, Homo sapiens
tctgctctggaat

SEQ ID NO: 1686633 - DNA, 17 bp, Homo sapiens
tctgctctttctctgcc

SEQ ID NO: 1686634 - DNA, 17 bp, Homo sapiens
tctgctgcaccttgtaa

SEQ ID NO: 1686635 - DNA, 13 bp, Homo sapiens
tctgctgccagca

SEQ ID NO: 1686636 - DNA, 20 bp, Homo sapiens
tctgctgccccgcttcccca

SEQ ID NO: 1686637 - DNA, 21 bp, Homo sapiens
tctgctgccccgcttccccac

SEQ ID NO: 1686638 - DNA, 22 bp, Homo sapiens
tctgctgccccgcttccccaca

SEQ ID NO: 1686639 - DNA, 13 bp, Homo sapiens
tctgctgcccctg

SEQ ID NO: 1686640 - DNA, 18 bp, Homo sapiens
tctgctgccggctctggg

SEQ ID NO: 1686641 - DNA, 22 bp, Homo sapiens
tctgctgccggctctgggcctg

SEQ ID NO: 1686642 - DNA, 15 bp, Homo sapiens
tctgctgcctctgaa

SEQ ID NO: 1686643 - DNA, 20 bp, Homo sapiens
tctgctgcctctgaaaatat

SEQ ID NO: 1686644 - DNA, 21 bp, Homo sapiens
tctgctgcctctgaaaatatt

SEQ ID NO: 1686645 - DNA, 17 bp, Homo sapiens
tctgctggaaggggcag

SEQ ID NO: 1686646 - DNA, 18 bp, Homo sapiens
tctgctggaaggggcagc

SEQ ID NO: 1686647 - DNA, 14 bp, Homo sapiens
tctgctggcctgga

SEQ ID NO: 1686648 - DNA, 17 bp, Homo sapiens
tctgctggtatttctaa

SEQ ID NO: 1686649 - DNA, 12 bp, Homo sapiens
tctgctgttgcc

SEQ ID NO: 1686650 - DNA, 16 bp, Homo sapiens
tctgcttacccttcac

SEQ ID NO: 1686651 - DNA, 21 bp, Homo sapiens
tctgcttatgcagtttttcag

SEQ ID NO: 1686652 - DNA, 14 bp, Homo sapiens
tctgcttctctgac

SEQ ID NO: 1686653 - DNA, 16 bp, Homo sapiens
tctgcttctctgactt

SEQ ID NO: 1686654 - DNA, 14 bp, Homo sapiens
tctgcttgtcatcc

SEQ ID NO: 1686655 - DNA, 14 bp, Homo sapiens
tctgcttgtgttaa

SEQ ID NO: 1686656 - DNA, 15 bp, Homo sapiens
tctgctttatgttgc

SEQ ID NO: 1686657 - DNA, 16 bp, Homo sapiens
tctgctttctgcctct

SEQ ID NO: 1686658 - DNA, 17 bp, Homo sapiens
tctgctttctgcctctc

SEQ ID NO: 1686659 - DNA, 17 bp, Homo sapiens
tctgcttttctgccctg

SEQ ID NO: 1686660 - DNA, 22 bp, Homo sapiens
tctgcttttctgccctggctgc

SEQ ID NO: 1686661 - DNA, 21 bp, Homo sapiens
tctgcttttgcacaccttttc

SEQ ID NO: 1686662 - DNA, 23 bp, Homo sapiens
tctgctttttaaagaatgctctt

SEQ ID NO: 1686663 - DNA, 16 bp, Homo sapiens
tctggaaaagctgggg

SEQ ID NO: 1686664 - DNA, 16 bp, Homo sapiens
tctggaacccagactc

SEQ ID NO: 1686665 - DNA, 15 bp, Homo sapiens
tctggaacctcagcc

SEQ ID NO: 1686666 - DNA, 16 bp, Homo sapiens
tctggaacctcagcct

SEQ ID NO: 1686667 - DNA, 18 bp, Homo sapiens
tctggaacctcagcctgg

SEQ ID NO: 1686668 - DNA, 19 bp, Homo sapiens
tctggaacctcagcctggc

SEQ ID NO: 1686669 - DNA, 20 bp, Homo sapiens
tctggaacctcagcctggcc

SEQ ID NO: 1686670 - DNA, 21 bp, Homo sapiens
tctggaacctcagcctggcca

SEQ ID NO: 1686671 - DNA, 23 bp, Homo sapiens
tctggaacctcagcctggccaga

SEQ ID NO: 1686672 - DNA, 18 bp, Homo sapiens
tctggaagattcttactg

SEQ ID NO: 1686673 - DNA, 18 bp, Homo sapiens
tctggaagcccctgggcc

SEQ ID NO: 1686674 - DNA, 14 bp, Homo sapiens
tctggaagcctgga

SEQ ID NO: 1686675 - DNA, 19 bp, Homo sapiens
tctggaaggctggctgagt

SEQ ID NO: 1686676 - DNA, 17 bp, Homo sapiens
tctggaaggtctgatct

SEQ ID NO: 1686677 - DNA, 13 bp, Homo sapiens
tctggaatattgt

SEQ ID NO: 1686678 - DNA, 18 bp, Homo sapiens
tctggacagccccaccct

SEQ ID NO: 1686679 - DNA, 17 bp, Homo sapiens
tctggacccttggcctc

SEQ ID NO: 1686680 - DNA, 14 bp, Homo sapiens
tctggacggcaggc

SEQ ID NO: 1686681 - DNA, 21 bp, Homo sapiens
tctggacggcaggctcactgc

SEQ ID NO: 1686682 - DNA, 14 bp, Homo sapiens
tctggacgtgaaat

SEQ ID NO: 1686683 - DNA, 19 bp, Homo sapiens
tctggacgtgaaatacttc

SEQ ID NO: 1686684 - DNA, 21 bp, Homo sapiens
tctggactcccactctttgaa

SEQ ID NO: 1686685 - DNA, 16 bp, Homo sapiens
tctggactctgcccca

SEQ ID NO: 1686686 - DNA, 20 bp, Homo sapiens
tctggactgaagcctgcagg

SEQ ID NO: 1686687 - DNA, 19 bp, Homo sapiens
tctggagaccagggagcct

SEQ ID NO: 1686688 - DNA, 21 bp, Homo sapiens
tctggagaccagggagccttt

SEQ ID NO: 1686689 - DNA, 21 bp, Homo sapiens
tctggagccctaaccccttcc

SEQ ID NO: 1686690 - DNA, 12 bp, Homo sapiens
tctggagcctga

SEQ ID NO: 1686691 - DNA, 20 bp, Homo sapiens
tctggagcgcttcagttcag

SEQ ID NO: 1686692 - DNA, 20 bp, Homo sapiens
tctggagcttaattttctgt

SEQ ID NO: 1686693 - DNA, 14 bp, Homo sapiens
tctggaggaaaggg

SEQ ID NO: 1686694 - DNA, 20 bp, Homo sapiens
tctggaggccttccagctgc

SEQ ID NO: 1686695 - DNA, 23 bp, Homo sapiens
tctggaggccttccagctgctgt

SEQ ID NO: 1686696 - DNA, 17 bp, Homo sapiens
tctggaggctgcagagc

SEQ ID NO: 1686697 - DNA, 17 bp, Homo sapiens
tctggaggggagagctt

SEQ ID NO: 1686698 - DNA, 18 bp, Homo sapiens
tctggaggggagagcttt

SEQ ID NO: 1686699 - DNA, 21 bp, Homo sapiens
tctggaggggagagctttgtg

SEQ ID NO: 1686700 - DNA, 18 bp, Homo sapiens
tctggaggtcatctggcg

SEQ ID NO: 1686701 - DNA, 20 bp, Homo sapiens
tctggagtgattctagaggg

SEQ ID NO: 1686702 - DNA, 20 bp, Homo sapiens
tctggagtgcccccagccca

SEQ ID NO: 1686703 - DNA, 16 bp, Homo sapiens
tctggagttgatctgg

SEQ ID NO: 1686704 - DNA, 22 bp, Homo sapiens
tctggatccatggggggagaag

SEQ ID NO: 1686705 - DNA, 16 bp, Homo sapiens
tctggatctagaaggg

SEQ ID NO: 1686706 - DNA, 23 bp, Homo sapiens
tctggatgcacagatgccatggc

SEQ ID NO: 1686707 - DNA, 23 bp, Homo sapiens
tctggattatgttatacaaggca

SEQ ID NO: 1686708 - DNA, 21 bp, Homo sapiens
tctggattctgaatctcaaga

SEQ ID NO: 1686709 - DNA, 19 bp, Homo sapiens
tctggcaaaaaggagcctt

SEQ ID NO: 1686710 - DNA, 22 bp, Homo sapiens
tctggcaaaaaggagccttttg

SEQ ID NO: 1686711 - DNA, 22 bp, Homo sapiens
tctggcaaacgtttctcaaatc

SEQ ID NO: 1686712 - DNA, 19 bp, Homo sapiens
tctgtagattctgtggaac

SEQ ID NO: 1686713 - DNA, 19 bp, Homo sapiens
tctgtagctccctcctccc

SEQ ID NO: 1686714 - DNA, 20 bp, Homo sapiens
tctgtagctccctcctccca

SEQ ID NO: 1686715 - DNA, 14 bp, Homo sapiens
tctgtagctcctca

SEQ ID NO: 1686716 - DNA, 18 bp, Homo sapiens
tctgtaggcacagagctg

SEQ ID NO: 1686717 - DNA, 17 bp, Homo sapiens
tctgtagggctggacct

SEQ ID NO: 1686718 - DNA, 22 bp, Homo sapiens
tctgtagtaatttattgtctgt

SEQ ID NO: 1686719 - DNA, 24 bp, Homo sapiens
tctgtagtaatttattgtctgtct

SEQ ID NO: 1686720 - DNA, 21 bp, Homo sapiens
tctgtagtggccccctcctcc

SEQ ID NO: 1686721 - DNA, 15 bp, Homo sapiens
tctgtagttgcagct

SEQ ID NO: 1686722 - DNA, 16 bp, Homo sapiens
tctgtatactcctgtc

SEQ ID NO: 1686723 - DNA, 14 bp, Homo sapiens
tctgtatataaaat

SEQ ID NO: 1686724 - DNA, 19 bp, Homo sapiens
tctgtatataagttgctgt

SEQ ID NO: 1686725 - DNA, 15 bp, Homo sapiens
tctgtatatacaata

SEQ ID NO: 1686726 - DNA, 22 bp, Homo sapiens
tctgtatatgattctctgtggt

SEQ ID NO: 1686727 - DNA, 23 bp, Homo sapiens
tctgtatatgattctctgtggtt

SEQ ID NO: 1686728 - DNA, 18 bp, Homo sapiens
tctgtatcggagacagtg

SEQ ID NO: 1686729 - DNA, 15 bp, Homo sapiens
tctgtatttaatttt

SEQ ID NO: 1686730 - DNA, 21 bp, Homo sapiens
tctgtcaaatgtttccttaaa

SEQ ID NO: 1686731 - DNA, 24 bp, Homo sapiens
tctgtcaaatgtttccttaaacat

SEQ ID NO: 1686732 - DNA, 13 bp, Homo sapiens
tctgtcaccaaat

SEQ ID NO: 1686733 - DNA, 16 bp, Homo sapiens
tctgtcacgtgaaata

SEQ ID NO: 1686734 - DNA, 18 bp, Homo sapiens
tctgtcacgtgaaatatt

SEQ ID NO: 1686735 - DNA, 19 bp, Homo sapiens
tctgtcagatgggaagaca

SEQ ID NO: 1686736 - DNA, 15 bp, Homo sapiens
tctgtcagcatctgg

SEQ ID NO: 1686737 - DNA, 19 bp, Homo sapiens
tctgtcagcatctggctgt

SEQ ID NO: 1686738 - DNA, 13 bp, Homo sapiens
tctgtcagctgca

SEQ ID NO: 1686739 - DNA, 18 bp, Homo sapiens
tctgtcatcactccctgg

SEQ ID NO: 1686740 - DNA, 22 bp, Homo sapiens
tctgtcatgaacatgttcctga

SEQ ID NO: 1686741 - DNA, 16 bp, Homo sapiens
tctgtccaaaggaggc

SEQ ID NO: 1686742 - DNA, 20 bp, Homo sapiens
tctgtccacatccccagagc

SEQ ID NO: 1686743 - DNA, 17 bp, Homo sapiens
tctgtccaggccactgt

SEQ ID NO: 1686744 - DNA, 21 bp, Homo sapiens
tctgtccaggccactgtggcc

SEQ ID NO: 1686745 - DNA, 19 bp, Homo sapiens
tctgtccccttctctcatc

SEQ ID NO: 1686746 - DNA, 20 bp, Homo sapiens
tctgtccccttctctcatct

SEQ ID NO: 1686747 - DNA, 22 bp, Homo sapiens
tctgtccccttctctcatctct

SEQ ID NO: 1686748 - DNA, 21 bp, Homo sapiens
tctgtccctgaactcccagaa

SEQ ID NO: 1686749 - DNA, 18 bp, Homo sapiens
tctgtccctttgctcccg

SEQ ID NO: 1686750 - DNA, 18 bp, Homo sapiens
tctgtcccttttctttga

SEQ ID NO: 1686751 - DNA, 22 bp, Homo sapiens
tctgtccgcctttacaagggag

SEQ ID NO: 1686752 - DNA, 17 bp, Homo sapiens
tctgtcctacttctgac

SEQ ID NO: 1686753 - DNA, 13 bp, Homo sapiens
tctgtcctcagcc

SEQ ID NO: 1686754 - DNA, 14 bp, Homo sapiens
tctgtcctcagcct

SEQ ID NO: 1686755 - DNA, 19 bp, Homo sapiens
tctgtcctcagccttgcca

SEQ ID NO: 1686756 - DNA, 21 bp, Homo sapiens
tctgtcctcagccttgccaga

SEQ ID NO: 1686757 - DNA, 12 bp, Homo sapiens
tctgtcctctgt

SEQ ID NO: 1686758 - DNA, 14 bp, Homo sapiens
tctgtctacatttc

SEQ ID NO: 1686759 - DNA, 15 bp, Homo sapiens
tctgtctacatttct

SEQ ID NO: 1686760 - DNA, 14 bp, Homo sapiens
tctgtctactgtgg

SEQ ID NO: 1686761 - DNA, 16 bp, Homo sapiens
tctgtctactgtggtg

SEQ ID NO: 1686762 - DNA, 17 bp, Homo sapiens
tctgtctactgtggtga

SEQ ID NO: 1686763 - DNA, 18 bp, Homo sapiens
tctgtctagactggccta

SEQ ID NO: 1686764 - DNA, 21 bp, Homo sapiens
tctgtctcaaaaaataaaaat

SEQ ID NO: 1686765 - DNA, 13 bp, Homo sapiens
tctgtctcccttc

SEQ ID NO: 1686766 - DNA, 16 bp, Homo sapiens
tctgtctcccttctct

SEQ ID NO: 1686767 - DNA, 16 bp, Homo sapiens
tctgtctcctgtcttc

SEQ ID NO: 1686768 - DNA, 23 bp, Homo sapiens
tctgtctcctgtcttcagagcaa

SEQ ID NO: 1686769 - DNA, 14 bp, Homo sapiens
tctgtctgattcta

SEQ ID NO: 1686770 - DNA, 16 bp, Homo sapiens
tctgtctgattctatg

SEQ ID NO: 1686771 - DNA, 17 bp, Homo sapiens
tctgtctgattctatgc

SEQ ID NO: 1686772 - DNA, 18 bp, Homo sapiens
tctgtctggagtgacaga

SEQ ID NO: 1686773 - DNA, 12 bp, Homo sapiens
tctgtctggatc

SEQ ID NO: 1686774 - DNA, 15 bp, Homo sapiens
tctgtcttcacaaca

SEQ ID NO: 1686775 - DNA, 22 bp, Homo sapiens
tctgtcttcccaaacccagtct

SEQ ID NO: 1686776 - DNA, 21 bp, Homo sapiens
tctgtcttgccagccagaagc

SEQ ID NO: 1686777 - DNA, 20 bp, Homo sapiens
tctgtcttggggcttttggt

SEQ ID NO: 1686778 - DNA, 13 bp, Homo sapiens
tctgtctttgtgg

SEQ ID NO: 1686779 - DNA, 19 bp, Homo sapiens
tctgtcttttggagaacca

SEQ ID NO: 1686780 - DNA, 18 bp, Homo sapiens
tctgtgaagcctctctcc

SEQ ID NO: 1686781 - DNA, 22 bp, Homo sapiens
tctgtgacacatcgttttgggg

SEQ ID NO: 1686782 - DNA, 16 bp, Homo sapiens
tctgtgacccatctgt

SEQ ID NO: 1686783 - DNA, 20 bp, Homo sapiens
tctgtgacccatctgtagta

SEQ ID NO: 1686784 - DNA, 17 bp, Homo sapiens
tctgtgacgcagacaga

SEQ ID NO: 1686785 - DNA, 20 bp, Homo sapiens
tcccagatttttactttttc

SEQ ID NO: 1686786 - DNA, 19 bp, Homo sapiens
tcccagcatccctggagca

SEQ ID NO: 1686787 - DNA, 19 bp, Homo sapiens
tcccagccacgcagggcca

SEQ ID NO: 1686788 - DNA, 16 bp, Homo sapiens
tcccagcccattgctg

SEQ ID NO: 1686789 - DNA, 19 bp, Homo sapiens
tcccagcccattgctgcca

SEQ ID NO: 1686790 - DNA, 22 bp, Homo sapiens
tcccagccctttgggaggctga

SEQ ID NO: 1686791 - DNA, 15 bp, Homo sapiens
tcccagcctgtggtt

SEQ ID NO: 1686792 - DNA, 22 bp, Homo sapiens
tcccagcggctggtgcagggcc

SEQ ID NO: 1686793 - DNA, 20 bp, Homo sapiens
tcccagctaccaagtcagac

SEQ ID NO: 1686794 - DNA, 15 bp, Homo sapiens
tcccagctactcagg

SEQ ID NO: 1686795 - DNA, 17 bp, Homo sapiens
tcccagctactcaggag

SEQ ID NO: 1686796 - DNA, 20 bp, Homo sapiens
tcccagctactcaggaggct

SEQ ID NO: 1686797 - DNA, 22 bp, Homo sapiens
tcccagctactcaggaggctga

SEQ ID NO: 1686798 - DNA, 11 bp, Homo sapiens
tcccaggaact

SEQ ID NO: 1686799 - DNA, 16 bp, Homo sapiens
tcccaggaactgggcc

SEQ ID NO: 1686800 - DNA, 18 bp, Homo sapiens
tcccaggaatatcccaaa

SEQ ID NO: 1686801 - DNA, 13 bp, Homo sapiens
tcccaggaccctg

SEQ ID NO: 1686802 - DNA, 22 bp, Homo sapiens
tcccaggacctcggatgaccat

SEQ ID NO: 1686803 - DNA, 23 bp, Homo sapiens
tcccaggagctgcccagagttgc

SEQ ID NO: 1686804 - DNA, 14 bp, Homo sapiens
tcccaggaggtgct

SEQ ID NO: 1686805 - DNA, 15 bp, Homo sapiens
tcccaggcagggaga

SEQ ID NO: 1686806 - DNA, 21 bp, Homo sapiens
tcccaggccaggctccttcct

SEQ ID NO: 1686807 - DNA, 10 bp, Homo sapiens
tcccaggccc

SEQ ID NO: 1686808 - DNA, 18 bp, Homo sapiens
tcccaggccccctgcatc

SEQ ID NO: 1686809 - DNA, 18 bp, Homo sapiens
tcccaggccctttggctt

SEQ ID NO: 1686810 - DNA, 19 bp, Homo sapiens
tcccaggccctttggcttc

SEQ ID NO: 1686811 - DNA, 18 bp, Homo sapiens
tcccaggcttcaccctga

SEQ ID NO: 1686812 - DNA, 16 bp, Homo sapiens
tcccagggccagggcc

SEQ ID NO: 1686813 - DNA, 21 bp, Homo sapiens
tcccagggccagggccctgca

SEQ ID NO: 1686814 - DNA, 22 bp, Homo sapiens
tcccagggccagggccctgcag

SEQ ID NO: 1686815 - DNA, 17 bp, Homo sapiens
tcccagggctctgcagg

SEQ ID NO: 1686816 - DNA, 23 bp, Homo sapiens
tcccagggctctgcaggccactg

SEQ ID NO: 1686817 - DNA, 18 bp, Homo sapiens
tcccaggggaccacacct

SEQ ID NO: 1686818 - DNA, 15 bp, Homo sapiens
tcccaggggagccag

SEQ ID NO: 1686819 - DNA, 18 bp, Homo sapiens
tcccaggggagccagctg

SEQ ID NO: 1686820 - DNA, 20 bp, Homo sapiens
tcccaggggagccagctgct

SEQ ID NO: 1686821 - DNA, 17 bp, Homo sapiens
tcccaggggcagccaca

SEQ ID NO: 1686822 - DNA, 17 bp, Homo sapiens
tcccaggtaccagctgc

SEQ ID NO: 1686823 - DNA, 18 bp, Homo sapiens
tcccaggtcgggcagtgg

SEQ ID NO: 1686824 - DNA, 20 bp, Homo sapiens
tcccaggtcgggcagtggag

SEQ ID NO: 1686825 - DNA, 21 bp, Homo sapiens
tcccaggtgttaacattccaa

SEQ ID NO: 1686826 - DNA, 15 bp, Homo sapiens
tcccaggttccagca

SEQ ID NO: 1686827 - DNA, 16 bp, Homo sapiens
tcccaggttcccccag

SEQ ID NO: 1686828 - DNA, 23 bp, Homo sapiens
tcccaggttgaggtgcgctcacc

SEQ ID NO: 1686829 - DNA, 15 bp, Homo sapiens
tcccagtagaaaata

SEQ ID NO: 1686830 - DNA, 16 bp, Homo sapiens
tcccagtagaaaatat

SEQ ID NO: 1686831 - DNA, 20 bp, Homo sapiens
tcccagtagccaaggcccgg

SEQ ID NO: 1686832 - DNA, 18 bp, Homo sapiens
tcccagtcactcctctct

SEQ ID NO: 1686833 - DNA, 15 bp, Homo sapiens
tcccagtcagaaata

SEQ ID NO: 1686834 - DNA, 22 bp, Homo sapiens
tcccagtcatttaataaatgtg

SEQ ID NO: 1686835 - DNA, 20 bp, Homo sapiens
tcccagtccaaatgtcctcc

SEQ ID NO: 1686836 - DNA, 23 bp, Homo sapiens
tcccagtccacctgaggaactgt

SEQ ID NO: 1686837 - DNA, 14 bp, Homo sapiens
tcccagtccctcgc

SEQ ID NO: 1686838 - DNA, 16 bp, Homo sapiens
tctgtgtcatttcttc

SEQ ID NO: 1686839 - DNA, 13 bp, Homo sapiens
tctgtgtcccagc

SEQ ID NO: 1686840 - DNA, 18 bp, Homo sapiens
tctgtgtcccagccacgc

SEQ ID NO: 1686841 - DNA, 18 bp, Homo sapiens
tctgtgtctaagattcta

SEQ ID NO: 1686842 - DNA, 20 bp, Homo sapiens
tctgtgtctaagattctaga

SEQ ID NO: 1686843 - DNA, 23 bp, Homo sapiens
tctgtgtctaagattctagatca

SEQ ID NO: 1686844 - DNA, 21 bp, Homo sapiens
tctgtgtgcacaaatatttat

SEQ ID NO: 1686845 - DNA, 15 bp, Homo sapiens
tctgtgtgcagcaac

SEQ ID NO: 1686846 - DNA, 12 bp, Homo sapiens
tctgtgtggctc

SEQ ID NO: 1686847 - DNA, 16 bp, Homo sapiens
tctgtgtggtggagcc

SEQ ID NO: 1686848 - DNA, 19 bp, Homo sapiens
tctgtgtggtggagccagg

SEQ ID NO: 1686849 - DNA, 22 bp, Homo sapiens
tctgtgtggtggagccagggcc

SEQ ID NO: 1686850 - DNA, 18 bp, Homo sapiens
tctgtgtgtgtgtatgtg

SEQ ID NO: 1686851 - DNA, 20 bp, Homo sapiens
tctgtgtgtgtgtgtgtgcg

SEQ ID NO: 1686852 - DNA, 12 bp, Homo sapiens
tctgtgttcatt

SEQ ID NO: 1686853 - DNA, 16 bp, Homo sapiens
tctgtgttgccaagct

SEQ ID NO: 1686854 - DNA, 16 bp, Homo sapiens
tctgtgtttctggagt

SEQ ID NO: 1686855 - DNA, 15 bp, Homo sapiens
tctgtgtttttgaaa

SEQ ID NO: 1686856 - DNA, 20 bp, Homo sapiens
tctgttaaaactcaaggctt

SEQ ID NO: 1686857 - DNA, 15 bp, Homo sapiens
tctgttaaaatgcat

SEQ ID NO: 1686858 - DNA, 22 bp, Homo sapiens
tctgttactccattactgtgat

SEQ ID NO: 1686859 - DNA, 23 bp, Homo sapiens
tctgttactccattactgtgatt

SEQ ID NO: 1686860 - DNA, 22 bp, Homo sapiens
tctgttataggtcctttagaaa

SEQ ID NO: 1686861 - DNA, 14 bp, Homo sapiens
tctgttatcctgct

SEQ ID NO: 1686862 - DNA, 21 bp, Homo sapiens
tctgttatgggcttttgggga

SEQ ID NO: 1686863 - DNA, 18 bp, Homo sapiens
tctgttatttagactcat

SEQ ID NO: 1686864 - DNA, 19 bp, Homo sapiens
tctgttcacaaactacctc

SEQ ID NO: 1686865 - DNA, 22 bp, Homo sapiens
tctgttcacaaactacctctgg

SEQ ID NO: 1686866 - DNA, 22 bp, Homo sapiens
tctgttcacagtctctggaaaa

SEQ ID NO: 1686867 - DNA, 21 bp, Homo sapiens
tctgttcacttttcctccctc

SEQ ID NO: 1686868 - DNA, 17 bp, Homo sapiens
tctgttcagatgtgcat

SEQ ID NO: 1686869 - DNA, 17 bp, Homo sapiens
tctgttcagattaaaaa

SEQ ID NO: 1686870 - DNA, 20 bp, Homo sapiens
tctgttccaacctcctgctc

SEQ ID NO: 1686871 - DNA, 17 bp, Homo sapiens
tctgttccatgcaactg

SEQ ID NO: 1686872 - DNA, 20 bp, Homo sapiens
tctgttccccatggccactt

SEQ ID NO: 1686873 - DNA, 19 bp, Homo sapiens
tctgttcctttctctgggc

SEQ ID NO: 1686874 - DNA, 15 bp, Homo sapiens
tctgttctccctggg

SEQ ID NO: 1686875 - DNA, 17 bp, Homo sapiens
tctgttctgtttggcac

SEQ ID NO: 1686876 - DNA, 16 bp, Homo sapiens
tctgttcttacaaatg

SEQ ID NO: 1686877 - DNA, 21 bp, Homo sapiens
tctgttcttacaaatgtgaaa

SEQ ID NO: 1686878 - DNA, 14 bp, Homo sapiens
tctgttgagtaaaa

SEQ ID NO: 1686879 - DNA, 17 bp, Homo sapiens
tctgttgataaatccat

SEQ ID NO: 1686880 - DNA, 22 bp, Homo sapiens
tctgttgatcccacttcactgt

SEQ ID NO: 1686881 - DNA, 21 bp, Homo sapiens
tctgttgattactactttaag

SEQ ID NO: 1686882 - DNA, 16 bp, Homo sapiens
tctgttgcaagtgcaa

SEQ ID NO: 1686883 - DNA, 18 bp, Homo sapiens
tctgttgccacaaccctg

SEQ ID NO: 1686884 - DNA, 13 bp, Homo sapiens
tctgttggagaaa

SEQ ID NO: 1686885 - DNA, 16 bp, Homo sapiens
tctgttggagaaagaa

SEQ ID NO: 1686886 - DNA, 17 bp, Homo sapiens
tctgttggagaaagaaa

SEQ ID NO: 1686887 - DNA, 12 bp, Homo sapiens
tctgttggataa

SEQ ID NO: 1686888 - DNA, 17 bp, Homo sapiens
tctgttgtcctcccctt

SEQ ID NO: 1686889 - DNA, 19 bp, Homo sapiens
tctgttgtcctccccttgg

SEQ ID NO: 1686890 - DNA, 21 bp, Homo sapiens
tctgttgtcctccccttgggc

SEQ ID NO: 1686891 - DNA, 13 bp, Homo sapiens
tctgttgtctgcg

SEQ ID NO: 1686892 - DNA, 22 bp, Homo sapiens
tctgttgtggaaagtagctgct

SEQ ID NO: 1686893 - DNA, 16 bp, Homo sapiens
tctgtttcaaagcaca

SEQ ID NO: 1686894 - DNA, 17 bp, Homo sapiens
tctgtttctctgctgtc

SEQ ID NO: 1686895 - DNA, 15 bp, Homo sapiens
tctgtttgaggagag

SEQ ID NO: 1686896 - DNA, 18 bp, Homo sapiens
tctgtttggcacttgtat

SEQ ID NO: 1686897 - DNA, 19 bp, Homo sapiens
tctgtttggcacttgtatt

SEQ ID NO: 1686898 - DNA, 15 bp, Homo sapiens
tctgtttgtgggact

SEQ ID NO: 1686899 - DNA, 16 bp, Homo sapiens
tctgtttgtgggactg

SEQ ID NO: 1686900 - DNA, 13 bp, Homo sapiens
tctgtttgttaaa

SEQ ID NO: 1686901 - DNA, 21 bp, Homo sapiens
tctgtttgttaaaactggcat

SEQ ID NO: 1686902 - DNA, 18 bp, Homo sapiens
tctgttttaggttaaaaa

SEQ ID NO: 1686903 - DNA, 15 bp, Homo sapiens
tctgttttctggaag

SEQ ID NO: 1686904 - DNA, 15 bp, Homo sapiens
tctgttttgtgagaa

SEQ ID NO: 1686905 - DNA, 20 bp, Homo sapiens
tctgttttgtggtttggaat

SEQ ID NO: 1686906 - DNA, 19 bp, Homo sapiens
tctgttttgtgtctggtgc

SEQ ID NO: 1686907 - DNA, 15 bp, Homo sapiens
tctgtttttaaaaat

SEQ ID NO: 1686908 - DNA, 14 bp, Homo sapiens
tctgtttttctcat

SEQ ID NO: 1686909 - DNA, 15 bp, Homo sapiens
tctgtttttgtatct

SEQ ID NO: 1686910 - DNA, 20 bp, Homo sapiens
tcttaaaacattatgagttt

SEQ ID NO: 1686911 - DNA, 12 bp, Homo sapiens
tcttaaaagata

SEQ ID NO: 1686912 - DNA, 14 bp, Homo sapiens
tcttaaaagtactt

SEQ ID NO: 1686913 - DNA, 15 bp, Homo sapiens
tcttaaaagtacttt

SEQ ID NO: 1686914 - DNA, 22 bp, Homo sapiens
tcttaaaagtactttaaaaagg

SEQ ID NO: 1686915 - DNA, 15 bp, Homo sapiens
tcttaaaccattttt

SEQ ID NO: 1686916 - DNA, 15 bp, Homo sapiens
tcttaccgtagcctc

SEQ ID NO: 1686917 - DNA, 21 bp, Homo sapiens
tcttacctactattggcccta

SEQ ID NO: 1686918 - DNA, 18 bp, Homo sapiens
tcttacctgttatttatc

SEQ ID NO: 1686919 - DNA, 14 bp, Homo sapiens
tcttactgataatt

SEQ ID NO: 1686920 - DNA, 16 bp, Homo sapiens
tcttactgataatttt

SEQ ID NO: 1686921 - DNA, 22 bp, Homo sapiens
tcttactttgcttgagaatcct

SEQ ID NO: 1686922 - DNA, 17 bp, Homo sapiens
tcttacttttccagtct

SEQ ID NO: 1686923 - DNA, 15 bp, Homo sapiens
tcttagaaaaggtga

SEQ ID NO: 1686924 - DNA, 20 bp, Homo sapiens
tcttagaagtgttgtaaaag

SEQ ID NO: 1686925 - DNA, 17 bp, Homo sapiens
tcttagacttttccaat

SEQ ID NO: 1686926 - DNA, 23 bp, Homo sapiens
tcttagacttttccaatatgtga

SEQ ID NO: 1686927 - DNA, 18 bp, Homo sapiens
tcttagagtgtagctgta

SEQ ID NO: 1686928 - DNA, 18 bp, Homo sapiens
tcttagatggattctcca

SEQ ID NO: 1686929 - DNA, 14 bp, Homo sapiens
tcttagatgtatat

SEQ ID NO: 1686930 - DNA, 15 bp, Homo sapiens
tcttagatgtatata

SEQ ID NO: 1686931 - DNA, 21 bp, Homo sapiens
tcttagattctctgtgtctaa

SEQ ID NO: 1686932 - DNA, 13 bp, Homo sapiens
tcttagattctta

SEQ ID NO: 1686933 - DNA, 13 bp, Homo sapiens
tcttagcaataaa

SEQ ID NO: 1686934 - DNA, 23 bp, Homo sapiens
tcttagcctctggatctagaagg

SEQ ID NO: 1686935 - DNA, 20 bp, Homo sapiens
tcttagctatcattgcttcc

SEQ ID NO: 1686936 - DNA, 22 bp, Homo sapiens
tcttagctatccttggctttca

SEQ ID NO: 1686937 - DNA, 14 bp, Homo sapiens
tcttagctcccctc

SEQ ID NO: 1686938 - DNA, 18 bp, Homo sapiens
tcttagctgtctgctcag

SEQ ID NO: 1686939 - DNA, 13 bp, Homo sapiens
tcttagcttacag

SEQ ID NO: 1686940 - DNA, 16 bp, Homo sapiens
tcttagcttacaggaa

SEQ ID NO: 1686941 - DNA, 14 bp, Homo sapiens
tcttagctttgaaa

SEQ ID NO: 1686942 - DNA, 19 bp, Homo sapiens
tcttaggaagagaaaccag

SEQ ID NO: 1686943 - DNA, 15 bp, Homo sapiens
tcttaggtcaggagt

SEQ ID NO: 1686944 - DNA, 16 bp, Homo sapiens
tcttaggtttactgtg

SEQ ID NO: 1686945 - DNA, 21 bp, Homo sapiens
tcttaggtttactgtgaagag

SEQ ID NO: 1686946 - DNA, 17 bp, Homo sapiens
tcttagtctaggtcctt

SEQ ID NO: 1686947 - DNA, 18 bp, Homo sapiens
tcttagtgcctgagagta

SEQ ID NO: 1686948 - DNA, 19 bp, Homo sapiens
tcttagtgcttcagagttt

SEQ ID NO: 1686949 - DNA, 16 bp, Homo sapiens
tcttagtggatgttct

SEQ ID NO: 1686950 - DNA, 14 bp, Homo sapiens
tcttagtgtatgat

SEQ ID NO: 1686951 - DNA, 14 bp, Homo sapiens
tcttatacatttga

SEQ ID NO: 1686952 - DNA, 16 bp, Homo sapiens
tcttatcctccaccgt

SEQ ID NO: 1686953 - DNA, 15 bp, Homo sapiens
tcttatcctctctct

SEQ ID NO: 1686954 - DNA, 21 bp, Homo sapiens
tcttatctcagatatttgcac

SEQ ID NO: 1686955 - DNA, 16 bp, Homo sapiens
tcttatggcacaaaaa

SEQ ID NO: 1686956 - DNA, 12 bp, Homo sapiens
tcttatgtgaca

SEQ ID NO: 1686957 - DNA, 13 bp, Homo sapiens
tcttatgtgacat

SEQ ID NO: 1686958 - DNA, 21 bp, Homo sapiens
tcttatgtgacattaacaaat

SEQ ID NO: 1686959 - DNA, 19 bp, Homo sapiens
tcttatgttgaatatgtta

SEQ ID NO: 1686960 - DNA, 16 bp, Homo sapiens
tcttattcccaaacta

SEQ ID NO: 1686961 - DNA, 22 bp, Homo sapiens
tcttattcccaaactacagaat

SEQ ID NO: 1686962 - DNA, 17 bp, Homo sapiens
tcttatttaatgaaaga

SEQ ID NO: 1686963 - DNA, 14 bp, Homo sapiens
tcttatttaccctt

SEQ ID NO: 1686964 - DNA, 22 bp, Homo sapiens
tcttatttcactaaatgtaaaa

SEQ ID NO: 1686965 - DNA, 19 bp, Homo sapiens
tcttatttcatttattttt

SEQ ID NO: 1686966 - DNA, 15 bp, Homo sapiens
tcttattttagtata

SEQ ID NO: 1686967 - DNA, 16 bp, Homo sapiens
tcttattttagtatac

SEQ ID NO: 1686968 - DNA, 12 bp, Homo sapiens
tcttattttgca

SEQ ID NO: 1686969 - DNA, 20 bp, Homo sapiens
tcttattttgcattccagaa

SEQ ID NO: 1686970 - DNA, 21 bp, Homo sapiens
tcttattttgcattccagaat

SEQ ID NO: 1686971 - DNA, 16 bp, Homo sapiens
tcttatttttcttacc

SEQ ID NO: 1686972 - DNA, 17 bp, Homo sapiens
tcttattttttaaaaag

SEQ ID NO: 1686973 - DNA, 19 bp, Homo sapiens
tcttcaaactttcactttg

SEQ ID NO: 1686974 - DNA, 17 bp, Homo sapiens
tcttcaaagccttctcc

SEQ ID NO: 1686975 - DNA, 11 bp, Homo sapiens
tcttcaacaga

SEQ ID NO: 1686976 - DNA, 19 bp, Homo sapiens
tcttcaactcctgggctca

SEQ ID NO: 1686977 - DNA, 13 bp, Homo sapiens
tcttcaatctctg

SEQ ID NO: 1686978 - DNA, 15 bp, Homo sapiens
tcttcaatctctgtt

SEQ ID NO: 1686979 - DNA, 19 bp, Homo sapiens
tcttcaatctctgttctgc

SEQ ID NO: 1686980 - DNA, 15 bp, Homo sapiens
tcttcacactgcgca

SEQ ID NO: 1686981 - DNA, 20 bp, Homo sapiens
tcttcacactgcgcaggtct

SEQ ID NO: 1686982 - DNA, 15 bp, Homo sapiens
tcttcacaggcactc

SEQ ID NO: 1686983 - DNA, 20 bp, Homo sapiens
tcttcacccagctaatctgt

SEQ ID NO: 1686984 - DNA, 22 bp, Homo sapiens
tcttcacccctacactgtgaag

SEQ ID NO: 1686985 - DNA, 15 bp, Homo sapiens
tcttcacctcagagt

SEQ ID NO: 1686986 - DNA, 17 bp, Homo sapiens
tcttcacctcagagtgg

SEQ ID NO: 1686987 - DNA, 18 bp, Homo sapiens
tcttcacctcctgccagc

SEQ ID NO: 1686988 - DNA, 17 bp, Homo sapiens
tcttcacctcttccact

SEQ ID NO: 1686989 - DNA, 18 bp, Homo sapiens
tcttcacctcttccactc

SEQ ID NO: 1686990 - DNA, 23 bp, Homo sapiens
tcttcacgacaatgttgagaagt

SEQ ID NO: 1686991 - DNA, 14 bp, Homo sapiens
tcttcactgtggcc

SEQ ID NO: 1686992 - DNA, 22 bp, Homo sapiens
tcttcactgtggccacagcccc

SEQ ID NO: 1686993 - DNA, 15 bp, Homo sapiens
tcttcagacccagag

SEQ ID NO: 1686994 - DNA, 12 bp, Homo sapiens
tcttcagagtga

SEQ ID NO: 1686995 - DNA, 19 bp, Homo sapiens
tcttcagagtgaagaatct

SEQ ID NO: 1686996 - DNA, 13 bp, Homo sapiens
tcttcagcccagg

SEQ ID NO: 1686997 - DNA, 21 bp, Homo sapiens
tcttcagcctagccgacctca

SEQ ID NO: 1686998 - DNA, 22 bp, Homo sapiens
tcttcagcctagccgacctcag

SEQ ID NO: 1686999 - DNA, 20 bp, Homo sapiens
tctttattcttattactatt

SEQ ID NO: 1687000 - DNA, 12 bp, Homo sapiens
tctttattgaaa

SEQ ID NO: 1687001 - DNA, 15 bp, Homo sapiens
tctttattgaaattc

SEQ ID NO: 1687002 - DNA, 15 bp, Homo sapiens
tctttatttctagca

SEQ ID NO: 1687003 - DNA, 22 bp, Homo sapiens
tctttcaaaggtagccatcatg

SEQ ID NO: 1687004 - DNA, 15 bp, Homo sapiens
tctttcaacttgcat

SEQ ID NO: 1687005 - DNA, 18 bp, Homo sapiens
tctttcaacttgcatcca

SEQ ID NO: 1687006 - DNA, 15 bp, Homo sapiens
tctttcacagctcct

SEQ ID NO: 1687007 - DNA, 22 bp, Homo sapiens
tctttcacattgtttgctgcta

SEQ ID NO: 1687008 - DNA, 23 bp, Homo sapiens
tctttcacattgtttgctgctat

SEQ ID NO: 1687009 - DNA, 23 bp, Homo sapiens
tctttcagtacttttttaaatat

SEQ ID NO: 1687010 - DNA, 21 bp, Homo sapiens
tctttccaaagcgctgaggct

SEQ ID NO: 1687011 - DNA, 11 bp, Homo sapiens
tctttccaaat

SEQ ID NO: 1687012 - DNA, 12 bp, Homo sapiens
tctttccaaatt

SEQ ID NO: 1687013 - DNA, 13 bp, Homo sapiens
tctttccaggctt

SEQ ID NO: 1687014 - DNA, 19 bp, Homo sapiens
tctttccattatgattctt

SEQ ID NO: 1687015 - DNA, 14 bp, Homo sapiens
tctttcccaggccg

SEQ ID NO: 1687016 - DNA, 11 bp, Homo sapiens
tctttccccag

SEQ ID NO: 1687017 - DNA, 15 bp, Homo sapiens
tctttccctggacag

SEQ ID NO: 1687018 - DNA, 14 bp, Homo sapiens
tctttccttcccaa

SEQ ID NO: 1687019 - DNA, 15 bp, Homo sapiens
tctttctacagagat

SEQ ID NO: 1687020 - DNA, 15 bp, Homo sapiens
tctttctcaaagaaa

SEQ ID NO: 1687021 - DNA, 13 bp, Homo sapiens
tctttctccctca

SEQ ID NO: 1687022 - DNA, 20 bp, Homo sapiens
tctttctccttcattaatga

SEQ ID NO: 1687023 - DNA, 13 bp, Homo sapiens
tctttctctgcca

SEQ ID NO: 1687024 - DNA, 16 bp, Homo sapiens
tctttctcttacctgt

SEQ ID NO: 1687025 - DNA, 16 bp, Homo sapiens
tctttctcttccctga

SEQ ID NO: 1687026 - DNA, 21 bp, Homo sapiens
tctttctgcagaaacagaaag

SEQ ID NO: 1687027 - DNA, 23 bp, Homo sapiens
tctttctgcccggctacatcagc

SEQ ID NO: 1687028 - DNA, 20 bp, Homo sapiens
tctttctgctctgccatctt

SEQ ID NO: 1687029 - DNA, 16 bp, Homo sapiens
tctttctggcctgcct

SEQ ID NO: 1687030 - DNA, 18 bp, Homo sapiens
tctttctggcctgccttc

SEQ ID NO: 1687031 - DNA, 23 bp, Homo sapiens
tctttctggggggatatttccta

SEQ ID NO: 1687032 - DNA, 12 bp, Homo sapiens
tctttctgtctc

SEQ ID NO: 1687033 - DNA, 14 bp, Homo sapiens
tctttctgtctccc

SEQ ID NO: 1687034 - DNA, 18 bp, Homo sapiens
tctttctgtctcccttct

SEQ ID NO: 1687035 - DNA, 20 bp, Homo sapiens
tctttctgtctcccttctct

SEQ ID NO: 1687036 - DNA, 19 bp, Homo sapiens
tctttctgtgcttggattt

SEQ ID NO: 1687037 - DNA, 14 bp, Homo sapiens
tctttctgttgaga

SEQ ID NO: 1687038 - DNA, 16 bp, Homo sapiens
tctttcttaagccctt

SEQ ID NO: 1687039 - DNA, 22 bp, Homo sapiens
tctttcttgggatagtgttctg

SEQ ID NO: 1687040 - DNA, 17 bp, Homo sapiens
tctttctttacctgaga

SEQ ID NO: 1687041 - DNA, 21 bp, Homo sapiens
tctttctttacctgagaccag

SEQ ID NO: 1687042 - DNA, 22 bp, Homo sapiens
tctttctttccaaaacatttct

SEQ ID NO: 1687043 - DNA, 12 bp, Homo sapiens
tctttctttgga

SEQ ID NO: 1687044 - DNA, 12 bp, Homo sapiens
tctttgaaataa

SEQ ID NO: 1687045 - DNA, 16 bp, Homo sapiens
tctttgaaataaaaaa

SEQ ID NO: 1687046 - DNA, 22 bp, Homo sapiens
tctttgaaatagtctgtgtgaa

SEQ ID NO: 1687047 - DNA, 14 bp, Homo sapiens
tctttgaacatgaa

SEQ ID NO: 1687048 - DNA, 12 bp, Homo sapiens
tctttgaatttc

SEQ ID NO: 1687049 - DNA, 16 bp, Homo sapiens
tctttgaccagatctt

SEQ ID NO: 1687050 - DNA, 12 bp, Homo sapiens
tctttgagaggg

SEQ ID NO: 1687051 - DNA, 14 bp, Homo sapiens
tctttgagtaatgt

SEQ ID NO: 1687052 - DNA, 12 bp, Homo sapiens
tctttgataaca

SEQ ID NO: 1687053 - DNA, 14 bp, Homo sapiens
tctttgataacaaa

SEQ ID NO: 1687054 - DNA, 16 bp, Homo sapiens
tctttgataacaggga

SEQ ID NO: 1687055 - DNA, 21 bp, Homo sapiens
tctttgatccttctgagctcc

SEQ ID NO: 1687056 - DNA, 15 bp, Homo sapiens
tctttgattctcctt

SEQ ID NO: 1687057 - DNA, 19 bp, Homo sapiens
tctttgattctccttcagc

SEQ ID NO: 1687058 - DNA, 23 bp, Homo sapiens
tctttgattctccttcagccctc

SEQ ID NO: 1687059 - DNA, 13 bp, Homo sapiens
tctttgattctgt

SEQ ID NO: 1687060 - DNA, 15 bp, Homo sapiens
tctttgcacatgtga

SEQ ID NO: 1687061 - DNA, 17 bp, Homo sapiens
tctttgcacatgtgacc

SEQ ID NO: 1687062 - DNA, 17 bp, Homo sapiens
tctttgcacttaaaaat

SEQ ID NO: 1687063 - DNA, 22 bp, Homo sapiens
tctttgcccccgacggctgtga

SEQ ID NO: 1687064 - DNA, 20 bp, Homo sapiens
tctttgcctcaactccagga

SEQ ID NO: 1687065 - DNA, 11 bp, Homo sapiens
tctttgcctct

SEQ ID NO: 1687066 - DNA, 13 bp, Homo sapiens
tctttgcctctgc

SEQ ID NO: 1687067 - DNA, 15 bp, Homo sapiens
tctttgcctctgcag

SEQ ID NO: 1687068 - DNA, 14 bp, Homo sapiens
tctttgccttgggc

SEQ ID NO: 1687069 - DNA, 20 bp, Homo sapiens
tctttgccttgggctgctcc

SEQ ID NO: 1687070 - DNA, 12 bp, Homo sapiens
tctttgctcagt

SEQ ID NO: 1687071 - DNA, 22 bp, Homo sapiens
tctttgctgcagtcatctactt

SEQ ID NO: 1687072 - DNA, 20 bp, Homo sapiens
tctttgctgtactcttgctg

SEQ ID NO: 1687073 - DNA, 23 bp, Homo sapiens
tctttggaagcagccccctgtgg

SEQ ID NO: 1687074 - DNA, 20 bp, Homo sapiens
tctttggagttaaaatgcac

SEQ ID NO: 1687075 - DNA, 15 bp, Homo sapiens
tctttggattctaaa

SEQ ID NO: 1687076 - DNA, 16 bp, Homo sapiens
tctttggattctaaat

SEQ ID NO: 1687077 - DNA, 14 bp, Homo sapiens
tctttggctcccct

SEQ ID NO: 1687078 - DNA, 12 bp, Homo sapiens
tctttggctgca

SEQ ID NO: 1687079 - DNA, 15 bp, Homo sapiens
tctttgggccagaca

SEQ ID NO: 1687080 - DNA, 16 bp, Homo sapiens
tctttgggccagacat

SEQ ID NO: 1687081 - DNA, 20 bp, Homo sapiens
tctttgggcctctcctgccc

SEQ ID NO: 1687082 - DNA, 15 bp, Homo sapiens
tctttggtaggtaaa

SEQ ID NO: 1687083 - DNA, 17 bp, Homo sapiens
tctttggtgtacagact

SEQ ID NO: 1687084 - DNA, 14 bp, Homo sapiens
tctttggttctaag

SEQ ID NO: 1687085 - DNA, 18 bp, Homo sapiens
tctttgtaaatgcatatt

SEQ ID NO: 1687086 - DNA, 15 bp, Homo sapiens
tctttgtaagagcaa

SEQ ID NO: 1687087 - DNA, 14 bp, Homo sapiens
tctttgtaccaaaa

SEQ ID NO: 1687088 - DNA, 17 bp, Homo sapiens
tctttgtaccatctgtc

SEQ ID NO: 1687089 - DNA, 13 bp, Homo sapiens
tctttgtgccttt

SEQ ID NO: 1687090 - DNA, 16 bp, Homo sapiens
tctttgtgcctttggc

SEQ ID NO: 1687091 - DNA, 15 bp, Homo sapiens
tctttgtggcagtgg

SEQ ID NO: 1687092 - DNA, 24 bp, Homo sapiens
tcttttcagcttgtttctatactg

SEQ ID NO: 1687093 - DNA, 20 bp, Homo sapiens
tcttttccactcctatggaa

SEQ ID NO: 1687094 - DNA, 17 bp, Homo sapiens
tcttttcccctttcctg

SEQ ID NO: 1687095 - DNA, 14 bp, Homo sapiens
tcttttcccttaaa

SEQ ID NO: 1687096 - DNA, 12 bp, Homo sapiens
tcttttcctcct

SEQ ID NO: 1687097 - DNA, 17 bp, Homo sapiens
tcttttcgttttcgttt

SEQ ID NO: 1687098 - DNA, 19 bp, Homo sapiens
tcttttctaaatgttatta

SEQ ID NO: 1687099 - DNA, 12 bp, Homo sapiens
tcttttctattt

SEQ ID NO: 1687100 - DNA, 13 bp, Homo sapiens
tcttttctctgtg

SEQ ID NO: 1687101 - DNA, 19 bp, Homo sapiens
tcttttctggaatgtaatc

SEQ ID NO: 1687102 - DNA, 21 bp, Homo sapiens
tcttttctgtcaccaaatttg

SEQ ID NO: 1687103 - DNA, 12 bp, Homo sapiens
tcttttcttatt

SEQ ID NO: 1687104 - DNA, 20 bp, Homo sapiens
tcttttcttgcctctgtccc

SEQ ID NO: 1687105 - DNA, 12 bp, Homo sapiens
tcttttctttac

SEQ ID NO: 1687106 - DNA, 13 bp, Homo sapiens
tcttttctttctg

SEQ ID NO: 1687107 - DNA, 14 bp, Homo sapiens
tcttttgaagcata

SEQ ID NO: 1687108 - DNA, 16 bp, Homo sapiens
tcttttgaattcttga

SEQ ID NO: 1687109 - DNA, 21 bp, Homo sapiens
tcttttgcccttcacagtgtt

SEQ ID NO: 1687110 - DNA, 23 bp, Homo sapiens
tcttttgccttttgcaaccagga

SEQ ID NO: 1687111 - DNA, 19 bp, Homo sapiens
tcttttgctactaagttca

SEQ ID NO: 1687112 - DNA, 13 bp, Homo sapiens
tcttttgctgtgc

SEQ ID NO: 1687113 - DNA, 20 bp, Homo sapiens
tcttttgcttgccaaagtac

SEQ ID NO: 1687114 - DNA, 20 bp, Homo sapiens
tcttttggaagttttgctag

SEQ ID NO: 1687115 - DNA, 13 bp, Homo sapiens
tcttttggcttcc

SEQ ID NO: 1687116 - DNA, 22 bp, Homo sapiens
tcttttgggtaaaatctgtaat

SEQ ID NO: 1687117 - DNA, 12 bp, Homo sapiens
tcttttgtaatt

SEQ ID NO: 1687118 - DNA, 14 bp, Homo sapiens
tcttttgtatatct

SEQ ID NO: 1687119 - DNA, 12 bp, Homo sapiens
tcttttgtatta

SEQ ID NO: 1687120 - DNA, 15 bp, Homo sapiens
tcttttgttctctga

SEQ ID NO: 1687121 - DNA, 21 bp, Homo sapiens
tctttttaattattttaaaat

SEQ ID NO: 1687122 - DNA, 17 bp, Homo sapiens
tctttttacagcattgt

SEQ ID NO: 1687123 - DNA, 20 bp, Homo sapiens
tctttttacagcattgtctt

SEQ ID NO: 1687124 - DNA, 16 bp, Homo sapiens
tctttttactgttgaa

SEQ ID NO: 1687125 - DNA, 14 bp, Homo sapiens
tctttttataggtt

SEQ ID NO: 1687126 - DNA, 15 bp, Homo sapiens
tctttttcaataaat

SEQ ID NO: 1687127 - DNA, 12 bp, Homo sapiens
tctttttccagt

SEQ ID NO: 1687128 - DNA, 13 bp, Homo sapiens
tctttttccagtg

SEQ ID NO: 1687129 - DNA, 17 bp, Homo sapiens
tctttttcttcttccct

SEQ ID NO: 1687130 - DNA, 16 bp, Homo sapiens
tctttttctttctttg

SEQ ID NO: 1687131 - DNA, 14 bp, Homo sapiens
tctttttgcttcta

SEQ ID NO: 1687132 - DNA, 19 bp, Homo sapiens
tctttttgggagagacttg

SEQ ID NO: 1687133 - DNA, 11 bp, Homo sapiens
tctttttgggg

SEQ ID NO: 1687134 - DNA, 12 bp, Homo sapiens
tcttttttaacc

SEQ ID NO: 1687135 - DNA, 16 bp, Homo sapiens
tcttttttaagttgtc

SEQ ID NO: 1687136 - DNA, 16 bp, Homo sapiens
tcttttttcaaaagaa

SEQ ID NO: 1687137 - DNA, 20 bp, Homo sapiens
tctttttttgagtgacagct

SEQ ID NO: 1687138 - DNA, 16 bp, Homo sapiens
tcttttttttcctttg

SEQ ID NO: 1687139 - DNA, 22 bp, Homo sapiens
tcttttttttcctttgaacgtg

SEQ ID NO: 1687140 - DNA, 16 bp, Homo sapiens
tctttttttttaagtt

SEQ ID NO: 1687141 - DNA, 18 bp, Homo sapiens
tctttttttttaagttct

SEQ ID NO: 1687142 - DNA, 23 bp, Homo sapiens
tctttttttttttttataaaagc

SEQ ID NO: 1687143 - DNA, 16 bp, Homo sapiens
tgaaaaaaaagtttca

SEQ ID NO: 1687144 - DNA, 11 bp, Homo sapiens
tgaaaaacaaa

SEQ ID NO: 1687145 - DNA, 14 bp, Homo sapiens
tgaaaaacaatttt

SEQ ID NO: 1687146 - DNA, 13 bp, Homo sapiens
tgaaaaactgagt

SEQ ID NO: 1687147 - DNA, 12 bp, Homo sapiens
tgaaaaactgat

SEQ ID NO: 1687148 - DNA, 21 bp, Homo sapiens
tgaaaaactgatcaaaaataa

SEQ ID NO: 1687149 - DNA, 22 bp, Homo sapiens
tgaaaaactgatcaaaaataaa

SEQ ID NO: 1687150 - DNA, 20 bp, Homo sapiens
tgaaaaaggaataaattgtt

SEQ ID NO: 1687151 - DNA, 15 bp, Homo sapiens
tgaaaaagttttaca

SEQ ID NO: 1687152 - DNA, 12 bp, Homo sapiens
tgaaaaatataa

SEQ ID NO: 1687153 - DNA, 13 bp, Homo sapiens
tgaaaaatataaa

SEQ ID NO: 1687154 - DNA, 16 bp, Homo sapiens
tgaaaaatatgttgag

SEQ ID NO: 1687155 - DNA, 18 bp, Homo sapiens
tgaaaaatcagatgaatt

SEQ ID NO: 1687156 - DNA, 20 bp, Homo sapiens
tgaaaaatgtttttattttt

SEQ ID NO: 1687157 - DNA, 16 bp, Homo sapiens
tgaaaaattaactttt

SEQ ID NO: 1687158 - DNA, 15 bp, Homo sapiens
tgaaaacaagaaaga

SEQ ID NO: 1687159 - DNA, 23 bp, Homo sapiens
tgaaaacaagaaagaaatggctt

SEQ ID NO: 1687160 - DNA, 13 bp, Homo sapiens
tgaaaacagatat

SEQ ID NO: 1687161 - DNA, 19 bp, Homo sapiens
tgaaaacatggtagaattg

SEQ ID NO: 1687162 - DNA, 14 bp, Homo sapiens
tgaaaacatgtaat

SEQ ID NO: 1687163 - DNA, 22 bp, Homo sapiens
tgaaaacatgtactacagctat

SEQ ID NO: 1687164 - DNA, 24 bp, Homo sapiens
tgaaaacatgtactacagctatat

SEQ ID NO: 1687165 - DNA, 19 bp, Homo sapiens
tgaaaacatttcaaagctg

SEQ ID NO: 1687166 - DNA, 17 bp, Homo sapiens
tgaaaaccaaccctgtg

SEQ ID NO: 1687167 - DNA, 13 bp, Homo sapiens
tgaaaactctggt

SEQ ID NO: 1687168 - DNA, 12 bp, Homo sapiens
tgaaaagaaaga

SEQ ID NO: 1687169 - DNA, 16 bp, Homo sapiens
tgaaaagaaatgctaa

SEQ ID NO: 1687170 - DNA, 12 bp, Homo sapiens
tgaaaagaagaa

SEQ ID NO: 1687171 - DNA, 19 bp, Homo sapiens
tgaaaagaagaaagtctat

SEQ ID NO: 1687172 - DNA, 15 bp, Homo sapiens
tgaaaagaaggaata

SEQ ID NO: 1687173 - DNA, 16 bp, Homo sapiens
tgaaaagactccaaag

SEQ ID NO: 1687174 - DNA, 22 bp, Homo sapiens
tgaaaagactccaaagaaatgt

SEQ ID NO: 1687175 - DNA, 23 bp, Homo sapiens
tgaaaagaggggaccagaagcca

SEQ ID NO: 1687176 - DNA, 23 bp, Homo sapiens
tgaaaagcagttcatgtctgaaa

SEQ ID NO: 1687177 - DNA, 21 bp, Homo sapiens
tgaaaagctttgtttgttctt

SEQ ID NO: 1687178 - DNA, 23 bp, Homo sapiens
tgaaaaggagagattaaaggtat

SEQ ID NO: 1687179 - DNA, 14 bp, Homo sapiens
tgaaaagggcactc

SEQ ID NO: 1687180 - DNA, 22 bp, Homo sapiens
tgaaaagggcggaagagttaca

SEQ ID NO: 1687181 - DNA, 23 bp, Homo sapiens
tgaaaagggcggaagagttacaa

SEQ ID NO: 1687182 - DNA, 20 bp, Homo sapiens
tgaaaagggtgttgggaggg

SEQ ID NO: 1687183 - DNA, 21 bp, Homo sapiens
tgaaaaggtgtccttttcctt

SEQ ID NO: 1687184 - DNA, 21 bp, Homo sapiens
tgaaaaggttcttcatccctt

SEQ ID NO: 1687185 - DNA, 17 bp, Homo sapiens
tgaaaaggttgcctgaa

SEQ ID NO: 1687186 - DNA, 20 bp, Homo sapiens
tgaaaagttactacctgtca

SEQ ID NO: 1687187 - DNA, 22 bp, Homo sapiens
tgaaaagttactacctgtcaag

SEQ ID NO: 1687188 - DNA, 17 bp, Homo sapiens
tgacatcctttctttta

SEQ ID NO: 1687189 - DNA, 16 bp, Homo sapiens
tgacatctgtgtttca

SEQ ID NO: 1687190 - DNA, 17 bp, Homo sapiens
tgacatcttgaatcctt

SEQ ID NO: 1687191 - DNA, 20 bp, Homo sapiens
tgacatcttgaatccttcca

SEQ ID NO: 1687192 - DNA, 15 bp, Homo sapiens
tgacatggaaatgaa

SEQ ID NO: 1687193 - DNA, 20 bp, Homo sapiens
tgacatggacccactaccct

SEQ ID NO: 1687194 - DNA, 15 bp, Homo sapiens
tgacatggtgcctga

SEQ ID NO: 1687195 - DNA, 21 bp, Homo sapiens
tgacatggtgcctgagaggca

SEQ ID NO: 1687196 - DNA, 16 bp, Homo sapiens
tgacatgtaagaaaat

SEQ ID NO: 1687197 - DNA, 19 bp, Homo sapiens
tgacatgtaagaaaatgtt

SEQ ID NO: 1687198 - DNA, 21 bp, Homo sapiens
tgacatgtaagaaaatgttac

SEQ ID NO: 1687199 - DNA, 16 bp, Homo sapiens
tgacatgtccctacac

SEQ ID NO: 1687200 - DNA, 17 bp, Homo sapiens
tgacatgtggggccagg

SEQ ID NO: 1687201 - DNA, 14 bp, Homo sapiens
tgacattaacaaat

SEQ ID NO: 1687202 - DNA, 17 bp, Homo sapiens
tgacattccttgtcacc

SEQ ID NO: 1687203 - DNA, 20 bp, Homo sapiens
tgacattccttgtcaccagc

SEQ ID NO: 1687204 - DNA, 21 bp, Homo sapiens
tgacattccttgtcaccagca

SEQ ID NO: 1687205 - DNA, 18 bp, Homo sapiens
tgacattcttagctgtaa

SEQ ID NO: 1687206 - DNA, 19 bp, Homo sapiens
tgacatttagaactttaag

SEQ ID NO: 1687207 - DNA, 13 bp, Homo sapiens
tgacatttctttg

SEQ ID NO: 1687208 - DNA, 15 bp, Homo sapiens
tgacatttggtggta

SEQ ID NO: 1687209 - DNA, 14 bp, Homo sapiens
tgacatttgtagtt

SEQ ID NO: 1687210 - DNA, 12 bp, Homo sapiens
tgacatttgttt

SEQ ID NO: 1687211 - DNA, 12 bp, Homo sapiens
tgaccaaaaaaa

SEQ ID NO: 1687212 - DNA, 15 bp, Homo sapiens
tgaccaaaccagcct

SEQ ID NO: 1687213 - DNA, 22 bp, Homo sapiens
tgaccaaatggccagttttctg

SEQ ID NO: 1687214 - DNA, 18 bp, Homo sapiens
tgaccaacagaaaccttt

SEQ ID NO: 1687215 - DNA, 18 bp, Homo sapiens
tgaccaacaggctgttct

SEQ ID NO: 1687216 - DNA, 23 bp, Homo sapiens
tgaccaacaggctgttctgcact

SEQ ID NO: 1687217 - DNA, 17 bp, Homo sapiens
tgaccaagagagaaaga

SEQ ID NO: 1687218 - DNA, 20 bp, Homo sapiens
tgaccaagttataaatcaat

SEQ ID NO: 1687219 - DNA, 14 bp, Homo sapiens
tgaccaatacattt

SEQ ID NO: 1687220 - DNA, 17 bp, Homo sapiens
tgaccaatacatttgta

SEQ ID NO: 1687221 - DNA, 19 bp, Homo sapiens
tgaccaatgggatgaggtc

SEQ ID NO: 1687222 - DNA, 15 bp, Homo sapiens
tgaccaattgtgctg

SEQ ID NO: 1687223 - DNA, 19 bp, Homo sapiens
tgaccacaccaaccaggcc

SEQ ID NO: 1687224 - DNA, 17 bp, Homo sapiens
tgaccacacctgcctct

SEQ ID NO: 1687225 - DNA, 21 bp, Homo sapiens
tgaccacaccttggccttctg

SEQ ID NO: 1687226 - DNA, 15 bp, Homo sapiens
tgaccaccctcccct

SEQ ID NO: 1687227 - DNA, 21 bp, Homo sapiens
tgaccacgctttctagctgtt

SEQ ID NO: 1687228 - DNA, 22 bp, Homo sapiens
tgaccacgctttctagctgttg

SEQ ID NO: 1687229 - DNA, 20 bp, Homo sapiens
tgaccacggacgtttccatc

SEQ ID NO: 1687230 - DNA, 16 bp, Homo sapiens
tgaccacggctgttcc

SEQ ID NO: 1687231 - DNA, 16 bp, Homo sapiens
tgaccacttgaggcct

SEQ ID NO: 1687232 - DNA, 17 bp, Homo sapiens
tgaccacttgaggcctg

SEQ ID NO: 1687233 - DNA, 16 bp, Homo sapiens
tgaccagatctttctc

SEQ ID NO: 1687234 - DNA, 17 bp, Homo sapiens
tgaccagatctttctct

SEQ ID NO: 1687235 - DNA, 19 bp, Homo sapiens
tgaccagatctttctcttc

SEQ ID NO: 1687236 - DNA, 20 bp, Homo sapiens
tgaccagatctttctcttcc

SEQ ID NO: 1687237 - DNA, 18 bp, Homo sapiens
tgaccagcactgtctcag

SEQ ID NO: 1687238 - DNA, 17 bp, Homo sapiens
tgaccagcagatcccag

SEQ ID NO: 1687239 - DNA, 21 bp, Homo sapiens
tgaccagcagatcccagctca

SEQ ID NO: 1687240 - DNA, 22 bp, Homo sapiens
tgaccagcagatcccagctcac

SEQ ID NO: 1687241 - DNA, 15 bp, Homo sapiens
tgaccagcggctgct

SEQ ID NO: 1687242 - DNA, 17 bp, Homo sapiens
tgaccagcggctgctca

SEQ ID NO: 1687243 - DNA, 16 bp, Homo sapiens
tgaccaggctgcctcc

SEQ ID NO: 1687244 - DNA, 18 bp, Homo sapiens
tgaccagggatgctgggc

SEQ ID NO: 1687245 - DNA, 20 bp, Homo sapiens
tgaccagggatgctgggctg

SEQ ID NO: 1687246 - DNA, 17 bp, Homo sapiens
tgaccataatcctagcc

SEQ ID NO: 1687247 - DNA, 23 bp, Homo sapiens
tgaccataatcctagccccgaga

SEQ ID NO: 1687248 - DNA, 15 bp, Homo sapiens
tgaccatcatttcac

SEQ ID NO: 1687249 - DNA, 19 bp, Homo sapiens
tgaccatccactctaccct

SEQ ID NO: 1687250 - DNA, 23 bp, Homo sapiens
tgaccatccactctaccctccca

SEQ ID NO: 1687251 - DNA, 19 bp, Homo sapiens
tgaccatcgtccttcctct

SEQ ID NO: 1687252 - DNA, 16 bp, Homo sapiens
tgaccatctgtgacta

SEQ ID NO: 1687253 - DNA, 18 bp, Homo sapiens
tgaccatgctcatctgct

SEQ ID NO: 1687254 - DNA, 13 bp, Homo sapiens
tgaccatgttcat

SEQ ID NO: 1687255 - DNA, 14 bp, Homo sapiens
tgaccatgttcatt

SEQ ID NO: 1687256 - DNA, 16 bp, Homo sapiens
tgaccatgttcattat

SEQ ID NO: 1687257 - DNA, 17 bp, Homo sapiens
tgaccattcaattagtg

SEQ ID NO: 1687258 - DNA, 13 bp, Homo sapiens
tgacccacactgc

SEQ ID NO: 1687259 - DNA, 14 bp, Homo sapiens
tgacccacactgcc

SEQ ID NO: 1687260 - DNA, 23 bp, Homo sapiens
tgacccacccctgtgctccgtgc

SEQ ID NO: 1687261 - DNA, 14 bp, Homo sapiens
tgacccactaaaga

SEQ ID NO: 1687262 - DNA, 20 bp, Homo sapiens
tgacccagcatctcccagca

SEQ ID NO: 1687263 - DNA, 19 bp, Homo sapiens
tgacccagccccttgagaa

SEQ ID NO: 1687264 - DNA, 12 bp, Homo sapiens
tgacccagcctg

SEQ ID NO: 1687265 - DNA, 13 bp, Homo sapiens
tgacccagcctga

SEQ ID NO: 1687266 - DNA, 14 bp, Homo sapiens
tgacccagcctgaa

SEQ ID NO: 1687267 - DNA, 21 bp, Homo sapiens
tgacccaggatatctgaaaat

SEQ ID NO: 1687268 - DNA, 15 bp, Homo sapiens
tgacccaggccgcag

SEQ ID NO: 1687269 - DNA, 19 bp, Homo sapiens
tgacccaggccgcagctct

SEQ ID NO: 1687270 - DNA, 14 bp, Homo sapiens
tgacccagtccctg

SEQ ID NO: 1687271 - DNA, 16 bp, Homo sapiens
tgacccagtgccccca

SEQ ID NO: 1687272 - DNA, 23 bp, Homo sapiens
tgacccagtgcccccactgacca

SEQ ID NO: 1687273 - DNA, 21 bp, Homo sapiens
tgaccccgacgccacagccca

SEQ ID NO: 1687274 - DNA, 15 bp, Homo sapiens
tgaccctgatgaaaa

SEQ ID NO: 1687275 - DNA, 21 bp, Homo sapiens
tgaccctgcgaaggggccctg

SEQ ID NO: 1687276 - DNA, 22 bp, Homo sapiens
tgaccctgcgaaggggccctgg

SEQ ID NO: 1687277 - DNA, 12 bp, Homo sapiens
tgaccctgggca

SEQ ID NO: 1687278 - DNA, 15 bp, Homo sapiens
tgaccctgggcaagt

SEQ ID NO: 1687279 - DNA, 14 bp, Homo sapiens
tgaccctgtgacaa

SEQ ID NO: 1687280 - DNA, 12 bp, Homo sapiens
tgacccttcagg

SEQ ID NO: 1687281 - DNA, 13 bp, Homo sapiens
tgacccttcaggg

SEQ ID NO: 1687282 - DNA, 14 bp, Homo sapiens
tgacccttcagggc

SEQ ID NO: 1687283 - DNA, 21 bp, Homo sapiens
tgacccttcagggccagaagg

SEQ ID NO: 1687284 - DNA, 20 bp, Homo sapiens
tgacccttccagacatacga

SEQ ID NO: 1687285 - DNA, 19 bp, Homo sapiens
tgacccttcccaatcagca

SEQ ID NO: 1687286 - DNA, 15 bp, Homo sapiens
tgaccgagccctgga

SEQ ID NO: 1687287 - DNA, 16 bp, Homo sapiens
tgaccgagccctggag

SEQ ID NO: 1687288 - DNA, 23 bp, Homo sapiens
tgaccgagccctggagagcccca

SEQ ID NO: 1687289 - DNA, 18 bp, Homo sapiens
tgacctaaatccattttc

SEQ ID NO: 1687290 - DNA, 19 bp, Homo sapiens
tgacctacagtgctgtgta

SEQ ID NO: 1687291 - DNA, 17 bp, Homo sapiens
tgacctaccccagccag

SEQ ID NO: 1687292 - DNA, 22 bp, Homo sapiens
tgacctattcaccctccacttc

SEQ ID NO: 1687293 - DNA, 18 bp, Homo sapiens
tgacctcacagtgaccct

SEQ ID NO: 1687294 - DNA, 17 bp, Homo sapiens
tgacctcacctggtcct

SEQ ID NO: 1687295 - DNA, 19 bp, Homo sapiens
tgacctcactgtcctgtga

SEQ ID NO: 1687296 - DNA, 22 bp, Homo sapiens
tgacctcagctgcacattcctg

SEQ ID NO: 1687297 - DNA, 21 bp, Homo sapiens
tgacctcatcattaataagtg

SEQ ID NO: 1687298 - DNA, 13 bp, Homo sapiens
tgacctccctcta

SEQ ID NO: 1687299 - DNA, 19 bp, Homo sapiens
tgacctccgcccctgcccc

SEQ ID NO: 1687300 - DNA, 19 bp, Homo sapiens
tgacttagcgtcaagacat

SEQ ID NO: 1687301 - DNA, 13 bp, Homo sapiens
tgacttcactgta

SEQ ID NO: 1687302 - DNA, 14 bp, Homo sapiens
tgacttcactgtat

SEQ ID NO: 1687303 - DNA, 20 bp, Homo sapiens
tgacttcagtgaatattttt

SEQ ID NO: 1687304 - DNA, 20 bp, Homo sapiens
tgacttccccaatatcttgc

SEQ ID NO: 1687305 - DNA, 21 bp, Homo sapiens
tgacttccccaatatcttgct

SEQ ID NO: 1687306 - DNA, 21 bp, Homo sapiens
tgacttccctggaggagaagt

SEQ ID NO: 1687307 - DNA, 22 bp, Homo sapiens
tgacttctaagtaaaaccacag

SEQ ID NO: 1687308 - DNA, 23 bp, Homo sapiens
tgacttctaagtaaaaccacagc

SEQ ID NO: 1687309 - DNA, 14 bp, Homo sapiens
tgaaaagttgaaat

SEQ ID NO: 1687310 - DNA, 16 bp, Homo sapiens
tgaaaagttgaaatgt

SEQ ID NO: 1687311 - DNA, 21 bp, Homo sapiens
tgaaaagttggaaggatctgc

SEQ ID NO: 1687312 - DNA, 16 bp, Homo sapiens
tgaaaataaaacacac

SEQ ID NO: 1687313 - DNA, 20 bp, Homo sapiens
tgaaaataaaacacacctcg

SEQ ID NO: 1687314 - DNA, 14 bp, Homo sapiens
tgaaaataattttc

SEQ ID NO: 1687315 - DNA, 18 bp, Homo sapiens
tgaaaatacttttgcatt

SEQ ID NO: 1687316 - DNA, 17 bp, Homo sapiens
tgaaaatagtgtaagaa

SEQ ID NO: 1687317 - DNA, 15 bp, Homo sapiens
tgaaaatatagacat

SEQ ID NO: 1687318 - DNA, 21 bp, Homo sapiens
tgaaaatatagacattctcac

SEQ ID NO: 1687319 - DNA, 22 bp, Homo sapiens
tgaaaatatttgtatcacaaat

SEQ ID NO: 1687320 - DNA, 23 bp, Homo sapiens
tgaaaatattttttatatataca

SEQ ID NO: 1687321 - DNA, 20 bp, Homo sapiens
tgaaaatatttttttctagc

SEQ ID NO: 1687322 - DNA, 13 bp, Homo sapiens
tgaaaatcaaagt

SEQ ID NO: 1687323 - DNA, 14 bp, Homo sapiens
tgaaaatcaaagta

SEQ ID NO: 1687324 - DNA, 18 bp, Homo sapiens
tgaaaatgtcagaaacca

SEQ ID NO: 1687325 - DNA, 16 bp, Homo sapiens
tgaaaatgtccaggaa

SEQ ID NO: 1687326 - DNA, 20 bp, Homo sapiens
tgaaaatgtccaggaaagtg

SEQ ID NO: 1687327 - DNA, 22 bp, Homo sapiens
tgaaaatgtgctatactgcata

SEQ ID NO: 1687328 - DNA, 23 bp, Homo sapiens
tgaaaattattttgttcatacat

SEQ ID NO: 1687329 - DNA, 20 bp, Homo sapiens
tgaaaattccagaaaggata

SEQ ID NO: 1687330 - DNA, 15 bp, Homo sapiens
tgaaaattttacttc

SEQ ID NO: 1687331 - DNA, 18 bp, Homo sapiens
tgaaaattttacttccat

SEQ ID NO: 1687332 - DNA, 18 bp, Homo sapiens
tgaaaatttttacattca

SEQ ID NO: 1687333 - DNA, 19 bp, Homo sapiens
tgaaacaaagtactcttta

SEQ ID NO: 1687334 - DNA, 22 bp, Homo sapiens
tgaaacaaataatcacattgac

SEQ ID NO: 1687335 - DNA, 15 bp, Homo sapiens
tgaaacaaattaatg

SEQ ID NO: 1687336 - DNA, 16 bp, Homo sapiens
tgaaacaaattaatga

SEQ ID NO: 1687337 - DNA, 19 bp, Homo sapiens
tgaaacaactccttttact

SEQ ID NO: 1687338 - DNA, 19 bp, Homo sapiens
tgaaacaatgttgtccaac

SEQ ID NO: 1687339 - DNA, 21 bp, Homo sapiens
tgaaacaatgttgtccaacaa

SEQ ID NO: 1687340 - DNA, 15 bp, Homo sapiens
tgaaacacacgagca

SEQ ID NO: 1687341 - DNA, 17 bp, Homo sapiens
tgaaacacacgagcaaa

SEQ ID NO: 1687342 - DNA, 17 bp, Homo sapiens
tgaaacacagctgttct

SEQ ID NO: 1687343 - DNA, 18 bp, Homo sapiens
tgaaacacagctgttctt

SEQ ID NO: 1687344 - DNA, 19 bp, Homo sapiens
tgaaacacagctgttcttc

SEQ ID NO: 1687345 - DNA, 16 bp, Homo sapiens
tgaaacacttctcatc

SEQ ID NO: 1687346 - DNA, 13 bp, Homo sapiens
tgaaacagaaaca

SEQ ID NO: 1687347 - DNA, 16 bp, Homo sapiens
tgaaacagaaacaaaa

SEQ ID NO: 1687348 - DNA, 14 bp, Homo sapiens
tgaaacatcttctc

SEQ ID NO: 1687349 - DNA, 14 bp, Homo sapiens
tgaaacatgcacat

SEQ ID NO: 1687350 - DNA, 17 bp, Homo sapiens
tgaaaccttattttttc

SEQ ID NO: 1687351 - DNA, 17 bp, Homo sapiens
tgaaacctttttttatc

SEQ ID NO: 1687352 - DNA, 20 bp, Homo sapiens
tgaaacgtcccacactttga

SEQ ID NO: 1687353 - DNA, 19 bp, Homo sapiens
tgaaactcatagacactga

SEQ ID NO: 1687354 - DNA, 22 bp, Homo sapiens
tgaaactcctgattttgtagtt

SEQ ID NO: 1687355 - DNA, 22 bp, Homo sapiens
tgaaactgagatgtgaacacat

SEQ ID NO: 1687356 - DNA, 17 bp, Homo sapiens
tgaaactttctttctaa

SEQ ID NO: 1687357 - DNA, 18 bp, Homo sapiens
tgaaactttctttctaaa

SEQ ID NO: 1687358 - DNA, 12 bp, Homo sapiens
tgaaactttgag

SEQ ID NO: 1687359 - DNA, 14 bp, Homo sapiens
tgaaactttgagat

SEQ ID NO: 1687360 - DNA, 21 bp, Homo sapiens
tgaaactttgggaaaacatgt

SEQ ID NO: 1687361 - DNA, 13 bp, Homo sapiens
tgaaagaaaattg

SEQ ID NO: 1687362 - DNA, 14 bp, Homo sapiens
tgaaagaaaattga

SEQ ID NO: 1687363 - DNA, 15 bp, Homo sapiens
tgaaagaaaattgag

SEQ ID NO: 1687364 - DNA, 22 bp, Homo sapiens
tgaaagaaacagttaactttca

SEQ ID NO: 1687365 - DNA, 19 bp, Homo sapiens
tgaaagaaagctgagaaga

SEQ ID NO: 1687366 - DNA, 20 bp, Homo sapiens
tgaaagaaagctgagaagaa

SEQ ID NO: 1687367 - DNA, 13 bp, Homo sapiens
tgaaagaagcaag

SEQ ID NO: 1687368 - DNA, 15 bp, Homo sapiens
tgaaagaagcaagac

SEQ ID NO: 1687369 - DNA, 14 bp, Homo sapiens
tgaaagacatcaat

SEQ ID NO: 1687370 - DNA, 15 bp, Homo sapiens
tgaaagacatcaatg

SEQ ID NO: 1687371 - DNA, 12 bp, Homo sapiens
tgaaagaccttc

SEQ ID NO: 1687372 - DNA, 15 bp, Homo sapiens
tgaaagactgtacaa

SEQ ID NO: 1687373 - DNA, 13 bp, Homo sapiens
tgaaagagaacca

SEQ ID NO: 1687374 - DNA, 18 bp, Homo sapiens
tgaaagagattacttaaa

SEQ ID NO: 1687375 - DNA, 21 bp, Homo sapiens
tgaaagattcaggtatgttgc

SEQ ID NO: 1687376 - DNA, 18 bp, Homo sapiens
tgaaagatttttactaat

SEQ ID NO: 1687377 - DNA, 17 bp, Homo sapiens
tgaaagcagcagctagg

SEQ ID NO: 1687378 - DNA, 21 bp, Homo sapiens
tgaaagcagcagctaggactg

SEQ ID NO: 1687379 - DNA, 22 bp, Homo sapiens
tgaaagcaggatgaattttctg

SEQ ID NO: 1687380 - DNA, 23 bp, Homo sapiens
tgaaagccagctgccgaccagag

SEQ ID NO: 1687381 - DNA, 12 bp, Homo sapiens
tgaaagcctcac

SEQ ID NO: 1687382 - DNA, 18 bp, Homo sapiens
tgaaagctgattactgtc

SEQ ID NO: 1687383 - DNA, 22 bp, Homo sapiens
tgaaaggaagagctaataaatc

SEQ ID NO: 1687384 - DNA, 14 bp, Homo sapiens
tgaaaggagacatt

SEQ ID NO: 1687385 - DNA, 17 bp, Homo sapiens
tgaaaggccaacagcaa

SEQ ID NO: 1687386 - DNA, 16 bp, Homo sapiens
tgaaaggcctcaagaa

SEQ ID NO: 1687387 - DNA, 14 bp, Homo sapiens
tgaaagggaaactg

SEQ ID NO: 1687388 - DNA, 20 bp, Homo sapiens
tgaaagggagctatcaggaa

SEQ ID NO: 1687389 - DNA, 22 bp, Homo sapiens
tgaaagggagctatcaggaaca

SEQ ID NO: 1687390 - DNA, 20 bp, Homo sapiens
tgaaagggcccttcccctcc

SEQ ID NO: 1687391 - DNA, 15 bp, Homo sapiens
tgaaagggctatggc

SEQ ID NO: 1687392 - DNA, 22 bp, Homo sapiens
tgaaagggtttgtaatacttta

SEQ ID NO: 1687393 - DNA, 16 bp, Homo sapiens
tgaaaggtaatttgag

SEQ ID NO: 1687394 - DNA, 14 bp, Homo sapiens
tgaaagtacatttg

SEQ ID NO: 1687395 - DNA, 17 bp, Homo sapiens
tgaaagtagagctagct

SEQ ID NO: 1687396 - DNA, 15 bp, Homo sapiens
tgaaagtagggggct

SEQ ID NO: 1687397 - DNA, 11 bp, Homo sapiens
tgaaagtgact

SEQ ID NO: 1687398 - DNA, 17 bp, Homo sapiens
tgaaagtttgcactgta

SEQ ID NO: 1687399 - DNA, 15 bp, Homo sapiens
tgaaataaattctga

SEQ ID NO: 1687400 - DNA, 13 bp, Homo sapiens
tgaaataatatat

SEQ ID NO: 1687401 - DNA, 13 bp, Homo sapiens
tgaaataattaca

SEQ ID NO: 1687402 - DNA, 23 bp, Homo sapiens
tgaaataccacaagcctgagaac

SEQ ID NO: 1687403 - DNA, 16 bp, Homo sapiens
tgaaataccagtgtgg

SEQ ID NO: 1687404 - DNA, 16 bp, Homo sapiens
tgaaataccattatta

SEQ ID NO: 1687405 - DNA, 14 bp, Homo sapiens
tgaaatagtataca

SEQ ID NO: 1687406 - DNA, 16 bp, Homo sapiens
tgaaatagtatacatt

SEQ ID NO: 1687407 - DNA, 17 bp, Homo sapiens
tgaaatagtatacattg

SEQ ID NO: 1687408 - DNA, 13 bp, Homo sapiens
tgaaatatataat

SEQ ID NO: 1687409 - DNA, 13 bp, Homo sapiens
tgaaatatcatgt

SEQ ID NO: 1687410 - DNA, 16 bp, Homo sapiens
tgaaatattcagaaat

SEQ ID NO: 1687411 - DNA, 16 bp, Homo sapiens
tgaaatattttacagt

SEQ ID NO: 1687412 - DNA, 19 bp, Homo sapiens
tgaaatcaaatgtatgtat

SEQ ID NO: 1687413 - DNA, 14 bp, Homo sapiens
tgaaatcctgcttc

SEQ ID NO: 1687414 - DNA, 15 bp, Homo sapiens
tgaaatctgctagaa

SEQ ID NO: 1687415 - DNA, 18 bp, Homo sapiens
tgaaatctgctagaaagt

SEQ ID NO: 1687416 - DNA, 20 bp, Homo sapiens
tgaaatctgctagaaagtta

SEQ ID NO: 1687417 - DNA, 14 bp, Homo sapiens
tgaaatgaaaggga

SEQ ID NO: 1687418 - DNA, 17 bp, Homo sapiens
tgaaatgaaagggaaac

SEQ ID NO: 1687419 - DNA, 20 bp, Homo sapiens
tgaaatgagtaaaaactaga

SEQ ID NO: 1687420 - DNA, 21 bp, Homo sapiens
tgaaatgagtaaaaactagaa

SEQ ID NO: 1687421 - DNA, 23 bp, Homo sapiens
tgaaatgccactgggacagctgg

SEQ ID NO: 1687422 - DNA, 18 bp, Homo sapiens
tgaaatgctcttttgcac

SEQ ID NO: 1687423 - DNA, 20 bp, Homo sapiens
tgaaatgctcttttgcacaa

SEQ ID NO: 1687424 - DNA, 16 bp, Homo sapiens
tgaaatgctgaaaatt

SEQ ID NO: 1687425 - DNA, 16 bp, Homo sapiens
tgaaatgctggcattt

SEQ ID NO: 1687426 - DNA, 15 bp, Homo sapiens
tgaatcctaagggct

SEQ ID NO: 1687427 - DNA, 21 bp, Homo sapiens
tgaatcctctattaattactg

SEQ ID NO: 1687428 - DNA, 18 bp, Homo sapiens
tgaatccttccattccac

SEQ ID NO: 1687429 - DNA, 20 bp, Homo sapiens
tgaatccttttaatctagag

SEQ ID NO: 1687430 - DNA, 18 bp, Homo sapiens
tgaatcgatataggcatt

SEQ ID NO: 1687431 - DNA, 14 bp, Homo sapiens
tgaatctaaggata

SEQ ID NO: 1687432 - DNA, 15 bp, Homo sapiens
tgaatctatgccaaa

SEQ ID NO: 1687433 - DNA, 19 bp, Homo sapiens
tgaatctattatactgtat

SEQ ID NO: 1687434 - DNA, 20 bp, Homo sapiens
tgaatctcataatttataca

SEQ ID NO: 1687435 - DNA, 14 bp, Homo sapiens
tgaatctgattgca

SEQ ID NO: 1687436 - DNA, 16 bp, Homo sapiens
tgaatctgctcacttt

SEQ ID NO: 1687437 - DNA, 13 bp, Homo sapiens
tgaatcttaattt

SEQ ID NO: 1687438 - DNA, 19 bp, Homo sapiens
tgaatcttcacgacaatgt

SEQ ID NO: 1687439 - DNA, 13 bp, Homo sapiens
tgaatctttaatt

SEQ ID NO: 1687440 - DNA, 13 bp, Homo sapiens
tgaatctttgtgc

SEQ ID NO: 1687441 - DNA, 16 bp, Homo sapiens
tgaatgaagcagtatt

SEQ ID NO: 1687442 - DNA, 15 bp, Homo sapiens
tgaatgaataaaaca

SEQ ID NO: 1687443 - DNA, 21 bp, Homo sapiens
tgaatgacttccccaatatct

SEQ ID NO: 1687444 - DNA, 18 bp, Homo sapiens
tgaatgaggtcccaggca

SEQ ID NO: 1687445 - DNA, 16 bp, Homo sapiens
tgaatgatcctgtctc

SEQ ID NO: 1687446 - DNA, 15 bp, Homo sapiens
tgaatgatctctctg

SEQ ID NO: 1687447 - DNA, 14 bp, Homo sapiens
tgaatgatgagcct

SEQ ID NO: 1687448 - DNA, 19 bp, Homo sapiens
tgaatgcaccatggtcaaa

SEQ ID NO: 1687449 - DNA, 15 bp, Homo sapiens
tgaatgcagaaaaca

SEQ ID NO: 1687450 - DNA, 15 bp, Homo sapiens
tgaatgccactgcct

SEQ ID NO: 1687451 - DNA, 19 bp, Homo sapiens
tgaatgccatttagaatct

SEQ ID NO: 1687452 - DNA, 21 bp, Homo sapiens
tgaatgccatttagaatctag

SEQ ID NO: 1687453 - DNA, 13 bp, Homo sapiens
tgaatgcggccca

SEQ ID NO: 1687454 - DNA, 13 bp, Homo sapiens
tgaatgctgccac

SEQ ID NO: 1687455 - DNA, 12 bp, Homo sapiens
tgaatgctggga

SEQ ID NO: 1687456 - DNA, 14 bp, Homo sapiens
tgaatgctgggact

SEQ ID NO: 1687457 - DNA, 15 bp, Homo sapiens
tgaatgctgggactc

SEQ ID NO: 1687458 - DNA, 18 bp, Homo sapiens
tgaatggccctagaactg

SEQ ID NO: 1687459 - DNA, 17 bp, Homo sapiens
tgaatgggtccattttg

SEQ ID NO: 1687460 - DNA, 13 bp, Homo sapiens
tgaatggtatgga

SEQ ID NO: 1687461 - DNA, 22 bp, Homo sapiens
tgaatgtaaatttgtactattt

SEQ ID NO: 1687462 - DNA, 14 bp, Homo sapiens
tgaatgtactatgt

SEQ ID NO: 1687463 - DNA, 18 bp, Homo sapiens
tgaatgtagaataggcag

SEQ ID NO: 1687464 - DNA, 15 bp, Homo sapiens
tgaatgtatcaggaa

SEQ ID NO: 1687465 - DNA, 16 bp, Homo sapiens
tgaatgtatcaggaaa

SEQ ID NO: 1687466 - DNA, 17 bp, Homo sapiens
tgaatgtatttatttgg

SEQ ID NO: 1687467 - DNA, 19 bp, Homo sapiens
tgaatgtatttatttggga

SEQ ID NO: 1687468 - DNA, 20 bp, Homo sapiens
tgaatgtatttgatttataa

SEQ ID NO: 1687469 - DNA, 14 bp, Homo sapiens
tgaatgtgctggtg

SEQ ID NO: 1687470 - DNA, 17 bp, Homo sapiens
tgaatgtggttacttcc

SEQ ID NO: 1687471 - DNA, 18 bp, Homo sapiens
tgaatgtgtctggacctc

SEQ ID NO: 1687472 - DNA, 20 bp, Homo sapiens
tgaatgttcccaagtaggca

SEQ ID NO: 1687473 - DNA, 16 bp, Homo sapiens
tgaattaaaaaagctc

SEQ ID NO: 1687474 - DNA, 22 bp, Homo sapiens
tgaattaaaagtctacagcact

SEQ ID NO: 1687475 - DNA, 17 bp, Homo sapiens
tgaattaaataaaccct

SEQ ID NO: 1687476 - DNA, 15 bp, Homo sapiens
tgaattaaataaata

SEQ ID NO: 1687477 - DNA, 23 bp, Homo sapiens
tgaattaatcatctataaagaag

SEQ ID NO: 1687478 - DNA, 21 bp, Homo sapiens
tgaattaatgacagagccagt

SEQ ID NO: 1687479 - DNA, 19 bp, Homo sapiens
tgaattaattaatttggag

SEQ ID NO: 1687480 - DNA, 15 bp, Homo sapiens
tgaattaatttctaa

SEQ ID NO: 1687481 - DNA, 20 bp, Homo sapiens
tgaattactgtatataaact

SEQ ID NO: 1687482 - DNA, 18 bp, Homo sapiens
tgaattaggctaaaaggt

SEQ ID NO: 1687483 - DNA, 15 bp, Homo sapiens
tgaattagtatttca

SEQ ID NO: 1687484 - DNA, 15 bp, Homo sapiens
tgaattagtgagtat

SEQ ID NO: 1687485 - DNA, 15 bp, Homo sapiens
tgaattatatgttca

SEQ ID NO: 1687486 - DNA, 15 bp, Homo sapiens
tgaattatcagcaaa

SEQ ID NO: 1687487 - DNA, 14 bp, Homo sapiens
tgaattattgacac

SEQ ID NO: 1687488 - DNA, 17 bp, Homo sapiens
tgaattcactccagtca

SEQ ID NO: 1687489 - DNA, 15 bp, Homo sapiens
tgaattcataaaaat

SEQ ID NO: 1687490 - DNA, 19 bp, Homo sapiens
tgaattcataaaaataacc

SEQ ID NO: 1687491 - DNA, 13 bp, Homo sapiens
tgaattctttcaa

SEQ ID NO: 1687492 - DNA, 16 bp, Homo sapiens
tgaattgaagtttcaa

SEQ ID NO: 1687493 - DNA, 19 bp, Homo sapiens
tgaattgaagtttcaagtt

SEQ ID NO: 1687494 - DNA, 13 bp, Homo sapiens
tgaattgactacc

SEQ ID NO: 1687495 - DNA, 16 bp, Homo sapiens
tgaattggaagggaaa

SEQ ID NO: 1687496 - DNA, 18 bp, Homo sapiens
tgaattggaagggaaaaa

SEQ ID NO: 1687497 - DNA, 14 bp, Homo sapiens
tgaattggtgaata

SEQ ID NO: 1687498 - DNA, 13 bp, Homo sapiens
tgaattgtctttt

SEQ ID NO: 1687499 - DNA, 13 bp, Homo sapiens
tgaattgtgaaat

SEQ ID NO: 1687500 - DNA, 20 bp, Homo sapiens
tgaattgtgtattgatgcaa

SEQ ID NO: 1687501 - DNA, 17 bp, Homo sapiens
tgaatttaaataaagtt

SEQ ID NO: 1687502 - DNA, 18 bp, Homo sapiens
tgaatttaaataaagtta

SEQ ID NO: 1687503 - DNA, 14 bp, Homo sapiens
tgaatttaaatata

SEQ ID NO: 1687504 - DNA, 19 bp, Homo sapiens
tgaatttaaatataattct

SEQ ID NO: 1687505 - DNA, 20 bp, Homo sapiens
tgaatttaaatataattctg

SEQ ID NO: 1687506 - DNA, 17 bp, Homo sapiens
tgaatttacttccttgc

SEQ ID NO: 1687507 - DNA, 15 bp, Homo sapiens
tgaatttatctttga

SEQ ID NO: 1687508 - DNA, 14 bp, Homo sapiens
tgaatttctggaag

SEQ ID NO: 1687509 - DNA, 20 bp, Homo sapiens
tgaatttggcctgcactaat

SEQ ID NO: 1687510 - DNA, 21 bp, Homo sapiens
tgaatttggcctgcactaatt

SEQ ID NO: 1687511 - DNA, 22 bp, Homo sapiens
tgaattttaaagtatgcattat

SEQ ID NO: 1687512 - DNA, 17 bp, Homo sapiens
tgaattttaaatctaaa

SEQ ID NO: 1687513 - DNA, 17 bp, Homo sapiens
tgaattttcaaggcctt

SEQ ID NO: 1687514 - DNA, 21 bp, Homo sapiens
tgaattttcaaggccttcagt

SEQ ID NO: 1687515 - DNA, 11 bp, Homo sapiens
tgaattttcta

SEQ ID NO: 1687516 - DNA, 22 bp, Homo sapiens
tgaattttctgcagctgtttca

SEQ ID NO: 1687517 - DNA, 20 bp, Homo sapiens
tgaattttgagtctatccta

SEQ ID NO: 1687518 - DNA, 17 bp, Homo sapiens
tgaattttgcaatgtat

SEQ ID NO: 1687519 - DNA, 20 bp, Homo sapiens
tgaattttgttctctgggag

SEQ ID NO: 1687520 - DNA, 22 bp, Homo sapiens
tgaattttgttctctgggagaa

SEQ ID NO: 1687521 - DNA, 16 bp, Homo sapiens
tgaattttgttgctgt

SEQ ID NO: 1687522 - DNA, 21 bp, Homo sapiens
tgaattttgtttttattttca

SEQ ID NO: 1687523 - DNA, 15 bp, Homo sapiens
tgaatttttatttct

SEQ ID NO: 1687524 - DNA, 22 bp, Homo sapiens
tgaatttttctctaactcagaa

SEQ ID NO: 1687525 - DNA, 22 bp, Homo sapiens
tgaatttttttgtaataagcaa

SEQ ID NO: 1687526 - DNA, 20 bp, Homo sapiens
tgaattttttttaacattcc

SEQ ID NO: 1687527 - DNA, 18 bp, Homo sapiens
tgacaaaaaatgttttaa

SEQ ID NO: 1687528 - DNA, 21 bp, Homo sapiens
tgacaaaaaatgttttaaaga

SEQ ID NO: 1687529 - DNA, 19 bp, Homo sapiens
tgacaaaaagtttccatat

SEQ ID NO: 1687530 - DNA, 17 bp, Homo sapiens
tgacaaaacctaacttg

SEQ ID NO: 1687531 - DNA, 18 bp, Homo sapiens
tgacaaaagatacaaaag

SEQ ID NO: 1687532 - DNA, 19 bp, Homo sapiens
tgacaaactggcaggtacc

SEQ ID NO: 1687533 - DNA, 17 bp, Homo sapiens
tgacaaagaaacccaag

SEQ ID NO: 1687534 - DNA, 16 bp, Homo sapiens
tgacaaaggtggtaaa

SEQ ID NO: 1687535 - DNA, 17 bp, Homo sapiens
tgacaaaggtggtaaat

SEQ ID NO: 1687536 - DNA, 20 bp, Homo sapiens
tgacaaaggtggtaaattca

SEQ ID NO: 1687537 - DNA, 19 bp, Homo sapiens
tgacaaatgtttctaaggt

SEQ ID NO: 1687538 - DNA, 14 bp, Homo sapiens
tgacaacagaaaaa

SEQ ID NO: 1687539 - DNA, 15 bp, Homo sapiens
tgacaacatcccaca

SEQ ID NO: 1687540 - DNA, 16 bp, Homo sapiens
tgacaaccattaaagt

SEQ ID NO: 1687541 - DNA, 15 bp, Homo sapiens
tgagagaatggagac

SEQ ID NO: 1687542 - DNA, 16 bp, Homo sapiens
tgagagacctctgcct

SEQ ID NO: 1687543 - DNA, 18 bp, Homo sapiens
tgagagacgccctatttc

SEQ ID NO: 1687544 - DNA, 19 bp, Homo sapiens
tgagagacgccctatttct

SEQ ID NO: 1687545 - DNA, 22 bp, Homo sapiens
tgagagagaatagagctgccac

SEQ ID NO: 1687546 - DNA, 23 bp, Homo sapiens
tgagagagaatagagctgccact

SEQ ID NO: 1687547 - DNA, 14 bp, Homo sapiens
tgagagagacaaga

SEQ ID NO: 1687548 - DNA, 12 bp, Homo sapiens
tgagagagactg

SEQ ID NO: 1687549 - DNA, 17 bp, Homo sapiens
tgagagagactgatggg

SEQ ID NO: 1687550 - DNA, 14 bp, Homo sapiens
tgagagcagatgcc

SEQ ID NO: 1687551 - DNA, 15 bp, Homo sapiens
tgagagccagcagca

SEQ ID NO: 1687552 - DNA, 15 bp, Homo sapiens
tgagagctgctgagg

SEQ ID NO: 1687553 - DNA, 20 bp, Homo sapiens
tgagaggcaatgattgttaa

SEQ ID NO: 1687554 - DNA, 18 bp, Homo sapiens
tgagaggcagacttccct

SEQ ID NO: 1687555 - DNA, 12 bp, Homo sapiens
tgagaggcaggc

SEQ ID NO: 1687556 - DNA, 17 bp, Homo sapiens
tgagaggcctggagccc

SEQ ID NO: 1687557 - DNA, 19 bp, Homo sapiens
tgagaggcgagctccttga

SEQ ID NO: 1687558 - DNA, 14 bp, Homo sapiens
tgaggcagacagca

SEQ ID NO: 1687559 - DNA, 15 bp, Homo sapiens
tgaggcagacagcag

SEQ ID NO: 1687560 - DNA, 20 bp, Homo sapiens
tgaggcagacagcagctcag

SEQ ID NO: 1687561 - DNA, 19 bp, Homo sapiens
tgaggcattcggggaagct

SEQ ID NO: 1687562 - DNA, 19 bp, Homo sapiens
tgaggccaagatggctgct

SEQ ID NO: 1687563 - DNA, 21 bp, Homo sapiens
tgaggccaagatggctgctgc

SEQ ID NO: 1687564 - DNA, 23 bp, Homo sapiens
tgaggccaagatggctgctgcct

SEQ ID NO: 1687565 - DNA, 13 bp, Homo sapiens
tgaggccacccac

SEQ ID NO: 1687566 - DNA, 16 bp, Homo sapiens
tgaggccatctcagga

SEQ ID NO: 1687567 - DNA, 21 bp, Homo sapiens
tgaggcccccgtcagggagag

SEQ ID NO: 1687568 - DNA, 21 bp, Homo sapiens
tgaggcccctaggtgcccagg

SEQ ID NO: 1687569 - DNA, 23 bp, Homo sapiens
tgaggccgctagaggcctgagga

SEQ ID NO: 1687570 - DNA, 14 bp, Homo sapiens
tgaggcctcatccc

SEQ ID NO: 1687571 - DNA, 13 bp, Homo sapiens
tgaggcctgcttc

SEQ ID NO: 1687572 - DNA, 11 bp, Homo sapiens
tgaggcctgga

SEQ ID NO: 1687573 - DNA, 17 bp, Homo sapiens
tgaggcctggactttcc

SEQ ID NO: 1687574 - DNA, 18 bp, Homo sapiens
tgaggccttgtgtgtcag

SEQ ID NO: 1687575 - DNA, 20 bp, Homo sapiens
tgaggctatggagggtcctc

SEQ ID NO: 1687576 - DNA, 18 bp, Homo sapiens
tgaggctctttctgggcc

SEQ ID NO: 1687577 - DNA, 18 bp, Homo sapiens
tgaggctgacatgctcac

SEQ ID NO: 1687578 - DNA, 13 bp, Homo sapiens
tgaggctgagact

SEQ ID NO: 1687579 - DNA, 12 bp, Homo sapiens
tgaggctgcagc

SEQ ID NO: 1687580 - DNA, 15 bp, Homo sapiens
tgaggctgctgccat

SEQ ID NO: 1687581 - DNA, 16 bp, Homo sapiens
tgaggctgctgccatc

SEQ ID NO: 1687582 - DNA, 18 bp, Homo sapiens
tgaggcttaggcctctct

SEQ ID NO: 1687583 - DNA, 20 bp, Homo sapiens
tgaggcttccaggctcttcc

SEQ ID NO: 1687584 - DNA, 19 bp, Homo sapiens
tgaggcttctccttctcct

SEQ ID NO: 1687585 - DNA, 17 bp, Homo sapiens
tgagggaacagacagga

SEQ ID NO: 1687586 - DNA, 22 bp, Homo sapiens
tgagggaacagacaggagaaat

SEQ ID NO: 1687587 - DNA, 21 bp, Homo sapiens
tgagggaaggagcccagccag

SEQ ID NO: 1687588 - DNA, 15 bp, Homo sapiens
tgagggaatccattg

SEQ ID NO: 1687589 - DNA, 15 bp, Homo sapiens
tgagggacagagccc

SEQ ID NO: 1687590 - DNA, 13 bp, Homo sapiens
tgagggaccagcc

SEQ ID NO: 1687591 - DNA, 18 bp, Homo sapiens
tgagggaccagccaagag

SEQ ID NO: 1687592 - DNA, 18 bp, Homo sapiens
tgagggagaatcctccct

SEQ ID NO: 1687593 - DNA, 23 bp, Homo sapiens
tgagggagaatcctcccttccca

SEQ ID NO: 1687594 - DNA, 13 bp, Homo sapiens
tgagggaggaggc

SEQ ID NO: 1687595 - DNA, 18 bp, Homo sapiens
tgagggaggaggccacct

SEQ ID NO: 1687596 - DNA, 14 bp, Homo sapiens
tgagggaggggaaa

SEQ ID NO: 1687597 - DNA, 14 bp, Homo sapiens
tgagggagttaggg

SEQ ID NO: 1687598 - DNA, 21 bp, Homo sapiens
tgagggagttagggagagaga

SEQ ID NO: 1687599 - DNA, 13 bp, Homo sapiens
tgagggccaagag

SEQ ID NO: 1687600 - DNA, 21 bp, Homo sapiens
tgagggccactttttttttat

SEQ ID NO: 1687601 - DNA, 16 bp, Homo sapiens
tgagggccagggaccc

SEQ ID NO: 1687602 - DNA, 18 bp, Homo sapiens
tgagggccagggacccag

SEQ ID NO: 1687603 - DNA, 16 bp, Homo sapiens
tgagggcccagccagg

SEQ ID NO: 1687604 - DNA, 19 bp, Homo sapiens
tgagggcccagccaggagc

SEQ ID NO: 1687605 - DNA, 19 bp, Homo sapiens
tgagggcctgctggaggcc

SEQ ID NO: 1687606 - DNA, 18 bp, Homo sapiens
tgaggggccctggccagg

SEQ ID NO: 1687607 - DNA, 15 bp, Homo sapiens
tgaggggctcctgga

SEQ ID NO: 1687608 - DNA, 14 bp, Homo sapiens
tgaggggctttctc

SEQ ID NO: 1687609 - DNA, 15 bp, Homo sapiens
tgaggggctttctct

SEQ ID NO: 1687610 - DNA, 11 bp, Homo sapiens
tgaggggtctc

SEQ ID NO: 1687611 - DNA, 18 bp, Homo sapiens
tgagggtccacctggaga

SEQ ID NO: 1687612 - DNA, 12 bp, Homo sapiens
tgagggtgactg

SEQ ID NO: 1687613 - DNA, 20 bp, Homo sapiens
tgagggtgccccgcctgagt

SEQ ID NO: 1687614 - DNA, 22 bp, Homo sapiens
tgagggtgccccgcctgagtca

SEQ ID NO: 1687615 - DNA, 19 bp, Homo sapiens
tgagggtgcccttttccag

SEQ ID NO: 1687616 - DNA, 14 bp, Homo sapiens
tgagggtggagact

SEQ ID NO: 1687617 - DNA, 15 bp, Homo sapiens
tgagggttttctcat

SEQ ID NO: 1687618 - DNA, 16 bp, Homo sapiens
tgaggtattttttcct

SEQ ID NO: 1687619 - DNA, 13 bp, Homo sapiens
tgaggtcaccagg

SEQ ID NO: 1687620 - DNA, 16 bp, Homo sapiens
tgaggtcaccagggga

SEQ ID NO: 1687621 - DNA, 22 bp, Homo sapiens
tgaggtcaccaggggaggagcc

SEQ ID NO: 1687622 - DNA, 14 bp, Homo sapiens
tgaggtcactgcta

SEQ ID NO: 1687623 - DNA, 15 bp, Homo sapiens
tgaggtcactgctag

SEQ ID NO: 1687624 - DNA, 16 bp, Homo sapiens
tgaggtcaggagttcc

SEQ ID NO: 1687625 - DNA, 19 bp, Homo sapiens
tgaggtcccaggcagagaa

SEQ ID NO: 1687626 - DNA, 15 bp, Homo sapiens
tgaggtctgaaatgg

SEQ ID NO: 1687627 - DNA, 17 bp, Homo sapiens
tgaggtgaaagggagct

SEQ ID NO: 1687628 - DNA, 18 bp, Homo sapiens
tgaggtgaaagggagcta

SEQ ID NO: 1687629 - DNA, 17 bp, Homo sapiens
tgaggtgaaatgggaga

SEQ ID NO: 1687630 - DNA, 14 bp, Homo sapiens
tgaggtgcctgtcc

SEQ ID NO: 1687631 - DNA, 18 bp, Homo sapiens
tgaggtgctgatgagtga

SEQ ID NO: 1687632 - DNA, 15 bp, Homo sapiens
tgaggtggaagccct

SEQ ID NO: 1687633 - DNA, 22 bp, Homo sapiens
tgaggtggaagccctccttcca

SEQ ID NO: 1687634 - DNA, 22 bp, Homo sapiens
tgaggtgggaggtggaagaagg

SEQ ID NO: 1687635 - DNA, 14 bp, Homo sapiens
tgaggtgggcccag

SEQ ID NO: 1687636 - DNA, 16 bp, Homo sapiens
tgaggtgggcccagga

SEQ ID NO: 1687637 - DNA, 15 bp, Homo sapiens
tgaggtgtgggggct

SEQ ID NO: 1687638 - DNA, 23 bp, Homo sapiens
tgaggtgtgggggctgcagcatg

SEQ ID NO: 1687639 - DNA, 14 bp, Homo sapiens
tgaggttcctctgc

SEQ ID NO: 1687640 - DNA, 21 bp, Homo sapiens
tgaggttcctctgcctgcccc

SEQ ID NO: 1687641 - DNA, 22 bp, Homo sapiens
tgaggttttatttcatttttca

SEQ ID NO: 1687642 - DNA, 14 bp, Homo sapiens
tgagtaaacataaa

SEQ ID NO: 1687643 - DNA, 21 bp, Homo sapiens
tgagtaaaggagtaagaacct

SEQ ID NO: 1687644 - DNA, 10 bp, Homo sapiens
tgagtaacat

SEQ ID NO: 1687645 - DNA, 19 bp, Homo sapiens
tgagtaactggttgctgtg

SEQ ID NO: 1687646 - DNA, 14 bp, Homo sapiens
tgagtaagagctgg

SEQ ID NO: 1687647 - DNA, 23 bp, Homo sapiens
tgataataggtgggggaaaatga

SEQ ID NO: 1687648 - DNA, 22 bp, Homo sapiens
tgataatattagtgattctgat

SEQ ID NO: 1687649 - DNA, 21 bp, Homo sapiens
tgataatctggtgacaaatat

SEQ ID NO: 1687650 - DNA, 18 bp, Homo sapiens
tgataatgatgatgacga

SEQ ID NO: 1687651 - DNA, 13 bp, Homo sapiens
tgataattttgct

SEQ ID NO: 1687652 - DNA, 23 bp, Homo sapiens
tgatacactatgaagatgtttca

SEQ ID NO: 1687653 - DNA, 18 bp, Homo sapiens
tgatacactgtatctaaa

SEQ ID NO: 1687654 - DNA, 19 bp, Homo sapiens
tgatacactgtatctaaaa

SEQ ID NO: 1687655 - DNA, 13 bp, Homo sapiens
tgatacataataa

SEQ ID NO: 1687656 - DNA, 18 bp, Homo sapiens
tgatacattttttaagct

SEQ ID NO: 1687657 - DNA, 18 bp, Homo sapiens
tgataccacctttactgt

SEQ ID NO: 1687658 - DNA, 19 bp, Homo sapiens
tgataccacctttactgtg

SEQ ID NO: 1687659 - DNA, 21 bp, Homo sapiens
tgataccagaagggaaagctt

SEQ ID NO: 1687660 - DNA, 18 bp, Homo sapiens
tgatacccccctctgtct

SEQ ID NO: 1687661 - DNA, 16 bp, Homo sapiens
tgatacgatgcttcaa

SEQ ID NO: 1687662 - DNA, 23 bp, Homo sapiens
tgatacgtccgtgtgtcccagat

SEQ ID NO: 1687663 - DNA, 18 bp, Homo sapiens
tgatactatccagttact

SEQ ID NO: 1687664 - DNA, 13 bp, Homo sapiens
tgatactgatggt

SEQ ID NO: 1687665 - DNA, 21 bp, Homo sapiens
tgatactgtgtgttttcccaa

SEQ ID NO: 1687666 - DNA, 15 bp, Homo sapiens
tgatacttcaggtgc

SEQ ID NO: 1687667 - DNA, 18 bp, Homo sapiens
tgatactttagccatcat

SEQ ID NO: 1687668 - DNA, 16 bp, Homo sapiens
tgatagaactgtactg

SEQ ID NO: 1687669 - DNA, 17 bp, Homo sapiens
tgatagaactgtactgt

SEQ ID NO: 1687670 - DNA, 22 bp, Homo sapiens
tgatagaactgtactgttttct

SEQ ID NO: 1687671 - DNA, 21 bp, Homo sapiens
tgatagaatgatgttttaaaa

SEQ ID NO: 1687672 - DNA, 13 bp, Homo sapiens
tgatagcattgct

SEQ ID NO: 1687673 - DNA, 23 bp, Homo sapiens
tgatagctttattttttaagtat

SEQ ID NO: 1687674 - DNA, 14 bp, Homo sapiens
tgatagttgtgtgt

SEQ ID NO: 1687675 - DNA, 16 bp, Homo sapiens
tgatataaatgcaata

SEQ ID NO: 1687676 - DNA, 15 bp, Homo sapiens
tgatatacattgtgt

SEQ ID NO: 1687677 - DNA, 18 bp, Homo sapiens
tgatatacattgtgtgaa

SEQ ID NO: 1687678 - DNA, 15 bp, Homo sapiens
tgatataccaaatta

SEQ ID NO: 1687679 - DNA, 15 bp, Homo sapiens
tgatctacatgagga

SEQ ID NO: 1687680 - DNA, 18 bp, Homo sapiens
tgatctacttctgtaatt

SEQ ID NO: 1687681 - DNA, 18 bp, Homo sapiens
tgatctagtccttgtctt

SEQ ID NO: 1687682 - DNA, 20 bp, Homo sapiens
tgatctattgctcatcagct

SEQ ID NO: 1687683 - DNA, 18 bp, Homo sapiens
tgatctcagctcactgca

SEQ ID NO: 1687684 - DNA, 14 bp, Homo sapiens
tgatctcaggagct

SEQ ID NO: 1687685 - DNA, 21 bp, Homo sapiens
tgatctcagggaagcccagct

SEQ ID NO: 1687686 - DNA, 22 bp, Homo sapiens
tgatctcagggaagcccagctc

SEQ ID NO: 1687687 - DNA, 19 bp, Homo sapiens
tgatctccatatgttacac

SEQ ID NO: 1687688 - DNA, 12 bp, Homo sapiens
tgatctcccctc

SEQ ID NO: 1687689 - DNA, 13 bp, Homo sapiens
tgatctccctgcc

SEQ ID NO: 1687690 - DNA, 16 bp, Homo sapiens
tgatctccctgccgcc

SEQ ID NO: 1687691 - DNA, 17 bp, Homo sapiens
tgatctccctgccgcct

SEQ ID NO: 1687692 - DNA, 20 bp, Homo sapiens
tgatctcccttggtcttcca

SEQ ID NO: 1687693 - DNA, 15 bp, Homo sapiens
tgatctcggatgacc

SEQ ID NO: 1687694 - DNA, 21 bp, Homo sapiens
tgatctctactaccacaagga

SEQ ID NO: 1687695 - DNA, 23 bp, Homo sapiens
tgatctctactaccacaaggaaa

SEQ ID NO: 1687696 - DNA, 20 bp, Homo sapiens
tgatctctcagccccaaaca

SEQ ID NO: 1687697 - DNA, 23 bp, Homo sapiens
tgatctctgttacaaaagaaaaa

SEQ ID NO: 1687698 - DNA, 17 bp, Homo sapiens
tgatctgagtcccagga

SEQ ID NO: 1687699 - DNA, 15 bp, Homo sapiens
tgatctggaacccag

SEQ ID NO: 1687700 - DNA, 15 bp, Homo sapiens
tgatctggacttcct

SEQ ID NO: 1687701 - DNA, 18 bp, Homo sapiens
tgatctgtagacttctgg

SEQ ID NO: 1687702 - DNA, 20 bp, Homo sapiens
tgatcttctgggagcaggaa

SEQ ID NO: 1687703 - DNA, 19 bp, Homo sapiens
tgatcttgtgctcagcatg

SEQ ID NO: 1687704 - DNA, 18 bp, Homo sapiens
tgatcttgttactgtgat

SEQ ID NO: 1687705 - DNA, 23 bp, Homo sapiens
tgatcttgttactgtgatatttt

SEQ ID NO: 1687706 - DNA, 14 bp, Homo sapiens
tgatctttaaaata

SEQ ID NO: 1687707 - DNA, 19 bp, Homo sapiens
tgatcttttaaaatcatga

SEQ ID NO: 1687708 - DNA, 17 bp, Homo sapiens
tgatcttttaaagtgtt

SEQ ID NO: 1687709 - DNA, 18 bp, Homo sapiens
tgatcttttaaagtgtta

SEQ ID NO: 1687710 - DNA, 16 bp, Homo sapiens
tgatgaaaagctttgt

SEQ ID NO: 1687711 - DNA, 22 bp, Homo sapiens
tgatgaaaagctttgtttgttc

SEQ ID NO: 1687712 - DNA, 17 bp, Homo sapiens
tgatgaaaataattttc

SEQ ID NO: 1687713 - DNA, 20 bp, Homo sapiens
tgatgaaaataattttccaa

SEQ ID NO: 1687714 - DNA, 20 bp, Homo sapiens
tgatgaaactcctgattttg

SEQ ID NO: 1687715 - DNA, 11 bp, Homo sapiens
tgatgaaagct

SEQ ID NO: 1687716 - DNA, 15 bp, Homo sapiens
tgatgaaagctgatt

SEQ ID NO: 1687717 - DNA, 12 bp, Homo sapiens
tgatgaaatctg

SEQ ID NO: 1687718 - DNA, 17 bp, Homo sapiens
tgatgaaattcttgaag

SEQ ID NO: 1687719 - DNA, 16 bp, Homo sapiens
tgaggagcgtggactc

SEQ ID NO: 1687720 - DNA, 24 bp, Homo sapiens
tgaggagcgtggactctgctagac

SEQ ID NO: 1687721 - DNA, 11 bp, Homo sapiens
tgaggagctgg

SEQ ID NO: 1687722 - DNA, 15 bp, Homo sapiens
tgaggaggaaaagga

SEQ ID NO: 1687723 - DNA, 20 bp, Homo sapiens
tgaggaggaaaaggaaaaaa

SEQ ID NO: 1687724 - DNA, 16 bp, Homo sapiens
tgaggaggaggacaca

SEQ ID NO: 1687725 - DNA, 17 bp, Homo sapiens
tgaggaggaggacacag

SEQ ID NO: 1687726 - DNA, 16 bp, Homo sapiens
tgaggaggggagggta

SEQ ID NO: 1687727 - DNA, 17 bp, Homo sapiens
tgaggagggtggaggaa

SEQ ID NO: 1687728 - DNA, 17 bp, Homo sapiens
tgaggagggtgggggag

SEQ ID NO: 1687729 - DNA, 15 bp, Homo sapiens
tgaggagtaaaattc

SEQ ID NO: 1687730 - DNA, 20 bp, Homo sapiens
tgaggagttgcctgactcct

SEQ ID NO: 1687731 - DNA, 20 bp, Homo sapiens
tgaggatagtagttaaataa

SEQ ID NO: 1687732 - DNA, 20 bp, Homo sapiens
tgaggatatattttcacttt

SEQ ID NO: 1687733 - DNA, 15 bp, Homo sapiens
tgaggatgagctgga

SEQ ID NO: 1687734 - DNA, 13 bp, Homo sapiens
tgaggatgctgca

SEQ ID NO: 1687735 - DNA, 23 bp, Homo sapiens
tgaggatgctgcagtgaggctgt

SEQ ID NO: 1687736 - DNA, 14 bp, Homo sapiens
tgaggattgtggaa

SEQ ID NO: 1687737 - DNA, 20 bp, Homo sapiens
tgaggattgtggaaaaccag

SEQ ID NO: 1687738 - DNA, 16 bp, Homo sapiens
tgaggcaatgtcagga

SEQ ID NO: 1687739 - DNA, 17 bp, Homo sapiens
tgaggcaatgtcaggaa

SEQ ID NO: 1687740 - DNA, 17 bp, Homo sapiens
tgaggcaccgtccaggc

SEQ ID NO: 1687741 - DNA, 18 bp, Homo sapiens
tgaggcagaagaattgaa

SEQ ID NO: 1687742 - DNA, 13 bp, Homo sapiens
tgaggcagacagc

SEQ ID NO: 1687743 - DNA, 17 bp, Homo sapiens
tgattttttttaattac

SEQ ID NO: 1687744 - DNA, 14 bp, Homo sapiens
tgcaaaaaaagcct

SEQ ID NO: 1687745 - DNA, 18 bp, Homo sapiens
tgcaaaaaaagcctccaa

SEQ ID NO: 1687746 - DNA, 14 bp, Homo sapiens
tgcaaaaaatctta

SEQ ID NO: 1687747 - DNA, 21 bp, Homo sapiens
tgcaaaaaatcttaatactgt

SEQ ID NO: 1687748 - DNA, 21 bp, Homo sapiens
tgcaaaaactctttgagaggg

SEQ ID NO: 1687749 - DNA, 18 bp, Homo sapiens
tgcaaaaagcttctgtgg

SEQ ID NO: 1687750 - DNA, 15 bp, Homo sapiens
tgcaaaaataaccaa

SEQ ID NO: 1687751 - DNA, 18 bp, Homo sapiens
tgcaaaaatccaaatatt

SEQ ID NO: 1687752 - DNA, 22 bp, Homo sapiens
tgcaaaaatccaaatattgtta

SEQ ID NO: 1687753 - DNA, 13 bp, Homo sapiens
tgcaaaaatgagt

SEQ ID NO: 1687754 - DNA, 19 bp, Homo sapiens
tgcaaaagcagctaaatgt

SEQ ID NO: 1687755 - DNA, 23 bp, Homo sapiens
tgcaaaaggttcactaaagcagt

SEQ ID NO: 1687756 - DNA, 16 bp, Homo sapiens
tgcaaaatagacatct

SEQ ID NO: 1687757 - DNA, 14 bp, Homo sapiens
tgcaaaattgtttt

SEQ ID NO: 1687758 - DNA, 15 bp, Homo sapiens
tgcaaaattgttttc

SEQ ID NO: 1687759 - DNA, 18 bp, Homo sapiens
tgcaaaattgttttcact

SEQ ID NO: 1687760 - DNA, 14 bp, Homo sapiens
tgcaaaatttccag

SEQ ID NO: 1687761 - DNA, 15 bp, Homo sapiens
tgcaaaatttccagt

SEQ ID NO: 1687762 - DNA, 19 bp, Homo sapiens
tgcaaaatttttttaatct

SEQ ID NO: 1687763 - DNA, 23 bp, Homo sapiens
tgcaaacaggttgttttctactt

SEQ ID NO: 1687764 - DNA, 16 bp, Homo sapiens
tgcaaacattggaaga

SEQ ID NO: 1687765 - DNA, 17 bp, Homo sapiens
tgcaaacctcatctttc

SEQ ID NO: 1687766 - DNA, 16 bp, Homo sapiens
tgcaaactcactgctc

SEQ ID NO: 1687767 - DNA, 18 bp, Homo sapiens
tgcaaagcactgacttct

SEQ ID NO: 1687768 - DNA, 22 bp, Homo sapiens
tgcaaagcttttgcctgcaaga

SEQ ID NO: 1687769 - DNA, 17 bp, Homo sapiens
tgcaaatagtagacatt

SEQ ID NO: 1687770 - DNA, 18 bp, Homo sapiens
tgcaaatagtagacattt

SEQ ID NO: 1687771 - DNA, 20 bp, Homo sapiens
tgcaaatagtagacatttgt

SEQ ID NO: 1687772 - DNA, 19 bp, Homo sapiens
tgcaaatagtttcaaatga

SEQ ID NO: 1687773 - DNA, 21 bp, Homo sapiens
tgcaaatctgccaagagagat

SEQ ID NO: 1687774 - DNA, 21 bp, Homo sapiens
tgcaaatgagctctgaaatct

SEQ ID NO: 1687775 - DNA, 19 bp, Homo sapiens
tgcaaatgcacatttgtca

SEQ ID NO: 1687776 - DNA, 21 bp, Homo sapiens
tgcaaatgctatgagatgcat

SEQ ID NO: 1687777 - DNA, 15 bp, Homo sapiens
tgcaaatgctgtatt

SEQ ID NO: 1687778 - DNA, 22 bp, Homo sapiens
tgcaaatgtcagatacaatgta

SEQ ID NO: 1687779 - DNA, 21 bp, Homo sapiens
tgcaaattcaagagcctcccc

SEQ ID NO: 1687780 - DNA, 23 bp, Homo sapiens
tgcaaattcaagagcctcccctg

SEQ ID NO: 1687781 - DNA, 16 bp, Homo sapiens
tgcaacaaaatacatt

SEQ ID NO: 1687782 - DNA, 13 bp, Homo sapiens
tgcaacaaaattc

SEQ ID NO: 1687783 - DNA, 16 bp, Homo sapiens
tgcaacatttgacaaa

SEQ ID NO: 1687784 - DNA, 16 bp, Homo sapiens
tgcaaccaagtcacac

SEQ ID NO: 1687785 - DNA, 17 bp, Homo sapiens
tgcaaccaagtcacacg

SEQ ID NO: 1687786 - DNA, 17 bp, Homo sapiens
tgcaaccaattgaaaag

SEQ ID NO: 1687787 - DNA, 11 bp, Homo sapiens
tgcaaccactg

SEQ ID NO: 1687788 - DNA, 12 bp, Homo sapiens
tgcaaccaggaa

SEQ ID NO: 1687789 - DNA, 13 bp, Homo sapiens
tgcaaccccccag

SEQ ID NO: 1687790 - DNA, 15 bp, Homo sapiens
tgcaacccttacccc

SEQ ID NO: 1687791 - DNA, 19 bp, Homo sapiens
tgcaacctcacctcccggg

SEQ ID NO: 1687792 - DNA, 14 bp, Homo sapiens
tgcaacctctgcct

SEQ ID NO: 1687793 - DNA, 21 bp, Homo sapiens
tgcaactcttttaagtgcctt

SEQ ID NO: 1687794 - DNA, 19 bp, Homo sapiens
tgcaactggagttccttat

SEQ ID NO: 1687795 - DNA, 14 bp, Homo sapiens
tgcaacttctttct

SEQ ID NO: 1687796 - DNA, 17 bp, Homo sapiens
tgattaacatctacaat

SEQ ID NO: 1687797 - DNA, 13 bp, Homo sapiens
tgattaacttgga

SEQ ID NO: 1687798 - DNA, 18 bp, Homo sapiens
tgattaataagaacttga

SEQ ID NO: 1687799 - DNA, 20 bp, Homo sapiens
tgattactggcctttttcat

SEQ ID NO: 1687800 - DNA, 21 bp, Homo sapiens
tgattactggcctttttcatt

SEQ ID NO: 1687801 - DNA, 17 bp, Homo sapiens
tgattactgtcaataaa

SEQ ID NO: 1687802 - DNA, 23 bp, Homo sapiens
tgattagagctgcataatgtccc

SEQ ID NO: 1687803 - DNA, 20 bp, Homo sapiens
tgattagagtgcaaaagtga

SEQ ID NO: 1687804 - DNA, 15 bp, Homo sapiens
tgattagataaagat

SEQ ID NO: 1687805 - DNA, 13 bp, Homo sapiens
tgattagcaagtt

SEQ ID NO: 1687806 - DNA, 18 bp, Homo sapiens
tgattagcaagttacagt

SEQ ID NO: 1687807 - DNA, 21 bp, Homo sapiens
tgattatagcaactaatgttt

SEQ ID NO: 1687808 - DNA, 14 bp, Homo sapiens
tgattatcttcagc

SEQ ID NO: 1687809 - DNA, 15 bp, Homo sapiens
tgattatcttcagcc

SEQ ID NO: 1687810 - DNA, 19 bp, Homo sapiens
tgattatcttcagcccagg

SEQ ID NO: 1687811 - DNA, 16 bp, Homo sapiens
tgattatgtatggata

SEQ ID NO: 1687812 - DNA, 17 bp, Homo sapiens
tgattatgtatggatat

SEQ ID NO: 1687813 - DNA, 16 bp, Homo sapiens
tgattattatgtttat

SEQ ID NO: 1687814 - DNA, 14 bp, Homo sapiens
tgattattgaatgt

SEQ ID NO: 1687815 - DNA, 22 bp, Homo sapiens
tgattatttaaaaagagaaagt

SEQ ID NO: 1687816 - DNA, 16 bp, Homo sapiens
tgattatttatgacct

SEQ ID NO: 1687817 - DNA, 16 bp, Homo sapiens
tgattatttattattt

SEQ ID NO: 1687818 - DNA, 16 bp, Homo sapiens
tgattatttcacttta

SEQ ID NO: 1687819 - DNA, 23 bp, Homo sapiens
tgattatttcactttagatgctg

SEQ ID NO: 1687820 - DNA, 13 bp, Homo sapiens
tgattatttgtat

SEQ ID NO: 1687821 - DNA, 13 bp, Homo sapiens
tgattattttctt

SEQ ID NO: 1687822 - DNA, 18 bp, Homo sapiens
tgattattttttttttct

SEQ ID NO: 1687823 - DNA, 22 bp, Homo sapiens
tgattcaaagtgttgtgttcct

SEQ ID NO: 1687824 - DNA, 18 bp, Homo sapiens
tgattcaaattgctgctt

SEQ ID NO: 1687825 - DNA, 19 bp, Homo sapiens
tgattcaaattgctgcttg

SEQ ID NO: 1687826 - DNA, 12 bp, Homo sapiens
tgattcaacagg

SEQ ID NO: 1687827 - DNA, 22 bp, Homo sapiens
tgattcaagaacaagcaatgat

SEQ ID NO: 1687828 - DNA, 21 bp, Homo sapiens
tgattcaatctgtaaactgtg

SEQ ID NO: 1687829 - DNA, 13 bp, Homo sapiens
tgattcacctctt

SEQ ID NO: 1687830 - DNA, 15 bp, Homo sapiens
tgattcacctcttcc

SEQ ID NO: 1687831 - DNA, 16 bp, Homo sapiens
tgattcacctcttctt

SEQ ID NO: 1687832 - DNA, 12 bp, Homo sapiens
tgattcactgca

SEQ ID NO: 1687833 - DNA, 14 bp, Homo sapiens
tgattcagaaattg

SEQ ID NO: 1687834 - DNA, 16 bp, Homo sapiens
tgattcagaaattgga

SEQ ID NO: 1687835 - DNA, 17 bp, Homo sapiens
tgattcagcaggccctt

SEQ ID NO: 1687836 - DNA, 16 bp, Homo sapiens
tgattcagcagtgcct

SEQ ID NO: 1687837 - DNA, 23 bp, Homo sapiens
tgattcatcctgggatgtaaacc

SEQ ID NO: 1687838 - DNA, 15 bp, Homo sapiens
tgattccaaatatgt

SEQ ID NO: 1687839 - DNA, 20 bp, Homo sapiens
tgattccactacacctggct

SEQ ID NO: 1687840 - DNA, 23 bp, Homo sapiens
tgattccactacacctggctgag

SEQ ID NO: 1687841 - DNA, 12 bp, Homo sapiens
tgattcccaccc

SEQ ID NO: 1687842 - DNA, 23 bp, Homo sapiens
tgattccttttgatggggagaaa

SEQ ID NO: 1687843 - DNA, 17 bp, Homo sapiens
tgattcgtatgatcagt

SEQ ID NO: 1687844 - DNA, 14 bp, Homo sapiens
tgattctccttcag

SEQ ID NO: 1687845 - DNA, 12 bp, Homo sapiens
tgattctctgtg

SEQ ID NO: 1687846 - DNA, 13 bp, Homo sapiens
tgattctgatttc

SEQ ID NO: 1687847 - DNA, 12 bp, Homo sapiens
tgattctgcctt

SEQ ID NO: 1687848 - DNA, 17 bp, Homo sapiens
tgattctgcttttacca

SEQ ID NO: 1687849 - DNA, 17 bp, Homo sapiens
tgattctggctttaagc

SEQ ID NO: 1687850 - DNA, 17 bp, Homo sapiens
tgattcttgattcctgg

SEQ ID NO: 1687851 - DNA, 19 bp, Homo sapiens
tgattctttgttacaggca

SEQ ID NO: 1687852 - DNA, 17 bp, Homo sapiens
tgattgaaaagaagaaa

SEQ ID NO: 1687853 - DNA, 14 bp, Homo sapiens
tgattgaattctaa

SEQ ID NO: 1687854 - DNA, 14 bp, Homo sapiens
tgcaccaccaagcc

SEQ ID NO: 1687855 - DNA, 16 bp, Homo sapiens
tgcaccaccaagccaa

SEQ ID NO: 1687856 - DNA, 18 bp, Homo sapiens
tgcaccaccaagccaagg

SEQ ID NO: 1687857 - DNA, 19 bp, Homo sapiens
tgcaccaccaagccaaggg

SEQ ID NO: 1687858 - DNA, 14 bp, Homo sapiens
tgcaccactctctt

SEQ ID NO: 1687859 - DNA, 12 bp, Homo sapiens
tgcaccaggaga

SEQ ID NO: 1687860 - DNA, 15 bp, Homo sapiens
tgcaccaggagacag

SEQ ID NO: 1687861 - DNA, 22 bp, Homo sapiens
tgcaccatactccttgcttcct

SEQ ID NO: 1687862 - DNA, 22 bp, Homo sapiens
tgcaccatgctgctggggaaga

SEQ ID NO: 1687863 - DNA, 16 bp, Homo sapiens
tgcacccacccctgcc

SEQ ID NO: 1687864 - DNA, 17 bp, Homo sapiens
tgcacccacccctgccc

SEQ ID NO: 1687865 - DNA, 19 bp, Homo sapiens
tgcacccacccctgcccag

SEQ ID NO: 1687866 - DNA, 13 bp, Homo sapiens
tgcacccacctgt

SEQ ID NO: 1687867 - DNA, 20 bp, Homo sapiens
tgcacccacctgttttctga

SEQ ID NO: 1687868 - DNA, 21 bp, Homo sapiens
tgcacccacctgttttctgaa

SEQ ID NO: 1687869 - DNA, 16 bp, Homo sapiens
tgcacccatggtacca

SEQ ID NO: 1687870 - DNA, 19 bp, Homo sapiens
tgcaccccaaagctttcct

SEQ ID NO: 1687871 - DNA, 20 bp, Homo sapiens
tgcaccccaaagctttcctg

SEQ ID NO: 1687872 - DNA, 19 bp, Homo sapiens
tgcaccccagcattccagc

SEQ ID NO: 1687873 - DNA, 12 bp, Homo sapiens
tgcacccctccc

SEQ ID NO: 1687874 - DNA, 15 bp, Homo sapiens
tgcacccctcccatt

SEQ ID NO: 1687875 - DNA, 18 bp, Homo sapiens
tgcacccctccccattca

SEQ ID NO: 1687876 - DNA, 22 bp, Homo sapiens
tgcacccctccccattcacaga

SEQ ID NO: 1687877 - DNA, 14 bp, Homo sapiens
tgcaccctccaccc

SEQ ID NO: 1687878 - DNA, 15 bp, Homo sapiens
tgcaccctccaccct

SEQ ID NO: 1687879 - DNA, 16 bp, Homo sapiens
tgcaccctccaccctg

SEQ ID NO: 1687880 - DNA, 17 bp, Homo sapiens
tgcaccctccaccctgt

SEQ ID NO: 1687881 - DNA, 18 bp, Homo sapiens
tgcaccctccaccctgtc

SEQ ID NO: 1687882 - DNA, 14 bp, Homo sapiens
tgcaccctccgcct

SEQ ID NO: 1687883 - DNA, 18 bp, Homo sapiens
tgcaccctgcgcctccag

SEQ ID NO: 1687884 - DNA, 14 bp, Homo sapiens
tgcaccgcctgccc

SEQ ID NO: 1687885 - DNA, 15 bp, Homo sapiens
tgcaccgcctgccct

SEQ ID NO: 1687886 - DNA, 16 bp, Homo sapiens
tgcaccgcctgccctc

SEQ ID NO: 1687887 - DNA, 16 bp, Homo sapiens
tgcaccgtcctcagca

SEQ ID NO: 1687888 - DNA, 14 bp, Homo sapiens
tgcaccgtggtcag

SEQ ID NO: 1687889 - DNA, 20 bp, Homo sapiens
tgcacctccccccactgcag

SEQ ID NO: 1687890 - DNA, 22 bp, Homo sapiens
tgcacctctggctagagccgag

SEQ ID NO: 1687891 - DNA, 23 bp, Homo sapiens
tgcacctctggctagagccgagg

SEQ ID NO: 1687892 - DNA, 14 bp, Homo sapiens
tgcacctgagaccc

SEQ ID NO: 1687893 - DNA, 15 bp, Homo sapiens
tgcacctgccagcct

SEQ ID NO: 1687894 - DNA, 16 bp, Homo sapiens
tgcacctgccagcctg

SEQ ID NO: 1687895 - DNA, 20 bp, Homo sapiens
tgcacctgcctccaccagca

SEQ ID NO: 1687896 - DNA, 16 bp, Homo sapiens
tgcacctggcctgggc

SEQ ID NO: 1687897 - DNA, 15 bp, Homo sapiens
tgcacgggcatgcac

SEQ ID NO: 1687898 - DNA, 15 bp, Homo sapiens
tgcacggttcaatgg

SEQ ID NO: 1687899 - DNA, 23 bp, Homo sapiens
tgcacgtggcatgtggcctgtgg

SEQ ID NO: 1687900 - DNA, 14 bp, Homo sapiens
tgcacgtggcctct

SEQ ID NO: 1687901 - DNA, 15 bp, Homo sapiens
tgcactactcctctg

SEQ ID NO: 1687902 - DNA, 14 bp, Homo sapiens
tgcactactgacat

SEQ ID NO: 1687903 - DNA, 15 bp, Homo sapiens
tgcactactgacatg

SEQ ID NO: 1687904 - DNA, 16 bp, Homo sapiens
tgcactactgacatgt

SEQ ID NO: 1687905 - DNA, 17 bp, Homo sapiens
tgcactagcctgtgatt

SEQ ID NO: 1687906 - DNA, 19 bp, Homo sapiens
tgcactcaaatcttaagaa

SEQ ID NO: 1687907 - DNA, 22 bp, Homo sapiens
tgcactcaaatcttaagaaata

SEQ ID NO: 1687908 - DNA, 14 bp, Homo sapiens
tgcactcaacctta

SEQ ID NO: 1687909 - DNA, 13 bp, Homo sapiens
tgcactccacaca

SEQ ID NO: 1687910 - DNA, 14 bp, Homo sapiens
tgcactccacacat

SEQ ID NO: 1687911 - DNA, 16 bp, Homo sapiens
tgcactccagcctggg

SEQ ID NO: 1687912 - DNA, 19 bp, Homo sapiens
tgcactccagcctgggcga

SEQ ID NO: 1687913 - DNA, 17 bp, Homo sapiens
tgcactccagcctgggg

SEQ ID NO: 1687914 - DNA, 16 bp, Homo sapiens
tgcactccatggccac

SEQ ID NO: 1687915 - DNA, 15 bp, Homo sapiens
tgcactcccacctga

SEQ ID NO: 1687916 - DNA, 18 bp, Homo sapiens
tgcactccctggccttgc

SEQ ID NO: 1687917 - DNA, 21 bp, Homo sapiens
tgcactccctggccttgcccg

SEQ ID NO: 1687918 - DNA, 23 bp, Homo sapiens
tgcactcgccatttcctcacgtg

SEQ ID NO: 1687919 - DNA, 16 bp, Homo sapiens
tgcactctagcctggc

SEQ ID NO: 1687920 - DNA, 12 bp, Homo sapiens
tgcactctgtaa

SEQ ID NO: 1687921 - DNA, 19 bp, Homo sapiens
tgcactcttgaactgggcg

SEQ ID NO: 1687922 - DNA, 21 bp, Homo sapiens
tgcactgaaaacttagccaga

SEQ ID NO: 1687923 - DNA, 15 bp, Homo sapiens
tgcactgacccttcc

SEQ ID NO: 1687924 - DNA, 18 bp, Homo sapiens
tgccagaggtgggcaggt

SEQ ID NO: 1687925 - DNA, 21 bp, Homo sapiens
tgccagaggtgggcaggtggt

SEQ ID NO: 1687926 - DNA, 22 bp, Homo sapiens
tgccagatataactgtcttgtt

SEQ ID NO: 1687927 - DNA, 16 bp, Homo sapiens
tgccagcacaggggcc

SEQ ID NO: 1687928 - DNA, 17 bp, Homo sapiens
tgccagcacaggggccc

SEQ ID NO: 1687929 - DNA, 18 bp, Homo sapiens
tgccagcacaggggcccc

SEQ ID NO: 1687930 - DNA, 16 bp, Homo sapiens
tgccagcacgcctggc

SEQ ID NO: 1687931 - DNA, 15 bp, Homo sapiens
tgccagcagcagcag

SEQ ID NO: 1687932 - DNA, 16 bp, Homo sapiens
tgccagcagcctcgca

SEQ ID NO: 1687933 - DNA, 22 bp, Homo sapiens
tgccagcagcctcgcacaggcc

SEQ ID NO: 1687934 - DNA, 18 bp, Homo sapiens
tgccagcatggttgcaga

SEQ ID NO: 1687935 - DNA, 15 bp, Homo sapiens
tgccagccagcagcc

SEQ ID NO: 1687936 - DNA, 16 bp, Homo sapiens
tgccagccagcagcca

SEQ ID NO: 1687937 - DNA, 23 bp, Homo sapiens
tgccagccccctaaaagcactcc

SEQ ID NO: 1687938 - DNA, 16 bp, Homo sapiens
tgccagcctggcttct

SEQ ID NO: 1687939 - DNA, 17 bp, Homo sapiens
tgccagcctggcttctg

SEQ ID NO: 1687940 - DNA, 18 bp, Homo sapiens
tgccagcctggcttctgg

SEQ ID NO: 1687941 - DNA, 14 bp, Homo sapiens
tgccagccttcctc

SEQ ID NO: 1687942 - DNA, 23 bp, Homo sapiens
tgccagccttgagccctggctgt

SEQ ID NO: 1687943 - DNA, 15 bp, Homo sapiens
tgccagccttggggg

SEQ ID NO: 1687944 - DNA, 17 bp, Homo sapiens
tgccagcgcatgtgtcc

SEQ ID NO: 1687945 - DNA, 14 bp, Homo sapiens
tgccagcgtctgtt

SEQ ID NO: 1687946 - DNA, 17 bp, Homo sapiens
tgccagcgtctgttgtg

SEQ ID NO: 1687947 - DNA, 13 bp, Homo sapiens
tgccagctccctc

SEQ ID NO: 1687948 - DNA, 21 bp, Homo sapiens
tgccagctgccttcctcatcc

SEQ ID NO: 1687949 - DNA, 16 bp, Homo sapiens
tgccagctgggcccag

SEQ ID NO: 1687950 - DNA, 21 bp, Homo sapiens
tgccagctgggcccagcacct

SEQ ID NO: 1687951 - DNA, 13 bp, Homo sapiens
tgccagcttctct

SEQ ID NO: 1687952 - DNA, 14 bp, Homo sapiens
tgccagcttctctc

SEQ ID NO: 1687953 - DNA, 19 bp, Homo sapiens
tgccagcttctctctccag

SEQ ID NO: 1687954 - DNA, 14 bp, Homo sapiens
tgccaggaaagagt

SEQ ID NO: 1687955 - DNA, 21 bp, Homo sapiens
tgccaggaacctgtcctaagg

SEQ ID NO: 1687956 - DNA, 12 bp, Homo sapiens
tgccaggaccag

SEQ ID NO: 1687957 - DNA, 23 bp, Homo sapiens
tgccaggacccgccagccccgct

SEQ ID NO: 1687958 - DNA, 15 bp, Homo sapiens
tgccaggcacctggc

SEQ ID NO: 1687959 - DNA, 19 bp, Homo sapiens
tgccaggcgttggtgccac

SEQ ID NO: 1687960 - DNA, 14 bp, Homo sapiens
tgccaggctccctt

SEQ ID NO: 1687961 - DNA, 19 bp, Homo sapiens
tgccaggctgcctcctgcc

SEQ ID NO: 1687962 - DNA, 21 bp, Homo sapiens
tgccaggctgcctcctgccct

SEQ ID NO: 1687963 - DNA, 15 bp, Homo sapiens
tgccagggatgggca

SEQ ID NO: 1687964 - DNA, 12 bp, Homo sapiens
tgccagggctgc

SEQ ID NO: 1687965 - DNA, 22 bp, Homo sapiens
tgccaggtccctttcatttgct

SEQ ID NO: 1687966 - DNA, 22 bp, Homo sapiens
tgccagtaaaaaaaaaaaatgg

SEQ ID NO: 1687967 - DNA, 22 bp, Homo sapiens
tgccagtaacgcgtcttcctga

SEQ ID NO: 1687968 - DNA, 13 bp, Homo sapiens
tgccagtcctggg

SEQ ID NO: 1687969 - DNA, 14 bp, Homo sapiens
tgccagtgaagact

SEQ ID NO: 1687970 - DNA, 22 bp, Homo sapiens
tgccagtgaagacttcttgggt

SEQ ID NO: 1687971 - DNA, 17 bp, Homo sapiens
tgccagtgacagacagg

SEQ ID NO: 1687972 - DNA, 20 bp, Homo sapiens
tgccagtgacagacaggctc

SEQ ID NO: 1687973 - DNA, 13 bp, Homo sapiens
tgccagtgcctta

SEQ ID NO: 1687974 - DNA, 16 bp, Homo sapiens
tgccagtgctcaaggt

SEQ ID NO: 1687975 - DNA, 13 bp, Homo sapiens
tgccagttcctgt

SEQ ID NO: 1687976 - DNA, 14 bp, Homo sapiens
tgccagttcctgta

SEQ ID NO: 1687977 - DNA, 23 bp, Homo sapiens
tgccagttgaaaatggattttta

SEQ ID NO: 1687978 - DNA, 16 bp, Homo sapiens
tgccagttttccctgg

SEQ ID NO: 1687979 - DNA, 14 bp, Homo sapiens
tgccataaccacat

SEQ ID NO: 1687980 - DNA, 17 bp, Homo sapiens
tgccatactttgtctga

SEQ ID NO: 1687981 - DNA, 17 bp, Homo sapiens
tgccatagtcttaactg

SEQ ID NO: 1687982 - DNA, 15 bp, Homo sapiens
tgccatagtttgtga

SEQ ID NO: 1687983 - DNA, 14 bp, Homo sapiens
tgccatattgtgta

SEQ ID NO: 1687984 - DNA, 21 bp, Homo sapiens
tgccatcactggtccaggtct

SEQ ID NO: 1687985 - DNA, 15 bp, Homo sapiens
tgccatcatgcctga

SEQ ID NO: 1687986 - DNA, 16 bp, Homo sapiens
tgccatcatgcctgac

SEQ ID NO: 1687987 - DNA, 22 bp, Homo sapiens
tgccatcatgtttacagaggac

SEQ ID NO: 1687988 - DNA, 16 bp, Homo sapiens
tgccatccattctgga

SEQ ID NO: 1687989 - DNA, 23 bp, Homo sapiens
tgccatccttgctgcagcttcta

SEQ ID NO: 1687990 - DNA, 16 bp, Homo sapiens
tgccatctagccagcc

SEQ ID NO: 1687991 - DNA, 17 bp, Homo sapiens
tgccatctagccagccc

SEQ ID NO: 1687992 - DNA, 16 bp, Homo sapiens
tgccatctatctagtt

SEQ ID NO: 1687993 - DNA, 23 bp, Homo sapiens
tgccatctgtacatattactgtt

SEQ ID NO: 1687994 - DNA, 12 bp, Homo sapiens
tgccatctgttt

SEQ ID NO: 1687995 - DNA, 15 bp, Homo sapiens
tgccatctgttttca

SEQ ID NO: 1687996 - DNA, 12 bp, Homo sapiens
tgccatcttctc

SEQ ID NO: 1687997 - DNA, 14 bp, Homo sapiens
tgccatcttctccc

SEQ ID NO: 1687998 - DNA, 18 bp, Homo sapiens
tgccatcttctccccgag

SEQ ID NO: 1687999 - DNA, 20 bp, Homo sapiens
tgccatgcaggaagaggccc

SEQ ID NO: 1688000 - DNA, 13 bp, Homo sapiens
tgccatgcctgct

SEQ ID NO: 1688001 - DNA, 22 bp, Homo sapiens
tgccatgcctgctccctgtctg

SEQ ID NO: 1688002 - DNA, 22 bp, Homo sapiens
tgccatgctgggccactgggga

SEQ ID NO: 1688003 - DNA, 23 bp, Homo sapiens
tgccatgctgggccactggggac

SEQ ID NO: 1688004 - DNA, 21 bp, Homo sapiens
tgccatggatctgatctgtac

SEQ ID NO: 1688005 - DNA, 22 bp, Homo sapiens
tgccatggctaggtagaagtga

SEQ ID NO: 1688006 - DNA, 18 bp, Homo sapiens
tgccatgtaaatccccac

SEQ ID NO: 1688007 - DNA, 20 bp, Homo sapiens
tgccatgtaaatccccactg

SEQ ID NO: 1688008 - DNA, 22 bp, Homo sapiens
tgccatgtagaccccttgaaga

SEQ ID NO: 1688009 - DNA, 20 bp, Homo sapiens
tgccatgtcagcgctctggt

SEQ ID NO: 1688010 - DNA, 15 bp, Homo sapiens
tgccatgtgaagagg

SEQ ID NO: 1688011 - DNA, 15 bp, Homo sapiens
tgccatgtgcacctt

SEQ ID NO: 1688012 - DNA, 15 bp, Homo sapiens
tgccatgttggccag

SEQ ID NO: 1688013 - DNA, 17 bp, Homo sapiens
tgccattacagaaccaa

SEQ ID NO: 1688014 - DNA, 22 bp, Homo sapiens
tgccattacagaggtattaaaa

SEQ ID NO: 1688015 - DNA, 16 bp, Homo sapiens
tgccattacccagtgc

SEQ ID NO: 1688016 - DNA, 17 bp, Homo sapiens
tgccattacccagtgcc

SEQ ID NO: 1688017 - DNA, 13 bp, Homo sapiens
tgcccccaggact

SEQ ID NO: 1688018 - DNA, 14 bp, Homo sapiens
tgcccccatccctc

SEQ ID NO: 1688019 - DNA, 22 bp, Homo sapiens
tgcccccatctccccaggcctc

SEQ ID NO: 1688020 - DNA, 14 bp, Homo sapiens
tgccccccagcctc

SEQ ID NO: 1688021 - DNA, 15 bp, Homo sapiens
tgccccccagcctct

SEQ ID NO: 1688022 - DNA, 19 bp, Homo sapiens
tgccccccagcctctggca

SEQ ID NO: 1688023 - DNA, 23 bp, Homo sapiens
tgccccccatgaggaaggaacag

SEQ ID NO: 1688024 - DNA, 20 bp, Homo sapiens
tgcccccctcaaacctcctc

SEQ ID NO: 1688025 - DNA, 23 bp, Homo sapiens
tgcccccctcaaacctcctcttc

SEQ ID NO: 1688026 - DNA, 15 bp, Homo sapiens
tgcccccctcctcca

SEQ ID NO: 1688027 - DNA, 16 bp, Homo sapiens
tgcccccgcctgccac

SEQ ID NO: 1688028 - DNA, 21 bp, Homo sapiens
tgccccctaatccccttctcc

SEQ ID NO: 1688029 - DNA, 18 bp, Homo sapiens
tgccccctccaggagaga

SEQ ID NO: 1688030 - DNA, 20 bp, Homo sapiens
tgccccctcccccatgggct

SEQ ID NO: 1688031 - DNA, 14 bp, Homo sapiens
tgccccctcctctc

SEQ ID NO: 1688032 - DNA, 22 bp, Homo sapiens
tgccccctggtggacagtcctg

SEQ ID NO: 1688033 - DNA, 22 bp, Homo sapiens
tgccccggccccggccccagcc

SEQ ID NO: 1688034 - DNA, 17 bp, Homo sapiens
tgccccggcccctcccc

SEQ ID NO: 1688035 - DNA, 21 bp, Homo sapiens
tgccccgggtccccagctccc

SEQ ID NO: 1688036 - DNA, 23 bp, Homo sapiens
tgccccgttccctgtcagaggct

SEQ ID NO: 1688037 - DNA, 15 bp, Homo sapiens
tgccccgttgcttcc

SEQ ID NO: 1688038 - DNA, 21 bp, Homo sapiens
tgcccctacgggcgctgcagc

SEQ ID NO: 1688039 - DNA, 14 bp, Homo sapiens
tgcccctcagagac

SEQ ID NO: 1688040 - DNA, 21 bp, Homo sapiens
tgcccctcccccaacccccac

SEQ ID NO: 1688041 - DNA, 16 bp, Homo sapiens
tgcccctcccctcccc

SEQ ID NO: 1688042 - DNA, 19 bp, Homo sapiens
tgcccctccgatgctgagg

SEQ ID NO: 1688043 - DNA, 21 bp, Homo sapiens
tgcccctccgatgctgaggcc

SEQ ID NO: 1688044 - DNA, 22 bp, Homo sapiens
tgcccctccgatgctgaggcca

SEQ ID NO: 1688045 - DNA, 14 bp, Homo sapiens
tgcccctctcacca

SEQ ID NO: 1688046 - DNA, 15 bp, Homo sapiens
tgcccctctcaccaa

SEQ ID NO: 1688047 - DNA, 20 bp, Homo sapiens
tgcccctctccaggcgccgg

SEQ ID NO: 1688048 - DNA, 14 bp, Homo sapiens
tgcccctgatgcag

SEQ ID NO: 1688049 - DNA, 17 bp, Homo sapiens
tgcccctgatgcagcct

SEQ ID NO: 1688050 - DNA, 16 bp, Homo sapiens
tgcccctgcagtttgg

SEQ ID NO: 1688051 - DNA, 22 bp, Homo sapiens
tgcccctgcagtttggccctgg

SEQ ID NO: 1688052 - DNA, 23 bp, Homo sapiens
tgcccctgcagtttggccctgga

SEQ ID NO: 1688053 - DNA, 20 bp, Homo sapiens
tgcccctggctttgcctctt

SEQ ID NO: 1688054 - DNA, 22 bp, Homo sapiens
tgccccttaaacacaggctgtc

SEQ ID NO: 1688055 - DNA, 20 bp, Homo sapiens
tgccccttaaccccaaggac

SEQ ID NO: 1688056 - DNA, 22 bp, Homo sapiens
tgccccttaagggttgaaggca

SEQ ID NO: 1688057 - DNA, 12 bp, Homo sapiens
tgccccttgggc

SEQ ID NO: 1688058 - DNA, 13 bp, Homo sapiens
tgccccttgggca

SEQ ID NO: 1688059 - DNA, 18 bp, Homo sapiens
tgcccctttctcttttcc

SEQ ID NO: 1688060 - DNA, 21 bp, Homo sapiens
tgcccgagagagctctggccc

SEQ ID NO: 1688061 - DNA, 19 bp, Homo sapiens
tgcccgcacccctccctgc

SEQ ID NO: 1688062 - DNA, 18 bp, Homo sapiens
tgcccgcaccctggcctg

SEQ ID NO: 1688063 - DNA, 19 bp, Homo sapiens
tgcccgcaccctggcctgg

SEQ ID NO: 1688064 - DNA, 23 bp, Homo sapiens
tgcccgccagcctcagtgccact

SEQ ID NO: 1688065 - DNA, 12 bp, Homo sapiens
tgcccgcctagg

SEQ ID NO: 1688066 - DNA, 18 bp, Homo sapiens
tgcccgcctaggagttga

SEQ ID NO: 1688067 - DNA, 13 bp, Homo sapiens
tgcccgctcccaa

SEQ ID NO: 1688068 - DNA, 17 bp, Homo sapiens
tgcccggattctgggag

SEQ ID NO: 1688069 - DNA, 22 bp, Homo sapiens
tgcccggattctgggaggaagc

SEQ ID NO: 1688070 - DNA, 20 bp, Homo sapiens
tgcccggggtggggtgcact

SEQ ID NO: 1688071 - DNA, 20 bp, Homo sapiens
tgcccggtggtttgccatgt

SEQ ID NO: 1688072 - DNA, 21 bp, Homo sapiens
tgcccggtggtttgccatgtc

SEQ ID NO: 1688073 - DNA, 16 bp, Homo sapiens
tgcccgtaatcccagc

SEQ ID NO: 1688074 - DNA, 18 bp, Homo sapiens
tgcccgtaatcccagcta

SEQ ID NO: 1688075 - DNA, 16 bp, Homo sapiens
tgcccgtcttcagcct

SEQ ID NO: 1688076 - DNA, 19 bp, Homo sapiens
tgccctaagagtgtcactg

SEQ ID NO: 1688077 - DNA, 16 bp, Homo sapiens
tgccctaagcccccag

SEQ ID NO: 1688078 - DNA, 18 bp, Homo sapiens
tgccctaagcccccaggg

SEQ ID NO: 1688079 - DNA, 14 bp, Homo sapiens
tgccctagctgacc

SEQ ID NO: 1688080 - DNA, 16 bp, Homo sapiens
tgccctatggatttga

SEQ ID NO: 1688081 - DNA, 15 bp, Homo sapiens
tgccctatgggcctg

SEQ ID NO: 1688082 - DNA, 16 bp, Homo sapiens
tgccctcaatcccagc

SEQ ID NO: 1688083 - DNA, 13 bp, Homo sapiens
tgccctcaccacc

SEQ ID NO: 1688084 - DNA, 14 bp, Homo sapiens
tgccctcactccct

SEQ ID NO: 1688085 - DNA, 19 bp, Homo sapiens
tgccctcactccctctgca

SEQ ID NO: 1688086 - DNA, 18 bp, Homo sapiens
tgccctccaaagagcctt

SEQ ID NO: 1688087 - DNA, 18 bp, Homo sapiens
tgccctcccacagcctcc

SEQ ID NO: 1688088 - DNA, 15 bp, Homo sapiens
tgccctcccctgctc

SEQ ID NO: 1688089 - DNA, 22 bp, Homo sapiens
tgccctcccctgctcccaggtt

SEQ ID NO: 1688090 - DNA, 18 bp, Homo sapiens
tgccctccccttcccctt

SEQ ID NO: 1688091 - DNA, 14 bp, Homo sapiens
tgccctcctcactc

SEQ ID NO: 1688092 - DNA, 15 bp, Homo sapiens
tgccctcctggacaa

SEQ ID NO: 1688093 - DNA, 19 bp, Homo sapiens
tgccctcgggcgagtcact

SEQ ID NO: 1688094 - DNA, 22 bp, Homo sapiens
tgccctcgggcgagtcactgcc

SEQ ID NO: 1688095 - DNA, 15 bp, Homo sapiens
tgccctctccttcct

SEQ ID NO: 1688096 - DNA, 17 bp, Homo sapiens
tgccctctccttcctta

SEQ ID NO: 1688097 - DNA, 21 bp, Homo sapiens
tgccctctccttccttaccca

SEQ ID NO: 1688098 - DNA, 12 bp, Homo sapiens
tgccctctctgc

SEQ ID NO: 1688099 - DNA, 23 bp, Homo sapiens
tgccctctctgcgctgaggccca

SEQ ID NO: 1688100 - DNA, 19 bp, Homo sapiens
tgccctctgctctgcctgg

SEQ ID NO: 1688101 - DNA, 20 bp, Homo sapiens
tgccctctgctctgcctgga

SEQ ID NO: 1688102 - DNA, 22 bp, Homo sapiens
tgccctctgctctgcctggagt

SEQ ID NO: 1688103 - DNA, 20 bp, Homo sapiens
tgccctctgctgctgcccgg

SEQ ID NO: 1688104 - DNA, 18 bp, Homo sapiens
tgccctcttaagatctga

SEQ ID NO: 1688105 - DNA, 20 bp, Homo sapiens
tgccctcttaagatctgact

SEQ ID NO: 1688106 - DNA, 12 bp, Homo sapiens
tgccctgccatt

SEQ ID NO: 1688107 - DNA, 14 bp, Homo sapiens
tgccctgcctgccc

SEQ ID NO: 1688108 - DNA, 16 bp, Homo sapiens
tgccctggcagcagca

SEQ ID NO: 1688109 - DNA, 22 bp, Homo sapiens
tgccctggccctgaggtgtggg

SEQ ID NO: 1688110 - DNA, 11 bp, Homo sapiens
tgccctggctg

SEQ ID NO: 1688111 - DNA, 12 bp, Homo sapiens
tgccctggctgc

SEQ ID NO: 1688112 - DNA, 22 bp, Homo sapiens
tgccctgggagctctgggactg

SEQ ID NO: 1688113 - DNA, 16 bp, Homo sapiens
tgccctgggatgtcca

SEQ ID NO: 1688114 - DNA, 23 bp, Homo sapiens
tgccctggggctgatctcaggga

SEQ ID NO: 1688115 - DNA, 12 bp, Homo sapiens
tgccctggtgct

SEQ ID NO: 1688116 - DNA, 18 bp, Homo sapiens
tgccctgtggacaggatg

SEQ ID NO: 1688117 - DNA, 15 bp, Homo sapiens
tgccctgtgtggctg

SEQ ID NO: 1688118 - DNA, 17 bp, Homo sapiens
tgcccttcacagtgttt

SEQ ID NO: 1688119 - DNA, 15 bp, Homo sapiens
tgcccttcactgtca

SEQ ID NO: 1688120 - DNA, 20 bp, Homo sapiens
tgcccttccctgtccctcta

SEQ ID NO: 1688121 - DNA, 18 bp, Homo sapiens
tgcccttcctcagtttaa

SEQ ID NO: 1688122 - DNA, 15 bp, Homo sapiens
tgcccttcctcctga

SEQ ID NO: 1688123 - DNA, 17 bp, Homo sapiens
tgcccttctcaagactt

SEQ ID NO: 1688124 - DNA, 18 bp, Homo sapiens
tgcccttctcaagacttt

SEQ ID NO: 1688125 - DNA, 20 bp, Homo sapiens
tgcccttctcaagactttag

SEQ ID NO: 1688126 - DNA, 11 bp, Homo sapiens
tgcccttctcc

SEQ ID NO: 1688127 - DNA, 14 bp, Homo sapiens
tgcccttgcccttg

SEQ ID NO: 1688128 - DNA, 21 bp, Homo sapiens
tgcccttggtagcagcctggg

SEQ ID NO: 1688129 - DNA, 22 bp, Homo sapiens
tgcccttggtagcagcctgggg

SEQ ID NO: 1688130 - DNA, 14 bp, Homo sapiens
tgccctttggggtc

SEQ ID NO: 1688131 - DNA, 21 bp, Homo sapiens
tgccgaacacacatcccagga

SEQ ID NO: 1688132 - DNA, 15 bp, Homo sapiens
tgccgacctcgtcct

SEQ ID NO: 1688133 - DNA, 17 bp, Homo sapiens
tgcctcttccttgaaga

SEQ ID NO: 1688134 - DNA, 14 bp, Homo sapiens
tgcctcttctttgt

SEQ ID NO: 1688135 - DNA, 19 bp, Homo sapiens
tgcctcttctttgtgcctt

SEQ ID NO: 1688136 - DNA, 14 bp, Homo sapiens
tgcctcttgttgca

SEQ ID NO: 1688137 - DNA, 15 bp, Homo sapiens
tgcctcttgttgcag

SEQ ID NO: 1688138 - DNA, 14 bp, Homo sapiens
tgcctctttcctgt

SEQ ID NO: 1688139 - DNA, 15 bp, Homo sapiens
tgcctgaaatgttac

SEQ ID NO: 1688140 - DNA, 13 bp, Homo sapiens
tgcctgaacatcc

SEQ ID NO: 1688141 - DNA, 22 bp, Homo sapiens
tgcctgaacatccttccttccc

SEQ ID NO: 1688142 - DNA, 13 bp, Homo sapiens
tgcctgaagaaca

SEQ ID NO: 1688143 - DNA, 16 bp, Homo sapiens
tgcctgacacactaac

SEQ ID NO: 1688144 - DNA, 16 bp, Homo sapiens
tgcctgactaattttt

SEQ ID NO: 1688145 - DNA, 22 bp, Homo sapiens
tgcctgactaatttttgtattt

SEQ ID NO: 1688146 - DNA, 15 bp, Homo sapiens
tgcctgagaggcagg

SEQ ID NO: 1688147 - DNA, 16 bp, Homo sapiens
tgcctgagaggcaggc

SEQ ID NO: 1688148 - DNA, 13 bp, Homo sapiens
tgcctgagattct

SEQ ID NO: 1688149 - DNA, 22 bp, Homo sapiens
tgcctgagattctttaaggaga

SEQ ID NO: 1688150 - DNA, 13 bp, Homo sapiens
tgcctgaggagga

SEQ ID NO: 1688151 - DNA, 19 bp, Homo sapiens
tgcctgaggaggaggacac

SEQ ID NO: 1688152 - DNA, 14 bp, Homo sapiens
tgcctgaggctgta

SEQ ID NO: 1688153 - DNA, 15 bp, Homo sapiens
tgcctgagggcccct

SEQ ID NO: 1688154 - DNA, 19 bp, Homo sapiens
tgcctgagggcccctctgc

SEQ ID NO: 1688155 - DNA, 21 bp, Homo sapiens
tgcctgagggcccctctgccc

SEQ ID NO: 1688156 - DNA, 23 bp, Homo sapiens
tgcctgagggcccctctgcccag

SEQ ID NO: 1688157 - DNA, 11 bp, Homo sapiens
tgcctgagggt

SEQ ID NO: 1688158 - DNA, 18 bp, Homo sapiens
tgcctgagggtggagact

SEQ ID NO: 1688159 - DNA, 16 bp, Homo sapiens
tgcctgagttataaat

SEQ ID NO: 1688160 - DNA, 21 bp, Homo sapiens
tgcctgagttataaatatttt

SEQ ID NO: 1688161 - DNA, 15 bp, Homo sapiens
tgcctgagtttccag

SEQ ID NO: 1688162 - DNA, 17 bp, Homo sapiens
tgcctgatccctgaacc

SEQ ID NO: 1688163 - DNA, 23 bp, Homo sapiens
tgcctgatccctgaacccctggc

SEQ ID NO: 1688164 - DNA, 18 bp, Homo sapiens
tgcctgatcctccaacag

SEQ ID NO: 1688165 - DNA, 19 bp, Homo sapiens
tgcctgattcggacggcca

SEQ ID NO: 1688166 - DNA, 16 bp, Homo sapiens
tgcctgcaagagaatc

SEQ ID NO: 1688167 - DNA, 15 bp, Homo sapiens
tgcctgcacccttcc

SEQ ID NO: 1688168 - DNA, 17 bp, Homo sapiens
tgcctgcacccttccct

SEQ ID NO: 1688169 - DNA, 17 bp, Homo sapiens
tgcctgcactccctggc

SEQ ID NO: 1688170 - DNA, 19 bp, Homo sapiens
tgcctgcactccctggcct

SEQ ID NO: 1688171 - DNA, 13 bp, Homo sapiens
tgcctgcagcaca

SEQ ID NO: 1688172 - DNA, 17 bp, Homo sapiens
tgcctgcagcacatgcg

SEQ ID NO: 1688173 - DNA, 12 bp, Homo sapiens
tgcctgcagggc

SEQ ID NO: 1688174 - DNA, 13 bp, Homo sapiens
tgcctgcagggcc

SEQ ID NO: 1688175 - DNA, 14 bp, Homo sapiens
tgcctgcagggcca

SEQ ID NO: 1688176 - DNA, 16 bp, Homo sapiens
tgcctgcagggccatg

SEQ ID NO: 1688177 - DNA, 17 bp, Homo sapiens
tgcctgcatgagctggc

SEQ ID NO: 1688178 - DNA, 13 bp, Homo sapiens
tgcctgcattctg

SEQ ID NO: 1688179 - DNA, 11 bp, Homo sapiens
tgcctgccact

SEQ ID NO: 1688180 - DNA, 14 bp, Homo sapiens
tgcctgccactctc

SEQ ID NO: 1688181 - DNA, 20 bp, Homo sapiens
tgcctgccactctctgggac

SEQ ID NO: 1688182 - DNA, 18 bp, Homo sapiens
tgcctgcccccctcatct

SEQ ID NO: 1688183 - DNA, 12 bp, Homo sapiens
tgcctgccccgc

SEQ ID NO: 1688184 - DNA, 20 bp, Homo sapiens
tgcctgcctgtctgtctctc

SEQ ID NO: 1688185 - DNA, 21 bp, Homo sapiens
tgcctgcctgtctgtctctcc

SEQ ID NO: 1688186 - DNA, 19 bp, Homo sapiens
tgcctgcgtgggtgtgtgc

SEQ ID NO: 1688187 - DNA, 13 bp, Homo sapiens
tgcctgctcagca

SEQ ID NO: 1688188 - DNA, 17 bp, Homo sapiens
tgcctgctcagcagcca

SEQ ID NO: 1688189 - DNA, 12 bp, Homo sapiens
tgcctgctccct

SEQ ID NO: 1688190 - DNA, 18 bp, Homo sapiens
tgcctgctccctgtctgt

SEQ ID NO: 1688191 - DNA, 24 bp, Homo sapiens
tgcctgctcctgcttaaacacaag

SEQ ID NO: 1688192 - DNA, 15 bp, Homo sapiens
tgcctgctttttgga

SEQ ID NO: 1688193 - DNA, 16 bp, Homo sapiens
tgcctgctttttggaa

SEQ ID NO: 1688194 - DNA, 21 bp, Homo sapiens
tgcctgctttttggaaagtca

SEQ ID NO: 1688195 - DNA, 19 bp, Homo sapiens
tgcctggaacaccagcagc

SEQ ID NO: 1688196 - DNA, 11 bp, Homo sapiens
tgcctggactg

SEQ ID NO: 1688197 - DNA, 12 bp, Homo sapiens
tgcctggactga

SEQ ID NO: 1688198 - DNA, 13 bp, Homo sapiens
tgcctggactgac

SEQ ID NO: 1688199 - DNA, 14 bp, Homo sapiens
tgcctggactgacc

SEQ ID NO: 1688200 - DNA, 23 bp, Homo sapiens
tgcctggagacaaggtgctaaca

SEQ ID NO: 1688201 - DNA, 18 bp, Homo sapiens
tgcctggaggtgtgggag

SEQ ID NO: 1688202 - DNA, 19 bp, Homo sapiens
tgcctggagtcccgtccct

SEQ ID NO: 1688203 - DNA, 23 bp, Homo sapiens
tgcctggagtgtatgactgcaca

SEQ ID NO: 1688204 - DNA, 14 bp, Homo sapiens
tgcctggagtgtcg

SEQ ID NO: 1688205 - DNA, 23 bp, Homo sapiens
tgcctggatgagaaacagctcag

SEQ ID NO: 1688206 - DNA, 22 bp, Homo sapiens
tgcctggatgggggtgcaggca

SEQ ID NO: 1688207 - DNA, 11 bp, Homo sapiens
tgcctggcccc

SEQ ID NO: 1688208 - DNA, 22 bp, Homo sapiens
tgcctggcctggcacacatcag

SEQ ID NO: 1688209 - DNA, 15 bp, Homo sapiens
tgcctggcctggctc

SEQ ID NO: 1688210 - DNA, 16 bp, Homo sapiens
tgcctgggaatgtatt

SEQ ID NO: 1688211 - DNA, 14 bp, Homo sapiens
tgcctgggccctgg

SEQ ID NO: 1688212 - DNA, 15 bp, Homo sapiens
tgcctgggcctgtgc

SEQ ID NO: 1688213 - DNA, 16 bp, Homo sapiens
tgcctgggcctgtgca

SEQ ID NO: 1688214 - DNA, 22 bp, Homo sapiens
tgcctgggcctgtgcagcagcc

SEQ ID NO: 1688215 - DNA, 17 bp, Homo sapiens
tgcctgggctgttggca

SEQ ID NO: 1688216 - DNA, 17 bp, Homo sapiens
tgcctggggtctgagca

SEQ ID NO: 1688217 - DNA, 19 bp, Homo sapiens
tgcctggggtgttagtggc

SEQ ID NO: 1688218 - DNA, 23 bp, Homo sapiens
tgcctggggtgttagtggcaccg

SEQ ID NO: 1688219 - DNA, 23 bp, Homo sapiens
tgcctggtatatccaaaagcttt

SEQ ID NO: 1688220 - DNA, 22 bp, Homo sapiens
tgcctggtcctccctcccaagg

SEQ ID NO: 1688221 - DNA, 18 bp, Homo sapiens
tgcctggtgcattgctgt

SEQ ID NO: 1688222 - DNA, 19 bp, Homo sapiens
tgcctggtgcattgctgtg

SEQ ID NO: 1688223 - DNA, 19 bp, Homo sapiens
tgcctgtagctttcctggt

SEQ ID NO: 1688224 - DNA, 17 bp, Homo sapiens
tgcctgtagtctcagct

SEQ ID NO: 1688225 - DNA, 20 bp, Homo sapiens
tgcctgtagtctcagctagt

SEQ ID NO: 1688226 - DNA, 21 bp, Homo sapiens
tgcctgtcacgctctggtgca

SEQ ID NO: 1688227 - DNA, 15 bp, Homo sapiens
tgcctgtccagcctg

SEQ ID NO: 1688228 - DNA, 16 bp, Homo sapiens
tgcctgtccagcctgg

SEQ ID NO: 1688229 - DNA, 18 bp, Homo sapiens
tgcctgtccagcctgggc

SEQ ID NO: 1688230 - DNA, 16 bp, Homo sapiens
tgcctgtcccaccccc

SEQ ID NO: 1688231 - DNA, 22 bp, Homo sapiens
tgcctgtccttgaaaaacaaag

SEQ ID NO: 1688232 - DNA, 14 bp, Homo sapiens
tgcctgtctccatg

SEQ ID NO: 1688233 - DNA, 23 bp, Homo sapiens
tgcctgtctcctttgcaggctca

SEQ ID NO: 1688234 - DNA, 15 bp, Homo sapiens
tgcctgtctctgttc

SEQ ID NO: 1688235 - DNA, 13 bp, Homo sapiens
tgcctgtctgccc

SEQ ID NO: 1688236 - DNA, 15 bp, Homo sapiens
tgcctgtctgcccca

SEQ ID NO: 1688237 - DNA, 17 bp, Homo sapiens
tgcctgtctggctcagg

SEQ ID NO: 1688238 - DNA, 16 bp, Homo sapiens
tgcctgtctggtgcct

SEQ ID NO: 1688239 - DNA, 19 bp, Homo sapiens
tgcctgtgatttcctaatt

SEQ ID NO: 1688240 - DNA, 14 bp, Homo sapiens
tgcctgtgccaccc

SEQ ID NO: 1688241 - DNA, 18 bp, Homo sapiens
tgcctgtggcagaaaaga

SEQ ID NO: 1688242 - DNA, 19 bp, Homo sapiens
tgcctgtgtccatgcgctc

SEQ ID NO: 1688243 - DNA, 21 bp, Homo sapiens
tgcctgtgtccatgcgctcag

SEQ ID NO: 1688244 - DNA, 22 bp, Homo sapiens
tgcggttataaaaaatggttca

SEQ ID NO: 1688245 - DNA, 16 bp, Homo sapiens
tgcgtacacagagaag

SEQ ID NO: 1688246 - DNA, 15 bp, Homo sapiens
tgcgtacgtttcctg

SEQ ID NO: 1688247 - DNA, 17 bp, Homo sapiens
tgcgtatatgtgcgtct

SEQ ID NO: 1688248 - DNA, 22 bp, Homo sapiens
tgcgtatatgtgcgtctctctt

SEQ ID NO: 1688249 - DNA, 12 bp, Homo sapiens
tgcgtcccaaga

SEQ ID NO: 1688250 - DNA, 14 bp, Homo sapiens
tgcgtcctcatttc

SEQ ID NO: 1688251 - DNA, 16 bp, Homo sapiens
tgcgtcctcatttccc

SEQ ID NO: 1688252 - DNA, 22 bp, Homo sapiens
tgcgtcctcctcacctcatgcc

SEQ ID NO: 1688253 - DNA, 18 bp, Homo sapiens
tgcgtcctgacgccctgc

SEQ ID NO: 1688254 - DNA, 19 bp, Homo sapiens
tgcgtcctgacgccctgcg

SEQ ID NO: 1688255 - DNA, 13 bp, Homo sapiens
tgcgtcctgcaga

SEQ ID NO: 1688256 - DNA, 13 bp, Homo sapiens
tgcgtctccagtc

SEQ ID NO: 1688257 - DNA, 21 bp, Homo sapiens
tgcgtctctctttctccctca

SEQ ID NO: 1688258 - DNA, 16 bp, Homo sapiens
tgcgtcttggtgtaat

SEQ ID NO: 1688259 - DNA, 16 bp, Homo sapiens
tgcgtgcccttttcat

SEQ ID NO: 1688260 - DNA, 18 bp, Homo sapiens
tgcgtggactctgcacat

SEQ ID NO: 1688261 - DNA, 22 bp, Homo sapiens
tgcgtggactctgcacatgtct

SEQ ID NO: 1688262 - DNA, 18 bp, Homo sapiens
tgcgtgggagtgtgtgcc

SEQ ID NO: 1688263 - DNA, 20 bp, Homo sapiens
tgcgtgtgacagtgtatggg

SEQ ID NO: 1688264 - DNA, 16 bp, Homo sapiens
tgcgtgttcagcagaa

SEQ ID NO: 1688265 - DNA, 20 bp, Homo sapiens
tgcgtgttcagcagaacctg

SEQ ID NO: 1688266 - DNA, 13 bp, Homo sapiens
tgcgttactaatt

SEQ ID NO: 1688267 - DNA, 13 bp, Homo sapiens
tgcgttggagcca

SEQ ID NO: 1688268 - DNA, 19 bp, Homo sapiens
tgcgttgggttttcccttg

SEQ ID NO: 1688269 - DNA, 23 bp, Homo sapiens
tgcgtttggaggcccctgggctc

SEQ ID NO: 1688270 - DNA, 14 bp, Homo sapiens
tgcgtttttacagt

SEQ ID NO: 1688271 - DNA, 19 bp, Homo sapiens
tgctaaaaaataaataaaa

SEQ ID NO: 1688272 - DNA, 21 bp, Homo sapiens
tgctaaacaagtaagaaaaat

SEQ ID NO: 1688273 - DNA, 14 bp, Homo sapiens
tgctaaactgtgaa

SEQ ID NO: 1688274 - DNA, 23 bp, Homo sapiens
tgctaaactgtgaaaaatcagat

SEQ ID NO: 1688275 - DNA, 19 bp, Homo sapiens
tgctaaattgattgaatta

SEQ ID NO: 1688276 - DNA, 22 bp, Homo sapiens
tgctaaattgattgaattaaat

SEQ ID NO: 1688277 - DNA, 23 bp, Homo sapiens
tgctaaattgattgaattaaatc

SEQ ID NO: 1688278 - DNA, 21 bp, Homo sapiens
tgctaaattttcagtagggct

SEQ ID NO: 1688279 - DNA, 13 bp, Homo sapiens
tgctaactggtta

SEQ ID NO: 1688280 - DNA, 18 bp, Homo sapiens
tgctaactggttaaacat

SEQ ID NO: 1688281 - DNA, 17 bp, Homo sapiens
tgctaacttggagcccc

SEQ ID NO: 1688282 - DNA, 23 bp, Homo sapiens
tgctaagctgatattatttcttc

SEQ ID NO: 1688283 - DNA, 19 bp, Homo sapiens
tgctaaggctcctccttgc

SEQ ID NO: 1688284 - DNA, 12 bp, Homo sapiens
tgctaaggttct

SEQ ID NO: 1688285 - DNA, 13 bp, Homo sapiens
tgctaaggttcta

SEQ ID NO: 1688286 - DNA, 17 bp, Homo sapiens
tgctaaggttctaaggc

SEQ ID NO: 1688287 - DNA, 18 bp, Homo sapiens
tgctaaggttctaaggcc

SEQ ID NO: 1688288 - DNA, 23 bp, Homo sapiens
tgctaagtgcttattacatttta

SEQ ID NO: 1688289 - DNA, 22 bp, Homo sapiens
tgctaagttctcccaacaacat

SEQ ID NO: 1688290 - DNA, 22 bp, Homo sapiens
tgctaatgtaatcatttatctt

SEQ ID NO: 1688291 - DNA, 17 bp, Homo sapiens
tgctaattctttgcaaa

SEQ ID NO: 1688292 - DNA, 12 bp, Homo sapiens
tgctaattgtgt

SEQ ID NO: 1688293 - DNA, 14 bp, Homo sapiens
tgctaattgtgtat

SEQ ID NO: 1688294 - DNA, 14 bp, Homo sapiens
tgctaatttagaga

SEQ ID NO: 1688295 - DNA, 16 bp, Homo sapiens
tgctacaaaaacacag

SEQ ID NO: 1688296 - DNA, 14 bp, Homo sapiens
tgctacaaatttat

SEQ ID NO: 1688297 - DNA, 19 bp, Homo sapiens
tgctacaaatttatgcatt

SEQ ID NO: 1688298 - DNA, 20 bp, Homo sapiens
tgctacaaatttatgcattt

SEQ ID NO: 1688299 - DNA, 21 bp, Homo sapiens
tgctacaacatcactaatttg

SEQ ID NO: 1688300 - DNA, 18 bp, Homo sapiens
tgctacatcagactctag

SEQ ID NO: 1688301 - DNA, 19 bp, Homo sapiens
tgctacatcagactctaga

SEQ ID NO: 1688302 - DNA, 13 bp, Homo sapiens
tgctaccaaagca

SEQ ID NO: 1688303 - DNA, 22 bp, Homo sapiens
tgctaccagtatttagaagcca

SEQ ID NO: 1688304 - DNA, 23 bp, Homo sapiens
tgctacccatgactttatatgga

SEQ ID NO: 1688305 - DNA, 15 bp, Homo sapiens
tgctaccgagaaggt

SEQ ID NO: 1688306 - DNA, 18 bp, Homo sapiens
tgctaccgttgacttcca

SEQ ID NO: 1688307 - DNA, 15 bp, Homo sapiens
tgctacctcactggg

SEQ ID NO: 1688308 - DNA, 16 bp, Homo sapiens
tgctacctcactgggg

SEQ ID NO: 1688309 - DNA, 15 bp, Homo sapiens
tgctacctcccttgc

SEQ ID NO: 1688310 - DNA, 19 bp, Homo sapiens
tgctacctgggtccttttc

SEQ ID NO: 1688311 - DNA, 17 bp, Homo sapiens
tgctacctttcaaagct

SEQ ID NO: 1688312 - DNA, 12 bp, Homo sapiens
tgctactcctgt

SEQ ID NO: 1688313 - DNA, 15 bp, Homo sapiens
tgctactcctgtgct

SEQ ID NO: 1688314 - DNA, 16 bp, Homo sapiens
tgctactcctgtgctc

SEQ ID NO: 1688315 - DNA, 17 bp, Homo sapiens
tgctactcctgtgctct

SEQ ID NO: 1688316 - DNA, 16 bp, Homo sapiens
tgctactgtcttacta

SEQ ID NO: 1688317 - DNA, 13 bp, Homo sapiens
tgctagaaaaatt

SEQ ID NO: 1688318 - DNA, 14 bp, Homo sapiens
tgctagaaattttc

SEQ ID NO: 1688319 - DNA, 15 bp, Homo sapiens
tgctagaaattttca

SEQ ID NO: 1688320 - DNA, 15 bp, Homo sapiens
tgctagaagctgtaa

SEQ ID NO: 1688321 - DNA, 22 bp, Homo sapiens
tgctagacagaaaccaagccat

SEQ ID NO: 1688322 - DNA, 17 bp, Homo sapiens
tgctagactcctcagga

SEQ ID NO: 1688323 - DNA, 21 bp, Homo sapiens
tgctagactcctcaggagaga

SEQ ID NO: 1688324 - DNA, 20 bp, Homo sapiens
tgctagactttctggagtga

SEQ ID NO: 1688325 - DNA, 17 bp, Homo sapiens
tgctagagcaacccctg

SEQ ID NO: 1688326 - DNA, 18 bp, Homo sapiens
tgctagcacttggagcca

SEQ ID NO: 1688327 - DNA, 18 bp, Homo sapiens
tgctagcagtaaaagatg

SEQ ID NO: 1688328 - DNA, 13 bp, Homo sapiens
tgctagccctggg

SEQ ID NO: 1688329 - DNA, 20 bp, Homo sapiens
tgctagccggccactttgga

SEQ ID NO: 1688330 - DNA, 18 bp, Homo sapiens
tgctaggaagaggagtgg

SEQ ID NO: 1688331 - DNA, 22 bp, Homo sapiens
tgctagggaaacttcccgtccc

SEQ ID NO: 1688332 - DNA, 20 bp, Homo sapiens
tgctagggttaggaggtcct

SEQ ID NO: 1688333 - DNA, 22 bp, Homo sapiens
tgctagtcactggcagcctgca

SEQ ID NO: 1688334 - DNA, 20 bp, Homo sapiens
tgctagtgaaatggctgggg

SEQ ID NO: 1688335 - DNA, 16 bp, Homo sapiens
tgctagtgctgtaata

SEQ ID NO: 1688336 - DNA, 23 bp, Homo sapiens
tgctagtgctgtaatattgtaaa

SEQ ID NO: 1688337 - DNA, 19 bp, Homo sapiens
tgctagtgggccctctctc

SEQ ID NO: 1688338 - DNA, 22 bp, Homo sapiens
tgctagtgggccctctctctgg

SEQ ID NO: 1688339 - DNA, 15 bp, Homo sapiens
tgctagttctgctgc

SEQ ID NO: 1688340 - DNA, 18 bp, Homo sapiens
tgctagttggagtgcttg

SEQ ID NO: 1688341 - DNA, 18 bp, Homo sapiens
tgctataaatgccagagc

SEQ ID NO: 1688342 - DNA, 14 bp, Homo sapiens
tgctatacacacac

SEQ ID NO: 1688343 - DNA, 20 bp, Homo sapiens
tgctatacttatcacatttt

SEQ ID NO: 1688344 - DNA, 18 bp, Homo sapiens
tgctatagagcctacctg

SEQ ID NO: 1688345 - DNA, 21 bp, Homo sapiens
tgctatatataaaacggtgct

SEQ ID NO: 1688346 - DNA, 12 bp, Homo sapiens
tgctatcactgt

SEQ ID NO: 1688347 - DNA, 21 bp, Homo sapiens
tgctatcgccctcctttccct

SEQ ID NO: 1688348 - DNA, 22 bp, Homo sapiens
tgctatcgccctcctttccctt

SEQ ID NO: 1688349 - DNA, 16 bp, Homo sapiens
tgctatctctgtgtgc

SEQ ID NO: 1688350 - DNA, 20 bp, Homo sapiens
tgctatctctgtgtgcacaa

SEQ ID NO: 1688351 - DNA, 21 bp, Homo sapiens
tgctatctctgtgtgcacaaa

SEQ ID NO: 1688352 - DNA, 16 bp, Homo sapiens
tgctatgaaaatgagc

SEQ ID NO: 1688353 - DNA, 22 bp, Homo sapiens
tgctatgagctggggatgtctc

SEQ ID NO: 1688354 - DNA, 20 bp, Homo sapiens
tgctatgagttttctccttg

SEQ ID NO: 1688355 - DNA, 16 bp, Homo sapiens
tgctatgttactattt

SEQ ID NO: 1688356 - DNA, 19 bp, Homo sapiens
tgctatgttactattttct

SEQ ID NO: 1688357 - DNA, 13 bp, Homo sapiens
tgctattctgtgt

SEQ ID NO: 1688358 - DNA, 15 bp, Homo sapiens
tgctattctgtgttg

SEQ ID NO: 1688359 - DNA, 20 bp, Homo sapiens
tgctattggaggatcagttt

SEQ ID NO: 1688360 - DNA, 16 bp, Homo sapiens
tgctatttattttcct

SEQ ID NO: 1688361 - DNA, 17 bp, Homo sapiens
tgctatttgaacaagtg

SEQ ID NO: 1688362 - DNA, 21 bp, Homo sapiens
tgctatttgagcatgcacagc

SEQ ID NO: 1688363 - DNA, 15 bp, Homo sapiens
tgccgcatgctccct

SEQ ID NO: 1688364 - DNA, 17 bp, Homo sapiens
tgccgcatgctccctcc

SEQ ID NO: 1688365 - DNA, 17 bp, Homo sapiens
tgccgccagctgccgca

SEQ ID NO: 1688366 - DNA, 18 bp, Homo sapiens
tgccgcccccgcctgggc

SEQ ID NO: 1688367 - DNA, 22 bp, Homo sapiens
tgccgcccccgcctgggcaccg

SEQ ID NO: 1688368 - DNA, 16 bp, Homo sapiens
tgccgcctgctcctca

SEQ ID NO: 1688369 - DNA, 18 bp, Homo sapiens
tgccgcgggcggccaggc

SEQ ID NO: 1688370 - DNA, 15 bp, Homo sapiens
tgccgctacctccct

SEQ ID NO: 1688371 - DNA, 18 bp, Homo sapiens
tgccgctacctccctccc

SEQ ID NO: 1688372 - DNA, 21 bp, Homo sapiens
tgccgctctaaattggctcca

SEQ ID NO: 1688373 - DNA, 17 bp, Homo sapiens
tgccgctctctctgagg

SEQ ID NO: 1688374 - DNA, 13 bp, Homo sapiens
tgccgctgtctct

SEQ ID NO: 1688375 - DNA, 16 bp, Homo sapiens
tgccgctgtctctgag

SEQ ID NO: 1688376 - DNA, 17 bp, Homo sapiens
tgccgctgtctctgagg

SEQ ID NO: 1688377 - DNA, 16 bp, Homo sapiens
tgccgctttctctgag

SEQ ID NO: 1688378 - DNA, 14 bp, Homo sapiens
tgccggaggagcat

SEQ ID NO: 1688379 - DNA, 21 bp, Homo sapiens
tgccggaggagcatgcgcaga

SEQ ID NO: 1688380 - DNA, 22 bp, Homo sapiens
tgccggcatctcccctagctca

SEQ ID NO: 1688381 - DNA, 21 bp, Homo sapiens
tgccgggcctgggcctcctgg

SEQ ID NO: 1688382 - DNA, 22 bp, Homo sapiens
tgccggtcccccatgccaccac

SEQ ID NO: 1688383 - DNA, 18 bp, Homo sapiens
tgccggtcgggcagccag

SEQ ID NO: 1688384 - DNA, 19 bp, Homo sapiens
tgccggtcgggcagccagc

SEQ ID NO: 1688385 - DNA, 22 bp, Homo sapiens
tgccggtgcacaggcctctgcc

SEQ ID NO: 1688386 - DNA, 13 bp, Homo sapiens
tgccggtgggacc

SEQ ID NO: 1688387 - DNA, 17 bp, Homo sapiens
tgccggttaaattccat

SEQ ID NO: 1688388 - DNA, 23 bp, Homo sapiens
tgccgtagggagtacctgctgcc

SEQ ID NO: 1688389 - DNA, 20 bp, Homo sapiens
tgccgtctaggattgggcct

SEQ ID NO: 1688390 - DNA, 16 bp, Homo sapiens
tgccgtcttctgccct

SEQ ID NO: 1688391 - DNA, 21 bp, Homo sapiens
tgccgtgtccaagggccgtgc

SEQ ID NO: 1688392 - DNA, 16 bp, Homo sapiens
tgccgttactctccaa

SEQ ID NO: 1688393 - DNA, 19 bp, Homo sapiens
tgccgttactctccaacct

SEQ ID NO: 1688394 - DNA, 19 bp, Homo sapiens
tgccgttctgttccaacct

SEQ ID NO: 1688395 - DNA, 12 bp, Homo sapiens
tgcctaaaataa

SEQ ID NO: 1688396 - DNA, 21 bp, Homo sapiens
tgcctaaaattgtatgaaaat

SEQ ID NO: 1688397 - DNA, 18 bp, Homo sapiens
tgcctaaattaaattggg

SEQ ID NO: 1688398 - DNA, 21 bp, Homo sapiens
tgcctaaatttaatgctgcct

SEQ ID NO: 1688399 - DNA, 15 bp, Homo sapiens
tgcctaacttgtaaa

SEQ ID NO: 1688400 - DNA, 15 bp, Homo sapiens
tgcctaatggagaag

SEQ ID NO: 1688401 - DNA, 14 bp, Homo sapiens
tgcctacagctgtc

SEQ ID NO: 1688402 - DNA, 15 bp, Homo sapiens
tgcctacagctgtct

SEQ ID NO: 1688403 - DNA, 22 bp, Homo sapiens
tgcctagagtgtagcctaaagg

SEQ ID NO: 1688404 - DNA, 20 bp, Homo sapiens
tgcctagattaggtagactt

SEQ ID NO: 1688405 - DNA, 21 bp, Homo sapiens
tgcctagattaggtagacttt

SEQ ID NO: 1688406 - DNA, 17 bp, Homo sapiens
tgcctaggcgattttgt

SEQ ID NO: 1688407 - DNA, 15 bp, Homo sapiens
tgcctaggctggaaa

SEQ ID NO: 1688408 - DNA, 17 bp, Homo sapiens
tgcctatagtcccagct

SEQ ID NO: 1688409 - DNA, 18 bp, Homo sapiens
tgcctatagtcccagcta

SEQ ID NO: 1688410 - DNA, 16 bp, Homo sapiens
tgcctatatctgagag

SEQ ID NO: 1688411 - DNA, 14 bp, Homo sapiens
tgcctattcacgcc

SEQ ID NO: 1688412 - DNA, 22 bp, Homo sapiens
tgcctattcacgccgtaattct

SEQ ID NO: 1688413 - DNA, 19 bp, Homo sapiens
tgcctcaagccccagagtg

SEQ ID NO: 1688414 - DNA, 14 bp, Homo sapiens
tgcctcacctcgaa

SEQ ID NO: 1688415 - DNA, 16 bp, Homo sapiens
tgcctcacctcgaaag

SEQ ID NO: 1688416 - DNA, 17 bp, Homo sapiens
tgcctcagactccgccc

SEQ ID NO: 1688417 - DNA, 15 bp, Homo sapiens
tgcctcagagaccag

SEQ ID NO: 1688418 - DNA, 14 bp, Homo sapiens
tgcctcagcctccg

SEQ ID NO: 1688419 - DNA, 16 bp, Homo sapiens
tgcctcaggccagggc

SEQ ID NO: 1688420 - DNA, 20 bp, Homo sapiens
tgcctcaggccagggctcac

SEQ ID NO: 1688421 - DNA, 15 bp, Homo sapiens
tgcctcagttttcct

SEQ ID NO: 1688422 - DNA, 17 bp, Homo sapiens
tgcctcagttttccttc

SEQ ID NO: 1688423 - DNA, 18 bp, Homo sapiens
tgcctcatagcatagcca

SEQ ID NO: 1688424 - DNA, 21 bp, Homo sapiens
tgcctcatagcatagccagca

SEQ ID NO: 1688425 - DNA, 14 bp, Homo sapiens
tgcctcatgccaca

SEQ ID NO: 1688426 - DNA, 22 bp, Homo sapiens
tgcctcatttagagaggaaaag

SEQ ID NO: 1688427 - DNA, 17 bp, Homo sapiens
tgcctccaagccattca

SEQ ID NO: 1688428 - DNA, 20 bp, Homo sapiens
tgcctccaccaccactggcc

SEQ ID NO: 1688429 - DNA, 23 bp, Homo sapiens
tgcctccaccaccactggccacc

SEQ ID NO: 1688430 - DNA, 19 bp, Homo sapiens
tgcctccaccgagccagct

SEQ ID NO: 1688431 - DNA, 17 bp, Homo sapiens
tgcctccaccgctgcct

SEQ ID NO: 1688432 - DNA, 20 bp, Homo sapiens
tgcctccaccgctgcctaag

SEQ ID NO: 1688433 - DNA, 18 bp, Homo sapiens
tgcctccagggctggact

SEQ ID NO: 1688434 - DNA, 20 bp, Homo sapiens
tgcctccagggctggactga

SEQ ID NO: 1688435 - DNA, 17 bp, Homo sapiens
tgcctccaggtgcagag

SEQ ID NO: 1688436 - DNA, 21 bp, Homo sapiens
tgcctcccaggcaagcagctg

SEQ ID NO: 1688437 - DNA, 23 bp, Homo sapiens
tgcctcccaggcaagcagctggt

SEQ ID NO: 1688438 - DNA, 20 bp, Homo sapiens
tgcctccccatttcccatct

SEQ ID NO: 1688439 - DNA, 23 bp, Homo sapiens
tgcctccccatttcccatctgca

SEQ ID NO: 1688440 - DNA, 17 bp, Homo sapiens
tgcctcccctctccttc

SEQ ID NO: 1688441 - DNA, 22 bp, Homo sapiens
tgcctccctggggaccaggagc

SEQ ID NO: 1688442 - DNA, 19 bp, Homo sapiens
tgcctccgggcaggcaagg

SEQ ID NO: 1688443 - DNA, 17 bp, Homo sapiens
tgcctcctgccacccct

SEQ ID NO: 1688444 - DNA, 14 bp, Homo sapiens
tgcctcctgccctt

SEQ ID NO: 1688445 - DNA, 16 bp, Homo sapiens
tgcctcctggctcagg

SEQ ID NO: 1688446 - DNA, 19 bp, Homo sapiens
tgcctcctggctcaggccc

SEQ ID NO: 1688447 - DNA, 18 bp, Homo sapiens
tgcctccttgatatttgt

SEQ ID NO: 1688448 - DNA, 16 bp, Homo sapiens
tgcctccttggccacc

SEQ ID NO: 1688449 - DNA, 22 bp, Homo sapiens
tgcctccttggccaccagacca

SEQ ID NO: 1688450 - DNA, 16 bp, Homo sapiens
tgcctcggactccatg

SEQ ID NO: 1688451 - DNA, 17 bp, Homo sapiens
tgcctctagtccccaag

SEQ ID NO: 1688452 - DNA, 18 bp, Homo sapiens
tgcctctagtccccaagg

SEQ ID NO: 1688453 - DNA, 21 bp, Homo sapiens
tgcctctagtccccaaggcct

SEQ ID NO: 1688454 - DNA, 22 bp, Homo sapiens
tgcctctagtccccaaggcctc

SEQ ID NO: 1688455 - DNA, 12 bp, Homo sapiens
tgcctctcacac

SEQ ID NO: 1688456 - DNA, 12 bp, Homo sapiens
tgcctctgaaaa

SEQ ID NO: 1688457 - DNA, 17 bp, Homo sapiens
tgcctctgaaaatattt

SEQ ID NO: 1688458 - DNA, 19 bp, Homo sapiens
tgcctctgacagtccacag

SEQ ID NO: 1688459 - DNA, 20 bp, Homo sapiens
tgcctctgacagtccacagg

SEQ ID NO: 1688460 - DNA, 21 bp, Homo sapiens
tgcctctgacagtccacaggg

SEQ ID NO: 1688461 - DNA, 22 bp, Homo sapiens
tgcctctgacagtccacagggg

SEQ ID NO: 1688462 - DNA, 13 bp, Homo sapiens
tgcctctgccctg

SEQ ID NO: 1688463 - DNA, 11 bp, Homo sapiens
tgcctctgctc

SEQ ID NO: 1688464 - DNA, 13 bp, Homo sapiens
tgcctctgctccc

SEQ ID NO: 1688465 - DNA, 15 bp, Homo sapiens
tgcctctgctccctc

SEQ ID NO: 1688466 - DNA, 13 bp, Homo sapiens
tgcctctgggact

SEQ ID NO: 1688467 - DNA, 13 bp, Homo sapiens
tgcctctgtcccc

SEQ ID NO: 1688468 - DNA, 14 bp, Homo sapiens
tgcctctgtcccct

SEQ ID NO: 1688469 - DNA, 12 bp, Homo sapiens
tgctcctcaccc

SEQ ID NO: 1688470 - DNA, 16 bp, Homo sapiens
tgctcctccagggcca

SEQ ID NO: 1688471 - DNA, 22 bp, Homo sapiens
tgctcctccagggccacgtgcc

SEQ ID NO: 1688472 - DNA, 12 bp, Homo sapiens
tgctcctccctg

SEQ ID NO: 1688473 - DNA, 16 bp, Homo sapiens
tgctcctccctgcccc

SEQ ID NO: 1688474 - DNA, 17 bp, Homo sapiens
tgctcctccctgccccc

SEQ ID NO: 1688475 - DNA, 22 bp, Homo sapiens
tgctcctccctggctgccctgg

SEQ ID NO: 1688476 - DNA, 17 bp, Homo sapiens
tgctcctcttgattcct

SEQ ID NO: 1688477 - DNA, 12 bp, Homo sapiens
tgctcctgccca

SEQ ID NO: 1688478 - DNA, 22 bp, Homo sapiens
tgctcctgcttttctgtcctgg

SEQ ID NO: 1688479 - DNA, 23 bp, Homo sapiens
tgctccttcactgttccctctgg

SEQ ID NO: 1688480 - DNA, 17 bp, Homo sapiens
tgctccttgagaggaga

SEQ ID NO: 1688481 - DNA, 18 bp, Homo sapiens
tgctcctttaccctcttg

SEQ ID NO: 1688482 - DNA, 15 bp, Homo sapiens
tgctccttttctctt

SEQ ID NO: 1688483 - DNA, 13 bp, Homo sapiens
tgctcgaccttga

SEQ ID NO: 1688484 - DNA, 17 bp, Homo sapiens
tgctcgagacacagtga

SEQ ID NO: 1688485 - DNA, 18 bp, Homo sapiens
tgctcgcccagacaccat

SEQ ID NO: 1688486 - DNA, 18 bp, Homo sapiens
tgctcggcttcttggacc

SEQ ID NO: 1688487 - DNA, 13 bp, Homo sapiens
tgctctaaaatat

SEQ ID NO: 1688488 - DNA, 19 bp, Homo sapiens
tgctctaaaatatttatga

SEQ ID NO: 1688489 - DNA, 17 bp, Homo sapiens
tgctctagattcataaa

SEQ ID NO: 1688490 - DNA, 16 bp, Homo sapiens
tgctctagctggcagg

SEQ ID NO: 1688491 - DNA, 13 bp, Homo sapiens
tgctggctgcccc

SEQ ID NO: 1688492 - DNA, 13 bp, Homo sapiens
tgctggctgcctt

SEQ ID NO: 1688493 - DNA, 21 bp, Homo sapiens
tgctggctgccttagaacctt

SEQ ID NO: 1688494 - DNA, 23 bp, Homo sapiens
tgctgggaaccccgcagcccgtg

SEQ ID NO: 1688495 - DNA, 18 bp, Homo sapiens
tgctgggaagagctcccc

SEQ ID NO: 1688496 - DNA, 17 bp, Homo sapiens
tgctgggaccagagcca

SEQ ID NO: 1688497 - DNA, 22 bp, Homo sapiens
tgctgggaccagagccagatgc

SEQ ID NO: 1688498 - DNA, 21 bp, Homo sapiens
tgctgggacccacctccccct

SEQ ID NO: 1688499 - DNA, 21 bp, Homo sapiens
tgctgggacgatcgcccaggc

SEQ ID NO: 1688500 - DNA, 22 bp, Homo sapiens
tgctgggactcagccttcagac

SEQ ID NO: 1688501 - DNA, 21 bp, Homo sapiens
tgctgggagctgaaaaatcac

SEQ ID NO: 1688502 - DNA, 16 bp, Homo sapiens
tgctgggattacagac

SEQ ID NO: 1688503 - DNA, 20 bp, Homo sapiens
tgctgggattacaggtgtga

SEQ ID NO: 1688504 - DNA, 13 bp, Homo sapiens
tgctgggcaatga

SEQ ID NO: 1688505 - DNA, 20 bp, Homo sapiens
tgctgggccactggggactt

SEQ ID NO: 1688506 - DNA, 12 bp, Homo sapiens
tgctgggccagg

SEQ ID NO: 1688507 - DNA, 13 bp, Homo sapiens
tgctgggccaggg

SEQ ID NO: 1688508 - DNA, 14 bp, Homo sapiens
tgctgggccaggga

SEQ ID NO: 1688509 - DNA, 20 bp, Homo sapiens
tgctgggcgtgtgtgacact

SEQ ID NO: 1688510 - DNA, 14 bp, Homo sapiens
tgctgggctctcca

SEQ ID NO: 1688511 - DNA, 23 bp, Homo sapiens
tgctgggctctccacctcagcct

SEQ ID NO: 1688512 - DNA, 13 bp, Homo sapiens
tgctgggctctgc

SEQ ID NO: 1688513 - DNA, 18 bp, Homo sapiens
tgctgggctggactggcc

SEQ ID NO: 1688514 - DNA, 19 bp, Homo sapiens
tgctgggctggactggcca

SEQ ID NO: 1688515 - DNA, 20 bp, Homo sapiens
tgctgggctggactggccat

SEQ ID NO: 1688516 - DNA, 15 bp, Homo sapiens
tgctgggctgggccc

SEQ ID NO: 1688517 - DNA, 13 bp, Homo sapiens
tgctggggaaggg

SEQ ID NO: 1688518 - DNA, 17 bp, Homo sapiens
tgctggggagtccctgc

SEQ ID NO: 1688519 - DNA, 23 bp, Homo sapiens
tgctggggcaagtccctgactct

SEQ ID NO: 1688520 - DNA, 18 bp, Homo sapiens
tgctggggcatgtgtgcc

SEQ ID NO: 1688521 - DNA, 20 bp, Homo sapiens
tgctggggcatgtgtgcctg

SEQ ID NO: 1688522 - DNA, 16 bp, Homo sapiens
tgctgggggccgccct

SEQ ID NO: 1688523 - DNA, 21 bp, Homo sapiens
tgctgggttcccactcccggc

SEQ ID NO: 1688524 - DNA, 17 bp, Homo sapiens
tgctgggttggtgcaca

SEQ ID NO: 1688525 - DNA, 19 bp, Homo sapiens
tgctgggttggtgcacagt

SEQ ID NO: 1688526 - DNA, 16 bp, Homo sapiens
tgctggtaacagtggc

SEQ ID NO: 1688527 - DNA, 19 bp, Homo sapiens
tgctggtagagacccccag

SEQ ID NO: 1688528 - DNA, 16 bp, Homo sapiens
tgctggtatttctaat

SEQ ID NO: 1688529 - DNA, 17 bp, Homo sapiens
tgctggtcccctcctca

SEQ ID NO: 1688530 - DNA, 13 bp, Homo sapiens
tgctggtccgtgg

SEQ ID NO: 1688531 - DNA, 20 bp, Homo sapiens
tgctggttgttgccaggttg

SEQ ID NO: 1688532 - DNA, 18 bp, Homo sapiens
tgctgtaactgctgagcc

SEQ ID NO: 1688533 - DNA, 20 bp, Homo sapiens
tgctgtaactgctgagccac

SEQ ID NO: 1688534 - DNA, 23 bp, Homo sapiens
tgctgtaactgctgagccactcg

SEQ ID NO: 1688535 - DNA, 12 bp, Homo sapiens
tgctgtaactgg

SEQ ID NO: 1688536 - DNA, 23 bp, Homo sapiens
tgctgtacacatatttgaagggt

SEQ ID NO: 1688537 - DNA, 15 bp, Homo sapiens
tgctgtacccttcca

SEQ ID NO: 1688538 - DNA, 18 bp, Homo sapiens
tgctgtactcttgctgat

SEQ ID NO: 1688539 - DNA, 18 bp, Homo sapiens
tgctgtagaaacacataa

SEQ ID NO: 1688540 - DNA, 17 bp, Homo sapiens
tgctgtagcctattttt

SEQ ID NO: 1688541 - DNA, 22 bp, Homo sapiens
tgctgtatgctgatcatcgcca

SEQ ID NO: 1688542 - DNA, 14 bp, Homo sapiens
tgctgtatttcctg

SEQ ID NO: 1688543 - DNA, 23 bp, Homo sapiens
tgctgtattttaacactttgtat

SEQ ID NO: 1688544 - DNA, 18 bp, Homo sapiens
tgctgtcacttcttcacc

SEQ ID NO: 1688545 - DNA, 14 bp, Homo sapiens
tgctgtccaggcag

SEQ ID NO: 1688546 - DNA, 15 bp, Homo sapiens
tgctgtccaggcagc

SEQ ID NO: 1688547 - DNA, 21 bp, Homo sapiens
tgctgtccaggcagctccctc

SEQ ID NO: 1688548 - DNA, 13 bp, Homo sapiens
tgctgtccctccc

SEQ ID NO: 1688549 - DNA, 17 bp, Homo sapiens
tgctgtccctccccctt

SEQ ID NO: 1688550 - DNA, 14 bp, Homo sapiens
tgctgtcctaggcc

SEQ ID NO: 1688551 - DNA, 14 bp, Homo sapiens
tgctgtcctgcagt

SEQ ID NO: 1688552 - DNA, 15 bp, Homo sapiens
tgctgtcctggtggc

SEQ ID NO: 1688553 - DNA, 14 bp, Homo sapiens
tgctgtcggcacca

SEQ ID NO: 1688554 - DNA, 14 bp, Homo sapiens
tgctgtctatgtgg

SEQ ID NO: 1688555 - DNA, 14 bp, Homo sapiens
tgctgtctctctgg

SEQ ID NO: 1688556 - DNA, 15 bp, Homo sapiens
tgctgtctctctggg

SEQ ID NO: 1688557 - DNA, 14 bp, Homo sapiens
tgctgtctggccct

SEQ ID NO: 1688558 - DNA, 16 bp, Homo sapiens
tgctgtctggccctgg

SEQ ID NO: 1688559 - DNA, 21 bp, Homo sapiens
tgctgtcttcagtctcacaga

SEQ ID NO: 1688560 - DNA, 23 bp, Homo sapiens
tgctgtcttcagtctcacagaga

SEQ ID NO: 1688561 - DNA, 15 bp, Homo sapiens
tgctgtctttctcta

SEQ ID NO: 1688562 - DNA, 18 bp, Homo sapiens
tgctgtgaaaactctggt

SEQ ID NO: 1688563 - DNA, 16 bp, Homo sapiens
tgctgtgaactttcat

SEQ ID NO: 1688564 - DNA, 18 bp, Homo sapiens
tgctgtgaggctgtcctg

SEQ ID NO: 1688565 - DNA, 16 bp, Homo sapiens
tgctgtgcagctctct

SEQ ID NO: 1688566 - DNA, 18 bp, Homo sapiens
tgctgtgccgtgtccaag

SEQ ID NO: 1688567 - DNA, 18 bp, Homo sapiens
tgctgtgcctgctagagc

SEQ ID NO: 1688568 - DNA, 16 bp, Homo sapiens
tgctgtgctctgggga

SEQ ID NO: 1688569 - DNA, 12 bp, Homo sapiens
tgctgtgctgga

SEQ ID NO: 1688570 - DNA, 15 bp, Homo sapiens
tgctgtggcctgggc

SEQ ID NO: 1688571 - DNA, 16 bp, Homo sapiens
tgctgtggcctgggca

SEQ ID NO: 1688572 - DNA, 14 bp, Homo sapiens
tgctgtgggagagc

SEQ ID NO: 1688573 - DNA, 13 bp, Homo sapiens
tgctgtgggcctc

SEQ ID NO: 1688574 - DNA, 13 bp, Homo sapiens
tgctgtgtatatg

SEQ ID NO: 1688575 - DNA, 18 bp, Homo sapiens
tgctgtgtgaatccagga

SEQ ID NO: 1688576 - DNA, 17 bp, Homo sapiens
tgctgtgtgaccctggg

SEQ ID NO: 1688577 - DNA, 16 bp, Homo sapiens
tgctgtgtgccccact

SEQ ID NO: 1688578 - DNA, 17 bp, Homo sapiens
tgctgtgtgccccactc

SEQ ID NO: 1688579 - DNA, 21 bp, Homo sapiens
tgctgtgtgccccactccagc

SEQ ID NO: 1688580 - DNA, 21 bp, Homo sapiens
tgctgtgtgctttttttgtgt

SEQ ID NO: 1688581 - DNA, 23 bp, Homo sapiens
tgctgtgtgtcccaggcagggag

SEQ ID NO: 1688582 - DNA, 18 bp, Homo sapiens
tgctgtgttaaataaacc

SEQ ID NO: 1688583 - DNA, 17 bp, Homo sapiens
tgctgtgttaagaggac

SEQ ID NO: 1688584 - DNA, 20 bp, Homo sapiens
tgctgttaatatttctaaaa

SEQ ID NO: 1688585 - DNA, 19 bp, Homo sapiens
tgctgttatgtccagaaat

SEQ ID NO: 1688586 - DNA, 17 bp, Homo sapiens
tgctgttcctgctccat

SEQ ID NO: 1688587 - DNA, 15 bp, Homo sapiens
tgctgttgccatagc

SEQ ID NO: 1688588 - DNA, 17 bp, Homo sapiens
tgctgttgccatagccc

SEQ ID NO: 1688589 - DNA, 17 bp, Homo sapiens
tgctgttgctgatttta

SEQ ID NO: 1688590 - DNA, 17 bp, Homo sapiens
tgctgttggtcctctct

SEQ ID NO: 1688591 - DNA, 14 bp, Homo sapiens
tgctgtttattaat

SEQ ID NO: 1688592 - DNA, 18 bp, Homo sapiens
tgctgtttcacaatacct

SEQ ID NO: 1688593 - DNA, 13 bp, Homo sapiens
tgctgtttctaag

SEQ ID NO: 1688594 - DNA, 23 bp, Homo sapiens
tgctgtttctaagaaaatgtagt

SEQ ID NO: 1688595 - DNA, 16 bp, Homo sapiens
tgctgtttggtttgga

SEQ ID NO: 1688596 - DNA, 17 bp, Homo sapiens
tgctgtttggtttggag

SEQ ID NO: 1688597 - DNA, 19 bp, Homo sapiens
tgctgtttgtttgacaaag

SEQ ID NO: 1688598 - DNA, 18 bp, Homo sapiens
tgcttaaaaaataataca

SEQ ID NO: 1688599 - DNA, 15 bp, Homo sapiens
tgcttaaaataagca

SEQ ID NO: 1688600 - DNA, 21 bp, Homo sapiens
tgcttaaaccacttaaacgaa

SEQ ID NO: 1688601 - DNA, 16 bp, Homo sapiens
tgcttaaactggaaag

SEQ ID NO: 1688602 - DNA, 15 bp, Homo sapiens
tgcttaaagcttccc

SEQ ID NO: 1688603 - DNA, 14 bp, Homo sapiens
tgctttcctgggcc

SEQ ID NO: 1688604 - DNA, 17 bp, Homo sapiens
tgctttcggagctcctg

SEQ ID NO: 1688605 - DNA, 20 bp, Homo sapiens
tgctttcgtccatgtttctc

SEQ ID NO: 1688606 - DNA, 12 bp, Homo sapiens
tgctttctagca

SEQ ID NO: 1688607 - DNA, 14 bp, Homo sapiens
tgctttctagcaaa

SEQ ID NO: 1688608 - DNA, 13 bp, Homo sapiens
tgctttctgaatt

SEQ ID NO: 1688609 - DNA, 14 bp, Homo sapiens
tgctttctgtggct

SEQ ID NO: 1688610 - DNA, 14 bp, Homo sapiens
tgctttctgtttct

SEQ ID NO: 1688611 - DNA, 16 bp, Homo sapiens
tgctttctgtttctta

SEQ ID NO: 1688612 - DNA, 11 bp, Homo sapiens
tgctttcttac

SEQ ID NO: 1688613 - DNA, 20 bp, Homo sapiens
tgctttcttttttaaaatca

SEQ ID NO: 1688614 - DNA, 15 bp, Homo sapiens
tgctttgaaaatatt

SEQ ID NO: 1688615 - DNA, 21 bp, Homo sapiens
tgctttgaaaatatttgtcca

SEQ ID NO: 1688616 - DNA, 22 bp, Homo sapiens
tgctttgaaaatatttgtccaa

SEQ ID NO: 1688617 - DNA, 20 bp, Homo sapiens
tgctttgcatctttgttact

SEQ ID NO: 1688618 - DNA, 13 bp, Homo sapiens
tgctttgccaaaa

SEQ ID NO: 1688619 - DNA, 17 bp, Homo sapiens
tgctttgccaaaatacc

SEQ ID NO: 1688620 - DNA, 17 bp, Homo sapiens
tgctttgccaagttgct

SEQ ID NO: 1688621 - DNA, 20 bp, Homo sapiens
tgctttgccaagttgctgtc

SEQ ID NO: 1688622 - DNA, 21 bp, Homo sapiens
tgctttgccaagttgctgtca

SEQ ID NO: 1688623 - DNA, 15 bp, Homo sapiens
tgctttgccagagca

SEQ ID NO: 1688624 - DNA, 21 bp, Homo sapiens
tgctttggacctaaatggcct

SEQ ID NO: 1688625 - DNA, 17 bp, Homo sapiens
tgctttggcttacttgt

SEQ ID NO: 1688626 - DNA, 15 bp, Homo sapiens
tgctttgggctgccc

SEQ ID NO: 1688627 - DNA, 16 bp, Homo sapiens
tgctttgggctgccct

SEQ ID NO: 1688628 - DNA, 21 bp, Homo sapiens
tgctttgggctttgcaggctc

SEQ ID NO: 1688629 - DNA, 22 bp, Homo sapiens
tgctttgggctttgcaggctct

SEQ ID NO: 1688630 - DNA, 23 bp, Homo sapiens
tgctttgggctttgcaggctctg

SEQ ID NO: 1688631 - DNA, 22 bp, Homo sapiens
tgctttggggggtgtgctgaca

SEQ ID NO: 1688632 - DNA, 18 bp, Homo sapiens
tgctttgttgatttagat

SEQ ID NO: 1688633 - DNA, 13 bp, Homo sapiens
tgcttttaattaa

SEQ ID NO: 1688634 - DNA, 14 bp, Homo sapiens
tgcttttcagctga

SEQ ID NO: 1688635 - DNA, 18 bp, Homo sapiens
tgcttttcattagcagtt

SEQ ID NO: 1688636 - DNA, 22 bp, Homo sapiens
tgcttttccaggatcctgcagg

SEQ ID NO: 1688637 - DNA, 23 bp, Homo sapiens
tgcttttccaggatcctgcagga

SEQ ID NO: 1688638 - DNA, 18 bp, Homo sapiens
tgcttttccctttgtgag

SEQ ID NO: 1688639 - DNA, 17 bp, Homo sapiens
tgcttttcctcaagcaa

SEQ ID NO: 1688640 - DNA, 20 bp, Homo sapiens
tgcttttctccaatatcagt

SEQ ID NO: 1688641 - DNA, 16 bp, Homo sapiens
tgcttttctgccctgg

SEQ ID NO: 1688642 - DNA, 12 bp, Homo sapiens
tgcttttgatgt

SEQ ID NO: 1688643 - DNA, 14 bp, Homo sapiens
tgcttttgccactt

SEQ ID NO: 1688644 - DNA, 16 bp, Homo sapiens
tgcttttgcttgcaat

SEQ ID NO: 1688645 - DNA, 13 bp, Homo sapiens
tgcttttgttttt

SEQ ID NO: 1688646 - DNA, 20 bp, Homo sapiens
tgcttttgtttttttcctca

SEQ ID NO: 1688647 - DNA, 22 bp, Homo sapiens
tggaattagaacccttgcacag

SEQ ID NO: 1688648 - DNA, 13 bp, Homo sapiens
tggaattataaat

SEQ ID NO: 1688649 - DNA, 16 bp, Homo sapiens
tggaattataaatatt

SEQ ID NO: 1688650 - DNA, 23 bp, Homo sapiens
tggaattattttgaatgtcacaa

SEQ ID NO: 1688651 - DNA, 20 bp, Homo sapiens
tggaattcagcaccctgggt

SEQ ID NO: 1688652 - DNA, 19 bp, Homo sapiens
tggaattcctctttaacaa

SEQ ID NO: 1688653 - DNA, 20 bp, Homo sapiens
tggaattctactggaaaaaa

SEQ ID NO: 1688654 - DNA, 15 bp, Homo sapiens
tggaattgccagctg

SEQ ID NO: 1688655 - DNA, 11 bp, Homo sapiens
tggaattgctt

SEQ ID NO: 1688656 - DNA, 13 bp, Homo sapiens
tggaatttgttca

SEQ ID NO: 1688657 - DNA, 23 bp, Homo sapiens
tggaattttgcaaagatttaatc

SEQ ID NO: 1688658 - DNA, 17 bp, Homo sapiens
tggaatttttttttcct

SEQ ID NO: 1688659 - DNA, 15 bp, Homo sapiens
tggacaaatcacata

SEQ ID NO: 1688660 - DNA, 22 bp, Homo sapiens
tggacaacttatttaaaaatat

SEQ ID NO: 1688661 - DNA, 16 bp, Homo sapiens
tggacaatcatgaaat

SEQ ID NO: 1688662 - DNA, 20 bp, Homo sapiens
tggacacacacagactattt

SEQ ID NO: 1688663 - DNA, 12 bp, Homo sapiens
tggacacagctc

SEQ ID NO: 1688664 - DNA, 20 bp, Homo sapiens
tggacaccaggagtccctgg

SEQ ID NO: 1688665 - DNA, 18 bp, Homo sapiens
tggacaccttgtgtttag

SEQ ID NO: 1688666 - DNA, 18 bp, Homo sapiens
tggacacctttaggttct

SEQ ID NO: 1688667 - DNA, 15 bp, Homo sapiens
tggacactcagacct

SEQ ID NO: 1688668 - DNA, 16 bp, Homo sapiens
tggacactcagacctg

SEQ ID NO: 1688669 - DNA, 20 bp, Homo sapiens
tggacactttgaaatgtgtt

SEQ ID NO: 1688670 - DNA, 21 bp, Homo sapiens
tggacactttgaaatgtgttt

SEQ ID NO: 1688671 - DNA, 12 bp, Homo sapiens
tggacagacaga

SEQ ID NO: 1688672 - DNA, 21 bp, Homo sapiens
tggacagattgcctgtttctg

SEQ ID NO: 1688673 - DNA, 12 bp, Homo sapiens
tggacagccccc

SEQ ID NO: 1688674 - DNA, 19 bp, Homo sapiens
tggacagcgatgaggggac

SEQ ID NO: 1688675 - DNA, 15 bp, Homo sapiens
tggacagctgcttgt

SEQ ID NO: 1688676 - DNA, 21 bp, Homo sapiens
tggacaggagatcagcagcgt

SEQ ID NO: 1688677 - DNA, 20 bp, Homo sapiens
tggacaggatgaggacagag

SEQ ID NO: 1688678 - DNA, 23 bp, Homo sapiens
tggacaggatgaggacagagggc

SEQ ID NO: 1688679 - DNA, 15 bp, Homo sapiens
tggacaggcagcctc

SEQ ID NO: 1688680 - DNA, 13 bp, Homo sapiens
tggacaggcccag

SEQ ID NO: 1688681 - DNA, 23 bp, Homo sapiens
tggacagggcccccggccacgct

SEQ ID NO: 1688682 - DNA, 19 bp, Homo sapiens
tggacagtacctgattgta

SEQ ID NO: 1688683 - DNA, 17 bp, Homo sapiens
tggacatcaccagtcct

SEQ ID NO: 1688684 - DNA, 20 bp, Homo sapiens
tggacatcaccagtcctagc

SEQ ID NO: 1688685 - DNA, 18 bp, Homo sapiens
tggacatcctcctcccac

SEQ ID NO: 1688686 - DNA, 14 bp, Homo sapiens
tggacatgcctcaa

SEQ ID NO: 1688687 - DNA, 17 bp, Homo sapiens
tggacattctctttgat

SEQ ID NO: 1688688 - DNA, 18 bp, Homo sapiens
tggacattctctttgata

SEQ ID NO: 1688689 - DNA, 18 bp, Homo sapiens
tggacatttctaattcct

SEQ ID NO: 1688690 - DNA, 22 bp, Homo sapiens
tggaccaaagggaagtgaggcc

SEQ ID NO: 1688691 - DNA, 19 bp, Homo sapiens
tggaccactcctgtccctg

SEQ ID NO: 1688692 - DNA, 12 bp, Homo sapiens
tggaccactgca

SEQ ID NO: 1688693 - DNA, 12 bp, Homo sapiens
tggaccagagga

SEQ ID NO: 1688694 - DNA, 14 bp, Homo sapiens
tggaccagaggaag

SEQ ID NO: 1688695 - DNA, 12 bp, Homo sapiens
tggaccagcctc

SEQ ID NO: 1688696 - DNA, 16 bp, Homo sapiens
tggaccaggtcctgct

SEQ ID NO: 1688697 - DNA, 22 bp, Homo sapiens
tggacccacgaacgctcttagc

SEQ ID NO: 1688698 - DNA, 13 bp, Homo sapiens
tggaccccagcat

SEQ ID NO: 1688699 - DNA, 17 bp, Homo sapiens
tggaaattctgaaaact

SEQ ID NO: 1688700 - DNA, 17 bp, Homo sapiens
tggaaatttaaatgaca

SEQ ID NO: 1688701 - DNA, 21 bp, Homo sapiens
tggaaatttgttataatgaat

SEQ ID NO: 1688702 - DNA, 15 bp, Homo sapiens
tggaacaacttgtag

SEQ ID NO: 1688703 - DNA, 22 bp, Homo sapiens
tggaacaagacagccttcactt

SEQ ID NO: 1688704 - DNA, 21 bp, Homo sapiens
tggaacaagatggttctagca

SEQ ID NO: 1688705 - DNA, 15 bp, Homo sapiens
tggaacaccagcagc

SEQ ID NO: 1688706 - DNA, 14 bp, Homo sapiens
tggaacaccctgga

SEQ ID NO: 1688707 - DNA, 18 bp, Homo sapiens
tggaacaccctggatgct

SEQ ID NO: 1688708 - DNA, 14 bp, Homo sapiens
tggaacaccttggg

SEQ ID NO: 1688709 - DNA, 19 bp, Homo sapiens
tggaacactcatgtctgga

SEQ ID NO: 1688710 - DNA, 13 bp, Homo sapiens
tggaacagcggga

SEQ ID NO: 1688711 - DNA, 16 bp, Homo sapiens
tggaacagcgggagac

SEQ ID NO: 1688712 - DNA, 12 bp, Homo sapiens
tggaacagtgct

SEQ ID NO: 1688713 - DNA, 12 bp, Homo sapiens
tggaacatttct

SEQ ID NO: 1688714 - DNA, 17 bp, Homo sapiens
tggaacatttctttctt

SEQ ID NO: 1688715 - DNA, 18 bp, Homo sapiens
tggaacatttgatatttt

SEQ ID NO: 1688716 - DNA, 22 bp, Homo sapiens
tggaacatttgatatttttcca

SEQ ID NO: 1688717 - DNA, 13 bp, Homo sapiens
tggaaccacctgg

SEQ ID NO: 1688718 - DNA, 12 bp, Homo sapiens
tggaaccagact

SEQ ID NO: 1688719 - DNA, 19 bp, Homo sapiens
tggaaccagggaggagagg

SEQ ID NO: 1688720 - DNA, 21 bp, Homo sapiens
tggaaccagggaggagaggaa

SEQ ID NO: 1688721 - DNA, 12 bp, Homo sapiens
tggaacccagac

SEQ ID NO: 1688722 - DNA, 14 bp, Homo sapiens
tggaacccagactc

SEQ ID NO: 1688723 - DNA, 16 bp, Homo sapiens
tggaacccagactcag

SEQ ID NO: 1688724 - DNA, 22 bp, Homo sapiens
tggaacccagactcagacattg

SEQ ID NO: 1688725 - DNA, 17 bp, Homo sapiens
tggaacctcagcctggc

SEQ ID NO: 1688726 - DNA, 18 bp, Homo sapiens
tggaacctcagcctggcc

SEQ ID NO: 1688727 - DNA, 20 bp, Homo sapiens
tggaacggtgaaggtgacag

SEQ ID NO: 1688728 - DNA, 14 bp, Homo sapiens
tggaactactgtac

SEQ ID NO: 1688729 - DNA, 17 bp, Homo sapiens
tggaactactgtacttt

SEQ ID NO: 1688730 - DNA, 19 bp, Homo sapiens
tggaactcattcctgcctg

SEQ ID NO: 1688731 - DNA, 21 bp, Homo sapiens
tggaactcattcctgcctgtc

SEQ ID NO: 1688732 - DNA, 13 bp, Homo sapiens
tggaactctgctt

SEQ ID NO: 1688733 - DNA, 23 bp, Homo sapiens
tggaactctgtgcaggtgctgcc

SEQ ID NO: 1688734 - DNA, 22 bp, Homo sapiens
tggaactgaccccctcccctga

SEQ ID NO: 1688735 - DNA, 13 bp, Homo sapiens
tggaactgtccca

SEQ ID NO: 1688736 - DNA, 13 bp, Homo sapiens
tggaagaaagtaa

SEQ ID NO: 1688737 - DNA, 16 bp, Homo sapiens
tggaagaacaggcctc

SEQ ID NO: 1688738 - DNA, 17 bp, Homo sapiens
tggaagaagggagaaga

SEQ ID NO: 1688739 - DNA, 14 bp, Homo sapiens
tggaagacacttca

SEQ ID NO: 1688740 - DNA, 17 bp, Homo sapiens
tggaagaccccacccaa

SEQ ID NO: 1688741 - DNA, 18 bp, Homo sapiens
tggaagactgtgcagaag

SEQ ID NO: 1688742 - DNA, 14 bp, Homo sapiens
tggaagagcagcct

SEQ ID NO: 1688743 - DNA, 15 bp, Homo sapiens
tggaagagcagcctg

SEQ ID NO: 1688744 - DNA, 17 bp, Homo sapiens
tggaagagcccagtctg

SEQ ID NO: 1688745 - DNA, 14 bp, Homo sapiens
tggaagagctcttc

SEQ ID NO: 1688746 - DNA, 13 bp, Homo sapiens
tggaagatcctgc

SEQ ID NO: 1688747 - DNA, 13 bp, Homo sapiens
tggaagattctta

SEQ ID NO: 1688748 - DNA, 23 bp, Homo sapiens
tggaccccagctgggaggcaaga

SEQ ID NO: 1688749 - DNA, 16 bp, Homo sapiens
tggacccttataaaat

SEQ ID NO: 1688750 - DNA, 20 bp, Homo sapiens
tggacccttggcctccattt

SEQ ID NO: 1688751 - DNA, 22 bp, Homo sapiens
tggaccgggtgggcctggcctg

SEQ ID NO: 1688752 - DNA, 23 bp, Homo sapiens
tggaccgggtgggcctggcctga

SEQ ID NO: 1688753 - DNA, 15 bp, Homo sapiens
tggaccgtggacagg

SEQ ID NO: 1688754 - DNA, 13 bp, Homo sapiens
tggacctaacatt

SEQ ID NO: 1688755 - DNA, 15 bp, Homo sapiens
tggacctaacattcg

SEQ ID NO: 1688756 - DNA, 22 bp, Homo sapiens
tggacctaatccaagcatccct

SEQ ID NO: 1688757 - DNA, 19 bp, Homo sapiens
tggacctatgtcctaagga

SEQ ID NO: 1688758 - DNA, 20 bp, Homo sapiens
tggacctgcctcctgcctgc

SEQ ID NO: 1688759 - DNA, 13 bp, Homo sapiens
tggacctggcagt

SEQ ID NO: 1688760 - DNA, 23 bp, Homo sapiens
tggacctgtatatttgtaaagct

SEQ ID NO: 1688761 - DNA, 16 bp, Homo sapiens
tggaccttaggccttc

SEQ ID NO: 1688762 - DNA, 21 bp, Homo sapiens
tggacctttgggttctttctg

SEQ ID NO: 1688763 - DNA, 21 bp, Homo sapiens
tggaccttttcccttgctgta

SEQ ID NO: 1688764 - DNA, 13 bp, Homo sapiens
tggacgctgccct

SEQ ID NO: 1688765 - DNA, 16 bp, Homo sapiens
tggacgctgccctgca

SEQ ID NO: 1688766 - DNA, 18 bp, Homo sapiens
tggacgctgccctgcatg

SEQ ID NO: 1688767 - DNA, 20 bp, Homo sapiens
tggacggcaggctcactgcc

SEQ ID NO: 1688768 - DNA, 13 bp, Homo sapiens
tggacgtgaaata

SEQ ID NO: 1688769 - DNA, 21 bp, Homo sapiens
tggactaaccccaacgcacag

SEQ ID NO: 1688770 - DNA, 13 bp, Homo sapiens
tggactacacaat

SEQ ID NO: 1688771 - DNA, 20 bp, Homo sapiens
tggactacacccaagcctga

SEQ ID NO: 1688772 - DNA, 15 bp, Homo sapiens
tggactatctgtctg

SEQ ID NO: 1688773 - DNA, 17 bp, Homo sapiens
tggactatctgtctggt

SEQ ID NO: 1688774 - DNA, 23 bp, Homo sapiens
tggactatctgtctggtggcccc

SEQ ID NO: 1688775 - DNA, 16 bp, Homo sapiens
tggactcaggatgccc

SEQ ID NO: 1688776 - DNA, 18 bp, Homo sapiens
tggactcaggatgcccag

SEQ ID NO: 1688777 - DNA, 14 bp, Homo sapiens
tggactccaggcct

SEQ ID NO: 1688778 - DNA, 20 bp, Homo sapiens
tggactccaggcctgaccag

SEQ ID NO: 1688779 - DNA, 18 bp, Homo sapiens
tggactcccactctttga

SEQ ID NO: 1688780 - DNA, 14 bp, Homo sapiens
tggactcctgacca

SEQ ID NO: 1688781 - DNA, 14 bp, Homo sapiens
tggactctgcacat

SEQ ID NO: 1688782 - DNA, 16 bp, Homo sapiens
tggactctgcacatga

SEQ ID NO: 1688783 - DNA, 19 bp, Homo sapiens
tggactctgccccaatcgg

SEQ ID NO: 1688784 - DNA, 10 bp, Homo sapiens
tggactgacc

SEQ ID NO: 1688785 - DNA, 14 bp, Homo sapiens
tggactgaccaaag

SEQ ID NO: 1688786 - DNA, 23 bp, Homo sapiens
tggactgaccacaccaaccaggc

SEQ ID NO: 1688787 - DNA, 18 bp, Homo sapiens
tggactgactgtgttggg

SEQ ID NO: 1688788 - DNA, 18 bp, Homo sapiens
tggactgagaaattatac

SEQ ID NO: 1688789 - DNA, 11 bp, Homo sapiens
tggactgaggc

SEQ ID NO: 1688790 - DNA, 19 bp, Homo sapiens
tggactgagtgggaagccc

SEQ ID NO: 1688791 - DNA, 12 bp, Homo sapiens
tggactgatttg

SEQ ID NO: 1688792 - DNA, 13 bp, Homo sapiens
tggactgcagaag

SEQ ID NO: 1688793 - DNA, 22 bp, Homo sapiens
tggactgcatggggaggcagca

SEQ ID NO: 1688794 - DNA, 23 bp, Homo sapiens
tggactgcatggggaggcagcag

SEQ ID NO: 1688795 - DNA, 14 bp, Homo sapiens
tggactggaagggg

SEQ ID NO: 1688796 - DNA, 20 bp, Homo sapiens
tggactggccatttttctgg

SEQ ID NO: 1688797 - DNA, 22 bp, Homo sapiens
tggactggccatttttctgggg

SEQ ID NO: 1688798 - DNA, 21 bp, Homo sapiens
tggactgggttgcgtcctgac

SEQ ID NO: 1688799 - DNA, 22 bp, Homo sapiens
tggactgtcctgaggagccctg

SEQ ID NO: 1688800 - DNA, 16 bp, Homo sapiens
tggactgtgcctcagg

SEQ ID NO: 1688801 - DNA, 17 bp, Homo sapiens
tggactgtgctggtgca

SEQ ID NO: 1688802 - DNA, 17 bp, Homo sapiens
tggactgtggagggtca

SEQ ID NO: 1688803 - DNA, 20 bp, Homo sapiens
tggactgtggcacttgcctg

SEQ ID NO: 1688804 - DNA, 17 bp, Homo sapiens
tggacttaaccggagtt

SEQ ID NO: 1688805 - DNA, 18 bp, Homo sapiens
tggacttcacataagctc

SEQ ID NO: 1688806 - DNA, 23 bp, Homo sapiens
tggacttcacataagctcagaat

SEQ ID NO: 1688807 - DNA, 14 bp, Homo sapiens
tggacttcctgggg

SEQ ID NO: 1688808 - DNA, 16 bp, Homo sapiens
tggagtcttttctgtt

SEQ ID NO: 1688809 - DNA, 17 bp, Homo sapiens
tggagtgaggcttccag

SEQ ID NO: 1688810 - DNA, 18 bp, Homo sapiens
tggagtgagtcacctgct

SEQ ID NO: 1688811 - DNA, 15 bp, Homo sapiens
tggagtgcagggagg

SEQ ID NO: 1688812 - DNA, 23 bp, Homo sapiens
tggagtgcgctcttggtccctgg

SEQ ID NO: 1688813 - DNA, 16 bp, Homo sapiens
tggagtggaggcattg

SEQ ID NO: 1688814 - DNA, 15 bp, Homo sapiens
tggagtgtgagccac

SEQ ID NO: 1688815 - DNA, 16 bp, Homo sapiens
tggagtgtgcagacag

SEQ ID NO: 1688816 - DNA, 17 bp, Homo sapiens
tggagtgtgcagacagc

SEQ ID NO: 1688817 - DNA, 18 bp, Homo sapiens
tggagtgtgcagacagcc

SEQ ID NO: 1688818 - DNA, 13 bp, Homo sapiens
tggagttaaataa

SEQ ID NO: 1688819 - DNA, 17 bp, Homo sapiens
tggagttacattaatgt

SEQ ID NO: 1688820 - DNA, 19 bp, Homo sapiens
tggagttcaccttggaagg

SEQ ID NO: 1688821 - DNA, 23 bp, Homo sapiens
tggagtttaatacagtgagctct

SEQ ID NO: 1688822 - DNA, 16 bp, Homo sapiens
tggagtttctaaggtc

SEQ ID NO: 1688823 - DNA, 17 bp, Homo sapiens
tggagtttgtgtctgtt

SEQ ID NO: 1688824 - DNA, 23 bp, Homo sapiens
tggagttttaaaaggctcccatg

SEQ ID NO: 1688825 - DNA, 16 bp, Homo sapiens
tggataactagccaga

SEQ ID NO: 1688826 - DNA, 17 bp, Homo sapiens
tggataactagccagac

SEQ ID NO: 1688827 - DNA, 13 bp, Homo sapiens
tggataagtttct

SEQ ID NO: 1688828 - DNA, 19 bp, Homo sapiens
tggataagtttctattctg

SEQ ID NO: 1688829 - DNA, 16 bp, Homo sapiens
tggataatgtgtataa

SEQ ID NO: 1688830 - DNA, 15 bp, Homo sapiens
tggatatatttgaaa

SEQ ID NO: 1688831 - DNA, 14 bp, Homo sapiens
tggatatcagggta

SEQ ID NO: 1688832 - DNA, 19 bp, Homo sapiens
tggatatcagggtataaat

SEQ ID NO: 1688833 - DNA, 20 bp, Homo sapiens
tggatatcagggtataaatt

SEQ ID NO: 1688834 - DNA, 21 bp, Homo sapiens
tggatatcagggtataaatta

SEQ ID NO: 1688835 - DNA, 12 bp, Homo sapiens
tggatatgaccc

SEQ ID NO: 1688836 - DNA, 14 bp, Homo sapiens
tggatatgctgctt

SEQ ID NO: 1688837 - DNA, 18 bp, Homo sapiens
tggatatttcaatctttt

SEQ ID NO: 1688838 - DNA, 17 bp, Homo sapiens
tggatcaccattatatt

SEQ ID NO: 1688839 - DNA, 15 bp, Homo sapiens
tggatcactcaccat

SEQ ID NO: 1688840 - DNA, 16 bp, Homo sapiens
tggatcagtcctttga

SEQ ID NO: 1688841 - DNA, 19 bp, Homo sapiens
tggatcataagacaatgga

SEQ ID NO: 1688842 - DNA, 17 bp, Homo sapiens
tggatcatagaattgca

SEQ ID NO: 1688843 - DNA, 23 bp, Homo sapiens
tggatccatcttgagccacagtc

SEQ ID NO: 1688844 - DNA, 14 bp, Homo sapiens
tggatcccaaagca

SEQ ID NO: 1688845 - DNA, 20 bp, Homo sapiens
tggatcctgaaatagaggct

SEQ ID NO: 1688846 - DNA, 14 bp, Homo sapiens
tggatccttccatc

SEQ ID NO: 1688847 - DNA, 18 bp, Homo sapiens
tggatcgagtgtagctgt

SEQ ID NO: 1688848 - DNA, 15 bp, Homo sapiens
tggatctccccactc

SEQ ID NO: 1688849 - DNA, 18 bp, Homo sapiens
tggatctcctgctgcctt

SEQ ID NO: 1688850 - DNA, 13 bp, Homo sapiens
tggatctccttcc

SEQ ID NO: 1688851 - DNA, 20 bp, Homo sapiens
tggatctccttcccttctct

SEQ ID NO: 1688852 - DNA, 15 bp, Homo sapiens
tggatctgtgagggg

SEQ ID NO: 1688853 - DNA, 20 bp, Homo sapiens
tggatgaaaaatatttctga

SEQ ID NO: 1688854 - DNA, 19 bp, Homo sapiens
tggatgaagattctcctgt

SEQ ID NO: 1688855 - DNA, 23 bp, Homo sapiens
tggatgaagattctcctgtgcta

SEQ ID NO: 1688856 - DNA, 15 bp, Homo sapiens
tggatgacagggcag

SEQ ID NO: 1688857 - DNA, 16 bp, Homo sapiens
tggatgacagggcaga

SEQ ID NO: 1688858 - DNA, 16 bp, Homo sapiens
tggatgaggagacaga

SEQ ID NO: 1688859 - DNA, 12 bp, Homo sapiens
tggatgatgttt

SEQ ID NO: 1688860 - DNA, 23 bp, Homo sapiens
tggcagccgtgccttcagctcta

SEQ ID NO: 1688861 - DNA, 14 bp, Homo sapiens
tggcagcctgctgc

SEQ ID NO: 1688862 - DNA, 15 bp, Homo sapiens
tggcagctagactgg

SEQ ID NO: 1688863 - DNA, 14 bp, Homo sapiens
tggcagctcctctc

SEQ ID NO: 1688864 - DNA, 17 bp, Homo sapiens
tggcagctcctctcctt

SEQ ID NO: 1688865 - DNA, 18 bp, Homo sapiens
tggcagctcctctccttg

SEQ ID NO: 1688866 - DNA, 11 bp, Homo sapiens
tggcagctctg

SEQ ID NO: 1688867 - DNA, 21 bp, Homo sapiens
tggcagctctggacagcccca

SEQ ID NO: 1688868 - DNA, 16 bp, Homo sapiens
tggcagctgagagccc

SEQ ID NO: 1688869 - DNA, 17 bp, Homo sapiens
tggcagctgagagccct

SEQ ID NO: 1688870 - DNA, 13 bp, Homo sapiens
tggcagctgcccc

SEQ ID NO: 1688871 - DNA, 18 bp, Homo sapiens
tggcagctgcccctggca

SEQ ID NO: 1688872 - DNA, 20 bp, Homo sapiens
tggcagctggggagcagctg

SEQ ID NO: 1688873 - DNA, 22 bp, Homo sapiens
tggcagctggggagcagctgag

SEQ ID NO: 1688874 - DNA, 16 bp, Homo sapiens
tggcagctgtttctca

SEQ ID NO: 1688875 - DNA, 13 bp, Homo sapiens
tggcaggagctcc

SEQ ID NO: 1688876 - DNA, 14 bp, Homo sapiens
tggcaggagctcct

SEQ ID NO: 1688877 - DNA, 16 bp, Homo sapiens
tggcaggagctcctgg

SEQ ID NO: 1688878 - DNA, 20 bp, Homo sapiens
tggcaggagctcctggaagc

SEQ ID NO: 1688879 - DNA, 18 bp, Homo sapiens
tggcaggctggccagtcc

SEQ ID NO: 1688880 - DNA, 18 bp, Homo sapiens
tggcaggggacaggagtc

SEQ ID NO: 1688881 - DNA, 18 bp, Homo sapiens
tggcagggggccccgcca

SEQ ID NO: 1688882 - DNA, 21 bp, Homo sapiens
tggcagggggccccgccaggg

SEQ ID NO: 1688883 - DNA, 22 bp, Homo sapiens
tggcagggggccccgccagggc

SEQ ID NO: 1688884 - DNA, 17 bp, Homo sapiens
tggcaggtcactgtcac

SEQ ID NO: 1688885 - DNA, 18 bp, Homo sapiens
tggcaggtgcagatgggc

SEQ ID NO: 1688886 - DNA, 22 bp, Homo sapiens
tggcaggtgtgggatctgggga

SEQ ID NO: 1688887 - DNA, 21 bp, Homo sapiens
tggcaggtgttgggacctgct

SEQ ID NO: 1688888 - DNA, 13 bp, Homo sapiens
tggcagtcctgga

SEQ ID NO: 1688889 - DNA, 19 bp, Homo sapiens
tggcagtcctggaggcagg

SEQ ID NO: 1688890 - DNA, 20 bp, Homo sapiens
tggcagtcctggaggcaggg

SEQ ID NO: 1688891 - DNA, 16 bp, Homo sapiens
tggcagtctgaatttt

SEQ ID NO: 1688892 - DNA, 22 bp, Homo sapiens
tggcagtctgaatttttaaaac

SEQ ID NO: 1688893 - DNA, 15 bp, Homo sapiens
tggcagtgcaatgct

SEQ ID NO: 1688894 - DNA, 13 bp, Homo sapiens
tggcagtggccag

SEQ ID NO: 1688895 - DNA, 16 bp, Homo sapiens
tggcagtggccaggca

SEQ ID NO: 1688896 - DNA, 17 bp, Homo sapiens
tggcagtggccaggcag

SEQ ID NO: 1688897 - DNA, 19 bp, Homo sapiens
tggcagtggccaggcaggg

SEQ ID NO: 1688898 - DNA, 13 bp, Homo sapiens
tggcatacaaaat

SEQ ID NO: 1688899 - DNA, 21 bp, Homo sapiens
tggcatacaaaatatttaagt

SEQ ID NO: 1688900 - DNA, 15 bp, Homo sapiens
tggcatagccccggc

SEQ ID NO: 1688901 - DNA, 15 bp, Homo sapiens
tggcatagctctggg

SEQ ID NO: 1688902 - DNA, 16 bp, Homo sapiens
tggcatagctctgggg

SEQ ID NO: 1688903 - DNA, 18 bp, Homo sapiens
tggcatatgtttctgcta

SEQ ID NO: 1688904 - DNA, 23 bp, Homo sapiens
tggcatcaagaggtgggagggcc

SEQ ID NO: 1688905 - DNA, 13 bp, Homo sapiens
tggcatcaaggga

SEQ ID NO: 1688906 - DNA, 18 bp, Homo sapiens
tggcatcacagggcagag

SEQ ID NO: 1688907 - DNA, 21 bp, Homo sapiens
tggcatcgcaccattctgact

SEQ ID NO: 1688908 - DNA, 22 bp, Homo sapiens
tggcatcgcaccattctgactc

SEQ ID NO: 1688909 - DNA, 16 bp, Homo sapiens
tggcatcgtagaagag

SEQ ID NO: 1688910 - DNA, 15 bp, Homo sapiens
tggcatctgacacaa

SEQ ID NO: 1688911 - DNA, 13 bp, Homo sapiens
tggcatctgctct

SEQ ID NO: 1688912 - DNA, 17 bp, Homo sapiens
tggcatctgctctagat

SEQ ID NO: 1688913 - DNA, 13 bp, Homo sapiens
tggcatcttctgg

SEQ ID NO: 1688914 - DNA, 16 bp, Homo sapiens
tggcatctttgccttg

SEQ ID NO: 1688915 - DNA, 20 bp, Homo sapiens
tggcatctttgccttgggct

SEQ ID NO: 1688916 - DNA, 20 bp, Homo sapiens
tggcatgagccactgtgccc

SEQ ID NO: 1688917 - DNA, 22 bp, Homo sapiens
tggcatgattagattgcaaagc

SEQ ID NO: 1688918 - DNA, 17 bp, Homo sapiens
tggcatgcatggaggac

SEQ ID NO: 1688919 - DNA, 19 bp, Homo sapiens
tggcatgccttccagcacc

SEQ ID NO: 1688920 - DNA, 16 bp, Homo sapiens
tggcatggcacctgtc

SEQ ID NO: 1688921 - DNA, 17 bp, Homo sapiens
tggcatggtgagtgttg

SEQ ID NO: 1688922 - DNA, 21 bp, Homo sapiens
tggcatggttttgtgccatct

SEQ ID NO: 1688923 - DNA, 23 bp, Homo sapiens
tggcatggttttgtgccatctgt

SEQ ID NO: 1688924 - DNA, 20 bp, Homo sapiens
tggcatgtgctgtgaccatt

SEQ ID NO: 1688925 - DNA, 13 bp, Homo sapiens
tggcatgttttct

SEQ ID NO: 1688926 - DNA, 13 bp, Homo sapiens
tggcattatgtcc

SEQ ID NO: 1688927 - DNA, 23 bp, Homo sapiens
tggcatttcaattcctggccctg

SEQ ID NO: 1688928 - DNA, 18 bp, Homo sapiens
tggcatttccaaacatcc

SEQ ID NO: 1688929 - DNA, 19 bp, Homo sapiens
tggcggcttcctgtccact

SEQ ID NO: 1688930 - DNA, 16 bp, Homo sapiens
tggcggtggctgcccc

SEQ ID NO: 1688931 - DNA, 21 bp, Homo sapiens
tggcgtaagatgatggatttg

SEQ ID NO: 1688932 - DNA, 15 bp, Homo sapiens
tggcgtaatgggcct

SEQ ID NO: 1688933 - DNA, 16 bp, Homo sapiens
tggcgtaatgggcctg

SEQ ID NO: 1688934 - DNA, 20 bp, Homo sapiens
tggcgtctgctctggtggct

SEQ ID NO: 1688935 - DNA, 15 bp, Homo sapiens
tggcgtgagaggcaa

SEQ ID NO: 1688936 - DNA, 21 bp, Homo sapiens
tggctaactatatttgctttt

SEQ ID NO: 1688937 - DNA, 17 bp, Homo sapiens
tggctaatgtactgcat

SEQ ID NO: 1688938 - DNA, 19 bp, Homo sapiens
tggctaattttttgtactt

SEQ ID NO: 1688939 - DNA, 15 bp, Homo sapiens
tggctacatcccagc

SEQ ID NO: 1688940 - DNA, 13 bp, Homo sapiens
tggctacgttttg

SEQ ID NO: 1688941 - DNA, 23 bp, Homo sapiens
tggctacgttttggttctatgct

SEQ ID NO: 1688942 - DNA, 14 bp, Homo sapiens
tggctacttccctt

SEQ ID NO: 1688943 - DNA, 15 bp, Homo sapiens
tggctacttcccttc

SEQ ID NO: 1688944 - DNA, 13 bp, Homo sapiens
tggctagagccga

SEQ ID NO: 1688945 - DNA, 14 bp, Homo sapiens
tggctagagccgag

SEQ ID NO: 1688946 - DNA, 15 bp, Homo sapiens
tggctagagtcctca

SEQ ID NO: 1688947 - DNA, 12 bp, Homo sapiens
tggctagagttt

SEQ ID NO: 1688948 - DNA, 17 bp, Homo sapiens
tggctagagtttccact

SEQ ID NO: 1688949 - DNA, 13 bp, Homo sapiens
tggctataaatat

SEQ ID NO: 1688950 - DNA, 16 bp, Homo sapiens
tggctatgatggtgac

SEQ ID NO: 1688951 - DNA, 14 bp, Homo sapiens
tggctatggccacc

SEQ ID NO: 1688952 - DNA, 14 bp, Homo sapiens
tggctatttctgtg

SEQ ID NO: 1688953 - DNA, 17 bp, Homo sapiens
tggctatttctgtgtcc

SEQ ID NO: 1688954 - DNA, 18 bp, Homo sapiens
tggctatttctgtgtcca

SEQ ID NO: 1688955 - DNA, 19 bp, Homo sapiens
tggctatttctgtgtccag

SEQ ID NO: 1688956 - DNA, 22 bp, Homo sapiens
tggctcaagacaaggctggcaa

SEQ ID NO: 1688957 - DNA, 22 bp, Homo sapiens
tggctcacaaggcccaggagac

SEQ ID NO: 1688958 - DNA, 13 bp, Homo sapiens
tggctcacactga

SEQ ID NO: 1688959 - DNA, 14 bp, Homo sapiens
tggctcacactgag

SEQ ID NO: 1688960 - DNA, 15 bp, Homo sapiens
tggctcacactgaga

SEQ ID NO: 1688961 - DNA, 18 bp, Homo sapiens
tggctgggtcaccagaaa

SEQ ID NO: 1688962 - DNA, 19 bp, Homo sapiens
tggctgggtcagggccaga

SEQ ID NO: 1688963 - DNA, 15 bp, Homo sapiens
tggctggtagaaaaa

SEQ ID NO: 1688964 - DNA, 18 bp, Homo sapiens
tggctggtagcagcaggc

SEQ ID NO: 1688965 - DNA, 16 bp, Homo sapiens
tggctggtccagggct

SEQ ID NO: 1688966 - DNA, 16 bp, Homo sapiens
tggctggtgggaaggc

SEQ ID NO: 1688967 - DNA, 21 bp, Homo sapiens
tggctggtgggaaggccggca

SEQ ID NO: 1688968 - DNA, 18 bp, Homo sapiens
tggctggttaatgggaaa

SEQ ID NO: 1688969 - DNA, 15 bp, Homo sapiens
tggctgtaaggctct

SEQ ID NO: 1688970 - DNA, 16 bp, Homo sapiens
tggctgtaaggctcta

SEQ ID NO: 1688971 - DNA, 13 bp, Homo sapiens
tggctgtaatcat

SEQ ID NO: 1688972 - DNA, 17 bp, Homo sapiens
tggctgtatcttgtttt

SEQ ID NO: 1688973 - DNA, 14 bp, Homo sapiens
tggctgtctagaat

SEQ ID NO: 1688974 - DNA, 19 bp, Homo sapiens
tggctgtctgaccagagaa

SEQ ID NO: 1688975 - DNA, 20 bp, Homo sapiens
tggctgtctgaccagagaat

SEQ ID NO: 1688976 - DNA, 15 bp, Homo sapiens
tggctgtctgcctgt

SEQ ID NO: 1688977 - DNA, 16 bp, Homo sapiens
tggctgtgacacctgg

SEQ ID NO: 1688978 - DNA, 22 bp, Homo sapiens
tggctgtgagacgaggcagggg

SEQ ID NO: 1688979 - DNA, 23 bp, Homo sapiens
tggctgtgagacgaggcaggggc

SEQ ID NO: 1688980 - DNA, 17 bp, Homo sapiens
tggctgtgagcagcctc

SEQ ID NO: 1688981 - DNA, 14 bp, Homo sapiens
tggctgtgcccagc

SEQ ID NO: 1688982 - DNA, 17 bp, Homo sapiens
tggctgtgcccagcagg

SEQ ID NO: 1688983 - DNA, 21 bp, Homo sapiens
tggctgtgcccagcaggccca

SEQ ID NO: 1688984 - DNA, 20 bp, Homo sapiens
tggctgtgtaaccttgggtg

SEQ ID NO: 1688985 - DNA, 15 bp, Homo sapiens
tggctgtgtgacaga

SEQ ID NO: 1688986 - DNA, 15 bp, Homo sapiens
tggctgttccagact

SEQ ID NO: 1688987 - DNA, 21 bp, Homo sapiens
tggctgttgagatgtgctttg

SEQ ID NO: 1688988 - DNA, 18 bp, Homo sapiens
tggcttaaagcatcctcc

SEQ ID NO: 1688989 - DNA, 16 bp, Homo sapiens
tggcttaagtgagcag

SEQ ID NO: 1688990 - DNA, 17 bp, Homo sapiens
tggcttaagtgagcaga

SEQ ID NO: 1688991 - DNA, 22 bp, Homo sapiens
tggcttaagtgagcagaacagg

SEQ ID NO: 1688992 - DNA, 20 bp, Homo sapiens
tggcttacctatctgtggaa

SEQ ID NO: 1688993 - DNA, 23 bp, Homo sapiens
tggcttaggatcgacaagaagtt

SEQ ID NO: 1688994 - DNA, 19 bp, Homo sapiens
tggcttatttaatatgctt

SEQ ID NO: 1688995 - DNA, 23 bp, Homo sapiens
tggcttcagcccccaccagggga

SEQ ID NO: 1688996 - DNA, 15 bp, Homo sapiens
tggcttcccgctcag

SEQ ID NO: 1688997 - DNA, 16 bp, Homo sapiens
tggcttcccgctcagc

SEQ ID NO: 1688998 - DNA, 21 bp, Homo sapiens
tggcttcccgctcagccctcc

SEQ ID NO: 1688999 - DNA, 15 bp, Homo sapiens
tggcttccctggaag

SEQ ID NO: 1689000 - DNA, 16 bp, Homo sapiens
tggcttccctggaagc

SEQ ID NO: 1689001 - DNA, 11 bp, Homo sapiens
tggcttcctcc

SEQ ID NO: 1689002 - DNA, 17 bp, Homo sapiens
tggcttctcctgtgacc

SEQ ID NO: 1689003 - DNA, 17 bp, Homo sapiens
tggcttctctcttttcc

SEQ ID NO: 1689004 - DNA, 21 bp, Homo sapiens
tggcttctctcttttcctcct

SEQ ID NO: 1689005 - DNA, 14 bp, Homo sapiens
tggcttctggagcc

SEQ ID NO: 1689006 - DNA, 21 bp, Homo sapiens
tggcttctgtgatgagctgat

SEQ ID NO: 1689007 - DNA, 22 bp, Homo sapiens
tggcttctgtgatgagctgatc

SEQ ID NO: 1689008 - DNA, 13 bp, Homo sapiens
tggcttctgtgca

SEQ ID NO: 1689009 - DNA, 16 bp, Homo sapiens
tggcttcttttcgttt

SEQ ID NO: 1689010 - DNA, 17 bp, Homo sapiens
tggcttgaaggactgca

SEQ ID NO: 1689011 - DNA, 19 bp, Homo sapiens
tggcttgactcaggattta

SEQ ID NO: 1689012 - DNA, 15 bp, Homo sapiens
tggcttgagctagag

SEQ ID NO: 1689013 - DNA, 12 bp, Homo sapiens
tggcttgctcca

SEQ ID NO: 1689014 - DNA, 14 bp, Homo sapiens
tggcttgggcattg

SEQ ID NO: 1689015 - DNA, 18 bp, Homo sapiens
tggcttggggattgtaca

SEQ ID NO: 1689016 - DNA, 23 bp, Homo sapiens
tggcttggggtcaagaaacagcc

SEQ ID NO: 1689017 - DNA, 12 bp, Homo sapiens
tggcttgtacat

SEQ ID NO: 1689018 - DNA, 13 bp, Homo sapiens
tggcttgtctata

SEQ ID NO: 1689019 - DNA, 17 bp, Homo sapiens
tggctttatttgttttt

SEQ ID NO: 1689020 - DNA, 12 bp, Homo sapiens
tggctttcacat

SEQ ID NO: 1689021 - DNA, 22 bp, Homo sapiens
tggctttcacatttaaatggtt

SEQ ID NO: 1689022 - DNA, 15 bp, Homo sapiens
tggctttcagggcag

SEQ ID NO: 1689023 - DNA, 17 bp, Homo sapiens
tggctttcattattagt

SEQ ID NO: 1689024 - DNA, 20 bp, Homo sapiens
tggctttgcccacccctcac

SEQ ID NO: 1689025 - DNA, 20 bp, Homo sapiens
tggctttgcctcttctttgt

SEQ ID NO: 1689026 - DNA, 18 bp, Homo sapiens
tggctttggcagtgtttt

SEQ ID NO: 1689027 - DNA, 15 bp, Homo sapiens
tggcttttcactgct

SEQ ID NO: 1689028 - DNA, 19 bp, Homo sapiens
tggcttttcactgctggct

SEQ ID NO: 1689029 - DNA, 16 bp, Homo sapiens
tggctttttctgccac

SEQ ID NO: 1689030 - DNA, 14 bp, Homo sapiens
tggcttttttgtgg

SEQ ID NO: 1689031 - DNA, 20 bp, Homo sapiens
tgggaaaaaagttttgatga

SEQ ID NO: 1689032 - DNA, 16 bp, Homo sapiens
tgggaaaacactgcca

SEQ ID NO: 1689033 - DNA, 14 bp, Homo sapiens
tgggaaagaagttg

SEQ ID NO: 1689034 - DNA, 16 bp, Homo sapiens
tgggaaagatggataa

SEQ ID NO: 1689035 - DNA, 15 bp, Homo sapiens
tgggaaagcataaag

SEQ ID NO: 1689036 - DNA, 17 bp, Homo sapiens
tgggaaagcattgtaaa

SEQ ID NO: 1689037 - DNA, 17 bp, Homo sapiens
tgggaaaggagtagaaa

SEQ ID NO: 1689038 - DNA, 17 bp, Homo sapiens
tgggaaataagagagaa

SEQ ID NO: 1689039 - DNA, 23 bp, Homo sapiens
tgggaacagtaaagaaagcagaa

SEQ ID NO: 1689040 - DNA, 21 bp, Homo sapiens
tgggaaccatttcaagacaga

SEQ ID NO: 1689041 - DNA, 18 bp, Homo sapiens
tgggaacgtgactgcccc

SEQ ID NO: 1689042 - DNA, 13 bp, Homo sapiens
tgggaactctgac

SEQ ID NO: 1689043 - DNA, 14 bp, Homo sapiens
tgggaagaagcaag

SEQ ID NO: 1689044 - DNA, 21 bp, Homo sapiens
tgggaagaccaaaggaaggaa

SEQ ID NO: 1689045 - DNA, 12 bp, Homo sapiens
tgggaagagaag

SEQ ID NO: 1689046 - DNA, 23 bp, Homo sapiens
tgggaagagaagagggcccagcc

SEQ ID NO: 1689047 - DNA, 17 bp, Homo sapiens
tgggaagagcttagaaa

SEQ ID NO: 1689048 - DNA, 17 bp, Homo sapiens
tgggaagataggctctg

SEQ ID NO: 1689049 - DNA, 15 bp, Homo sapiens
tgggaagctgtactc

SEQ ID NO: 1689050 - DNA, 16 bp, Homo sapiens
tgggaagcttgagcct

SEQ ID NO: 1689051 - DNA, 11 bp, Homo sapiens
tggccaggagc

SEQ ID NO: 1689052 - DNA, 14 bp, Homo sapiens
tggccaggagcagg

SEQ ID NO: 1689053 - DNA, 14 bp, Homo sapiens
tggccaggagctct

SEQ ID NO: 1689054 - DNA, 16 bp, Homo sapiens
tggccaggagctcttc

SEQ ID NO: 1689055 - DNA, 20 bp, Homo sapiens
tggccaggagctcttcaggc

SEQ ID NO: 1689056 - DNA, 12 bp, Homo sapiens
tggccaggatgg

SEQ ID NO: 1689057 - DNA, 16 bp, Homo sapiens
tggccaggatggtctc

SEQ ID NO: 1689058 - DNA, 23 bp, Homo sapiens
tggccagggtagacttggagctg

SEQ ID NO: 1689059 - DNA, 19 bp, Homo sapiens
tggccaggtggccactcca

SEQ ID NO: 1689060 - DNA, 17 bp, Homo sapiens
tggccagtccaggctgc

SEQ ID NO: 1689061 - DNA, 15 bp, Homo sapiens
tggccagtcctggtc

SEQ ID NO: 1689062 - DNA, 17 bp, Homo sapiens
tggccagtcctggtcct

SEQ ID NO: 1689063 - DNA, 21 bp, Homo sapiens
tggccagtcttcctcttagcc

SEQ ID NO: 1689064 - DNA, 19 bp, Homo sapiens
tggccagtgtttaaaactt

SEQ ID NO: 1689065 - DNA, 16 bp, Homo sapiens
tggccatagaggccca

SEQ ID NO: 1689066 - DNA, 19 bp, Homo sapiens
tggccatagaggcccaggc

SEQ ID NO: 1689067 - DNA, 22 bp, Homo sapiens
tggccatagaggcccaggcacc

SEQ ID NO: 1689068 - DNA, 17 bp, Homo sapiens
tggccatccttctgtgt

SEQ ID NO: 1689069 - DNA, 21 bp, Homo sapiens
tggccatgcaggaggtggaga

SEQ ID NO: 1689070 - DNA, 20 bp, Homo sapiens
tggccatttgctagttctgc

SEQ ID NO: 1689071 - DNA, 15 bp, Homo sapiens
tggccatttgctttt

SEQ ID NO: 1689072 - DNA, 16 bp, Homo sapiens
tggccatttttctggg

SEQ ID NO: 1689073 - DNA, 12 bp, Homo sapiens
tggcccactgct

SEQ ID NO: 1689074 - DNA, 19 bp, Homo sapiens
tggcccactgctggctgca

SEQ ID NO: 1689075 - DNA, 13 bp, Homo sapiens
tggcccagaaaca

SEQ ID NO: 1689076 - DNA, 14 bp, Homo sapiens
tggcccagaaagcc

SEQ ID NO: 1689077 - DNA, 11 bp, Homo sapiens
tggcccagaga

SEQ ID NO: 1689078 - DNA, 11 bp, Homo sapiens
tggcccagccg

SEQ ID NO: 1689079 - DNA, 13 bp, Homo sapiens
tggcccagccggc

SEQ ID NO: 1689080 - DNA, 15 bp, Homo sapiens
tggcccagccggcct

SEQ ID NO: 1689081 - DNA, 18 bp, Homo sapiens
tggcccagccggcctctc

SEQ ID NO: 1689082 - DNA, 14 bp, Homo sapiens
tggcccagcggccc

SEQ ID NO: 1689083 - DNA, 16 bp, Homo sapiens
tggcccagcggcccct

SEQ ID NO: 1689084 - DNA, 16 bp, Homo sapiens
tggcccaggaattaga

SEQ ID NO: 1689085 - DNA, 22 bp, Homo sapiens
tggcccaggaattagagaagct

SEQ ID NO: 1689086 - DNA, 16 bp, Homo sapiens
tggcccaggagctctg

SEQ ID NO: 1689087 - DNA, 20 bp, Homo sapiens
tggcccaggagctctgcgcc

SEQ ID NO: 1689088 - DNA, 22 bp, Homo sapiens
tggcccaggagctctgcgccag

SEQ ID NO: 1689089 - DNA, 22 bp, Homo sapiens
tggcccagggcccagagcccag

SEQ ID NO: 1689090 - DNA, 17 bp, Homo sapiens
tggcccagggggcctgg

SEQ ID NO: 1689091 - DNA, 18 bp, Homo sapiens
tggcccagggggcctgga

SEQ ID NO: 1689092 - DNA, 19 bp, Homo sapiens
tggcccagggggcctggag

SEQ ID NO: 1689093 - DNA, 20 bp, Homo sapiens
tggcccagggggcctggagc

SEQ ID NO: 1689094 - DNA, 13 bp, Homo sapiens
tggcccagtgtca

SEQ ID NO: 1689095 - DNA, 14 bp, Homo sapiens
tggcccagttctga

SEQ ID NO: 1689096 - DNA, 15 bp, Homo sapiens
tggccccaccctggg

SEQ ID NO: 1689097 - DNA, 22 bp, Homo sapiens
tggccccaccctgggccctggg

SEQ ID NO: 1689098 - DNA, 12 bp, Homo sapiens
tggccccagcac

SEQ ID NO: 1689099 - DNA, 17 bp, Homo sapiens
tggccccagcacagctt

SEQ ID NO: 1689100 - DNA, 19 bp, Homo sapiens
tggccccagcacagcttga

SEQ ID NO: 1689101 - DNA, 18 bp, Homo sapiens
tggccccagccctgctgg

SEQ ID NO: 1689102 - DNA, 15 bp, Homo sapiens
tggcccccagctggt

SEQ ID NO: 1689103 - DNA, 17 bp, Homo sapiens
tggcccccaggggcagg

SEQ ID NO: 1689104 - DNA, 18 bp, Homo sapiens
tggccccgggctctggcc

SEQ ID NO: 1689105 - DNA, 16 bp, Homo sapiens
tggccccgtttctggt

SEQ ID NO: 1689106 - DNA, 23 bp, Homo sapiens
tggcccctactttgtggcaatct

SEQ ID NO: 1689107 - DNA, 21 bp, Homo sapiens
tggcccctcaaatcgtccagc

SEQ ID NO: 1689108 - DNA, 13 bp, Homo sapiens
tggcccctccagc

SEQ ID NO: 1689109 - DNA, 19 bp, Homo sapiens
tggcccctccccctgccag

SEQ ID NO: 1689110 - DNA, 21 bp, Homo sapiens
tggcccctcgaccctgtgcag

SEQ ID NO: 1689111 - DNA, 16 bp, Homo sapiens
tggcccctctgacctg

SEQ ID NO: 1689112 - DNA, 15 bp, Homo sapiens
tggcccctgagccca

SEQ ID NO: 1689113 - DNA, 14 bp, Homo sapiens
tggcccctgccttg

SEQ ID NO: 1689114 - DNA, 15 bp, Homo sapiens
tggcccctgtgtgag

SEQ ID NO: 1689115 - DNA, 15 bp, Homo sapiens
tggcccgacagcctg

SEQ ID NO: 1689116 - DNA, 17 bp, Homo sapiens
tggcccgacagcctggc

SEQ ID NO: 1689117 - DNA, 21 bp, Homo sapiens
tggcccggccggcctggcacc

SEQ ID NO: 1689118 - DNA, 15 bp, Homo sapiens
tggccctcactcaag

SEQ ID NO: 1689119 - DNA, 23 bp, Homo sapiens
tggccctccaccttgttcctgcc

SEQ ID NO: 1689120 - DNA, 19 bp, Homo sapiens
tggccctgccatcttccca

SEQ ID NO: 1689121 - DNA, 15 bp, Homo sapiens
tggccctgcccagcc

SEQ ID NO: 1689122 - DNA, 12 bp, Homo sapiens
tggccctgcctt

SEQ ID NO: 1689123 - DNA, 17 bp, Homo sapiens
tggccctgcttcctgct

SEQ ID NO: 1689124 - DNA, 12 bp, Homo sapiens
tggccctggagc

SEQ ID NO: 1689125 - DNA, 21 bp, Homo sapiens
tgggaaggagggagctgctca

SEQ ID NO: 1689126 - DNA, 23 bp, Homo sapiens
tgggaaggagggagctgctcaga

SEQ ID NO: 1689127 - DNA, 14 bp, Homo sapiens
tgggaagggagagg

SEQ ID NO: 1689128 - DNA, 22 bp, Homo sapiens
tgggaaggttagaaaggcagcc

SEQ ID NO: 1689129 - DNA, 19 bp, Homo sapiens
tgggaagtgtgtttagaag

SEQ ID NO: 1689130 - DNA, 15 bp, Homo sapiens
tgggaagttaaaggg

SEQ ID NO: 1689131 - DNA, 23 bp, Homo sapiens
tgggaagttaaagggaagaaaac

SEQ ID NO: 1689132 - DNA, 23 bp, Homo sapiens
tgggaataagtgccaggatggaa

SEQ ID NO: 1689133 - DNA, 19 bp, Homo sapiens
tgggaatgaaattaacaca

SEQ ID NO: 1689134 - DNA, 12 bp, Homo sapiens
tgggaatgggag

SEQ ID NO: 1689135 - DNA, 21 bp, Homo sapiens
tgggaatgtattattctgcag

SEQ ID NO: 1689136 - DNA, 22 bp, Homo sapiens
tgggaatgtattattctgcagc

SEQ ID NO: 1689137 - DNA, 13 bp, Homo sapiens
tgggaatttcaat

SEQ ID NO: 1689138 - DNA, 14 bp, Homo sapiens
tgggaatttcaatg

SEQ ID NO: 1689139 - DNA, 15 bp, Homo sapiens
tgggaatttgtcagc

SEQ ID NO: 1689140 - DNA, 19 bp, Homo sapiens
tgggaatttgtcagcgttc

SEQ ID NO: 1689141 - DNA, 17 bp, Homo sapiens
tgggacaagcagtccct

SEQ ID NO: 1689142 - DNA, 13 bp, Homo sapiens
tgggacaccaggg

SEQ ID NO: 1689143 - DNA, 15 bp, Homo sapiens
tgggacacctgggag

SEQ ID NO: 1689144 - DNA, 17 bp, Homo sapiens
tgggacacctgggagaa

SEQ ID NO: 1689145 - DNA, 13 bp, Homo sapiens
tgggacagctggc

SEQ ID NO: 1689146 - DNA, 16 bp, Homo sapiens
tgggacagctggctgg

SEQ ID NO: 1689147 - DNA, 21 bp, Homo sapiens
tgggacagtggtgacatagtc

SEQ ID NO: 1689148 - DNA, 14 bp, Homo sapiens
tgggaccagagcca

SEQ ID NO: 1689149 - DNA, 16 bp, Homo sapiens
tgggaccagagccaga

SEQ ID NO: 1689150 - DNA, 17 bp, Homo sapiens
tgggaccagagccagat

SEQ ID NO: 1689151 - DNA, 21 bp, Homo sapiens
tgggaccagtcccacaccgct

SEQ ID NO: 1689152 - DNA, 20 bp, Homo sapiens
tgggacccaaaacacaggaa

SEQ ID NO: 1689153 - DNA, 22 bp, Homo sapiens
tgggacccaaaacacaggaagt

SEQ ID NO: 1689154 - DNA, 18 bp, Homo sapiens
tgggacccagctactctg

SEQ ID NO: 1689155 - DNA, 22 bp, Homo sapiens
tgggacccagctactctgtcca

SEQ ID NO: 1689156 - DNA, 23 bp, Homo sapiens
tgggacccagctactctgtccag

SEQ ID NO: 1689157 - DNA, 22 bp, Homo sapiens
tgggacccccgtggggcaggga

SEQ ID NO: 1689158 - DNA, 14 bp, Homo sapiens
tgggacccctccca

SEQ ID NO: 1689159 - DNA, 22 bp, Homo sapiens
tgggaccctgtccggcccagtg

SEQ ID NO: 1689160 - DNA, 17 bp, Homo sapiens
tgggaccctttccttcc

SEQ ID NO: 1689161 - DNA, 17 bp, Homo sapiens
tgggacctgatttattg

SEQ ID NO: 1689162 - DNA, 17 bp, Homo sapiens
tgggacctgccaggcag

SEQ ID NO: 1689163 - DNA, 23 bp, Homo sapiens
tgggacgggatggttctggctgt

SEQ ID NO: 1689164 - DNA, 20 bp, Homo sapiens
tgggactaggacctgagcct

SEQ ID NO: 1689165 - DNA, 17 bp, Homo sapiens
tgggactgatgtcatct

SEQ ID NO: 1689166 - DNA, 19 bp, Homo sapiens
tgggactgatgtcatcttg

SEQ ID NO: 1689167 - DNA, 12 bp, Homo sapiens
tgggactggagt

SEQ ID NO: 1689168 - DNA, 19 bp, Homo sapiens
tgggactgggtttggaccc

SEQ ID NO: 1689169 - DNA, 13 bp, Homo sapiens
tgggacttttctt

SEQ ID NO: 1689170 - DNA, 12 bp, Homo sapiens
tgggagaaagca

SEQ ID NO: 1689171 - DNA, 23 bp, Homo sapiens
tgggagaacctcaggcttccttg

SEQ ID NO: 1689172 - DNA, 19 bp, Homo sapiens
tgggagaaggtctccaagg

SEQ ID NO: 1689173 - DNA, 20 bp, Homo sapiens
tgggagaatgtcagtatgtg

SEQ ID NO: 1689174 - DNA, 21 bp, Homo sapiens
tgggagaattcttacatgttt

SEQ ID NO: 1689175 - DNA, 17 bp, Homo sapiens
tgggagaattgcttgag

SEQ ID NO: 1689176 - DNA, 12 bp, Homo sapiens
tgggagacagca

SEQ ID NO: 1689177 - DNA, 14 bp, Homo sapiens
tgggagacagcagc

SEQ ID NO: 1689178 - DNA, 14 bp, Homo sapiens
tgggagagacttgt

SEQ ID NO: 1689179 - DNA, 14 bp, Homo sapiens
tgggagagcccagc

SEQ ID NO: 1689180 - DNA, 21 bp, Homo sapiens
tgggagatatatttttaagat

SEQ ID NO: 1689181 - DNA, 18 bp, Homo sapiens
tgggagatttttttgagt

SEQ ID NO: 1689182 - DNA, 17 bp, Homo sapiens
tgggagccacttctccc

SEQ ID NO: 1689183 - DNA, 20 bp, Homo sapiens
tgggagccacttctccccag

SEQ ID NO: 1689184 - DNA, 12 bp, Homo sapiens
tgggagccagaa

SEQ ID NO: 1689185 - DNA, 13 bp, Homo sapiens
tgggagccaggag

SEQ ID NO: 1689186 - DNA, 14 bp, Homo sapiens
tgggagccaggagt

SEQ ID NO: 1689187 - DNA, 19 bp, Homo sapiens
tgggagccagtcctccact

SEQ ID NO: 1689188 - DNA, 14 bp, Homo sapiens
tgggagcccagagg

SEQ ID NO: 1689189 - DNA, 16 bp, Homo sapiens
tgggagcctaaggaag

SEQ ID NO: 1689190 - DNA, 13 bp, Homo sapiens
tgggagcctagct

SEQ ID NO: 1689191 - DNA, 21 bp, Homo sapiens
tgggagcctagctcctgccac

SEQ ID NO: 1689192 - DNA, 22 bp, Homo sapiens
tgggagcctagctcctgccaca

SEQ ID NO: 1689193 - DNA, 18 bp, Homo sapiens
tgggagctcctccgcaga

SEQ ID NO: 1689194 - DNA, 13 bp, Homo sapiens
tgggagctctgct

SEQ ID NO: 1689195 - DNA, 15 bp, Homo sapiens
tgggagctgagctgg

SEQ ID NO: 1689196 - DNA, 18 bp, Homo sapiens
tgggagctgagctggaag

SEQ ID NO: 1689197 - DNA, 20 bp, Homo sapiens
tgggagctgcgccggacaga

SEQ ID NO: 1689198 - DNA, 21 bp, Homo sapiens
tgggagctgcgccggacagag

SEQ ID NO: 1689199 - DNA, 18 bp, Homo sapiens
tgggagctggttagaaat

SEQ ID NO: 1689200 - DNA, 20 bp, Homo sapiens
tgggagcttcccacacctgc

SEQ ID NO: 1689201 - DNA, 22 bp, Homo sapiens
tgggagcttcccacacctgcct

SEQ ID NO: 1689202 - DNA, 23 bp, Homo sapiens
tgggagcttcccacacctgcctg

SEQ ID NO: 1689203 - DNA, 18 bp, Homo sapiens
tgggagcttccgctttga

SEQ ID NO: 1689204 - DNA, 11 bp, Homo sapiens
tgggaggaagc

SEQ ID NO: 1689205 - DNA, 24 bp, Homo sapiens
tgggaggaagcaggttgaggggct

SEQ ID NO: 1689206 - DNA, 13 bp, Homo sapiens
tgggaggagcaga

SEQ ID NO: 1689207 - DNA, 18 bp, Homo sapiens
tgggaggagcagattttt

SEQ ID NO: 1689208 - DNA, 19 bp, Homo sapiens
tgggaggagggagagggag

SEQ ID NO: 1689209 - DNA, 18 bp, Homo sapiens
tgggaggcaagaaaagga

SEQ ID NO: 1689210 - DNA, 21 bp, Homo sapiens
tgggaggcaagaaaaggacaa

SEQ ID NO: 1689211 - DNA, 23 bp, Homo sapiens
tgggaggcaagaaaaggacaaat

SEQ ID NO: 1689212 - DNA, 16 bp, Homo sapiens
tgggaggcagccgagg

SEQ ID NO: 1689213 - DNA, 18 bp, Homo sapiens
tgggaggctgaggcagga

SEQ ID NO: 1689214 - DNA, 16 bp, Homo sapiens
tgggaggggcaggctg

SEQ ID NO: 1689215 - DNA, 17 bp, Homo sapiens
tgggaggggcaggctga

SEQ ID NO: 1689216 - DNA, 18 bp, Homo sapiens
tgggaggggcaggctgac

SEQ ID NO: 1689217 - DNA, 19 bp, Homo sapiens
tgggaggggcaggctgaca

SEQ ID NO: 1689218 - DNA, 23 bp, Homo sapiens
tgggagggggctatttctctccc

SEQ ID NO: 1689219 - DNA, 15 bp, Homo sapiens
tgggagggttcccct

SEQ ID NO: 1689220 - DNA, 18 bp, Homo sapiens
tgggaggtgcgtgttcag

SEQ ID NO: 1689221 - DNA, 22 bp, Homo sapiens
tgggaggtggaagaagggagaa

SEQ ID NO: 1689222 - DNA, 20 bp, Homo sapiens
tgggaggtggaggttgcagt

SEQ ID NO: 1689223 - DNA, 20 bp, Homo sapiens
tgggagtccccttttctttt

SEQ ID NO: 1689224 - DNA, 17 bp, Homo sapiens
tgggagtcttaataaaa

SEQ ID NO: 1689225 - DNA, 15 bp, Homo sapiens
tgggagtgtgggctg

SEQ ID NO: 1689226 - DNA, 16 bp, Homo sapiens
tgggagtgtgggctgc

SEQ ID NO: 1689227 - DNA, 14 bp, Homo sapiens
tgggagtgtgtctg

SEQ ID NO: 1689228 - DNA, 16 bp, Homo sapiens
tgggagtgtgtctgct

SEQ ID NO: 1689229 - DNA, 18 bp, Homo sapiens
tgggagtgtgtctgctga

SEQ ID NO: 1689230 - DNA, 19 bp, Homo sapiens
tgggatagtgttctgctcc

SEQ ID NO: 1689231 - DNA, 23 bp, Homo sapiens
tgggatagtgttctgctcctgct

SEQ ID NO: 1689232 - DNA, 15 bp, Homo sapiens
tgggatatggctgcc

SEQ ID NO: 1689233 - DNA, 21 bp, Homo sapiens
tgggatccttgggcccatcac

SEQ ID NO: 1689234 - DNA, 12 bp, Homo sapiens
tgggatctgggg

SEQ ID NO: 1689235 - DNA, 13 bp, Homo sapiens
tgggatctgggga

SEQ ID NO: 1689236 - DNA, 19 bp, Homo sapiens
tgggatctgttttctggaa

SEQ ID NO: 1689237 - DNA, 23 bp, Homo sapiens
tgggatgccaatttcctctccac

SEQ ID NO: 1689238 - DNA, 13 bp, Homo sapiens
tgggatggaggag

SEQ ID NO: 1689239 - DNA, 16 bp, Homo sapiens
tgggatggaggagaag

SEQ ID NO: 1689240 - DNA, 16 bp, Homo sapiens
tgggatgggaggccgg

SEQ ID NO: 1689241 - DNA, 15 bp, Homo sapiens
tggccctggagccag

SEQ ID NO: 1689242 - DNA, 15 bp, Homo sapiens
tggccctggcctgct

SEQ ID NO: 1689243 - DNA, 21 bp, Homo sapiens
tggccctgggcggggcgtggg

SEQ ID NO: 1689244 - DNA, 13 bp, Homo sapiens
tggccctgtgcct

SEQ ID NO: 1689245 - DNA, 16 bp, Homo sapiens
tggccctgtgcctggg

SEQ ID NO: 1689246 - DNA, 12 bp, Homo sapiens
tggcccttcagt

SEQ ID NO: 1689247 - DNA, 22 bp, Homo sapiens
tggcccttgcagttcagcacca

SEQ ID NO: 1689248 - DNA, 13 bp, Homo sapiens
tggccctttcctt

SEQ ID NO: 1689249 - DNA, 20 bp, Homo sapiens
tggccgagggtcctggctcc

SEQ ID NO: 1689250 - DNA, 23 bp, Homo sapiens
tggccgcacctaaagcagccagc

SEQ ID NO: 1689251 - DNA, 19 bp, Homo sapiens
tggccgcacgcctctccct

SEQ ID NO: 1689252 - DNA, 21 bp, Homo sapiens
tggccgcacgcctctccctgc

SEQ ID NO: 1689253 - DNA, 13 bp, Homo sapiens
tggccgccacccc

SEQ ID NO: 1689254 - DNA, 14 bp, Homo sapiens
tggccgccaccccc

SEQ ID NO: 1689255 - DNA, 17 bp, Homo sapiens
tggccgccacccccatc

SEQ ID NO: 1689256 - DNA, 12 bp, Homo sapiens
tggccgccacct

SEQ ID NO: 1689257 - DNA, 15 bp, Homo sapiens
tggccgcctccagga

SEQ ID NO: 1689258 - DNA, 19 bp, Homo sapiens
tggccgcctggcaggtgga

SEQ ID NO: 1689259 - DNA, 17 bp, Homo sapiens
tggccgctgagtggcag

SEQ ID NO: 1689260 - DNA, 14 bp, Homo sapiens
tggccggctccagt

SEQ ID NO: 1689261 - DNA, 16 bp, Homo sapiens
tggccgggctgctgct

SEQ ID NO: 1689262 - DNA, 13 bp, Homo sapiens
tggccggtgctgg

SEQ ID NO: 1689263 - DNA, 17 bp, Homo sapiens
tggccgtggatgcgcag

SEQ ID NO: 1689264 - DNA, 18 bp, Homo sapiens
tggccgtggtccagctct

SEQ ID NO: 1689265 - DNA, 23 bp, Homo sapiens
tggccgtggtccagctcttggcc

SEQ ID NO: 1689266 - DNA, 16 bp, Homo sapiens
tggccgttcagcctgt

SEQ ID NO: 1689267 - DNA, 22 bp, Homo sapiens
tggcctaggagatatctgaggg

SEQ ID NO: 1689268 - DNA, 17 bp, Homo sapiens
tggcctaggggccaggg

SEQ ID NO: 1689269 - DNA, 15 bp, Homo sapiens
tggcctatccgctgc

SEQ ID NO: 1689270 - DNA, 19 bp, Homo sapiens
tggcctatccgctgccagc

SEQ ID NO: 1689271 - DNA, 15 bp, Homo sapiens
tggcctcacccaccc

SEQ ID NO: 1689272 - DNA, 23 bp, Homo sapiens
tggcctcactggctggggcagag

SEQ ID NO: 1689273 - DNA, 16 bp, Homo sapiens
tggcctcagctgcctc

SEQ ID NO: 1689274 - DNA, 18 bp, Homo sapiens
tggcctcagctgcctcac

SEQ ID NO: 1689275 - DNA, 18 bp, Homo sapiens
tggcctcagttcccagct

SEQ ID NO: 1689276 - DNA, 17 bp, Homo sapiens
tggcctcatgtggctgg

SEQ ID NO: 1689277 - DNA, 12 bp, Homo sapiens
ttattgtacctc

SEQ ID NO: 1689278 - DNA, 14 bp, Homo sapiens
ttattgtctgtcta

SEQ ID NO: 1689279 - DNA, 18 bp, Homo sapiens
ttattgtgtgcgctgcct

SEQ ID NO: 1689280 - DNA, 19 bp, Homo sapiens
ttattgtgtgcgctgcctg

SEQ ID NO: 1689281 - DNA, 20 bp, Homo sapiens
ttattgtgtgcgctgcctgg

SEQ ID NO: 1689282 - DNA, 22 bp, Homo sapiens
ttattgtgtgcgctgcctggcc

SEQ ID NO: 1689283 - DNA, 14 bp, Homo sapiens
ttattgttaataca

SEQ ID NO: 1689284 - DNA, 13 bp, Homo sapiens
ttatttaaaagat

SEQ ID NO: 1689285 - DNA, 17 bp, Homo sapiens
ttatttaaaagattcat

SEQ ID NO: 1689286 - DNA, 12 bp, Homo sapiens
ttatttaaatta

SEQ ID NO: 1689287 - DNA, 13 bp, Homo sapiens
ttatttaaggatg

SEQ ID NO: 1689288 - DNA, 21 bp, Homo sapiens
ttatttaaggatggatggcac

SEQ ID NO: 1689289 - DNA, 23 bp, Homo sapiens
ttatttaaggatggatggcaccc

SEQ ID NO: 1689290 - DNA, 18 bp, Homo sapiens
ttatttaatagctgtgat

SEQ ID NO: 1689291 - DNA, 18 bp, Homo sapiens
ttatttaatgaaagactg

SEQ ID NO: 1689292 - DNA, 20 bp, Homo sapiens
ttatttacagatgaatgtat

SEQ ID NO: 1689293 - DNA, 15 bp, Homo sapiens
ttatttacatttaat

SEQ ID NO: 1689294 - DNA, 13 bp, Homo sapiens
ttatttacatttt

SEQ ID NO: 1689295 - DNA, 18 bp, Homo sapiens
ttatttacgcttttattg

SEQ ID NO: 1689296 - DNA, 12 bp, Homo sapiens
ttatttactttt

SEQ ID NO: 1689297 - DNA, 14 bp, Homo sapiens
ttatttagacaaga

SEQ ID NO: 1689298 - DNA, 15 bp, Homo sapiens
ttatttagacaagag

SEQ ID NO: 1689299 - DNA, 18 bp, Homo sapiens
ttatttagacaagagatg

SEQ ID NO: 1689300 - DNA, 22 bp, Homo sapiens
ttatttagttgaaaaatctagt

SEQ ID NO: 1689301 - DNA, 12 bp, Homo sapiens
ttatttataaac

SEQ ID NO: 1689302 - DNA, 17 bp, Homo sapiens
ttatttatatgtactgt

SEQ ID NO: 1689303 - DNA, 20 bp, Homo sapiens
ttatttatgcctctgtattt

SEQ ID NO: 1689304 - DNA, 15 bp, Homo sapiens
ttatttattggagat

SEQ ID NO: 1689305 - DNA, 15 bp, Homo sapiens
ttatttatttatgga

SEQ ID NO: 1689306 - DNA, 16 bp, Homo sapiens
ttatttcaccagcagc

SEQ ID NO: 1689307 - DNA, 18 bp, Homo sapiens
ttatttcactaaatgtaa

SEQ ID NO: 1689308 - DNA, 18 bp, Homo sapiens
ttatttcataaacaactt

SEQ ID NO: 1689309 - DNA, 19 bp, Homo sapiens
ttatttccaggtaatatgt

SEQ ID NO: 1689310 - DNA, 14 bp, Homo sapiens
ttatttccccagcc

SEQ ID NO: 1689311 - DNA, 17 bp, Homo sapiens
ttatttccccagccaca

SEQ ID NO: 1689312 - DNA, 14 bp, Homo sapiens
ttatttctaaaata

SEQ ID NO: 1689313 - DNA, 22 bp, Homo sapiens
ttatttctaatccttttcctta

SEQ ID NO: 1689314 - DNA, 21 bp, Homo sapiens
ttatttctagcagagtgagga

SEQ ID NO: 1689315 - DNA, 18 bp, Homo sapiens
ttatttctagtccaaaat

SEQ ID NO: 1689316 - DNA, 19 bp, Homo sapiens
ttatttctagttctttcct

SEQ ID NO: 1689317 - DNA, 12 bp, Homo sapiens
ttatttctatga

SEQ ID NO: 1689318 - DNA, 19 bp, Homo sapiens
ttatttctgctctggaata

SEQ ID NO: 1689319 - DNA, 14 bp, Homo sapiens
ttatttcttaacct

SEQ ID NO: 1689320 - DNA, 12 bp, Homo sapiens
ttatttcttccc

SEQ ID NO: 1689321 - DNA, 14 bp, Homo sapiens
ttatttcttccctg

SEQ ID NO: 1689322 - DNA, 12 bp, Homo sapiens
ttatttcttctc

SEQ ID NO: 1689323 - DNA, 15 bp, Homo sapiens
ttatttcttctctta

SEQ ID NO: 1689324 - DNA, 19 bp, Homo sapiens
ttatttgaatgaacactat

SEQ ID NO: 1689325 - DNA, 14 bp, Homo sapiens
ttatttgaatgact

SEQ ID NO: 1689326 - DNA, 19 bp, Homo sapiens
ttatttgactatgaatgtt

SEQ ID NO: 1689327 - DNA, 18 bp, Homo sapiens
ttatttgcagagacagga

SEQ ID NO: 1689328 - DNA, 23 bp, Homo sapiens
ttatttggaaccttgttttggac

SEQ ID NO: 1689329 - DNA, 23 bp, Homo sapiens
ttatttggagtggaggcattgtt

SEQ ID NO: 1689330 - DNA, 16 bp, Homo sapiens
ttatttgtaattttaa

SEQ ID NO: 1689331 - DNA, 12 bp, Homo sapiens
ttatttgtatta

SEQ ID NO: 1689332 - DNA, 23 bp, Homo sapiens
ttatttgtctgtaaaaaatggag

SEQ ID NO: 1689333 - DNA, 22 bp, Homo sapiens
ttatttgtgttttaatttaaac

SEQ ID NO: 1689334 - DNA, 24 bp, Homo sapiens
ttattttaatattttgtattttca

SEQ ID NO: 1689335 - DNA, 20 bp, Homo sapiens
ttattttacagctcattaaa

SEQ ID NO: 1689336 - DNA, 23 bp, Homo sapiens
ttattttagacaaccatagaact

SEQ ID NO: 1689337 - DNA, 18 bp, Homo sapiens
ttattttcaagaaactga

SEQ ID NO: 1689338 - DNA, 14 bp, Homo sapiens
ttattttcacctgt

SEQ ID NO: 1689339 - DNA, 12 bp, Homo sapiens
ttattttcactg

SEQ ID NO: 1689340 - DNA, 19 bp, Homo sapiens
ttattttcagtatactgtg

SEQ ID NO: 1689341 - DNA, 21 bp, Homo sapiens
ttattttcagtatactgtgtg

SEQ ID NO: 1689342 - DNA, 21 bp, Homo sapiens
ttattttctttttcttaagaa

SEQ ID NO: 1689343 - DNA, 21 bp, Homo sapiens
ttattttgagatgtaaaaaga

SEQ ID NO: 1689344 - DNA, 14 bp, Homo sapiens
ttattttgcactgt

SEQ ID NO: 1689345 - DNA, 11 bp, Homo sapiens
ttattttgctg

SEQ ID NO: 1689346 - DNA, 15 bp, Homo sapiens
ttattttgctttggt

SEQ ID NO: 1689347 - DNA, 16 bp, Homo sapiens
ttattttggaactatg

SEQ ID NO: 1689348 - DNA, 13 bp, Homo sapiens
ttattttggtact

SEQ ID NO: 1689349 - DNA, 12 bp, Homo sapiens
ttattttgtaag

SEQ ID NO: 1689350 - DNA, 19 bp, Homo sapiens
ttattttgtgctcatttaa

SEQ ID NO: 1689351 - DNA, 16 bp, Homo sapiens
ttatttttataattgt

SEQ ID NO: 1689352 - DNA, 13 bp, Homo sapiens
ttatttttcttac

SEQ ID NO: 1689353 - DNA, 15 bp, Homo sapiens
ttatttttcttacca

SEQ ID NO: 1689354 - DNA, 16 bp, Homo sapiens
ttatttttgtacatgt

SEQ ID NO: 1689355 - DNA, 18 bp, Homo sapiens
ttattttttctacacagt

SEQ ID NO: 1689356 - DNA, 20 bp, Homo sapiens
ttattttttcttttgtaatt

SEQ ID NO: 1689357 - DNA, 16 bp, Homo sapiens
ttatttttttaaaatt

SEQ ID NO: 1689358 - DNA, 17 bp, Homo sapiens
ttatttttttaaaattt

SEQ ID NO: 1689359 - DNA, 22 bp, Homo sapiens
ttatttttttaaagtgatttgc

SEQ ID NO: 1689360 - DNA, 18 bp, Homo sapiens
ttcaaaaaaacactagtt

SEQ ID NO: 1689361 - DNA, 22 bp, Homo sapiens
ttcaaaaaatcatgtttatttt

SEQ ID NO: 1689362 - DNA, 17 bp, Homo sapiens
ttcaaaaaccagccagg

SEQ ID NO: 1689363 - DNA, 15 bp, Homo sapiens
ttcacatttgatgta

SEQ ID NO: 1689364 - DNA, 20 bp, Homo sapiens
ttcacatttgatgtacatgt

SEQ ID NO: 1689365 - DNA, 12 bp, Homo sapiens
ttcaccagagca

SEQ ID NO: 1689366 - DNA, 15 bp, Homo sapiens
ttcaccagagcccat

SEQ ID NO: 1689367 - DNA, 18 bp, Homo sapiens
ttcaccagatttgctaat

SEQ ID NO: 1689368 - DNA, 13 bp, Homo sapiens
ttcaccagtctgt

SEQ ID NO: 1689369 - DNA, 17 bp, Homo sapiens
ttcaccatcaatcctga

SEQ ID NO: 1689370 - DNA, 12 bp, Homo sapiens
ttcaccatggcc

SEQ ID NO: 1689371 - DNA, 15 bp, Homo sapiens
ttcacccagacagct

SEQ ID NO: 1689372 - DNA, 13 bp, Homo sapiens
ttcaccccaccct

SEQ ID NO: 1689373 - DNA, 14 bp, Homo sapiens
ttcaccccaccctt

SEQ ID NO: 1689374 - DNA, 14 bp, Homo sapiens
ttcacccccaactt

SEQ ID NO: 1689375 - DNA, 18 bp, Homo sapiens
ttcacccccctctgctgc

SEQ ID NO: 1689376 - DNA, 18 bp, Homo sapiens
ttcacccctacactgtga

SEQ ID NO: 1689377 - DNA, 22 bp, Homo sapiens
ttcacccctccctttctcccct

SEQ ID NO: 1689378 - DNA, 12 bp, Homo sapiens
ttcacccctgca

SEQ ID NO: 1689379 - DNA, 17 bp, Homo sapiens
ttcacccctgcacttca

SEQ ID NO: 1689380 - DNA, 16 bp, Homo sapiens
ttcaccctcatgaaaa

SEQ ID NO: 1689381 - DNA, 22 bp, Homo sapiens
ttcaccctgtcaagttaacaag

SEQ ID NO: 1689382 - DNA, 21 bp, Homo sapiens
ttcacctaagtctctgtgaat

SEQ ID NO: 1689383 - DNA, 14 bp, Homo sapiens
ttcacctcagtaga

SEQ ID NO: 1689384 - DNA, 21 bp, Homo sapiens
ttcacctccaagcatttcatg

SEQ ID NO: 1689385 - DNA, 13 bp, Homo sapiens
ttcacctcttcca

SEQ ID NO: 1689386 - DNA, 13 bp, Homo sapiens
ttcacctcttcct

SEQ ID NO: 1689387 - DNA, 17 bp, Homo sapiens
ttcacctcttcctctgg

SEQ ID NO: 1689388 - DNA, 18 bp, Homo sapiens
ttcacctcttcctctggt

SEQ ID NO: 1689389 - DNA, 18 bp, Homo sapiens
ttcacctgtaaacctgag

SEQ ID NO: 1689390 - DNA, 19 bp, Homo sapiens
ttcacctgtgacaaaggat

SEQ ID NO: 1689391 - DNA, 21 bp, Homo sapiens
ttcacctgtttttaagctgtt

SEQ ID NO: 1689392 - DNA, 12 bp, Homo sapiens
ttcaccttggaa

SEQ ID NO: 1689393 - DNA, 15 bp, Homo sapiens
ttcaccttggaaggg

SEQ ID NO: 1689394 - DNA, 16 bp, Homo sapiens
ttcaccttgggatgat

SEQ ID NO: 1689395 - DNA, 15 bp, Homo sapiens
ttcacctttggtgca

SEQ ID NO: 1689396 - DNA, 16 bp, Homo sapiens
ttcacctttggtgcag

SEQ ID NO: 1689397 - DNA, 19 bp, Homo sapiens
ttcacctttggtgcagagg

SEQ ID NO: 1689398 - DNA, 21 bp, Homo sapiens
ttcacgcctgtaatcccagca

SEQ ID NO: 1689399 - DNA, 16 bp, Homo sapiens
ttcacggcagaccaga

SEQ ID NO: 1689400 - DNA, 21 bp, Homo sapiens
ttcacgtgctttgtgttcagt

SEQ ID NO: 1689401 - DNA, 18 bp, Homo sapiens
ttcactactcatgcgtga

SEQ ID NO: 1689402 - DNA, 22 bp, Homo sapiens
ttcactagaagccgtgggaaga

SEQ ID NO: 1689403 - DNA, 23 bp, Homo sapiens
ttcactagtgaccccttccctgt

SEQ ID NO: 1689404 - DNA, 18 bp, Homo sapiens
ttcactataaatggtgtt

SEQ ID NO: 1689405 - DNA, 13 bp, Homo sapiens
ttcactatttcct

SEQ ID NO: 1689406 - DNA, 20 bp, Homo sapiens
ttcactatttttatttatat

SEQ ID NO: 1689407 - DNA, 23 bp, Homo sapiens
ttcactcaagagttcagtgctca

SEQ ID NO: 1689408 - DNA, 16 bp, Homo sapiens
ttcactcacatagcca

SEQ ID NO: 1689409 - DNA, 21 bp, Homo sapiens
ttcactcatagccacttttat

SEQ ID NO: 1689410 - DNA, 13 bp, Homo sapiens
ttcactccagtca

SEQ ID NO: 1689411 - DNA, 17 bp, Homo sapiens
ttcactccagtcaacag

SEQ ID NO: 1689412 - DNA, 14 bp, Homo sapiens
ttcactctccatta

SEQ ID NO: 1689413 - DNA, 16 bp, Homo sapiens
ttcactcttccagaat

SEQ ID NO: 1689414 - DNA, 13 bp, Homo sapiens
ttcactgcaattt

SEQ ID NO: 1689415 - DNA, 13 bp, Homo sapiens
ttcactgccatga

SEQ ID NO: 1689416 - DNA, 17 bp, Homo sapiens
ttcactgcctgtagaga

SEQ ID NO: 1689417 - DNA, 13 bp, Homo sapiens
ttcactgccttcc

SEQ ID NO: 1689418 - DNA, 16 bp, Homo sapiens
ttcactggagttacat

SEQ ID NO: 1689419 - DNA, 18 bp, Homo sapiens
ttcactggcgccttctcg

SEQ ID NO: 1689420 - DNA, 13 bp, Homo sapiens
ttcactgtactgc

SEQ ID NO: 1689421 - DNA, 22 bp, Homo sapiens
ttcactgtactgcatgtgactt

SEQ ID NO: 1689422 - DNA, 23 bp, Homo sapiens
ttcactgtcaccaccctgctcat

SEQ ID NO: 1689423 - DNA, 21 bp, Homo sapiens
ttcactgtcaggaagaaatca

SEQ ID NO: 1689424 - DNA, 21 bp, Homo sapiens
ttcactgtgaggggaaggcct

SEQ ID NO: 1689425 - DNA, 18 bp, Homo sapiens
ttcacttaagtttttcca

SEQ ID NO: 1689426 - DNA, 15 bp, Homo sapiens
ttcacttaataattt

SEQ ID NO: 1689427 - DNA, 16 bp, Homo sapiens
ttcacttacctgaaaa

SEQ ID NO: 1689428 - DNA, 12 bp, Homo sapiens
ttcacttcaaaa

SEQ ID NO: 1689429 - DNA, 13 bp, Homo sapiens
ttcacttcttcct

SEQ ID NO: 1689430 - DNA, 17 bp, Homo sapiens
ttcacttgtattgactt

SEQ ID NO: 1689431 - DNA, 19 bp, Homo sapiens
ttcacttgtattgacttta

SEQ ID NO: 1689432 - DNA, 12 bp, Homo sapiens
ttcactttgaaa

SEQ ID NO: 1689433 - DNA, 14 bp, Homo sapiens
ttcactttgaaaag

SEQ ID NO: 1689434 - DNA, 22 bp, Homo sapiens
ttcactttgaaaagttggaagg

SEQ ID NO: 1689435 - DNA, 23 bp, Homo sapiens
ttcagaaaacccttttctacagt

SEQ ID NO: 1689436 - DNA, 13 bp, Homo sapiens
ttcagaaaatatt

SEQ ID NO: 1689437 - DNA, 14 bp, Homo sapiens
ttcagaaaatatta

SEQ ID NO: 1689438 - DNA, 16 bp, Homo sapiens
ttcagaaagacttggt

SEQ ID NO: 1689439 - DNA, 21 bp, Homo sapiens
ttcagaaatataacacatttt

SEQ ID NO: 1689440 - DNA, 13 bp, Homo sapiens
ttcagaaatatgt

SEQ ID NO: 1689441 - DNA, 17 bp, Homo sapiens
ttcagaaatgctgcctg

SEQ ID NO: 1689442 - DNA, 21 bp, Homo sapiens
ttcagaaatgctgcctgcctg

SEQ ID NO: 1689443 - DNA, 20 bp, Homo sapiens
ttcagaaattggaacagaat

SEQ ID NO: 1689444 - DNA, 22 bp, Homo sapiens
ttcagaacacacagactttctg

SEQ ID NO: 1689445 - DNA, 16 bp, Homo sapiens
ttcagaaccatccata

SEQ ID NO: 1689446 - DNA, 15 bp, Homo sapiens
ttcagaagtttaaat

SEQ ID NO: 1689447 - DNA, 16 bp, Homo sapiens
ttcagaatattttcaa

SEQ ID NO: 1689448 - DNA, 20 bp, Homo sapiens
ttcagacacctgttcacaga

SEQ ID NO: 1689449 - DNA, 22 bp, Homo sapiens
ttcagacacctgttcacagaaa

SEQ ID NO: 1689450 - DNA, 16 bp, Homo sapiens
ttcagacactttggaa

SEQ ID NO: 1689451 - DNA, 20 bp, Homo sapiens
ttcagacatctgaggtttta

SEQ ID NO: 1689452 - DNA, 11 bp, Homo sapiens
ttcagacattt

SEQ ID NO: 1689453 - DNA, 14 bp, Homo sapiens
ttcagaccccccca

SEQ ID NO: 1689454 - DNA, 16 bp, Homo sapiens
ttcagacccctgcctg

SEQ ID NO: 1689455 - DNA, 17 bp, Homo sapiens
ttcagactaaaaataca

SEQ ID NO: 1689456 - DNA, 12 bp, Homo sapiens
ttcagactcaga

SEQ ID NO: 1689457 - DNA, 20 bp, Homo sapiens
ttcagactcccattcctgaa

SEQ ID NO: 1689458 - DNA, 14 bp, Homo sapiens
ttcagactggccct

SEQ ID NO: 1689459 - DNA, 20 bp, Homo sapiens
ttcagagaaggccttacaga

SEQ ID NO: 1689460 - DNA, 19 bp, Homo sapiens
ttcagagccctcggagcca

SEQ ID NO: 1689461 - DNA, 14 bp, Homo sapiens
ttcagagcctagcc

SEQ ID NO: 1689462 - DNA, 18 bp, Homo sapiens
ttcagagcctagccacct

SEQ ID NO: 1689463 - DNA, 20 bp, Homo sapiens
ttcagagcctagccacctcc

SEQ ID NO: 1689464 - DNA, 21 bp, Homo sapiens
ttcagagtttgtcatatactg

SEQ ID NO: 1689465 - DNA, 17 bp, Homo sapiens
ttcagagtttgtgtgta

SEQ ID NO: 1689466 - DNA, 23 bp, Homo sapiens
ttcagagtttgtgtgtatttgta

SEQ ID NO: 1689467 - DNA, 17 bp, Homo sapiens
ttcagatacaaactgca

SEQ ID NO: 1689468 - DNA, 19 bp, Homo sapiens
ttcagatatcaaaattcta

SEQ ID NO: 1689469 - DNA, 22 bp, Homo sapiens
ttcagatatcttggacaaatca

SEQ ID NO: 1689470 - DNA, 18 bp, Homo sapiens
ttcagatattattgcttt

SEQ ID NO: 1689471 - DNA, 18 bp, Homo sapiens
ttcagatcactgaattta

SEQ ID NO: 1689472 - DNA, 22 bp, Homo sapiens
ttcagatctgaggttggatttg

SEQ ID NO: 1689473 - DNA, 23 bp, Homo sapiens
ttcagatgtgcaataatttgtac

SEQ ID NO: 1689474 - DNA, 15 bp, Homo sapiens
ttccaacccagccac

SEQ ID NO: 1689475 - DNA, 14 bp, Homo sapiens
ttccaacctcctgc

SEQ ID NO: 1689476 - DNA, 15 bp, Homo sapiens
ttccaacctcctgct

SEQ ID NO: 1689477 - DNA, 23 bp, Homo sapiens
ttccaacctcctgctctgggacg

SEQ ID NO: 1689478 - DNA, 14 bp, Homo sapiens
ttccaagacagagt

SEQ ID NO: 1689479 - DNA, 21 bp, Homo sapiens
ttccaagacatgtctgttcta

SEQ ID NO: 1689480 - DNA, 16 bp, Homo sapiens
ttccaagactctagag

SEQ ID NO: 1689481 - DNA, 17 bp, Homo sapiens
ttccaagactctagagt

SEQ ID NO: 1689482 - DNA, 22 bp, Homo sapiens
ttccaagactctagagtccaag

SEQ ID NO: 1689483 - DNA, 12 bp, Homo sapiens
ttccaagagtct

SEQ ID NO: 1689484 - DNA, 13 bp, Homo sapiens
ttccaaggccctg

SEQ ID NO: 1689485 - DNA, 13 bp, Homo sapiens
ttccaaggcttct

SEQ ID NO: 1689486 - DNA, 16 bp, Homo sapiens
ttccaagtctttgcta

SEQ ID NO: 1689487 - DNA, 16 bp, Homo sapiens
ttccaagtgcattttt

SEQ ID NO: 1689488 - DNA, 20 bp, Homo sapiens
ttccaagtgcatttttctta

SEQ ID NO: 1689489 - DNA, 15 bp, Homo sapiens
ttccaataaactatg

SEQ ID NO: 1689490 - DNA, 20 bp, Homo sapiens
ttccaatctctgttctgttt

SEQ ID NO: 1689491 - DNA, 13 bp, Homo sapiens
ttccaatttggaa

SEQ ID NO: 1689492 - DNA, 18 bp, Homo sapiens
ttccacaaaatctgtcca

SEQ ID NO: 1689493 - DNA, 12 bp, Homo sapiens
ttccacaaaatt

SEQ ID NO: 1689494 - DNA, 20 bp, Homo sapiens
ttccacaagattcccagaga

SEQ ID NO: 1689495 - DNA, 16 bp, Homo sapiens
ttccacacgcattaat

SEQ ID NO: 1689496 - DNA, 13 bp, Homo sapiens
ttccacagccgcc

SEQ ID NO: 1689497 - DNA, 14 bp, Homo sapiens
ttccacagggacca

SEQ ID NO: 1689498 - DNA, 22 bp, Homo sapiens
ttccaccacagccagcacctgg

SEQ ID NO: 1689499 - DNA, 22 bp, Homo sapiens
ttccaccaggattaatctctaa

SEQ ID NO: 1689500 - DNA, 15 bp, Homo sapiens
ttccaccccaagaga

SEQ ID NO: 1689501 - DNA, 13 bp, Homo sapiens
ttccaccctggaa

SEQ ID NO: 1689502 - DNA, 16 bp, Homo sapiens
ttccacgcagcaccct

SEQ ID NO: 1689503 - DNA, 19 bp, Homo sapiens
ttccactattttcaaagaa

SEQ ID NO: 1689504 - DNA, 20 bp, Homo sapiens
ttccactcctatggaaaagg

SEQ ID NO: 1689505 - DNA, 16 bp, Homo sapiens
ttccactgaacaaaac

SEQ ID NO: 1689506 - DNA, 16 bp, Homo sapiens
ttccactgaagtagtg

SEQ ID NO: 1689507 - DNA, 13 bp, Homo sapiens
ttccactgcaaaa

SEQ ID NO: 1689508 - DNA, 13 bp, Homo sapiens
ttccactgcttct

SEQ ID NO: 1689509 - DNA, 12 bp, Homo sapiens
ttccactggact

SEQ ID NO: 1689510 - DNA, 18 bp, Homo sapiens
ttccacttgtttgcactg

SEQ ID NO: 1689511 - DNA, 19 bp, Homo sapiens
ttccagaaagcaggagcag

SEQ ID NO: 1689512 - DNA, 14 bp, Homo sapiens
ttccagaaaggata

SEQ ID NO: 1689513 - DNA, 14 bp, Homo sapiens
ttccagaacagccc

SEQ ID NO: 1689514 - DNA, 22 bp, Homo sapiens
ttccagaagaagagaagctgct

SEQ ID NO: 1689515 - DNA, 16 bp, Homo sapiens
ttccagaatcccaaga

SEQ ID NO: 1689516 - DNA, 12 bp, Homo sapiens
ttccagaatctt

SEQ ID NO: 1689517 - DNA, 22 bp, Homo sapiens
ttccagaatcttgactttctga

SEQ ID NO: 1689518 - DNA, 20 bp, Homo sapiens
ttccagaatgctgaactcct

SEQ ID NO: 1689519 - DNA, 21 bp, Homo sapiens
ttccagaccaataaatttgta

SEQ ID NO: 1689520 - DNA, 19 bp, Homo sapiens
ttccagactcaggttccag

SEQ ID NO: 1689521 - DNA, 18 bp, Homo sapiens
ttccagagagtggctcct

SEQ ID NO: 1689522 - DNA, 20 bp, Homo sapiens
ttccagaggctattattttc

SEQ ID NO: 1689523 - DNA, 20 bp, Homo sapiens
ttccagatctttcagaaata

SEQ ID NO: 1689524 - DNA, 15 bp, Homo sapiens
ttccagcagtcagtc

SEQ ID NO: 1689525 - DNA, 15 bp, Homo sapiens
ttccagcatttttat

SEQ ID NO: 1689526 - DNA, 13 bp, Homo sapiens
ttccagctctgcc

SEQ ID NO: 1689527 - DNA, 21 bp, Homo sapiens
ttccagctctgcccccgcggg

SEQ ID NO: 1689528 - DNA, 19 bp, Homo sapiens
ttccagctgacatcttgca

SEQ ID NO: 1689529 - DNA, 12 bp, Homo sapiens
ttccagctgcca

SEQ ID NO: 1689530 - DNA, 12 bp, Homo sapiens
ttccagctgctg

SEQ ID NO: 1689531 - DNA, 15 bp, Homo sapiens
ttccagctgctgtct

SEQ ID NO: 1689532 - DNA, 20 bp, Homo sapiens
ttccagctgtcactctgtgc

SEQ ID NO: 1689533 - DNA, 19 bp, Homo sapiens
ttccagcttgcattgattg

SEQ ID NO: 1689534 - DNA, 24 bp, Homo sapiens
ttccaggaaactccacatctgcct

SEQ ID NO: 1689535 - DNA, 23 bp, Homo sapiens
ttccaggagaagggggctctgcc

SEQ ID NO: 1689536 - DNA, 18 bp, Homo sapiens
ttccaggatcctgcagga

SEQ ID NO: 1689537 - DNA, 16 bp, Homo sapiens
ttccaggcccctgagg

SEQ ID NO: 1689538 - DNA, 17 bp, Homo sapiens
ttccaggcccctgagga

SEQ ID NO: 1689539 - DNA, 22 bp, Homo sapiens
ttccaggcctgaagtcttctcc

SEQ ID NO: 1689540 - DNA, 20 bp, Homo sapiens
ttccaggctcttcctggacc

SEQ ID NO: 1689541 - DNA, 12 bp, Homo sapiens
ttccaggctgag

SEQ ID NO: 1689542 - DNA, 19 bp, Homo sapiens
ttccaggcttccctgactt

SEQ ID NO: 1689543 - DNA, 14 bp, Homo sapiens
ttccagggatccag

SEQ ID NO: 1689544 - DNA, 12 bp, Homo sapiens
ttccagggccct

SEQ ID NO: 1689545 - DNA, 20 bp, Homo sapiens
ttccaggtaatatgtcttgg

SEQ ID NO: 1689546 - DNA, 19 bp, Homo sapiens
ttccaggttccatccacca

SEQ ID NO: 1689547 - DNA, 13 bp, Homo sapiens
ttccagtaacttt

SEQ ID NO: 1689548 - DNA, 16 bp, Homo sapiens
ttccagtaactttttt

SEQ ID NO: 1689549 - DNA, 18 bp, Homo sapiens
ttccagtacctttgtcac

SEQ ID NO: 1689550 - DNA, 19 bp, Homo sapiens
ttccagtgaggaaccctga

SEQ ID NO: 1689551 - DNA, 22 bp, Homo sapiens
ttccagtgatgtgtgagctatg

SEQ ID NO: 1689552 - DNA, 21 bp, Homo sapiens
ttccagttcatctatggcagt

SEQ ID NO: 1689553 - DNA, 14 bp, Homo sapiens
ttccagtttctcct

SEQ ID NO: 1689554 - DNA, 20 bp, Homo sapiens
ttccataaatttggactgtc

SEQ ID NO: 1689555 - DNA, 19 bp, Homo sapiens
ttccataaggaatgtagct

SEQ ID NO: 1689556 - DNA, 16 bp, Homo sapiens
ttccataatgtataaa

SEQ ID NO: 1689557 - DNA, 14 bp, Homo sapiens
ttccatacttctct

SEQ ID NO: 1689558 - DNA, 15 bp, Homo sapiens
ttccatacttctctc

SEQ ID NO: 1689559 - DNA, 22 bp, Homo sapiens
ttccataggacatactgcatgt

SEQ ID NO: 1689560 - DNA, 23 bp, Homo sapiens
ttccataggacatactgcatgta

SEQ ID NO: 1689561 - DNA, 15 bp, Homo sapiens
ttccatagtcaatga

SEQ ID NO: 1689562 - DNA, 21 bp, Homo sapiens
ttccatagtgttaactgtcag

SEQ ID NO: 1689563 - DNA, 14 bp, Homo sapiens
ttccatatgctcca

SEQ ID NO: 1689564 - DNA, 16 bp, Homo sapiens
ttccatatgctccagg

SEQ ID NO: 1689565 - DNA, 15 bp, Homo sapiens
ttccatcatcactgt

SEQ ID NO: 1689566 - DNA, 16 bp, Homo sapiens
ttccatcatcactgta

SEQ ID NO: 1689567 - DNA, 22 bp, Homo sapiens
ttccatcatcactgtaaagaca

SEQ ID NO: 1689568 - DNA, 12 bp, Homo sapiens
ttccatcatgtc

SEQ ID NO: 1689569 - DNA, 18 bp, Homo sapiens
ttccatccaccaccttgc

SEQ ID NO: 1689570 - DNA, 15 bp, Homo sapiens
ttccatccctacccc

SEQ ID NO: 1689571 - DNA, 21 bp, Homo sapiens
ttccatcctagtcactacctt

SEQ ID NO: 1689572 - DNA, 21 bp, Homo sapiens
ttccatcttgtggggccagga

SEQ ID NO: 1689573 - DNA, 16 bp, Homo sapiens
ttccatgaaggcagag

SEQ ID NO: 1689574 - DNA, 13 bp, Homo sapiens
ttccatgacaata

SEQ ID NO: 1689575 - DNA, 10 bp, Homo sapiens
ttccatgagc

SEQ ID NO: 1689576 - DNA, 23 bp, Homo sapiens
ttccatgcaactggagttcctta

SEQ ID NO: 1689577 - DNA, 15 bp, Homo sapiens
ttccatgcagccttg

SEQ ID NO: 1689578 - DNA, 18 bp, Homo sapiens
ttccatgcgtgtttctga

SEQ ID NO: 1689579 - DNA, 13 bp, Homo sapiens
ttccatgtgcctt

SEQ ID NO: 1689580 - DNA, 20 bp, Homo sapiens
ttccatgtgcctttctttgc

SEQ ID NO: 1689581 - DNA, 23 bp, Homo sapiens
ttccatgtgcctttctttgcctc

SEQ ID NO: 1689582 - DNA, 15 bp, Homo sapiens
ttccatgttgctgcc

SEQ ID NO: 1689583 - DNA, 16 bp, Homo sapiens
ttccatgttgctgcca

SEQ ID NO: 1689584 - DNA, 15 bp, Homo sapiens
ttccattagcatttg

SEQ ID NO: 1689585 - DNA, 14 bp, Homo sapiens
ttccattatgattc

SEQ ID NO: 1689586 - DNA, 16 bp, Homo sapiens
ttccattccattgttt

SEQ ID NO: 1689587 - DNA, 14 bp, Homo sapiens
ttccattctttcag

SEQ ID NO: 1689588 - DNA, 14 bp, Homo sapiens
ttccattgaccagc

SEQ ID NO: 1689589 - DNA, 15 bp, Homo sapiens
ttccattgaccagct

SEQ ID NO: 1689590 - DNA, 13 bp, Homo sapiens
ttccattgcttat

SEQ ID NO: 1689591 - DNA, 16 bp, Homo sapiens
ttccattggtccaaga

SEQ ID NO: 1689592 - DNA, 17 bp, Homo sapiens
ttccattggtccaagat

SEQ ID NO: 1689593 - DNA, 19 bp, Homo sapiens
ttccattggtccaagattc

SEQ ID NO: 1689594 - DNA, 13 bp, Homo sapiens
ttccattgtttta

SEQ ID NO: 1689595 - DNA, 17 bp, Homo sapiens
ttccatttatttatgaa

SEQ ID NO: 1689596 - DNA, 16 bp, Homo sapiens
ttccatttccagttca

SEQ ID NO: 1689597 - DNA, 14 bp, Homo sapiens
ttccatttctcaat

SEQ ID NO: 1689598 - DNA, 13 bp, Homo sapiens
ttccattttaatt

SEQ ID NO: 1689599 - DNA, 23 bp, Homo sapiens
ttccatttttttctttacttatc

SEQ ID NO: 1689600 - DNA, 18 bp, Homo sapiens
ttcccaaagtcctctgct

SEQ ID NO: 1689601 - DNA, 12 bp, Homo sapiens
ttcccaaatttc

SEQ ID NO: 1689602 - DNA, 19 bp, Homo sapiens
ttcccaacttgcctttgaa

SEQ ID NO: 1689603 - DNA, 20 bp, Homo sapiens
ttcccaacttgcctttgaag

SEQ ID NO: 1689604 - DNA, 23 bp, Homo sapiens
ttcccaacttgcctttgaagagt

SEQ ID NO: 1689605 - DNA, 15 bp, Homo sapiens
ttcccaagtatgcct

SEQ ID NO: 1689606 - DNA, 19 bp, Homo sapiens
ttcccaagtatgccttaag

SEQ ID NO: 1689607 - DNA, 21 bp, Homo sapiens
ttcccaagtatgccttaagca

SEQ ID NO: 1689608 - DNA, 15 bp, Homo sapiens
ttcccaataaaagtg

SEQ ID NO: 1689609 - DNA, 20 bp, Homo sapiens
ttcccaatagcaacgtagct

SEQ ID NO: 1689610 - DNA, 14 bp, Homo sapiens
ttcccaattaggaa

SEQ ID NO: 1689611 - DNA, 17 bp, Homo sapiens
ttcccacacctgcctgc

SEQ ID NO: 1689612 - DNA, 18 bp, Homo sapiens
ttcccacacctgcctgcg

SEQ ID NO: 1689613 - DNA, 16 bp, Homo sapiens
ttcccaccagctccca

SEQ ID NO: 1689614 - DNA, 15 bp, Homo sapiens
ttcccacccatcgct

SEQ ID NO: 1689615 - DNA, 15 bp, Homo sapiens
ttcccactcaccagc

SEQ ID NO: 1689616 - DNA, 18 bp, Homo sapiens
ttcccactcaccagccct

SEQ ID NO: 1689617 - DNA, 14 bp, Homo sapiens
ttcccactccttca

SEQ ID NO: 1689618 - DNA, 18 bp, Homo sapiens
ttcccactttcccacccc

SEQ ID NO: 1689619 - DNA, 20 bp, Homo sapiens
ttcccactttcccaccccac

SEQ ID NO: 1689620 - DNA, 19 bp, Homo sapiens
ttcccagaatctctgagcc

SEQ ID NO: 1689621 - DNA, 23 bp, Homo sapiens
ttcccagagcaaaataattttaa

SEQ ID NO: 1689622 - DNA, 19 bp, Homo sapiens
ttcccagagtcatctgatt

SEQ ID NO: 1689623 - DNA, 14 bp, Homo sapiens
ttcccagatacttc

SEQ ID NO: 1689624 - DNA, 13 bp, Homo sapiens
ttcccagcccagc

SEQ ID NO: 1689625 - DNA, 16 bp, Homo sapiens
ttcccagctctccctc

SEQ ID NO: 1689626 - DNA, 18 bp, Homo sapiens
ttcccagctctccctctg

SEQ ID NO: 1689627 - DNA, 20 bp, Homo sapiens
ttcccagctctccctctggc

SEQ ID NO: 1689628 - DNA, 23 bp, Homo sapiens
ttcccagctctccctctggccct

SEQ ID NO: 1689629 - DNA, 10 bp, Homo sapiens
ttcccaggcc

SEQ ID NO: 1689630 - DNA, 16 bp, Homo sapiens
ttcccaggccctttgg

SEQ ID NO: 1689631 - DNA, 17 bp, Homo sapiens
ttcccaggccctttggc

SEQ ID NO: 1689632 - DNA, 20 bp, Homo sapiens
ttcccaggccctttggcttc

SEQ ID NO: 1689633 - DNA, 22 bp, Homo sapiens
ttcccaggccctttggcttctg

SEQ ID NO: 1689634 - DNA, 18 bp, Homo sapiens
ttcccaggttctgtttat

SEQ ID NO: 1689635 - DNA, 19 bp, Homo sapiens
ttcccagtatttttatacg

SEQ ID NO: 1689636 - DNA, 16 bp, Homo sapiens
ttcccagttaaagatt

SEQ ID NO: 1689637 - DNA, 16 bp, Homo sapiens
ttcccataattttctt

SEQ ID NO: 1689638 - DNA, 14 bp, Homo sapiens
ttcccatcgctgtc

SEQ ID NO: 1689639 - DNA, 15 bp, Homo sapiens
ttcccatcgctgtca

SEQ ID NO: 1689640 - DNA, 12 bp, Homo sapiens
ttcccatctgca

SEQ ID NO: 1689641 - DNA, 23 bp, Homo sapiens
ttcccatggggagggattctggt

SEQ ID NO: 1689642 - DNA, 17 bp, Homo sapiens
ttcccatgtagccccct

SEQ ID NO: 1689643 - DNA, 19 bp, Homo sapiens
ttcccattattatttctgt

SEQ ID NO: 1689644 - DNA, 20 bp, Homo sapiens
ttcccattctgccccagagt

SEQ ID NO: 1689645 - DNA, 23 bp, Homo sapiens
ttcccattggttcacctgtgact

SEQ ID NO: 1689646 - DNA, 17 bp, Homo sapiens
ttcccattgtggctcct

SEQ ID NO: 1689647 - DNA, 14 bp, Homo sapiens
ttcccatttcagct

SEQ ID NO: 1689648 - DNA, 13 bp, Homo sapiens
ttcccatttcttc

SEQ ID NO: 1689649 - DNA, 20 bp, Homo sapiens
ttcccatttgtgccagagga

SEQ ID NO: 1689650 - DNA, 17 bp, Homo sapiens
ttcccattttgcaaaat

SEQ ID NO: 1689651 - DNA, 14 bp, Homo sapiens
ttccccaagagaaa

SEQ ID NO: 1689652 - DNA, 16 bp, Homo sapiens
ttccccacacagggca

SEQ ID NO: 1689653 - DNA, 22 bp, Homo sapiens
ttccccacacagggcactgact

SEQ ID NO: 1689654 - DNA, 13 bp, Homo sapiens
ttccccacagaac

SEQ ID NO: 1689655 - DNA, 21 bp, Homo sapiens
ttccccactgacagcctccca

SEQ ID NO: 1689656 - DNA, 14 bp, Homo sapiens
ttccccagacttgc

SEQ ID NO: 1689657 - DNA, 11 bp, Homo sapiens
ttccccagaga

SEQ ID NO: 1689658 - DNA, 20 bp, Homo sapiens
ttccccagaggctcccaatc

SEQ ID NO: 1689659 - DNA, 13 bp, Homo sapiens
ttccccagccaca

SEQ ID NO: 1689660 - DNA, 15 bp, Homo sapiens
ttccccagctctcag

SEQ ID NO: 1689661 - DNA, 17 bp, Homo sapiens
ttcccccactactgcag

SEQ ID NO: 1689662 - DNA, 20 bp, Homo sapiens
ttcccccagcaacgcccctc

SEQ ID NO: 1689663 - DNA, 16 bp, Homo sapiens
ttcccccagcccaata

SEQ ID NO: 1689664 - DNA, 17 bp, Homo sapiens
ttcccccagcccaataa

SEQ ID NO: 1689665 - DNA, 19 bp, Homo sapiens
ttccccctccaatcccacc

SEQ ID NO: 1689666 - DNA, 13 bp, Homo sapiens
ttccccctcctca

SEQ ID NO: 1689667 - DNA, 21 bp, Homo sapiens
ttccccgatgtcccctgcggg

SEQ ID NO: 1689668 - DNA, 20 bp, Homo sapiens
ttccccgcaacccacagctc

SEQ ID NO: 1689669 - DNA, 16 bp, Homo sapiens
ttccccgggggaggaa

SEQ ID NO: 1689670 - DNA, 19 bp, Homo sapiens
ttcccctacacctccctcc

SEQ ID NO: 1689671 - DNA, 21 bp, Homo sapiens
ttcccctcccaatcctctctc

SEQ ID NO: 1689672 - DNA, 22 bp, Homo sapiens
ttcccctcccaatcctctctcc

SEQ ID NO: 1689673 - DNA, 13 bp, Homo sapiens
ttcccctccctgg

SEQ ID NO: 1689674 - DNA, 14 bp, Homo sapiens
ttcccctccctggg

SEQ ID NO: 1689675 - DNA, 18 bp, Homo sapiens
ttcccctccttctccctt

SEQ ID NO: 1689676 - DNA, 13 bp, Homo sapiens
ttcccctctcgcg

SEQ ID NO: 1689677 - DNA, 19 bp, Homo sapiens
ttcccctcttcccttcaac

SEQ ID NO: 1689678 - DNA, 13 bp, Homo sapiens
ttcccctgcacct

SEQ ID NO: 1689679 - DNA, 19 bp, Homo sapiens
ttcccctgcacctggcctg

SEQ ID NO: 1689680 - DNA, 13 bp, Homo sapiens
ttcccctggcctc

SEQ ID NO: 1689681 - DNA, 13 bp, Homo sapiens
ttcccctggcctt

SEQ ID NO: 1689682 - DNA, 15 bp, Homo sapiens
ttcccctgtggggat

SEQ ID NO: 1689683 - DNA, 13 bp, Homo sapiens
ttcccctgtgtca

SEQ ID NO: 1689684 - DNA, 12 bp, Homo sapiens
ttccccttccct

SEQ ID NO: 1689685 - DNA, 14 bp, Homo sapiens
ttccccttccctta

SEQ ID NO: 1689686 - DNA, 12 bp, Homo sapiens
ttccccttggac

SEQ ID NO: 1689687 - DNA, 22 bp, Homo sapiens
ttccccttttgcctggctgtgg

SEQ ID NO: 1689688 - DNA, 22 bp, Homo sapiens
ttcccgaggaactcgcctcagc

SEQ ID NO: 1689689 - DNA, 20 bp, Homo sapiens
ttcccgccttgggcttgcag

SEQ ID NO: 1689690 - DNA, 12 bp, Homo sapiens
ttcccgctcagc

SEQ ID NO: 1689691 - DNA, 21 bp, Homo sapiens
ttcccgggataaactgagcct

SEQ ID NO: 1689692 - DNA, 18 bp, Homo sapiens
ttcccgggccagggctgc

SEQ ID NO: 1689693 - DNA, 14 bp, Homo sapiens
ttcccgtctcagaa

SEQ ID NO: 1689694 - DNA, 17 bp, Homo sapiens
ttcccgtttctccacct

SEQ ID NO: 1689695 - DNA, 14 bp, Homo sapiens
ttccctacctcagg

SEQ ID NO: 1689696 - DNA, 12 bp, Homo sapiens
ttccctagagag

SEQ ID NO: 1689697 - DNA, 17 bp, Homo sapiens
ttccctagagagaataa

SEQ ID NO: 1689698 - DNA, 20 bp, Homo sapiens
ttccctcacctttcccatct

SEQ ID NO: 1689699 - DNA, 23 bp, Homo sapiens
ttccctccatccccctttaccct

SEQ ID NO: 1689700 - DNA, 15 bp, Homo sapiens
ttccctcctgctact

SEQ ID NO: 1689701 - DNA, 19 bp, Homo sapiens
ttccctctcagctgctggg

SEQ ID NO: 1689702 - DNA, 14 bp, Homo sapiens
ttccctctcatctc

SEQ ID NO: 1689703 - DNA, 12 bp, Homo sapiens
ttccctctccct

SEQ ID NO: 1689704 - DNA, 19 bp, Homo sapiens
ttccctctcgctcccctct

SEQ ID NO: 1689705 - DNA, 14 bp, Homo sapiens
ttccctctctcact

SEQ ID NO: 1689706 - DNA, 15 bp, Homo sapiens
ttccctctgggcctg

SEQ ID NO: 1689707 - DNA, 16 bp, Homo sapiens
ttccctcttccctctc

SEQ ID NO: 1689708 - DNA, 16 bp, Homo sapiens
ttccctctttggctcc

SEQ ID NO: 1689709 - DNA, 23 bp, Homo sapiens
ttccctgagaaacccaccagcct

SEQ ID NO: 1689710 - DNA, 18 bp, Homo sapiens
ttccctgagtcaccagga

SEQ ID NO: 1689711 - DNA, 21 bp, Homo sapiens
ttccctgcaaccaattgaaaa

SEQ ID NO: 1689712 - DNA, 22 bp, Homo sapiens
ttccctgcaggtagttgagttg

SEQ ID NO: 1689713 - DNA, 23 bp, Homo sapiens
ttccctgcctctcatcaactgaa

SEQ ID NO: 1689714 - DNA, 11 bp, Homo sapiens
ttccctgctga

SEQ ID NO: 1689715 - DNA, 14 bp, Homo sapiens
ttccctgcttccag

SEQ ID NO: 1689716 - DNA, 16 bp, Homo sapiens
ttccctgcttccagga

SEQ ID NO: 1689717 - DNA, 21 bp, Homo sapiens
ttccctgctttgcatctttgt

SEQ ID NO: 1689718 - DNA, 20 bp, Homo sapiens
ttccctggaaaccttccacc

SEQ ID NO: 1689719 - DNA, 19 bp, Homo sapiens
ttccctggaactcctggcc

SEQ ID NO: 1689720 - DNA, 17 bp, Homo sapiens
ttccctggacaggcagc

SEQ ID NO: 1689721 - DNA, 20 bp, Homo sapiens
ttccctggacaggcagcctc

SEQ ID NO: 1689722 - DNA, 21 bp, Homo sapiens
ttccctggacaggcagcctcc

SEQ ID NO: 1689723 - DNA, 20 bp, Homo sapiens
ttccctggcaggtggccagg

SEQ ID NO: 1689724 - DNA, 18 bp, Homo sapiens
ttccctggctacttccct

SEQ ID NO: 1689725 - DNA, 22 bp, Homo sapiens
ttccctggctacttcccttcct

SEQ ID NO: 1689726 - DNA, 23 bp, Homo sapiens
ttccctggctacttcccttcctc

SEQ ID NO: 1689727 - DNA, 22 bp, Homo sapiens
ttcccttaaggggtatcatgta

SEQ ID NO: 1689728 - DNA, 14 bp, Homo sapiens
ttcccttacaaggt

SEQ ID NO: 1689729 - DNA, 15 bp, Homo sapiens
ttcccttattgcctc

SEQ ID NO: 1689730 - DNA, 12 bp, Homo sapiens
ttcccttccaaa

SEQ ID NO: 1689731 - DNA, 11 bp, Homo sapiens
ttcccttcctc

SEQ ID NO: 1689732 - DNA, 21 bp, Homo sapiens
ttcccttctacaaggactcca

SEQ ID NO: 1689733 - DNA, 22 bp, Homo sapiens
ttcccttctgggcttcattctg

SEQ ID NO: 1689734 - DNA, 15 bp, Homo sapiens
ttcccttgagccctc

SEQ ID NO: 1689735 - DNA, 20 bp, Homo sapiens
ttcccttgcaggggtccccc

SEQ ID NO: 1689736 - DNA, 11 bp, Homo sapiens
ttcccttggaa

SEQ ID NO: 1689737 - DNA, 17 bp, Homo sapiens
ttcccttggatgtagtc

SEQ ID NO: 1689738 - DNA, 16 bp, Homo sapiens
ttcccttggcctcaga

SEQ ID NO: 1689739 - DNA, 11 bp, Homo sapiens
ttcccttgtat

SEQ ID NO: 1689740 - DNA, 12 bp, Homo sapiens
ttcccttgtatt

SEQ ID NO: 1689741 - DNA, 22 bp, Homo sapiens
ttccctttgtgagtcaatacat

SEQ ID NO: 1689742 - DNA, 17 bp, Homo sapiens
ttcccttttacatactg

SEQ ID NO: 1689743 - DNA, 14 bp, Homo sapiens
ttccgaatctcttt

SEQ ID NO: 1689744 - DNA, 22 bp, Homo sapiens
ttccgacatcccagaccagcca

SEQ ID NO: 1689745 - DNA, 17 bp, Homo sapiens
ttccgagcattccagta

SEQ ID NO: 1689746 - DNA, 14 bp, Homo sapiens
ttccgatcaacatt

SEQ ID NO: 1689747 - DNA, 21 bp, Homo sapiens
ttccgatcaacatttatgacc

SEQ ID NO: 1689748 - DNA, 16 bp, Homo sapiens
ttccgtatttaaagtt

SEQ ID NO: 1689749 - DNA, 17 bp, Homo sapiens
ttccgtatttaaagttg

SEQ ID NO: 1689750 - DNA, 15 bp, Homo sapiens
ttccgtcacttaaat

SEQ ID NO: 1689751 - DNA, 18 bp, Homo sapiens
ttccgtgacgtcactgga

SEQ ID NO: 1689752 - DNA, 21 bp, Homo sapiens
ttccgtggtcagagtgccact

SEQ ID NO: 1689753 - DNA, 21 bp, Homo sapiens
ttccgtgtgattgtctttgaa

SEQ ID NO: 1689754 - DNA, 18 bp, Homo sapiens
ttcctaaacataattgtg

SEQ ID NO: 1689755 - DNA, 14 bp, Homo sapiens
ttcctaaactccct

SEQ ID NO: 1689756 - DNA, 19 bp, Homo sapiens
ttcctaacacagcatgtgt

SEQ ID NO: 1689757 - DNA, 15 bp, Homo sapiens
ttcctaacaggatga

SEQ ID NO: 1689758 - DNA, 16 bp, Homo sapiens
ttcctaacctgtcaga

SEQ ID NO: 1689759 - DNA, 15 bp, Homo sapiens
ttcctaactagaatt

SEQ ID NO: 1689760 - DNA, 24 bp, Homo sapiens
ttcctaactagaattagtatgtct

SEQ ID NO: 1689761 - DNA, 12 bp, Homo sapiens
ttcctaaggcat

SEQ ID NO: 1689762 - DNA, 13 bp, Homo sapiens
ttcctaaggcatg

SEQ ID NO: 1689763 - DNA, 15 bp, Homo sapiens
ttcctaaggcatgtg

SEQ ID NO: 1689764 - DNA, 16 bp, Homo sapiens
ttcctacaaagatgtt

SEQ ID NO: 1689765 - DNA, 19 bp, Homo sapiens
ttcctacaacttaatggaa

SEQ ID NO: 1689766 - DNA, 20 bp, Homo sapiens
ttcctacaagagcagcctgt

SEQ ID NO: 1689767 - DNA, 23 bp, Homo sapiens
ttcctacagaaatactgctctga

SEQ ID NO: 1689768 - DNA, 17 bp, Homo sapiens
ttcctactcacacttca

SEQ ID NO: 1689769 - DNA, 20 bp, Homo sapiens
ttcctactcacacttcagct

SEQ ID NO: 1689770 - DNA, 16 bp, Homo sapiens
ttcctactgtcctcag

SEQ ID NO: 1689771 - DNA, 18 bp, Homo sapiens
ttcctactgtcctcagag

SEQ ID NO: 1689772 - DNA, 14 bp, Homo sapiens
ttcctagccctctc

SEQ ID NO: 1689773 - DNA, 18 bp, Homo sapiens
ttcctagctgtgtgaata

SEQ ID NO: 1689774 - DNA, 23 bp, Homo sapiens
ttcctaggaaatcacaggcttct

SEQ ID NO: 1689775 - DNA, 19 bp, Homo sapiens
ttcctagggatctgaaatc

SEQ ID NO: 1689776 - DNA, 21 bp, Homo sapiens
ttcctagggatctgaaatcca

SEQ ID NO: 1689777 - DNA, 18 bp, Homo sapiens
ttcctagttttctcctcc

SEQ ID NO: 1689778 - DNA, 21 bp, Homo sapiens
ttcctatatagtttattgaca

SEQ ID NO: 1689779 - DNA, 23 bp, Homo sapiens
ttcctatttcagaagtttaaata

SEQ ID NO: 1689780 - DNA, 20 bp, Homo sapiens
ttcctcaaattttttgactt

SEQ ID NO: 1689781 - DNA, 22 bp, Homo sapiens
ttcctcaaattttttgactttt

SEQ ID NO: 1689782 - DNA, 22 bp, Homo sapiens
ttcctcaagtatcttctatttt

SEQ ID NO: 1689783 - DNA, 23 bp, Homo sapiens
ttcctcaagtatcttctattttt

SEQ ID NO: 1689784 - DNA, 22 bp, Homo sapiens
ttcctcacacccctgtcccacc

SEQ ID NO: 1689785 - DNA, 13 bp, Homo sapiens
ttcctcagcctcc

SEQ ID NO: 1689786 - DNA, 14 bp, Homo sapiens
ttcctcagcctcca

SEQ ID NO: 1689787 - DNA, 15 bp, Homo sapiens
ttcctcagctgccaa

SEQ ID NO: 1689788 - DNA, 12 bp, Homo sapiens
ttcctcagctta

SEQ ID NO: 1689789 - DNA, 19 bp, Homo sapiens
ttcctcagcttatctcttt

SEQ ID NO: 1689790 - DNA, 19 bp, Homo sapiens
ttcctcatccaccccatcc

SEQ ID NO: 1689791 - DNA, 14 bp, Homo sapiens
ttcctcatgtaaca

SEQ ID NO: 1689792 - DNA, 22 bp, Homo sapiens
ttcctcatgtaacattggtgaa

SEQ ID NO: 1689793 - DNA, 20 bp, Homo sapiens
ttcctcattaatagctgcct

SEQ ID NO: 1689794 - DNA, 23 bp, Homo sapiens
ttcctcattaatagctgccttca

SEQ ID NO: 1689795 - DNA, 20 bp, Homo sapiens
ttcctccccacactccactc

SEQ ID NO: 1689796 - DNA, 21 bp, Homo sapiens
ttcctccccattagagtcagc

SEQ ID NO: 1689797 - DNA, 17 bp, Homo sapiens
ttcctccccctgcaact

SEQ ID NO: 1689798 - DNA, 10 bp, Homo sapiens
ttcctccctc

SEQ ID NO: 1689799 - DNA, 19 bp, Homo sapiens
ttcctccgtccacccaggc

SEQ ID NO: 1689800 - DNA, 20 bp, Homo sapiens
ttcctccgtccacccaggct

SEQ ID NO: 1689801 - DNA, 19 bp, Homo sapiens
ttcctcctccacagtgctg

SEQ ID NO: 1689802 - DNA, 18 bp, Homo sapiens
ttcctcctcccagtgcct

SEQ ID NO: 1689803 - DNA, 16 bp, Homo sapiens
ttcctcctccccgctc

SEQ ID NO: 1689804 - DNA, 13 bp, Homo sapiens
ttcctcctggaaa

SEQ ID NO: 1689805 - DNA, 20 bp, Homo sapiens
ttcctctaactcactgccta

SEQ ID NO: 1689806 - DNA, 21 bp, Homo sapiens
ttcctctaactcactgcctag

SEQ ID NO: 1689807 - DNA, 17 bp, Homo sapiens
ttcctctagaagccaag

SEQ ID NO: 1689808 - DNA, 23 bp, Homo sapiens
ttcctctagtgccctccacagcc

SEQ ID NO: 1689809 - DNA, 15 bp, Homo sapiens
ttcctctatactttg

SEQ ID NO: 1689810 - DNA, 22 bp, Homo sapiens
ttcctctatactttgttctgtt

SEQ ID NO: 1689811 - DNA, 23 bp, Homo sapiens
ttcctctattgatgtacagtctg

SEQ ID NO: 1689812 - DNA, 14 bp, Homo sapiens
ttcctctccactgc

SEQ ID NO: 1689813 - DNA, 15 bp, Homo sapiens
ttcctctccactgcc

SEQ ID NO: 1689814 - DNA, 15 bp, Homo sapiens
ttcctctccaggcca

SEQ ID NO: 1689815 - DNA, 14 bp, Homo sapiens
ttcctctctccaga

SEQ ID NO: 1689816 - DNA, 13 bp, Homo sapiens
ttcctctgcagct

SEQ ID NO: 1689817 - DNA, 19 bp, Homo sapiens
ttcctctgcagctgacctc

SEQ ID NO: 1689818 - DNA, 12 bp, Homo sapiens
ttcctctgcctg

SEQ ID NO: 1689819 - DNA, 14 bp, Homo sapiens
ttcctctgcctgcc

SEQ ID NO: 1689820 - DNA, 14 bp, Homo sapiens
ttcctctgctcacc

SEQ ID NO: 1689821 - DNA, 12 bp, Homo sapiens
ttcctctgggaa

SEQ ID NO: 1689822 - DNA, 18 bp, Homo sapiens
ttcctctgggtttctaag

SEQ ID NO: 1689823 - DNA, 18 bp, Homo sapiens
ttcctctgtctcctaagc

SEQ ID NO: 1689824 - DNA, 15 bp, Homo sapiens
ttcctcttagcctct

SEQ ID NO: 1689825 - DNA, 16 bp, Homo sapiens
ttcctcttcctgccct

SEQ ID NO: 1689826 - DNA, 16 bp, Homo sapiens
ttcctcttgtcctggc

SEQ ID NO: 1689827 - DNA, 21 bp, Homo sapiens
ttcctcttgtcctggcccttc

SEQ ID NO: 1689828 - DNA, 22 bp, Homo sapiens
ttcctcttgtcctggcccttca

SEQ ID NO: 1689829 - DNA, 15 bp, Homo sapiens
ttcctcttgtctgat

SEQ ID NO: 1689830 - DNA, 18 bp, Homo sapiens
ttcctctttctgctctgc

SEQ ID NO: 1689831 - DNA, 21 bp, Homo sapiens
ttcctctttctgctctgccat

SEQ ID NO: 1689832 - DNA, 22 bp, Homo sapiens
ttcctctttctgctctgccatc

SEQ ID NO: 1689833 - DNA, 19 bp, Homo sapiens
ttcctcttttcctgctccc

SEQ ID NO: 1689834 - DNA, 20 bp, Homo sapiens
ttcctcttttgggtaaaatc

SEQ ID NO: 1689835 - DNA, 17 bp, Homo sapiens
ttcctgaaagaaacagt

SEQ ID NO: 1689836 - DNA, 16 bp, Homo sapiens
ttcctgaagaaccagt

SEQ ID NO: 1689837 - DNA, 16 bp, Homo sapiens
ttcctgaatgaaatat

SEQ ID NO: 1689838 - DNA, 13 bp, Homo sapiens
ttcctgacaaaag

SEQ ID NO: 1689839 - DNA, 13 bp, Homo sapiens
ttcctgacacttt

SEQ ID NO: 1689840 - DNA, 15 bp, Homo sapiens
ttcctgacattgtct

SEQ ID NO: 1689841 - DNA, 13 bp, Homo sapiens
ttcctgacttgag

SEQ ID NO: 1689842 - DNA, 23 bp, Homo sapiens
ttcctgacttgagtgttcctttt

SEQ ID NO: 1689843 - DNA, 22 bp, Homo sapiens
ttcctgagctgtcgctgcctcc

SEQ ID NO: 1689844 - DNA, 23 bp, Homo sapiens
ttcctgagctgtcgctgcctcca

SEQ ID NO: 1689845 - DNA, 17 bp, Homo sapiens
ttcctgataataattga

SEQ ID NO: 1689846 - DNA, 22 bp, Homo sapiens
ttcctgatagcatatgacaaat

SEQ ID NO: 1689847 - DNA, 15 bp, Homo sapiens
ttcctgatgacccag

SEQ ID NO: 1689848 - DNA, 16 bp, Homo sapiens
ttcctgatgacccagg

SEQ ID NO: 1689849 - DNA, 17 bp, Homo sapiens
ttcctgatgacccaggc

SEQ ID NO: 1689850 - DNA, 18 bp, Homo sapiens
ttcctgatgacccaggct

SEQ ID NO: 1689851 - DNA, 19 bp, Homo sapiens
ttcctgcaactcaaggact

SEQ ID NO: 1689852 - DNA, 18 bp, Homo sapiens
ttcctgcattcacccaga

SEQ ID NO: 1689853 - DNA, 18 bp, Homo sapiens
ttcctgccccaggcctga

SEQ ID NO: 1689854 - DNA, 12 bp, Homo sapiens
ttcctgcccttg

SEQ ID NO: 1689855 - DNA, 15 bp, Homo sapiens
ttcctgcctgtctcc

SEQ ID NO: 1689856 - DNA, 21 bp, Homo sapiens
ttcctgccttggcctcccaag

SEQ ID NO: 1689857 - DNA, 11 bp, Homo sapiens
ttcctgccttt

SEQ ID NO: 1689858 - DNA, 20 bp, Homo sapiens
ttcctgcggagtgaagaggg

SEQ ID NO: 1689859 - DNA, 23 bp, Homo sapiens
ttcctgcggagtgaagaggggca

SEQ ID NO: 1689860 - DNA, 17 bp, Homo sapiens
ttcctgcgtcctcctca

SEQ ID NO: 1689861 - DNA, 11 bp, Homo sapiens
ttcctgctccg

SEQ ID NO: 1689862 - DNA, 14 bp, Homo sapiens
ttcctgctgcaccc

SEQ ID NO: 1689863 - DNA, 11 bp, Homo sapiens
ttcctgctgct

SEQ ID NO: 1689864 - DNA, 15 bp, Homo sapiens
ttcctgctgctgcta

SEQ ID NO: 1689865 - DNA, 17 bp, Homo sapiens
ttcctgctgctgctact

SEQ ID NO: 1689866 - DNA, 18 bp, Homo sapiens
ttcctgctgctgctactg

SEQ ID NO: 1689867 - DNA, 10 bp, Homo sapiens
ttcctgctgt

SEQ ID NO: 1689868 - DNA, 18 bp, Homo sapiens
ttcctgctgtcctggtgg

SEQ ID NO: 1689869 - DNA, 14 bp, Homo sapiens
ttcctgcttccctg

SEQ ID NO: 1689870 - DNA, 13 bp, Homo sapiens
ttcctgcttccga

SEQ ID NO: 1689871 - DNA, 15 bp, Homo sapiens
ttcctggaagcagag

SEQ ID NO: 1689872 - DNA, 19 bp, Homo sapiens
ttcctggacactcagacct

SEQ ID NO: 1689873 - DNA, 15 bp, Homo sapiens
ttcctggacatcacc

SEQ ID NO: 1689874 - DNA, 16 bp, Homo sapiens
ttcctggagcccagag

SEQ ID NO: 1689875 - DNA, 23 bp, Homo sapiens
ttcctggattttctttctatgta

SEQ ID NO: 1689876 - DNA, 17 bp, Homo sapiens
ttcctggcccactctgt

SEQ ID NO: 1689877 - DNA, 15 bp, Homo sapiens
ttcctggccctccac

SEQ ID NO: 1689878 - DNA, 14 bp, Homo sapiens
ttcctggcctgaga

SEQ ID NO: 1689879 - DNA, 12 bp, Homo sapiens
ttcctggctcta

SEQ ID NO: 1689880 - DNA, 16 bp, Homo sapiens
ttcctggggatgtcat

SEQ ID NO: 1689881 - DNA, 15 bp, Homo sapiens
ttcctgggtcctgcc

SEQ ID NO: 1689882 - DNA, 22 bp, Homo sapiens
ttcctgggtcctgcctggtcct

SEQ ID NO: 1689883 - DNA, 17 bp, Homo sapiens
ttcctggtacccagcca

SEQ ID NO: 1689884 - DNA, 14 bp, Homo sapiens
ttcctggtccctca

SEQ ID NO: 1689885 - DNA, 20 bp, Homo sapiens
ttcctggtgccaatttcaag

SEQ ID NO: 1689886 - DNA, 15 bp, Homo sapiens
ttcctggtgctcttt

SEQ ID NO: 1689887 - DNA, 23 bp, Homo sapiens
ttcctggttctgtctagactggc

SEQ ID NO: 1689888 - DNA, 18 bp, Homo sapiens
ttcctggttgttcctgca

SEQ ID NO: 1689889 - DNA, 17 bp, Homo sapiens
ttcctggtttgactcag

SEQ ID NO: 1689890 - DNA, 16 bp, Homo sapiens
ttcctgtatgttgtcc

SEQ ID NO: 1689891 - DNA, 15 bp, Homo sapiens
ttcctgtccagctcc

SEQ ID NO: 1689892 - DNA, 11 bp, Homo sapiens
ttcctgtccca

SEQ ID NO: 1689893 - DNA, 19 bp, Homo sapiens
ttcctgtcttatcctccac

SEQ ID NO: 1689894 - DNA, 21 bp, Homo sapiens
ttcctgtctttgttgtctccc

SEQ ID NO: 1689895 - DNA, 22 bp, Homo sapiens
ttcctgtctttgttgtctccct

SEQ ID NO: 1689896 - DNA, 24 bp, Homo sapiens
ttcctgtgaagtttaattgtctca

SEQ ID NO: 1689897 - DNA, 22 bp, Homo sapiens
ttcctgtgatccacccaaccct

SEQ ID NO: 1689898 - DNA, 19 bp, Homo sapiens
ttcctgtggccaggaggtt

SEQ ID NO: 1689899 - DNA, 22 bp, Homo sapiens
ttcctgtgtacctctagaatcc

SEQ ID NO: 1689900 - DNA, 14 bp, Homo sapiens
ttcctgtgtcctga

SEQ ID NO: 1689901 - DNA, 21 bp, Homo sapiens
ttcctgtgtgtactctgtcca

SEQ ID NO: 1689902 - DNA, 21 bp, Homo sapiens
ttcctgtgtgtccaaaactgc

SEQ ID NO: 1689903 - DNA, 23 bp, Homo sapiens
ttcctgttaggtattagaaagtg

SEQ ID NO: 1689904 - DNA, 16 bp, Homo sapiens
ttcctgttcagtgaga

SEQ ID NO: 1689905 - DNA, 20 bp, Homo sapiens
ttcctgttgatgggaaaagc

SEQ ID NO: 1689906 - DNA, 19 bp, Homo sapiens
ttcctgttgctgtcttcag

SEQ ID NO: 1689907 - DNA, 19 bp, Homo sapiens
ttcctgttggatttgttta

SEQ ID NO: 1689908 - DNA, 18 bp, Homo sapiens
ttcctgtttatgcattca

SEQ ID NO: 1689909 - DNA, 21 bp, Homo sapiens
ttcctgtttcagaccccccca

SEQ ID NO: 1689910 - DNA, 23 bp, Homo sapiens
ttcctgtttttcacattttcctt

SEQ ID NO: 1689911 - DNA, 17 bp, Homo sapiens
ttccttaaactgtgtgg

SEQ ID NO: 1689912 - DNA, 15 bp, Homo sapiens
ttccttaagccagga

SEQ ID NO: 1689913 - DNA, 19 bp, Homo sapiens
ttccttagacccgccaggt

SEQ ID NO: 1689914 - DNA, 22 bp, Homo sapiens
ttccttagcttagacctcagcc

SEQ ID NO: 1689915 - DNA, 22 bp, Homo sapiens
ttccttaggtaatctataacta

SEQ ID NO: 1689916 - DNA, 19 bp, Homo sapiens
ttccttatccctctcttcc

SEQ ID NO: 1689917 - DNA, 22 bp, Homo sapiens
ttccttatgtatcagtgtcctt

SEQ ID NO: 1689918 - DNA, 13 bp, Homo sapiens
ttccttcagggtt

SEQ ID NO: 1689919 - DNA, 17 bp, Homo sapiens
ttccttcagtgaagaac

SEQ ID NO: 1689920 - DNA, 12 bp, Homo sapiens
ttccttcccacc

SEQ ID NO: 1689921 - DNA, 13 bp, Homo sapiens
ttccttcccaggc

SEQ ID NO: 1689922 - DNA, 22 bp, Homo sapiens
ttccttcccaggccctttggct

SEQ ID NO: 1689923 - DNA, 12 bp, Homo sapiens
ttccttcctaaa

SEQ ID NO: 1689924 - DNA, 17 bp, Homo sapiens
ttccttcctaaaataat

SEQ ID NO: 1689925 - DNA, 14 bp, Homo sapiens
ttccttccttccct

SEQ ID NO: 1689926 - DNA, 18 bp, Homo sapiens
ttccttcgaaaggccttc

SEQ ID NO: 1689927 - DNA, 16 bp, Homo sapiens
ttccttctcatctgtg

SEQ ID NO: 1689928 - DNA, 10 bp, Homo sapiens
ttccttctct

SEQ ID NO: 1689929 - DNA, 21 bp, Homo sapiens
ttccttctggcctctgctgaa

SEQ ID NO: 1689930 - DNA, 13 bp, Homo sapiens
ttccttgaccagc

SEQ ID NO: 1689931 - DNA, 17 bp, Homo sapiens
ttccttggactcatttt

SEQ ID NO: 1689932 - DNA, 12 bp, Homo sapiens
ttccttggaggc

SEQ ID NO: 1689933 - DNA, 18 bp, Homo sapiens
ttccttggcatgccttcc

SEQ ID NO: 1689934 - DNA, 21 bp, Homo sapiens
ttccttggcatgccttccagc

SEQ ID NO: 1689935 - DNA, 15 bp, Homo sapiens
ttccttggctttatg

SEQ ID NO: 1689936 - DNA, 15 bp, Homo sapiens
ttccttgtatttaaa

SEQ ID NO: 1689937 - DNA, 15 bp, Homo sapiens
ttccttgtcaccagc

SEQ ID NO: 1689938 - DNA, 16 bp, Homo sapiens
ttccttgtcactggta

SEQ ID NO: 1689939 - DNA, 13 bp, Homo sapiens
ttccttgtgcaaa

SEQ ID NO: 1689940 - DNA, 19 bp, Homo sapiens
ttcctttatgtgaattttt

SEQ ID NO: 1689941 - DNA, 23 bp, Homo sapiens
ttcctttcatctctctacctcca

SEQ ID NO: 1689942 - DNA, 14 bp, Homo sapiens
ttcctttcccaagc

SEQ ID NO: 1689943 - DNA, 15 bp, Homo sapiens
ttcctttctcctgcc

SEQ ID NO: 1689944 - DNA, 17 bp, Homo sapiens
ttcctttctcctgcccc

SEQ ID NO: 1689945 - DNA, 15 bp, Homo sapiens
ttcctttgaacgtgc

SEQ ID NO: 1689946 - DNA, 19 bp, Homo sapiens
ttcctttgaacgtgcttct

SEQ ID NO: 1689947 - DNA, 22 bp, Homo sapiens
ttcctttgaacttgattgccta

SEQ ID NO: 1689948 - DNA, 16 bp, Homo sapiens
ttcctttggaagaaaa

SEQ ID NO: 1689949 - DNA, 23 bp, Homo sapiens
ttccttttgaaagaatcagtctt

SEQ ID NO: 1689950 - DNA, 16 bp, Homo sapiens
ttccttttggaacatt

SEQ ID NO: 1689951 - DNA, 17 bp, Homo sapiens
ttccttttggaacattt

SEQ ID NO: 1689952 - DNA, 18 bp, Homo sapiens
ttccttttggaacatttc

SEQ ID NO: 1689953 - DNA, 16 bp, Homo sapiens
ttcctttttaaatgtg

SEQ ID NO: 1689954 - DNA, 19 bp, Homo sapiens
ttcctttttaaatgtgaat

SEQ ID NO: 1689955 - DNA, 22 bp, Homo sapiens
ttcctttttaaatgtgaatttt

SEQ ID NO: 1689956 - DNA, 14 bp, Homo sapiens
ttcctttttcagat

SEQ ID NO: 1689957 - DNA, 14 bp, Homo sapiens
ttcctttttcttcg

SEQ ID NO: 1689958 - DNA, 17 bp, Homo sapiens
ttcctttttcttcgctg

SEQ ID NO: 1689959 - DNA, 17 bp, Homo sapiens
ttcctttttgacactga

SEQ ID NO: 1689960 - DNA, 16 bp, Homo sapiens
ttccttttttcaaaat

SEQ ID NO: 1689961 - DNA, 15 bp, Homo sapiens
ttccttttttgtcta

SEQ ID NO: 1689962 - DNA, 16 bp, Homo sapiens
ttccttttttgtctat

SEQ ID NO: 1689963 - DNA, 23 bp, Homo sapiens
ttcgaatgacggtaagtgttctc

SEQ ID NO: 1689964 - DNA, 15 bp, Homo sapiens
ttcgacatatttcct

SEQ ID NO: 1689965 - DNA, 12 bp, Homo sapiens
ttcgactggtcc

SEQ ID NO: 1689966 - DNA, 16 bp, Homo sapiens
ttcgactggtccagct

SEQ ID NO: 1689967 - DNA, 20 bp, Homo sapiens
ttcgactggtccagctctga

SEQ ID NO: 1689968 - DNA, 17 bp, Homo sapiens
ttcgagaccagcctggc

SEQ ID NO: 1689969 - DNA, 20 bp, Homo sapiens
ttcgagacccaaacccccaa

SEQ ID NO: 1689970 - DNA, 12 bp, Homo sapiens
ttcgaggcctga

SEQ ID NO: 1689971 - DNA, 19 bp, Homo sapiens
ttcgatgcctgcatgctga

SEQ ID NO: 1689972 - DNA, 21 bp, Homo sapiens
ttcgccttaatacttttttat

SEQ ID NO: 1689973 - DNA, 14 bp, Homo sapiens
ttcgcctttgtctt

SEQ ID NO: 1689974 - DNA, 20 bp, Homo sapiens
ttcgctatgggaggcagccg

SEQ ID NO: 1689975 - DNA, 19 bp, Homo sapiens
ttcgctgctctagctggca

SEQ ID NO: 1689976 - DNA, 16 bp, Homo sapiens
ttcgctggactattgt

SEQ ID NO: 1689977 - DNA, 17 bp, Homo sapiens
ttcggagcgttctctgt

SEQ ID NO: 1689978 - DNA, 21 bp, Homo sapiens
ttcggccttggtgaacacaca

SEQ ID NO: 1689979 - DNA, 16 bp, Homo sapiens
ttcggcctttgggtgt

SEQ ID NO: 1689980 - DNA, 17 bp, Homo sapiens
ttcgggaccaatatata

SEQ ID NO: 1689981 - DNA, 14 bp, Homo sapiens
ttcgggctgtgccc

SEQ ID NO: 1689982 - DNA, 18 bp, Homo sapiens
ttcgtctgtcccagagct

SEQ ID NO: 1689983 - DNA, 17 bp, Homo sapiens
ttcgtgaagtatactgt

SEQ ID NO: 1689984 - DNA, 16 bp, Homo sapiens
ttcgtgcactctgcta

SEQ ID NO: 1689985 - DNA, 15 bp, Homo sapiens
ttcgtttattttcaa

SEQ ID NO: 1689986 - DNA, 16 bp, Homo sapiens
ttcgtttccatcatgt

SEQ ID NO: 1689987 - DNA, 13 bp, Homo sapiens
ttctaaaaaacag

SEQ ID NO: 1689988 - DNA, 12 bp, Homo sapiens
ttctaaaacaat

SEQ ID NO: 1689989 - DNA, 17 bp, Homo sapiens
ttctaaaactgcctttc

SEQ ID NO: 1689990 - DNA, 17 bp, Homo sapiens
ttctaaaagctttcatg

SEQ ID NO: 1689991 - DNA, 22 bp, Homo sapiens
ttctaaaagtttgaggaatatt

SEQ ID NO: 1689992 - DNA, 20 bp, Homo sapiens
ttctaaaatcttatagttct

SEQ ID NO: 1689993 - DNA, 19 bp, Homo sapiens
ttctaaaatgtgatgttct

SEQ ID NO: 1689994 - DNA, 20 bp, Homo sapiens
ttctaaaatgtgatgttcta

SEQ ID NO: 1689995 - DNA, 15 bp, Homo sapiens
ttctaaactgttttc

SEQ ID NO: 1689996 - DNA, 15 bp, Homo sapiens
ttctaaagatggaaa

SEQ ID NO: 1689997 - DNA, 20 bp, Homo sapiens
ttctaaagccaagaagaatt

SEQ ID NO: 1689998 - DNA, 13 bp, Homo sapiens
ttctaaagctcaa

SEQ ID NO: 1689999 - DNA, 15 bp, Homo sapiens
ttctaaagctctgac

SEQ ID NO: 1690000 - DNA, 13 bp, Homo sapiens
ttctaaaggtcca

SEQ ID NO: 1690001 - DNA, 20 bp, Homo sapiens
ttctaaagttctaagattct

SEQ ID NO: 1690002 - DNA, 23 bp, Homo sapiens
ttctaaatacatgccacatcaaa

SEQ ID NO: 1690003 - DNA, 21 bp, Homo sapiens
ttctaaatgaatgtttacact

SEQ ID NO: 1690004 - DNA, 18 bp, Homo sapiens
ttctaaatgttattactt

SEQ ID NO: 1690005 - DNA, 19 bp, Homo sapiens
ttctaacaaaaaaatatat

SEQ ID NO: 1690006 - DNA, 16 bp, Homo sapiens
ttctaacattaaatca

SEQ ID NO: 1690007 - DNA, 18 bp, Homo sapiens
ttctaaccccctctgctc

SEQ ID NO: 1690008 - DNA, 18 bp, Homo sapiens
ttctaagaaaagcatttt

SEQ ID NO: 1690009 - DNA, 14 bp, Homo sapiens
ttctaagaaaatgt

SEQ ID NO: 1690010 - DNA, 22 bp, Homo sapiens
ttctaagaaaatgtagttagct

SEQ ID NO: 1690011 - DNA, 13 bp, Homo sapiens
ttctaagaagaca

SEQ ID NO: 1690012 - DNA, 15 bp, Homo sapiens
ttctaagaagacatt

SEQ ID NO: 1690013 - DNA, 16 bp, Homo sapiens
ttctaagaagacattt

SEQ ID NO: 1690014 - DNA, 21 bp, Homo sapiens
ttctaagactcaaatgttcta

SEQ ID NO: 1690015 - DNA, 22 bp, Homo sapiens
ttctaagactcaaatgttctaa

SEQ ID NO: 1690016 - DNA, 12 bp, Homo sapiens
ttctaagatgtg

SEQ ID NO: 1690017 - DNA, 19 bp, Homo sapiens
ttctaagatgtgatattct

SEQ ID NO: 1690018 - DNA, 20 bp, Homo sapiens
ttctaagatgtgatattcta

SEQ ID NO: 1690019 - DNA, 22 bp, Homo sapiens
ttctaagatgtgatattctaag

SEQ ID NO: 1690020 - DNA, 12 bp, Homo sapiens
ttctaagattct

SEQ ID NO: 1690021 - DNA, 13 bp, Homo sapiens
ttctaagattcta

SEQ ID NO: 1690022 - DNA, 15 bp, Homo sapiens
ttctaagattctaaa

SEQ ID NO: 1690023 - DNA, 17 bp, Homo sapiens
ttctaagattctaaagg

SEQ ID NO: 1690024 - DNA, 21 bp, Homo sapiens
ttctaagccctgttctcctgt

SEQ ID NO: 1690025 - DNA, 21 bp, Homo sapiens
ttctaagcgcctattgtttgt

SEQ ID NO: 1690026 - DNA, 17 bp, Homo sapiens
ttctaagcttatttcta

SEQ ID NO: 1690027 - DNA, 23 bp, Homo sapiens
ttctaaggaaatggagaagctct

SEQ ID NO: 1690028 - DNA, 21 bp, Homo sapiens
ttctaaggacctgaaattcca

SEQ ID NO: 1690029 - DNA, 21 bp, Homo sapiens
ttctaaggcctaggattctaa

SEQ ID NO: 1690030 - DNA, 22 bp, Homo sapiens
ttctaaggcctaggattctaaa

SEQ ID NO: 1690031 - DNA, 13 bp, Homo sapiens
ttctaaggctctg

SEQ ID NO: 1690032 - DNA, 18 bp, Homo sapiens
ttctaaggctctgagagt

SEQ ID NO: 1690033 - DNA, 20 bp, Homo sapiens
ttctaaggtccggtgttcta

SEQ ID NO: 1690034 - DNA, 15 bp, Homo sapiens
ttctaagtaaaacca

SEQ ID NO: 1690035 - DNA, 21 bp, Homo sapiens
ttctaagtaaaaccacagcag

SEQ ID NO: 1690036 - DNA, 23 bp, Homo sapiens
ttctaagtcaaacacttgtgact

SEQ ID NO: 1690037 - DNA, 14 bp, Homo sapiens
ttctaagtgggaga

SEQ ID NO: 1690038 - DNA, 14 bp, Homo sapiens
ttctaagtttctaa

SEQ ID NO: 1690039 - DNA, 16 bp, Homo sapiens
ttctaagtttctaaga

SEQ ID NO: 1690040 - DNA, 16 bp, Homo sapiens
ttctaataaatatact

SEQ ID NO: 1690041 - DNA, 16 bp, Homo sapiens
ttctaataatttctaa

SEQ ID NO: 1690042 - DNA, 19 bp, Homo sapiens
ttctaatacgagccttctc

SEQ ID NO: 1690043 - DNA, 14 bp, Homo sapiens
ttctaatagaactc

SEQ ID NO: 1690044 - DNA, 15 bp, Homo sapiens
ttctaatcacagtgt

SEQ ID NO: 1690045 - DNA, 21 bp, Homo sapiens
ttctaatcccagcactttggt

SEQ ID NO: 1690046 - DNA, 18 bp, Homo sapiens
ttctacaaaaaaccagga

SEQ ID NO: 1690047 - DNA, 12 bp, Homo sapiens
ttctacaattaa

SEQ ID NO: 1690048 - DNA, 22 bp, Homo sapiens
ttctacacagtaaaaacttgta

SEQ ID NO: 1690049 - DNA, 15 bp, Homo sapiens
ttctacatactatgg

SEQ ID NO: 1690050 - DNA, 15 bp, Homo sapiens
ttctacatagatgct

SEQ ID NO: 1690051 - DNA, 17 bp, Homo sapiens
ttctacatttcttagac

SEQ ID NO: 1690052 - DNA, 14 bp, Homo sapiens
ttctaccatttcag

SEQ ID NO: 1690053 - DNA, 15 bp, Homo sapiens
ttctaccatttcaga

SEQ ID NO: 1690054 - DNA, 21 bp, Homo sapiens
ttctaccctagccattcctgg

SEQ ID NO: 1690055 - DNA, 18 bp, Homo sapiens
ttctaccggagagagaat

SEQ ID NO: 1690056 - DNA, 14 bp, Homo sapiens
ttctacggatcatc

SEQ ID NO: 1690057 - DNA, 13 bp, Homo sapiens
ttctactcccctt

SEQ ID NO: 1690058 - DNA, 12 bp, Homo sapiens
ttctactggaaa

SEQ ID NO: 1690059 - DNA, 17 bp, Homo sapiens
ttctactggcctgtaat

SEQ ID NO: 1690060 - DNA, 22 bp, Homo sapiens
ttctagaaagagaaacagttgg

SEQ ID NO: 1690061 - DNA, 12 bp, Homo sapiens
ttctagacagag

SEQ ID NO: 1690062 - DNA, 15 bp, Homo sapiens
ttctagacgcccctc

SEQ ID NO: 1690063 - DNA, 14 bp, Homo sapiens
ttctagagccagca

SEQ ID NO: 1690064 - DNA, 15 bp, Homo sapiens
ttctagaggcctcag

SEQ ID NO: 1690065 - DNA, 16 bp, Homo sapiens
ttctagatcagatgct

SEQ ID NO: 1690066 - DNA, 22 bp, Homo sapiens
ttctagatcagatgctccaaga

SEQ ID NO: 1690067 - DNA, 23 bp, Homo sapiens
ttctagatcagatgctccaagat

SEQ ID NO: 1690068 - DNA, 24 bp, Homo sapiens
ttctagatcagatgctccaagatt

SEQ ID NO: 1690069 - DNA, 15 bp, Homo sapiens
ttctagatcctgcac

SEQ ID NO: 1690070 - DNA, 14 bp, Homo sapiens
ttctagatgacata

SEQ ID NO: 1690071 - DNA, 22 bp, Homo sapiens
ttctagatgattaaataagatt

SEQ ID NO: 1690072 - DNA, 15 bp, Homo sapiens
ttctagattatgtct

SEQ ID NO: 1690073 - DNA, 14 bp, Homo sapiens
ttctagattcactg

SEQ ID NO: 1690074 - DNA, 18 bp, Homo sapiens
ttctagcaagatagtctt

SEQ ID NO: 1690075 - DNA, 19 bp, Homo sapiens
ttctagcaagatagtcttc

SEQ ID NO: 1690076 - DNA, 21 bp, Homo sapiens
ttctagcatggcatatttttc

SEQ ID NO: 1690077 - DNA, 17 bp, Homo sapiens
ttctagctaatgtaata

SEQ ID NO: 1690078 - DNA, 17 bp, Homo sapiens
ttctagctagaaatatg

SEQ ID NO: 1690079 - DNA, 22 bp, Homo sapiens
ttctagctagaaatatgatttt

SEQ ID NO: 1690080 - DNA, 17 bp, Homo sapiens
ttctagcttagtgctat

SEQ ID NO: 1690081 - DNA, 21 bp, Homo sapiens
ttctagcttagtgctatgtgt

SEQ ID NO: 1690082 - DNA, 16 bp, Homo sapiens
ttctaggcatctctgt

SEQ ID NO: 1690083 - DNA, 17 bp, Homo sapiens
ttctaggtaggaagagc

SEQ ID NO: 1690084 - DNA, 14 bp, Homo sapiens
ttctagtattttat

SEQ ID NO: 1690085 - DNA, 16 bp, Homo sapiens
ttctagtcaactgctg

SEQ ID NO: 1690086 - DNA, 18 bp, Homo sapiens
ttctagtcaactgctgtt

SEQ ID NO: 1690087 - DNA, 21 bp, Homo sapiens
ttctagtcaactgctgtttta

SEQ ID NO: 1690088 - DNA, 15 bp, Homo sapiens
ttctagtctctgatt

SEQ ID NO: 1690089 - DNA, 23 bp, Homo sapiens
ttctagtgatgatggttcacgtt

SEQ ID NO: 1690090 - DNA, 15 bp, Homo sapiens
ttctagtttgcattc

SEQ ID NO: 1690091 - DNA, 17 bp, Homo sapiens
ttctataaatagatgct

SEQ ID NO: 1690092 - DNA, 12 bp, Homo sapiens
ttctatactgtt

SEQ ID NO: 1690093 - DNA, 19 bp, Homo sapiens
ttctatactgtttgtaata

SEQ ID NO: 1690094 - DNA, 23 bp, Homo sapiens
ttctatagcagattgtgtaacaa

SEQ ID NO: 1690095 - DNA, 14 bp, Homo sapiens
ttctatagttctag

SEQ ID NO: 1690096 - DNA, 23 bp, Homo sapiens
ttctatatagttccttgccttaa

SEQ ID NO: 1690097 - DNA, 12 bp, Homo sapiens
ttctatatcaaa

SEQ ID NO: 1690098 - DNA, 23 bp, Homo sapiens
ttctatatgaatttaaatataat

SEQ ID NO: 1690099 - DNA, 16 bp, Homo sapiens
ttctatatttcatatt

SEQ ID NO: 1690100 - DNA, 17 bp, Homo sapiens
ttctatattttaataga

SEQ ID NO: 1690101 - DNA, 18 bp, Homo sapiens
ttctatcagaagttgtat

SEQ ID NO: 1690102 - DNA, 20 bp, Homo sapiens
ttctatcattccaattctaa

SEQ ID NO: 1690103 - DNA, 22 bp, Homo sapiens
ttctatcattccaattctaaat

SEQ ID NO: 1690104 - DNA, 16 bp, Homo sapiens
ttctatccccaagctg

SEQ ID NO: 1690105 - DNA, 20 bp, Homo sapiens
ttctatccccaagctggcca

SEQ ID NO: 1690106 - DNA, 13 bp, Homo sapiens
ttctatgagaaaa

SEQ ID NO: 1690107 - DNA, 18 bp, Homo sapiens
ttctatgcaagccttgct

SEQ ID NO: 1690108 - DNA, 20 bp, Homo sapiens
ttctatgctaaactgtgaaa

SEQ ID NO: 1690109 - DNA, 16 bp, Homo sapiens
ttctatgctgcttcca

SEQ ID NO: 1690110 - DNA, 18 bp, Homo sapiens
ttctatgtaaaaatcact

SEQ ID NO: 1690111 - DNA, 14 bp, Homo sapiens
ttctatgtatgtta

SEQ ID NO: 1690112 - DNA, 22 bp, Homo sapiens
ttctatgtgacaattttgtaca

SEQ ID NO: 1690113 - DNA, 17 bp, Homo sapiens
ttctattaatcaagaga

SEQ ID NO: 1690114 - DNA, 16 bp, Homo sapiens
ttctattgaaaacagt

SEQ ID NO: 1690115 - DNA, 16 bp, Homo sapiens
ttctattgtgtggatg

SEQ ID NO: 1690116 - DNA, 13 bp, Homo sapiens
ttctatttaatgg

SEQ ID NO: 1690117 - DNA, 14 bp, Homo sapiens
ttctatttaatgga

SEQ ID NO: 1690118 - DNA, 13 bp, Homo sapiens
ttctatttataat

SEQ ID NO: 1690119 - DNA, 13 bp, Homo sapiens
ttctatttctatc

SEQ ID NO: 1690120 - DNA, 17 bp, Homo sapiens
ttctatttgctgggctt

SEQ ID NO: 1690121 - DNA, 18 bp, Homo sapiens
ttctatttgctgggcttt

SEQ ID NO: 1690122 - DNA, 14 bp, Homo sapiens
ttctatttttatca

SEQ ID NO: 1690123 - DNA, 24 bp, Homo sapiens
ttctcaaaagaggttactttagtt

SEQ ID NO: 1690124 - DNA, 18 bp, Homo sapiens
ttctcaaagatctgaatt

SEQ ID NO: 1690125 - DNA, 18 bp, Homo sapiens
ttctcaaaggccctcagt

SEQ ID NO: 1690126 - DNA, 19 bp, Homo sapiens
ttctcaaaggccctcagtg

SEQ ID NO: 1690127 - DNA, 20 bp, Homo sapiens
ttctcaagacctgagtattt

SEQ ID NO: 1690128 - DNA, 14 bp, Homo sapiens
ttctcaagtccctt

SEQ ID NO: 1690129 - DNA, 20 bp, Homo sapiens
ttctcaagttctaagattct

SEQ ID NO: 1690130 - DNA, 22 bp, Homo sapiens
ttctcaagttctaagattctaa

SEQ ID NO: 1690131 - DNA, 23 bp, Homo sapiens
ttctcaagttctaagattctaat

SEQ ID NO: 1690132 - DNA, 12 bp, Homo sapiens
ttctcacaaaaa

SEQ ID NO: 1690133 - DNA, 22 bp, Homo sapiens
ttctcacaccaacagtgtgaag

SEQ ID NO: 1690134 - DNA, 15 bp, Homo sapiens
ttctcacacccaccg

SEQ ID NO: 1690135 - DNA, 19 bp, Homo sapiens
ttctcacagtgggagccag

SEQ ID NO: 1690136 - DNA, 13 bp, Homo sapiens
ttctcacattgct

SEQ ID NO: 1690137 - DNA, 16 bp, Homo sapiens
ttctcactcctacctg

SEQ ID NO: 1690138 - DNA, 16 bp, Homo sapiens
ttctcagaacagctga

SEQ ID NO: 1690139 - DNA, 17 bp, Homo sapiens
ttctcagaacagctgaa

SEQ ID NO: 1690140 - DNA, 17 bp, Homo sapiens
ttctcagaataactacc

SEQ ID NO: 1690141 - DNA, 23 bp, Homo sapiens
ttctcagaatctcaaataactaa

SEQ ID NO: 1690142 - DNA, 19 bp, Homo sapiens
ttctcagatccttgtttca

SEQ ID NO: 1690143 - DNA, 14 bp, Homo sapiens
ttctcagatcttga

SEQ ID NO: 1690144 - DNA, 18 bp, Homo sapiens
ttctcaggaagagctatg

SEQ ID NO: 1690145 - DNA, 23 bp, Homo sapiens
ttctcaggtaggaagcaacagct

SEQ ID NO: 1690146 - DNA, 19 bp, Homo sapiens
ttctcaggtgttgccaaat

SEQ ID NO: 1690147 - DNA, 17 bp, Homo sapiens
ttctcataaaactgtga

SEQ ID NO: 1690148 - DNA, 22 bp, Homo sapiens
ttctcataggaaaagtacattt

SEQ ID NO: 1690149 - DNA, 16 bp, Homo sapiens
ttctcatcatattgta

SEQ ID NO: 1690150 - DNA, 15 bp, Homo sapiens
ttctcatctttcttg

SEQ ID NO: 1690151 - DNA, 20 bp, Homo sapiens
ttctcatttggtctgccaga

SEQ ID NO: 1690152 - DNA, 21 bp, Homo sapiens
ttctcatttggtctgccagaa

SEQ ID NO: 1690153 - DNA, 14 bp, Homo sapiens
ttctccaaatgaga

SEQ ID NO: 1690154 - DNA, 22 bp, Homo sapiens
ttctccaacatcacagcccagc

SEQ ID NO: 1690155 - DNA, 19 bp, Homo sapiens
ttctccaatatcagtgctc

SEQ ID NO: 1690156 - DNA, 21 bp, Homo sapiens
ttctccaatatcagtgctcga

SEQ ID NO: 1690157 - DNA, 12 bp, Homo sapiens
ttctccacactc

SEQ ID NO: 1690158 - DNA, 14 bp, Homo sapiens
ttctccactcagtt

SEQ ID NO: 1690159 - DNA, 17 bp, Homo sapiens
ttctccactcagttgca

SEQ ID NO: 1690160 - DNA, 12 bp, Homo sapiens
ttctccactgga

SEQ ID NO: 1690161 - DNA, 14 bp, Homo sapiens
ttctccactgtgca

SEQ ID NO: 1690162 - DNA, 18 bp, Homo sapiens
ttctccactgtgcacacc

SEQ ID NO: 1690163 - DNA, 13 bp, Homo sapiens
ttctccagttgat

SEQ ID NO: 1690164 - DNA, 19 bp, Homo sapiens
ttctcccaggtaccagctg

SEQ ID NO: 1690165 - DNA, 20 bp, Homo sapiens
ttctcccaggtaccagctgc

SEQ ID NO: 1690166 - DNA, 14 bp, Homo sapiens
ttctcccagtgtga

SEQ ID NO: 1690167 - DNA, 22 bp, Homo sapiens
ttctccccgcagcccgcctgcc

SEQ ID NO: 1690168 - DNA, 15 bp, Homo sapiens
ttctcccctgcactg

SEQ ID NO: 1690169 - DNA, 16 bp, Homo sapiens
ttctcccctgcactgt

SEQ ID NO: 1690170 - DNA, 19 bp, Homo sapiens
ttctcccctgcccccagga

SEQ ID NO: 1690171 - DNA, 22 bp, Homo sapiens
ttctcccctgcccccaggactg

SEQ ID NO: 1690172 - DNA, 23 bp, Homo sapiens
ttctcccctgcccccaggactgg

SEQ ID NO: 1690173 - DNA, 14 bp, Homo sapiens
ttctcccgcctcag

SEQ ID NO: 1690174 - DNA, 17 bp, Homo sapiens
ttctcccgcctcagcct

SEQ ID NO: 1690175 - DNA, 13 bp, Homo sapiens
ttctcccgcttcc

SEQ ID NO: 1690176 - DNA, 19 bp, Homo sapiens
ttctcccgcttcctggcct

SEQ ID NO: 1690177 - DNA, 22 bp, Homo sapiens
ttctcccgcttcctggcctccc

SEQ ID NO: 1690178 - DNA, 22 bp, Homo sapiens
ttctcccgggggcagggtgggg

SEQ ID NO: 1690179 - DNA, 21 bp, Homo sapiens
ttctccctcacccccaggtgt

SEQ ID NO: 1690180 - DNA, 13 bp, Homo sapiens
ttctccgccagcc

SEQ ID NO: 1690181 - DNA, 17 bp, Homo sapiens
ttctccgccagcctcct

SEQ ID NO: 1690182 - DNA, 20 bp, Homo sapiens
ttctccgccagcctcctctg

SEQ ID NO: 1690183 - DNA, 17 bp, Homo sapiens
ttctccggggtctgtgc

SEQ ID NO: 1690184 - DNA, 17 bp, Homo sapiens
ttctccgttagctcctg

SEQ ID NO: 1690185 - DNA, 18 bp, Homo sapiens
ttctccgttagctcctgt

SEQ ID NO: 1690186 - DNA, 22 bp, Homo sapiens
ttctccgttagctcctgtggcc

SEQ ID NO: 1690187 - DNA, 13 bp, Homo sapiens
ttctcctgaatat

SEQ ID NO: 1690188 - DNA, 18 bp, Homo sapiens
ttctcctgacccagtccc

SEQ ID NO: 1690189 - DNA, 20 bp, Homo sapiens
ttctcctgatgttttgccgt

SEQ ID NO: 1690190 - DNA, 21 bp, Homo sapiens
ttctcctgatgttttgccgtg

SEQ ID NO: 1690191 - DNA, 12 bp, Homo sapiens
ttctcctgtctc

SEQ ID NO: 1690192 - DNA, 22 bp, Homo sapiens
ttctcctgtctcagcctcctga

SEQ ID NO: 1690193 - DNA, 22 bp, Homo sapiens
ttctccttagttggctggaaac

SEQ ID NO: 1690194 - DNA, 22 bp, Homo sapiens
ttctccttcattaatgatgatc

SEQ ID NO: 1690195 - DNA, 17 bp, Homo sapiens
ttctcctttcacaacct

SEQ ID NO: 1690196 - DNA, 18 bp, Homo sapiens
ttctcctttcacaacctt

SEQ ID NO: 1690197 - DNA, 22 bp, Homo sapiens
ttctcctttcacaaccttctgt

SEQ ID NO: 1690198 - DNA, 18 bp, Homo sapiens
ttctcctttccttcccag

SEQ ID NO: 1690199 - DNA, 12 bp, Homo sapiens
ttctccttttcc

SEQ ID NO: 1690200 - DNA, 18 bp, Homo sapiens
ttctcgcgccctccccca

SEQ ID NO: 1690201 - DNA, 14 bp, Homo sapiens
ttctcggagctggc

SEQ ID NO: 1690202 - DNA, 18 bp, Homo sapiens
ttctcggagctggcccag

SEQ ID NO: 1690203 - DNA, 19 bp, Homo sapiens
ttctcggagctggcccagg

SEQ ID NO: 1690204 - DNA, 14 bp, Homo sapiens
ttctctaaccctat

SEQ ID NO: 1690205 - DNA, 16 bp, Homo sapiens
ttctctacccatctcc

SEQ ID NO: 1690206 - DNA, 17 bp, Homo sapiens
ttctctacccatctccc

SEQ ID NO: 1690207 - DNA, 20 bp, Homo sapiens
ttctctatgacatgaaatga

SEQ ID NO: 1690208 - DNA, 13 bp, Homo sapiens
ttctctcagctcc

SEQ ID NO: 1690209 - DNA, 14 bp, Homo sapiens
ttctctcagctccc

SEQ ID NO: 1690210 - DNA, 12 bp, Homo sapiens
ttctctcatctc

SEQ ID NO: 1690211 - DNA, 17 bp, Homo sapiens
ttctctcatctcttagc

SEQ ID NO: 1690212 - DNA, 20 bp, Homo sapiens
ttctctcatctcttagctcc

SEQ ID NO: 1690213 - DNA, 16 bp, Homo sapiens
ttctctccacagtgtt

SEQ ID NO: 1690214 - DNA, 18 bp, Homo sapiens
ttctctccaccttagtac

SEQ ID NO: 1690215 - DNA, 21 bp, Homo sapiens
ttctctccaccttagtacttt

SEQ ID NO: 1690216 - DNA, 19 bp, Homo sapiens
ttctctccagctgactaaa

SEQ ID NO: 1690217 - DNA, 15 bp, Homo sapiens
ttctctctccacccc

SEQ ID NO: 1690218 - DNA, 19 bp, Homo sapiens
ttctctctccagggtgctt

SEQ ID NO: 1690219 - DNA, 14 bp, Homo sapiens
ttctctctctctca

SEQ ID NO: 1690220 - DNA, 20 bp, Homo sapiens
ttctctctctctctctcgct

SEQ ID NO: 1690221 - DNA, 21 bp, Homo sapiens
ttctctctggcttctctcttt

SEQ ID NO: 1690222 - DNA, 17 bp, Homo sapiens
ttctctctttatacagc

SEQ ID NO: 1690223 - DNA, 17 bp, Homo sapiens
ttctctgacttctgcct

SEQ ID NO: 1690224 - DNA, 10 bp, Homo sapiens
ttctctgcca

SEQ ID NO: 1690225 - DNA, 13 bp, Homo sapiens
ttctctgcccagc

SEQ ID NO: 1690226 - DNA, 14 bp, Homo sapiens
ttctctgcccagcc

SEQ ID NO: 1690227 - DNA, 19 bp, Homo sapiens
ttctctgcccagccgggca

SEQ ID NO: 1690228 - DNA, 22 bp, Homo sapiens
ttctctgccgctacctccctcc

SEQ ID NO: 1690229 - DNA, 23 bp, Homo sapiens
ttctctgccgctacctccctccc

SEQ ID NO: 1690230 - DNA, 20 bp, Homo sapiens
ttctctgggagaaaatcatc

SEQ ID NO: 1690231 - DNA, 12 bp, Homo sapiens
ttctctgggctt

SEQ ID NO: 1690232 - DNA, 23 bp, Homo sapiens
ttctctgggtctgattttctcac

SEQ ID NO: 1690233 - DNA, 15 bp, Homo sapiens
ttctctggtctcctt

SEQ ID NO: 1690234 - DNA, 17 bp, Homo sapiens
ttctctggtctccttga

SEQ ID NO: 1690235 - DNA, 14 bp, Homo sapiens
ttctctgtatagta

SEQ ID NO: 1690236 - DNA, 14 bp, Homo sapiens
ttctctgtcctact

SEQ ID NO: 1690237 - DNA, 20 bp, Homo sapiens
ttctctgtgaacgatttaga

SEQ ID NO: 1690238 - DNA, 18 bp, Homo sapiens
ttctctgtgtctaagatt

SEQ ID NO: 1690239 - DNA, 20 bp, Homo sapiens
ttctctgtgtctaagattct

SEQ ID NO: 1690240 - DNA, 21 bp, Homo sapiens
ttctctgtgtctaagattcta

SEQ ID NO: 1690241 - DNA, 22 bp, Homo sapiens
ttctctgtgtctaagattctag

SEQ ID NO: 1690242 - DNA, 23 bp, Homo sapiens
ttctctgtgtctaagattctaga

SEQ ID NO: 1690243 - DNA, 14 bp, Homo sapiens
ttctctgtgtgcac

SEQ ID NO: 1690244 - DNA, 13 bp, Homo sapiens
ttctcttacctgt

SEQ ID NO: 1690245 - DNA, 12 bp, Homo sapiens
ttctcttagaaa

SEQ ID NO: 1690246 - DNA, 18 bp, Homo sapiens
ttctcttagcaactcaga

SEQ ID NO: 1690247 - DNA, 19 bp, Homo sapiens
ttctcttcatattcagctt

SEQ ID NO: 1690248 - DNA, 22 bp, Homo sapiens
ttctcttccaaccatttatctt

SEQ ID NO: 1690249 - DNA, 13 bp, Homo sapiens
ttctcttccctga

SEQ ID NO: 1690250 - DNA, 16 bp, Homo sapiens
ttctcttcccttccca

SEQ ID NO: 1690251 - DNA, 21 bp, Homo sapiens
ttctcttgaaaagttcaggga

SEQ ID NO: 1690252 - DNA, 15 bp, Homo sapiens
ttctcttgaataaag

SEQ ID NO: 1690253 - DNA, 15 bp, Homo sapiens
ttctcttgagctggc

SEQ ID NO: 1690254 - DNA, 20 bp, Homo sapiens
ttctcttgagctggcctctc

SEQ ID NO: 1690255 - DNA, 22 bp, Homo sapiens
ttctcttgagctggcctctcta

SEQ ID NO: 1690256 - DNA, 15 bp, Homo sapiens
ttctcttgtaccata

SEQ ID NO: 1690257 - DNA, 17 bp, Homo sapiens
ttctctttaccttctaa

SEQ ID NO: 1690258 - DNA, 14 bp, Homo sapiens
ttctctttctctcc

SEQ ID NO: 1690259 - DNA, 16 bp, Homo sapiens
ttctctttgataacaa

SEQ ID NO: 1690260 - DNA, 19 bp, Homo sapiens
ttctctttgataacaaaaa

SEQ ID NO: 1690261 - DNA, 20 bp, Homo sapiens
ttctctttggaaatagcatg

SEQ ID NO: 1690262 - DNA, 14 bp, Homo sapiens
ttctcttttgaaag

SEQ ID NO: 1690263 - DNA, 16 bp, Homo sapiens
ttctcttttttcagag

SEQ ID NO: 1690264 - DNA, 18 bp, Homo sapiens
ttctgaaacacacgagca

SEQ ID NO: 1690265 - DNA, 13 bp, Homo sapiens
ttctgaaacctta

SEQ ID NO: 1690266 - DNA, 19 bp, Homo sapiens
ttctgaaagagtctttctt

SEQ ID NO: 1690267 - DNA, 18 bp, Homo sapiens
ttctgaactcaaactgag

SEQ ID NO: 1690268 - DNA, 19 bp, Homo sapiens
ttctgaactcaagctgcgt

SEQ ID NO: 1690269 - DNA, 15 bp, Homo sapiens
ttctgaactctgaca

SEQ ID NO: 1690270 - DNA, 14 bp, Homo sapiens
ttctgaactgttac

SEQ ID NO: 1690271 - DNA, 16 bp, Homo sapiens
ttctgaataatttctt

SEQ ID NO: 1690272 - DNA, 13 bp, Homo sapiens
ttctgaattcata

SEQ ID NO: 1690273 - DNA, 20 bp, Homo sapiens
ttctgacaaaggtggtaaat

SEQ ID NO: 1690274 - DNA, 21 bp, Homo sapiens
ttctgacagtttttctgtttt

SEQ ID NO: 1690275 - DNA, 14 bp, Homo sapiens
ttctgaccatttca

SEQ ID NO: 1690276 - DNA, 18 bp, Homo sapiens
ttctgaccctgcttcaaa

SEQ ID NO: 1690277 - DNA, 21 bp, Homo sapiens
ttctgacctgttgccagcaga

SEQ ID NO: 1690278 - DNA, 20 bp, Homo sapiens
ttctgacgtgccttttgcac

SEQ ID NO: 1690279 - DNA, 19 bp, Homo sapiens
ttctgactcggtttctcca

SEQ ID NO: 1690280 - DNA, 13 bp, Homo sapiens
ttctgactgtcca

SEQ ID NO: 1690281 - DNA, 21 bp, Homo sapiens
ttctgagaaaacaagcaagtt

SEQ ID NO: 1690282 - DNA, 13 bp, Homo sapiens
ttctgagaccaaa

SEQ ID NO: 1690283 - DNA, 22 bp, Homo sapiens
ttctgagagttggctcaggcag

SEQ ID NO: 1690284 - DNA, 15 bp, Homo sapiens
ttctgagcattcgct

SEQ ID NO: 1690285 - DNA, 19 bp, Homo sapiens
ttctgagcccgggctgcct

SEQ ID NO: 1690286 - DNA, 21 bp, Homo sapiens
ttctgagcccgggctgcctgg

SEQ ID NO: 1690287 - DNA, 16 bp, Homo sapiens
ttctgagctatttcat

SEQ ID NO: 1690288 - DNA, 17 bp, Homo sapiens
ttctgagctccacctct

SEQ ID NO: 1690289 - DNA, 15 bp, Homo sapiens
ttctgaggtccttat

SEQ ID NO: 1690290 - DNA, 22 bp, Homo sapiens
ttctgatatgcagttttcctta

SEQ ID NO: 1690291 - DNA, 22 bp, Homo sapiens
ttctgatcttggaaaaacagcg

SEQ ID NO: 1690292 - DNA, 13 bp, Homo sapiens
ttctgatgtttct

SEQ ID NO: 1690293 - DNA, 15 bp, Homo sapiens
ttctgatgtttctgt

SEQ ID NO: 1690294 - DNA, 13 bp, Homo sapiens
ttctgattagagt

SEQ ID NO: 1690295 - DNA, 23 bp, Homo sapiens
ttctgattctggctttaagcctt

SEQ ID NO: 1690296 - DNA, 17 bp, Homo sapiens
ttctgattggtgattca

SEQ ID NO: 1690297 - DNA, 14 bp, Homo sapiens
ttctgatttcagtt

SEQ ID NO: 1690298 - DNA, 23 bp, Homo sapiens
ttctgattttaggagctaaggct

SEQ ID NO: 1690299 - DNA, 15 bp, Homo sapiens
ttctgatttttctct

SEQ ID NO: 1690300 - DNA, 15 bp, Homo sapiens
ttctgcaactagcca

SEQ ID NO: 1690301 - DNA, 19 bp, Homo sapiens
ttctgcaactagccaaggc

SEQ ID NO: 1690302 - DNA, 21 bp, Homo sapiens
ttctgcaagcacatctgcatt

SEQ ID NO: 1690303 - DNA, 18 bp, Homo sapiens
ttctgcaagcctcatgcc

SEQ ID NO: 1690304 - DNA, 12 bp, Homo sapiens
ttctgcaccctc

SEQ ID NO: 1690305 - DNA, 13 bp, Homo sapiens
ttctgcactgaaa

SEQ ID NO: 1690306 - DNA, 23 bp, Homo sapiens
ttctgcagagtttccaaaaccag

SEQ ID NO: 1690307 - DNA, 22 bp, Homo sapiens
ttctgcagcatgacctgtgacc

SEQ ID NO: 1690308 - DNA, 14 bp, Homo sapiens
ttctgccacataaa

SEQ ID NO: 1690309 - DNA, 15 bp, Homo sapiens
ttctgccagggagct

SEQ ID NO: 1690310 - DNA, 14 bp, Homo sapiens
ttctgccccagagt

SEQ ID NO: 1690311 - DNA, 11 bp, Homo sapiens
ttctgccctgc

SEQ ID NO: 1690312 - DNA, 14 bp, Homo sapiens
ttctgccctggctg

SEQ ID NO: 1690313 - DNA, 16 bp, Homo sapiens
ttctgccctggctgct

SEQ ID NO: 1690314 - DNA, 20 bp, Homo sapiens
ttctgccctggctgctgccc

SEQ ID NO: 1690315 - DNA, 22 bp, Homo sapiens
ttctgccgccccctcctgaacc

SEQ ID NO: 1690316 - DNA, 19 bp, Homo sapiens
ttctgcctcagcctcctga

SEQ ID NO: 1690317 - DNA, 12 bp, Homo sapiens
ttctgcctctcc

SEQ ID NO: 1690318 - DNA, 14 bp, Homo sapiens
ttctgcctgagatt

SEQ ID NO: 1690319 - DNA, 17 bp, Homo sapiens
ttctgcctgccagctgc

SEQ ID NO: 1690320 - DNA, 18 bp, Homo sapiens
ttctgcctgccagctgca

SEQ ID NO: 1690321 - DNA, 22 bp, Homo sapiens
ttctgcctgccagctgcactga

SEQ ID NO: 1690322 - DNA, 20 bp, Homo sapiens
ttctgcctgttataactctg

SEQ ID NO: 1690323 - DNA, 10 bp, Homo sapiens
ttctgccttt

SEQ ID NO: 1690324 - DNA, 16 bp, Homo sapiens
ttctgcctttgatgtt

SEQ ID NO: 1690325 - DNA, 12 bp, Homo sapiens
ttctgccttttc

SEQ ID NO: 1690326 - DNA, 20 bp, Homo sapiens
ttctgcgctgtgtacaatgt

SEQ ID NO: 1690327 - DNA, 15 bp, Homo sapiens
ttctgcgtgtgtata

SEQ ID NO: 1690328 - DNA, 15 bp, Homo sapiens
ttctgctccaccctt

SEQ ID NO: 1690329 - DNA, 20 bp, Homo sapiens
ttctgctccacccttggcct

SEQ ID NO: 1690330 - DNA, 20 bp, Homo sapiens
ttctgctccataccttttct

SEQ ID NO: 1690331 - DNA, 12 bp, Homo sapiens
ttctgctcctgc

SEQ ID NO: 1690332 - DNA, 14 bp, Homo sapiens
ttctgctcctgctt

SEQ ID NO: 1690333 - DNA, 18 bp, Homo sapiens
ttctgctcctgcttttct

SEQ ID NO: 1690334 - DNA, 20 bp, Homo sapiens
ttctgctcctgcttttctgt

SEQ ID NO: 1690335 - DNA, 16 bp, Homo sapiens
ttctgctctgccatct

SEQ ID NO: 1690336 - DNA, 23 bp, Homo sapiens
ttctgctctggaataaagttgca

SEQ ID NO: 1690337 - DNA, 17 bp, Homo sapiens
ttctgctcttttcctgg

SEQ ID NO: 1690338 - DNA, 23 bp, Homo sapiens
ttctgctgcttgagttgcctgat

SEQ ID NO: 1690339 - DNA, 17 bp, Homo sapiens
ttctgctggcatcaaga

SEQ ID NO: 1690340 - DNA, 12 bp, Homo sapiens
ttctgctggcct

SEQ ID NO: 1690341 - DNA, 13 bp, Homo sapiens
ttctgctggcctg

SEQ ID NO: 1690342 - DNA, 15 bp, Homo sapiens
ttctgctggcctgga

SEQ ID NO: 1690343 - DNA, 18 bp, Homo sapiens
ttctgctggcctggatct

SEQ ID NO: 1690344 - DNA, 14 bp, Homo sapiens
ttctgctttcactt

SEQ ID NO: 1690345 - DNA, 17 bp, Homo sapiens
ttctgcttttctgccct

SEQ ID NO: 1690346 - DNA, 20 bp, Homo sapiens
ttctggaagattcttactgt

SEQ ID NO: 1690347 - DNA, 19 bp, Homo sapiens
ttctggaaggctggctgag

SEQ ID NO: 1690348 - DNA, 19 bp, Homo sapiens
ttctggaatacatgaaata

SEQ ID NO: 1690349 - DNA, 20 bp, Homo sapiens
ttctggaatgtaatcaatgt

SEQ ID NO: 1690350 - DNA, 21 bp, Homo sapiens
ttctggacattctctttgata

SEQ ID NO: 1690351 - DNA, 17 bp, Homo sapiens
ttctggactcccactct

SEQ ID NO: 1690352 - DNA, 21 bp, Homo sapiens
ttctggactcccactctttga

SEQ ID NO: 1690353 - DNA, 15 bp, Homo sapiens
ttctggactctgccc

SEQ ID NO: 1690354 - DNA, 18 bp, Homo sapiens
ttctggactctgccccaa

SEQ ID NO: 1690355 - DNA, 20 bp, Homo sapiens
ttctggactctgccccaatc

SEQ ID NO: 1690356 - DNA, 19 bp, Homo sapiens
ttctggacttggtcttgaa

SEQ ID NO: 1690357 - DNA, 13 bp, Homo sapiens
ttctggagccctt

SEQ ID NO: 1690358 - DNA, 14 bp, Homo sapiens
ttctggagctggga

SEQ ID NO: 1690359 - DNA, 22 bp, Homo sapiens
ttctggagctgggagacaaagg

SEQ ID NO: 1690360 - DNA, 19 bp, Homo sapiens
ttctggaggaaagggagga

SEQ ID NO: 1690361 - DNA, 19 bp, Homo sapiens
ttctggagtgattctagag

SEQ ID NO: 1690362 - DNA, 13 bp, Homo sapiens
ttctggataaagc

SEQ ID NO: 1690363 - DNA, 18 bp, Homo sapiens
ttctggataaagccactg

SEQ ID NO: 1690364 - DNA, 19 bp, Homo sapiens
ttctggataaagccactga

SEQ ID NO: 1690365 - DNA, 16 bp, Homo sapiens
ttctggatctcctgct

SEQ ID NO: 1690366 - DNA, 20 bp, Homo sapiens
ttctggatctcctgctgcct

SEQ ID NO: 1690367 - DNA, 22 bp, Homo sapiens
ttctggatttttttttctttat

SEQ ID NO: 1690368 - DNA, 22 bp, Homo sapiens
ttctggcagatgtaggtaaaga

SEQ ID NO: 1690369 - DNA, 23 bp, Homo sapiens
ttctggcagatgtaggtaaagag

SEQ ID NO: 1690370 - DNA, 21 bp, Homo sapiens
ttctggccaaggggtgggcct

SEQ ID NO: 1690371 - DNA, 21 bp, Homo sapiens
ttctggccagtgtttaaaact

SEQ ID NO: 1690372 - DNA, 22 bp, Homo sapiens
ttctggccagtgtttaaaactt

SEQ ID NO: 1690373 - DNA, 17 bp, Homo sapiens
ttctggccttgtaagac

SEQ ID NO: 1690374 - DNA, 15 bp, Homo sapiens
ttctggctgtttgag

SEQ ID NO: 1690375 - DNA, 22 bp, Homo sapiens
ttctgggaaaaacaacatcatt

SEQ ID NO: 1690376 - DNA, 19 bp, Homo sapiens
ttctgggatgtcacagtcc

SEQ ID NO: 1690377 - DNA, 23 bp, Homo sapiens
ttctgggcacagtggactcagca

SEQ ID NO: 1690378 - DNA, 18 bp, Homo sapiens
ttctgggccagtgagcca

SEQ ID NO: 1690379 - DNA, 23 bp, Homo sapiens
ttctgggcgtctgagctggggtg

SEQ ID NO: 1690380 - DNA, 14 bp, Homo sapiens
ttctgggcttcatt

SEQ ID NO: 1690381 - DNA, 20 bp, Homo sapiens
ttctggggaaagacactgcc

SEQ ID NO: 1690382 - DNA, 22 bp, Homo sapiens
ttctggggaaagacactgcctg

SEQ ID NO: 1690383 - DNA, 20 bp, Homo sapiens
ttctggggcaggctgggcca

SEQ ID NO: 1690384 - DNA, 21 bp, Homo sapiens
ttctggggcaggctgggccat

SEQ ID NO: 1690385 - DNA, 21 bp, Homo sapiens
ttctggggggacccagtgcag

SEQ ID NO: 1690386 - DNA, 15 bp, Homo sapiens
ttctggtataattgt

SEQ ID NO: 1690387 - DNA, 16 bp, Homo sapiens
ttctggtgggacaatg

SEQ ID NO: 1690388 - DNA, 21 bp, Homo sapiens
ttctggtgttcctaccaggac

SEQ ID NO: 1690389 - DNA, 13 bp, Homo sapiens
ttctggttccatt

SEQ ID NO: 1690390 - DNA, 14 bp, Homo sapiens
ttctggttgatttg

SEQ ID NO: 1690391 - DNA, 16 bp, Homo sapiens
ttctggttgcttcaga

SEQ ID NO: 1690392 - DNA, 17 bp, Homo sapiens
ttctggttgtatttcta

SEQ ID NO: 1690393 - DNA, 13 bp, Homo sapiens
ttctgtaaactta

SEQ ID NO: 1690394 - DNA, 14 bp, Homo sapiens
ttctgtaatgtaaa

SEQ ID NO: 1690395 - DNA, 19 bp, Homo sapiens
ttctgtaatgtaaataaac

SEQ ID NO: 1690396 - DNA, 11 bp, Homo sapiens
ttctgtaccag

SEQ ID NO: 1690397 - DNA, 21 bp, Homo sapiens
ttctgtaccagttaatttttc

SEQ ID NO: 1690398 - DNA, 14 bp, Homo sapiens
ttctgtactgattt

SEQ ID NO: 1690399 - DNA, 19 bp, Homo sapiens
ttctgtagacttttgaaaa

SEQ ID NO: 1690400 - DNA, 13 bp, Homo sapiens
ttctgtagattct

SEQ ID NO: 1690401 - DNA, 21 bp, Homo sapiens
ttctgtatatgattctctgtg

SEQ ID NO: 1690402 - DNA, 14 bp, Homo sapiens
ttctgtatccgtga

SEQ ID NO: 1690403 - DNA, 19 bp, Homo sapiens
ttctgtccctttgctcccg

SEQ ID NO: 1690404 - DNA, 14 bp, Homo sapiens
ttctgtctcccttc

SEQ ID NO: 1690405 - DNA, 18 bp, Homo sapiens
ttctgtctcttttctctt

SEQ ID NO: 1690406 - DNA, 17 bp, Homo sapiens
ttctgtcttcacaacag

SEQ ID NO: 1690407 - DNA, 22 bp, Homo sapiens
ttctgtcttcatcccctcagaa

SEQ ID NO: 1690408 - DNA, 13 bp, Homo sapiens
ttctgtcttccca

SEQ ID NO: 1690409 - DNA, 17 bp, Homo sapiens
ttctgtgaaattctcag

SEQ ID NO: 1690410 - DNA, 11 bp, Homo sapiens
ttctgtgaaga

SEQ ID NO: 1690411 - DNA, 19 bp, Homo sapiens
ttctgtgacccatctgtag

SEQ ID NO: 1690412 - DNA, 21 bp, Homo sapiens
ttctgtgcctccccccagacc

SEQ ID NO: 1690413 - DNA, 15 bp, Homo sapiens
ttctgtgcctgaata

SEQ ID NO: 1690414 - DNA, 12 bp, Homo sapiens
ttctgtggctca

SEQ ID NO: 1690415 - DNA, 16 bp, Homo sapiens
ttctgtggctcacaga

SEQ ID NO: 1690416 - DNA, 20 bp, Homo sapiens
ttctgtggttcctctgctca

SEQ ID NO: 1690417 - DNA, 21 bp, Homo sapiens
ttctgtggttcctctgctcac

SEQ ID NO: 1690418 - DNA, 18 bp, Homo sapiens
ttctgtggttttcccctc

SEQ ID NO: 1690419 - DNA, 22 bp, Homo sapiens
ttctgtgtaccacttcctgagg

SEQ ID NO: 1690420 - DNA, 15 bp, Homo sapiens
ttctgtgtacttttt

SEQ ID NO: 1690421 - DNA, 21 bp, Homo sapiens
ttctgtgtatctctttcacat

SEQ ID NO: 1690422 - DNA, 19 bp, Homo sapiens
ttctgtgtcagagcccagc

SEQ ID NO: 1690423 - DNA, 13 bp, Homo sapiens
ttctgtgtgtgag

SEQ ID NO: 1690424 - DNA, 14 bp, Homo sapiens
ttctgtgttcattt

SEQ ID NO: 1690425 - DNA, 12 bp, Homo sapiens
ttctgtgtttat

SEQ ID NO: 1690426 - DNA, 17 bp, Homo sapiens
ttctgtgtttattcaaa

SEQ ID NO: 1690427 - DNA, 16 bp, Homo sapiens
ttctgtgtttctggag

SEQ ID NO: 1690428 - DNA, 17 bp, Homo sapiens
ttctgttaactcttgaa

SEQ ID NO: 1690429 - DNA, 17 bp, Homo sapiens
ttctgttacccagggct

SEQ ID NO: 1690430 - DNA, 23 bp, Homo sapiens
ttctgttacccagggctctgcag

SEQ ID NO: 1690431 - DNA, 13 bp, Homo sapiens
ttctgttctcatt

SEQ ID NO: 1690432 - DNA, 15 bp, Homo sapiens
ttctgttctggagga

SEQ ID NO: 1690433 - DNA, 19 bp, Homo sapiens
ttctgttgaaaagcacaca

SEQ ID NO: 1690434 - DNA, 15 bp, Homo sapiens
ttctgtttcaaagca

SEQ ID NO: 1690435 - DNA, 11 bp, Homo sapiens
ttctgtttctt

SEQ ID NO: 1690436 - DNA, 17 bp, Homo sapiens
ttctgtttcttcttgtg

SEQ ID NO: 1690437 - DNA, 19 bp, Homo sapiens
ttctgtttgcgtacttgta

SEQ ID NO: 1690438 - DNA, 15 bp, Homo sapiens
ttctgtttggcactt

SEQ ID NO: 1690439 - DNA, 19 bp, Homo sapiens
ttctgtttggcacttgtat

SEQ ID NO: 1690440 - DNA, 14 bp, Homo sapiens
ttctgtttgttaaa

SEQ ID NO: 1690441 - DNA, 17 bp, Homo sapiens
ttctgttttcccccagc

SEQ ID NO: 1690442 - DNA, 17 bp, Homo sapiens
ttctgttttcttctcag

SEQ ID NO: 1690443 - DNA, 23 bp, Homo sapiens
ttctgttttgtttggcaaggaaa

SEQ ID NO: 1690444 - DNA, 22 bp, Homo sapiens
ttctgtttttaaaaattagcct

SEQ ID NO: 1690445 - DNA, 18 bp, Homo sapiens
ttctgtttttacagtgga

SEQ ID NO: 1690446 - DNA, 17 bp, Homo sapiens
ttcttaaaaaattgaaa

SEQ ID NO: 1690447 - DNA, 11 bp, Homo sapiens
ttcttaaaagt

SEQ ID NO: 1690448 - DNA, 14 bp, Homo sapiens
ttcttaaaagtact

SEQ ID NO: 1690449 - DNA, 19 bp, Homo sapiens
ttcttaaaagtactttaaa

SEQ ID NO: 1690450 - DNA, 18 bp, Homo sapiens
ttcttaaaatcaaatgta

SEQ ID NO: 1690451 - DNA, 23 bp, Homo sapiens
ttcttaaaattcaagaaaataaa

SEQ ID NO: 1690452 - DNA, 19 bp, Homo sapiens
ttcttaaagcaaagtcact

SEQ ID NO: 1690453 - DNA, 15 bp, Homo sapiens
ttcttaaaggcctgg

SEQ ID NO: 1690454 - DNA, 16 bp, Homo sapiens
ttcttaaaggcctgga

SEQ ID NO: 1690455 - DNA, 16 bp, Homo sapiens
ttcttaaataatgctt

SEQ ID NO: 1690456 - DNA, 11 bp, Homo sapiens
ttcttaaatat

SEQ ID NO: 1690457 - DNA, 21 bp, Homo sapiens
ttcttaaatgggctactttgt

SEQ ID NO: 1690458 - DNA, 20 bp, Homo sapiens
ttcttaaccctttccagagt

SEQ ID NO: 1690459 - DNA, 13 bp, Homo sapiens
ttcttaacctttg

SEQ ID NO: 1690460 - DNA, 19 bp, Homo sapiens
ttcttaacctttgctatgt

SEQ ID NO: 1690461 - DNA, 17 bp, Homo sapiens
ttcttaacttcttgctt

SEQ ID NO: 1690462 - DNA, 18 bp, Homo sapiens
ttcttaagaaatgccagt

SEQ ID NO: 1690463 - DNA, 16 bp, Homo sapiens
ttcttacatgcatttg

SEQ ID NO: 1690464 - DNA, 14 bp, Homo sapiens
ttcttacatgtttt

SEQ ID NO: 1690465 - DNA, 14 bp, Homo sapiens
ttcttaccaattgt

SEQ ID NO: 1690466 - DNA, 16 bp, Homo sapiens
ttcttacgcaatgctt

SEQ ID NO: 1690467 - DNA, 19 bp, Homo sapiens
ttcttactgttttgtatca

SEQ ID NO: 1690468 - DNA, 18 bp, Homo sapiens
ttcttagacttttccaat

SEQ ID NO: 1690469 - DNA, 22 bp, Homo sapiens
ttcttagagtgtagctgtaagg

SEQ ID NO: 1690470 - DNA, 17 bp, Homo sapiens
ttcttagcaataaatgc

SEQ ID NO: 1690471 - DNA, 18 bp, Homo sapiens
ttcttaggtttactgtga

SEQ ID NO: 1690472 - DNA, 21 bp, Homo sapiens
ttcttaggtttactgtgaaga

SEQ ID NO: 1690473 - DNA, 13 bp, Homo sapiens
ttcttagtgactt

SEQ ID NO: 1690474 - DNA, 19 bp, Homo sapiens
ttcttagtgcttcagagtt

SEQ ID NO: 1690475 - DNA, 18 bp, Homo sapiens
ttcttagttgacaaccta

SEQ ID NO: 1690476 - DNA, 21 bp, Homo sapiens
ttcttagttgacaacctagaa

SEQ ID NO: 1690477 - DNA, 16 bp, Homo sapiens
ttcttatacgcttttc

SEQ ID NO: 1690478 - DNA, 14 bp, Homo sapiens
ttcttatgaggagg

SEQ ID NO: 1690479 - DNA, 18 bp, Homo sapiens
ttcttatgccatataatt

SEQ ID NO: 1690480 - DNA, 16 bp, Homo sapiens
ttcttatgtgacatta

SEQ ID NO: 1690481 - DNA, 13 bp, Homo sapiens
ttcttatgttgaa

SEQ ID NO: 1690482 - DNA, 15 bp, Homo sapiens
ttcttattgctttta

SEQ ID NO: 1690483 - DNA, 21 bp, Homo sapiens
ttcttatttaatcttttctta

SEQ ID NO: 1690484 - DNA, 17 bp, Homo sapiens
ttcttatttaccctttt

SEQ ID NO: 1690485 - DNA, 12 bp, Homo sapiens
ttcttattttag

SEQ ID NO: 1690486 - DNA, 16 bp, Homo sapiens
ttcttcaaatgtttaa

SEQ ID NO: 1690487 - DNA, 14 bp, Homo sapiens
ttcttcaactcctg

SEQ ID NO: 1690488 - DNA, 17 bp, Homo sapiens
ttcttcacttcaagctg

SEQ ID NO: 1690489 - DNA, 21 bp, Homo sapiens
ttcttcagagtgaagaatctt

SEQ ID NO: 1690490 - DNA, 21 bp, Homo sapiens
ttcttcataacaattttagga

SEQ ID NO: 1690491 - DNA, 20 bp, Homo sapiens
ttcttcatattctaaaacca

SEQ ID NO: 1690492 - DNA, 15 bp, Homo sapiens
ttcttcatgcaatga

SEQ ID NO: 1690493 - DNA, 20 bp, Homo sapiens
ttcttcattcaatacaagtg

SEQ ID NO: 1690494 - DNA, 16 bp, Homo sapiens
ttcttcatttctctgc

SEQ ID NO: 1690495 - DNA, 17 bp, Homo sapiens
ttcttccaaatgcagtt

SEQ ID NO: 1690496 - DNA, 17 bp, Homo sapiens
ttcttccatattagtgt

SEQ ID NO: 1690497 - DNA, 19 bp, Homo sapiens
ttcttccatcatcactgta

SEQ ID NO: 1690498 - DNA, 21 bp, Homo sapiens
ttcttccatcatcactgtaaa

SEQ ID NO: 1690499 - DNA, 22 bp, Homo sapiens
ttcttccatcatcactgtaaag

SEQ ID NO: 1690500 - DNA, 23 bp, Homo sapiens
ttcttccatcatcactgtaaaga

SEQ ID NO: 1690501 - DNA, 21 bp, Homo sapiens
ttcttcccaacttgcctttga

SEQ ID NO: 1690502 - DNA, 13 bp, Homo sapiens
ttcttccccacaa

SEQ ID NO: 1690503 - DNA, 20 bp, Homo sapiens
ttcttcccccacttcccctc

SEQ ID NO: 1690504 - DNA, 21 bp, Homo sapiens
ttcttccctgctttgcatctt

SEQ ID NO: 1690505 - DNA, 15 bp, Homo sapiens
ttcttcctcactatg

SEQ ID NO: 1690506 - DNA, 16 bp, Homo sapiens
ttcttcctcactatga

SEQ ID NO: 1690507 - DNA, 11 bp, Homo sapiens
ttcttcctgtg

SEQ ID NO: 1690508 - DNA, 14 bp, Homo sapiens
ttcttcctgtgaag

SEQ ID NO: 1690509 - DNA, 22 bp, Homo sapiens
ttcttccttaattcactcccac

SEQ ID NO: 1690510 - DNA, 20 bp, Homo sapiens
ttcttcgctgctctagctgg

SEQ ID NO: 1690511 - DNA, 20 bp, Homo sapiens
ttcttcggggaactcctgga

SEQ ID NO: 1690512 - DNA, 15 bp, Homo sapiens
ttcttctaagaagac

SEQ ID NO: 1690513 - DNA, 19 bp, Homo sapiens
ttcttctaagaagacattt

SEQ ID NO: 1690514 - DNA, 20 bp, Homo sapiens
ttcttctattaatcaagaga

SEQ ID NO: 1690515 - DNA, 13 bp, Homo sapiens
ttcttctgaactc

SEQ ID NO: 1690516 - DNA, 20 bp, Homo sapiens
ttcttctgtgtttataaaat

SEQ ID NO: 1690517 - DNA, 15 bp, Homo sapiens
ttcttcttcagaaga

SEQ ID NO: 1690518 - DNA, 22 bp, Homo sapiens
ttcttcttccaacgtggcccag

SEQ ID NO: 1690519 - DNA, 15 bp, Homo sapiens
ttcttcttctaagaa

SEQ ID NO: 1690520 - DNA, 12 bp, Homo sapiens
ttcttctttccc

SEQ ID NO: 1690521 - DNA, 14 bp, Homo sapiens
ttcttctttccctg

SEQ ID NO: 1690522 - DNA, 14 bp, Homo sapiens
ttcttgaaagctgt

SEQ ID NO: 1690523 - DNA, 22 bp, Homo sapiens
ttcttgaaaggtccaaatgttt

SEQ ID NO: 1690524 - DNA, 17 bp, Homo sapiens
ttcttgaagttcatggt

SEQ ID NO: 1690525 - DNA, 20 bp, Homo sapiens
ttcttgacaaaacctaactt

SEQ ID NO: 1690526 - DNA, 13 bp, Homo sapiens
ttcttgacaagct

SEQ ID NO: 1690527 - DNA, 23 bp, Homo sapiens
ttcttgacaagctgacttggcac

SEQ ID NO: 1690528 - DNA, 20 bp, Homo sapiens
ttcttgatcagtagtttgca

SEQ ID NO: 1690529 - DNA, 22 bp, Homo sapiens
ttcttgatcagtagtttgcatt

SEQ ID NO: 1690530 - DNA, 16 bp, Homo sapiens
ttcttgatcttaaaga

SEQ ID NO: 1690531 - DNA, 17 bp, Homo sapiens
ttcttgatcttaaagat

SEQ ID NO: 1690532 - DNA, 14 bp, Homo sapiens
ttcttgatgtaaaa

SEQ ID NO: 1690533 - DNA, 15 bp, Homo sapiens
ttcttgatgtaaaat

SEQ ID NO: 1690534 - DNA, 16 bp, Homo sapiens
ttcttgatgttgctta

SEQ ID NO: 1690535 - DNA, 18 bp, Homo sapiens
ttcttgattaaagtgatt

SEQ ID NO: 1690536 - DNA, 14 bp, Homo sapiens
ttcttgcagattct

SEQ ID NO: 1690537 - DNA, 23 bp, Homo sapiens
ttcttgcataggctcttaagcag

SEQ ID NO: 1690538 - DNA, 16 bp, Homo sapiens
ttcttgccaatgaggt

SEQ ID NO: 1690539 - DNA, 16 bp, Homo sapiens
ttcttgccatcactgg

SEQ ID NO: 1690540 - DNA, 21 bp, Homo sapiens
ttcttgcctactatgccagat

SEQ ID NO: 1690541 - DNA, 20 bp, Homo sapiens
ttcttgcctctgtccccttc

SEQ ID NO: 1690542 - DNA, 15 bp, Homo sapiens
ttcttgcctctgtgc

SEQ ID NO: 1690543 - DNA, 17 bp, Homo sapiens
ttcttgcctctgtgctg

SEQ ID NO: 1690544 - DNA, 18 bp, Homo sapiens
ttcttgcctgaactcctg

SEQ ID NO: 1690545 - DNA, 11 bp, Homo sapiens
ttcttgctgct

SEQ ID NO: 1690546 - DNA, 19 bp, Homo sapiens
ttcttgcttctttctagaa

SEQ ID NO: 1690547 - DNA, 17 bp, Homo sapiens
ttcttgctttcacaaat

SEQ ID NO: 1690548 - DNA, 20 bp, Homo sapiens
ttcttggaactgtcccagct

SEQ ID NO: 1690549 - DNA, 21 bp, Homo sapiens
ttcttggaactgtcccagcta

SEQ ID NO: 1690550 - DNA, 20 bp, Homo sapiens
ttcttggagctttggaatat

SEQ ID NO: 1690551 - DNA, 22 bp, Homo sapiens
ttcttggatcctcagaactctt

SEQ ID NO: 1690552 - DNA, 14 bp, Homo sapiens
ttcttggcaaattt

SEQ ID NO: 1690553 - DNA, 22 bp, Homo sapiens
ttcttggcttaatcattttcat

SEQ ID NO: 1690554 - DNA, 17 bp, Homo sapiens
ttcttgggaattgaaaa

SEQ ID NO: 1690555 - DNA, 22 bp, Homo sapiens
ttcttgggatagtgttctgctc

SEQ ID NO: 1690556 - DNA, 17 bp, Homo sapiens
ttcttggggcccagtgc

SEQ ID NO: 1690557 - DNA, 13 bp, Homo sapiens
ttcttgtaaatgt

SEQ ID NO: 1690558 - DNA, 14 bp, Homo sapiens
ttcttgtaaatgtt

SEQ ID NO: 1690559 - DNA, 11 bp, Homo sapiens
ttcttgtaatt

SEQ ID NO: 1690560 - DNA, 18 bp, Homo sapiens
ttcttgtgggagacagca

SEQ ID NO: 1690561 - DNA, 21 bp, Homo sapiens
ttcttgtgggagacagcagcc

SEQ ID NO: 1690562 - DNA, 13 bp, Homo sapiens
ttcttgtggttaa

SEQ ID NO: 1690563 - DNA, 13 bp, Homo sapiens
ttcttgtgtcctg

SEQ ID NO: 1690564 - DNA, 18 bp, Homo sapiens
ttcttgttggtagcatgt

SEQ ID NO: 1690565 - DNA, 22 bp, Homo sapiens
ttcttgtttaccaaagaagagt

SEQ ID NO: 1690566 - DNA, 14 bp, Homo sapiens
ttcttgtttccttg

SEQ ID NO: 1690567 - DNA, 16 bp, Homo sapiens
ttcttgtttccttgtt

SEQ ID NO: 1690568 - DNA, 13 bp, Homo sapiens
ttcttgtttgaat

SEQ ID NO: 1690569 - DNA, 19 bp, Homo sapiens
ttcttgtttgtcagcatct

SEQ ID NO: 1690570 - DNA, 21 bp, Homo sapiens
ttcttgtttgtcagcatctga

SEQ ID NO: 1690571 - DNA, 20 bp, Homo sapiens
ttctttaacatacatctaag

SEQ ID NO: 1690572 - DNA, 20 bp, Homo sapiens
ttctttacctgagaccagtt

SEQ ID NO: 1690573 - DNA, 15 bp, Homo sapiens
ttctttactgcactc

SEQ ID NO: 1690574 - DNA, 16 bp, Homo sapiens
ttctttagaattttta

SEQ ID NO: 1690575 - DNA, 20 bp, Homo sapiens
ttctttagcatttttatgca

SEQ ID NO: 1690576 - DNA, 22 bp, Homo sapiens
ttctttagtactcaatgtttct

SEQ ID NO: 1690577 - DNA, 13 bp, Homo sapiens
ttctttataaact

SEQ ID NO: 1690578 - DNA, 18 bp, Homo sapiens
ttctttataattctactt

SEQ ID NO: 1690579 - DNA, 19 bp, Homo sapiens
ttctttcacaaaaaagaag

SEQ ID NO: 1690580 - DNA, 17 bp, Homo sapiens
ttctttccatgcagact

SEQ ID NO: 1690581 - DNA, 20 bp, Homo sapiens
ttctttccattatgattctt

SEQ ID NO: 1690582 - DNA, 14 bp, Homo sapiens
ttctttcccatgta

SEQ ID NO: 1690583 - DNA, 10 bp, Homo sapiens
ttctttcccc

SEQ ID NO: 1690584 - DNA, 16 bp, Homo sapiens
ttctttccccagaggc

SEQ ID NO: 1690585 - DNA, 21 bp, Homo sapiens
ttctttccctggacaggcagc

SEQ ID NO: 1690586 - DNA, 11 bp, Homo sapiens
ttctttcctcc

SEQ ID NO: 1690587 - DNA, 17 bp, Homo sapiens
ttctttctatgtagaac

SEQ ID NO: 1690588 - DNA, 16 bp, Homo sapiens
ttctttctgtctccct

SEQ ID NO: 1690589 - DNA, 11 bp, Homo sapiens
ttctttcttcc

SEQ ID NO: 1690590 - DNA, 14 bp, Homo sapiens
ttctttcttcctct

SEQ ID NO: 1690591 - DNA, 22 bp, Homo sapiens
ttctttgaccagatctttctct

SEQ ID NO: 1690592 - DNA, 17 bp, Homo sapiens
ttctttgagactgggtc

SEQ ID NO: 1690593 - DNA, 16 bp, Homo sapiens
ttctttgatcatgaat

SEQ ID NO: 1690594 - DNA, 16 bp, Homo sapiens
ttctttgcaaaaatcc

SEQ ID NO: 1690595 - DNA, 14 bp, Homo sapiens
ttctttgcaccaaa

SEQ ID NO: 1690596 - DNA, 16 bp, Homo sapiens
ttctttgcaccaaaga

SEQ ID NO: 1690597 - DNA, 12 bp, Homo sapiens
ttctttggctgc

SEQ ID NO: 1690598 - DNA, 13 bp, Homo sapiens
ttctttggctgca

SEQ ID NO: 1690599 - DNA, 20 bp, Homo sapiens
ttctttggtaggtaaatcta

SEQ ID NO: 1690600 - DNA, 15 bp, Homo sapiens
ttctttggttgtgaa

SEQ ID NO: 1690601 - DNA, 17 bp, Homo sapiens
ttctttgtaccatctgt

SEQ ID NO: 1690602 - DNA, 14 bp, Homo sapiens
ttctttgtttcttt

SEQ ID NO: 1690603 - DNA, 21 bp, Homo sapiens
ttcttttaaaggggcagaaaa

SEQ ID NO: 1690604 - DNA, 22 bp, Homo sapiens
ttcttttaatgatgccatggca

SEQ ID NO: 1690605 - DNA, 21 bp, Homo sapiens
ttcttttcacattaggctgtt

SEQ ID NO: 1690606 - DNA, 12 bp, Homo sapiens
ttcttttctcct

SEQ ID NO: 1690607 - DNA, 13 bp, Homo sapiens
ttcttttgcaatt

SEQ ID NO: 1690608 - DNA, 22 bp, Homo sapiens
ttcttttgcccttcacagtgtt

SEQ ID NO: 1690609 - DNA, 17 bp, Homo sapiens
ttcttttgtggtgtctt

SEQ ID NO: 1690610 - DNA, 13 bp, Homo sapiens
ttcttttgtttgg

SEQ ID NO: 1690611 - DNA, 14 bp, Homo sapiens
ttctttttactgtt

SEQ ID NO: 1690612 - DNA, 20 bp, Homo sapiens
ttctttttattttgcactct

SEQ ID NO: 1690613 - DNA, 12 bp, Homo sapiens
ttctttttgaat

SEQ ID NO: 1690614 - DNA, 12 bp, Homo sapiens
ttctttttgctc

SEQ ID NO: 1690615 - DNA, 14 bp, Homo sapiens
ttctttttgctcta

SEQ ID NO: 1690616 - DNA, 18 bp, Homo sapiens
ttctttttgggagagact

SEQ ID NO: 1690617 - DNA, 20 bp, Homo sapiens
ttcttttttatcttgcactt

SEQ ID NO: 1690618 - DNA, 16 bp, Homo sapiens
ttcttttttcctctga

SEQ ID NO: 1690619 - DNA, 18 bp, Homo sapiens
ttctttttttccttttta

SEQ ID NO: 1690620 - DNA, 11 bp, Homo sapiens
ttgaaaaacaa

SEQ ID NO: 1690621 - DNA, 20 bp, Homo sapiens
ttgaaaaatataaaattatg

SEQ ID NO: 1690622 - DNA, 16 bp, Homo sapiens
ttgaaaacctgacaaa

SEQ ID NO: 1690623 - DNA, 13 bp, Homo sapiens
ttgaaaagaaaga

SEQ ID NO: 1690624 - DNA, 13 bp, Homo sapiens
ttgaaaagaagaa

SEQ ID NO: 1690625 - DNA, 22 bp, Homo sapiens
ttgaaaagactccaaagaaatg

SEQ ID NO: 1690626 - DNA, 22 bp, Homo sapiens
ttgaaaataacctaattaatat

SEQ ID NO: 1690627 - DNA, 22 bp, Homo sapiens
ttgaaaatacttttgcattttt

SEQ ID NO: 1690628 - DNA, 13 bp, Homo sapiens
ttgaaaatgcatt

SEQ ID NO: 1690629 - DNA, 16 bp, Homo sapiens
ttgaaaatgtccagga

SEQ ID NO: 1690630 - DNA, 18 bp, Homo sapiens
ttgaaaattttacttcca

SEQ ID NO: 1690631 - DNA, 12 bp, Homo sapiens
ttgaaacaaagt

SEQ ID NO: 1690632 - DNA, 18 bp, Homo sapiens
ttgaaacgttatgatgac

SEQ ID NO: 1690633 - DNA, 22 bp, Homo sapiens
ttgaaactgagtataatcaata

SEQ ID NO: 1690634 - DNA, 12 bp, Homo sapiens
ttgaaagaactt

SEQ ID NO: 1690635 - DNA, 13 bp, Homo sapiens
ttgaaagaagttt

SEQ ID NO: 1690636 - DNA, 14 bp, Homo sapiens
ttgaaagaatagaa

SEQ ID NO: 1690637 - DNA, 13 bp, Homo sapiens
ttgaaagacatca

SEQ ID NO: 1690638 - DNA, 15 bp, Homo sapiens
ttgaaagacatcaat

SEQ ID NO: 1690639 - DNA, 13 bp, Homo sapiens
ttgaaagaccttc

SEQ ID NO: 1690640 - DNA, 14 bp, Homo sapiens
ttgaaagagttaag

SEQ ID NO: 1690641 - DNA, 15 bp, Homo sapiens
ttgaaagattcaggt

SEQ ID NO: 1690642 - DNA, 21 bp, Homo sapiens
ttgaaaggggacacctgtaca

SEQ ID NO: 1690643 - DNA, 19 bp, Homo sapiens
ttgaaaggtccaaatgttt

SEQ ID NO: 1690644 - DNA, 22 bp, Homo sapiens
ttgaaagtgcttcaagggtaat

SEQ ID NO: 1690645 - DNA, 17 bp, Homo sapiens
ttgaaagttagagattt

SEQ ID NO: 1690646 - DNA, 21 bp, Homo sapiens
ttgaaataactggaacaaatt

SEQ ID NO: 1690647 - DNA, 14 bp, Homo sapiens
ttgaaatatcatgt

SEQ ID NO: 1690648 - DNA, 18 bp, Homo sapiens
ttgaaatcacctggtatt

SEQ ID NO: 1690649 - DNA, 20 bp, Homo sapiens
ttgaaatgctcttttgcaca

SEQ ID NO: 1690650 - DNA, 19 bp, Homo sapiens
ttgaaatgtgtttctgtat

SEQ ID NO: 1690651 - DNA, 18 bp, Homo sapiens
ttgaaattatgtatgttt

SEQ ID NO: 1690652 - DNA, 16 bp, Homo sapiens
ttgaacaaaataaatt

SEQ ID NO: 1690653 - DNA, 13 bp, Homo sapiens
ttgaacactgggg

SEQ ID NO: 1690654 - DNA, 13 bp, Homo sapiens
ttgaacatgaact

SEQ ID NO: 1690655 - DNA, 16 bp, Homo sapiens
ttgaacccaaattgag

SEQ ID NO: 1690656 - DNA, 12 bp, Homo sapiens
ttgaacccagga

SEQ ID NO: 1690657 - DNA, 13 bp, Homo sapiens
ttgaacccaggag

SEQ ID NO: 1690658 - DNA, 19 bp, Homo sapiens
ttgaacgagcagcccaggg

SEQ ID NO: 1690659 - DNA, 20 bp, Homo sapiens
ttgaacgtgcttctttgtaa

SEQ ID NO: 1690660 - DNA, 15 bp, Homo sapiens
ttgaactctgagaga

SEQ ID NO: 1690661 - DNA, 12 bp, Homo sapiens
ttgaactgaagg

SEQ ID NO: 1690662 - DNA, 20 bp, Homo sapiens
ttgaactggcaattgtctat

SEQ ID NO: 1690663 - DNA, 23 bp, Homo sapiens
ttgaactggcaattgtctattta

SEQ ID NO: 1690664 - DNA, 14 bp, Homo sapiens
ttgaactgttagaa

SEQ ID NO: 1690665 - DNA, 15 bp, Homo sapiens
ttgaactgttagaat

SEQ ID NO: 1690666 - DNA, 13 bp, Homo sapiens
ttgaacttttgta

SEQ ID NO: 1690667 - DNA, 17 bp, Homo sapiens
ttgaagaaacagagtgg

SEQ ID NO: 1690668 - DNA, 16 bp, Homo sapiens
ttgaagaactgcaggc

SEQ ID NO: 1690669 - DNA, 13 bp, Homo sapiens
ttgaagacaattt

SEQ ID NO: 1690670 - DNA, 15 bp, Homo sapiens
ttgaagacaatttga

SEQ ID NO: 1690671 - DNA, 14 bp, Homo sapiens
ttgaagagacagag

SEQ ID NO: 1690672 - DNA, 17 bp, Homo sapiens
ttgaagaggggaggggc

SEQ ID NO: 1690673 - DNA, 11 bp, Homo sapiens
ttgaagcaaat

SEQ ID NO: 1690674 - DNA, 11 bp, Homo sapiens
ttgaagcactt

SEQ ID NO: 1690675 - DNA, 11 bp, Homo sapiens
ttgaagcatag

SEQ ID NO: 1690676 - DNA, 14 bp, Homo sapiens
ttgaagccaaagaa

SEQ ID NO: 1690677 - DNA, 15 bp, Homo sapiens
ttgaagccaaagaaa

SEQ ID NO: 1690678 - DNA, 19 bp, Homo sapiens
ttgaagcctaaatttgtgc

SEQ ID NO: 1690679 - DNA, 19 bp, Homo sapiens
ttgaaggaaagctatatct

SEQ ID NO: 1690680 - DNA, 22 bp, Homo sapiens
ttgaaggaaagctatatctatt

SEQ ID NO: 1690681 - DNA, 17 bp, Homo sapiens
ttgaaggagaaaataga

SEQ ID NO: 1690682 - DNA, 13 bp, Homo sapiens
ttgaaggcagtct

SEQ ID NO: 1690683 - DNA, 16 bp, Homo sapiens
ttgaaggcagtctgaa

SEQ ID NO: 1690684 - DNA, 20 bp, Homo sapiens
ttgaagggaaacaaagaagt

SEQ ID NO: 1690685 - DNA, 15 bp, Homo sapiens
ttgaagggaggggct

SEQ ID NO: 1690686 - DNA, 20 bp, Homo sapiens
ttgaagggaggggctgtgtt

SEQ ID NO: 1690687 - DNA, 19 bp, Homo sapiens
ttgaagggcaagaaatggc

SEQ ID NO: 1690688 - DNA, 20 bp, Homo sapiens
ttgaagggccagagccaggg

SEQ ID NO: 1690689 - DNA, 14 bp, Homo sapiens
ttgaagggtcctgc

SEQ ID NO: 1690690 - DNA, 19 bp, Homo sapiens
ttgaagggtctttctcaaa

SEQ ID NO: 1690691 - DNA, 22 bp, Homo sapiens
ttgaaggttgtatgtaaatctg

SEQ ID NO: 1690692 - DNA, 20 bp, Homo sapiens
ttgaagtaacttatttgact

SEQ ID NO: 1690693 - DNA, 12 bp, Homo sapiens
ttgaagtaatga

SEQ ID NO: 1690694 - DNA, 18 bp, Homo sapiens
ttgaagtattttgctgga

SEQ ID NO: 1690695 - DNA, 12 bp, Homo sapiens
ttgaagtcagcc

SEQ ID NO: 1690696 - DNA, 14 bp, Homo sapiens
ttgaagtcagccac

SEQ ID NO: 1690697 - DNA, 23 bp, Homo sapiens
ttgaagtcagccacactgggcct

SEQ ID NO: 1690698 - DNA, 19 bp, Homo sapiens
ttgaagtttcaagttttaa

SEQ ID NO: 1690699 - DNA, 22 bp, Homo sapiens
ttgaataccattaaaactgctt

SEQ ID NO: 1690700 - DNA, 17 bp, Homo sapiens
ttgaataggtagtatca

SEQ ID NO: 1690701 - DNA, 21 bp, Homo sapiens
ttgaatagttgcttaattttg

SEQ ID NO: 1690702 - DNA, 23 bp, Homo sapiens
ttgaatagttgcttaattttgat

SEQ ID NO: 1690703 - DNA, 12 bp, Homo sapiens
ttgaatatatat

SEQ ID NO: 1690704 - DNA, 13 bp, Homo sapiens
ttgaatatattat

SEQ ID NO: 1690705 - DNA, 19 bp, Homo sapiens
ttgaatccatgcttgggtg

SEQ ID NO: 1690706 - DNA, 14 bp, Homo sapiens
ttgaatctttaatt

SEQ ID NO: 1690707 - DNA, 19 bp, Homo sapiens
ttgaatggatcaatacaca

SEQ ID NO: 1690708 - DNA, 18 bp, Homo sapiens
ttgaatggcctgccttga

SEQ ID NO: 1690709 - DNA, 20 bp, Homo sapiens
ttgaatgtatttgatttata

SEQ ID NO: 1690710 - DNA, 12 bp, Homo sapiens
ttgaatgtcaca

SEQ ID NO: 1690711 - DNA, 19 bp, Homo sapiens
ttgaatgtcacaaattgat

SEQ ID NO: 1690712 - DNA, 12 bp, Homo sapiens
ttgaatgtcttt

SEQ ID NO: 1690713 - DNA, 16 bp, Homo sapiens
ttgaatgtcttttgaa

SEQ ID NO: 1690714 - DNA, 22 bp, Homo sapiens
ttgaattaaattaggaataaat

SEQ ID NO: 1690715 - DNA, 16 bp, Homo sapiens
ttgaattaggctaaaa

SEQ ID NO: 1690716 - DNA, 23 bp, Homo sapiens
ttgaattatccacatgaaaataa

SEQ ID NO: 1690717 - DNA, 13 bp, Homo sapiens
ttgaattatcttg

SEQ ID NO: 1690718 - DNA, 20 bp, Homo sapiens
ttgaattatcttggttgaaa

SEQ ID NO: 1690719 - DNA, 22 bp, Homo sapiens
ttgaattatcttggttgaaaat

SEQ ID NO: 1690720 - DNA, 14 bp, Homo sapiens
ttgaatttaaataa

SEQ ID NO: 1690721 - DNA, 15 bp, Homo sapiens
ttgaatttaaataaa

SEQ ID NO: 1690722 - DNA, 17 bp, Homo sapiens
ttgaatttaaataaagt

SEQ ID NO: 1690723 - DNA, 16 bp, Homo sapiens
ttgaattttaaatcta

SEQ ID NO: 1690724 - DNA, 22 bp, Homo sapiens
ttgaattttttttaacattcct

SEQ ID NO: 1690725 - DNA, 14 bp, Homo sapiens
ttgacaactgtgac

SEQ ID NO: 1690726 - DNA, 16 bp, Homo sapiens
ttgacaactgtgactg

SEQ ID NO: 1690727 - DNA, 18 bp, Homo sapiens
ttgacaaggaaaatctat

SEQ ID NO: 1690728 - DNA, 21 bp, Homo sapiens
ttgacaagttgcgacggagag

SEQ ID NO: 1690729 - DNA, 18 bp, Homo sapiens
ttgacaataaatgtgctt

SEQ ID NO: 1690730 - DNA, 15 bp, Homo sapiens
ttgacaattcctaga

SEQ ID NO: 1690731 - DNA, 16 bp, Homo sapiens
ttgacaattgggagct

SEQ ID NO: 1690732 - DNA, 14 bp, Homo sapiens
ttgacaattttgtc

SEQ ID NO: 1690733 - DNA, 20 bp, Homo sapiens
ttgacaattttgtcttaagt

SEQ ID NO: 1690734 - DNA, 22 bp, Homo sapiens
ttgacacaaagcttctaaagca

SEQ ID NO: 1690735 - DNA, 16 bp, Homo sapiens
ttgacacacagcactc

SEQ ID NO: 1690736 - DNA, 18 bp, Homo sapiens
ttgacacatatgaacaca

SEQ ID NO: 1690737 - DNA, 19 bp, Homo sapiens
ttgacacatatgaacacag

SEQ ID NO: 1690738 - DNA, 14 bp, Homo sapiens
ttgacactatatct

SEQ ID NO: 1690739 - DNA, 19 bp, Homo sapiens
ttgacactatatctgtata

SEQ ID NO: 1690740 - DNA, 11 bp, Homo sapiens
ttgacactgaa

SEQ ID NO: 1690741 - DNA, 14 bp, Homo sapiens
ttgacactgaactt

SEQ ID NO: 1690742 - DNA, 15 bp, Homo sapiens
ttgacactgaactta

SEQ ID NO: 1690743 - DNA, 22 bp, Homo sapiens
ttgacactgaacttaataactg

SEQ ID NO: 1690744 - DNA, 14 bp, Homo sapiens
ttgacagactattt

SEQ ID NO: 1690745 - DNA, 23 bp, Homo sapiens
ttgacagcaaaatgttgaagaaa

SEQ ID NO: 1690746 - DNA, 19 bp, Homo sapiens
ttgacaggattattggaaa

SEQ ID NO: 1690747 - DNA, 15 bp, Homo sapiens
ttgacagtatatttg

SEQ ID NO: 1690748 - DNA, 14 bp, Homo sapiens
ttgacagtgttttt

SEQ ID NO: 1690749 - DNA, 17 bp, Homo sapiens
ttgacagttctgaagaa

SEQ ID NO: 1690750 - DNA, 19 bp, Homo sapiens
ttgacataactatcttttt

SEQ ID NO: 1690751 - DNA, 16 bp, Homo sapiens
ttgacatccaaatcta

SEQ ID NO: 1690752 - DNA, 17 bp, Homo sapiens
ttgacatccaaatctag

SEQ ID NO: 1690753 - DNA, 16 bp, Homo sapiens
ttgacatttagaactt

SEQ ID NO: 1690754 - DNA, 19 bp, Homo sapiens
ttgaccaacagaaaccttt

SEQ ID NO: 1690755 - DNA, 15 bp, Homo sapiens
ttgaccagatctttc

SEQ ID NO: 1690756 - DNA, 19 bp, Homo sapiens
ttgaccagctctcttcctg

SEQ ID NO: 1690757 - DNA, 22 bp, Homo sapiens
ttgacctcacagtgacccttcc

SEQ ID NO: 1690758 - DNA, 22 bp, Homo sapiens
ttgacctcagctgcacattcct

SEQ ID NO: 1690759 - DNA, 15 bp, Homo sapiens
ttgacctcatcatta

SEQ ID NO: 1690760 - DNA, 22 bp, Homo sapiens
ttgacgggagcattggcccctg

SEQ ID NO: 1690761 - DNA, 15 bp, Homo sapiens
ttgactaaagctatg

SEQ ID NO: 1690762 - DNA, 23 bp, Homo sapiens
ttgactaactcaaatacacattt

SEQ ID NO: 1690763 - DNA, 17 bp, Homo sapiens
ttgactatcaaactgaa

SEQ ID NO: 1690764 - DNA, 19 bp, Homo sapiens
ttgactcccaagtttccat

SEQ ID NO: 1690765 - DNA, 17 bp, Homo sapiens
ttgactctcacactgaa

SEQ ID NO: 1690766 - DNA, 19 bp, Homo sapiens
ttgactctgcctacttctg

SEQ ID NO: 1690767 - DNA, 17 bp, Homo sapiens
ttgactgtctttcctat

SEQ ID NO: 1690768 - DNA, 20 bp, Homo sapiens
ttgactgtgatttatttgga

SEQ ID NO: 1690769 - DNA, 16 bp, Homo sapiens
ttgacttgaaatgctc

SEQ ID NO: 1690770 - DNA, 16 bp, Homo sapiens
ttgacttgattagtgc

SEQ ID NO: 1690771 - DNA, 22 bp, Homo sapiens
ttgactttacgcccatctcagg

SEQ ID NO: 1690772 - DNA, 14 bp, Homo sapiens
ttgactttcaggta

SEQ ID NO: 1690773 - DNA, 20 bp, Homo sapiens
ttgacttttataaagcatgt

SEQ ID NO: 1690774 - DNA, 19 bp, Homo sapiens
ttgacttttctgtaattca

SEQ ID NO: 1690775 - DNA, 22 bp, Homo sapiens
ttgagaaaccttattgtacctc

SEQ ID NO: 1690776 - DNA, 23 bp, Homo sapiens
ttgagaaaccttattgtacctct

SEQ ID NO: 1690777 - DNA, 15 bp, Homo sapiens
ttgagaaatgaataa

SEQ ID NO: 1690778 - DNA, 16 bp, Homo sapiens
ttgagaaatgaataat

SEQ ID NO: 1690779 - DNA, 23 bp, Homo sapiens
ttgagaactggttttagcattta

SEQ ID NO: 1690780 - DNA, 15 bp, Homo sapiens
ttgagaagaaaacat

SEQ ID NO: 1690781 - DNA, 23 bp, Homo sapiens
ttgagaagccttcagctccaggg

SEQ ID NO: 1690782 - DNA, 12 bp, Homo sapiens
ttgagaagctct

SEQ ID NO: 1690783 - DNA, 18 bp, Homo sapiens
ttgagacaagccctggca

SEQ ID NO: 1690784 - DNA, 19 bp, Homo sapiens
ttgagacaagccctggcaa

SEQ ID NO: 1690785 - DNA, 20 bp, Homo sapiens
ttgagacactggtttacact

SEQ ID NO: 1690786 - DNA, 16 bp, Homo sapiens
ttgagaccagcctggc

SEQ ID NO: 1690787 - DNA, 15 bp, Homo sapiens
ttgagaccaggctgg

SEQ ID NO: 1690788 - DNA, 14 bp, Homo sapiens
ttgagacctcagcc

SEQ ID NO: 1690789 - DNA, 17 bp, Homo sapiens
ttgagacctcagccatg

SEQ ID NO: 1690790 - DNA, 21 bp, Homo sapiens
ttgagacgcaccatgtgggca

SEQ ID NO: 1690791 - DNA, 19 bp, Homo sapiens
ttgagagactgccatacat

SEQ ID NO: 1690792 - DNA, 22 bp, Homo sapiens
ttgagagcccgcgtgctggaga

SEQ ID NO: 1690793 - DNA, 16 bp, Homo sapiens
ttgagagctgctgagg

SEQ ID NO: 1690794 - DNA, 16 bp, Homo sapiens
ttgagaggctgaggtg

SEQ ID NO: 1690795 - DNA, 13 bp, Homo sapiens
ttgagatccagtg

SEQ ID NO: 1690796 - DNA, 17 bp, Homo sapiens
ttgagatgtatgaaggc

SEQ ID NO: 1690797 - DNA, 22 bp, Homo sapiens
ttgagcacttttcaaacaatca

SEQ ID NO: 1690798 - DNA, 17 bp, Homo sapiens
ttgagcatcaatcttgt

SEQ ID NO: 1690799 - DNA, 21 bp, Homo sapiens
ttgagcatgacagcctgcagc

SEQ ID NO: 1690800 - DNA, 12 bp, Homo sapiens
ttgagccacagt

SEQ ID NO: 1690801 - DNA, 17 bp, Homo sapiens
ttgagccccagtgctgg

SEQ ID NO: 1690802 - DNA, 13 bp, Homo sapiens
ttgagccctggct

SEQ ID NO: 1690803 - DNA, 20 bp, Homo sapiens
ttgagccgggcccctgggct

SEQ ID NO: 1690804 - DNA, 21 bp, Homo sapiens
ttgagctcagccccaactctt

SEQ ID NO: 1690805 - DNA, 19 bp, Homo sapiens
ttgagctcatgagggccca

SEQ ID NO: 1690806 - DNA, 18 bp, Homo sapiens
ttgagctcccctggagcc

SEQ ID NO: 1690807 - DNA, 16 bp, Homo sapiens
ttgagctcttcattta

SEQ ID NO: 1690808 - DNA, 12 bp, Homo sapiens
ttgagctgcctt

SEQ ID NO: 1690809 - DNA, 14 bp, Homo sapiens
ttgagctgccttcc

SEQ ID NO: 1690810 - DNA, 18 bp, Homo sapiens
ttgagctgctttttttga

SEQ ID NO: 1690811 - DNA, 13 bp, Homo sapiens
ttgagctggcctc

SEQ ID NO: 1690812 - DNA, 20 bp, Homo sapiens
ttgagctgttgtgagctttg

SEQ ID NO: 1690813 - DNA, 15 bp, Homo sapiens
ttgaggaaaatattg

SEQ ID NO: 1690814 - DNA, 17 bp, Homo sapiens
ttgaggaaatttgcagc

SEQ ID NO: 1690815 - DNA, 21 bp, Homo sapiens
ttgaggaatatttcaagctct

SEQ ID NO: 1690816 - DNA, 13 bp, Homo sapiens
ttgaggagtgtga

SEQ ID NO: 1690817 - DNA, 15 bp, Homo sapiens
ttgaggccaagatgg

SEQ ID NO: 1690818 - DNA, 22 bp, Homo sapiens
ttgaggccaagatggctgctgc

SEQ ID NO: 1690819 - DNA, 22 bp, Homo sapiens
ttgaggcccccgtcagggagag

SEQ ID NO: 1690820 - DNA, 14 bp, Homo sapiens
ttgaggctgcagcg

SEQ ID NO: 1690821 - DNA, 21 bp, Homo sapiens
ttgagggacgctttgtctgtc

SEQ ID NO: 1690822 - DNA, 18 bp, Homo sapiens
ttgagggagctgggagac

SEQ ID NO: 1690823 - DNA, 20 bp, Homo sapiens
ttgagggcattagtactttg

SEQ ID NO: 1690824 - DNA, 16 bp, Homo sapiens
ttgaggggctcctgga

SEQ ID NO: 1690825 - DNA, 13 bp, Homo sapiens
ttgagggtaggag

SEQ ID NO: 1690826 - DNA, 21 bp, Homo sapiens
ttgaggtagaggggaaggaaa

SEQ ID NO: 1690827 - DNA, 19 bp, Homo sapiens
ttgaggtggaagccctcct

SEQ ID NO: 1690828 - DNA, 11 bp, Homo sapiens
ttgaggtggct

SEQ ID NO: 1690829 - DNA, 19 bp, Homo sapiens
ttgaggttttgtaaaactg

SEQ ID NO: 1690830 - DNA, 20 bp, Homo sapiens
ttgaggttttgtaaaactgt

SEQ ID NO: 1690831 - DNA, 15 bp, Homo sapiens
ttgagtaaaacacat

SEQ ID NO: 1690832 - DNA, 16 bp, Homo sapiens
ttgagtaatggtgtag

SEQ ID NO: 1690833 - DNA, 20 bp, Homo sapiens
ttgagtattgtttaaaatgt

SEQ ID NO: 1690834 - DNA, 22 bp, Homo sapiens
ttgagtattgtttaaaatgtaa

SEQ ID NO: 1690835 - DNA, 19 bp, Homo sapiens
ttgagtcctaggacttaaa

SEQ ID NO: 1690836 - DNA, 13 bp, Homo sapiens
ttgagtctcaagg

SEQ ID NO: 1690837 - DNA, 22 bp, Homo sapiens
ttgagtctcaagggtggcaggt

SEQ ID NO: 1690838 - DNA, 21 bp, Homo sapiens
ttgagtgacagctttctggga

SEQ ID NO: 1690839 - DNA, 14 bp, Homo sapiens
ttgagtgagaagag

SEQ ID NO: 1690840 - DNA, 21 bp, Homo sapiens
ttgagtgagaagagcttgcac

SEQ ID NO: 1690841 - DNA, 21 bp, Homo sapiens
ttgagtgctgtctccatgttt

SEQ ID NO: 1690842 - DNA, 23 bp, Homo sapiens
ttgagttgacttctgacaaaggt

SEQ ID NO: 1690843 - DNA, 23 bp, Homo sapiens
ttgagtttgtcgctcatgtgtgc

SEQ ID NO: 1690844 - DNA, 21 bp, Homo sapiens
ttgagttttgttttaaaatta

SEQ ID NO: 1690845 - DNA, 14 bp, Homo sapiens
ttgataaagtttct

SEQ ID NO: 1690846 - DNA, 15 bp, Homo sapiens
ttgataaatccatca

SEQ ID NO: 1690847 - DNA, 16 bp, Homo sapiens
ttgataagttcataca

SEQ ID NO: 1690848 - DNA, 17 bp, Homo sapiens
ttgataagttcatacat

SEQ ID NO: 1690849 - DNA, 17 bp, Homo sapiens
ttgataatatataaaca

SEQ ID NO: 1690850 - DNA, 13 bp, Homo sapiens
ttgatacataata

SEQ ID NO: 1690851 - DNA, 13 bp, Homo sapiens
ttgatacccccct

SEQ ID NO: 1690852 - DNA, 15 bp, Homo sapiens
ttgatacccccctct

SEQ ID NO: 1690853 - DNA, 23 bp, Homo sapiens
ttgatacgtccgtgtgtcccaga

SEQ ID NO: 1690854 - DNA, 19 bp, Homo sapiens
ttgatagaaaatccttcag

SEQ ID NO: 1690855 - DNA, 23 bp, Homo sapiens
ttgataggccgttggttgtctga

SEQ ID NO: 1690856 - DNA, 16 bp, Homo sapiens
ttgatagtgatgtatt

SEQ ID NO: 1690857 - DNA, 19 bp, Homo sapiens
ttgatagtgatgtatttta

SEQ ID NO: 1690858 - DNA, 14 bp, Homo sapiens
ttgatatacattgt

SEQ ID NO: 1690859 - DNA, 16 bp, Homo sapiens
ttgatatgcttataca

SEQ ID NO: 1690860 - DNA, 12 bp, Homo sapiens
ttgatatgtaac

SEQ ID NO: 1690861 - DNA, 13 bp, Homo sapiens
ttgatatttgtat

SEQ ID NO: 1690862 - DNA, 22 bp, Homo sapiens
ttgatattttcaacgcagccct

SEQ ID NO: 1690863 - DNA, 17 bp, Homo sapiens
ttgatatttttatacaa

SEQ ID NO: 1690864 - DNA, 22 bp, Homo sapiens
ttgatcaacatcttttcttgcc

SEQ ID NO: 1690865 - DNA, 17 bp, Homo sapiens
ttgatcacatgcttgaa

SEQ ID NO: 1690866 - DNA, 21 bp, Homo sapiens
ttgatcagccccaccctggcc

SEQ ID NO: 1690867 - DNA, 17 bp, Homo sapiens
ttgatcagtagtttgca

SEQ ID NO: 1690868 - DNA, 18 bp, Homo sapiens
ttgatcattttcccccca

SEQ ID NO: 1690869 - DNA, 19 bp, Homo sapiens
ttgatcattttccccccac

SEQ ID NO: 1690870 - DNA, 20 bp, Homo sapiens
ttgatcccacttcactgtga

SEQ ID NO: 1690871 - DNA, 21 bp, Homo sapiens
ttgatccctgttacccagaga

SEQ ID NO: 1690872 - DNA, 17 bp, Homo sapiens
ttgatctctcttgtcct

SEQ ID NO: 1690873 - DNA, 19 bp, Homo sapiens
ttgatctggaacccagact

SEQ ID NO: 1690874 - DNA, 19 bp, Homo sapiens
ttgatctttttatattctt

SEQ ID NO: 1690875 - DNA, 14 bp, Homo sapiens
ttgatgaaaagctt

SEQ ID NO: 1690876 - DNA, 18 bp, Homo sapiens
ttgatgaaattcttgaag

SEQ ID NO: 1690877 - DNA, 12 bp, Homo sapiens
ttgatgccagag

SEQ ID NO: 1690878 - DNA, 18 bp, Homo sapiens
ttgatgcctgtgaagaac

SEQ ID NO: 1690879 - DNA, 14 bp, Homo sapiens
ttgatggaaaataa

SEQ ID NO: 1690880 - DNA, 15 bp, Homo sapiens
ttgatggaaaataaa

SEQ ID NO: 1690881 - DNA, 16 bp, Homo sapiens
ttgatggctgggtcct

SEQ ID NO: 1690882 - DNA, 12 bp, Homo sapiens
ttgatggggaca

SEQ ID NO: 1690883 - DNA, 12 bp, Homo sapiens
ttgatggggaga

SEQ ID NO: 1690884 - DNA, 14 bp, Homo sapiens
ttgatggggagaaa

SEQ ID NO: 1690885 - DNA, 15 bp, Homo sapiens
ttgatgtaaaatctt

SEQ ID NO: 1690886 - DNA, 18 bp, Homo sapiens
ttgatgtaaaatcttgtc

SEQ ID NO: 1690887 - DNA, 19 bp, Homo sapiens
ttgatgtacagtctgtcat

SEQ ID NO: 1690888 - DNA, 14 bp, Homo sapiens
ttgatgtatatgtt

SEQ ID NO: 1690889 - DNA, 20 bp, Homo sapiens
ttgatgtatggtatctttag

SEQ ID NO: 1690890 - DNA, 16 bp, Homo sapiens
ttgatgtatgtgtgaa

SEQ ID NO: 1690891 - DNA, 20 bp, Homo sapiens
ttgatgtatgtgtgaaacaa

SEQ ID NO: 1690892 - DNA, 21 bp, Homo sapiens
ttgatgtcatgtacttcctgt

SEQ ID NO: 1690893 - DNA, 15 bp, Homo sapiens
ttgatgttacagatt

SEQ ID NO: 1690894 - DNA, 17 bp, Homo sapiens
ttgatgtttcctggaag

SEQ ID NO: 1690895 - DNA, 13 bp, Homo sapiens
ttgatgtttgtgg

SEQ ID NO: 1690896 - DNA, 15 bp, Homo sapiens
ttgatgtttgtggcc

SEQ ID NO: 1690897 - DNA, 17 bp, Homo sapiens
ttgatgtttgtggcctc

SEQ ID NO: 1690898 - DNA, 14 bp, Homo sapiens
ttgattaaaaatgt

SEQ ID NO: 1690899 - DNA, 22 bp, Homo sapiens
ttgattaacaatgtattttaat

SEQ ID NO: 1690900 - DNA, 16 bp, Homo sapiens
ttgattattcaacaca

SEQ ID NO: 1690901 - DNA, 17 bp, Homo sapiens
ttgattcattttcctgt

SEQ ID NO: 1690902 - DNA, 13 bp, Homo sapiens
ttgattcctggtt

SEQ ID NO: 1690903 - DNA, 12 bp, Homo sapiens
ttgattctcctt

SEQ ID NO: 1690904 - DNA, 17 bp, Homo sapiens
ttgattcttatttgatg

SEQ ID NO: 1690905 - DNA, 22 bp, Homo sapiens
ttgattgagaaagatgttccag

SEQ ID NO: 1690906 - DNA, 22 bp, Homo sapiens
ttgattgggaaaacatttgctg

SEQ ID NO: 1690907 - DNA, 22 bp, Homo sapiens
ttgattggttgtgccttccctt

SEQ ID NO: 1690908 - DNA, 15 bp, Homo sapiens
ttgattgtcagctac

SEQ ID NO: 1690909 - DNA, 20 bp, Homo sapiens
ttgatttcaaagttttgttg

SEQ ID NO: 1690910 - DNA, 19 bp, Homo sapiens
ttgatttggtggatgtgat

SEQ ID NO: 1690911 - DNA, 22 bp, Homo sapiens
ttgattttaaaatgtacatgta

SEQ ID NO: 1690912 - DNA, 13 bp, Homo sapiens
ttgattttacaat

SEQ ID NO: 1690913 - DNA, 16 bp, Homo sapiens
ttgatttttactgtgt

SEQ ID NO: 1690914 - DNA, 13 bp, Homo sapiens
ttgcaaaaatcca

SEQ ID NO: 1690915 - DNA, 16 bp, Homo sapiens
ttgcaaaatttccagt

SEQ ID NO: 1690916 - DNA, 22 bp, Homo sapiens
ttgcaaaatttccagtaccttt

SEQ ID NO: 1690917 - DNA, 15 bp, Homo sapiens
ttgcaaagcaatgaa

SEQ ID NO: 1690918 - DNA, 20 bp, Homo sapiens
ttgcaaatgcacatttgtca

SEQ ID NO: 1690919 - DNA, 17 bp, Homo sapiens
ttgcaaattattctagt

SEQ ID NO: 1690920 - DNA, 17 bp, Homo sapiens
ttgcaacaaaatacatt

SEQ ID NO: 1690921 - DNA, 13 bp, Homo sapiens
ttgcaaccaggaa

SEQ ID NO: 1690922 - DNA, 14 bp, Homo sapiens
ttgcaacgtttaca

SEQ ID NO: 1690923 - DNA, 18 bp, Homo sapiens
ttgcaagactcgaataaa

SEQ ID NO: 1690924 - DNA, 20 bp, Homo sapiens
ttgcaagatgtgaattattg

SEQ ID NO: 1690925 - DNA, 19 bp, Homo sapiens
ttgcaagcatgcttgtgaa

SEQ ID NO: 1690926 - DNA, 23 bp, Homo sapiens
ttgcaaggccgctgttcacccac

SEQ ID NO: 1690927 - DNA, 18 bp, Homo sapiens
ttgcaaggtaaaatttta

SEQ ID NO: 1690928 - DNA, 21 bp, Homo sapiens
ttgcaataaatggcttgattt

SEQ ID NO: 1690929 - DNA, 23 bp, Homo sapiens
ttgcaataacttctatattttaa

SEQ ID NO: 1690930 - DNA, 22 bp, Homo sapiens
ttgcaatatctgaagccctccc

SEQ ID NO: 1690931 - DNA, 19 bp, Homo sapiens
ttgcaatggatcagccaag

SEQ ID NO: 1690932 - DNA, 19 bp, Homo sapiens
ttgcacaatattgaacttt

SEQ ID NO: 1690933 - DNA, 18 bp, Homo sapiens
ttgcacaattttgtccta

SEQ ID NO: 1690934 - DNA, 18 bp, Homo sapiens
ttgcacacactcagtgca

SEQ ID NO: 1690935 - DNA, 17 bp, Homo sapiens
ttgcacactcccctgca

SEQ ID NO: 1690936 - DNA, 22 bp, Homo sapiens
ttgcacactcccctgcactgga

SEQ ID NO: 1690937 - DNA, 21 bp, Homo sapiens
ttgcacagccaacgagacaca

SEQ ID NO: 1690938 - DNA, 22 bp, Homo sapiens
ttgcacagccaacgagacacat

SEQ ID NO: 1690939 - DNA, 15 bp, Homo sapiens
ttgcacatcttggct

SEQ ID NO: 1690940 - DNA, 23 bp, Homo sapiens
ttgcacattgttgtttttttaat

SEQ ID NO: 1690941 - DNA, 21 bp, Homo sapiens
ttgcaccccaaagctttcctg

SEQ ID NO: 1690942 - DNA, 15 bp, Homo sapiens
ttgcacccctcccat

SEQ ID NO: 1690943 - DNA, 18 bp, Homo sapiens
ttgcacctgtccccaccc

SEQ ID NO: 1690944 - DNA, 18 bp, Homo sapiens
ttgcacgtcttgctattt

SEQ ID NO: 1690945 - DNA, 15 bp, Homo sapiens
ttgcacgtggcctct

SEQ ID NO: 1690946 - DNA, 17 bp, Homo sapiens
ttgcactcaaatcttaa

SEQ ID NO: 1690947 - DNA, 18 bp, Homo sapiens
ttgcactccacacatctt

SEQ ID NO: 1690948 - DNA, 16 bp, Homo sapiens
ttgcactccagcctgg

SEQ ID NO: 1690949 - DNA, 14 bp, Homo sapiens
ttgcactccagtct

SEQ ID NO: 1690950 - DNA, 20 bp, Homo sapiens
ttgcactctagcctggcaac

SEQ ID NO: 1690951 - DNA, 13 bp, Homo sapiens
ttgcactgtaatg

SEQ ID NO: 1690952 - DNA, 14 bp, Homo sapiens
ttgcacttaaaaat

SEQ ID NO: 1690953 - DNA, 15 bp, Homo sapiens
ttgcacttaatggct

SEQ ID NO: 1690954 - DNA, 15 bp, Homo sapiens
ttgcactttcagact

SEQ ID NO: 1690955 - DNA, 17 bp, Homo sapiens
ttgcagaaaagcacctg

SEQ ID NO: 1690956 - DNA, 18 bp, Homo sapiens
ttgcagaaaagcacctgc

SEQ ID NO: 1690957 - DNA, 20 bp, Homo sapiens
ttgcagaaaagcacctgccg

SEQ ID NO: 1690958 - DNA, 13 bp, Homo sapiens
ttgcagaagaggg

SEQ ID NO: 1690959 - DNA, 16 bp, Homo sapiens
ttgcagaagagggtgt

SEQ ID NO: 1690960 - DNA, 20 bp, Homo sapiens
ttgcagaagagggtgtgttt

SEQ ID NO: 1690961 - DNA, 20 bp, Homo sapiens
ttgcagactagaattctagt

SEQ ID NO: 1690962 - DNA, 12 bp, Homo sapiens
ttgcagagactc

SEQ ID NO: 1690963 - DNA, 21 bp, Homo sapiens
ttgcagagtggaaactcagcc

SEQ ID NO: 1690964 - DNA, 22 bp, Homo sapiens
ttgcagagtggaaactcagccg

SEQ ID NO: 1690965 - DNA, 22 bp, Homo sapiens
ttgcagataaactgatgtttga

SEQ ID NO: 1690966 - DNA, 17 bp, Homo sapiens
ttgcagcatgagacttt

SEQ ID NO: 1690967 - DNA, 15 bp, Homo sapiens
ttgcagcatttacta

SEQ ID NO: 1690968 - DNA, 15 bp, Homo sapiens
ttgcagcccttgtga

SEQ ID NO: 1690969 - DNA, 21 bp, Homo sapiens
ttgcagcccttgtgatgtgat

SEQ ID NO: 1690970 - DNA, 14 bp, Homo sapiens
ttgcagctggccca

SEQ ID NO: 1690971 - DNA, 14 bp, Homo sapiens
ttgcagcttcaact

SEQ ID NO: 1690972 - DNA, 21 bp, Homo sapiens
ttgcagctttatgttcatttg

SEQ ID NO: 1690973 - DNA, 16 bp, Homo sapiens
ttgcaggattcccttc

SEQ ID NO: 1690974 - DNA, 23 bp, Homo sapiens
ttgcaggtgggggttgctgtata

SEQ ID NO: 1690975 - DNA, 14 bp, Homo sapiens
ttgcagtcatagaa

SEQ ID NO: 1690976 - DNA, 16 bp, Homo sapiens
ttgcagtgagctgaga

SEQ ID NO: 1690977 - DNA, 18 bp, Homo sapiens
ttgcagtggcctggccgt

SEQ ID NO: 1690978 - DNA, 17 bp, Homo sapiens
ttgcagtggcttttcat

SEQ ID NO: 1690979 - DNA, 13 bp, Homo sapiens
ttgcagttcacct

SEQ ID NO: 1690980 - DNA, 16 bp, Homo sapiens
ttgcatactttgtatt

SEQ ID NO: 1690981 - DNA, 17 bp, Homo sapiens
ttgcatactttgtattt

SEQ ID NO: 1690982 - DNA, 21 bp, Homo sapiens
ttgcatactttgtattttgat

SEQ ID NO: 1690983 - DNA, 23 bp, Homo sapiens
ttgcatagtaccaatcattttaa

SEQ ID NO: 1690984 - DNA, 15 bp, Homo sapiens
ttgcatatcaccctt

SEQ ID NO: 1690985 - DNA, 20 bp, Homo sapiens
ttgcatatcacccttccctg

SEQ ID NO: 1690986 - DNA, 15 bp, Homo sapiens
ttgcatattttgaga

SEQ ID NO: 1690987 - DNA, 16 bp, Homo sapiens
ttgcatattttgagaa

SEQ ID NO: 1690988 - DNA, 21 bp, Homo sapiens
ttgcatattttgagaaactgc

SEQ ID NO: 1690989 - DNA, 15 bp, Homo sapiens
ttgcatccattgttg

SEQ ID NO: 1690990 - DNA, 17 bp, Homo sapiens
ttgcatctgaaatagga

SEQ ID NO: 1690991 - DNA, 13 bp, Homo sapiens
ttgcatctgggcc

SEQ ID NO: 1690992 - DNA, 22 bp, Homo sapiens
ttgcatgaattactgtatataa

SEQ ID NO: 1690993 - DNA, 17 bp, Homo sapiens
ttgcatgatatcttcaa

SEQ ID NO: 1690994 - DNA, 13 bp, Homo sapiens
ttgcatgcatgca

SEQ ID NO: 1690995 - DNA, 22 bp, Homo sapiens
ttgcattccagagttaaaatgt

SEQ ID NO: 1690996 - DNA, 21 bp, Homo sapiens
ttgcatttaaaacagacactg

SEQ ID NO: 1690997 - DNA, 22 bp, Homo sapiens
ttgcatttaaaacagacactgg

SEQ ID NO: 1690998 - DNA, 15 bp, Homo sapiens
ttgcatttatggtca

SEQ ID NO: 1690999 - DNA, 14 bp, Homo sapiens
ttgcatttcagaaa

SEQ ID NO: 1691000 - DNA, 19 bp, Homo sapiens
ttgcatttctcttcctaaa

SEQ ID NO: 1691001 - DNA, 13 bp, Homo sapiens
ttgcatttctgct

SEQ ID NO: 1691002 - DNA, 14 bp, Homo sapiens
ttgccaaaatacca

SEQ ID NO: 1691003 - DNA, 20 bp, Homo sapiens
ttgccaaaataccagagcct

SEQ ID NO: 1691004 - DNA, 23 bp, Homo sapiens
ttgccaaaataccagagccttca

SEQ ID NO: 1691005 - DNA, 19 bp, Homo sapiens
ttgccaaattgctgcatat

SEQ ID NO: 1691006 - DNA, 22 bp, Homo sapiens
ttgccaaccttatagggatgag

SEQ ID NO: 1691007 - DNA, 12 bp, Homo sapiens
ttgccaataaag

SEQ ID NO: 1691008 - DNA, 22 bp, Homo sapiens
ttgccaatggtgtagctgtcct

SEQ ID NO: 1691009 - DNA, 14 bp, Homo sapiens
ttgccacagctttt

SEQ ID NO: 1691010 - DNA, 18 bp, Homo sapiens
ttgccacagcttttgcaa

SEQ ID NO: 1691011 - DNA, 16 bp, Homo sapiens
ttgccaccaggagaac

SEQ ID NO: 1691012 - DNA, 15 bp, Homo sapiens
ttgccacccccagtt

SEQ ID NO: 1691013 - DNA, 15 bp, Homo sapiens
ttgccacctgttaaa

SEQ ID NO: 1691014 - DNA, 13 bp, Homo sapiens
ttgccactctcct

SEQ ID NO: 1691015 - DNA, 22 bp, Homo sapiens
ttgccactttggcttctcctgt

SEQ ID NO: 1691016 - DNA, 24 bp, Homo sapiens
ttgccactttggcttctcctgtga

SEQ ID NO: 1691017 - DNA, 14 bp, Homo sapiens
ttgccagacttaaa

SEQ ID NO: 1691018 - DNA, 15 bp, Homo sapiens
ttgccagagcaggag

SEQ ID NO: 1691019 - DNA, 13 bp, Homo sapiens
ttgccagcacagg

SEQ ID NO: 1691020 - DNA, 21 bp, Homo sapiens
ttgccagcacaggggccccag

SEQ ID NO: 1691021 - DNA, 12 bp, Homo sapiens
ttgccagccaga

SEQ ID NO: 1691022 - DNA, 18 bp, Homo sapiens
ttgccagccagaagcctc

SEQ ID NO: 1691023 - DNA, 15 bp, Homo sapiens
ttgccaggacatgca

SEQ ID NO: 1691024 - DNA, 16 bp, Homo sapiens
ttgccaggacatgcaa

SEQ ID NO: 1691025 - DNA, 19 bp, Homo sapiens
ttgccagtattatgcatat

SEQ ID NO: 1691026 - DNA, 15 bp, Homo sapiens
ttgccagtcagcaac

SEQ ID NO: 1691027 - DNA, 18 bp, Homo sapiens
ttgccagttttccctgga

SEQ ID NO: 1691028 - DNA, 22 bp, Homo sapiens
ttgccatactttgtctgaaaaa

SEQ ID NO: 1691029 - DNA, 13 bp, Homo sapiens
ttgccatcactgg

SEQ ID NO: 1691030 - DNA, 22 bp, Homo sapiens
ttgccatcactggtccaggtct

SEQ ID NO: 1691031 - DNA, 14 bp, Homo sapiens
ttgccatgcaggaa

SEQ ID NO: 1691032 - DNA, 22 bp, Homo sapiens
ttgccattcaaggcttatttat

SEQ ID NO: 1691033 - DNA, 17 bp, Homo sapiens
ttgccattctcttgcat

SEQ ID NO: 1691034 - DNA, 23 bp, Homo sapiens
ttgccatttttctataaatcagt

SEQ ID NO: 1691035 - DNA, 14 bp, Homo sapiens
ttgcccacacactt

SEQ ID NO: 1691036 - DNA, 15 bp, Homo sapiens
ttgcccacacacttt

SEQ ID NO: 1691037 - DNA, 19 bp, Homo sapiens
ttgcccactgcctgcctcc

SEQ ID NO: 1691038 - DNA, 17 bp, Homo sapiens
ttgcccagagatgcctc

SEQ ID NO: 1691039 - DNA, 18 bp, Homo sapiens
ttgcccagagatgcctcc

SEQ ID NO: 1691040 - DNA, 15 bp, Homo sapiens
ttgcccagcagctca

SEQ ID NO: 1691041 - DNA, 17 bp, Homo sapiens
ttgcccagggctcagcc

SEQ ID NO: 1691042 - DNA, 20 bp, Homo sapiens
ttgcccagtacatttaaatt

SEQ ID NO: 1691043 - DNA, 17 bp, Homo sapiens
ttgcccatcctgactga

SEQ ID NO: 1691044 - DNA, 14 bp, Homo sapiens
ttgccccaagtcct

SEQ ID NO: 1691045 - DNA, 16 bp, Homo sapiens
ttgccccacctccccc

SEQ ID NO: 1691046 - DNA, 18 bp, Homo sapiens
ttgccccagacctggaag

SEQ ID NO: 1691047 - DNA, 19 bp, Homo sapiens
ttgccccagacctggaaga

SEQ ID NO: 1691048 - DNA, 19 bp, Homo sapiens
ttgcccccgacggctgtga

SEQ ID NO: 1691049 - DNA, 14 bp, Homo sapiens
ttgccccctctcac

SEQ ID NO: 1691050 - DNA, 13 bp, Homo sapiens
ttgcccctgagac

SEQ ID NO: 1691051 - DNA, 14 bp, Homo sapiens
ttgcccctggcttt

SEQ ID NO: 1691052 - DNA, 18 bp, Homo sapiens
ttgcccctggctttgcct

SEQ ID NO: 1691053 - DNA, 22 bp, Homo sapiens
ttgcccgccagcctcagtgcca

SEQ ID NO: 1691054 - DNA, 23 bp, Homo sapiens
ttgcccgccagcctcagtgccac

SEQ ID NO: 1691055 - DNA, 15 bp, Homo sapiens
ttgccctccgcctgg

SEQ ID NO: 1691056 - DNA, 17 bp, Homo sapiens
ttgccctccgcctggga

SEQ ID NO: 1691057 - DNA, 10 bp, Homo sapiens
ttgccctggt

SEQ ID NO: 1691058 - DNA, 18 bp, Homo sapiens
ttgcccttcacagtgttt

SEQ ID NO: 1691059 - DNA, 13 bp, Homo sapiens
ttgcccttccctg

SEQ ID NO: 1691060 - DNA, 14 bp, Homo sapiens
ttgcccttccctgt

SEQ ID NO: 1691061 - DNA, 19 bp, Homo sapiens
ttgcccttccctgtccctc

SEQ ID NO: 1691062 - DNA, 15 bp, Homo sapiens
ttgccgtctaggatt

SEQ ID NO: 1691063 - DNA, 22 bp, Homo sapiens
ttgccgtctaggattgggcctc

SEQ ID NO: 1691064 - DNA, 17 bp, Homo sapiens
ttgcctaaatccaaaga

SEQ ID NO: 1691065 - DNA, 15 bp, Homo sapiens
ttgcctacaataaaa

SEQ ID NO: 1691066 - DNA, 17 bp, Homo sapiens
ttgcctactatgccaga

SEQ ID NO: 1691067 - DNA, 17 bp, Homo sapiens
ttgcctagaaatatctt

SEQ ID NO: 1691068 - DNA, 23 bp, Homo sapiens
ttgcctagaaatatctttctctt

SEQ ID NO: 1691069 - DNA, 20 bp, Homo sapiens
ttgcctatggatcaaagaaa

SEQ ID NO: 1691070 - DNA, 17 bp, Homo sapiens
ttgcctcaactccagga

SEQ ID NO: 1691071 - DNA, 22 bp, Homo sapiens
ttgcctccccatttcccatctg

SEQ ID NO: 1691072 - DNA, 17 bp, Homo sapiens
ttgcctctgccctggat

SEQ ID NO: 1691073 - DNA, 17 bp, Homo sapiens
ttgcctctgtccccttc

SEQ ID NO: 1691074 - DNA, 20 bp, Homo sapiens
ttgcctctgtccccttctct

SEQ ID NO: 1691075 - DNA, 13 bp, Homo sapiens
ttgcctctgtgct

SEQ ID NO: 1691076 - DNA, 15 bp, Homo sapiens
ttgcctgcagggcca

SEQ ID NO: 1691077 - DNA, 14 bp, Homo sapiens
ttgcctggactgac

SEQ ID NO: 1691078 - DNA, 13 bp, Homo sapiens
ttgccttaaaata

SEQ ID NO: 1691079 - DNA, 17 bp, Homo sapiens
ttgccttattaaagttc

SEQ ID NO: 1691080 - DNA, 17 bp, Homo sapiens
ttgccttatttgtctgt

SEQ ID NO: 1691081 - DNA, 22 bp, Homo sapiens
ttgccttatttgtctgtaaaaa

SEQ ID NO: 1691082 - DNA, 19 bp, Homo sapiens
ttgccttcttcacccagct

SEQ ID NO: 1691083 - DNA, 16 bp, Homo sapiens
ttgccttgctgtttgt

SEQ ID NO: 1691084 - DNA, 13 bp, Homo sapiens
ttgcctttaacag

SEQ ID NO: 1691085 - DNA, 17 bp, Homo sapiens
ttgcctttcgaggcctg

SEQ ID NO: 1691086 - DNA, 17 bp, Homo sapiens
ttgcctttctgtgttta

SEQ ID NO: 1691087 - DNA, 19 bp, Homo sapiens
ttgcctttctgtgtttatt

SEQ ID NO: 1691088 - DNA, 14 bp, Homo sapiens
ttgcctttgaggtt

SEQ ID NO: 1691089 - DNA, 12 bp, Homo sapiens
ttgcgccactgc

SEQ ID NO: 1691090 - DNA, 13 bp, Homo sapiens
ttgcgccactgca

SEQ ID NO: 1691091 - DNA, 22 bp, Homo sapiens
ttgcgctctcaagaccagagac

SEQ ID NO: 1691092 - DNA, 23 bp, Homo sapiens
ttgcgctggtggaccacaggcat

SEQ ID NO: 1691093 - DNA, 15 bp, Homo sapiens
ttgcgtacacagaga

SEQ ID NO: 1691094 - DNA, 18 bp, Homo sapiens
ttgcgtacacagagaagg

SEQ ID NO: 1691095 - DNA, 23 bp, Homo sapiens
ttgcgtacacagagaaggctatg

SEQ ID NO: 1691096 - DNA, 16 bp, Homo sapiens
ttgcgtacttgtaata

SEQ ID NO: 1691097 - DNA, 15 bp, Homo sapiens
ttgcgtcctgcagag

SEQ ID NO: 1691098 - DNA, 16 bp, Homo sapiens
ttgcgttacacccttt

SEQ ID NO: 1691099 - DNA, 13 bp, Homo sapiens
ttgctaaaaaata

SEQ ID NO: 1691100 - DNA, 20 bp, Homo sapiens
ttgctaaaaaataaataaaa

SEQ ID NO: 1691101 - DNA, 21 bp, Homo sapiens
ttgctaaagcactttgcactt

SEQ ID NO: 1691102 - DNA, 20 bp, Homo sapiens
ttgctaaatacaacactgat

SEQ ID NO: 1691103 - DNA, 17 bp, Homo sapiens
ttgctaaattgattgaa

SEQ ID NO: 1691104 - DNA, 14 bp, Homo sapiens
ttgctaactgggtt

SEQ ID NO: 1691105 - DNA, 15 bp, Homo sapiens
ttgctaactgggtta

SEQ ID NO: 1691106 - DNA, 20 bp, Homo sapiens
ttgctaactgggttaaatat

SEQ ID NO: 1691107 - DNA, 13 bp, Homo sapiens
ttgctaactggtt

SEQ ID NO: 1691108 - DNA, 18 bp, Homo sapiens
ttgtcttgtacttctgtg

SEQ ID NO: 1691109 - DNA, 13 bp, Homo sapiens
ttgtcttgtggag

SEQ ID NO: 1691110 - DNA, 14 bp, Homo sapiens
ttgtctttaaacag

SEQ ID NO: 1691111 - DNA, 23 bp, Homo sapiens
ttgtctttgtaatgtcaccacct

SEQ ID NO: 1691112 - DNA, 14 bp, Homo sapiens
ttgtcttttgagct

SEQ ID NO: 1691113 - DNA, 21 bp, Homo sapiens
ttgtcttttttttcctttgaa

SEQ ID NO: 1691114 - DNA, 18 bp, Homo sapiens
ttgtgaaacacagctgtt

SEQ ID NO: 1691115 - DNA, 22 bp, Homo sapiens
ttgtgaaagaaagctgagaaga

SEQ ID NO: 1691116 - DNA, 18 bp, Homo sapiens
ttgtgaactggaagaaag

SEQ ID NO: 1691117 - DNA, 18 bp, Homo sapiens
ttgtgaattaggctgtaa

SEQ ID NO: 1691118 - DNA, 23 bp, Homo sapiens
ttgtgaattaggctgtaactact

SEQ ID NO: 1691119 - DNA, 16 bp, Homo sapiens
ttgtgacaagaataat

SEQ ID NO: 1691120 - DNA, 12 bp, Homo sapiens
ttgtgacagtgc

SEQ ID NO: 1691121 - DNA, 15 bp, Homo sapiens
ttgtgacagtgcctc

SEQ ID NO: 1691122 - DNA, 21 bp, Homo sapiens
ttgtgacagtgcctcttccag

SEQ ID NO: 1691123 - DNA, 13 bp, Homo sapiens
ttgtgacattaaa

SEQ ID NO: 1691124 - DNA, 14 bp, Homo sapiens
ttgtgacattaaaa

SEQ ID NO: 1691125 - DNA, 20 bp, Homo sapiens
ttgtgaccaatacatttgta

SEQ ID NO: 1691126 - DNA, 14 bp, Homo sapiens
ttgtgactgaaggg

SEQ ID NO: 1691127 - DNA, 17 bp, Homo sapiens
ttgtgagcatcagaggg

SEQ ID NO: 1691128 - DNA, 23 bp, Homo sapiens
ttgtgaggattatgggtcctgca

SEQ ID NO: 1691129 - DNA, 17 bp, Homo sapiens
ttgtgatattaaatttc

SEQ ID NO: 1691130 - DNA, 13 bp, Homo sapiens
ttgtgatcctaaa

SEQ ID NO: 1691131 - DNA, 18 bp, Homo sapiens
ttgtgattatttcacttt

SEQ ID NO: 1691132 - DNA, 23 bp, Homo sapiens
ttgtgattatttcactttagatg

SEQ ID NO: 1691133 - DNA, 15 bp, Homo sapiens
ttgtgattggcctgt

SEQ ID NO: 1691134 - DNA, 15 bp, Homo sapiens
ttgtgattggctgca

SEQ ID NO: 1691135 - DNA, 21 bp, Homo sapiens
ttgtgcaaaagcttcaaatta

SEQ ID NO: 1691136 - DNA, 21 bp, Homo sapiens
ttgtgcacaagtctttccaga

SEQ ID NO: 1691137 - DNA, 14 bp, Homo sapiens
ttgtgcacatttct

SEQ ID NO: 1691138 - DNA, 19 bp, Homo sapiens
ttgtgcaccctctatccca

SEQ ID NO: 1691139 - DNA, 15 bp, Homo sapiens
ttgtgcagaatctct

SEQ ID NO: 1691140 - DNA, 13 bp, Homo sapiens
ttgtgcattcttt

SEQ ID NO: 1691141 - DNA, 22 bp, Homo sapiens
ttgtgccatagtcacatggcct

SEQ ID NO: 1691142 - DNA, 12 bp, Homo sapiens
ttgtgccatctg

SEQ ID NO: 1691143 - DNA, 19 bp, Homo sapiens
ttgtgcccacccagggaag

SEQ ID NO: 1691144 - DNA, 17 bp, Homo sapiens
ttgtgccccttcactca

SEQ ID NO: 1691145 - DNA, 15 bp, Homo sapiens
ttgtgccgtaattat

SEQ ID NO: 1691146 - DNA, 22 bp, Homo sapiens
ttgtgcctccttggtaaataca

SEQ ID NO: 1691147 - DNA, 13 bp, Homo sapiens
ttgtgccttccct

SEQ ID NO: 1691148 - DNA, 10 bp, Homo sapiens
ttgtgccttt

SEQ ID NO: 1691149 - DNA, 14 bp, Homo sapiens
ttgtgcctttggcc

SEQ ID NO: 1691150 - DNA, 16 bp, Homo sapiens
ttgtgctagaaatttt

SEQ ID NO: 1691151 - DNA, 14 bp, Homo sapiens
ttgtgctagaatac

SEQ ID NO: 1691152 - DNA, 16 bp, Homo sapiens
ttgtgctcataaattg

SEQ ID NO: 1691153 - DNA, 23 bp, Homo sapiens
ttgtgctcctcttgattcctggt

SEQ ID NO: 1691154 - DNA, 23 bp, Homo sapiens
ttgtgctctatagcagacactaa

SEQ ID NO: 1691155 - DNA, 14 bp, Homo sapiens
ttgtgcttgtttac

SEQ ID NO: 1691156 - DNA, 14 bp, Homo sapiens
ttgtgcttttcctg

SEQ ID NO: 1691157 - DNA, 15 bp, Homo sapiens
ttgtgcttttcctga

SEQ ID NO: 1691158 - DNA, 21 bp, Homo sapiens
ttgtgcttttctgttttcaag

SEQ ID NO: 1691159 - DNA, 18 bp, Homo sapiens
ttgtggaaagcctctgct

SEQ ID NO: 1691160 - DNA, 20 bp, Homo sapiens
ttgtggaaagtagctgctag

SEQ ID NO: 1691161 - DNA, 19 bp, Homo sapiens
ttgtggccccttttacttt

SEQ ID NO: 1691162 - DNA, 11 bp, Homo sapiens
ttgtggcctca

SEQ ID NO: 1691163 - DNA, 13 bp, Homo sapiens
ttgtggcctcaga

SEQ ID NO: 1691164 - DNA, 14 bp, Homo sapiens
ttgtggctttatga

SEQ ID NO: 1691165 - DNA, 17 bp, Homo sapiens
ttgtgggtttctctgtg

SEQ ID NO: 1691166 - DNA, 18 bp, Homo sapiens
ttgtgggtttctctgtgc

SEQ ID NO: 1691167 - DNA, 11 bp, Homo sapiens
ttgtggtgtga

SEQ ID NO: 1691168 - DNA, 23 bp, Homo sapiens
ttgtggtgtgaccatgttcatta

SEQ ID NO: 1691169 - DNA, 17 bp, Homo sapiens
ttgtggttccatgcagc

SEQ ID NO: 1691170 - DNA, 16 bp, Homo sapiens
ttgtggttgaaatctg

SEQ ID NO: 1691171 - DNA, 21 bp, Homo sapiens
ttgtgtaaaaaatggaaaaaa

SEQ ID NO: 1691172 - DNA, 22 bp, Homo sapiens
ttgtgtaacaattttaatgcta

SEQ ID NO: 1691173 - DNA, 22 bp, Homo sapiens
ttgtgtacatagagcaatgttg

SEQ ID NO: 1691174 - DNA, 20 bp, Homo sapiens
ttgtgtagccccttttcttt

SEQ ID NO: 1691175 - DNA, 19 bp, Homo sapiens
ttgtgtatatgttggttta

SEQ ID NO: 1691176 - DNA, 13 bp, Homo sapiens
ttgtgtatgtact

SEQ ID NO: 1691177 - DNA, 15 bp, Homo sapiens
ttgtgtattgatgca

SEQ ID NO: 1691178 - DNA, 18 bp, Homo sapiens
ttgtgtattgatgcaata

SEQ ID NO: 1691179 - DNA, 15 bp, Homo sapiens
ttgtgtctgtacacg

SEQ ID NO: 1691180 - DNA, 22 bp, Homo sapiens
ttgtgtctgtgccctccaaaga

SEQ ID NO: 1691181 - DNA, 20 bp, Homo sapiens
ttgtttcattgactatcaaa

SEQ ID NO: 1691182 - DNA, 19 bp, Homo sapiens
ttgtttcctcttccaaagt

SEQ ID NO: 1691183 - DNA, 21 bp, Homo sapiens
ttgtttctgacccactgatct

SEQ ID NO: 1691184 - DNA, 13 bp, Homo sapiens
ttgtttcttccaa

SEQ ID NO: 1691185 - DNA, 18 bp, Homo sapiens
ttgtttgaggcaaatcta

SEQ ID NO: 1691186 - DNA, 23 bp, Homo sapiens
ttgtttgaggcaaatctaaaatt

SEQ ID NO: 1691187 - DNA, 12 bp, Homo sapiens
ttgtttgcactg

SEQ ID NO: 1691188 - DNA, 15 bp, Homo sapiens
ttgtttgccatactt

SEQ ID NO: 1691189 - DNA, 12 bp, Homo sapiens
ttgtttgctgct

SEQ ID NO: 1691190 - DNA, 14 bp, Homo sapiens
ttgtttgctgctat

SEQ ID NO: 1691191 - DNA, 21 bp, Homo sapiens
ttgtttgggtatcctgcccag

SEQ ID NO: 1691192 - DNA, 19 bp, Homo sapiens
ttgtttggtaaatgtttct

SEQ ID NO: 1691193 - DNA, 22 bp, Homo sapiens
ttgtttgtaaataagagatttg

SEQ ID NO: 1691194 - DNA, 21 bp, Homo sapiens
ttgtttgtcagcatctgacca

SEQ ID NO: 1691195 - DNA, 20 bp, Homo sapiens
ttgttttaaaattaaagcta

SEQ ID NO: 1691196 - DNA, 15 bp, Homo sapiens
ttgttttaattttag

SEQ ID NO: 1691197 - DNA, 12 bp, Homo sapiens
ttgttttacaat

SEQ ID NO: 1691198 - DNA, 16 bp, Homo sapiens
ttgttttatatacctg

SEQ ID NO: 1691199 - DNA, 17 bp, Homo sapiens
ttgttttattttaatag

SEQ ID NO: 1691200 - DNA, 14 bp, Homo sapiens
ttgttttcacttgt

SEQ ID NO: 1691201 - DNA, 18 bp, Homo sapiens
ttgttttcacttgtattg

SEQ ID NO: 1691202 - DNA, 13 bp, Homo sapiens
ttgttttcagtgt

SEQ ID NO: 1691203 - DNA, 14 bp, Homo sapiens
ttgttttcattatc

SEQ ID NO: 1691204 - DNA, 18 bp, Homo sapiens
ttgttttctgactaatta

SEQ ID NO: 1691205 - DNA, 20 bp, Homo sapiens
ttgttttcttctgtatgtta

SEQ ID NO: 1691206 - DNA, 15 bp, Homo sapiens
ttgttttgaaaataa

SEQ ID NO: 1691207 - DNA, 19 bp, Homo sapiens
ttgttttgacggatgattg

SEQ ID NO: 1691208 - DNA, 17 bp, Homo sapiens
ttgttttgagctttcca

SEQ ID NO: 1691209 - DNA, 12 bp, Homo sapiens
ttgttttgcttt

SEQ ID NO: 1691210 - DNA, 13 bp, Homo sapiens
ttgttttggaata

SEQ ID NO: 1691211 - DNA, 13 bp, Homo sapiens
ttgttttgtacag

SEQ ID NO: 1691212 - DNA, 23 bp, Homo sapiens
ttgtttttgaatttaaataaagt

SEQ ID NO: 1691213 - DNA, 22 bp, Homo sapiens
ttgtttttgagtactgtactat

SEQ ID NO: 1691214 - DNA, 16 bp, Homo sapiens
ttgttttttaaagcaa

SEQ ID NO: 1691215 - DNA, 13 bp, Homo sapiens
ttgttttttaagt

SEQ ID NO: 1691216 - DNA, 16 bp, Homo sapiens
ttgttttttgtaacta

SEQ ID NO: 1691217 - DNA, 15 bp, Homo sapiens
ttgtttttttcctca

SEQ ID NO: 1691218 - DNA, 23 bp, Homo sapiens
ttgtttttttcctcatgtaacat

SEQ ID NO: 1691219 - DNA, 19 bp, Homo sapiens
ttgttttttttttccactt

SEQ ID NO: 1691220 - DNA, 19 bp, Homo sapiens
tttaaaaaaagctaaatta

SEQ ID NO: 1691221 - DNA, 23 bp, Homo sapiens
tttaaaaaacaaaaaccagcagg

SEQ ID NO: 1691222 - DNA, 15 bp, Homo sapiens
tttaaaaaagactga

SEQ ID NO: 1691223 - DNA, 18 bp, Homo sapiens
tttaaaaaagactgaaca

SEQ ID NO: 1691224 - DNA, 22 bp, Homo sapiens
tttaaaaaagactgaacatgtt

SEQ ID NO: 1691225 - DNA, 22 bp, Homo sapiens
tttaaaaaataaataaaaacta

SEQ ID NO: 1691226 - DNA, 13 bp, Homo sapiens
tttaaaaactgga

SEQ ID NO: 1691227 - DNA, 17 bp, Homo sapiens
tttaaaaagaaatctgg

SEQ ID NO: 1691228 - DNA, 23 bp, Homo sapiens
tttaaaaaggaaatttgtttgta

SEQ ID NO: 1691229 - DNA, 23 bp, Homo sapiens
tttaaattgctcacagttattac

SEQ ID NO: 1691230 - DNA, 15 bp, Homo sapiens
tttaacaaatctaat

SEQ ID NO: 1691231 - DNA, 16 bp, Homo sapiens
tttaacaatctaacaa

SEQ ID NO: 1691232 - DNA, 21 bp, Homo sapiens
tttaacaccttttttgtgggg

SEQ ID NO: 1691233 - DNA, 12 bp, Homo sapiens
tttaacagaaat

SEQ ID NO: 1691234 - DNA, 19 bp, Homo sapiens
tttaacagaaattgtatat

SEQ ID NO: 1691235 - DNA, 16 bp, Homo sapiens
tttaacagtcatttaa

SEQ ID NO: 1691236 - DNA, 14 bp, Homo sapiens
tttaacagtgcaaa

SEQ ID NO: 1691237 - DNA, 19 bp, Homo sapiens
tttaacatacaagaaaatg

SEQ ID NO: 1691238 - DNA, 21 bp, Homo sapiens
tttaacatagtcctgttacta

SEQ ID NO: 1691239 - DNA, 13 bp, Homo sapiens
tttaacattcctc

SEQ ID NO: 1691240 - DNA, 22 bp, Homo sapiens
tttaacattcctcatgaatgta

SEQ ID NO: 1691241 - DNA, 17 bp, Homo sapiens
tttaaccattttaacct

SEQ ID NO: 1691242 - DNA, 14 bp, Homo sapiens
tttaacggcagtgt

SEQ ID NO: 1691243 - DNA, 16 bp, Homo sapiens
tttaactaataaaata

SEQ ID NO: 1691244 - DNA, 15 bp, Homo sapiens
tttaactagaattta

SEQ ID NO: 1691245 - DNA, 14 bp, Homo sapiens
tttaactgagaaat

SEQ ID NO: 1691246 - DNA, 13 bp, Homo sapiens
tttaactgctgca

SEQ ID NO: 1691247 - DNA, 18 bp, Homo sapiens
tttaactggtgaagagaa

SEQ ID NO: 1691248 - DNA, 15 bp, Homo sapiens
tttaactgtggatat

SEQ ID NO: 1691249 - DNA, 14 bp, Homo sapiens
tttaactttaatac

SEQ ID NO: 1691250 - DNA, 22 bp, Homo sapiens
tttaacttttgaaaagaccaag

SEQ ID NO: 1691251 - DNA, 18 bp, Homo sapiens
tttaagaaaaaataacac

SEQ ID NO: 1691252 - DNA, 20 bp, Homo sapiens
tttaagaaaacaccatggag

SEQ ID NO: 1691253 - DNA, 12 bp, Homo sapiens
tttaagaaaata

SEQ ID NO: 1691254 - DNA, 21 bp, Homo sapiens
tttaagaatatctgtaatggt

SEQ ID NO: 1691255 - DNA, 16 bp, Homo sapiens
tttaagaccagcctgg

SEQ ID NO: 1691256 - DNA, 14 bp, Homo sapiens
tttaagataattat

SEQ ID NO: 1691257 - DNA, 16 bp, Homo sapiens
tttaagatatccatct

SEQ ID NO: 1691258 - DNA, 23 bp, Homo sapiens
tttaagatatccatctttttctt

SEQ ID NO: 1691259 - DNA, 17 bp, Homo sapiens
tttaagatccagaaata

SEQ ID NO: 1691260 - DNA, 15 bp, Homo sapiens
tttaagatttgtgtt

SEQ ID NO: 1691261 - DNA, 17 bp, Homo sapiens
tttaagcagactcagct

SEQ ID NO: 1691262 - DNA, 16 bp, Homo sapiens
tttaagcctgaagagc

SEQ ID NO: 1691263 - DNA, 21 bp, Homo sapiens
tttaagcctgcattcttaaca

SEQ ID NO: 1691264 - DNA, 15 bp, Homo sapiens
tttaagccttacaaa

SEQ ID NO: 1691265 - DNA, 17 bp, Homo sapiens
tttaagccttacaaagg

SEQ ID NO: 1691266 - DNA, 18 bp, Homo sapiens
tttaagccttcaaaacta

SEQ ID NO: 1691267 - DNA, 16 bp, Homo sapiens
tttaagctaaaatgtt

SEQ ID NO: 1691268 - DNA, 17 bp, Homo sapiens
tttaagctaaaatgtta

SEQ ID NO: 1691269 - DNA, 20 bp, Homo sapiens
tttaagctgcaaatctgatg

SEQ ID NO: 1691270 - DNA, 12 bp, Homo sapiens
tttaagctgttt

SEQ ID NO: 1691271 - DNA, 19 bp, Homo sapiens
tttaaggataaatcataaa

SEQ ID NO: 1691272 - DNA, 13 bp, Homo sapiens
tttaaggatggat

SEQ ID NO: 1691273 - DNA, 15 bp, Homo sapiens
tttaaggtctgtttg

SEQ ID NO: 1691274 - DNA, 22 bp, Homo sapiens
tttaaggttgcacacagtacac

SEQ ID NO: 1691275 - DNA, 17 bp, Homo sapiens
tttaagtaaaaaagaaa

SEQ ID NO: 1691276 - DNA, 15 bp, Homo sapiens
tttaagtaagacttt

SEQ ID NO: 1691277 - DNA, 21 bp, Homo sapiens
tttaagtatatagtatattta

SEQ ID NO: 1691278 - DNA, 12 bp, Homo sapiens
tttaagtattta

SEQ ID NO: 1691279 - DNA, 20 bp, Homo sapiens
tttaagtatttatatattta

SEQ ID NO: 1691280 - DNA, 15 bp, Homo sapiens
tttaagtctctcgta

SEQ ID NO: 1691281 - DNA, 20 bp, Homo sapiens
tttaagtgacacagacattt

SEQ ID NO: 1691282 - DNA, 22 bp, Homo sapiens
tttaagtgacacagacattttg

SEQ ID NO: 1691283 - DNA, 18 bp, Homo sapiens
tttaagtgctttgtaatg

SEQ ID NO: 1691284 - DNA, 17 bp, Homo sapiens
tttactgtgaaactggc

SEQ ID NO: 1691285 - DNA, 17 bp, Homo sapiens
tttactgtgaagagaat

SEQ ID NO: 1691286 - DNA, 14 bp, Homo sapiens
tttactgttagaat

SEQ ID NO: 1691287 - DNA, 16 bp, Homo sapiens
tttactgttgaactta

SEQ ID NO: 1691288 - DNA, 14 bp, Homo sapiens
tttacttaaagatt

SEQ ID NO: 1691289 - DNA, 23 bp, Homo sapiens
tttacttaaagatttatcaaatc

SEQ ID NO: 1691290 - DNA, 16 bp, Homo sapiens
tttacttcacttcaaa

SEQ ID NO: 1691291 - DNA, 14 bp, Homo sapiens
tttacttcttatac

SEQ ID NO: 1691292 - DNA, 19 bp, Homo sapiens
tttacttcttatacatttg

SEQ ID NO: 1691293 - DNA, 15 bp, Homo sapiens
tttacttgttttgga

SEQ ID NO: 1691294 - DNA, 18 bp, Homo sapiens
tttactttagaagcctgc

SEQ ID NO: 1691295 - DNA, 22 bp, Homo sapiens
tttactttattaatatgagtta

SEQ ID NO: 1691296 - DNA, 15 bp, Homo sapiens
tttacttttaaacag

SEQ ID NO: 1691297 - DNA, 19 bp, Homo sapiens
tttacttttcacactgtct

SEQ ID NO: 1691298 - DNA, 21 bp, Homo sapiens
tttagaaacagaaatagactt

SEQ ID NO: 1691299 - DNA, 13 bp, Homo sapiens
tttagaaatgcat

SEQ ID NO: 1691300 - DNA, 15 bp, Homo sapiens
tttagaaatgcatat

SEQ ID NO: 1691301 - DNA, 12 bp, Homo sapiens
tttagaactcta

SEQ ID NO: 1691302 - DNA, 19 bp, Homo sapiens
tttagaagaagtgtgtcac

SEQ ID NO: 1691303 - DNA, 16 bp, Homo sapiens
tttagaatctagaaat

SEQ ID NO: 1691304 - DNA, 22 bp, Homo sapiens
tttagaatggaggaagaacaac

SEQ ID NO: 1691305 - DNA, 20 bp, Homo sapiens
tttagactaattgtgtttgt

SEQ ID NO: 1691306 - DNA, 15 bp, Homo sapiens
tttagagaggaaaag

SEQ ID NO: 1691307 - DNA, 18 bp, Homo sapiens
tttagagataggaaactg

SEQ ID NO: 1691308 - DNA, 23 bp, Homo sapiens
tttagatatttgcctgtctgttt

SEQ ID NO: 1691309 - DNA, 17 bp, Homo sapiens
tttagatctcctgtatt

SEQ ID NO: 1691310 - DNA, 19 bp, Homo sapiens
tttagattgaaaacttttc

SEQ ID NO: 1691311 - DNA, 22 bp, Homo sapiens
tttagattttcttttttatctt

SEQ ID NO: 1691312 - DNA, 22 bp, Homo sapiens
tttagattttgtgtttattctt

SEQ ID NO: 1691313 - DNA, 23 bp, Homo sapiens
tttagcaatttaatattttgcac

SEQ ID NO: 1691314 - DNA, 11 bp, Homo sapiens
tttagccagat

SEQ ID NO: 1691315 - DNA, 13 bp, Homo sapiens
tttagccagtgac

SEQ ID NO: 1691316 - DNA, 14 bp, Homo sapiens
tttagcccagtgtt

SEQ ID NO: 1691317 - DNA, 17 bp, Homo sapiens
tttagcccagtgttttc

SEQ ID NO: 1691318 - DNA, 22 bp, Homo sapiens
tttagcccagtgttttctttga

SEQ ID NO: 1691319 - DNA, 16 bp, Homo sapiens
tttagcgggactcagt

SEQ ID NO: 1691320 - DNA, 16 bp, Homo sapiens
tttagctatttattgt

SEQ ID NO: 1691321 - DNA, 21 bp, Homo sapiens
tttagctgatgaacttattct

SEQ ID NO: 1691322 - DNA, 13 bp, Homo sapiens
tttagctggccac

SEQ ID NO: 1691323 - DNA, 12 bp, Homo sapiens
tttagctttgga

SEQ ID NO: 1691324 - DNA, 14 bp, Homo sapiens
tttagcttttcctt

SEQ ID NO: 1691325 - DNA, 21 bp, Homo sapiens
tttaggacacatttagatgca

SEQ ID NO: 1691326 - DNA, 21 bp, Homo sapiens
tttaggcttctatgtccaaca

SEQ ID NO: 1691327 - DNA, 16 bp, Homo sapiens
tttaggttctaaagtt

SEQ ID NO: 1691328 - DNA, 18 bp, Homo sapiens
tttaggttctaaagttct

SEQ ID NO: 1691329 - DNA, 23 bp, Homo sapiens
tttaggttctttgctgcattctg

SEQ ID NO: 1691330 - DNA, 18 bp, Homo sapiens
tttagtaatattttactt

SEQ ID NO: 1691331 - DNA, 15 bp, Homo sapiens
tttagtattcattct

SEQ ID NO: 1691332 - DNA, 17 bp, Homo sapiens
tttagtgactgtaatta

SEQ ID NO: 1691333 - DNA, 12 bp, Homo sapiens
tttagtgtctga

SEQ ID NO: 1691334 - DNA, 11 bp, Homo sapiens
tttagttcttt

SEQ ID NO: 1691335 - DNA, 22 bp, Homo sapiens
tttatgaagttaacagtctcat

SEQ ID NO: 1691336 - DNA, 14 bp, Homo sapiens
tttatgagaaactt

SEQ ID NO: 1691337 - DNA, 18 bp, Homo sapiens
tttatgataatagattct

SEQ ID NO: 1691338 - DNA, 19 bp, Homo sapiens
tttatgataatagattctc

SEQ ID NO: 1691339 - DNA, 14 bp, Homo sapiens
tttatgatcagtgt

SEQ ID NO: 1691340 - DNA, 16 bp, Homo sapiens
tttatgcaaaaggttt

SEQ ID NO: 1691341 - DNA, 15 bp, Homo sapiens
tttatgcaaggaagg

SEQ ID NO: 1691342 - DNA, 14 bp, Homo sapiens
tttatgcagacagt

SEQ ID NO: 1691343 - DNA, 18 bp, Homo sapiens
tttatgccggatgtgctt

SEQ ID NO: 1691344 - DNA, 14 bp, Homo sapiens
tttatgctgtattt

SEQ ID NO: 1691345 - DNA, 20 bp, Homo sapiens
tttatgctgtattttaacac

SEQ ID NO: 1691346 - DNA, 18 bp, Homo sapiens
tttatggatatgctgctt

SEQ ID NO: 1691347 - DNA, 22 bp, Homo sapiens
tttatggccacatttaatatct

SEQ ID NO: 1691348 - DNA, 16 bp, Homo sapiens
tttatggctagacagg

SEQ ID NO: 1691349 - DNA, 21 bp, Homo sapiens
tttatggttacttcttctctt

SEQ ID NO: 1691350 - DNA, 21 bp, Homo sapiens
tttatggtttcccccttctac

SEQ ID NO: 1691351 - DNA, 22 bp, Homo sapiens
tttatgtaaactgcattagaaa

SEQ ID NO: 1691352 - DNA, 11 bp, Homo sapiens
tttatgtatta

SEQ ID NO: 1691353 - DNA, 15 bp, Homo sapiens
tttatgtgaattttt

SEQ ID NO: 1691354 - DNA, 20 bp, Homo sapiens
tttatgtgaatttttaagct

SEQ ID NO: 1691355 - DNA, 17 bp, Homo sapiens
tttatgtgctatgcaaa

SEQ ID NO: 1691356 - DNA, 22 bp, Homo sapiens
tttatgtgtgaggagctgctgg

SEQ ID NO: 1691357 - DNA, 13 bp, Homo sapiens
tttatgtgtgtgt

SEQ ID NO: 1691358 - DNA, 17 bp, Homo sapiens
tttatgtgttatgaaca

SEQ ID NO: 1691359 - DNA, 18 bp, Homo sapiens
tttatgtgttatgaacat

SEQ ID NO: 1691360 - DNA, 16 bp, Homo sapiens
tttatgtttaaaaagt

SEQ ID NO: 1691361 - DNA, 18 bp, Homo sapiens
tttatgtttaaaagaaat

SEQ ID NO: 1691362 - DNA, 23 bp, Homo sapiens
tttatgtttgcacttgtgattat

SEQ ID NO: 1691363 - DNA, 14 bp, Homo sapiens
tttatgtttgtctt

SEQ ID NO: 1691364 - DNA, 16 bp, Homo sapiens
tttattaaaaacatga

SEQ ID NO: 1691365 - DNA, 13 bp, Homo sapiens
tttattaaaatct

SEQ ID NO: 1691366 - DNA, 13 bp, Homo sapiens
tttattaaagatg

SEQ ID NO: 1691367 - DNA, 14 bp, Homo sapiens
tttattaaatttat

SEQ ID NO: 1691368 - DNA, 20 bp, Homo sapiens
tttattaagcacgtatttat

SEQ ID NO: 1691369 - DNA, 14 bp, Homo sapiens
tttattaagtctgg

SEQ ID NO: 1691370 - DNA, 22 bp, Homo sapiens
tttattaataaaacaaaatgtt

SEQ ID NO: 1691371 - DNA, 13 bp, Homo sapiens
tttattaatctta

SEQ ID NO: 1691372 - DNA, 21 bp, Homo sapiens
tttattaatgcctctcccgca

SEQ ID NO: 1691373 - DNA, 18 bp, Homo sapiens
tttattaatgttttcaaa

SEQ ID NO: 1691374 - DNA, 17 bp, Homo sapiens
tttattaattttctatg

SEQ ID NO: 1691375 - DNA, 12 bp, Homo sapiens
tttattaccccc

SEQ ID NO: 1691376 - DNA, 11 bp, Homo sapiens
tttattcacat

SEQ ID NO: 1691377 - DNA, 16 bp, Homo sapiens
tttattcactgtaagt

SEQ ID NO: 1691378 - DNA, 18 bp, Homo sapiens
tttattcagtaaacaaat

SEQ ID NO: 1691379 - DNA, 23 bp, Homo sapiens
ttcaaagcatggacatttagaag

SEQ ID NO: 1691380 - DNA, 16 bp, Homo sapiens
ttcaaaggaacattgt

SEQ ID NO: 1691381 - DNA, 20 bp, Homo sapiens
ttcaaagttttgttgtactt

SEQ ID NO: 1691382 - DNA, 14 bp, Homo sapiens
ttcaaatcagtgat

SEQ ID NO: 1691383 - DNA, 12 bp, Homo sapiens
ttcaaatcctca

SEQ ID NO: 1691384 - DNA, 19 bp, Homo sapiens
ttcaaatgggctgctgctt

SEQ ID NO: 1691385 - DNA, 16 bp, Homo sapiens
ttcaaattcttctgaa

SEQ ID NO: 1691386 - DNA, 12 bp, Homo sapiens
ttcaaatttgat

SEQ ID NO: 1691387 - DNA, 14 bp, Homo sapiens
ttcaaatttgatga

SEQ ID NO: 1691388 - DNA, 17 bp, Homo sapiens
ttcaaatttgtgtcata

SEQ ID NO: 1691389 - DNA, 22 bp, Homo sapiens
ttcaacaaatattcactggccc

SEQ ID NO: 1691390 - DNA, 21 bp, Homo sapiens
ttcaacaacgtgagagaaaga

SEQ ID NO: 1691391 - DNA, 15 bp, Homo sapiens
ttcaacaatttcaat

SEQ ID NO: 1691392 - DNA, 21 bp, Homo sapiens
ttcaacacttattttctgaat

SEQ ID NO: 1691393 - DNA, 20 bp, Homo sapiens
ttcaacatttttttttctcc

SEQ ID NO: 1691394 - DNA, 16 bp, Homo sapiens
ttcaaccctcagcctt

SEQ ID NO: 1691395 - DNA, 15 bp, Homo sapiens
ttcaacctctagaat

SEQ ID NO: 1691396 - DNA, 19 bp, Homo sapiens
ttcaacgcagccctgcttt

SEQ ID NO: 1691397 - DNA, 13 bp, Homo sapiens
ttcaactcctggg

SEQ ID NO: 1691398 - DNA, 23 bp, Homo sapiens
ttcaactgtgctcttgttttgtc

SEQ ID NO: 1691399 - DNA, 13 bp, Homo sapiens
ttcaacttttcta

SEQ ID NO: 1691400 - DNA, 14 bp, Homo sapiens
ttcaagaaaataaa

SEQ ID NO: 1691401 - DNA, 13 bp, Homo sapiens
ttcaagaaaggaa

SEQ ID NO: 1691402 - DNA, 16 bp, Homo sapiens
ttcaagaacaagcaat

SEQ ID NO: 1691403 - DNA, 16 bp, Homo sapiens
ttcaagaacctggaaa

SEQ ID NO: 1691404 - DNA, 23 bp, Homo sapiens
ttcaagaataatcacgctttcct

SEQ ID NO: 1691405 - DNA, 21 bp, Homo sapiens
ttcaagaatgaaaaatataat

SEQ ID NO: 1691406 - DNA, 16 bp, Homo sapiens
ttcaagacgaggggca

SEQ ID NO: 1691407 - DNA, 17 bp, Homo sapiens
ttcaagacgaggggcag

SEQ ID NO: 1691408 - DNA, 21 bp, Homo sapiens
ttcaagacttgagcggagccc

SEQ ID NO: 1691409 - DNA, 18 bp, Homo sapiens
ttcaagagctagaaaaat

SEQ ID NO: 1691410 - DNA, 20 bp, Homo sapiens
ttcaagagctagaaaaataa

SEQ ID NO: 1691411 - DNA, 12 bp, Homo sapiens
ttcaagattcta

SEQ ID NO: 1691412 - DNA, 17 bp, Homo sapiens
ttcaagattctaaagct

SEQ ID NO: 1691413 - DNA, 16 bp, Homo sapiens
ttcaagcaatcctccc

SEQ ID NO: 1691414 - DNA, 18 bp, Homo sapiens
ttcaagcacactggaata

SEQ ID NO: 1691415 - DNA, 19 bp, Homo sapiens
ttcaagcacactggaatat

SEQ ID NO: 1691416 - DNA, 23 bp, Homo sapiens
ttcaagcagtcgtgcctgtgtcc

SEQ ID NO: 1691417 - DNA, 20 bp, Homo sapiens
ttcaagcgattctcccgcct

SEQ ID NO: 1691418 - DNA, 11 bp, Homo sapiens
ttcaagctgca

SEQ ID NO: 1691419 - DNA, 12 bp, Homo sapiens
ttcaaggaaagt

SEQ ID NO: 1691420 - DNA, 14 bp, Homo sapiens
ttcaaggcactcta

SEQ ID NO: 1691421 - DNA, 19 bp, Homo sapiens
ttcaaggcactctagattc

SEQ ID NO: 1691422 - DNA, 21 bp, Homo sapiens
ttcaaggcactctagattcca

SEQ ID NO: 1691423 - DNA, 17 bp, Homo sapiens
ttcaaggccttcagttt

SEQ ID NO: 1691424 - DNA, 19 bp, Homo sapiens
ttcaaggccttcagtttat

SEQ ID NO: 1691425 - DNA, 20 bp, Homo sapiens
ttcaaggccttcagtttatt

SEQ ID NO: 1691426 - DNA, 13 bp, Homo sapiens
ttcaaggctcaga

SEQ ID NO: 1691427 - DNA, 16 bp, Homo sapiens
ttcaagggaagaaaca

SEQ ID NO: 1691428 - DNA, 14 bp, Homo sapiens
ttcaagggtaatct

SEQ ID NO: 1691429 - DNA, 14 bp, Homo sapiens
ttcaaggttctaac

SEQ ID NO: 1691430 - DNA, 16 bp, Homo sapiens
ttcaaggttttaaaac

SEQ ID NO: 1691431 - DNA, 16 bp, Homo sapiens
ttcaagtatttaagcc

SEQ ID NO: 1691432 - DNA, 20 bp, Homo sapiens
ttcaagtgattctcctgcct

SEQ ID NO: 1691433 - DNA, 22 bp, Homo sapiens
ttcaagtgcatgctctctgcag

SEQ ID NO: 1691434 - DNA, 15 bp, Homo sapiens
ttcaagtgcctagac

SEQ ID NO: 1691435 - DNA, 18 bp, Homo sapiens
ttcaagtggggctcgcca

SEQ ID NO: 1691436 - DNA, 15 bp, Homo sapiens
ttcaagtgtaaatga

SEQ ID NO: 1691437 - DNA, 17 bp, Homo sapiens
ttcaagttagctcagga

SEQ ID NO: 1691438 - DNA, 12 bp, Homo sapiens
ttcaagttattc

SEQ ID NO: 1691439 - DNA, 20 bp, Homo sapiens
ttcaagttattcaaatttgt

SEQ ID NO: 1691440 - DNA, 22 bp, Homo sapiens
ttcaagttgtaaataatttatt

SEQ ID NO: 1691441 - DNA, 22 bp, Homo sapiens
ttcaagttttgggtatgtttaa

SEQ ID NO: 1691442 - DNA, 23 bp, Homo sapiens
ttcaataaaaaaaagaaatgaaa

SEQ ID NO: 1691443 - DNA, 19 bp, Homo sapiens
ttcaataaagcactgagca

SEQ ID NO: 1691444 - DNA, 14 bp, Homo sapiens
ttcaataccaggga

SEQ ID NO: 1691445 - DNA, 12 bp, Homo sapiens
ttcaatagcttt

SEQ ID NO: 1691446 - DNA, 18 bp, Homo sapiens
ttcaatagtaatataata

SEQ ID NO: 1691447 - DNA, 16 bp, Homo sapiens
ttcaatataagaagca

SEQ ID NO: 1691448 - DNA, 22 bp, Homo sapiens
ttcaatataagaagcaatcttt

SEQ ID NO: 1691449 - DNA, 11 bp, Homo sapiens
ttcaatatcag

SEQ ID NO: 1691450 - DNA, 16 bp, Homo sapiens
ttcaatatgaatctat

SEQ ID NO: 1691451 - DNA, 16 bp, Homo sapiens
ttcaatattgacattt

SEQ ID NO: 1691452 - DNA, 19 bp, Homo sapiens
ttcaatattgacatttgta

SEQ ID NO: 1691453 - DNA, 11 bp, Homo sapiens
ttcaatattta

SEQ ID NO: 1691454 - DNA, 21 bp, Homo sapiens
ttcaatcaactttactgtaat

SEQ ID NO: 1691455 - DNA, 17 bp, Homo sapiens
ttcaatcctacttttcg

SEQ ID NO: 1691456 - DNA, 20 bp, Homo sapiens
ttcaatctcccgctgctgct

SEQ ID NO: 1691457 - DNA, 14 bp, Homo sapiens
ttcaatctgtaaac

SEQ ID NO: 1691458 - DNA, 20 bp, Homo sapiens
ttcaatctgtaaactgtgta

SEQ ID NO: 1691459 - DNA, 13 bp, Homo sapiens
ttcaatcttttaa

SEQ ID NO: 1691460 - DNA, 19 bp, Homo sapiens
ttcaatgattatttgtatt

SEQ ID NO: 1691461 - DNA, 18 bp, Homo sapiens
ttcaatgcgttttgttgt

SEQ ID NO: 1691462 - DNA, 19 bp, Homo sapiens
ttcacaaactacctctgga

SEQ ID NO: 1691463 - DNA, 16 bp, Homo sapiens
ttcacaaactgtgaaa

SEQ ID NO: 1691464 - DNA, 18 bp, Homo sapiens
ttcacaaatatagttgaa

SEQ ID NO: 1691465 - DNA, 23 bp, Homo sapiens
ttcacaaggtgactgggatgtag

SEQ ID NO: 1691466 - DNA, 15 bp, Homo sapiens
ttcacaataaaagct

SEQ ID NO: 1691467 - DNA, 17 bp, Homo sapiens
ttcacaatgtgaaactg

SEQ ID NO: 1691468 - DNA, 13 bp, Homo sapiens
ttcacaatgttaa

SEQ ID NO: 1691469 - DNA, 21 bp, Homo sapiens
ttcacacctgactctgaaatc

SEQ ID NO: 1691470 - DNA, 18 bp, Homo sapiens
ttcacactggtaaatgtt

SEQ ID NO: 1691471 - DNA, 19 bp, Homo sapiens
tttcgactggtccagctct

SEQ ID NO: 1691472 - DNA, 20 bp, Homo sapiens
tttcgccccctgcctgccat

SEQ ID NO: 1691473 - DNA, 19 bp, Homo sapiens
tttcgccgttgaagaggaa

SEQ ID NO: 1691474 - DNA, 16 bp, Homo sapiens
tttcgtaacacagcat

SEQ ID NO: 1691475 - DNA, 21 bp, Homo sapiens
tttcgtccatgtttctcacat

SEQ ID NO: 1691476 - DNA, 16 bp, Homo sapiens
tttcgtctactgcaag

SEQ ID NO: 1691477 - DNA, 15 bp, Homo sapiens
tttcgttaacattga

SEQ ID NO: 1691478 - DNA, 18 bp, Homo sapiens
tttcgttaacattgacca

SEQ ID NO: 1691479 - DNA, 12 bp, Homo sapiens
tttcgttctgct

SEQ ID NO: 1691480 - DNA, 14 bp, Homo sapiens
tttctaaaaaacag

SEQ ID NO: 1691481 - DNA, 16 bp, Homo sapiens
tttctaaaagctttca

SEQ ID NO: 1691482 - DNA, 12 bp, Homo sapiens
tttctaaaatct

SEQ ID NO: 1691483 - DNA, 21 bp, Homo sapiens
tttctaacaaaaaaatatatt

SEQ ID NO: 1691484 - DNA, 17 bp, Homo sapiens
tttctaaccttgaatgc

SEQ ID NO: 1691485 - DNA, 14 bp, Homo sapiens
tttctaactatata

SEQ ID NO: 1691486 - DNA, 15 bp, Homo sapiens
tttctaactatataa

SEQ ID NO: 1691487 - DNA, 16 bp, Homo sapiens
tttctaagaaaatgta

SEQ ID NO: 1691488 - DNA, 13 bp, Homo sapiens
tttctaagattct

SEQ ID NO: 1691489 - DNA, 18 bp, Homo sapiens
tttctaagattctaaagg

SEQ ID NO: 1691490 - DNA, 21 bp, Homo sapiens
tttctaatacgagccttctca

SEQ ID NO: 1691491 - DNA, 18 bp, Homo sapiens
tttctaatccttttcctt

SEQ ID NO: 1691492 - DNA, 15 bp, Homo sapiens
tttctaattaacctt

SEQ ID NO: 1691493 - DNA, 20 bp, Homo sapiens
tttctaattcctgttgctct

SEQ ID NO: 1691494 - DNA, 13 bp, Homo sapiens
tttctaattgtaa

SEQ ID NO: 1691495 - DNA, 18 bp, Homo sapiens
tttctacaactgattgca

SEQ ID NO: 1691496 - DNA, 19 bp, Homo sapiens
tttctacagtggttttata

SEQ ID NO: 1691497 - DNA, 20 bp, Homo sapiens
tttctacataattgtgacca

SEQ ID NO: 1691498 - DNA, 16 bp, Homo sapiens
tttctaccatttcaga

SEQ ID NO: 1691499 - DNA, 18 bp, Homo sapiens
tttctacctcttttttct

SEQ ID NO: 1691500 - DNA, 15 bp, Homo sapiens
tttctagagacacat

SEQ ID NO: 1691501 - DNA, 19 bp, Homo sapiens
tttctagcaattttctttg

SEQ ID NO: 1691502 - DNA, 19 bp, Homo sapiens
tttctagctagaaatatga

SEQ ID NO: 1691503 - DNA, 20 bp, Homo sapiens
tttctagctagaaatatgat

SEQ ID NO: 1691504 - DNA, 18 bp, Homo sapiens
tttctagctataacaact

SEQ ID NO: 1691505 - DNA, 19 bp, Homo sapiens
tttctagctgttgagctgt

SEQ ID NO: 1691506 - DNA, 15 bp, Homo sapiens
tttctagggaaatga

SEQ ID NO: 1691507 - DNA, 18 bp, Homo sapiens
tttctagggaaatgaaag

SEQ ID NO: 1691508 - DNA, 15 bp, Homo sapiens
tttctagtccaaaat

SEQ ID NO: 1691509 - DNA, 14 bp, Homo sapiens
tttctataaatcag

SEQ ID NO: 1691510 - DNA, 16 bp, Homo sapiens
tttctataaatcagta

SEQ ID NO: 1691511 - DNA, 16 bp, Homo sapiens
tttctatatagttcct

SEQ ID NO: 1691512 - DNA, 14 bp, Homo sapiens
tttctatcacatat

SEQ ID NO: 1691513 - DNA, 18 bp, Homo sapiens
tttctatcagaagttgta

SEQ ID NO: 1691514 - DNA, 15 bp, Homo sapiens
tttctatctgcaaat

SEQ ID NO: 1691515 - DNA, 21 bp, Homo sapiens
tttctatgtagaactgttcat

SEQ ID NO: 1691516 - DNA, 22 bp, Homo sapiens
tttctattctgtcagtgttaaa

SEQ ID NO: 1691517 - DNA, 20 bp, Homo sapiens
tttctattgttaaacaaatg

SEQ ID NO: 1691518 - DNA, 22 bp, Homo sapiens
tttctattgttaaacaaatgat

SEQ ID NO: 1691519 - DNA, 16 bp, Homo sapiens
tttctatttataagtg

SEQ ID NO: 1691520 - DNA, 20 bp, Homo sapiens
tttctcaaaagaggttactt

SEQ ID NO: 1691521 - DNA, 17 bp, Homo sapiens
tttctcaatcagtgcag

SEQ ID NO: 1691522 - DNA, 20 bp, Homo sapiens
tttctcaatcagtgcagtga

SEQ ID NO: 1691523 - DNA, 13 bp, Homo sapiens
tttctcaatgtct

SEQ ID NO: 1691524 - DNA, 13 bp, Homo sapiens
tttctcacaaaaa

SEQ ID NO: 1691525 - DNA, 22 bp, Homo sapiens
tttctcacaaaaaggcaaatat

SEQ ID NO: 1691526 - DNA, 18 bp, Homo sapiens
tttctcacattgctgtat

SEQ ID NO: 1691527 - DNA, 23 bp, Homo sapiens
tttctcagatccttgtttcaaac

SEQ ID NO: 1691528 - DNA, 23 bp, Homo sapiens
tttctcagccgcttctgactgct

SEQ ID NO: 1691529 - DNA, 17 bp, Homo sapiens
tttctcataattttgca

SEQ ID NO: 1691530 - DNA, 12 bp, Homo sapiens
tttctcatactt

SEQ ID NO: 1691531 - DNA, 15 bp, Homo sapiens
tttctccacactcca

SEQ ID NO: 1691532 - DNA, 18 bp, Homo sapiens
tttctccagccagcaatg

SEQ ID NO: 1691533 - DNA, 12 bp, Homo sapiens
tttctccagctg

SEQ ID NO: 1691534 - DNA, 14 bp, Homo sapiens
tttctccatcttta

SEQ ID NO: 1691535 - DNA, 23 bp, Homo sapiens
tttctccatctttatagaaggaa

SEQ ID NO: 1691536 - DNA, 20 bp, Homo sapiens
tttctcccctgcccccagga

SEQ ID NO: 1691537 - DNA, 22 bp, Homo sapiens
tttctcccctgcccccaggact

SEQ ID NO: 1691538 - DNA, 18 bp, Homo sapiens
tttctccggggtctgtgc

SEQ ID NO: 1691539 - DNA, 15 bp, Homo sapiens
tttctcctcccagga

SEQ ID NO: 1691540 - DNA, 16 bp, Homo sapiens
tttctcctcccttcct

SEQ ID NO: 1691541 - DNA, 14 bp, Homo sapiens
tttctcctgtgccc

SEQ ID NO: 1691542 - DNA, 13 bp, Homo sapiens
tttctccttgaaa

SEQ ID NO: 1691543 - DNA, 22 bp, Homo sapiens
tttctccttgaaatgagtaaaa

SEQ ID NO: 1691544 - DNA, 12 bp, Homo sapiens
tttctccttggt

SEQ ID NO: 1691545 - DNA, 16 bp, Homo sapiens
tttctccttggtttgc

SEQ ID NO: 1691546 - DNA, 16 bp, Homo sapiens
tttctcctttgataaa

SEQ ID NO: 1691547 - DNA, 19 bp, Homo sapiens
tttctccttttcctatcct

SEQ ID NO: 1691548 - DNA, 18 bp, Homo sapiens
tttctctaaccctatcct

SEQ ID NO: 1691549 - DNA, 20 bp, Homo sapiens
tttctctccagcctgacttg

SEQ ID NO: 1691550 - DNA, 13 bp, Homo sapiens
tttctctcctggc

SEQ ID NO: 1691551 - DNA, 13 bp, Homo sapiens
tttctctctggct

SEQ ID NO: 1691552 - DNA, 18 bp, Homo sapiens
tttctctctggcttctct

SEQ ID NO: 1691553 - DNA, 13 bp, Homo sapiens
tttctctcttccc

SEQ ID NO: 1691554 - DNA, 13 bp, Homo sapiens
tttctctgcagaa

SEQ ID NO: 1691555 - DNA, 12 bp, Homo sapiens
tttctctgctgt

SEQ ID NO: 1691556 - DNA, 17 bp, Homo sapiens
tttctctgcttaccctt

SEQ ID NO: 1691557 - DNA, 13 bp, Homo sapiens
tttctctgggctt

SEQ ID NO: 1691558 - DNA, 23 bp, Homo sapiens
tttctggactgaagcctgcagga

SEQ ID NO: 1691559 - DNA, 18 bp, Homo sapiens
tttctggagtgaaccaga

SEQ ID NO: 1691560 - DNA, 22 bp, Homo sapiens
tttctggcaaacgtttctcaaa

SEQ ID NO: 1691561 - DNA, 12 bp, Homo sapiens
tttctggcaccg

SEQ ID NO: 1691562 - DNA, 17 bp, Homo sapiens
tttctggccaaaagcag

SEQ ID NO: 1691563 - DNA, 11 bp, Homo sapiens
tttctggccag

SEQ ID NO: 1691564 - DNA, 15 bp, Homo sapiens
tttctggggaaagac

SEQ ID NO: 1691565 - DNA, 22 bp, Homo sapiens
tttctggggaaagacactgcct

SEQ ID NO: 1691566 - DNA, 20 bp, Homo sapiens
tttctggtggggctgtcctg

SEQ ID NO: 1691567 - DNA, 15 bp, Homo sapiens
tttctggttctaaca

SEQ ID NO: 1691568 - DNA, 16 bp, Homo sapiens
tttctggtttggcatg

SEQ ID NO: 1691569 - DNA, 22 bp, Homo sapiens
tttctgtaagagaaaatattac

SEQ ID NO: 1691570 - DNA, 13 bp, Homo sapiens
tttctgtcctggg

SEQ ID NO: 1691571 - DNA, 23 bp, Homo sapiens
tttctgtccttttggcactgaga

SEQ ID NO: 1691572 - DNA, 20 bp, Homo sapiens
tttctgtctcccttctctct

SEQ ID NO: 1691573 - DNA, 21 bp, Homo sapiens
tttctgtctcccttctctctc

SEQ ID NO: 1691574 - DNA, 12 bp, Homo sapiens
tttctgtgaata

SEQ ID NO: 1691575 - DNA, 17 bp, Homo sapiens
tttctgttaaaatgcat

SEQ ID NO: 1691576 - DNA, 15 bp, Homo sapiens
tttctgttgaagttt

SEQ ID NO: 1691577 - DNA, 14 bp, Homo sapiens
tttctgttggataa

SEQ ID NO: 1691578 - DNA, 14 bp, Homo sapiens
tttcttaaaagtac

SEQ ID NO: 1691579 - DNA, 15 bp, Homo sapiens
tttcttaaaagtact

SEQ ID NO: 1691580 - DNA, 22 bp, Homo sapiens
tttcttaaaagtactttaaaaa

SEQ ID NO: 1691581 - DNA, 12 bp, Homo sapiens
tttcttaaataa

SEQ ID NO: 1691582 - DNA, 22 bp, Homo sapiens
tttcttaaataatgcttcagat

SEQ ID NO: 1691583 - DNA, 20 bp, Homo sapiens
tttcttaaatatgtatatga

SEQ ID NO: 1691584 - DNA, 14 bp, Homo sapiens
tttcttaacttctt

SEQ ID NO: 1691585 - DNA, 14 bp, Homo sapiens
tttcttaatgagat

SEQ ID NO: 1691586 - DNA, 13 bp, Homo sapiens
tttcttagacttt

SEQ ID NO: 1691587 - DNA, 15 bp, Homo sapiens
tttcttatgtgacat

SEQ ID NO: 1691588 - DNA, 15 bp, Homo sapiens
tttcttattctgtat

SEQ ID NO: 1691589 - DNA, 17 bp, Homo sapiens
tttcttattgcgctgct

SEQ ID NO: 1691590 - DNA, 22 bp, Homo sapiens
tttcttcaaacagtatataact

SEQ ID NO: 1691591 - DNA, 23 bp, Homo sapiens
tttcttcacttcaagctgttatt

SEQ ID NO: 1691592 - DNA, 19 bp, Homo sapiens
tttcttcatgcaatgacat

SEQ ID NO: 1691593 - DNA, 21 bp, Homo sapiens
tttcttcccagaatctctgag

SEQ ID NO: 1691594 - DNA, 14 bp, Homo sapiens
tttcttcccatcac

SEQ ID NO: 1691595 - DNA, 12 bp, Homo sapiens
tttcttccctgc

SEQ ID NO: 1691596 - DNA, 13 bp, Homo sapiens
tttcttctattaa

SEQ ID NO: 1691597 - DNA, 12 bp, Homo sapiens
tttcttctgggc

SEQ ID NO: 1691598 - DNA, 17 bp, Homo sapiens
tttcttctggtagcata

SEQ ID NO: 1691599 - DNA, 14 bp, Homo sapiens
tttcttctgtgtta

SEQ ID NO: 1691600 - DNA, 23 bp, Homo sapiens
tttcttcttcaaacctttgtgtg

SEQ ID NO: 1691601 - DNA, 13 bp, Homo sapiens
tttcttcttcatg

SEQ ID NO: 1691602 - DNA, 12 bp, Homo sapiens
tttcttctttcc

SEQ ID NO: 1691603 - DNA, 18 bp, Homo sapiens
tttcttctttccctggac

SEQ ID NO: 1691604 - DNA, 16 bp, Homo sapiens
tttcttgaacatactt

SEQ ID NO: 1691605 - DNA, 20 bp, Homo sapiens
tttcttgacaaaacctaact

SEQ ID NO: 1691606 - DNA, 14 bp, Homo sapiens
tttcttgacaagct

SEQ ID NO: 1691607 - DNA, 16 bp, Homo sapiens
tttcttgacaagctga

SEQ ID NO: 1691608 - DNA, 23 bp, Homo sapiens
tttcttgccaatgaggtctgaaa

SEQ ID NO: 1691609 - DNA, 18 bp, Homo sapiens
tttcttgcctctgtcccc

SEQ ID NO: 1691610 - DNA, 22 bp, Homo sapiens
tttcttgccttaaccagtctct

SEQ ID NO: 1691611 - DNA, 12 bp, Homo sapiens
tttcttgctgct

SEQ ID NO: 1691612 - DNA, 16 bp, Homo sapiens
tttcttgctgcttcta

SEQ ID NO: 1691613 - DNA, 23 bp, Homo sapiens
tttcttgggaattgaaaaaaatt

SEQ ID NO: 1691614 - DNA, 19 bp, Homo sapiens
tttcttgtaaatgtttctt

SEQ ID NO: 1691615 - DNA, 19 bp, Homo sapiens
tttcttgtaatttaaacag

SEQ ID NO: 1691616 - DNA, 12 bp, Homo sapiens
tttcttgtttac

SEQ ID NO: 1691617 - DNA, 15 bp, Homo sapiens
tttctttaagaaagt

SEQ ID NO: 1691618 - DNA, 16 bp, Homo sapiens
tttctttaagaaagta

SEQ ID NO: 1691619 - DNA, 16 bp, Homo sapiens
tttctttcacaaaaaa

SEQ ID NO: 1691620 - DNA, 20 bp, Homo sapiens
tttctttccaaaacatttct

SEQ ID NO: 1691621 - DNA, 17 bp, Homo sapiens
tttctttcccatgtatt

SEQ ID NO: 1691622 - DNA, 16 bp, Homo sapiens
tttctttcttagtcca

SEQ ID NO: 1691623 - DNA, 23 bp, Homo sapiens
tttctttgaccagatctttctct

SEQ ID NO: 1691624 - DNA, 12 bp, Homo sapiens
tttctttgatca

SEQ ID NO: 1691625 - DNA, 12 bp, Homo sapiens
tttctttgcctc

SEQ ID NO: 1691626 - DNA, 14 bp, Homo sapiens
tttctttgcctctg

SEQ ID NO: 1691627 - DNA, 22 bp, Homo sapiens
tttctttgcctctgcagtctca

SEQ ID NO: 1691628 - DNA, 14 bp, Homo sapiens
tttctttgtgtagt

SEQ ID NO: 1691629 - DNA, 12 bp, Homo sapiens
tttctttgtgtt

SEQ ID NO: 1691630 - DNA, 14 bp, Homo sapiens
tttcttttatatct

SEQ ID NO: 1691631 - DNA, 21 bp, Homo sapiens
tttcttttcccccattaatca

SEQ ID NO: 1691632 - DNA, 21 bp, Homo sapiens
tttcttttctaccctagccat

SEQ ID NO: 1691633 - DNA, 22 bp, Homo sapiens
tttcttttctggaatgtaatca

SEQ ID NO: 1691634 - DNA, 22 bp, Homo sapiens
tttctttttaaccctaatcttt

SEQ ID NO: 1691635 - DNA, 20 bp, Homo sapiens
tttctttttaattattttaa

SEQ ID NO: 1691636 - DNA, 17 bp, Homo sapiens
tttctttttgaatcttt

SEQ ID NO: 1691637 - DNA, 23 bp, Homo sapiens
tttcttttttcctctgagttctg

SEQ ID NO: 1691638 - DNA, 19 bp, Homo sapiens
tttctttttttaactggtg

SEQ ID NO: 1691639 - DNA, 18 bp, Homo sapiens
tttgaaaagaccaagact

SEQ ID NO: 1691640 - DNA, 23 bp, Homo sapiens
tttgaaactgtaaatatgtttgt

SEQ ID NO: 1691641 - DNA, 21 bp, Homo sapiens
tttgaaagaatagaacacagt

SEQ ID NO: 1691642 - DNA, 21 bp, Homo sapiens
tttgaaaggagatgtcttgga

SEQ ID NO: 1691643 - DNA, 20 bp, Homo sapiens
tttgaaatagtctgtgtgaa

SEQ ID NO: 1691644 - DNA, 12 bp, Homo sapiens
tttgaaatgctg

SEQ ID NO: 1691645 - DNA, 19 bp, Homo sapiens
tttgaacacgaaagaaatg

SEQ ID NO: 1691646 - DNA, 20 bp, Homo sapiens
tttgaacatgtttaatgggt

SEQ ID NO: 1691647 - DNA, 15 bp, Homo sapiens
tttgaacccctgtgt

SEQ ID NO: 1691648 - DNA, 18 bp, Homo sapiens
tttgcatgatatcttcaa

SEQ ID NO: 1691649 - DNA, 19 bp, Homo sapiens
tttgcatgatatcttcaag

SEQ ID NO: 1691650 - DNA, 18 bp, Homo sapiens
tttgcattaatctaagaa

SEQ ID NO: 1691651 - DNA, 15 bp, Homo sapiens
tttgcattccttaga

SEQ ID NO: 1691652 - DNA, 19 bp, Homo sapiens
tttgcattgtctaatgaca

SEQ ID NO: 1691653 - DNA, 18 bp, Homo sapiens
tttgcattgtgtcagaaa

SEQ ID NO: 1691654 - DNA, 16 bp, Homo sapiens
tttgcatttaaaacag

SEQ ID NO: 1691655 - DNA, 17 bp, Homo sapiens
tttgcatttaaaacaga

SEQ ID NO: 1691656 - DNA, 21 bp, Homo sapiens
tttgcatttaaaacagacact

SEQ ID NO: 1691657 - DNA, 23 bp, Homo sapiens
tttgcatttaaaacagacactgg

SEQ ID NO: 1691658 - DNA, 21 bp, Homo sapiens
tttgcatttcagaaagccttt

SEQ ID NO: 1691659 - DNA, 20 bp, Homo sapiens
tttgcatttctcttcctaaa

SEQ ID NO: 1691660 - DNA, 15 bp, Homo sapiens
ttttaacactttgta

SEQ ID NO: 1691661 - DNA, 13 bp, Homo sapiens
ttttaacattcct

SEQ ID NO: 1691662 - DNA, 20 bp, Homo sapiens
ttttaacctaatatcactta

SEQ ID NO: 1691663 - DNA, 20 bp, Homo sapiens
ttttaactaaattttaaagc

SEQ ID NO: 1691664 - DNA, 12 bp, Homo sapiens
ttttaactcacc

SEQ ID NO: 1691665 - DNA, 19 bp, Homo sapiens
ttttaactgccaatcctta

SEQ ID NO: 1691666 - DNA, 14 bp, Homo sapiens
ttttaactgctgca

SEQ ID NO: 1691667 - DNA, 23 bp, Homo sapiens
ttttatggaggctttgcatagat

SEQ ID NO: 1691668 - DNA, 17 bp, Homo sapiens
ttttatggttacttctt

SEQ ID NO: 1691669 - DNA, 18 bp, Homo sapiens
ttttatgtgagagaaagt

SEQ ID NO: 1691670 - DNA, 14 bp, Homo sapiens
ttttattaaaaata

SEQ ID NO: 1691671 - DNA, 15 bp, Homo sapiens
ttttattaaacacag

SEQ ID NO: 1691672 - DNA, 13 bp, Homo sapiens
ttttattaaagat

SEQ ID NO: 1691673 - DNA, 20 bp, Homo sapiens
ttttattaaagcatttccta

SEQ ID NO: 1691674 - DNA, 12 bp, Homo sapiens
ttttattaaatt

SEQ ID NO: 1691675 - DNA, 19 bp, Homo sapiens
ttttattaaattaattgaa

SEQ ID NO: 1691676 - DNA, 23 bp, Homo sapiens
ttttattaaatttatttgaaaat

SEQ ID NO: 1691677 - DNA, 13 bp, Homo sapiens
ttttattaattta

SEQ ID NO: 1691678 - DNA, 23 bp, Homo sapiens
ttttattcctgccctgctgttta

SEQ ID NO: 1691679 - DNA, 15 bp, Homo sapiens
ttttattcctgtatg

SEQ ID NO: 1691680 - DNA, 19 bp, Homo sapiens
ttttatttagttgaaaaat

SEQ ID NO: 1691681 - DNA, 16 bp, Homo sapiens
ttttatttataaacta

SEQ ID NO: 1691682 - DNA, 15 bp, Homo sapiens
ttttatttgacaaaa

SEQ ID NO: 1691683 - DNA, 15 bp, Homo sapiens
ttttatttgcatgtg

SEQ ID NO: 1691684 - DNA, 18 bp, Homo sapiens
ttttatttgtaaagtgat

SEQ ID NO: 1691685 - DNA, 11 bp, Homo sapiens
ttttattttac

SEQ ID NO: 1691686 - DNA, 15 bp, Homo sapiens
ttttattttactatt

SEQ ID NO: 1691687 - DNA, 12 bp, Homo sapiens
ttttattttcaa

SEQ ID NO: 1691688 - DNA, 15 bp, Homo sapiens
ttttattttgctgag

SEQ ID NO: 1691689 - DNA, 20 bp, Homo sapiens
ttttattttgctgagttgtt

SEQ ID NO: 1691690 - DNA, 13 bp, Homo sapiens
ttttatttttcta

SEQ ID NO: 1691691 - DNA, 21 bp, Homo sapiens
ttttatttttctcatgatgag

SEQ ID NO: 1691692 - DNA, 17 bp, Homo sapiens
ttttcaaaaggtattat

SEQ ID NO: 1691693 - DNA, 14 bp, Homo sapiens
ttttcaaaatggag

SEQ ID NO: 1691694 - DNA, 21 bp, Homo sapiens
ttttcaaacctcaaatatagt

SEQ ID NO: 1691695 - DNA, 14 bp, Homo sapiens
ttttcaaactgctg

SEQ ID NO: 1691696 - DNA, 20 bp, Homo sapiens
ttttcaaactgctgcatact

SEQ ID NO: 1691697 - DNA, 18 bp, Homo sapiens
ttttcaaccataaaagaa

SEQ ID NO: 1691698 - DNA, 22 bp, Homo sapiens
ttttcaaccataaaagaagttt

SEQ ID NO: 1691699 - DNA, 17 bp, Homo sapiens
ttttcaacctctagaat

SEQ ID NO: 1691700 - DNA, 16 bp, Homo sapiens
ttttcaagaagttctt

SEQ ID NO: 1691701 - DNA, 14 bp, Homo sapiens
ttttcaaggcattt

SEQ ID NO: 1691702 - DNA, 12 bp, Homo sapiens
ttttcaagtatt

SEQ ID NO: 1691703 - DNA, 17 bp, Homo sapiens
ttttcaagtatttaagc

SEQ ID NO: 1691704 - DNA, 20 bp, Homo sapiens
ttttcaagtatttaagccta

SEQ ID NO: 1691705 - DNA, 16 bp, Homo sapiens
ttttcaataccaggga

SEQ ID NO: 1691706 - DNA, 21 bp, Homo sapiens
ttttcaatatattgaactttt

SEQ ID NO: 1691707 - DNA, 13 bp, Homo sapiens
ttttcaatcttct

SEQ ID NO: 1691708 - DNA, 20 bp, Homo sapiens
ttttcaatcttctactttta

SEQ ID NO: 1691709 - DNA, 16 bp, Homo sapiens
ttttcacatatctagt

SEQ ID NO: 1691710 - DNA, 11 bp, Homo sapiens
ttttcaccaat

SEQ ID NO: 1691711 - DNA, 23 bp, Homo sapiens
ttttcacctgtttttaagctgtt

SEQ ID NO: 1691712 - DNA, 20 bp, Homo sapiens
ttttcaccttttcaggaaaa

SEQ ID NO: 1691713 - DNA, 22 bp, Homo sapiens
ttttcactggaagatttatgaa

SEQ ID NO: 1691714 - DNA, 18 bp, Homo sapiens
ttttcactttgtgattat

SEQ ID NO: 1691715 - DNA, 23 bp, Homo sapiens
ttttcagaaaatattatgtgttt

SEQ ID NO: 1691716 - DNA, 15 bp, Homo sapiens
ttttcagaaatatgt

SEQ ID NO: 1691717 - DNA, 18 bp, Homo sapiens
ttttcagaacctcttccc

SEQ ID NO: 1691718 - DNA, 11 bp, Homo sapiens
ttttcagaccc

SEQ ID NO: 1691719 - DNA, 20 bp, Homo sapiens
ttttcagcttgtttctatac

SEQ ID NO: 1691720 - DNA, 22 bp, Homo sapiens
ttttcaggtaggcccttgtcct

SEQ ID NO: 1691721 - DNA, 18 bp, Homo sapiens
ttttcagtatactgtgtg

SEQ ID NO: 1691722 - DNA, 15 bp, Homo sapiens
ttttcatagatgtgt

SEQ ID NO: 1691723 - DNA, 22 bp, Homo sapiens
ttttcatcccgtatcacagtgt

SEQ ID NO: 1691724 - DNA, 13 bp, Homo sapiens
ttttcatgaaaat

SEQ ID NO: 1691725 - DNA, 22 bp, Homo sapiens
ttttcatggacactttgaaatg

SEQ ID NO: 1691726 - DNA, 10 bp, Homo sapiens
ttttcatgtt

SEQ ID NO: 1691727 - DNA, 13 bp, Homo sapiens
ttttcattaaact

SEQ ID NO: 1691728 - DNA, 20 bp, Homo sapiens
ttttcattaaattagctatt

SEQ ID NO: 1691729 - DNA, 22 bp, Homo sapiens
ttttcattagcagttgctcaca

SEQ ID NO: 1691730 - DNA, 21 bp, Homo sapiens
ttttcattcaggtatttgtaa

SEQ ID NO: 1691731 - DNA, 18 bp, Homo sapiens
ttttcattgaacagcaaa

SEQ ID NO: 1691732 - DNA, 12 bp, Homo sapiens
ttttcatttgta

SEQ ID NO: 1691733 - DNA, 17 bp, Homo sapiens
ttttcatttgttttgct

SEQ ID NO: 1691734 - DNA, 11 bp, Homo sapiens
ttttcattttg

SEQ ID NO: 1691735 - DNA, 19 bp, Homo sapiens
ttttccaaaacaaaaagat

SEQ ID NO: 1691736 - DNA, 15 bp, Homo sapiens
ttttccaaaataatt

SEQ ID NO: 1691737 - DNA, 19 bp, Homo sapiens
ttttccaaagagtgatagt

SEQ ID NO: 1691738 - DNA, 13 bp, Homo sapiens
ttttccacattcc

SEQ ID NO: 1691739 - DNA, 15 bp, Homo sapiens
ttttccaccctggaa

SEQ ID NO: 1691740 - DNA, 13 bp, Homo sapiens
ttttccactactg

SEQ ID NO: 1691741 - DNA, 18 bp, Homo sapiens
ttttccactccattgtcg

SEQ ID NO: 1691742 - DNA, 12 bp, Homo sapiens
ttttccagcaag

SEQ ID NO: 1691743 - DNA, 13 bp, Homo sapiens
ttttccagcaagt

SEQ ID NO: 1691744 - DNA, 19 bp, Homo sapiens
ttttccaggatcctgcagg

SEQ ID NO: 1691745 - DNA, 16 bp, Homo sapiens
ttttccatctaaaaat

SEQ ID NO: 1691746 - DNA, 14 bp, Homo sapiens
ttttcccaagtgta

SEQ ID NO: 1691747 - DNA, 14 bp, Homo sapiens
ttttcccaataaat

SEQ ID NO: 1691748 - DNA, 23 bp, Homo sapiens
ttttcccccttgaggattgtgga

SEQ ID NO: 1691749 - DNA, 15 bp, Homo sapiens
ttttcccctttcctg

SEQ ID NO: 1691750 - DNA, 17 bp, Homo sapiens
ttttcccctttgattca

SEQ ID NO: 1691751 - DNA, 22 bp, Homo sapiens
ttttccctctttggctcccctg

SEQ ID NO: 1691752 - DNA, 21 bp, Homo sapiens
ttttccctgaagttatgtgta

SEQ ID NO: 1691753 - DNA, 18 bp, Homo sapiens
ttttccctggaactcctg

SEQ ID NO: 1691754 - DNA, 15 bp, Homo sapiens
ttttccctgtacagt

SEQ ID NO: 1691755 - DNA, 13 bp, Homo sapiens
ttttcccttaaat

SEQ ID NO: 1691756 - DNA, 15 bp, Homo sapiens
ttttcccttgctgta

SEQ ID NO: 1691757 - DNA, 14 bp, Homo sapiens
ttttccctttgcct

SEQ ID NO: 1691758 - DNA, 17 bp, Homo sapiens
ttttccctttttatgtg

SEQ ID NO: 1691759 - DNA, 17 bp, Homo sapiens
ttttcctaagcacaaat

SEQ ID NO: 1691760 - DNA, 17 bp, Homo sapiens
ttttcctagccctctca

SEQ ID NO: 1691761 - DNA, 14 bp, Homo sapiens
ttttcctcaagcaa

SEQ ID NO: 1691762 - DNA, 19 bp, Homo sapiens
ttttgcattccagaatctt

SEQ ID NO: 1691763 - DNA, 20 bp, Homo sapiens
ttttgcatttctcttcctaa

SEQ ID NO: 1691764 - DNA, 20 bp, Homo sapiens
ttttgccacagcttttgcaa

SEQ ID NO: 1691765 - DNA, 22 bp, Homo sapiens
ttttgccactaattttagtatt

SEQ ID NO: 1691766 - DNA, 22 bp, Homo sapiens
ttttgccactttggcttctcct

SEQ ID NO: 1691767 - DNA, 23 bp, Homo sapiens
ttttgccggctggtgaattcaaa

SEQ ID NO: 1691768 - DNA, 19 bp, Homo sapiens
ttttgccgtggcttgggga

SEQ ID NO: 1691769 - DNA, 12 bp, Homo sapiens
ttttgcctggct

SEQ ID NO: 1691770 - DNA, 13 bp, Homo sapiens
ttttgcctggctg

SEQ ID NO: 1691771 - DNA, 22 bp, Homo sapiens
ttttgcctggctgtggaggcct

SEQ ID NO: 1691772 - DNA, 15 bp, Homo sapiens
ttttgccttttgcaa

SEQ ID NO: 1691773 - DNA, 11 bp, Homo sapiens
ttttgctaact

SEQ ID NO: 1691774 - DNA, 14 bp, Homo sapiens
ttttgctaactggg

SEQ ID NO: 1691775 - DNA, 15 bp, Homo sapiens
ttttgctaactgggt

SEQ ID NO: 1691776 - DNA, 14 bp, Homo sapiens
ttttgctaactggt

SEQ ID NO: 1691777 - DNA, 18 bp, Homo sapiens
ttttgctaactggttaaa

SEQ ID NO: 1691778 - DNA, 19 bp, Homo sapiens
ttttgctaggagccccagc

SEQ ID NO: 1691779 - DNA, 22 bp, Homo sapiens
ttttgctctaaaatatttatga

SEQ ID NO: 1691780 - DNA, 13 bp, Homo sapiens
ttttgctgaattc

SEQ ID NO: 1691781 - DNA, 23 bp, Homo sapiens
ttttgcttgttatattaagcaga

SEQ ID NO: 1691782 - DNA, 13 bp, Homo sapiens
ttttgctttaatt

SEQ ID NO: 1691783 - DNA, 18 bp, Homo sapiens
ttttgctttaattttagc

SEQ ID NO: 1691784 - DNA, 12 bp, Homo sapiens
ttttgctttggt

SEQ ID NO: 1691785 - DNA, 19 bp, Homo sapiens
ttttgcttttaattaaata

SEQ ID NO: 1691786 - DNA, 18 bp, Homo sapiens
ttttggaactatgaagac

SEQ ID NO: 1691787 - DNA, 22 bp, Homo sapiens
ttttggaagagacaaagatttc

SEQ ID NO: 1691788 - DNA, 17 bp, Homo sapiens
ttttggactccatctct

SEQ ID NO: 1691789 - DNA, 17 bp, Homo sapiens
ttttggacttcaaagca

SEQ ID NO: 1691790 - DNA, 19 bp, Homo sapiens
ttttggatgattaaaaaat

SEQ ID NO: 1691791 - DNA, 19 bp, Homo sapiens
ttttggcaaacgctaaaga

SEQ ID NO: 1691792 - DNA, 17 bp, Homo sapiens
ttttggccaaagtgtta

SEQ ID NO: 1691793 - DNA, 14 bp, Homo sapiens
ttttggcctgtttg

SEQ ID NO: 1691794 - DNA, 15 bp, Homo sapiens
ttttggcctgtttga

SEQ ID NO: 1691795 - DNA, 17 bp, Homo sapiens
ttttgggctcaaagccc

SEQ ID NO: 1691796 - DNA, 18 bp, Homo sapiens
ttttggggcatcctggat

SEQ ID NO: 1691797 - DNA, 21 bp, Homo sapiens
ttttgggtactggagctttta

SEQ ID NO: 1691798 - DNA, 23 bp, Homo sapiens
ttttgggtattgtaatctgaagt

SEQ ID NO: 1691799 - DNA, 16 bp, Homo sapiens
ttttgggttaaaagat

SEQ ID NO: 1691800 - DNA, 17 bp, Homo sapiens
ttttggtagagaaggag

SEQ ID NO: 1691801 - DNA, 21 bp, Homo sapiens
ttttggtccaagttgtgctta

SEQ ID NO: 1691802 - DNA, 22 bp, Homo sapiens
ttttggttgtcaatattaaata

SEQ ID NO: 1691803 - DNA, 14 bp, Homo sapiens
ttttggttttgttc

SEQ ID NO: 1691804 - DNA, 14 bp, Homo sapiens
ttttgtaaaacaat

SEQ ID NO: 1691805 - DNA, 15 bp, Homo sapiens
ttttgtaaaagaaat

SEQ ID NO: 1691806 - DNA, 12 bp, Homo sapiens
ttttgtaactac

SEQ ID NO: 1691807 - DNA, 22 bp, Homo sapiens
ttttgtaagagtgagctctggt

SEQ ID NO: 1691808 - DNA, 22 bp, Homo sapiens
ttttgtaataagcaatcaaggt

SEQ ID NO: 1691809 - DNA, 19 bp, Homo sapiens
ttttgtacaattactaaat

SEQ ID NO: 1691810 - DNA, 11 bp, Homo sapiens
ttttgtacata

SEQ ID NO: 1691811 - DNA, 16 bp, Homo sapiens
ttttgtacattacact

SEQ ID NO: 1691812 - DNA, 18 bp, Homo sapiens
ttttgtacattacactaa

SEQ ID NO: 1691813 - DNA, 15 bp, Homo sapiens
ttttgtactgaatct

SEQ ID NO: 1691814 - DNA, 13 bp, Homo sapiens
ttttgtataaaat

SEQ ID NO: 1691815 - DNA, 14 bp, Homo sapiens
ttttgtataattgg

SEQ ID NO: 1691816 - DNA, 23 bp, Homo sapiens
ttttgtataattggatttcctaa

SEQ ID NO: 1691817 - DNA, 24 bp, Homo sapiens
ttttgtataattggatttcctaat

SEQ ID NO: 1691818 - DNA, 16 bp, Homo sapiens
ttttgtatagtaaagt

SEQ ID NO: 1691819 - DNA, 17 bp, Homo sapiens
ttttgtatattaacttt

SEQ ID NO: 1691820 - DNA, 20 bp, Homo sapiens
ttttgtcccccaacttgaga

SEQ ID NO: 1691821 - DNA, 15 bp, Homo sapiens
ttttgtctatgaagt

SEQ ID NO: 1691822 - DNA, 22 bp, Homo sapiens
ttttgtcttaagtgtttctcaa

SEQ ID NO: 1691823 - DNA, 13 bp, Homo sapiens
ttttgtcttgaat

SEQ ID NO: 1691824 - DNA, 22 bp, Homo sapiens
ttttgtgaaatgaaaacatgta

SEQ ID NO: 1691825 - DNA, 14 bp, Homo sapiens
ttttgtgaagtatt

SEQ ID NO: 1691826 - DNA, 21 bp, Homo sapiens
ttttgtgcaaaagcttcaaat

SEQ ID NO: 1691827 - DNA, 19 bp, Homo sapiens
ttttgtgcattctttggta

SEQ ID NO: 1691828 - DNA, 18 bp, Homo sapiens
ttttgtgggctggttgct

SEQ ID NO: 1691829 - DNA, 22 bp, Homo sapiens
ttttgtgggtttctctgtgctc

SEQ ID NO: 1691830 - DNA, 16 bp, Homo sapiens
ttttgtgtattctgtg

SEQ ID NO: 1691831 - DNA, 13 bp, Homo sapiens
ttttgtgtcctcc

SEQ ID NO: 1691832 - DNA, 17 bp, Homo sapiens
ttttgtgtctggtgcag

SEQ ID NO: 1691833 - DNA, 14 bp, Homo sapiens
ttttgtgtgaaatt

SEQ ID NO: 1691834 - DNA, 16 bp, Homo sapiens
ttttgtgttgaagagc

SEQ ID NO: 1691835 - DNA, 23 bp, Homo sapiens
ttttgtgtttattcttgatgaaa

SEQ ID NO: 1691836 - DNA, 16 bp, Homo sapiens
ttttgtgtttgttgta

SEQ ID NO: 1691837 - DNA, 20 bp, Homo sapiens
ttttgtgttttcttgtaaat

SEQ ID NO: 1691838 - DNA, 16 bp, Homo sapiens
ttttgttaactgattt

SEQ ID NO: 1691839 - DNA, 20 bp, Homo sapiens
ttttgttccaatgtcaatgt

SEQ ID NO: 1691840 - DNA, 15 bp, Homo sapiens
ttttgttctacatga

SEQ ID NO: 1691841 - DNA, 17 bp, Homo sapiens
ttttgttctctgggaga

SEQ ID NO: 1691842 - DNA, 15 bp, Homo sapiens
ttttgttgttcctct

SEQ ID NO: 1691843 - DNA, 15 bp, Homo sapiens
ttttgttttggctga

SEQ ID NO: 1691844 - DNA, 18 bp, Homo sapiens
tttttaaaaaaactggat

SEQ ID NO: 1691845 - DNA, 18 bp, Homo sapiens
tttttaaaaaatattttc

SEQ ID NO: 1691846 - DNA, 13 bp, Homo sapiens
tttttaaaaacct

SEQ ID NO: 1691847 - DNA, 14 bp, Homo sapiens
tttttaaaacacat

SEQ ID NO: 1691848 - DNA, 18 bp, Homo sapiens
tttttaaaacacatgttt

SEQ ID NO: 1691849 - DNA, 14 bp, Homo sapiens
tttttaaaatagaa

SEQ ID NO: 1691850 - DNA, 23 bp, Homo sapiens
tttttaaaatagaaattttgtaa

SEQ ID NO: 1691851 - DNA, 12 bp, Homo sapiens
tttttaaaattt

SEQ ID NO: 1691852 - DNA, 11 bp, Homo sapiens
tttttaaactt

SEQ ID NO: 1691853 - DNA, 12 bp, Homo sapiens
tttttaaacttg

SEQ ID NO: 1691854 - DNA, 16 bp, Homo sapiens
tttttaaataaaagca

SEQ ID NO: 1691855 - DNA, 16 bp, Homo sapiens
tttttaacacttaaat

SEQ ID NO: 1691856 - DNA, 16 bp, Homo sapiens
tttttaactgattctt

SEQ ID NO: 1691857 - DNA, 23 bp, Homo sapiens
tttttaactgattcttatgatta

SEQ ID NO: 1691858 - DNA, 15 bp, Homo sapiens
tttttaagaaaacat

SEQ ID NO: 1691859 - DNA, 17 bp, Homo sapiens
tttttaagaatatctgt

SEQ ID NO: 1691860 - DNA, 18 bp, Homo sapiens
tttttaagaatatctgta

SEQ ID NO: 1691861 - DNA, 15 bp, Homo sapiens
tttttaagatagtgt

SEQ ID NO: 1691862 - DNA, 16 bp, Homo sapiens
tttttaagatagtgta

SEQ ID NO: 1691863 - DNA, 20 bp, Homo sapiens
tttttaagatagtgtaactt

SEQ ID NO: 1691864 - DNA, 20 bp, Homo sapiens
tttttaagctgcaaatctga

SEQ ID NO: 1691865 - DNA, 18 bp, Homo sapiens
tttttaagctgtttccat

SEQ ID NO: 1691866 - DNA, 22 bp, Homo sapiens
tttttaaggtagtggttaatta

SEQ ID NO: 1691867 - DNA, 19 bp, Homo sapiens
tttttaagttgtcaaagaa

SEQ ID NO: 1691868 - DNA, 21 bp, Homo sapiens
ttttttacaactatgtaattt

SEQ ID NO: 1691869 - DNA, 12 bp, Homo sapiens
ttttttataaag

SEQ ID NO: 1691870 - DNA, 16 bp, Homo sapiens
ttttttataagtatgt

SEQ ID NO: 1691871 - DNA, 13 bp, Homo sapiens
ttttttatgctaa

SEQ ID NO: 1691872 - DNA, 18 bp, Homo sapiens
ttttttcaatatttatta

SEQ ID NO: 1691873 - DNA, 22 bp, Homo sapiens
ttttttcacaatgtgaaactga

SEQ ID NO: 1691874 - DNA, 12 bp, Homo sapiens
ttttttcatctt

SEQ ID NO: 1691875 - DNA, 13 bp, Homo sapiens
ttttttcatttat

SEQ ID NO: 1691876 - DNA, 13 bp, Homo sapiens
ttttttccactta

SEQ ID NO: 1691877 - DNA, 12 bp, Homo sapiens
ttttttctgggt

SEQ ID NO: 1691878 - DNA, 13 bp, Homo sapiens
ttttttctttata

SEQ ID NO: 1691879 - DNA, 13 bp, Homo sapiens
ttttttcttttta

SEQ ID NO: 1691880 - DNA, 17 bp, Homo sapiens
ttttttgcagtaactgt

SEQ ID NO: 1691881 - DNA, 20 bp, Homo sapiens
ttttttggtggtgaaattga

SEQ ID NO: 1691882 - DNA, 12 bp, Homo sapiens
ttttttggttaa

SEQ ID NO: 1691883 - DNA, 13 bp, Homo sapiens
ttttttgtaacta

SEQ ID NO: 1691884 - DNA, 13 bp, Homo sapiens
ttttttgtaataa

SEQ ID NO: 1691885 - DNA, 21 bp, Homo sapiens
ttttttgtatagaccaaagca

SEQ ID NO: 1691886 - DNA, 12 bp, Homo sapiens
tttttttcctga

SEQ ID NO: 1691887 - DNA, 14 bp, Homo sapiens
tttttttctaagag

SEQ ID NO: 1691888 - DNA, 12 bp, Homo sapiens
tttttttctagc

SEQ ID NO: 1691889 - DNA, 12 bp, Homo sapiens
tttttttctggg

SEQ ID NO: 1691890 - DNA, 12 bp, Homo sapiens
tttttttcttta

SEQ ID NO: 1691891 - DNA, 11 bp, Homo sapiens
tttttttgcca

SEQ ID NO: 1691892 - DNA, 12 bp, Homo sapiens
tttttttgtgtg

SEQ ID NO: 1691893 - DNA, 13 bp, Homo sapiens
ttttttttcccat

SEQ ID NO: 1691894 - DNA, 12 bp, Homo sapiens
ttttttttgcag

SEQ ID NO: 1691895 - DNA, 13 bp, Homo sapiens
tttttttttgagg

SEQ ID NO: 1691896 - DNA, 12 bp, Homo sapiens
aaaggcagctgc

SEQ ID NO: 1691897 - DNA, 16 bp, Homo sapiens
aaaggcagctgcctct

SEQ ID NO: 1691898 - DNA, 21 bp, Homo sapiens
aaaggcagctgcctctgctcc

SEQ ID NO: 1691899 - DNA, 18 bp, Homo sapiens
aaaggcagtattttgtgt

SEQ ID NO: 1691900 - DNA, 19 bp, Homo sapiens
aaaggcagtattttgtgtc

SEQ ID NO: 1691901 - DNA, 15 bp, Homo sapiens
aaaggcattagagtc

SEQ ID NO: 1691902 - DNA, 17 bp, Homo sapiens
aaaggccttcagacaca

SEQ ID NO: 1691903 - DNA, 19 bp, Homo sapiens
aaaggctaggtacacagct

SEQ ID NO: 1691904 - DNA, 22 bp, Homo sapiens
aaaggctattttcagatgaaat

SEQ ID NO: 1691905 - DNA, 21 bp, Homo sapiens
aaaggctcatttaaaacaggc

SEQ ID NO: 1691906 - DNA, 24 bp, Homo sapiens
aaaggctcatttaaaacaggcaaa

SEQ ID NO: 1691907 - DNA, 12 bp, Homo sapiens
aaaggctccctc

SEQ ID NO: 1691908 - DNA, 18 bp, Homo sapiens
aaaggctcgtttggatct

SEQ ID NO: 1691909 - DNA, 12 bp, Homo sapiens
aaaggcttggct

SEQ ID NO: 1691910 - DNA, 15 bp, Homo sapiens
aaagggagaaggaag

SEQ ID NO: 1691911 - DNA, 20 bp, Homo sapiens
aaagggagcagaactgaacc

SEQ ID NO: 1691912 - DNA, 15 bp, Homo sapiens
aaagggagtttttga

SEQ ID NO: 1691913 - DNA, 14 bp, Homo sapiens
aaagggatttgacc

SEQ ID NO: 1691914 - DNA, 20 bp, Homo sapiens
aaagggcagggcatctcctg

SEQ ID NO: 1691915 - DNA, 13 bp, Homo sapiens
aaagggcagggcc

SEQ ID NO: 1691916 - DNA, 16 bp, Homo sapiens
aaagggcggaagagtt

SEQ ID NO: 1691917 - DNA, 17 bp, Homo sapiens
aaagggcggaagagtta

SEQ ID NO: 1691918 - DNA, 16 bp, Homo sapiens
aaagggctctttagcc

SEQ ID NO: 1691919 - DNA, 18 bp, Homo sapiens
aaaggggcagaaaaactc

SEQ ID NO: 1691920 - DNA, 21 bp, Homo sapiens
aaaggggcccaagccccatct

SEQ ID NO: 1691921 - DNA, 18 bp, Homo sapiens
aaaggggggagggggagg

SEQ ID NO: 1691922 - DNA, 20 bp, Homo sapiens
aaagggggtcccagtgggag

SEQ ID NO: 1691923 - DNA, 24 bp, Homo sapiens
aaaggggtcggctgaccatgctca

SEQ ID NO: 1691924 - DNA, 21 bp, Homo sapiens
aaagggtgaagctatttatct

SEQ ID NO: 1691925 - DNA, 14 bp, Homo sapiens
aaagggtgtactta

SEQ ID NO: 1691926 - DNA, 17 bp, Homo sapiens
aaagggtgtatagtgtt

SEQ ID NO: 1691927 - DNA, 19 bp, Homo sapiens
aaagggtttgtaatacttt

SEQ ID NO: 1691928 - DNA, 20 bp, Homo sapiens
aaagggtttgtaatacttta

SEQ ID NO: 1691929 - DNA, 22 bp, Homo sapiens
aaaggtacgattatacttgaga

SEQ ID NO: 1691930 - DNA, 21 bp, Homo sapiens
aaaggtagcttacctgacaca

SEQ ID NO: 1691931 - DNA, 16 bp, Homo sapiens
aaaggtataattttat

SEQ ID NO: 1691932 - DNA, 14 bp, Homo sapiens
aaaggtatattgtg

SEQ ID NO: 1691933 - DNA, 20 bp, Homo sapiens
aaaggtattccttgttcttc

SEQ ID NO: 1691934 - DNA, 20 bp, Homo sapiens
aaaggtgagtttgagctgcc

SEQ ID NO: 1691935 - DNA, 18 bp, Homo sapiens
aaaggtgataaaatcata

SEQ ID NO: 1691936 - DNA, 13 bp, Homo sapiens
aaaggtgcctcat

SEQ ID NO: 1691937 - DNA, 15 bp, Homo sapiens
aaaggtgcctcatag

SEQ ID NO: 1691938 - DNA, 18 bp, Homo sapiens
aaaggtggaataaacatt

SEQ ID NO: 1691939 - DNA, 20 bp, Homo sapiens
aaaggtggaataaacattaa

SEQ ID NO: 1691940 - DNA, 19 bp, Homo sapiens
aaaggtggtaaattcagac

SEQ ID NO: 1691941 - DNA, 23 bp, Homo sapiens
aaaggtggtatgtaatttatgca

SEQ ID NO: 1691942 - DNA, 19 bp, Homo sapiens
aaaggtgtccttttccttt

SEQ ID NO: 1691943 - DNA, 13 bp, Homo sapiens
aaaggttctaggt

SEQ ID NO: 1691944 - DNA, 20 bp, Homo sapiens
aaaggttctaggtttcaaag

SEQ ID NO: 1691945 - DNA, 19 bp, Homo sapiens
aaaggttgccaaattgctg

SEQ ID NO: 1691946 - DNA, 19 bp, Homo sapiens
aaaggttgctgtttcacaa

SEQ ID NO: 1691947 - DNA, 13 bp, Homo sapiens
aaagtaaaatgaa

SEQ ID NO: 1691948 - DNA, 22 bp, Homo sapiens
aaagtaactcatttgttaaaat

SEQ ID NO: 1691949 - DNA, 14 bp, Homo sapiens
aaagtacagaattt

SEQ ID NO: 1691950 - DNA, 21 bp, Homo sapiens
aaagtacagaatttgaattat

SEQ ID NO: 1691951 - DNA, 13 bp, Homo sapiens
aaagtacatttaa

SEQ ID NO: 1691952 - DNA, 18 bp, Homo sapiens
aaagtacattttttgaaa

SEQ ID NO: 1691953 - DNA, 13 bp, Homo sapiens
aaagtactcttta

SEQ ID NO: 1691954 - DNA, 19 bp, Homo sapiens
aaagtactttaaaaaggaa

SEQ ID NO: 1691955 - DNA, 13 bp, Homo sapiens
aaagtagctgcta

SEQ ID NO: 1691956 - DNA, 12 bp, Homo sapiens
aaagtagggggc

SEQ ID NO: 1691957 - DNA, 16 bp, Homo sapiens
aaagtagtcctgtgaa

SEQ ID NO: 1691958 - DNA, 15 bp, Homo sapiens
aaagtagttgattca

SEQ ID NO: 1691959 - DNA, 16 bp, Homo sapiens
aaagtataatgtttat

SEQ ID NO: 1691960 - DNA, 22 bp, Homo sapiens
aaagtataatgtttattaaatg

SEQ ID NO: 1691961 - DNA, 23 bp, Homo sapiens
aaagtatatatttatttaagctt

SEQ ID NO: 1691962 - DNA, 21 bp, Homo sapiens
aaagtatcctgcttctgatat

SEQ ID NO: 1691963 - DNA, 12 bp, Homo sapiens
aaagtatgaatc

SEQ ID NO: 1691964 - DNA, 19 bp, Homo sapiens
aaagtattctgtactctta

SEQ ID NO: 1691965 - DNA, 23 bp, Homo sapiens
aaagtattgaaagccaacaactc

SEQ ID NO: 1691966 - DNA, 23 bp, Homo sapiens
aaagtatttttgattaacaatgt

SEQ ID NO: 1691967 - DNA, 16 bp, Homo sapiens
aaagtcaaaaaattat

SEQ ID NO: 1691968 - DNA, 20 bp, Homo sapiens
aaagtcaaaaggtgcctgtg

SEQ ID NO: 1691969 - DNA, 15 bp, Homo sapiens
aaagtcacaggaaga

SEQ ID NO: 1691970 - DNA, 17 bp, Homo sapiens
aaagtcaccaaatagtg

SEQ ID NO: 1691971 - DNA, 14 bp, Homo sapiens
aaagtcagaatcag

SEQ ID NO: 1691972 - DNA, 20 bp, Homo sapiens
aaagtcagctttcagagcca

SEQ ID NO: 1691973 - DNA, 18 bp, Homo sapiens
aaagtcagtatcatatta

SEQ ID NO: 1691974 - DNA, 12 bp, Homo sapiens
aaagtccagatt

SEQ ID NO: 1691975 - DNA, 16 bp, Homo sapiens
aaagtcctctgctcca

SEQ ID NO: 1691976 - DNA, 17 bp, Homo sapiens
aaagtcctggccctggc

SEQ ID NO: 1691977 - DNA, 14 bp, Homo sapiens
aaagtctaagcaag

SEQ ID NO: 1691978 - DNA, 13 bp, Homo sapiens
aaagtctatttta

SEQ ID NO: 1691979 - DNA, 15 bp, Homo sapiens
aaagtctccagccca

SEQ ID NO: 1691980 - DNA, 15 bp, Homo sapiens
aaagtctctaattct

SEQ ID NO: 1691981 - DNA, 18 bp, Homo sapiens
aaagtctctaattctatt

SEQ ID NO: 1691982 - DNA, 13 bp, Homo sapiens
aaagtgaagcaaa

SEQ ID NO: 1691983 - DNA, 23 bp, Homo sapiens
aaagtgaagcaaatcagaaactt

SEQ ID NO: 1691984 - DNA, 20 bp, Homo sapiens
aaagtgaagtgaatctgatt

SEQ ID NO: 1691985 - DNA, 14 bp, Homo sapiens
aaagtgacacagca

SEQ ID NO: 1691986 - DNA, 21 bp, Homo sapiens
aaagtgatgtttgtgtgtttt

SEQ ID NO: 1691987 - DNA, 23 bp, Homo sapiens
aaagtgcagctccgtttggcagt

SEQ ID NO: 1691988 - DNA, 18 bp, Homo sapiens
aaagtgcatatttatcca

SEQ ID NO: 1691989 - DNA, 13 bp, Homo sapiens
aaagtgctaaggt

SEQ ID NO: 1691990 - DNA, 18 bp, Homo sapiens
aaagtgctaaggttctaa

SEQ ID NO: 1691991 - DNA, 20 bp, Homo sapiens
aaagtgctaaggttctaagg

SEQ ID NO: 1691992 - DNA, 21 bp, Homo sapiens
aaagtgctgcagggctttaaa

SEQ ID NO: 1691993 - DNA, 11 bp, Homo sapiens
aaagtgctggg

SEQ ID NO: 1691994 - DNA, 18 bp, Homo sapiens
aaatacattgtatatatg

SEQ ID NO: 1691995 - DNA, 14 bp, Homo sapiens
aaatacatttgtaa

SEQ ID NO: 1691996 - DNA, 14 bp, Homo sapiens
aaataccacaagcc

SEQ ID NO: 1691997 - DNA, 15 bp, Homo sapiens
aaataccacaagcct

SEQ ID NO: 1691998 - DNA, 19 bp, Homo sapiens
aaataccacaagcctgaga

SEQ ID NO: 1691999 - DNA, 16 bp, Homo sapiens
aaataccactgtaatt

SEQ ID NO: 1692000 - DNA, 18 bp, Homo sapiens
aaataccactgtaattga

SEQ ID NO: 1692001 - DNA, 14 bp, Homo sapiens
aaataccagagcct

SEQ ID NO: 1692002 - DNA, 17 bp, Homo sapiens
aaataccagtgtggttt

SEQ ID NO: 1692003 - DNA, 19 bp, Homo sapiens
aaataccatgtctctaagc

SEQ ID NO: 1692004 - DNA, 15 bp, Homo sapiens
aaataccattattat

SEQ ID NO: 1692005 - DNA, 12 bp, Homo sapiens
aaataccattta

SEQ ID NO: 1692006 - DNA, 18 bp, Homo sapiens
aaatacctaattgtggat

SEQ ID NO: 1692007 - DNA, 20 bp, Homo sapiens
aaatacctccattaaatggt

SEQ ID NO: 1692008 - DNA, 15 bp, Homo sapiens
aaatactactcctgt

SEQ ID NO: 1692009 - DNA, 16 bp, Homo sapiens
aaatactattgcctca

SEQ ID NO: 1692010 - DNA, 16 bp, Homo sapiens
aaatactatttaagat

SEQ ID NO: 1692011 - DNA, 18 bp, Homo sapiens
aaatactatttaagatgt

SEQ ID NO: 1692012 - DNA, 19 bp, Homo sapiens
aaatactcaccaaaatata

SEQ ID NO: 1692013 - DNA, 14 bp, Homo sapiens
aaatactgctctga

SEQ ID NO: 1692014 - DNA, 15 bp, Homo sapiens
aaatactgctctgaa

SEQ ID NO: 1692015 - DNA, 14 bp, Homo sapiens
aaatactggactca

SEQ ID NO: 1692016 - DNA, 21 bp, Homo sapiens
aaatactggactcaggaactt

SEQ ID NO: 1692017 - DNA, 18 bp, Homo sapiens
aaatactgtcaaacaata

SEQ ID NO: 1692018 - DNA, 14 bp, Homo sapiens
aaatactgtgaaat

SEQ ID NO: 1692019 - DNA, 16 bp, Homo sapiens
aaatacttaaatgtta

SEQ ID NO: 1692020 - DNA, 17 bp, Homo sapiens
aaatacttcgatgatga

SEQ ID NO: 1692021 - DNA, 16 bp, Homo sapiens
aaatacttgtgatttt

SEQ ID NO: 1692022 - DNA, 22 bp, Homo sapiens
aaatacttttgcatttttcctt

SEQ ID NO: 1692023 - DNA, 14 bp, Homo sapiens
aaatagaaaatggt

SEQ ID NO: 1692024 - DNA, 15 bp, Homo sapiens
aaatagaaaatggtc

SEQ ID NO: 1692025 - DNA, 17 bp, Homo sapiens
aaatagaaattagattt

SEQ ID NO: 1692026 - DNA, 12 bp, Homo sapiens
aaatagaaattt

SEQ ID NO: 1692027 - DNA, 14 bp, Homo sapiens
aaatagacaaaaag

SEQ ID NO: 1692028 - DNA, 15 bp, Homo sapiens
aaatagacaaataga

SEQ ID NO: 1692029 - DNA, 14 bp, Homo sapiens
aaatagatacaaat

SEQ ID NO: 1692030 - DNA, 15 bp, Homo sapiens
aaatagatataaatt

SEQ ID NO: 1692031 - DNA, 15 bp, Homo sapiens
aaatagatgctgtgt

SEQ ID NO: 1692032 - DNA, 13 bp, Homo sapiens
aaatagcagagcc

SEQ ID NO: 1692033 - DNA, 23 bp, Homo sapiens
aaatagcgatgtgcaggaagaaa

SEQ ID NO: 1692034 - DNA, 14 bp, Homo sapiens
aaataggaaacaag

SEQ ID NO: 1692035 - DNA, 16 bp, Homo sapiens
aaataggaaacaagtg

SEQ ID NO: 1692036 - DNA, 19 bp, Homo sapiens
aaataggattttgaaccca

SEQ ID NO: 1692037 - DNA, 20 bp, Homo sapiens
aaataggattttgaacccaa

SEQ ID NO: 1692038 - DNA, 17 bp, Homo sapiens
aaataggttcagatttt

SEQ ID NO: 1692039 - DNA, 14 bp, Homo sapiens
aaatagtatacatt

SEQ ID NO: 1692040 - DNA, 20 bp, Homo sapiens
aaatagtctgattttaatga

SEQ ID NO: 1692041 - DNA, 19 bp, Homo sapiens
aaatagtgacataatatat

SEQ ID NO: 1692042 - DNA, 22 bp, Homo sapiens
aaatagtgacataatatattct

SEQ ID NO: 1692043 - DNA, 13 bp, Homo sapiens
aaatagtgtaaga

SEQ ID NO: 1692044 - DNA, 15 bp, Homo sapiens
aaatagtgtaagaac

SEQ ID NO: 1692045 - DNA, 16 bp, Homo sapiens
aaatagtgtaagaact

SEQ ID NO: 1692046 - DNA, 22 bp, Homo sapiens
aaatagtgtaagaactgtacat

SEQ ID NO: 1692047 - DNA, 23 bp, Homo sapiens
aaatagtgtcatataaactcatt

SEQ ID NO: 1692048 - DNA, 13 bp, Homo sapiens
aaatagttctatt

SEQ ID NO: 1692049 - DNA, 18 bp, Homo sapiens
aaatagttctatttctat

SEQ ID NO: 1692050 - DNA, 22 bp, Homo sapiens
aaatagttgcatagcagtatat

SEQ ID NO: 1692051 - DNA, 17 bp, Homo sapiens
aaatagtttcaaatgag

SEQ ID NO: 1692052 - DNA, 18 bp, Homo sapiens
aaatagtttcaaatgagt

SEQ ID NO: 1692053 - DNA, 13 bp, Homo sapiens
aaatataaaatta

SEQ ID NO: 1692054 - DNA, 13 bp, Homo sapiens
aaatataaacaaa

SEQ ID NO: 1692055 - DNA, 23 bp, Homo sapiens
aaatataaacaaagattcatgat

SEQ ID NO: 1692056 - DNA, 16 bp, Homo sapiens
aaatataaatgtttaa

SEQ ID NO: 1692057 - DNA, 14 bp, Homo sapiens
aaatataacacatt

SEQ ID NO: 1692058 - DNA, 22 bp, Homo sapiens
aaatataatgttgataatatat

SEQ ID NO: 1692059 - DNA, 16 bp, Homo sapiens
aaatataattctgtaa

SEQ ID NO: 1692060 - DNA, 17 bp, Homo sapiens
aaatataattctgtaaa

SEQ ID NO: 1692061 - DNA, 14 bp, Homo sapiens
aaatataattgaca

SEQ ID NO: 1692062 - DNA, 15 bp, Homo sapiens
aaatatacatgttta

SEQ ID NO: 1692063 - DNA, 16 bp, Homo sapiens
aaatatacatgtttat

SEQ ID NO: 1692064 - DNA, 23 bp, Homo sapiens
aaatatacatgtttatgtaaaca

SEQ ID NO: 1692065 - DNA, 15 bp, Homo sapiens
aaatatagtgcaata

SEQ ID NO: 1692066 - DNA, 21 bp, Homo sapiens
aaatatagttgaacaagattt

SEQ ID NO: 1692067 - DNA, 15 bp, Homo sapiens
aaatatatatgtcaa

SEQ ID NO: 1692068 - DNA, 21 bp, Homo sapiens
aaatatatgaagacaataatt

SEQ ID NO: 1692069 - DNA, 19 bp, Homo sapiens
aaatatattacttaactgt

SEQ ID NO: 1692070 - DNA, 20 bp, Homo sapiens
aaatatattctttcaaagga

SEQ ID NO: 1692071 - DNA, 20 bp, Homo sapiens
aaatatatttaagataatta

SEQ ID NO: 1692072 - DNA, 21 bp, Homo sapiens
aaatatatttaagataattat

SEQ ID NO: 1692073 - DNA, 15 bp, Homo sapiens
aaatatcagactagt

SEQ ID NO: 1692074 - DNA, 17 bp, Homo sapiens
aaatatcataaagcatt

SEQ ID NO: 1692075 - DNA, 21 bp, Homo sapiens
aaatatcatgttaaattagaa

SEQ ID NO: 1692076 - DNA, 16 bp, Homo sapiens
aaatatccatttatct

SEQ ID NO: 1692077 - DNA, 14 bp, Homo sapiens
aaatatcctcaggg

SEQ ID NO: 1692078 - DNA, 23 bp, Homo sapiens
aaatatcctcaggggtggagaag

SEQ ID NO: 1692079 - DNA, 18 bp, Homo sapiens
aaatatccttgatgtaca

SEQ ID NO: 1692080 - DNA, 20 bp, Homo sapiens
aaatatctagtaatatattt

SEQ ID NO: 1692081 - DNA, 13 bp, Homo sapiens
aaatatctctaaa

SEQ ID NO: 1692082 - DNA, 12 bp, Homo sapiens
aaatatctgaaa

SEQ ID NO: 1692083 - DNA, 14 bp, Homo sapiens
aaatatctgctcaa

SEQ ID NO: 1692084 - DNA, 15 bp, Homo sapiens
aaatatctgtattta

SEQ ID NO: 1692085 - DNA, 22 bp, Homo sapiens
aaatatctgtatttaattttga

SEQ ID NO: 1692086 - DNA, 13 bp, Homo sapiens
aaatatctgttat

SEQ ID NO: 1692087 - DNA, 13 bp, Homo sapiens
aaatatctttctc

SEQ ID NO: 1692088 - DNA, 15 bp, Homo sapiens
aaatatctttctctt

SEQ ID NO: 1692089 - DNA, 21 bp, Homo sapiens
aaatatctttctcttacctgt

SEQ ID NO: 1692090 - DNA, 19 bp, Homo sapiens
aaatatgaacctattttca

SEQ ID NO: 1692091 - DNA, 22 bp, Homo sapiens
aaatatgaatgaacaaacctgt

SEQ ID NO: 1692092 - DNA, 12 bp, Homo sapiens
aaatatgatact

SEQ ID NO: 1692093 - DNA, 15 bp, Homo sapiens
aaatatgcaaagcac

SEQ ID NO: 1692094 - DNA, 18 bp, Homo sapiens
aaatatgcatctggccca

SEQ ID NO: 1692095 - DNA, 15 bp, Homo sapiens
aaatatgtaagaaca

SEQ ID NO: 1692096 - DNA, 12 bp, Homo sapiens
aaatatgtaata

SEQ ID NO: 1692097 - DNA, 16 bp, Homo sapiens
aaatatgtcctggggt

SEQ ID NO: 1692098 - DNA, 22 bp, Homo sapiens
aaatatgtgaaaggaacatttt

SEQ ID NO: 1692099 - DNA, 13 bp, Homo sapiens
aaatatgttttta

SEQ ID NO: 1692100 - DNA, 15 bp, Homo sapiens
aaagttaacattaat

SEQ ID NO: 1692101 - DNA, 22 bp, Homo sapiens
aaagttacccaaagggcttatt

SEQ ID NO: 1692102 - DNA, 15 bp, Homo sapiens
aaagttactgtaaat

SEQ ID NO: 1692103 - DNA, 20 bp, Homo sapiens
aaagttagtatcttttgata

SEQ ID NO: 1692104 - DNA, 17 bp, Homo sapiens
aaagttagtattaaaat

SEQ ID NO: 1692105 - DNA, 18 bp, Homo sapiens
aaagttagtattaaaatc

SEQ ID NO: 1692106 - DNA, 15 bp, Homo sapiens
aaagttattaaaatt

SEQ ID NO: 1692107 - DNA, 23 bp, Homo sapiens
aaagttattgataagttcataca

SEQ ID NO: 1692108 - DNA, 20 bp, Homo sapiens
aaagttatttccctttagct

SEQ ID NO: 1692109 - DNA, 18 bp, Homo sapiens
aaagttccaagagtctaa

SEQ ID NO: 1692110 - DNA, 12 bp, Homo sapiens
aaagttccttaa

SEQ ID NO: 1692111 - DNA, 11 bp, Homo sapiens
aaagttctaag

SEQ ID NO: 1692112 - DNA, 12 bp, Homo sapiens
aaagttctaaga

SEQ ID NO: 1692113 - DNA, 16 bp, Homo sapiens
aaagttctaagattct

SEQ ID NO: 1692114 - DNA, 17 bp, Homo sapiens
aaagttctaagattctg

SEQ ID NO: 1692115 - DNA, 21 bp, Homo sapiens
aaagttctaataatttctaat

SEQ ID NO: 1692116 - DNA, 17 bp, Homo sapiens
aaagttctgtaaaatat

SEQ ID NO: 1692117 - DNA, 13 bp, Homo sapiens
aaagttcttattt

SEQ ID NO: 1692118 - DNA, 12 bp, Homo sapiens
aaagttgaaatt

SEQ ID NO: 1692119 - DNA, 12 bp, Homo sapiens
aaagttgctttt

SEQ ID NO: 1692120 - DNA, 17 bp, Homo sapiens
aaagttggaaaggaaaa

SEQ ID NO: 1692121 - DNA, 18 bp, Homo sapiens
aaagttggaaggatctgc

SEQ ID NO: 1692122 - DNA, 20 bp, Homo sapiens
aaagttggaaggatctgctg

SEQ ID NO: 1692123 - DNA, 20 bp, Homo sapiens
aaagttgggcccctgaggag

SEQ ID NO: 1692124 - DNA, 18 bp, Homo sapiens
aaagttgtaaaatagaaa

SEQ ID NO: 1692125 - DNA, 16 bp, Homo sapiens
aaagttgtactttaaa

SEQ ID NO: 1692126 - DNA, 13 bp, Homo sapiens
aaagttgttcttt

SEQ ID NO: 1692127 - DNA, 13 bp, Homo sapiens
aaagttgttgtaa

SEQ ID NO: 1692128 - DNA, 16 bp, Homo sapiens
aaagtttacaacataa

SEQ ID NO: 1692129 - DNA, 16 bp, Homo sapiens
aaagtttacaagcgag

SEQ ID NO: 1692130 - DNA, 17 bp, Homo sapiens
aaagttttatatgcttt

SEQ ID NO: 1692131 - DNA, 16 bp, Homo sapiens
aaagttttatttttct

SEQ ID NO: 1692132 - DNA, 21 bp, Homo sapiens
aaagttttgatgaaattcttg

SEQ ID NO: 1692133 - DNA, 18 bp, Homo sapiens
aaagttttgtaaaagaaa

SEQ ID NO: 1692134 - DNA, 12 bp, Homo sapiens
aaagttttgttg

SEQ ID NO: 1692135 - DNA, 12 bp, Homo sapiens
aaagtttttgct

SEQ ID NO: 1692136 - DNA, 11 bp, Homo sapiens
aaagtttttta

SEQ ID NO: 1692137 - DNA, 14 bp, Homo sapiens
aaataaaaagtgac

SEQ ID NO: 1692138 - DNA, 21 bp, Homo sapiens
aaataaaaagtgacacagcag

SEQ ID NO: 1692139 - DNA, 16 bp, Homo sapiens
aaataaaaataaattc

SEQ ID NO: 1692140 - DNA, 17 bp, Homo sapiens
aaataaaacacacctcg

SEQ ID NO: 1692141 - DNA, 18 bp, Homo sapiens
aaataaaacacacctcgt

SEQ ID NO: 1692142 - DNA, 11 bp, Homo sapiens
aaataaaagca

SEQ ID NO: 1692143 - DNA, 19 bp, Homo sapiens
aaataaaagcagcatctgc

SEQ ID NO: 1692144 - DNA, 13 bp, Homo sapiens
aaataaaatatgt

SEQ ID NO: 1692145 - DNA, 17 bp, Homo sapiens
aaataaaatatgttctt

SEQ ID NO: 1692146 - DNA, 14 bp, Homo sapiens
aaataaaatattca

SEQ ID NO: 1692147 - DNA, 16 bp, Homo sapiens
aaataaaatgtgtaca

SEQ ID NO: 1692148 - DNA, 23 bp, Homo sapiens
aaataaaatgtgtacagtgaatt

SEQ ID NO: 1692149 - DNA, 14 bp, Homo sapiens
aaataaaatgtttc

SEQ ID NO: 1692150 - DNA, 16 bp, Homo sapiens
aaataaaatgtttcat

SEQ ID NO: 1692151 - DNA, 13 bp, Homo sapiens
aaataaaattatg

SEQ ID NO: 1692152 - DNA, 13 bp, Homo sapiens
aaataaacacagt

SEQ ID NO: 1692153 - DNA, 16 bp, Homo sapiens
aaataaacatcagttt

SEQ ID NO: 1692154 - DNA, 12 bp, Homo sapiens
aaataaactaga

SEQ ID NO: 1692155 - DNA, 13 bp, Homo sapiens
aaataaactattt

SEQ ID NO: 1692156 - DNA, 19 bp, Homo sapiens
aaataaactatttatatca

SEQ ID NO: 1692157 - DNA, 14 bp, Homo sapiens
aaataaactgttgc

SEQ ID NO: 1692158 - DNA, 20 bp, Homo sapiens
aaataaagaagaaaataacc

SEQ ID NO: 1692159 - DNA, 13 bp, Homo sapiens
aaataaagaagta

SEQ ID NO: 1692160 - DNA, 17 bp, Homo sapiens
aaataaagataaccctt

SEQ ID NO: 1692161 - DNA, 11 bp, Homo sapiens
aaataaagcct

SEQ ID NO: 1692162 - DNA, 16 bp, Homo sapiens
aaataaagtatatata

SEQ ID NO: 1692163 - DNA, 16 bp, Homo sapiens
aaataaagtctatttt

SEQ ID NO: 1692164 - DNA, 18 bp, Homo sapiens
aaataaagttggtgacag

SEQ ID NO: 1692165 - DNA, 12 bp, Homo sapiens
aaataaatattt

SEQ ID NO: 1692166 - DNA, 21 bp, Homo sapiens
aaataaatcatcctcatgtcc

SEQ ID NO: 1692167 - DNA, 15 bp, Homo sapiens
aaataaatgtatcat

SEQ ID NO: 1692168 - DNA, 21 bp, Homo sapiens
aaataaatgtatcatagaaat

SEQ ID NO: 1692169 - DNA, 16 bp, Homo sapiens
aaataaattcctacaa

SEQ ID NO: 1692170 - DNA, 13 bp, Homo sapiens
aaataaatttccc

SEQ ID NO: 1692171 - DNA, 19 bp, Homo sapiens
aaataaatttggttctaat

SEQ ID NO: 1692172 - DNA, 14 bp, Homo sapiens
aaataaattttaaa

SEQ ID NO: 1692173 - DNA, 13 bp, Homo sapiens
aaataaattttgt

SEQ ID NO: 1692174 - DNA, 15 bp, Homo sapiens
aaataacacagagag

SEQ ID NO: 1692175 - DNA, 23 bp, Homo sapiens
aaataacacagagagacagactt

SEQ ID NO: 1692176 - DNA, 14 bp, Homo sapiens
aaataacatattct

SEQ ID NO: 1692177 - DNA, 17 bp, Homo sapiens
aaataacatattcttgc

SEQ ID NO: 1692178 - DNA, 15 bp, Homo sapiens
aaataacatctgaaa

SEQ ID NO: 1692179 - DNA, 15 bp, Homo sapiens
aaataacccataatt

SEQ ID NO: 1692180 - DNA, 20 bp, Homo sapiens
aaataacctaattaatatat

SEQ ID NO: 1692181 - DNA, 18 bp, Homo sapiens
aaataactgaatttggag

SEQ ID NO: 1692182 - DNA, 21 bp, Homo sapiens
aaataactggaaaacagaaca

SEQ ID NO: 1692183 - DNA, 15 bp, Homo sapiens
aaataactgtaatta

SEQ ID NO: 1692184 - DNA, 22 bp, Homo sapiens
aaataactgtaattatttgaat

SEQ ID NO: 1692185 - DNA, 14 bp, Homo sapiens
aaataagaaataat

SEQ ID NO: 1692186 - DNA, 20 bp, Homo sapiens
aaataagaacgaggatttta

SEQ ID NO: 1692187 - DNA, 16 bp, Homo sapiens
aaataagattctaacg

SEQ ID NO: 1692188 - DNA, 15 bp, Homo sapiens
aaataagcaggtgga

SEQ ID NO: 1692189 - DNA, 12 bp, Homo sapiens
aaataagtattt

SEQ ID NO: 1692190 - DNA, 17 bp, Homo sapiens
aaataagtatttataat

SEQ ID NO: 1692191 - DNA, 13 bp, Homo sapiens
aaataagtcaaca

SEQ ID NO: 1692192 - DNA, 15 bp, Homo sapiens
aaataagtcaacagt

SEQ ID NO: 1692193 - DNA, 12 bp, Homo sapiens
aaataataaatc

SEQ ID NO: 1692194 - DNA, 13 bp, Homo sapiens
aaataatatgcat

SEQ ID NO: 1692195 - DNA, 14 bp, Homo sapiens
aaataatcaagatt

SEQ ID NO: 1692196 - DNA, 22 bp, Homo sapiens
aaataatctatttctatgagaa

SEQ ID NO: 1692197 - DNA, 13 bp, Homo sapiens
aaataatgtctct

SEQ ID NO: 1692198 - DNA, 21 bp, Homo sapiens
aaataattatataactgtatt

SEQ ID NO: 1692199 - DNA, 9 bp, Homo sapiens
aaataattg

SEQ ID NO: 1692200 - DNA, 23 bp, Homo sapiens
aaataatttgaatgtatttgatt

SEQ ID NO: 1692201 - DNA, 14 bp, Homo sapiens
aaataattttaaac

SEQ ID NO: 1692202 - DNA, 18 bp, Homo sapiens
aaataattttaaacaaag

SEQ ID NO: 1692203 - DNA, 19 bp, Homo sapiens
aacagtggttgcctggggg

SEQ ID NO: 1692204 - DNA, 20 bp, Homo sapiens
aacagtgtcttgagctctaa

SEQ ID NO: 1692205 - DNA, 13 bp, Homo sapiens
aacagtgtttaaa

SEQ ID NO: 1692206 - DNA, 21 bp, Homo sapiens
aacagtgtttcccataatttt

SEQ ID NO: 1692207 - DNA, 13 bp, Homo sapiens
aacagttatattt

SEQ ID NO: 1692208 - DNA, 16 bp, Homo sapiens
aacagttatatttttg

SEQ ID NO: 1692209 - DNA, 17 bp, Homo sapiens
aacagttatatttttgt

SEQ ID NO: 1692210 - DNA, 16 bp, Homo sapiens
aacagttatttctgtt

SEQ ID NO: 1692211 - DNA, 20 bp, Homo sapiens
aacagttgcatgtagtaaca

SEQ ID NO: 1692212 - DNA, 14 bp, Homo sapiens
aacagttgctgtga

SEQ ID NO: 1692213 - DNA, 17 bp, Homo sapiens
aacagttggtaactttt

SEQ ID NO: 1692214 - DNA, 20 bp, Homo sapiens
aacagttgtatttaacagaa

SEQ ID NO: 1692215 - DNA, 22 bp, Homo sapiens
aacagtttcttgcttggaagcc

SEQ ID NO: 1692216 - DNA, 16 bp, Homo sapiens
aacataaaaactgatt

SEQ ID NO: 1692217 - DNA, 17 bp, Homo sapiens
aacataaaaactgattt

SEQ ID NO: 1692218 - DNA, 14 bp, Homo sapiens
aacacccttagaaa

SEQ ID NO: 1692219 - DNA, 16 bp, Homo sapiens
aacacgattttcaaga

SEQ ID NO: 1692220 - DNA, 17 bp, Homo sapiens
aacacgattttcaagat

SEQ ID NO: 1692221 - DNA, 14 bp, Homo sapiens
aacactaaaaataa

SEQ ID NO: 1692222 - DNA, 17 bp, Homo sapiens
aacactaactcaccagc

SEQ ID NO: 1692223 - DNA, 20 bp, Homo sapiens
aacactaatatatttaaaaa

SEQ ID NO: 1692224 - DNA, 22 bp, Homo sapiens
aacactaatatatttaaaaata

SEQ ID NO: 1692225 - DNA, 16 bp, Homo sapiens
aacactaattcataat

SEQ ID NO: 1692226 - DNA, 16 bp, Homo sapiens
aacactatgtttattt

SEQ ID NO: 1692227 - DNA, 22 bp, Homo sapiens
aacactcctctactcttacaga

SEQ ID NO: 1692228 - DNA, 19 bp, Homo sapiens
aacactgcagtttcctgga

SEQ ID NO: 1692229 - DNA, 13 bp, Homo sapiens
aaatgtaagcaaa

SEQ ID NO: 1692230 - DNA, 13 bp, Homo sapiens
aaatgtaaggcaa

SEQ ID NO: 1692231 - DNA, 16 bp, Homo sapiens
aaatgtaagggaaact

SEQ ID NO: 1692232 - DNA, 22 bp, Homo sapiens
aaatgtaagggaaactgccagc

SEQ ID NO: 1692233 - DNA, 15 bp, Homo sapiens
aaatgtaatagccaa

SEQ ID NO: 1692234 - DNA, 21 bp, Homo sapiens
aaatgtaatataatgtatttt

SEQ ID NO: 1692235 - DNA, 22 bp, Homo sapiens
aaatgtacactaccaaacactc

SEQ ID NO: 1692236 - DNA, 13 bp, Homo sapiens
aaatgtacatgta

SEQ ID NO: 1692237 - DNA, 16 bp, Homo sapiens
aaatgtacatgtatta

SEQ ID NO: 1692238 - DNA, 23 bp, Homo sapiens
aaatgtacatgtattaaattaca

SEQ ID NO: 1692239 - DNA, 22 bp, Homo sapiens
aaatgtacccctctcagtctgc

SEQ ID NO: 1692240 - DNA, 20 bp, Homo sapiens
aaatgtacccgagcacatag

SEQ ID NO: 1692241 - DNA, 14 bp, Homo sapiens
aaatgtactggtaa

SEQ ID NO: 1692242 - DNA, 17 bp, Homo sapiens
aaatgtactggtaattg

SEQ ID NO: 1692243 - DNA, 22 bp, Homo sapiens
aaatgtactggtaattgtacaa

SEQ ID NO: 1692244 - DNA, 19 bp, Homo sapiens
aaatgtagaaacttaaaca

SEQ ID NO: 1692245 - DNA, 13 bp, Homo sapiens
aaatgtaggtcct

SEQ ID NO: 1692246 - DNA, 19 bp, Homo sapiens
aaatgtataaaaattatca

SEQ ID NO: 1692247 - DNA, 21 bp, Homo sapiens
aaatgtataaaaattatcaaa

SEQ ID NO: 1692248 - DNA, 13 bp, Homo sapiens
aaatgtataaata

SEQ ID NO: 1692249 - DNA, 21 bp, Homo sapiens
aaatgtataaatatacagtat

SEQ ID NO: 1692250 - DNA, 20 bp, Homo sapiens
aaatgtatcatagaaatgta

SEQ ID NO: 1692251 - DNA, 17 bp, Homo sapiens
aaatgtatcttattcac

SEQ ID NO: 1692252 - DNA, 16 bp, Homo sapiens
aaatgtattgattcaa

SEQ ID NO: 1692253 - DNA, 20 bp, Homo sapiens
aaatgtatttaattccatat

SEQ ID NO: 1692254 - DNA, 15 bp, Homo sapiens
aaatgtcagatacaa

SEQ ID NO: 1692255 - DNA, 14 bp, Homo sapiens
aaatgtccagatgt

SEQ ID NO: 1692256 - DNA, 12 bp, Homo sapiens
aaatgtgaattt

SEQ ID NO: 1692257 - DNA, 15 bp, Homo sapiens
aaatgtgatttttct

SEQ ID NO: 1692258 - DNA, 12 bp, Homo sapiens
aaatgtgtacag

SEQ ID NO: 1692259 - DNA, 16 bp, Homo sapiens
aaatgtgtacagtgaa

SEQ ID NO: 1692260 - DNA, 19 bp, Homo sapiens
aaatgtgtatttttcaagg

SEQ ID NO: 1692261 - DNA, 14 bp, Homo sapiens
aaatgtgtcagaat

SEQ ID NO: 1692262 - DNA, 20 bp, Homo sapiens
aaatgtgtcagaataggaaa

SEQ ID NO: 1692263 - DNA, 20 bp, Homo sapiens
aaatgtgtcctatctatctt

SEQ ID NO: 1692264 - DNA, 19 bp, Homo sapiens
aaatgtgtttttctatata

SEQ ID NO: 1692265 - DNA, 18 bp, Homo sapiens
aaatgttaaaagttttat

SEQ ID NO: 1692266 - DNA, 13 bp, Homo sapiens
aaatgttaagaaa

SEQ ID NO: 1692267 - DNA, 22 bp, Homo sapiens
aaatgttacacattaaacagga

SEQ ID NO: 1692268 - DNA, 14 bp, Homo sapiens
aaatgttacctaat

SEQ ID NO: 1692269 - DNA, 23 bp, Homo sapiens
aaatgttacctaattattacagc

SEQ ID NO: 1692270 - DNA, 17 bp, Homo sapiens
aaatgttacctctgaat

SEQ ID NO: 1692271 - DNA, 22 bp, Homo sapiens
aaatgttactccctgttttagt

SEQ ID NO: 1692272 - DNA, 13 bp, Homo sapiens
aaatgttatgtat

SEQ ID NO: 1692273 - DNA, 14 bp, Homo sapiens
aaatgttatgtata

SEQ ID NO: 1692274 - DNA, 16 bp, Homo sapiens
aaatgttcacaaggta

SEQ ID NO: 1692275 - DNA, 13 bp, Homo sapiens
aaatgttctaagt

SEQ ID NO: 1692276 - DNA, 17 bp, Homo sapiens
aaatgttctaagtttct

SEQ ID NO: 1692277 - DNA, 17 bp, Homo sapiens
aaatgttctatttaaca

SEQ ID NO: 1692278 - DNA, 22 bp, Homo sapiens
aaatgttctatttaacaactgg

SEQ ID NO: 1692279 - DNA, 13 bp, Homo sapiens
aaatgtttactgt

SEQ ID NO: 1692280 - DNA, 14 bp, Homo sapiens
aaatgtttactgta

SEQ ID NO: 1692281 - DNA, 23 bp, Homo sapiens
aaatgtttcattatgcactttta

SEQ ID NO: 1692282 - DNA, 19 bp, Homo sapiens
aaatgtttccttaaacatg

SEQ ID NO: 1692283 - DNA, 19 bp, Homo sapiens
aaatgtttcttttgtttgg

SEQ ID NO: 1692284 - DNA, 19 bp, Homo sapiens
aaatgtttgaaaacaaaaa

SEQ ID NO: 1692285 - DNA, 12 bp, Homo sapiens
aaatgtttggat

SEQ ID NO: 1692286 - DNA, 18 bp, Homo sapiens
aaatgttttagcaattta

SEQ ID NO: 1692287 - DNA, 16 bp, Homo sapiens
aaatgtttttctgcca

SEQ ID NO: 1692288 - DNA, 15 bp, Homo sapiens
aaattaaaaaaaaat

SEQ ID NO: 1692289 - DNA, 17 bp, Homo sapiens
aaattaaaaaaaaattg

SEQ ID NO: 1692290 - DNA, 16 bp, Homo sapiens
aaattaaacatttttc

SEQ ID NO: 1692291 - DNA, 15 bp, Homo sapiens
aaattaaaccaatga

SEQ ID NO: 1692292 - DNA, 19 bp, Homo sapiens
aaattaaatgccttgtata

SEQ ID NO: 1692293 - DNA, 12 bp, Homo sapiens
aaattaactttt

SEQ ID NO: 1692294 - DNA, 23 bp, Homo sapiens
aaattaacttttttgtggcaatt

SEQ ID NO: 1692295 - DNA, 17 bp, Homo sapiens
aaattaagatgttcaga

SEQ ID NO: 1692296 - DNA, 13 bp, Homo sapiens
aaattaagcaaat

SEQ ID NO: 1692297 - DNA, 13 bp, Homo sapiens
aaattaagttgaa

SEQ ID NO: 1692298 - DNA, 15 bp, Homo sapiens
aaattaatcttgctt

SEQ ID NO: 1692299 - DNA, 20 bp, Homo sapiens
aaattaatgcagatttctct

SEQ ID NO: 1692300 - DNA, 12 bp, Homo sapiens
aaattacatttg

SEQ ID NO: 1692301 - DNA, 15 bp, Homo sapiens
aaattacatttgtaa

SEQ ID NO: 1692302 - DNA, 18 bp, Homo sapiens
aaattacatttgtaattt

SEQ ID NO: 1692303 - DNA, 15 bp, Homo sapiens
aaattacctgtggat

SEQ ID NO: 1692304 - DNA, 13 bp, Homo sapiens
aaattacctttaa

SEQ ID NO: 1692305 - DNA, 22 bp, Homo sapiens
aaattactaattttacacatta

SEQ ID NO: 1692306 - DNA, 13 bp, Homo sapiens
aaattactataaa

SEQ ID NO: 1692307 - DNA, 14 bp, Homo sapiens
aaattagaaaggac

SEQ ID NO: 1692308 - DNA, 15 bp, Homo sapiens
aaattagaaaggaca

SEQ ID NO: 1692309 - DNA, 16 bp, Homo sapiens
aaattagaaaggacaa

SEQ ID NO: 1692310 - DNA, 23 bp, Homo sapiens
aaattagaaaggacaacagttct

SEQ ID NO: 1692311 - DNA, 20 bp, Homo sapiens
aaattagaatgaatttatct

SEQ ID NO: 1692312 - DNA, 20 bp, Homo sapiens
aaattagacaaatgctacat

SEQ ID NO: 1692313 - DNA, 13 bp, Homo sapiens
aaattagaggaga

SEQ ID NO: 1692314 - DNA, 22 bp, Homo sapiens
aaattagatttggcatctcctg

SEQ ID NO: 1692315 - DNA, 15 bp, Homo sapiens
aaattagctatttct

SEQ ID NO: 1692316 - DNA, 18 bp, Homo sapiens
aaattatataagtattct

SEQ ID NO: 1692317 - DNA, 13 bp, Homo sapiens
aaattatatccgt

SEQ ID NO: 1692318 - DNA, 14 bp, Homo sapiens
aaattatcttcacc

SEQ ID NO: 1692319 - DNA, 13 bp, Homo sapiens
aaattatgacaat

SEQ ID NO: 1692320 - DNA, 16 bp, Homo sapiens
aaattatggcatttct

SEQ ID NO: 1692321 - DNA, 17 bp, Homo sapiens
aaattatgtatgtttac

SEQ ID NO: 1692322 - DNA, 21 bp, Homo sapiens
aaattatgtgaccataatgta

SEQ ID NO: 1692323 - DNA, 20 bp, Homo sapiens
aaattatgttacatctgttt

SEQ ID NO: 1692324 - DNA, 13 bp, Homo sapiens
aaattattctagt

SEQ ID NO: 1692325 - DNA, 14 bp, Homo sapiens
aaattattctagtc

SEQ ID NO: 1692326 - DNA, 19 bp, Homo sapiens
aaattattttgttcataca

SEQ ID NO: 1692327 - DNA, 21 bp, Homo sapiens
aaattattttgttcatacata

SEQ ID NO: 1692328 - DNA, 20 bp, Homo sapiens
aaattcaacacttattttct

SEQ ID NO: 1692329 - DNA, 21 bp, Homo sapiens
aaattcaagagctagaaaaat

SEQ ID NO: 1692330 - DNA, 22 bp, Homo sapiens
aaattcaagagctagaaaaata

SEQ ID NO: 1692331 - DNA, 17 bp, Homo sapiens
aaattcaataaaaacct

SEQ ID NO: 1692332 - DNA, 14 bp, Homo sapiens
aaattcaatagtaa

SEQ ID NO: 1692333 - DNA, 17 bp, Homo sapiens
aaattcaatagtaatat

SEQ ID NO: 1692334 - DNA, 21 bp, Homo sapiens
aaattcactgtttcactgaaa

SEQ ID NO: 1692335 - DNA, 22 bp, Homo sapiens
aaattcactgtttcactgaaat

SEQ ID NO: 1692336 - DNA, 21 bp, Homo sapiens
aaattcagacaacattatgat

SEQ ID NO: 1692337 - DNA, 19 bp, Homo sapiens
aaattcagagcaagttcct

SEQ ID NO: 1692338 - DNA, 14 bp, Homo sapiens
aaattcataaccaa

SEQ ID NO: 1692339 - DNA, 16 bp, Homo sapiens
aaattcatattctgtc

SEQ ID NO: 1692340 - DNA, 18 bp, Homo sapiens
aaattcatggcatgctta

SEQ ID NO: 1692341 - DNA, 22 bp, Homo sapiens
aaattcatttttttcactggag

SEQ ID NO: 1692342 - DNA, 18 bp, Homo sapiens
aaattccaaagtctctaa

SEQ ID NO: 1692343 - DNA, 15 bp, Homo sapiens
aacaaaagagagaat

SEQ ID NO: 1692344 - DNA, 22 bp, Homo sapiens
aacaaaagatttgtttttgtag

SEQ ID NO: 1692345 - DNA, 15 bp, Homo sapiens
aacaaaagcaagact

SEQ ID NO: 1692346 - DNA, 21 bp, Homo sapiens
aacaaaagcgacccattcaga

SEQ ID NO: 1692347 - DNA, 21 bp, Homo sapiens
aacaaaaggacttcaggaaca

SEQ ID NO: 1692348 - DNA, 17 bp, Homo sapiens
aacaaaagggtgtatag

SEQ ID NO: 1692349 - DNA, 23 bp, Homo sapiens
aacaaaagggtgtatagtgttca

SEQ ID NO: 1692350 - DNA, 23 bp, Homo sapiens
aaatattccatccatatactttg

SEQ ID NO: 1692351 - DNA, 20 bp, Homo sapiens
aaatattctacacatgtaaa

SEQ ID NO: 1692352 - DNA, 14 bp, Homo sapiens
aaatattctatatg

SEQ ID NO: 1692353 - DNA, 16 bp, Homo sapiens
aaatattgaagttgtt

SEQ ID NO: 1692354 - DNA, 17 bp, Homo sapiens
aaatattgaagttgttt

SEQ ID NO: 1692355 - DNA, 23 bp, Homo sapiens
aaatattgaagttgtttatcaac

SEQ ID NO: 1692356 - DNA, 21 bp, Homo sapiens
aaatattgctgtgtcttcatt

SEQ ID NO: 1692357 - DNA, 17 bp, Homo sapiens
aaatattggttgaaagt

SEQ ID NO: 1692358 - DNA, 14 bp, Homo sapiens
aaatatttaaacct

SEQ ID NO: 1692359 - DNA, 20 bp, Homo sapiens
aaatatttaagtatatagta

SEQ ID NO: 1692360 - DNA, 21 bp, Homo sapiens
aaatatttaagtgaaggagaa

SEQ ID NO: 1692361 - DNA, 20 bp, Homo sapiens
aaatatttaatatcaaaaga

SEQ ID NO: 1692362 - DNA, 21 bp, Homo sapiens
aaatatttaatgttgaacaaa

SEQ ID NO: 1692363 - DNA, 10 bp, Homo sapiens
aaatatttat

SEQ ID NO: 1692364 - DNA, 12 bp, Homo sapiens
aaatatttatct

SEQ ID NO: 1692365 - DNA, 15 bp, Homo sapiens
aaatatttatgtaaa

SEQ ID NO: 1692366 - DNA, 12 bp, Homo sapiens
aaatatttcaag

SEQ ID NO: 1692367 - DNA, 20 bp, Homo sapiens
aaatatttctaagcttattt

SEQ ID NO: 1692368 - DNA, 22 bp, Homo sapiens
aaatatttgttacttttagttc

SEQ ID NO: 1692369 - DNA, 19 bp, Homo sapiens
aaatattttaaaatcagct

SEQ ID NO: 1692370 - DNA, 22 bp, Homo sapiens
aaatattttaatttttaaatgc

SEQ ID NO: 1692371 - DNA, 19 bp, Homo sapiens
aaatattttcctagcatca

SEQ ID NO: 1692372 - DNA, 17 bp, Homo sapiens
aaatattttctatttta

SEQ ID NO: 1692373 - DNA, 12 bp, Homo sapiens
aaatattttctc

SEQ ID NO: 1692374 - DNA, 13 bp, Homo sapiens
aaatattttgcta

SEQ ID NO: 1692375 - DNA, 16 bp, Homo sapiens
aaatattttgctaact

SEQ ID NO: 1692376 - DNA, 17 bp, Homo sapiens
aaatattttgctaactg

SEQ ID NO: 1692377 - DNA, 20 bp, Homo sapiens
aaatattttgctaactggtt

SEQ ID NO: 1692378 - DNA, 17 bp, Homo sapiens
aaatatttttggggcat

SEQ ID NO: 1692379 - DNA, 16 bp, Homo sapiens
aaatatttttttctag

SEQ ID NO: 1692380 - DNA, 22 bp, Homo sapiens
aaatcaaataataccttagaag

SEQ ID NO: 1692381 - DNA, 19 bp, Homo sapiens
aaatcaagagcattgcttt

SEQ ID NO: 1692382 - DNA, 20 bp, Homo sapiens
aaatcaaggaaaggctcatt

SEQ ID NO: 1692383 - DNA, 23 bp, Homo sapiens
aaatcaaggaaaggctcatttaa

SEQ ID NO: 1692384 - DNA, 17 bp, Homo sapiens
aaatcaagtattataaa

SEQ ID NO: 1692385 - DNA, 15 bp, Homo sapiens
aaatcaatacactag

SEQ ID NO: 1692386 - DNA, 14 bp, Homo sapiens
aaatcacatttcca

SEQ ID NO: 1692387 - DNA, 23 bp, Homo sapiens
aaatcacctggtattatttttct

SEQ ID NO: 1692388 - DNA, 13 bp, Homo sapiens
aaatcacttgttt

SEQ ID NO: 1692389 - DNA, 19 bp, Homo sapiens
aaatcactttacctgcagg

SEQ ID NO: 1692390 - DNA, 22 bp, Homo sapiens
aaatcactttacctgcaggctc

SEQ ID NO: 1692391 - DNA, 22 bp, Homo sapiens
aaatcaggcttttgtttccttt

SEQ ID NO: 1692392 - DNA, 18 bp, Homo sapiens
aaatcagttgtgaataca

SEQ ID NO: 1692393 - DNA, 14 bp, Homo sapiens
aaatcataaagtca

SEQ ID NO: 1692394 - DNA, 14 bp, Homo sapiens
aaatcataccagtt

SEQ ID NO: 1692395 - DNA, 21 bp, Homo sapiens
aaatcataccagttgttcatt

SEQ ID NO: 1692396 - DNA, 23 bp, Homo sapiens
aaatcataccagttgttcattga

SEQ ID NO: 1692397 - DNA, 13 bp, Homo sapiens
aaatcatcaagaa

SEQ ID NO: 1692398 - DNA, 19 bp, Homo sapiens
aaatcatcaagaagggctg

SEQ ID NO: 1692399 - DNA, 23 bp, Homo sapiens
aaatcatcaagaagggctgcatg

SEQ ID NO: 1692400 - DNA, 21 bp, Homo sapiens
aaatcatcattaatgacttta

SEQ ID NO: 1692401 - DNA, 23 bp, Homo sapiens
aaatcatgttgatcatgtacttt

SEQ ID NO: 1692402 - DNA, 14 bp, Homo sapiens
aaatcatgtttatt

SEQ ID NO: 1692403 - DNA, 17 bp, Homo sapiens
aaatcatgttttgatga

SEQ ID NO: 1692404 - DNA, 19 bp, Homo sapiens
aaatcatttctgcatcagc

SEQ ID NO: 1692405 - DNA, 18 bp, Homo sapiens
aaatccaaaacttctctt

SEQ ID NO: 1692406 - DNA, 12 bp, Homo sapiens
aaatccaaagaa

SEQ ID NO: 1692407 - DNA, 14 bp, Homo sapiens
aaatccaaagaaaa

SEQ ID NO: 1692408 - DNA, 16 bp, Homo sapiens
aaatccaaatattgtt

SEQ ID NO: 1692409 - DNA, 14 bp, Homo sapiens
aaatccaatattgt

SEQ ID NO: 1692410 - DNA, 17 bp, Homo sapiens
aaatccagtggtgggta

SEQ ID NO: 1692411 - DNA, 20 bp, Homo sapiens
aaatccagtggtgggtaatt

SEQ ID NO: 1692412 - DNA, 21 bp, Homo sapiens
aaatccataaactaagagaaa

SEQ ID NO: 1692413 - DNA, 20 bp, Homo sapiens
aaatccatatcttaaagaaa

SEQ ID NO: 1692414 - DNA, 15 bp, Homo sapiens
aaatcccaagaaatg

SEQ ID NO: 1692415 - DNA, 15 bp, Homo sapiens
aaatcccaccagaat

SEQ ID NO: 1692416 - DNA, 14 bp, Homo sapiens
aaatccgacttgaa

SEQ ID NO: 1692417 - DNA, 19 bp, Homo sapiens
aaatccgtgaagtcacatt

SEQ ID NO: 1692418 - DNA, 12 bp, Homo sapiens
aaatcctctggc

SEQ ID NO: 1692419 - DNA, 22 bp, Homo sapiens
aaatcctgcaatgaaaggtact

SEQ ID NO: 1692420 - DNA, 16 bp, Homo sapiens
aaatcctgccatttaa

SEQ ID NO: 1692421 - DNA, 19 bp, Homo sapiens
aaatcctggaaggacacag

SEQ ID NO: 1692422 - DNA, 16 bp, Homo sapiens
aaatccttaacatttc

SEQ ID NO: 1692423 - DNA, 19 bp, Homo sapiens
aaatccttaacatttctct

SEQ ID NO: 1692424 - DNA, 23 bp, Homo sapiens
aaatccttatgcatgaaatgaat

SEQ ID NO: 1692425 - DNA, 16 bp, Homo sapiens
aaatccttttctcatt

SEQ ID NO: 1692426 - DNA, 18 bp, Homo sapiens
aaatcctttttctttata

SEQ ID NO: 1692427 - DNA, 15 bp, Homo sapiens
aaatcgatattagaa

SEQ ID NO: 1692428 - DNA, 20 bp, Homo sapiens
aaatcgatgagcgccacctc

SEQ ID NO: 1692429 - DNA, 13 bp, Homo sapiens
aaatcgatgcagt

SEQ ID NO: 1692430 - DNA, 14 bp, Homo sapiens
aaatcgattggctt

SEQ ID NO: 1692431 - DNA, 21 bp, Homo sapiens
aaatcgtggcacgtattgctg

SEQ ID NO: 1692432 - DNA, 22 bp, Homo sapiens
aaatcgtggcacgtattgctgt

SEQ ID NO: 1692433 - DNA, 12 bp, Homo sapiens
aaatctaaaatt

SEQ ID NO: 1692434 - DNA, 15 bp, Homo sapiens
aaatctaagctgtgt

SEQ ID NO: 1692435 - DNA, 19 bp, Homo sapiens
aaatctaatctcttattct

SEQ ID NO: 1692436 - DNA, 19 bp, Homo sapiens
aaatctagttttttttgta

SEQ ID NO: 1692437 - DNA, 20 bp, Homo sapiens
aaatctagttttttttgtaa

SEQ ID NO: 1692438 - DNA, 21 bp, Homo sapiens
aaatctagttttttttgtaaa

SEQ ID NO: 1692439 - DNA, 18 bp, Homo sapiens
aaatctatatttgtcttc

SEQ ID NO: 1692440 - DNA, 12 bp, Homo sapiens
aaatctattgac

SEQ ID NO: 1692441 - DNA, 22 bp, Homo sapiens
aaatctattgacttttcaataa

SEQ ID NO: 1692442 - DNA, 17 bp, Homo sapiens
aaatctatttattaata

SEQ ID NO: 1692443 - DNA, 19 bp, Homo sapiens
aaatctatttattaatatt

SEQ ID NO: 1692444 - DNA, 22 bp, Homo sapiens
aaatctatttattaatatttaa

SEQ ID NO: 1692445 - DNA, 23 bp, Homo sapiens
aaatctcaaatttggattgctaa

SEQ ID NO: 1692446 - DNA, 18 bp, Homo sapiens
aaatctcatctctacaaa

SEQ ID NO: 1692447 - DNA, 22 bp, Homo sapiens
aaatctcatctctacaaaaagt

SEQ ID NO: 1692448 - DNA, 12 bp, Homo sapiens
aaatctcattcc

SEQ ID NO: 1692449 - DNA, 22 bp, Homo sapiens
aaatctctacaaatttttctgt

SEQ ID NO: 1692450 - DNA, 20 bp, Homo sapiens
aaatctgaattttgcaatgt

SEQ ID NO: 1692451 - DNA, 17 bp, Homo sapiens
aaatctgacctaaaagt

SEQ ID NO: 1692452 - DNA, 20 bp, Homo sapiens
aaatctgcttcatccaatgt

SEQ ID NO: 1692453 - DNA, 19 bp, Homo sapiens
aaatctgggtatctttcca

SEQ ID NO: 1692454 - DNA, 20 bp, Homo sapiens
aaatctggtcttgttagaaa

SEQ ID NO: 1692455 - DNA, 17 bp, Homo sapiens
aaatctgtaaagccagt

SEQ ID NO: 1692456 - DNA, 20 bp, Homo sapiens
aaatctgtcataagcattac

SEQ ID NO: 1692457 - DNA, 21 bp, Homo sapiens
aaatctgtccaaaggaggctg

SEQ ID NO: 1692458 - DNA, 22 bp, Homo sapiens
aaatctgtccaaaggaggctgg

SEQ ID NO: 1692459 - DNA, 11 bp, Homo sapiens
aaacttgtaaa

SEQ ID NO: 1692460 - DNA, 13 bp, Homo sapiens
aaactttaatata

SEQ ID NO: 1692461 - DNA, 15 bp, Homo sapiens
aaactttagacttcc

SEQ ID NO: 1692462 - DNA, 11 bp, Homo sapiens
aaactttattt

SEQ ID NO: 1692463 - DNA, 17 bp, Homo sapiens
aaactttgggaaaacat

SEQ ID NO: 1692464 - DNA, 18 bp, Homo sapiens
aaactttggtgcattgtt

SEQ ID NO: 1692465 - DNA, 22 bp, Homo sapiens
aaacttttgagaatgtttgaaa

SEQ ID NO: 1692466 - DNA, 13 bp, Homo sapiens
aaacttttgttta

SEQ ID NO: 1692467 - DNA, 15 bp, Homo sapiens
aaactttttttctgt

SEQ ID NO: 1692468 - DNA, 13 bp, Homo sapiens
aaagaaaaatatt

SEQ ID NO: 1692469 - DNA, 13 bp, Homo sapiens
aaagaaaaatgca

SEQ ID NO: 1692470 - DNA, 16 bp, Homo sapiens
aaagaaaagacatttt

SEQ ID NO: 1692471 - DNA, 14 bp, Homo sapiens
aaagaaaagataaa

SEQ ID NO: 1692472 - DNA, 23 bp, Homo sapiens
aaagaaaagataaagatgatcta

SEQ ID NO: 1692473 - DNA, 11 bp, Homo sapiens
aaagaaaagga

SEQ ID NO: 1692474 - DNA, 13 bp, Homo sapiens
aaagaaaattgag

SEQ ID NO: 1692475 - DNA, 17 bp, Homo sapiens
aaagaaacaagctgtgc

SEQ ID NO: 1692476 - DNA, 13 bp, Homo sapiens
aaagaaacagctt

SEQ ID NO: 1692477 - DNA, 15 bp, Homo sapiens
aaagaaacagctttc

SEQ ID NO: 1692478 - DNA, 12 bp, Homo sapiens
aaagaaaggaaa

SEQ ID NO: 1692479 - DNA, 16 bp, Homo sapiens
aaagaaagtgtatttg

SEQ ID NO: 1692480 - DNA, 11 bp, Homo sapiens
aaagaaatatt

SEQ ID NO: 1692481 - DNA, 18 bp, Homo sapiens
aaagaaatcatgtccata

SEQ ID NO: 1692482 - DNA, 23 bp, Homo sapiens
aaagaaatccatatcttaaagaa

SEQ ID NO: 1692483 - DNA, 14 bp, Homo sapiens
aaagaaatgcaaaa

SEQ ID NO: 1692484 - DNA, 15 bp, Homo sapiens
aaagaaatggctttt

SEQ ID NO: 1692485 - DNA, 23 bp, Homo sapiens
aaagaaattcagaacagcctgcc

SEQ ID NO: 1692486 - DNA, 16 bp, Homo sapiens
aaagcaacaaattaac

SEQ ID NO: 1692487 - DNA, 19 bp, Homo sapiens
aaagcaaccacaaatgcat

SEQ ID NO: 1692488 - DNA, 13 bp, Homo sapiens
aaagcaaggcaca

SEQ ID NO: 1692489 - DNA, 23 bp, Homo sapiens
aaagcaagggagaaaagagaaac

SEQ ID NO: 1692490 - DNA, 13 bp, Homo sapiens
aaagcaagtgttg

SEQ ID NO: 1692491 - DNA, 18 bp, Homo sapiens
aaagcaatacgtttgtgc

SEQ ID NO: 1692492 - DNA, 17 bp, Homo sapiens
aaagcacagatttgcat

SEQ ID NO: 1692493 - DNA, 14 bp, Homo sapiens
aaagcacatgaata

SEQ ID NO: 1692494 - DNA, 22 bp, Homo sapiens
aaagcactgacctgtcatgccc

SEQ ID NO: 1692495 - DNA, 21 bp, Homo sapiens
aaagcactgacttctaagtaa

SEQ ID NO: 1692496 - DNA, 16 bp, Homo sapiens
aaagcactttgcactt

SEQ ID NO: 1692497 - DNA, 15 bp, Homo sapiens
aaagcagaattttaa

SEQ ID NO: 1692498 - DNA, 23 bp, Homo sapiens
aaagcagaattttaatgtgaaga

SEQ ID NO: 1692499 - DNA, 20 bp, Homo sapiens
aaagcagctaaatgtaactt

SEQ ID NO: 1692500 - DNA, 21 bp, Homo sapiens
aaagcagctaaatgtaactta

SEQ ID NO: 1692501 - DNA, 22 bp, Homo sapiens
aaagcaggcttgcccagtacat

SEQ ID NO: 1692502 - DNA, 17 bp, Homo sapiens
aaagcagtaactgacaa

SEQ ID NO: 1692503 - DNA, 22 bp, Homo sapiens
aaagcagtagaaataatatgca

SEQ ID NO: 1692504 - DNA, 16 bp, Homo sapiens
aaagcataaaaacatt

SEQ ID NO: 1692505 - DNA, 18 bp, Homo sapiens
aaagcataaaaacatttt

SEQ ID NO: 1692506 - DNA, 14 bp, Homo sapiens
aaagcataaaactt

SEQ ID NO: 1692507 - DNA, 15 bp, Homo sapiens
aaagcataaatgcaa

SEQ ID NO: 1692508 - DNA, 16 bp, Homo sapiens
aaagcatcacctcagg

SEQ ID NO: 1692509 - DNA, 18 bp, Homo sapiens
aaagcatcacctcaggcc

SEQ ID NO: 1692510 - DNA, 17 bp, Homo sapiens
aaagcatccctcaccca

SEQ ID NO: 1692511 - DNA, 14 bp, Homo sapiens
aaagcatgaatggt

SEQ ID NO: 1692512 - DNA, 16 bp, Homo sapiens
aaagcatgatgggaaa

SEQ ID NO: 1692513 - DNA, 16 bp, Homo sapiens
aaagcatttggtgcct

SEQ ID NO: 1692514 - DNA, 17 bp, Homo sapiens
aaagccaaactctgcca

SEQ ID NO: 1692515 - DNA, 15 bp, Homo sapiens
aaagccaaggcagcg

SEQ ID NO: 1692516 - DNA, 17 bp, Homo sapiens
aaagccacattatttct

SEQ ID NO: 1692517 - DNA, 21 bp, Homo sapiens
aaagccacattatttctagtc

SEQ ID NO: 1692518 - DNA, 13 bp, Homo sapiens
aaagccactggaa

SEQ ID NO: 1692519 - DNA, 20 bp, Homo sapiens
aaagccagaaccagatgagt

SEQ ID NO: 1692520 - DNA, 19 bp, Homo sapiens
aaagccagctgccgaccag

SEQ ID NO: 1692521 - DNA, 22 bp, Homo sapiens
aaagcccataaggccagaaact

SEQ ID NO: 1692522 - DNA, 17 bp, Homo sapiens
aaagcccccagttaata

SEQ ID NO: 1692523 - DNA, 18 bp, Homo sapiens
aaagccctgcctctgtgt

SEQ ID NO: 1692524 - DNA, 23 bp, Homo sapiens
aaagcccttatgtttaatcagcg

SEQ ID NO: 1692525 - DNA, 14 bp, Homo sapiens
aaagcctaaaattg

SEQ ID NO: 1692526 - DNA, 20 bp, Homo sapiens
aaagcctagacaacctttct

SEQ ID NO: 1692527 - DNA, 22 bp, Homo sapiens
aaagcctagacaacctttctgt

SEQ ID NO: 1692528 - DNA, 16 bp, Homo sapiens
aaagcctcagaaaggg

SEQ ID NO: 1692529 - DNA, 18 bp, Homo sapiens
aaagcctgcaatttcata

SEQ ID NO: 1692530 - DNA, 14 bp, Homo sapiens
aaagcggtccctgt

SEQ ID NO: 1692531 - DNA, 14 bp, Homo sapiens
aaagcgtcctctca

SEQ ID NO: 1692532 - DNA, 18 bp, Homo sapiens
aaagctaaagtatctgta

SEQ ID NO: 1692533 - DNA, 14 bp, Homo sapiens
aaagctaagtatag

SEQ ID NO: 1692534 - DNA, 15 bp, Homo sapiens
aaagctaatgtgcag

SEQ ID NO: 1692535 - DNA, 23 bp, Homo sapiens
aaagctagtgtacctcctctcag

SEQ ID NO: 1692536 - DNA, 20 bp, Homo sapiens
aaagctataaagcagtattt

SEQ ID NO: 1692537 - DNA, 13 bp, Homo sapiens
aaagctcaggagg

SEQ ID NO: 1692538 - DNA, 15 bp, Homo sapiens
aaagctcaggagggt

SEQ ID NO: 1692539 - DNA, 21 bp, Homo sapiens
aaagctctgttccatgcaact

SEQ ID NO: 1692540 - DNA, 23 bp, Homo sapiens
aaagctgaacacatttcttttta

SEQ ID NO: 1692541 - DNA, 14 bp, Homo sapiens
aaagctgatttttt

SEQ ID NO: 1692542 - DNA, 24 bp, Homo sapiens
aaagctgcccactgtttctcttga

SEQ ID NO: 1692543 - DNA, 10 bp, Homo sapiens
aaagctgcct

SEQ ID NO: 1692544 - DNA, 14 bp, Homo sapiens
aaagctgctgtgat

SEQ ID NO: 1692545 - DNA, 15 bp, Homo sapiens
aaagctggaacattt

SEQ ID NO: 1692546 - DNA, 16 bp, Homo sapiens
aaagctggactgacca

SEQ ID NO: 1692547 - DNA, 17 bp, Homo sapiens
aaagctggactgaccaa

SEQ ID NO: 1692548 - DNA, 14 bp, Homo sapiens
aaagctgtgtttat

SEQ ID NO: 1692549 - DNA, 19 bp, Homo sapiens
aaagctgttattcttgtta

SEQ ID NO: 1692550 - DNA, 19 bp, Homo sapiens
aaagcttaaattgcttttg

SEQ ID NO: 1692551 - DNA, 16 bp, Homo sapiens
aaagcttaatgattct

SEQ ID NO: 1692552 - DNA, 16 bp, Homo sapiens
aaagcttcacagtacc

SEQ ID NO: 1692553 - DNA, 12 bp, Homo sapiens
aaagcttctaaa

SEQ ID NO: 1692554 - DNA, 19 bp, Homo sapiens
aaagcttctatcccaggag

SEQ ID NO: 1692555 - DNA, 14 bp, Homo sapiens
aaagcttcttcaga

SEQ ID NO: 1692556 - DNA, 15 bp, Homo sapiens
aaagctttactactg

SEQ ID NO: 1692557 - DNA, 20 bp, Homo sapiens
aaagctttactactgtggaa

SEQ ID NO: 1692558 - DNA, 23 bp, Homo sapiens
aaagctttcatgtcccagaactt

SEQ ID NO: 1692559 - DNA, 12 bp, Homo sapiens
aaagctttgcta

SEQ ID NO: 1692560 - DNA, 14 bp, Homo sapiens
aaagctttgctaca

SEQ ID NO: 1692561 - DNA, 24 bp, Homo sapiens
aaagctttgctacaaatttatgca

SEQ ID NO: 1692562 - DNA, 16 bp, Homo sapiens
aaagctttggacaagt

SEQ ID NO: 1692563 - DNA, 19 bp, Homo sapiens
aaagcttttaaaatgtaga

SEQ ID NO: 1692564 - DNA, 19 bp, Homo sapiens
aaagctttttattcctcct

SEQ ID NO: 1692565 - DNA, 12 bp, Homo sapiens
aaaggaaaaaaa

SEQ ID NO: 1692566 - DNA, 20 bp, Homo sapiens
aaaggaaaaaaaaacagcca

SEQ ID NO: 1692567 - DNA, 11 bp, Homo sapiens
aaaggaaaaat

SEQ ID NO: 1692568 - DNA, 14 bp, Homo sapiens
aaaggaaaaataat

SEQ ID NO: 1692569 - DNA, 18 bp, Homo sapiens
aaaggaaaatagtaatgt

SEQ ID NO: 1692570 - DNA, 18 bp, Homo sapiens
aaaggaaagctgtgttta

SEQ ID NO: 1692571 - DNA, 16 bp, Homo sapiens
aaaggaaatattcttt

SEQ ID NO: 1692572 - DNA, 12 bp, Homo sapiens
aaaggaaatttg

SEQ ID NO: 1692573 - DNA, 13 bp, Homo sapiens
aaaggaacatttt

SEQ ID NO: 1692574 - DNA, 12 bp, Homo sapiens
aaaggaactaga

SEQ ID NO: 1692575 - DNA, 12 bp, Homo sapiens
aaaggaagacta

SEQ ID NO: 1692576 - DNA, 13 bp, Homo sapiens
aaaggaagactag

SEQ ID NO: 1692577 - DNA, 12 bp, Homo sapiens
aaaggaaggaaa

SEQ ID NO: 1692578 - DNA, 22 bp, Homo sapiens
aaaggacaccttttaactcacc

SEQ ID NO: 1692579 - DNA, 22 bp, Homo sapiens
aaaggactaacataaaatctgt

SEQ ID NO: 1692580 - DNA, 18 bp, Homo sapiens
aaaggagaaaaaaaacct

SEQ ID NO: 1692581 - DNA, 13 bp, Homo sapiens
aaaatgtttactg

SEQ ID NO: 1692582 - DNA, 15 bp, Homo sapiens
aaaatgtttcattat

SEQ ID NO: 1692583 - DNA, 22 bp, Homo sapiens
aaaatgtttcattatgcacttt

SEQ ID NO: 1692584 - DNA, 12 bp, Homo sapiens
aaaatgtttggt

SEQ ID NO: 1692585 - DNA, 12 bp, Homo sapiens
aaaatgttttaa

SEQ ID NO: 1692586 - DNA, 15 bp, Homo sapiens
aaaatgttttagcaa

SEQ ID NO: 1692587 - DNA, 13 bp, Homo sapiens
aaaattaaagccc

SEQ ID NO: 1692588 - DNA, 12 bp, Homo sapiens
aaaattaacttt

SEQ ID NO: 1692589 - DNA, 19 bp, Homo sapiens
aaaattaatagttttatct

SEQ ID NO: 1692590 - DNA, 18 bp, Homo sapiens
aaaattacctttaatttt

SEQ ID NO: 1692591 - DNA, 12 bp, Homo sapiens
aaaattactaat

SEQ ID NO: 1692592 - DNA, 15 bp, Homo sapiens
aaaattactaatttt

SEQ ID NO: 1692593 - DNA, 11 bp, Homo sapiens
aaaattacttt

SEQ ID NO: 1692594 - DNA, 15 bp, Homo sapiens
aaaattatgcaaaag

SEQ ID NO: 1692595 - DNA, 18 bp, Homo sapiens
aaaattattttgttcata

SEQ ID NO: 1692596 - DNA, 15 bp, Homo sapiens
aaaattcaaagcatg

SEQ ID NO: 1692597 - DNA, 13 bp, Homo sapiens
aaaattcaacaaa

SEQ ID NO: 1692598 - DNA, 15 bp, Homo sapiens
aaaattcataaccaa

SEQ ID NO: 1692599 - DNA, 19 bp, Homo sapiens
aaaattcatagtaagattg

SEQ ID NO: 1692600 - DNA, 13 bp, Homo sapiens
aaaattcatttct

SEQ ID NO: 1692601 - DNA, 12 bp, Homo sapiens
aaaattcatttt

SEQ ID NO: 1692602 - DNA, 17 bp, Homo sapiens
aaaattccaaattcatg

SEQ ID NO: 1692603 - DNA, 12 bp, Homo sapiens
aaaattccagaa

SEQ ID NO: 1692604 - DNA, 15 bp, Homo sapiens
aaaattcctatctca

SEQ ID NO: 1692605 - DNA, 23 bp, Homo sapiens
aaaattcctgtgttcaatattta

SEQ ID NO: 1692606 - DNA, 20 bp, Homo sapiens
aaaattctcagtcagtaatt

SEQ ID NO: 1692607 - DNA, 22 bp, Homo sapiens
aaaattctgttgttccatttta

SEQ ID NO: 1692608 - DNA, 23 bp, Homo sapiens
aaaattctgttgttccattttat

SEQ ID NO: 1692609 - DNA, 16 bp, Homo sapiens
aaaattgaaagaactt

SEQ ID NO: 1692610 - DNA, 19 bp, Homo sapiens
aaaattgaacaaagactac

SEQ ID NO: 1692611 - DNA, 19 bp, Homo sapiens
aaaattgatttttctcttc

SEQ ID NO: 1692612 - DNA, 21 bp, Homo sapiens
aaaattgatttttctcttcat

SEQ ID NO: 1692613 - DNA, 22 bp, Homo sapiens
aaaattgcctttctgtgtttat

SEQ ID NO: 1692614 - DNA, 20 bp, Homo sapiens
aaaattgctatgttactatt

SEQ ID NO: 1692615 - DNA, 15 bp, Homo sapiens
aaaattgctgtgcct

SEQ ID NO: 1692616 - DNA, 12 bp, Homo sapiens
aaaattgcttct

SEQ ID NO: 1692617 - DNA, 15 bp, Homo sapiens
aaaattgcttctaaa

SEQ ID NO: 1692618 - DNA, 19 bp, Homo sapiens
aaaattgcttctaaaacaa

SEQ ID NO: 1692619 - DNA, 13 bp, Homo sapiens
aaacagtatttct

SEQ ID NO: 1692620 - DNA, 22 bp, Homo sapiens
aaacagtatttctggtgtatat

SEQ ID NO: 1692621 - DNA, 18 bp, Homo sapiens
aaacagtgcctgctgaat

SEQ ID NO: 1692622 - DNA, 16 bp, Homo sapiens
aaacagttgctgtgaa

SEQ ID NO: 1692623 - DNA, 21 bp, Homo sapiens
aaacataaaaagcagaatttt

SEQ ID NO: 1692624 - DNA, 14 bp, Homo sapiens
aaacataagtgcaa

SEQ ID NO: 1692625 - DNA, 13 bp, Homo sapiens
aaacataattctt

SEQ ID NO: 1692626 - DNA, 13 bp, Homo sapiens
aaacatacataat

SEQ ID NO: 1692627 - DNA, 14 bp, Homo sapiens
aaacatagaaatgg

SEQ ID NO: 1692628 - DNA, 16 bp, Homo sapiens
aaacatcagctgaatt

SEQ ID NO: 1692629 - DNA, 18 bp, Homo sapiens
aaacatcagctgaattca

SEQ ID NO: 1692630 - DNA, 16 bp, Homo sapiens
aaacatcagttactct

SEQ ID NO: 1692631 - DNA, 23 bp, Homo sapiens
aaacatcagttactctgaagggc

SEQ ID NO: 1692632 - DNA, 20 bp, Homo sapiens
aaacatctattctctccaaa

SEQ ID NO: 1692633 - DNA, 12 bp, Homo sapiens
aaacatctctgg

SEQ ID NO: 1692634 - DNA, 12 bp, Homo sapiens
aaacatgaaact

SEQ ID NO: 1692635 - DNA, 15 bp, Homo sapiens
aaacatgcacatttt

SEQ ID NO: 1692636 - DNA, 19 bp, Homo sapiens
aaacatgcttgaataactg

SEQ ID NO: 1692637 - DNA, 21 bp, Homo sapiens
aaacatgcttgaataactgag

SEQ ID NO: 1692638 - DNA, 23 bp, Homo sapiens
aaacatgcttgaataactgagct

SEQ ID NO: 1692639 - DNA, 16 bp, Homo sapiens
aaacatggagaaatct

SEQ ID NO: 1692640 - DNA, 15 bp, Homo sapiens
aaacatggtgcctat

SEQ ID NO: 1692641 - DNA, 18 bp, Homo sapiens
aaacatgtacaaaatcga

SEQ ID NO: 1692642 - DNA, 13 bp, Homo sapiens
aaacatgtcatgt

SEQ ID NO: 1692643 - DNA, 16 bp, Homo sapiens
aaacatgttaatgaca

SEQ ID NO: 1692644 - DNA, 16 bp, Homo sapiens
aaacatgttagaagca

SEQ ID NO: 1692645 - DNA, 17 bp, Homo sapiens
aaacatgttagaagcaa

SEQ ID NO: 1692646 - DNA, 19 bp, Homo sapiens
aaacatgtttaaatagcct

SEQ ID NO: 1692647 - DNA, 15 bp, Homo sapiens
aaacattaaacactg

SEQ ID NO: 1692648 - DNA, 17 bp, Homo sapiens
aaacattaatatttacc

SEQ ID NO: 1692649 - DNA, 20 bp, Homo sapiens
aaacattaattttgtgcatt

SEQ ID NO: 1692650 - DNA, 23 bp, Homo sapiens
aaacattctgatttggaaaaaga

SEQ ID NO: 1692651 - DNA, 14 bp, Homo sapiens
aaacattcttattt

SEQ ID NO: 1692652 - DNA, 19 bp, Homo sapiens
aaacatttacaataaatat

SEQ ID NO: 1692653 - DNA, 21 bp, Homo sapiens
aaacatttctggacagtacct

SEQ ID NO: 1692654 - DNA, 16 bp, Homo sapiens
aaacattttatcatta

SEQ ID NO: 1692655 - DNA, 22 bp, Homo sapiens
aaacattttatcattaaaaatt

SEQ ID NO: 1692656 - DNA, 10 bp, Homo sapiens
aaacattttc

SEQ ID NO: 1692657 - DNA, 15 bp, Homo sapiens
aaacattttttcttc

SEQ ID NO: 1692658 - DNA, 20 bp, Homo sapiens
aaaccaaaagttattaaaat

SEQ ID NO: 1692659 - DNA, 22 bp, Homo sapiens
aaaccaaaagttattaaaattg

SEQ ID NO: 1692660 - DNA, 20 bp, Homo sapiens
aaaccaaagagggcttcctc

SEQ ID NO: 1692661 - DNA, 18 bp, Homo sapiens
aaaccaagccattaatga

SEQ ID NO: 1692662 - DNA, 23 bp, Homo sapiens
aaaccaagccattaatgagatgt

SEQ ID NO: 1692663 - DNA, 16 bp, Homo sapiens
aaaccaagccgtggct

SEQ ID NO: 1692664 - DNA, 19 bp, Homo sapiens
aaaccaatgaagaagacaa

SEQ ID NO: 1692665 - DNA, 13 bp, Homo sapiens
aaaccacagctgg

SEQ ID NO: 1692666 - DNA, 18 bp, Homo sapiens
aaaccactgaaaaaatat

SEQ ID NO: 1692667 - DNA, 14 bp, Homo sapiens
aaaccacttgagcc

SEQ ID NO: 1692668 - DNA, 16 bp, Homo sapiens
aaaccagaaaagcaat

SEQ ID NO: 1692669 - DNA, 13 bp, Homo sapiens
aaaccagcaggtg

SEQ ID NO: 1692670 - DNA, 13 bp, Homo sapiens
aaaccagctgcta

SEQ ID NO: 1692671 - DNA, 12 bp, Homo sapiens
aaaccagggagc

SEQ ID NO: 1692672 - DNA, 15 bp, Homo sapiens
aaaccatgcctggta

SEQ ID NO: 1692673 - DNA, 21 bp, Homo sapiens
aaaccatgcctggtattttca

SEQ ID NO: 1692674 - DNA, 21 bp, Homo sapiens
aaaccattcgaagtcagctaa

SEQ ID NO: 1692675 - DNA, 13 bp, Homo sapiens
aaaccatttcagc

SEQ ID NO: 1692676 - DNA, 20 bp, Homo sapiens
aaaccattttcccatcatcc

SEQ ID NO: 1692677 - DNA, 23 bp, Homo sapiens
aaaccattttcccatcatccttt

SEQ ID NO: 1692678 - DNA, 17 bp, Homo sapiens
aaaccatttttgctgaa

SEQ ID NO: 1692679 - DNA, 16 bp, Homo sapiens
aaacccaaaaaagaac

SEQ ID NO: 1692680 - DNA, 13 bp, Homo sapiens
aaacccaagtccc

SEQ ID NO: 1692681 - DNA, 11 bp, Homo sapiens
aaacccagaga

SEQ ID NO: 1692682 - DNA, 13 bp, Homo sapiens
aaacccagaggtg

SEQ ID NO: 1692683 - DNA, 13 bp, Homo sapiens
aaacccatacaat

SEQ ID NO: 1692684 - DNA, 19 bp, Homo sapiens
aaacccatacaatgtatgt

SEQ ID NO: 1692685 - DNA, 13 bp, Homo sapiens
aaacccatgtgtt

SEQ ID NO: 1692686 - DNA, 19 bp, Homo sapiens
aaacccatgtgttaaaata

SEQ ID NO: 1692687 - DNA, 14 bp, Homo sapiens
aaaccctagccttg

SEQ ID NO: 1692688 - DNA, 15 bp, Homo sapiens
aaaccctagccttgc

SEQ ID NO: 1692689 - DNA, 15 bp, Homo sapiens
aaaccctataaacct

SEQ ID NO: 1692690 - DNA, 12 bp, Homo sapiens
aaaccctgcttc

SEQ ID NO: 1692691 - DNA, 13 bp, Homo sapiens
aaaccctgcttct

SEQ ID NO: 1692692 - DNA, 23 bp, Homo sapiens
aaaccgccagcgaacttgacaat

SEQ ID NO: 1692693 - DNA, 13 bp, Homo sapiens
aaacctaaaaatt

SEQ ID NO: 1692694 - DNA, 15 bp, Homo sapiens
aaacctaaaaatttt

SEQ ID NO: 1692695 - DNA, 17 bp, Homo sapiens
aaacctaaaaattttgt

SEQ ID NO: 1692696 - DNA, 19 bp, Homo sapiens
aaacctaagtcctttatgt

SEQ ID NO: 1692697 - DNA, 20 bp, Homo sapiens
aaacctaagtcctttatgtg

SEQ ID NO: 1692698 - DNA, 18 bp, Homo sapiens
aaacctaattaaggaagt

SEQ ID NO: 1692699 - DNA, 18 bp, Homo sapiens
aaacctacacactgtcat

SEQ ID NO: 1692700 - DNA, 17 bp, Homo sapiens
aaacctactgcccacat

SEQ ID NO: 1692701 - DNA, 18 bp, Homo sapiens
aaacctactgcccacatt

SEQ ID NO: 1692702 - DNA, 21 bp, Homo sapiens
aaacctactttttatgtgcta

SEQ ID NO: 1692703 - DNA, 20 bp, Homo sapiens
aaaagtgattatctctttga

SEQ ID NO: 1692704 - DNA, 22 bp, Homo sapiens
aaaagtgctgcagggctttaaa

SEQ ID NO: 1692705 - DNA, 19 bp, Homo sapiens
aaaagtggcaagaccaaaa

SEQ ID NO: 1692706 - DNA, 19 bp, Homo sapiens
aaaagtgtggcttgggcat

SEQ ID NO: 1692707 - DNA, 14 bp, Homo sapiens
aaaagttagtatta

SEQ ID NO: 1692708 - DNA, 21 bp, Homo sapiens
aaaagttcaatactcttgaaa

SEQ ID NO: 1692709 - DNA, 22 bp, Homo sapiens
aaaagttccaagagtctaaaga

SEQ ID NO: 1692710 - DNA, 23 bp, Homo sapiens
aaaagttccaagagtctaaagat

SEQ ID NO: 1692711 - DNA, 14 bp, Homo sapiens
aaaagttgaaaagc

SEQ ID NO: 1692712 - DNA, 17 bp, Homo sapiens
aaaagttgaaaagccaa

SEQ ID NO: 1692713 - DNA, 21 bp, Homo sapiens
aaaagttggaaggatctgctg

SEQ ID NO: 1692714 - DNA, 22 bp, Homo sapiens
aaaagttggaaggatctgctga

SEQ ID NO: 1692715 - DNA, 23 bp, Homo sapiens
aaaagtttacaacataatctagt

SEQ ID NO: 1692716 - DNA, 14 bp, Homo sapiens
aaaataaaactaag

SEQ ID NO: 1692717 - DNA, 14 bp, Homo sapiens
aaaataaaatattc

SEQ ID NO: 1692718 - DNA, 16 bp, Homo sapiens
aaaataaaatgcattt

SEQ ID NO: 1692719 - DNA, 19 bp, Homo sapiens
aaaataaaatgcatttaaa

SEQ ID NO: 1692720 - DNA, 12 bp, Homo sapiens
aaaataaacaaa

SEQ ID NO: 1692721 - DNA, 14 bp, Homo sapiens
aaaataaacaaata

SEQ ID NO: 1692722 - DNA, 12 bp, Homo sapiens
aaaataaactag

SEQ ID NO: 1692723 - DNA, 19 bp, Homo sapiens
aaaataaactagtttccag

SEQ ID NO: 1692724 - DNA, 21 bp, Homo sapiens
aaaataaactagtttccagtg

SEQ ID NO: 1692725 - DNA, 12 bp, Homo sapiens
aaaataaagcct

SEQ ID NO: 1692726 - DNA, 14 bp, Homo sapiens
aaaataaatatatc

SEQ ID NO: 1692727 - DNA, 19 bp, Homo sapiens
aaaataacaactatttttg

SEQ ID NO: 1692728 - DNA, 14 bp, Homo sapiens
aaaataacacacat

SEQ ID NO: 1692729 - DNA, 13 bp, Homo sapiens
aaaataacatatt

SEQ ID NO: 1692730 - DNA, 17 bp, Homo sapiens
aaaataacatctgaaaa

SEQ ID NO: 1692731 - DNA, 13 bp, Homo sapiens
aaaataaccaaaa

SEQ ID NO: 1692732 - DNA, 19 bp, Homo sapiens
aaaataaccggatatatac

SEQ ID NO: 1692733 - DNA, 17 bp, Homo sapiens
aaaataacctaattaat

SEQ ID NO: 1692734 - DNA, 18 bp, Homo sapiens
aaaataactatgctttag

SEQ ID NO: 1692735 - DNA, 16 bp, Homo sapiens
aaaataactgtgcact

SEQ ID NO: 1692736 - DNA, 16 bp, Homo sapiens
aaaataacttcaagca

SEQ ID NO: 1692737 - DNA, 14 bp, Homo sapiens
aaaataagcaggtg

SEQ ID NO: 1692738 - DNA, 12 bp, Homo sapiens
aaaataagggcc

SEQ ID NO: 1692739 - DNA, 14 bp, Homo sapiens
aaaataagtcaaca

SEQ ID NO: 1692740 - DNA, 14 bp, Homo sapiens
aaaataatcaagat

SEQ ID NO: 1692741 - DNA, 21 bp, Homo sapiens
aaaataatctatttctatgag

SEQ ID NO: 1692742 - DNA, 16 bp, Homo sapiens
aaaataattgatttca

SEQ ID NO: 1692743 - DNA, 22 bp, Homo sapiens
aaaataattgatttcaagacct

SEQ ID NO: 1692744 - DNA, 20 bp, Homo sapiens
aaaataattttaaacaaagg

SEQ ID NO: 1692745 - DNA, 12 bp, Homo sapiens
aaaatacattct

SEQ ID NO: 1692746 - DNA, 17 bp, Homo sapiens
aaaatacatttgtaagt

SEQ ID NO: 1692747 - DNA, 20 bp, Homo sapiens
aaaataccactgtaattgac

SEQ ID NO: 1692748 - DNA, 15 bp, Homo sapiens
aaaataccagagcct

SEQ ID NO: 1692749 - DNA, 21 bp, Homo sapiens
aaaataccagagccttcaagt

SEQ ID NO: 1692750 - DNA, 19 bp, Homo sapiens
aaaatacctaattgtggat

SEQ ID NO: 1692751 - DNA, 22 bp, Homo sapiens
aaaatacctctaataaacactg

SEQ ID NO: 1692752 - DNA, 17 bp, Homo sapiens
aaaatactattgcctca

SEQ ID NO: 1692753 - DNA, 17 bp, Homo sapiens
aaaatactatttaagat

SEQ ID NO: 1692754 - DNA, 18 bp, Homo sapiens
aaaatactatttaagatg

SEQ ID NO: 1692755 - DNA, 14 bp, Homo sapiens
aaaatactcttttt

SEQ ID NO: 1692756 - DNA, 22 bp, Homo sapiens
aaaatacttttgcatttttcct

SEQ ID NO: 1692757 - DNA, 17 bp, Homo sapiens
aaaatagaaaaagtgga

SEQ ID NO: 1692758 - DNA, 13 bp, Homo sapiens
aaaatagaaatta

SEQ ID NO: 1692759 - DNA, 15 bp, Homo sapiens
aaaatagacaaatag

SEQ ID NO: 1692760 - DNA, 19 bp, Homo sapiens
aaaatagacaaatagaaaa

SEQ ID NO: 1692761 - DNA, 20 bp, Homo sapiens
aaaatagacctaactgaata

SEQ ID NO: 1692762 - DNA, 16 bp, Homo sapiens
aaaatagagcttttaa

SEQ ID NO: 1692763 - DNA, 20 bp, Homo sapiens
aaaatagagtgtagtttaca

SEQ ID NO: 1692764 - DNA, 18 bp, Homo sapiens
aaaataggggatatttaa

SEQ ID NO: 1692765 - DNA, 14 bp, Homo sapiens
aaaatagttacagt

SEQ ID NO: 1692766 - DNA, 14 bp, Homo sapiens
aaaatagttctatt

SEQ ID NO: 1692767 - DNA, 18 bp, Homo sapiens
aaaatagttctatttcta

SEQ ID NO: 1692768 - DNA, 23 bp, Homo sapiens
aaaatagttctatttctatctgc

SEQ ID NO: 1692769 - DNA, 14 bp, Homo sapiens
aaaatataaaatta

SEQ ID NO: 1692770 - DNA, 11 bp, Homo sapiens
aaaatatacat

SEQ ID NO: 1692771 - DNA, 17 bp, Homo sapiens
aaaatatatgaagacaa

SEQ ID NO: 1692772 - DNA, 15 bp, Homo sapiens
aaaatatatttaatg

SEQ ID NO: 1692773 - DNA, 19 bp, Homo sapiens
aaaatatctagtaatatat

SEQ ID NO: 1692774 - DNA, 17 bp, Homo sapiens
aaaactccaccttccca

SEQ ID NO: 1692775 - DNA, 15 bp, Homo sapiens
aaaactctacttaat

SEQ ID NO: 1692776 - DNA, 15 bp, Homo sapiens
aaaactgatcaaaaa

SEQ ID NO: 1692777 - DNA, 17 bp, Homo sapiens
aaaactgatcaaaaata

SEQ ID NO: 1692778 - DNA, 21 bp, Homo sapiens
aaaactgatcaaaaataaact

SEQ ID NO: 1692779 - DNA, 22 bp, Homo sapiens
aaaactgatcaaaaataaacta

SEQ ID NO: 1692780 - DNA, 23 bp, Homo sapiens
aaaactgatcaaaaataaactag

SEQ ID NO: 1692781 - DNA, 20 bp, Homo sapiens
aaaactgcgaggacatcaaa

SEQ ID NO: 1692782 - DNA, 22 bp, Homo sapiens
aaaactgcgaggacatcaaagt

SEQ ID NO: 1692783 - DNA, 19 bp, Homo sapiens
aaaactggacctgtatatt

SEQ ID NO: 1692784 - DNA, 17 bp, Homo sapiens
aaaactgtacatttaaa

SEQ ID NO: 1692785 - DNA, 15 bp, Homo sapiens
aaaactgtactgtgt

SEQ ID NO: 1692786 - DNA, 20 bp, Homo sapiens
aaaacttatgctagtttatt

SEQ ID NO: 1692787 - DNA, 21 bp, Homo sapiens
aaaacttcagtttcacagaaa

SEQ ID NO: 1692788 - DNA, 21 bp, Homo sapiens
aaaacttgactccatttcatc

SEQ ID NO: 1692789 - DNA, 16 bp, Homo sapiens
aaaactttatttaaaa

SEQ ID NO: 1692790 - DNA, 14 bp, Homo sapiens
aaaactttcctcgc

SEQ ID NO: 1692791 - DNA, 19 bp, Homo sapiens
aaaactttggaaccagact

SEQ ID NO: 1692792 - DNA, 23 bp, Homo sapiens
aaaactttggtgcattgttattt

SEQ ID NO: 1692793 - DNA, 18 bp, Homo sapiens
aaaagaaactttgttttt

SEQ ID NO: 1692794 - DNA, 10 bp, Homo sapiens
aaaagaaagc

SEQ ID NO: 1692795 - DNA, 18 bp, Homo sapiens
aaaagaaaggctgttaaa

SEQ ID NO: 1692796 - DNA, 23 bp, Homo sapiens
aaaagaaatatattttttgttat

SEQ ID NO: 1692797 - DNA, 14 bp, Homo sapiens
aaaagaaatcaata

SEQ ID NO: 1692798 - DNA, 13 bp, Homo sapiens
aaaagaaatgcaa

SEQ ID NO: 1692799 - DNA, 19 bp, Homo sapiens
aaaagaaatgctaatgtaa

SEQ ID NO: 1692800 - DNA, 22 bp, Homo sapiens
aaaagaacaataatgagagcaa

SEQ ID NO: 1692801 - DNA, 14 bp, Homo sapiens
aaaagaagaaagtc

SEQ ID NO: 1692802 - DNA, 21 bp, Homo sapiens
aaaagaagaaagtctatgctt

SEQ ID NO: 1692803 - DNA, 14 bp, Homo sapiens
aaaagaaggaaaga

SEQ ID NO: 1692804 - DNA, 12 bp, Homo sapiens
aaaagaatattt

SEQ ID NO: 1692805 - DNA, 23 bp, Homo sapiens
aaaagaatgacgtttacatataa

SEQ ID NO: 1692806 - DNA, 14 bp, Homo sapiens
aaaagacattttaa

SEQ ID NO: 1692807 - DNA, 16 bp, Homo sapiens
aaaagaccaaatctca

SEQ ID NO: 1692808 - DNA, 16 bp, Homo sapiens
aaaagactcagtgttc

SEQ ID NO: 1692809 - DNA, 21 bp, Homo sapiens
aaaagagaaacaagtattttg

SEQ ID NO: 1692810 - DNA, 15 bp, Homo sapiens
aaaagaggggctggg

SEQ ID NO: 1692811 - DNA, 19 bp, Homo sapiens
aaaagaggttactttagtt

SEQ ID NO: 1692812 - DNA, 15 bp, Homo sapiens
aaaagagtcttccaa

SEQ ID NO: 1692813 - DNA, 22 bp, Homo sapiens
aaaagataaagaccagaaattc

SEQ ID NO: 1692814 - DNA, 17 bp, Homo sapiens
aaaagataaagatgatc

SEQ ID NO: 1692815 - DNA, 18 bp, Homo sapiens
aaaagataaagatgatct

SEQ ID NO: 1692816 - DNA, 15 bp, Homo sapiens
aaaagatcaccttgt

SEQ ID NO: 1692817 - DNA, 18 bp, Homo sapiens
aaaagatggcctttgctt

SEQ ID NO: 1692818 - DNA, 12 bp, Homo sapiens
aaaagattcttc

SEQ ID NO: 1692819 - DNA, 15 bp, Homo sapiens
aaaagatttgttttt

SEQ ID NO: 1692820 - DNA, 14 bp, Homo sapiens
aaaagcaaatcatt

SEQ ID NO: 1692821 - DNA, 13 bp, Homo sapiens
aaaagcaacttca

SEQ ID NO: 1692822 - DNA, 18 bp, Homo sapiens
aaaagcaagggagaaaag

SEQ ID NO: 1692823 - DNA, 21 bp, Homo sapiens
aaaagcaattaggtagcacag

SEQ ID NO: 1692824 - DNA, 12 bp, Homo sapiens
aaaagcaattct

SEQ ID NO: 1692825 - DNA, 23 bp, Homo sapiens
aaaagcagacgcagcagctggga

SEQ ID NO: 1692826 - DNA, 14 bp, Homo sapiens
aaaagcagctacca

SEQ ID NO: 1692827 - DNA, 19 bp, Homo sapiens
aaaagcagttcatgtctga

SEQ ID NO: 1692828 - DNA, 23 bp, Homo sapiens
aaaagcagttcatgtctgaaaca

SEQ ID NO: 1692829 - DNA, 14 bp, Homo sapiens
aaaagccaaaggtc

SEQ ID NO: 1692830 - DNA, 21 bp, Homo sapiens
aaaagcctcaactagtcattt

SEQ ID NO: 1692831 - DNA, 11 bp, Homo sapiens
aaaagcctcct

SEQ ID NO: 1692832 - DNA, 13 bp, Homo sapiens
aaaagcctccttg

SEQ ID NO: 1692833 - DNA, 14 bp, Homo sapiens
aaaagcctctttct

SEQ ID NO: 1692834 - DNA, 14 bp, Homo sapiens
aaaagccttggcct

SEQ ID NO: 1692835 - DNA, 22 bp, Homo sapiens
aaaagcggaaagttagtgcttg

SEQ ID NO: 1692836 - DNA, 14 bp, Homo sapiens
aaaagctaaattac

SEQ ID NO: 1692837 - DNA, 17 bp, Homo sapiens
aaaagctagaacactgc

SEQ ID NO: 1692838 - DNA, 21 bp, Homo sapiens
aaaagctagtgtacctcctct

SEQ ID NO: 1692839 - DNA, 21 bp, Homo sapiens
aaaagctataaagtatatatt

SEQ ID NO: 1692840 - DNA, 16 bp, Homo sapiens
aaaaagtgtctcaaag

SEQ ID NO: 1692841 - DNA, 13 bp, Homo sapiens
aaaaagttccttc

SEQ ID NO: 1692842 - DNA, 14 bp, Homo sapiens
aaaaagttgttctt

SEQ ID NO: 1692843 - DNA, 17 bp, Homo sapiens
aaaaagttttatttttc

SEQ ID NO: 1692844 - DNA, 21 bp, Homo sapiens
aaaaataaaaactaatttcat

SEQ ID NO: 1692845 - DNA, 12 bp, Homo sapiens
aaaaataaaata

SEQ ID NO: 1692846 - DNA, 13 bp, Homo sapiens
aaaaataaaatta

SEQ ID NO: 1692847 - DNA, 19 bp, Homo sapiens
aaaaataaactagtttcca

SEQ ID NO: 1692848 - DNA, 21 bp, Homo sapiens
aaaaataaactagtttccagt

SEQ ID NO: 1692849 - DNA, 18 bp, Homo sapiens
aaaaataactgtaattat

SEQ ID NO: 1692850 - DNA, 16 bp, Homo sapiens
aaaaataataataatg

SEQ ID NO: 1692851 - DNA, 18 bp, Homo sapiens
aaaaatactatttaagat

SEQ ID NO: 1692852 - DNA, 16 bp, Homo sapiens
aaaaatagaaattaga

SEQ ID NO: 1692853 - DNA, 12 bp, Homo sapiens
aaaaatagacag

SEQ ID NO: 1692854 - DNA, 14 bp, Homo sapiens
aaaaatagtaaaca

SEQ ID NO: 1692855 - DNA, 22 bp, Homo sapiens
aaaaatataaaattatgagatt

SEQ ID NO: 1692856 - DNA, 14 bp, Homo sapiens
aaaaatataatgtt

SEQ ID NO: 1692857 - DNA, 21 bp, Homo sapiens
aaaaatatccttgatgtacag

SEQ ID NO: 1692858 - DNA, 12 bp, Homo sapiens
aaaaatatgaac

SEQ ID NO: 1692859 - DNA, 14 bp, Homo sapiens
aaaaatatgaacct

SEQ ID NO: 1692860 - DNA, 13 bp, Homo sapiens
aaaaatattccat

SEQ ID NO: 1692861 - DNA, 16 bp, Homo sapiens
aaaaatatttaatgtt

SEQ ID NO: 1692862 - DNA, 15 bp, Homo sapiens
aaaaatcacatcctg

SEQ ID NO: 1692863 - DNA, 20 bp, Homo sapiens
aaaaatcactatgatttctg

SEQ ID NO: 1692864 - DNA, 23 bp, Homo sapiens
aaaaatcagatgaattgataaaa

SEQ ID NO: 1692865 - DNA, 18 bp, Homo sapiens
aaaaatccaaatattgtt

SEQ ID NO: 1692866 - DNA, 16 bp, Homo sapiens
aaaaatccagaaagaa

SEQ ID NO: 1692867 - DNA, 23 bp, Homo sapiens
aaaaatccattttacacagcacc

SEQ ID NO: 1692868 - DNA, 20 bp, Homo sapiens
aaaaatcctattctgatgaa

SEQ ID NO: 1692869 - DNA, 13 bp, Homo sapiens
aaaaatctagttt

SEQ ID NO: 1692870 - DNA, 14 bp, Homo sapiens
aaaaatctagtttt

SEQ ID NO: 1692871 - DNA, 15 bp, Homo sapiens
aaaaatcttaatact

SEQ ID NO: 1692872 - DNA, 13 bp, Homo sapiens
aaaaatcttgtgc

SEQ ID NO: 1692873 - DNA, 15 bp, Homo sapiens
aaaaatgacaacaga

SEQ ID NO: 1692874 - DNA, 15 bp, Homo sapiens
aaaaatgatgttcat

SEQ ID NO: 1692875 - DNA, 18 bp, Homo sapiens
aaaaatgcccttaaatca

SEQ ID NO: 1692876 - DNA, 14 bp, Homo sapiens
aaaaatgctgctct

SEQ ID NO: 1692877 - DNA, 12 bp, Homo sapiens
aaaaatggaaaa

SEQ ID NO: 1692878 - DNA, 17 bp, Homo sapiens
aaaaatggaaaaaaaca

SEQ ID NO: 1692879 - DNA, 22 bp, Homo sapiens
aaaaatggaacataaaatacaa

SEQ ID NO: 1692880 - DNA, 12 bp, Homo sapiens
aaaaatggatat

SEQ ID NO: 1692881 - DNA, 15 bp, Homo sapiens
aaaaatggatattat

SEQ ID NO: 1692882 - DNA, 20 bp, Homo sapiens
aaaaatgggagacagcctct

SEQ ID NO: 1692883 - DNA, 15 bp, Homo sapiens
aaaaatgggagccag

SEQ ID NO: 1692884 - DNA, 13 bp, Homo sapiens
aaaaatggtataa

SEQ ID NO: 1692885 - DNA, 14 bp, Homo sapiens
aaaaatggtataaa

SEQ ID NO: 1692886 - DNA, 18 bp, Homo sapiens
aaaaatggtataaaaggt

SEQ ID NO: 1692887 - DNA, 20 bp, Homo sapiens
aaaaatggttgatggaaaat

SEQ ID NO: 1692888 - DNA, 18 bp, Homo sapiens
aaaaatgtataaaaatta

SEQ ID NO: 1692889 - DNA, 22 bp, Homo sapiens
aaaaatgtcttgggtaggcggg

SEQ ID NO: 1692890 - DNA, 17 bp, Homo sapiens
aaaaatgtgagctataa

SEQ ID NO: 1692891 - DNA, 14 bp, Homo sapiens
aaaaattaaagccc

SEQ ID NO: 1692892 - DNA, 19 bp, Homo sapiens
aaaaattacctttaatttt

SEQ ID NO: 1692893 - DNA, 15 bp, Homo sapiens
aaaaattcaatagta

SEQ ID NO: 1692894 - DNA, 17 bp, Homo sapiens
aaaaattcaatagtaat

SEQ ID NO: 1692895 - DNA, 18 bp, Homo sapiens
aaaaattcaatagtaata

SEQ ID NO: 1692896 - DNA, 20 bp, Homo sapiens
aaaaattctgttgttccatt

SEQ ID NO: 1692897 - DNA, 21 bp, Homo sapiens
aaaaattgtattgaaaacact

SEQ ID NO: 1692898 - DNA, 14 bp, Homo sapiens
aaaaattgtgatca

SEQ ID NO: 1692899 - DNA, 21 bp, Homo sapiens
aaaaattgttaatttttccta

SEQ ID NO: 1692900 - DNA, 13 bp, Homo sapiens
aaaaattgtttct

SEQ ID NO: 1692901 - DNA, 18 bp, Homo sapiens
aaaaattgtttcttgaca

SEQ ID NO: 1692902 - DNA, 21 bp, Homo sapiens
aaaaatttaaagggtgtactt

SEQ ID NO: 1692903 - DNA, 15 bp, Homo sapiens
aaaaatttttataaa

SEQ ID NO: 1692904 - DNA, 18 bp, Homo sapiens
aatcagtcccctcccatc

SEQ ID NO: 1692905 - DNA, 20 bp, Homo sapiens
aatcagtgatctatgtttgt

SEQ ID NO: 1692906 - DNA, 17 bp, Homo sapiens
aatcagtgcagtgatac

SEQ ID NO: 1692907 - DNA, 14 bp, Homo sapiens
aatcagtgtgtcta

SEQ ID NO: 1692908 - DNA, 22 bp, Homo sapiens
aatcagtgtgtctaaatttgaa

SEQ ID NO: 1692909 - DNA, 15 bp, Homo sapiens
aatcagttagttttt

SEQ ID NO: 1692910 - DNA, 21 bp, Homo sapiens
aatcagttgtgaatacattct

SEQ ID NO: 1692911 - DNA, 13 bp, Homo sapiens
aatcataaagtca

SEQ ID NO: 1692912 - DNA, 14 bp, Homo sapiens
aatcatacaaactc

SEQ ID NO: 1692913 - DNA, 21 bp, Homo sapiens
aatcatacaaactctcaccat

SEQ ID NO: 1692914 - DNA, 16 bp, Homo sapiens
aatcataccagttgtt

SEQ ID NO: 1692915 - DNA, 18 bp, Homo sapiens
aatcatataataaatgta

SEQ ID NO: 1692916 - DNA, 18 bp, Homo sapiens
aatcatcaagaagggctg

SEQ ID NO: 1692917 - DNA, 17 bp, Homo sapiens
aatcatcattaatgact

SEQ ID NO: 1692918 - DNA, 18 bp, Homo sapiens
aatcatctataaagaaga

SEQ ID NO: 1692919 - DNA, 16 bp, Homo sapiens
aatcatctgcattcct

SEQ ID NO: 1692920 - DNA, 17 bp, Homo sapiens
aatcatgaaatatgcat

SEQ ID NO: 1692921 - DNA, 19 bp, Homo sapiens
aatcatgaatctttgtttc

SEQ ID NO: 1692922 - DNA, 15 bp, Homo sapiens
aatcatgccagtatt

SEQ ID NO: 1692923 - DNA, 18 bp, Homo sapiens
aatcatgccctgccttgt

SEQ ID NO: 1692924 - DNA, 20 bp, Homo sapiens
aatcatggcggaaggtgaaa

SEQ ID NO: 1692925 - DNA, 13 bp, Homo sapiens
aatcatgtagttt

SEQ ID NO: 1692926 - DNA, 22 bp, Homo sapiens
aatcatgtccatacactttgtt

SEQ ID NO: 1692927 - DNA, 21 bp, Homo sapiens
aatcatgtgggtgagccagtg

SEQ ID NO: 1692928 - DNA, 23 bp, Homo sapiens
aatcatgtgggtgagccagtgga

SEQ ID NO: 1692929 - DNA, 23 bp, Homo sapiens
aatcatgttgatcatgtactttt

SEQ ID NO: 1692930 - DNA, 15 bp, Homo sapiens
aatcattagttttag

SEQ ID NO: 1692931 - DNA, 13 bp, Homo sapiens
aatcattcagaaa

SEQ ID NO: 1692932 - DNA, 23 bp, Homo sapiens
aatcattcagaaatgttgagtct

SEQ ID NO: 1692933 - DNA, 13 bp, Homo sapiens
aatcattgtagaa

SEQ ID NO: 1692934 - DNA, 14 bp, Homo sapiens
aatcatttattcat

SEQ ID NO: 1692935 - DNA, 22 bp, Homo sapiens
aatcatttctgcatcagctgct

SEQ ID NO: 1692936 - DNA, 13 bp, Homo sapiens
aatcatttggtta

SEQ ID NO: 1692937 - DNA, 16 bp, Homo sapiens
aatcattttaattatt

SEQ ID NO: 1692938 - DNA, 20 bp, Homo sapiens
aatcatttttaattcacgtg

SEQ ID NO: 1692939 - DNA, 22 bp, Homo sapiens
aatcattttttatatatatgca

SEQ ID NO: 1692940 - DNA, 10 bp, Homo sapiens
aatccaaaga

SEQ ID NO: 1692941 - DNA, 14 bp, Homo sapiens
aatccaaatattgt

SEQ ID NO: 1692942 - DNA, 21 bp, Homo sapiens
aatccaactttcacagtgaag

SEQ ID NO: 1692943 - DNA, 18 bp, Homo sapiens
aatccaatactgcccaag

SEQ ID NO: 1692944 - DNA, 15 bp, Homo sapiens
aatccaatattgtaa

SEQ ID NO: 1692945 - DNA, 17 bp, Homo sapiens
aatccaatattgtaatc

SEQ ID NO: 1692946 - DNA, 15 bp, Homo sapiens
aatccacatttctaa

SEQ ID NO: 1692947 - DNA, 19 bp, Homo sapiens
aatccacctgcctcggcct

SEQ ID NO: 1692948 - DNA, 13 bp, Homo sapiens
aatccagaaagaa

SEQ ID NO: 1692949 - DNA, 19 bp, Homo sapiens
aatccagaggaacaagcat

SEQ ID NO: 1692950 - DNA, 20 bp, Homo sapiens
aatccagtttgtgtttttct

SEQ ID NO: 1692951 - DNA, 20 bp, Homo sapiens
aatccataaactaagagaaa

SEQ ID NO: 1692952 - DNA, 18 bp, Homo sapiens
aatccataaatgtgttcc

SEQ ID NO: 1692953 - DNA, 20 bp, Homo sapiens
aatccataaatgtgttcctg

SEQ ID NO: 1692954 - DNA, 13 bp, Homo sapiens
aatccattttcta

SEQ ID NO: 1692955 - DNA, 22 bp, Homo sapiens
aatccattttctaaactgtttt

SEQ ID NO: 1692956 - DNA, 15 bp, Homo sapiens
aatcccaatgtttga

SEQ ID NO: 1692957 - DNA, 15 bp, Homo sapiens
aatcccaccttccca

SEQ ID NO: 1692958 - DNA, 16 bp, Homo sapiens
aatcccaccttcccac

SEQ ID NO: 1692959 - DNA, 15 bp, Homo sapiens
aatcccagcactttg

SEQ ID NO: 1692960 - DNA, 18 bp, Homo sapiens
aatcccagctactcagga

SEQ ID NO: 1692961 - DNA, 17 bp, Homo sapiens
aatcccctaaaataaca

SEQ ID NO: 1692962 - DNA, 12 bp, Homo sapiens
aatcccctcctt

SEQ ID NO: 1692963 - DNA, 17 bp, Homo sapiens
aatcccctccttgggca

SEQ ID NO: 1692964 - DNA, 13 bp, Homo sapiens
aatccccttctcc

SEQ ID NO: 1692965 - DNA, 16 bp, Homo sapiens
aatccccttctcccct

SEQ ID NO: 1692966 - DNA, 15 bp, Homo sapiens
aatcccgggctaaga

SEQ ID NO: 1692967 - DNA, 22 bp, Homo sapiens
aatccctgctttttgtgttttt

SEQ ID NO: 1692968 - DNA, 17 bp, Homo sapiens
aatccctgggcattgct

SEQ ID NO: 1692969 - DNA, 21 bp, Homo sapiens
aatccctgggcattgctttcc

SEQ ID NO: 1692970 - DNA, 23 bp, Homo sapiens
aatcccttgtacctatggctgcc

SEQ ID NO: 1692971 - DNA, 13 bp, Homo sapiens
aatccctttgcac

SEQ ID NO: 1692972 - DNA, 13 bp, Homo sapiens
aatccgtgtgtgt

SEQ ID NO: 1692973 - DNA, 23 bp, Homo sapiens
aatccgttcatagaaattgtgtt

SEQ ID NO: 1692974 - DNA, 20 bp, Homo sapiens
aatcctagaaccaagcttca

SEQ ID NO: 1692975 - DNA, 21 bp, Homo sapiens
aatcctcatgttactcagtgt

SEQ ID NO: 1692976 - DNA, 18 bp, Homo sapiens
aatcctccctacttccaa

SEQ ID NO: 1692977 - DNA, 14 bp, Homo sapiens
aatcctctctcccc

SEQ ID NO: 1692978 - DNA, 15 bp, Homo sapiens
aatcctctctcccct

SEQ ID NO: 1692979 - DNA, 17 bp, Homo sapiens
aatcctggaaggacaca

SEQ ID NO: 1692980 - DNA, 22 bp, Homo sapiens
aatcctggcaagaaagcttgag

SEQ ID NO: 1692981 - DNA, 13 bp, Homo sapiens
aatcctggcagcc

SEQ ID NO: 1692982 - DNA, 19 bp, Homo sapiens
aatcctgttactctgtccc

SEQ ID NO: 1692983 - DNA, 13 bp, Homo sapiens
aatccttaacatt

SEQ ID NO: 1692984 - DNA, 23 bp, Homo sapiens
aatccttatgcatgaaatgaatg

SEQ ID NO: 1692985 - DNA, 13 bp, Homo sapiens
aatccttccctgc

SEQ ID NO: 1692986 - DNA, 20 bp, Homo sapiens
aatccttcctaaacccaatg

SEQ ID NO: 1692987 - DNA, 14 bp, Homo sapiens
aatccttctagttt

SEQ ID NO: 1692988 - DNA, 16 bp, Homo sapiens
aatccttctagtttcc

SEQ ID NO: 1692989 - DNA, 22 bp, Homo sapiens
aatccttctattctagcctgca

SEQ ID NO: 1692990 - DNA, 13 bp, Homo sapiens
aatccttgcttat

SEQ ID NO: 1692991 - DNA, 18 bp, Homo sapiens
aatccttggagtcccagg

SEQ ID NO: 1692992 - DNA, 13 bp, Homo sapiens
aatcctttactgt

SEQ ID NO: 1692993 - DNA, 21 bp, Homo sapiens
aatcctttgagaatgtgattc

SEQ ID NO: 1692994 - DNA, 17 bp, Homo sapiens
aatccttttccttattt

SEQ ID NO: 1692995 - DNA, 19 bp, Homo sapiens
aatccttttgataaattta

SEQ ID NO: 1692996 - DNA, 18 bp, Homo sapiens
aatcgaagtgtttatgta

SEQ ID NO: 1692997 - DNA, 13 bp, Homo sapiens
aatcgattggctt

SEQ ID NO: 1692998 - DNA, 21 bp, Homo sapiens
aatcgcttaaagatgttccta

SEQ ID NO: 1692999 - DNA, 11 bp, Homo sapiens
aatcggactgc

SEQ ID NO: 1693000 - DNA, 15 bp, Homo sapiens
aatcggactgccaaa

SEQ ID NO: 1693001 - DNA, 21 bp, Homo sapiens
aatcgtactacagaaattaag

SEQ ID NO: 1693002 - DNA, 23 bp, Homo sapiens
aatcgtggcacgtattgctgtgt

SEQ ID NO: 1693003 - DNA, 23 bp, Homo sapiens
aatcgtgtgccatggatctgatc

SEQ ID NO: 1693004 - DNA, 17 bp, Homo sapiens
aatctaaaatttaaaat

SEQ ID NO: 1693005 - DNA, 20 bp, Homo sapiens
aatctaaaccttacatgtgt

SEQ ID NO: 1693006 - DNA, 20 bp, Homo sapiens
aatctaaacgtggtcacctt

SEQ ID NO: 1693007 - DNA, 14 bp, Homo sapiens
aatctaaatctatt

SEQ ID NO: 1693008 - DNA, 16 bp, Homo sapiens
aatctaaatctattta

SEQ ID NO: 1693009 - DNA, 17 bp, Homo sapiens
aatctaaatctatttat

SEQ ID NO: 1693010 - DNA, 19 bp, Homo sapiens
aatctaaatctatttatta

SEQ ID NO: 1693011 - DNA, 17 bp, Homo sapiens
aatctaacaataatatt

SEQ ID NO: 1693012 - DNA, 20 bp, Homo sapiens
aatctaacaataatatttca

SEQ ID NO: 1693013 - DNA, 17 bp, Homo sapiens
aatctaacacatttcat

SEQ ID NO: 1693014 - DNA, 20 bp, Homo sapiens
aatctaagaaaaggggagag

SEQ ID NO: 1693015 - DNA, 23 bp, Homo sapiens
aatctacaccaatgaaaacatgt

SEQ ID NO: 1693016 - DNA, 21 bp, Homo sapiens
aatctacatttgtttgtattc

SEQ ID NO: 1693017 - DNA, 23 bp, Homo sapiens
aatctactggaaatgtagcactt

SEQ ID NO: 1693018 - DNA, 14 bp, Homo sapiens
aatctagaaatgtt

SEQ ID NO: 1693019 - DNA, 18 bp, Homo sapiens
aatctagaagatgtgtaa

SEQ ID NO: 1693020 - DNA, 14 bp, Homo sapiens
aagcttcagagcct

SEQ ID NO: 1693021 - DNA, 20 bp, Homo sapiens
aagcttcagagcctagccac

SEQ ID NO: 1693022 - DNA, 21 bp, Homo sapiens
aagcttcagagcctagccacc

SEQ ID NO: 1693023 - DNA, 15 bp, Homo sapiens
aagcttcagttgctt

SEQ ID NO: 1693024 - DNA, 15 bp, Homo sapiens
aagcttccacaaaat

SEQ ID NO: 1693025 - DNA, 17 bp, Homo sapiens
aagcttcgttagaatgt

SEQ ID NO: 1693026 - DNA, 17 bp, Homo sapiens
aagcttgactcccaagt

SEQ ID NO: 1693027 - DNA, 18 bp, Homo sapiens
aagcttgactcccaagtt

SEQ ID NO: 1693028 - DNA, 18 bp, Homo sapiens
aagcttgagcctccccca

SEQ ID NO: 1693029 - DNA, 14 bp, Homo sapiens
aagcttggcagccg

SEQ ID NO: 1693030 - DNA, 23 bp, Homo sapiens
aagcttgtggccccttttacttt

SEQ ID NO: 1693031 - DNA, 22 bp, Homo sapiens
aagcttgttgaaaacccagact

SEQ ID NO: 1693032 - DNA, 13 bp, Homo sapiens
aagctttactact

SEQ ID NO: 1693033 - DNA, 14 bp, Homo sapiens
aagctttactactg

SEQ ID NO: 1693034 - DNA, 11 bp, Homo sapiens
aagctttgcta

SEQ ID NO: 1693035 - DNA, 23 bp, Homo sapiens
aagctttgcttatggtaataaaa

SEQ ID NO: 1693036 - DNA, 17 bp, Homo sapiens
aagcttttaaaatgtag

SEQ ID NO: 1693037 - DNA, 18 bp, Homo sapiens
aagcttttgcctgcaaga

SEQ ID NO: 1693038 - DNA, 15 bp, Homo sapiens
aaggaaaaaagaaaa

SEQ ID NO: 1693039 - DNA, 15 bp, Homo sapiens
aaggaaaaaagcaag

SEQ ID NO: 1693040 - DNA, 16 bp, Homo sapiens
aaggaaaaacacaagc

SEQ ID NO: 1693041 - DNA, 20 bp, Homo sapiens
aaggaaaaacacaagcaaaa

SEQ ID NO: 1693042 - DNA, 15 bp, Homo sapiens
aaggaaaaataacaa

SEQ ID NO: 1693043 - DNA, 17 bp, Homo sapiens
aaggaaaaataatcaag

SEQ ID NO: 1693044 - DNA, 19 bp, Homo sapiens
aaggaaaagcaagaaacag

SEQ ID NO: 1693045 - DNA, 15 bp, Homo sapiens
aaggaaaaggaggag

SEQ ID NO: 1693046 - DNA, 13 bp, Homo sapiens
aaggaaaatgatc

SEQ ID NO: 1693047 - DNA, 20 bp, Homo sapiens
aaggaaacacttctatttaa

SEQ ID NO: 1693048 - DNA, 22 bp, Homo sapiens
aaggaaaccaagtggtcaggag

SEQ ID NO: 1693049 - DNA, 12 bp, Homo sapiens
aaggaaagaaaa

SEQ ID NO: 1693050 - DNA, 22 bp, Homo sapiens
aaggaaaggctcatttaaaaca

SEQ ID NO: 1693051 - DNA, 22 bp, Homo sapiens
aaggaaataaagcgtcctctca

SEQ ID NO: 1693052 - DNA, 22 bp, Homo sapiens
aaggaaatctcaccccatccca

SEQ ID NO: 1693053 - DNA, 19 bp, Homo sapiens
aaggaaatctcctcttttg

SEQ ID NO: 1693054 - DNA, 21 bp, Homo sapiens
aaggaacactggcttgaagga

SEQ ID NO: 1693055 - DNA, 23 bp, Homo sapiens
aaggaagcattgtaaaataattc

SEQ ID NO: 1693056 - DNA, 11 bp, Homo sapiens
aaggaaggaaa

SEQ ID NO: 1693057 - DNA, 13 bp, Homo sapiens
aaggaaggaggca

SEQ ID NO: 1693058 - DNA, 14 bp, Homo sapiens
aaggaaggagggca

SEQ ID NO: 1693059 - DNA, 14 bp, Homo sapiens
aaggaagtctagga

SEQ ID NO: 1693060 - DNA, 14 bp, Homo sapiens
aaggaagtggggtg

SEQ ID NO: 1693061 - DNA, 18 bp, Homo sapiens
aaggaatagccagagagg

SEQ ID NO: 1693062 - DNA, 19 bp, Homo sapiens
aaggaatgcctgtgccaat

SEQ ID NO: 1693063 - DNA, 21 bp, Homo sapiens
aaggaatgtagctggtttcct

SEQ ID NO: 1693064 - DNA, 21 bp, Homo sapiens
aaggaattaccaagaatatcc

SEQ ID NO: 1693065 - DNA, 16 bp, Homo sapiens
aaggaattatcaatta

SEQ ID NO: 1693066 - DNA, 20 bp, Homo sapiens
aaggaattctaggcatccca

SEQ ID NO: 1693067 - DNA, 16 bp, Homo sapiens
aaggaatttcttaact

SEQ ID NO: 1693068 - DNA, 19 bp, Homo sapiens
aaggaatttcttaacttct

SEQ ID NO: 1693069 - DNA, 20 bp, Homo sapiens
aaggaatttcttaacttctt

SEQ ID NO: 1693070 - DNA, 13 bp, Homo sapiens
aaggaatttgtac

SEQ ID NO: 1693071 - DNA, 16 bp, Homo sapiens
aaggacaaagtctcca

SEQ ID NO: 1693072 - DNA, 21 bp, Homo sapiens
aaggacaaagtctccagccca

SEQ ID NO: 1693073 - DNA, 13 bp, Homo sapiens
aaggacacagtga

SEQ ID NO: 1693074 - DNA, 18 bp, Homo sapiens
aaggacacttcctgccta

SEQ ID NO: 1693075 - DNA, 17 bp, Homo sapiens
aaggacagagtatgaac

SEQ ID NO: 1693076 - DNA, 15 bp, Homo sapiens
aaggacagcagctgg

SEQ ID NO: 1693077 - DNA, 16 bp, Homo sapiens
aaggacaggaagctgg

SEQ ID NO: 1693078 - DNA, 15 bp, Homo sapiens
aaggacaggaccctc

SEQ ID NO: 1693079 - DNA, 19 bp, Homo sapiens
aaggaccaactggcttctg

SEQ ID NO: 1693080 - DNA, 23 bp, Homo sapiens
aaggaccaactggcttctgtgca

SEQ ID NO: 1693081 - DNA, 16 bp, Homo sapiens
aaggaccacattttat

SEQ ID NO: 1693082 - DNA, 19 bp, Homo sapiens
aaggaccacattttatatt

SEQ ID NO: 1693083 - DNA, 13 bp, Homo sapiens
aaggaccaggact

SEQ ID NO: 1693084 - DNA, 23 bp, Homo sapiens
aaggacccacccatcttcctgct

SEQ ID NO: 1693085 - DNA, 21 bp, Homo sapiens
aaggacctctttactctctcc

SEQ ID NO: 1693086 - DNA, 14 bp, Homo sapiens
aaggacgctggcta

SEQ ID NO: 1693087 - DNA, 16 bp, Homo sapiens
aaggacgctggctact

SEQ ID NO: 1693088 - DNA, 15 bp, Homo sapiens
aaggactgagggcag

SEQ ID NO: 1693089 - DNA, 22 bp, Homo sapiens
aaggactgcagacaggctctga

SEQ ID NO: 1693090 - DNA, 23 bp, Homo sapiens
aaggactgcgggacttgggtctc

SEQ ID NO: 1693091 - DNA, 15 bp, Homo sapiens
aaggactgtaaacat

SEQ ID NO: 1693092 - DNA, 17 bp, Homo sapiens
aaggactttgtacattt

SEQ ID NO: 1693093 - DNA, 17 bp, Homo sapiens
aaggagaaaaaaaacct

SEQ ID NO: 1693094 - DNA, 16 bp, Homo sapiens
aaggagaatatgataa

SEQ ID NO: 1693095 - DNA, 19 bp, Homo sapiens
aagtagtgggcatttcata

SEQ ID NO: 1693096 - DNA, 17 bp, Homo sapiens
aagtagtgtatcacagt

SEQ ID NO: 1693097 - DNA, 15 bp, Homo sapiens
aagtagtgtgcagtt

SEQ ID NO: 1693098 - DNA, 17 bp, Homo sapiens
aagtagttggtttgtat

SEQ ID NO: 1693099 - DNA, 23 bp, Homo sapiens
aagtataaagtcacttccagtgt

SEQ ID NO: 1693100 - DNA, 22 bp, Homo sapiens
aagtataatgtttattaaatgc

SEQ ID NO: 1693101 - DNA, 20 bp, Homo sapiens
aagtatagatacaaaacctt

SEQ ID NO: 1693102 - DNA, 22 bp, Homo sapiens
aagtatagcctatggcagaaaa

SEQ ID NO: 1693103 - DNA, 21 bp, Homo sapiens
aagtatatagtatatttatac

SEQ ID NO: 1693104 - DNA, 22 bp, Homo sapiens
aagtatatagtatatttatact

SEQ ID NO: 1693105 - DNA, 11 bp, Homo sapiens
aagtatatata

SEQ ID NO: 1693106 - DNA, 16 bp, Homo sapiens
aagtatatatagaatc

SEQ ID NO: 1693107 - DNA, 18 bp, Homo sapiens
aagtatatatatatatta

SEQ ID NO: 1693108 - DNA, 12 bp, Homo sapiens
aagtatatatta

SEQ ID NO: 1693109 - DNA, 16 bp, Homo sapiens
aagtatatattaggat

SEQ ID NO: 1693110 - DNA, 13 bp, Homo sapiens
aagtatatattta

SEQ ID NO: 1693111 - DNA, 13 bp, Homo sapiens
aagtatatgtcat

SEQ ID NO: 1693112 - DNA, 18 bp, Homo sapiens
aagtatcctgcttctgat

SEQ ID NO: 1693113 - DNA, 19 bp, Homo sapiens
aagtatcttctatttttat

SEQ ID NO: 1693114 - DNA, 20 bp, Homo sapiens
aagtatcttctatttttatc

SEQ ID NO: 1693115 - DNA, 21 bp, Homo sapiens
aagtatcttctatttttatca

SEQ ID NO: 1693116 - DNA, 21 bp, Homo sapiens
aagtatgcaatgcttcattat

SEQ ID NO: 1693117 - DNA, 22 bp, Homo sapiens
aagtatgcaatgcttcattatt

SEQ ID NO: 1693118 - DNA, 13 bp, Homo sapiens
aagtatgccttaa

SEQ ID NO: 1693119 - DNA, 16 bp, Homo sapiens
aagtatgccttaagca

SEQ ID NO: 1693120 - DNA, 18 bp, Homo sapiens
aagtatgccttaagcaga

SEQ ID NO: 1693121 - DNA, 16 bp, Homo sapiens
aaggatccaggaatat

SEQ ID NO: 1693122 - DNA, 22 bp, Homo sapiens
aaggatctctcaggagcacagg

SEQ ID NO: 1693123 - DNA, 13 bp, Homo sapiens
aaggatctgctga

SEQ ID NO: 1693124 - DNA, 14 bp, Homo sapiens
aaggatctgctgag

SEQ ID NO: 1693125 - DNA, 24 bp, Homo sapiens
aaggatctgctgaggcccagtgca

SEQ ID NO: 1693126 - DNA, 21 bp, Homo sapiens
aaggatctgtgattggctggt

SEQ ID NO: 1693127 - DNA, 22 bp, Homo sapiens
aaggatgaagaacacagcatgt

SEQ ID NO: 1693128 - DNA, 23 bp, Homo sapiens
aaggatgaatgaggtcccaggca

SEQ ID NO: 1693129 - DNA, 11 bp, Homo sapiens
aaggatgactt

SEQ ID NO: 1693130 - DNA, 13 bp, Homo sapiens
aaggatggatggc

SEQ ID NO: 1693131 - DNA, 15 bp, Homo sapiens
aaggatggatggcac

SEQ ID NO: 1693132 - DNA, 17 bp, Homo sapiens
aaggatggatggcaccc

SEQ ID NO: 1693133 - DNA, 20 bp, Homo sapiens
aaggatggtggttattttaa

SEQ ID NO: 1693134 - DNA, 23 bp, Homo sapiens
aaggatgtaaacagtgcctgctg

SEQ ID NO: 1693135 - DNA, 17 bp, Homo sapiens
aaggattgtgatatttt

SEQ ID NO: 1693136 - DNA, 16 bp, Homo sapiens
aaggatttgtgtttta

SEQ ID NO: 1693137 - DNA, 13 bp, Homo sapiens
aaggattttacca

SEQ ID NO: 1693138 - DNA, 14 bp, Homo sapiens
aaggattttaccaa

SEQ ID NO: 1693139 - DNA, 17 bp, Homo sapiens
aaggcaaataatggaaa

SEQ ID NO: 1693140 - DNA, 18 bp, Homo sapiens
aaggcaaatgtgtacatg

SEQ ID NO: 1693141 - DNA, 15 bp, Homo sapiens
aaggcaagccaggct

SEQ ID NO: 1693142 - DNA, 16 bp, Homo sapiens
aaggcaagccaggctc

SEQ ID NO: 1693143 - DNA, 23 bp, Homo sapiens
aaggcaagccaggctcactcaca

SEQ ID NO: 1693144 - DNA, 16 bp, Homo sapiens
aaggcaattttagtgt

SEQ ID NO: 1693145 - DNA, 12 bp, Homo sapiens
aaggcacagtgg

SEQ ID NO: 1693146 - DNA, 17 bp, Homo sapiens
aaggcacagtgggagct

SEQ ID NO: 1693147 - DNA, 19 bp, Homo sapiens
aaggcacccacaaataaat

SEQ ID NO: 1693148 - DNA, 22 bp, Homo sapiens
aaggcacccatctgtctgccaa

SEQ ID NO: 1693149 - DNA, 14 bp, Homo sapiens
aaggcactctagat

SEQ ID NO: 1693150 - DNA, 22 bp, Homo sapiens
aaggcagacacaccgcggccag

SEQ ID NO: 1693151 - DNA, 13 bp, Homo sapiens
aaggcagagaaat

SEQ ID NO: 1693152 - DNA, 15 bp, Homo sapiens
aaggcagaggcctgg

SEQ ID NO: 1693153 - DNA, 16 bp, Homo sapiens
aaggcagccctcacct

SEQ ID NO: 1693154 - DNA, 18 bp, Homo sapiens
aaggcagcctccagagcc

SEQ ID NO: 1693155 - DNA, 17 bp, Homo sapiens
aaggcagctgcctctgc

SEQ ID NO: 1693156 - DNA, 12 bp, Homo sapiens
aaggcagctgct

SEQ ID NO: 1693157 - DNA, 13 bp, Homo sapiens
aaggcagctgctc

SEQ ID NO: 1693158 - DNA, 12 bp, Homo sapiens
aaggcagggacc

SEQ ID NO: 1693159 - DNA, 12 bp, Homo sapiens
aaggcagggcag

SEQ ID NO: 1693160 - DNA, 14 bp, Homo sapiens
aaggcaggtgcctc

SEQ ID NO: 1693161 - DNA, 21 bp, Homo sapiens
aaggcatacgagagcagaggt

SEQ ID NO: 1693162 - DNA, 17 bp, Homo sapiens
aaggcatccttgtcttt

SEQ ID NO: 1693163 - DNA, 21 bp, Homo sapiens
aaggcatgatgttaaccagaa

SEQ ID NO: 1693164 - DNA, 21 bp, Homo sapiens
aaggcatgtggcctttatctc

SEQ ID NO: 1693165 - DNA, 19 bp, Homo sapiens
aaggcatgttcccagaaag

SEQ ID NO: 1693166 - DNA, 19 bp, Homo sapiens
aaggccaagaggctgttcc

SEQ ID NO: 1693167 - DNA, 15 bp, Homo sapiens
aaggccaaggtgctg

SEQ ID NO: 1693168 - DNA, 23 bp, Homo sapiens
aaggccacctcccactcctgctg

SEQ ID NO: 1693169 - DNA, 16 bp, Homo sapiens
aaggccacctctgcct

SEQ ID NO: 1693170 - DNA, 17 bp, Homo sapiens
aaggccacctctgcctc

SEQ ID NO: 1693171 - DNA, 18 bp, Homo sapiens
aaggccacctctgcctct

SEQ ID NO: 1693172 - DNA, 20 bp, Homo sapiens
aaggccagagtggcctggcc

SEQ ID NO: 1693173 - DNA, 22 bp, Homo sapiens
aaggccagagtggcctggccag

SEQ ID NO: 1693174 - DNA, 22 bp, Homo sapiens
aaggccaggacgggccacacgt

SEQ ID NO: 1693175 - DNA, 20 bp, Homo sapiens
aaggccaggccctgtgtgaa

SEQ ID NO: 1693176 - DNA, 12 bp, Homo sapiens
aaggcccaggag

SEQ ID NO: 1693177 - DNA, 16 bp, Homo sapiens
aaggccccagagagac

SEQ ID NO: 1693178 - DNA, 13 bp, Homo sapiens
aaggccccttccc

SEQ ID NO: 1693179 - DNA, 14 bp, Homo sapiens
aaggccccttccct

SEQ ID NO: 1693180 - DNA, 14 bp, Homo sapiens
aaggcccggctgag

SEQ ID NO: 1693181 - DNA, 18 bp, Homo sapiens
aaggccctgctgagtcat

SEQ ID NO: 1693182 - DNA, 23 bp, Homo sapiens
aaggccctgttagtgcactgatt

SEQ ID NO: 1693183 - DNA, 22 bp, Homo sapiens
aaggcccttcagccagaagact

SEQ ID NO: 1693184 - DNA, 13 bp, Homo sapiens
aaggccctttcct

SEQ ID NO: 1693185 - DNA, 15 bp, Homo sapiens
aaggccgccagcgtg

SEQ ID NO: 1693186 - DNA, 14 bp, Homo sapiens
aaggcctctctctg

SEQ ID NO: 1693187 - DNA, 17 bp, Homo sapiens
aaggcctctctctgcct

SEQ ID NO: 1693188 - DNA, 19 bp, Homo sapiens
aaggcctctctctgcctga

SEQ ID NO: 1693189 - DNA, 19 bp, Homo sapiens
aaggcctggaaccagggag

SEQ ID NO: 1693190 - DNA, 22 bp, Homo sapiens
aaggcctggaaccagggaggag

SEQ ID NO: 1693191 - DNA, 21 bp, Homo sapiens
aaggccttattctacatttca

SEQ ID NO: 1693192 - DNA, 15 bp, Homo sapiens
aaggccttctcctcc

SEQ ID NO: 1693193 - DNA, 19 bp, Homo sapiens
aaggccttggtggagcagc

SEQ ID NO: 1693194 - DNA, 21 bp, Homo sapiens
aaggccttggtggagcagcca

SEQ ID NO: 1693195 - DNA, 22 bp, Homo sapiens
aaggccttggtggagcagccag

SEQ ID NO: 1693196 - DNA, 16 bp, Homo sapiens
aaggcctttaataaat

SEQ ID NO: 1693197 - DNA, 22 bp, Homo sapiens
aaggcggggtattcccactcac

SEQ ID NO: 1693198 - DNA, 18 bp, Homo sapiens
aaggctaacatcccactt

SEQ ID NO: 1693199 - DNA, 17 bp, Homo sapiens
aaggctcagtctcagga

SEQ ID NO: 1693200 - DNA, 13 bp, Homo sapiens
aaggctctagatc

SEQ ID NO: 1693201 - DNA, 16 bp, Homo sapiens
aaggctctatgagtct

SEQ ID NO: 1693202 - DNA, 19 bp, Homo sapiens
aaggctctcacccccatcc

SEQ ID NO: 1693203 - DNA, 22 bp, Homo sapiens
aaggctctcgggtgggggagcc

SEQ ID NO: 1693204 - DNA, 23 bp, Homo sapiens
aaggctctcgggtgggggagcca

SEQ ID NO: 1693205 - DNA, 12 bp, Homo sapiens
aaggctctgaga

SEQ ID NO: 1693206 - DNA, 17 bp, Homo sapiens
aaggctctgtgccttgg

SEQ ID NO: 1693207 - DNA, 15 bp, Homo sapiens
aaggctgaccaagag

SEQ ID NO: 1693208 - DNA, 12 bp, Homo sapiens
aaggctggctga

SEQ ID NO: 1693209 - DNA, 16 bp, Homo sapiens
aaggctggctgagtgg

SEQ ID NO: 1693210 - DNA, 18 bp, Homo sapiens
aaggctggtaagagaagt

SEQ ID NO: 1693211 - DNA, 12 bp, Homo sapiens
aaggcttctctc

SEQ ID NO: 1693212 - DNA, 15 bp, Homo sapiens
aaggcttctctccac

SEQ ID NO: 1693213 - DNA, 13 bp, Homo sapiens
aaggcttgaagct

SEQ ID NO: 1693214 - DNA, 13 bp, Homo sapiens
aaggcttggctgg

SEQ ID NO: 1693215 - DNA, 15 bp, Homo sapiens
aagggaaaaaaaatg

SEQ ID NO: 1693216 - DNA, 19 bp, Homo sapiens
aagggaaaaatttttatgt

SEQ ID NO: 1693217 - DNA, 16 bp, Homo sapiens
aagggaaactgccagc

SEQ ID NO: 1693218 - DNA, 23 bp, Homo sapiens
aagggaaactgccagcaacgcag

SEQ ID NO: 1693219 - DNA, 21 bp, Homo sapiens
aagggaaattgtttatgtgtt

SEQ ID NO: 1693220 - DNA, 16 bp, Homo sapiens
aagggaactagataac

SEQ ID NO: 1693221 - DNA, 20 bp, Homo sapiens
aagggaagaaggaggaatgc

SEQ ID NO: 1693222 - DNA, 18 bp, Homo sapiens
aagggaagtgaggcccaa

SEQ ID NO: 1693223 - DNA, 22 bp, Homo sapiens
aagggaagtgaggcccaaggag

SEQ ID NO: 1693224 - DNA, 12 bp, Homo sapiens
aagggaatcctc

SEQ ID NO: 1693225 - DNA, 17 bp, Homo sapiens
aagggaatcctcctcca

SEQ ID NO: 1693226 - DNA, 12 bp, Homo sapiens
aagggacagcaa

SEQ ID NO: 1693227 - DNA, 16 bp, Homo sapiens
aagggacagctgctgg

SEQ ID NO: 1693228 - DNA, 13 bp, Homo sapiens
aagggagaaaaga

SEQ ID NO: 1693229 - DNA, 23 bp, Homo sapiens
aagggagaagacaacagaaagag

SEQ ID NO: 1693230 - DNA, 17 bp, Homo sapiens
aagggagagcggggcag

SEQ ID NO: 1693231 - DNA, 15 bp, Homo sapiens
aagggaggaacacta

SEQ ID NO: 1693232 - DNA, 20 bp, Homo sapiens
aagggaggaaggcctttctt

SEQ ID NO: 1693233 - DNA, 21 bp, Homo sapiens
aagggagggtgcagccctctt

SEQ ID NO: 1693234 - DNA, 13 bp, Homo sapiens
aagggagggtggc

SEQ ID NO: 1693235 - DNA, 15 bp, Homo sapiens
aagggagtttttgat

SEQ ID NO: 1693236 - DNA, 18 bp, Homo sapiens
aagggatataaaatgaaa

SEQ ID NO: 1693237 - DNA, 20 bp, Homo sapiens
aagggatataaaatgaaaga

SEQ ID NO: 1693238 - DNA, 14 bp, Homo sapiens
aagggatggcaaga

SEQ ID NO: 1693239 - DNA, 11 bp, Homo sapiens
aagggattctg

SEQ ID NO: 1693240 - DNA, 15 bp, Homo sapiens
aagggattctgggaa

SEQ ID NO: 1693241 - DNA, 23 bp, Homo sapiens
aagggattgaggagttgcctgac

SEQ ID NO: 1693242 - DNA, 15 bp, Homo sapiens
aagggcaagaaatgg

SEQ ID NO: 1693243 - DNA, 13 bp, Homo sapiens
aagggcacacaca

SEQ ID NO: 1693244 - DNA, 15 bp, Homo sapiens
aagggcacacccctg

SEQ ID NO: 1693245 - DNA, 21 bp, Homo sapiens
aagggcacagacactacatat

SEQ ID NO: 1693246 - DNA, 16 bp, Homo sapiens
aagggcacatagaaag

SEQ ID NO: 1693247 - DNA, 14 bp, Homo sapiens
aagggcacattgcc

SEQ ID NO: 1693248 - DNA, 22 bp, Homo sapiens
aagggcaggaaggagagcctgc

SEQ ID NO: 1693249 - DNA, 13 bp, Homo sapiens
aagggcagtgccc

SEQ ID NO: 1693250 - DNA, 22 bp, Homo sapiens
aagggcagtgcccatgtgtaca

SEQ ID NO: 1693251 - DNA, 20 bp, Homo sapiens
aagggcagttttgaggcatg

SEQ ID NO: 1693252 - DNA, 12 bp, Homo sapiens
aagggccagagc

SEQ ID NO: 1693253 - DNA, 16 bp, Homo sapiens
aagggccagagccagg

SEQ ID NO: 1693254 - DNA, 16 bp, Homo sapiens
aagggccagtcctgcc

SEQ ID NO: 1693255 - DNA, 18 bp, Homo sapiens
aagggcccagaccctggg

SEQ ID NO: 1693256 - DNA, 13 bp, Homo sapiens
aagggcccagagt

SEQ ID NO: 1693257 - DNA, 13 bp, Homo sapiens
aagggccccaggg

SEQ ID NO: 1693258 - DNA, 14 bp, Homo sapiens
aagggccccagggg

SEQ ID NO: 1693259 - DNA, 15 bp, Homo sapiens
aagggccccaggggc

SEQ ID NO: 1693260 - DNA, 12 bp, Homo sapiens
aagggccctggc

SEQ ID NO: 1693261 - DNA, 17 bp, Homo sapiens
aagggccctggcacccc

SEQ ID NO: 1693262 - DNA, 19 bp, Homo sapiens
aagggcggaagagttacaa

SEQ ID NO: 1693263 - DNA, 12 bp, Homo sapiens
aagggctccagc

SEQ ID NO: 1693264 - DNA, 22 bp, Homo sapiens
aagggctccagcatccagcctg

SEQ ID NO: 1693265 - DNA, 24 bp, Homo sapiens
aagggctccagcatccagcctgtg

SEQ ID NO: 1693266 - DNA, 18 bp, Homo sapiens
aagggctgacctgcctct

SEQ ID NO: 1693267 - DNA, 13 bp, Homo sapiens
aagggctgcatga

SEQ ID NO: 1693268 - DNA, 14 bp, Homo sapiens
aagggctgcatgat

SEQ ID NO: 1693269 - DNA, 17 bp, Homo sapiens
aagggctgcatgatgtt

SEQ ID NO: 1693270 - DNA, 17 bp, Homo sapiens
aagggctgccgggccag

SEQ ID NO: 1693271 - DNA, 22 bp, Homo sapiens
aagggctggcacttttttaaat

SEQ ID NO: 1693272 - DNA, 21 bp, Homo sapiens
aagggctggggccggggctga

SEQ ID NO: 1693273 - DNA, 19 bp, Homo sapiens
aagggcttctgcaccctcc

SEQ ID NO: 1693274 - DNA, 23 bp, Homo sapiens
aagggctttggttccttctctgg

SEQ ID NO: 1693275 - DNA, 21 bp, Homo sapiens
aaggggaaaatgtgaagctga

SEQ ID NO: 1693276 - DNA, 17 bp, Homo sapiens
aaggggacacctgtaca

SEQ ID NO: 1693277 - DNA, 16 bp, Homo sapiens
aaggggacagctgtgt

SEQ ID NO: 1693278 - DNA, 12 bp, Homo sapiens
aaggggagagcc

SEQ ID NO: 1693279 - DNA, 16 bp, Homo sapiens
aaggggagcccactgt

SEQ ID NO: 1693280 - DNA, 21 bp, Homo sapiens
aaggggaggacactggtggtt

SEQ ID NO: 1693281 - DNA, 16 bp, Homo sapiens
aaggggcgagcaccca

SEQ ID NO: 1693282 - DNA, 22 bp, Homo sapiens
aaggggctgaggacgagacccc

SEQ ID NO: 1693283 - DNA, 14 bp, Homo sapiens
aagggggccctgct

SEQ ID NO: 1693284 - DNA, 15 bp, Homo sapiens
aagggggccctgcta

SEQ ID NO: 1693285 - DNA, 17 bp, Homo sapiens
aagggggtcccagtggg

SEQ ID NO: 1693286 - DNA, 14 bp, Homo sapiens
aagggggtctctgt

SEQ ID NO: 1693287 - DNA, 15 bp, Homo sapiens
aagggggtgactgga

SEQ ID NO: 1693288 - DNA, 16 bp, Homo sapiens
aagggggtggggggag

SEQ ID NO: 1693289 - DNA, 16 bp, Homo sapiens
aaggggtgcacccacc

SEQ ID NO: 1693290 - DNA, 14 bp, Homo sapiens
aaggggtgctttta

SEQ ID NO: 1693291 - DNA, 18 bp, Homo sapiens
aaggggttcctcaaattt

SEQ ID NO: 1693292 - DNA, 20 bp, Homo sapiens
aaggggttggttgaggtgga

SEQ ID NO: 1693293 - DNA, 15 bp, Homo sapiens
aagggtatctgctgc

SEQ ID NO: 1693294 - DNA, 16 bp, Homo sapiens
aagggtctagggagag

SEQ ID NO: 1693295 - DNA, 17 bp, Homo sapiens
aagggtctagggagaga

SEQ ID NO: 1693296 - DNA, 18 bp, Homo sapiens
aagggtctagggagagac

SEQ ID NO: 1693297 - DNA, 18 bp, Homo sapiens
aagggtctctctccaggt

SEQ ID NO: 1693298 - DNA, 22 bp, Homo sapiens
aagggtctctctccaggtcagc

SEQ ID NO: 1693299 - DNA, 14 bp, Homo sapiens
aagggtcttcttgg

SEQ ID NO: 1693300 - DNA, 21 bp, Homo sapiens
aagggtgatgggaaagcattg

SEQ ID NO: 1693301 - DNA, 22 bp, Homo sapiens
aagggtggaaatcaaccctctc

SEQ ID NO: 1693302 - DNA, 18 bp, Homo sapiens
aagggtggcaggtcactg

SEQ ID NO: 1693303 - DNA, 20 bp, Homo sapiens
aagggtggcctgttccctag

SEQ ID NO: 1693304 - DNA, 23 bp, Homo sapiens
aagggtggcctgttccctagaga

SEQ ID NO: 1693305 - DNA, 19 bp, Homo sapiens
aagggtgtaggggccacct

SEQ ID NO: 1693306 - DNA, 20 bp, Homo sapiens
aagggtgtaggggccacctc

SEQ ID NO: 1693307 - DNA, 16 bp, Homo sapiens
aagggttctgccctgc

SEQ ID NO: 1693308 - DNA, 20 bp, Homo sapiens
aagggttctgccctgcctga

SEQ ID NO: 1693309 - DNA, 21 bp, Homo sapiens
aagggttctgccctgcctgag

SEQ ID NO: 1693310 - DNA, 23 bp, Homo sapiens
aagggttctgccctgcctgagga

SEQ ID NO: 1693311 - DNA, 17 bp, Homo sapiens
aagggttctggctgccc

SEQ ID NO: 1693312 - DNA, 15 bp, Homo sapiens
aagggttgaaggcag

SEQ ID NO: 1693313 - DNA, 14 bp, Homo sapiens
aagggttgggcccc

SEQ ID NO: 1693314 - DNA, 19 bp, Homo sapiens
aagggttttccaccctgga

SEQ ID NO: 1693315 - DNA, 16 bp, Homo sapiens
aaggtaaataaaaaga

SEQ ID NO: 1693316 - DNA, 18 bp, Homo sapiens
aaggtacaactgtattta

SEQ ID NO: 1693317 - DNA, 20 bp, Homo sapiens
aaggtacaactgtatttatt

SEQ ID NO: 1693318 - DNA, 18 bp, Homo sapiens
aaggtagcttacctgaca

SEQ ID NO: 1693319 - DNA, 16 bp, Homo sapiens
aaggtataataaaatt

SEQ ID NO: 1693320 - DNA, 11 bp, Homo sapiens
aaggtataatt

SEQ ID NO: 1693321 - DNA, 22 bp, Homo sapiens
aaggtatatcattctaaagata

SEQ ID NO: 1693322 - DNA, 23 bp, Homo sapiens
aaggtatggtggggatattttta

SEQ ID NO: 1693323 - DNA, 18 bp, Homo sapiens
aaggtattaaattgatgt

SEQ ID NO: 1693324 - DNA, 16 bp, Homo sapiens
aaggtattatacatgt

SEQ ID NO: 1693325 - DNA, 19 bp, Homo sapiens
aaggtattccttgttcttc

SEQ ID NO: 1693326 - DNA, 22 bp, Homo sapiens
aaggtattccttttgtgtacag

SEQ ID NO: 1693327 - DNA, 20 bp, Homo sapiens
aaggtattttgtagatgtga

SEQ ID NO: 1693328 - DNA, 14 bp, Homo sapiens
aaggtcaaacaggc

SEQ ID NO: 1693329 - DNA, 21 bp, Homo sapiens
aaggtccaacaagaatgcatt

SEQ ID NO: 1693330 - DNA, 19 bp, Homo sapiens
aaggtccacaggtctagac

SEQ ID NO: 1693331 - DNA, 19 bp, Homo sapiens
aaggtccggtgttctaaga

SEQ ID NO: 1693332 - DNA, 17 bp, Homo sapiens
aaggtctccaagggagg

SEQ ID NO: 1693333 - DNA, 21 bp, Homo sapiens
aaggtctcctaaaactgggat

SEQ ID NO: 1693334 - DNA, 20 bp, Homo sapiens
aaggtctccttactctgagc

SEQ ID NO: 1693335 - DNA, 21 bp, Homo sapiens
aaggtctccttactctgagcc

SEQ ID NO: 1693336 - DNA, 18 bp, Homo sapiens
aaggtctgtttgctgttg

SEQ ID NO: 1693337 - DNA, 14 bp, Homo sapiens
aaggtctgttttga

SEQ ID NO: 1693338 - DNA, 21 bp, Homo sapiens
aaggtcttgcagtggcttttc

SEQ ID NO: 1693339 - DNA, 23 bp, Homo sapiens
aaggtcttgcagtggcttttcat

SEQ ID NO: 1693340 - DNA, 19 bp, Homo sapiens
aaggtctttggttcagcta

SEQ ID NO: 1693341 - DNA, 12 bp, Homo sapiens
aaggtgaagaat

SEQ ID NO: 1693342 - DNA, 15 bp, Homo sapiens
aaggtgaagcacata

SEQ ID NO: 1693343 - DNA, 20 bp, Homo sapiens
aaggtgacacattacaaagc

SEQ ID NO: 1693344 - DNA, 21 bp, Homo sapiens
aaggtgacatcggaaaaataa

SEQ ID NO: 1693345 - DNA, 18 bp, Homo sapiens
aaggtgagaattaagttt

SEQ ID NO: 1693346 - DNA, 19 bp, Homo sapiens
aaggtgccctttagccaga

SEQ ID NO: 1693347 - DNA, 16 bp, Homo sapiens
aagcactattttatat

SEQ ID NO: 1693348 - DNA, 21 bp, Homo sapiens
aagcactattttatatttaaa

SEQ ID NO: 1693349 - DNA, 20 bp, Homo sapiens
aagcactcgagaccatcctg

SEQ ID NO: 1693350 - DNA, 12 bp, Homo sapiens
aagcactcgtgt

SEQ ID NO: 1693351 - DNA, 16 bp, Homo sapiens
aagcactgacttctaa

SEQ ID NO: 1693352 - DNA, 20 bp, Homo sapiens
aagcactgacttctaagtaa

SEQ ID NO: 1693353 - DNA, 21 bp, Homo sapiens
aagcactgctcacgtctctgc

SEQ ID NO: 1693354 - DNA, 15 bp, Homo sapiens
aagcacttcccagga

SEQ ID NO: 1693355 - DNA, 14 bp, Homo sapiens
aagcactttaagct

SEQ ID NO: 1693356 - DNA, 14 bp, Homo sapiens
aagcactttgcact

SEQ ID NO: 1693357 - DNA, 20 bp, Homo sapiens
aagcagaaaataaaggaagc

SEQ ID NO: 1693358 - DNA, 14 bp, Homo sapiens
aagcagaacaaatg

SEQ ID NO: 1693359 - DNA, 11 bp, Homo sapiens
aagcagaagga

SEQ ID NO: 1693360 - DNA, 14 bp, Homo sapiens
aagcagaagtctgg

SEQ ID NO: 1693361 - DNA, 16 bp, Homo sapiens
aagcagaattttaatg

SEQ ID NO: 1693362 - DNA, 21 bp, Homo sapiens
aagcagaattttaatgtgaag

SEQ ID NO: 1693363 - DNA, 17 bp, Homo sapiens
aagcagacgcagcagct

SEQ ID NO: 1693364 - DNA, 14 bp, Homo sapiens
aagcagagcaaaat

SEQ ID NO: 1693365 - DNA, 15 bp, Homo sapiens
aagcagaggaccagg

SEQ ID NO: 1693366 - DNA, 15 bp, Homo sapiens
aagcagagtggactg

SEQ ID NO: 1693367 - DNA, 14 bp, Homo sapiens
aagcagagttttca

SEQ ID NO: 1693368 - DNA, 12 bp, Homo sapiens
aagcagccagcc

SEQ ID NO: 1693369 - DNA, 13 bp, Homo sapiens
aagcagccagcca

SEQ ID NO: 1693370 - DNA, 17 bp, Homo sapiens
aagcagccagccagtct

SEQ ID NO: 1693371 - DNA, 12 bp, Homo sapiens
aagcagccagct

SEQ ID NO: 1693372 - DNA, 21 bp, Homo sapiens
aagcagccagctccccacacc

SEQ ID NO: 1693373 - DNA, 20 bp, Homo sapiens
aagcagccccctgtggcggc

SEQ ID NO: 1693374 - DNA, 22 bp, Homo sapiens
aagcagcccttgctttcggagc

SEQ ID NO: 1693375 - DNA, 21 bp, Homo sapiens
aagcagctttaaacaaattca

SEQ ID NO: 1693376 - DNA, 15 bp, Homo sapiens
aagcaggaattatgt

SEQ ID NO: 1693377 - DNA, 19 bp, Homo sapiens
aagcaggatgaattttctg

SEQ ID NO: 1693378 - DNA, 14 bp, Homo sapiens
aagcaggtggatct

SEQ ID NO: 1693379 - DNA, 22 bp, Homo sapiens
aagcaggtggatctatttcatg

SEQ ID NO: 1693380 - DNA, 20 bp, Homo sapiens
aagcaggttcttgatgtcat

SEQ ID NO: 1693381 - DNA, 17 bp, Homo sapiens
aagcaggtttgttttca

SEQ ID NO: 1693382 - DNA, 22 bp, Homo sapiens
aagcagtaaaaactgttctcta

SEQ ID NO: 1693383 - DNA, 20 bp, Homo sapiens
aagcagtagaaataatatgc

SEQ ID NO: 1693384 - DNA, 20 bp, Homo sapiens
aagcagtatattagtattat

SEQ ID NO: 1693385 - DNA, 12 bp, Homo sapiens
aagcagtatttt

SEQ ID NO: 1693386 - DNA, 17 bp, Homo sapiens
aagcagtatttttcttg

SEQ ID NO: 1693387 - DNA, 16 bp, Homo sapiens
aagcagtcccattcat

SEQ ID NO: 1693388 - DNA, 21 bp, Homo sapiens
aagcagtgcctcgaggcaccg

SEQ ID NO: 1693389 - DNA, 17 bp, Homo sapiens
aagcagttcatgtctga

SEQ ID NO: 1693390 - DNA, 23 bp, Homo sapiens
aagcagttcatgtctgaaacaga

SEQ ID NO: 1693391 - DNA, 17 bp, Homo sapiens
aagcagttttgtaaatg

SEQ ID NO: 1693392 - DNA, 19 bp, Homo sapiens
aagcagttttgtaaatgta

SEQ ID NO: 1693393 - DNA, 23 bp, Homo sapiens
aagcagttttgtaaatgtactgg

SEQ ID NO: 1693394 - DNA, 17 bp, Homo sapiens
aagcataaaaacatttt

SEQ ID NO: 1693395 - DNA, 15 bp, Homo sapiens
aagcataaaagatca

SEQ ID NO: 1693396 - DNA, 22 bp, Homo sapiens
aagcataaatgcaaacacacaa

SEQ ID NO: 1693397 - DNA, 17 bp, Homo sapiens
aagcatactttgtaaat

SEQ ID NO: 1693398 - DNA, 21 bp, Homo sapiens
aagcatagataatattgtttg

SEQ ID NO: 1693399 - DNA, 22 bp, Homo sapiens
aagcatagataatattgtttgg

SEQ ID NO: 1693400 - DNA, 16 bp, Homo sapiens
aagcatctgatagaat

SEQ ID NO: 1693401 - DNA, 13 bp, Homo sapiens
aagcatctggctc

SEQ ID NO: 1693402 - DNA, 20 bp, Homo sapiens
aagcatcttgggggggtggc

SEQ ID NO: 1693403 - DNA, 22 bp, Homo sapiens
aagcatgacagaaaatatgtat

SEQ ID NO: 1693404 - DNA, 14 bp, Homo sapiens
aagcatgatcttgt

SEQ ID NO: 1693405 - DNA, 23 bp, Homo sapiens
aagcatgatgggaaaatatttcc

SEQ ID NO: 1693406 - DNA, 22 bp, Homo sapiens
aagcatgcttgtgaaaatgtgt

SEQ ID NO: 1693407 - DNA, 16 bp, Homo sapiens
aagcatgctttgctgc

SEQ ID NO: 1693408 - DNA, 22 bp, Homo sapiens
aagcatggcctggactgactgc

SEQ ID NO: 1693409 - DNA, 15 bp, Homo sapiens
aagcatgtgtttgca

SEQ ID NO: 1693410 - DNA, 17 bp, Homo sapiens
aagcatgttttgcatgt

SEQ ID NO: 1693411 - DNA, 13 bp, Homo sapiens
aagcattactctt

SEQ ID NO: 1693412 - DNA, 14 bp, Homo sapiens
aagcattctcccca

SEQ ID NO: 1693413 - DNA, 23 bp, Homo sapiens
aagcattctccccagtgtatgtc

SEQ ID NO: 1693414 - DNA, 19 bp, Homo sapiens
aagcattgcctggactgac

SEQ ID NO: 1693415 - DNA, 21 bp, Homo sapiens
aagcattgcctggactgacca

SEQ ID NO: 1693416 - DNA, 22 bp, Homo sapiens
aagcattgggtgggtaaattca

SEQ ID NO: 1693417 - DNA, 17 bp, Homo sapiens
aagcattgtaaaataat

SEQ ID NO: 1693418 - DNA, 18 bp, Homo sapiens
aagcattgtaaatgtgct

SEQ ID NO: 1693419 - DNA, 18 bp, Homo sapiens
aagcatttacaagtgctg

SEQ ID NO: 1693420 - DNA, 20 bp, Homo sapiens
aagcatttcaaagccctgcc

SEQ ID NO: 1693421 - DNA, 21 bp, Homo sapiens
aagcatttcatgaaaaagctg

SEQ ID NO: 1693422 - DNA, 12 bp, Homo sapiens
aagcattttgaa

SEQ ID NO: 1693423 - DNA, 19 bp, Homo sapiens
aagcattttgaaacaaagt

SEQ ID NO: 1693424 - DNA, 18 bp, Homo sapiens
aagcattttgggatcctt

SEQ ID NO: 1693425 - DNA, 22 bp, Homo sapiens
aagcattttgggatccttcagc

SEQ ID NO: 1693426 - DNA, 14 bp, Homo sapiens
aagccaaaatggga

SEQ ID NO: 1693427 - DNA, 19 bp, Homo sapiens
aagccaaacattcttattt

SEQ ID NO: 1693428 - DNA, 20 bp, Homo sapiens
aagccaaactcaggcccaga

SEQ ID NO: 1693429 - DNA, 13 bp, Homo sapiens
aagccaaagaaaa

SEQ ID NO: 1693430 - DNA, 15 bp, Homo sapiens
aagccaaagaaaaat

SEQ ID NO: 1693431 - DNA, 15 bp, Homo sapiens
aagccaaagaaacaa

SEQ ID NO: 1693432 - DNA, 18 bp, Homo sapiens
aagccaaagaaacaagct

SEQ ID NO: 1693433 - DNA, 23 bp, Homo sapiens
aagccaaagaaacaagctgtgca

SEQ ID NO: 1693434 - DNA, 19 bp, Homo sapiens
aagccaaaggcagctaaga

SEQ ID NO: 1693435 - DNA, 23 bp, Homo sapiens
aagccaaagttttcaaactgctg

SEQ ID NO: 1693436 - DNA, 18 bp, Homo sapiens
aagccaacaactctgcct

SEQ ID NO: 1693437 - DNA, 16 bp, Homo sapiens
aagccaacttgtaaat

SEQ ID NO: 1693438 - DNA, 16 bp, Homo sapiens
aagccaagggaaaggg

SEQ ID NO: 1693439 - DNA, 20 bp, Homo sapiens
aagccaagggaacctgtgtc

SEQ ID NO: 1693440 - DNA, 14 bp, Homo sapiens
aagccaagggcagt

SEQ ID NO: 1693441 - DNA, 19 bp, Homo sapiens
aagccaagtggggtgctgg

SEQ ID NO: 1693442 - DNA, 14 bp, Homo sapiens
aagccaatcccctc

SEQ ID NO: 1693443 - DNA, 19 bp, Homo sapiens
aagccacaggcctgagatt

SEQ ID NO: 1693444 - DNA, 20 bp, Homo sapiens
aagccacagtgcccacctgc

SEQ ID NO: 1693445 - DNA, 19 bp, Homo sapiens
aagccacattatttctagt

SEQ ID NO: 1693446 - DNA, 16 bp, Homo sapiens
aagccactggaaggag

SEQ ID NO: 1693447 - DNA, 18 bp, Homo sapiens
aagccactggaaggagca

SEQ ID NO: 1693448 - DNA, 13 bp, Homo sapiens
aagccacttgaaa

SEQ ID NO: 1693449 - DNA, 12 bp, Homo sapiens
aagccagagcct

SEQ ID NO: 1693450 - DNA, 14 bp, Homo sapiens
aagccagaggctgg

SEQ ID NO: 1693451 - DNA, 15 bp, Homo sapiens
aagccagaggctggg

SEQ ID NO: 1693452 - DNA, 10 bp, Homo sapiens
aagccagagt

SEQ ID NO: 1693453 - DNA, 11 bp, Homo sapiens
aagccagccac

SEQ ID NO: 1693454 - DNA, 20 bp, Homo sapiens
aagccagccacagacccctg

SEQ ID NO: 1693455 - DNA, 23 bp, Homo sapiens
aagccagccacagacccctggga

SEQ ID NO: 1693456 - DNA, 15 bp, Homo sapiens
aagccagctgccgac

SEQ ID NO: 1693457 - DNA, 17 bp, Homo sapiens
aagccagctttccctgc

SEQ ID NO: 1693458 - DNA, 23 bp, Homo sapiens
aagccaggctgagtgagccacag

SEQ ID NO: 1693459 - DNA, 23 bp, Homo sapiens
aagccagtttgggtaaaatactt

SEQ ID NO: 1693460 - DNA, 16 bp, Homo sapiens
aagccagttttcattt

SEQ ID NO: 1693461 - DNA, 18 bp, Homo sapiens
aagccataattgttctta

SEQ ID NO: 1693462 - DNA, 14 bp, Homo sapiens
aagccatcatcctc

SEQ ID NO: 1693463 - DNA, 11 bp, Homo sapiens
aagatgtgaaa

SEQ ID NO: 1693464 - DNA, 15 bp, Homo sapiens
aagatgtgaaaactc

SEQ ID NO: 1693465 - DNA, 15 bp, Homo sapiens
aagatgtgaattatt

SEQ ID NO: 1693466 - DNA, 18 bp, Homo sapiens
aagatgtgaattattgac

SEQ ID NO: 1693467 - DNA, 21 bp, Homo sapiens
aagatgtgaattattgacact

SEQ ID NO: 1693468 - DNA, 14 bp, Homo sapiens
aagatgtgatattc

SEQ ID NO: 1693469 - DNA, 16 bp, Homo sapiens
aagatgtgatattcta

SEQ ID NO: 1693470 - DNA, 20 bp, Homo sapiens
aagatgtgatattctaagac

SEQ ID NO: 1693471 - DNA, 17 bp, Homo sapiens
aagatgtgcaaaatcac

SEQ ID NO: 1693472 - DNA, 18 bp, Homo sapiens
aagatgtgcaaaatcact

SEQ ID NO: 1693473 - DNA, 17 bp, Homo sapiens
aagatgtgtaaacaggt

SEQ ID NO: 1693474 - DNA, 18 bp, Homo sapiens
aagatgtgtaaacaggta

SEQ ID NO: 1693475 - DNA, 18 bp, Homo sapiens
aagatgtgttcttatttt

SEQ ID NO: 1693476 - DNA, 22 bp, Homo sapiens
aagatgttgatttttactgtgt

SEQ ID NO: 1693477 - DNA, 23 bp, Homo sapiens
aagattaatctaccttgcagtgt

SEQ ID NO: 1693478 - DNA, 18 bp, Homo sapiens
aagattacttagaggaaa

SEQ ID NO: 1693479 - DNA, 16 bp, Homo sapiens
aagattataatatgtg

SEQ ID NO: 1693480 - DNA, 23 bp, Homo sapiens
aagattataatatgtgccttaag

SEQ ID NO: 1693481 - DNA, 14 bp, Homo sapiens
aagattataattgt

SEQ ID NO: 1693482 - DNA, 14 bp, Homo sapiens
aagattatagattc

SEQ ID NO: 1693483 - DNA, 17 bp, Homo sapiens
aagattatagattctaa

SEQ ID NO: 1693484 - DNA, 21 bp, Homo sapiens
aagattatgatgcatacagtt

SEQ ID NO: 1693485 - DNA, 20 bp, Homo sapiens
aagattcatatttacttctt

SEQ ID NO: 1693486 - DNA, 19 bp, Homo sapiens
aagattcatttttaatcat

SEQ ID NO: 1693487 - DNA, 21 bp, Homo sapiens
aagattccggatcctaagcat

SEQ ID NO: 1693488 - DNA, 11 bp, Homo sapiens
aagattctaaa

SEQ ID NO: 1693489 - DNA, 12 bp, Homo sapiens
aagattctaaag

SEQ ID NO: 1693490 - DNA, 13 bp, Homo sapiens
aagattctaaagg

SEQ ID NO: 1693491 - DNA, 21 bp, Homo sapiens
aagattctactcttgtcattt

SEQ ID NO: 1693492 - DNA, 14 bp, Homo sapiens
aagattctagatga

SEQ ID NO: 1693493 - DNA, 19 bp, Homo sapiens
aagattctatagttctaga

SEQ ID NO: 1693494 - DNA, 20 bp, Homo sapiens
aagattctatagttctagac

SEQ ID NO: 1693495 - DNA, 17 bp, Homo sapiens
aagattctcctgtgcta

SEQ ID NO: 1693496 - DNA, 15 bp, Homo sapiens
aagattctctttaaa

SEQ ID NO: 1693497 - DNA, 14 bp, Homo sapiens
aagattgagaagcc

SEQ ID NO: 1693498 - DNA, 17 bp, Homo sapiens
aagattgatagaaaatc

SEQ ID NO: 1693499 - DNA, 15 bp, Homo sapiens
aagattgctgaaatt

SEQ ID NO: 1693500 - DNA, 16 bp, Homo sapiens
aagattgctgaaattt

SEQ ID NO: 1693501 - DNA, 16 bp, Homo sapiens
aagattgcttaaaata

SEQ ID NO: 1693502 - DNA, 19 bp, Homo sapiens
aagattgcttaataaattg

SEQ ID NO: 1693503 - DNA, 23 bp, Homo sapiens
aagattggtctcccatatgcaga

SEQ ID NO: 1693504 - DNA, 22 bp, Homo sapiens
aagattgtacttagccagttca

SEQ ID NO: 1693505 - DNA, 23 bp, Homo sapiens
aagattgttgataggaactgtct

SEQ ID NO: 1693506 - DNA, 22 bp, Homo sapiens
aagattgttggtgaattttcaa

SEQ ID NO: 1693507 - DNA, 12 bp, Homo sapiens
aagatttacatt

SEQ ID NO: 1693508 - DNA, 14 bp, Homo sapiens
aagatttacattcc

SEQ ID NO: 1693509 - DNA, 22 bp, Homo sapiens
aagatttaccttttctgttgta

SEQ ID NO: 1693510 - DNA, 23 bp, Homo sapiens
aagatttaccttttctgttgtac

SEQ ID NO: 1693511 - DNA, 13 bp, Homo sapiens
aagatttactgct

SEQ ID NO: 1693512 - DNA, 13 bp, Homo sapiens
aagatttagaaaa

SEQ ID NO: 1693513 - DNA, 14 bp, Homo sapiens
aagatttatcaaat

SEQ ID NO: 1693514 - DNA, 21 bp, Homo sapiens
aagatttatgaacagaaatat

SEQ ID NO: 1693515 - DNA, 22 bp, Homo sapiens
aagatttgtgaactggaagaaa

SEQ ID NO: 1693516 - DNA, 18 bp, Homo sapiens
aagaagaaatagttctgt

SEQ ID NO: 1693517 - DNA, 13 bp, Homo sapiens
aagaagaagaagg

SEQ ID NO: 1693518 - DNA, 13 bp, Homo sapiens
aagaagaagttca

SEQ ID NO: 1693519 - DNA, 21 bp, Homo sapiens
aagaagacaaagtctaaggaa

SEQ ID NO: 1693520 - DNA, 22 bp, Homo sapiens
aagaagagcgagagatcaaaga

SEQ ID NO: 1693521 - DNA, 23 bp, Homo sapiens
aagaagagcgagagatcaaagat

SEQ ID NO: 1693522 - DNA, 12 bp, Homo sapiens
aagaagaggagc

SEQ ID NO: 1693523 - DNA, 16 bp, Homo sapiens
aagaagaggagcctca

SEQ ID NO: 1693524 - DNA, 17 bp, Homo sapiens
aagaagaggagcctcag

SEQ ID NO: 1693525 - DNA, 18 bp, Homo sapiens
aagaagaggagcctcaga

SEQ ID NO: 1693526 - DNA, 14 bp, Homo sapiens
aagaagagtaaaca

SEQ ID NO: 1693527 - DNA, 15 bp, Homo sapiens
aagaagagtttacag

SEQ ID NO: 1693528 - DNA, 12 bp, Homo sapiens
aagaagatgctc

SEQ ID NO: 1693529 - DNA, 22 bp, Homo sapiens
aagaagatgctccagcaacaca

SEQ ID NO: 1693530 - DNA, 14 bp, Homo sapiens
aagaagattctaaa

SEQ ID NO: 1693531 - DNA, 16 bp, Homo sapiens
aagaagcaataactat

SEQ ID NO: 1693532 - DNA, 19 bp, Homo sapiens
aagaagccacagacctagg

SEQ ID NO: 1693533 - DNA, 17 bp, Homo sapiens
aagaagccacagctctt

SEQ ID NO: 1693534 - DNA, 20 bp, Homo sapiens
aagaagccttaatttgcaca

SEQ ID NO: 1693535 - DNA, 22 bp, Homo sapiens
aagaagccttaatttgcacagt

SEQ ID NO: 1693536 - DNA, 12 bp, Homo sapiens
aagaagctctcc

SEQ ID NO: 1693537 - DNA, 17 bp, Homo sapiens
aagaagctgtgaatatt

SEQ ID NO: 1693538 - DNA, 16 bp, Homo sapiens
aagaagcttccacaaa

SEQ ID NO: 1693539 - DNA, 18 bp, Homo sapiens
aagaaggaaagatggtta

SEQ ID NO: 1693540 - DNA, 12 bp, Homo sapiens
aagaaggaatcc

SEQ ID NO: 1693541 - DNA, 23 bp, Homo sapiens
aagaaggcatcgtcatgcacagt

SEQ ID NO: 1693542 - DNA, 13 bp, Homo sapiens
aagaaggctagga

SEQ ID NO: 1693543 - DNA, 14 bp, Homo sapiens
aagaagggagaaga

SEQ ID NO: 1693544 - DNA, 15 bp, Homo sapiens
aagaagggagaagaa

SEQ ID NO: 1693545 - DNA, 16 bp, Homo sapiens
aagaagggctgcatga

SEQ ID NO: 1693546 - DNA, 21 bp, Homo sapiens
aagaagggctgcatgatgttt

SEQ ID NO: 1693547 - DNA, 22 bp, Homo sapiens
aagaagggctgcatgatgtttg

SEQ ID NO: 1693548 - DNA, 15 bp, Homo sapiens
aagaagggggccctg

SEQ ID NO: 1693549 - DNA, 19 bp, Homo sapiens
aagaagtcactgaacaaaa

SEQ ID NO: 1693550 - DNA, 16 bp, Homo sapiens
aagaagtgtccgagaa

SEQ ID NO: 1693551 - DNA, 19 bp, Homo sapiens
aagaagtgtccgagaacta

SEQ ID NO: 1693552 - DNA, 18 bp, Homo sapiens
aagaagttttaaaaagcc

SEQ ID NO: 1693553 - DNA, 23 bp, Homo sapiens
aagaagttttaaaaagccagttt

SEQ ID NO: 1693554 - DNA, 14 bp, Homo sapiens
aagaagttttatgc

SEQ ID NO: 1693555 - DNA, 12 bp, Homo sapiens
aagaataaagtc

SEQ ID NO: 1693556 - DNA, 17 bp, Homo sapiens
aagaataaataaagaag

SEQ ID NO: 1693557 - DNA, 19 bp, Homo sapiens
aagaataaataaagaagaa

SEQ ID NO: 1693558 - DNA, 21 bp, Homo sapiens
aagaataaataaagaagaaaa

SEQ ID NO: 1693559 - DNA, 22 bp, Homo sapiens
aagaataatcacgctttcctga

SEQ ID NO: 1693560 - DNA, 23 bp, Homo sapiens
aagaataatcacgctttcctgaa

SEQ ID NO: 1693561 - DNA, 13 bp, Homo sapiens
aagaatacagaaa

SEQ ID NO: 1693562 - DNA, 12 bp, Homo sapiens
aagaatacttga

SEQ ID NO: 1693563 - DNA, 12 bp, Homo sapiens
aagaatatagtt

SEQ ID NO: 1693564 - DNA, 17 bp, Homo sapiens
aagaatatctgtaatgg

SEQ ID NO: 1693565 - DNA, 19 bp, Homo sapiens
aagaatatctgtaatggta

SEQ ID NO: 1693566 - DNA, 16 bp, Homo sapiens
aagaatccacaaggac

SEQ ID NO: 1693567 - DNA, 21 bp, Homo sapiens
aagaatccacatttctaaaat

SEQ ID NO: 1693568 - DNA, 17 bp, Homo sapiens
aagaatccttatctata

SEQ ID NO: 1693569 - DNA, 23 bp, Homo sapiens
aagaatctaaaccttacatgtgt

SEQ ID NO: 1693570 - DNA, 18 bp, Homo sapiens
aagaatctagaagatgtg

SEQ ID NO: 1693571 - DNA, 17 bp, Homo sapiens
aagaatgaaagctgttc

SEQ ID NO: 1693572 - DNA, 16 bp, Homo sapiens
aagaatgcaagagtgg

SEQ ID NO: 1693573 - DNA, 17 bp, Homo sapiens
aagaatgcacaagaatg

SEQ ID NO: 1693574 - DNA, 18 bp, Homo sapiens
aagaatgcacaagaatgg

SEQ ID NO: 1693575 - DNA, 16 bp, Homo sapiens
aagaatgcagtacaga

SEQ ID NO: 1693576 - DNA, 18 bp, Homo sapiens
aagaatgcagtacagaat

SEQ ID NO: 1693577 - DNA, 13 bp, Homo sapiens
aagaatggccaac

SEQ ID NO: 1693578 - DNA, 15 bp, Homo sapiens
aagaatggctttcaa

SEQ ID NO: 1693579 - DNA, 20 bp, Homo sapiens
aagaatgtccttattcttgt

SEQ ID NO: 1693580 - DNA, 11 bp, Homo sapiens
aagaattacag

SEQ ID NO: 1693581 - DNA, 17 bp, Homo sapiens
aagaattatttttgtgt

SEQ ID NO: 1693582 - DNA, 22 bp, Homo sapiens
aagaattatttttgtgtttcta

SEQ ID NO: 1693583 - DNA, 20 bp, Homo sapiens
aagaattgtttttgaattta

SEQ ID NO: 1693584 - DNA, 22 bp, Homo sapiens
aagaattgtttttgaatttaaa

SEQ ID NO: 1693585 - DNA, 16 bp, Homo sapiens
aagaatttagtattat

SEQ ID NO: 1693586 - DNA, 20 bp, Homo sapiens
aagaatttctgctaaatatc

SEQ ID NO: 1693587 - DNA, 20 bp, Homo sapiens
aagaatttcttggtaagaag

SEQ ID NO: 1693588 - DNA, 22 bp, Homo sapiens
aagaatttcttggtaagaagcc

SEQ ID NO: 1693589 - DNA, 20 bp, Homo sapiens
aagaattttcagaccccagc

SEQ ID NO: 1693590 - DNA, 13 bp, Homo sapiens
aagaatttttaaa

SEQ ID NO: 1693591 - DNA, 21 bp, Homo sapiens
aagaattttttctcattctgt

SEQ ID NO: 1693592 - DNA, 13 bp, Homo sapiens
aagaatttttttg

SEQ ID NO: 1693593 - DNA, 14 bp, Homo sapiens
aagaatttttttgt

SEQ ID NO: 1693594 - DNA, 16 bp, Homo sapiens
aagacaaaaataatag

SEQ ID NO: 1693595 - DNA, 18 bp, Homo sapiens
aagacaaaaatcaaagaa

SEQ ID NO: 1693596 - DNA, 13 bp, Homo sapiens
aagacaaacactg

SEQ ID NO: 1693597 - DNA, 23 bp, Homo sapiens
aagacaaacactgccatattgtg

SEQ ID NO: 1693598 - DNA, 18 bp, Homo sapiens
aagacaaagtcccagaat

SEQ ID NO: 1693599 - DNA, 18 bp, Homo sapiens
aagacaaagtctaaggaa

SEQ ID NO: 1693600 - DNA, 14 bp, Homo sapiens
aagacaacaaaaga

SEQ ID NO: 1693601 - DNA, 15 bp, Homo sapiens
aagacaacattaaaa

SEQ ID NO: 1693602 - DNA, 21 bp, Homo sapiens
aagacaagagatctacacatg

SEQ ID NO: 1693603 - DNA, 17 bp, Homo sapiens
aagacaataattacatt

SEQ ID NO: 1693604 - DNA, 21 bp, Homo sapiens
aagacacaaggtgatttcaga

SEQ ID NO: 1693605 - DNA, 14 bp, Homo sapiens
aagacacctggttg

SEQ ID NO: 1693606 - DNA, 14 bp, Homo sapiens
aagacacttcagat

SEQ ID NO: 1693607 - DNA, 22 bp, Homo sapiens
aagacacttcagatctgaggtt

SEQ ID NO: 1693608 - DNA, 13 bp, Homo sapiens
aagacagaatggt

SEQ ID NO: 1693609 - DNA, 21 bp, Homo sapiens
aagacagagacgcaggaatgg

SEQ ID NO: 1693610 - DNA, 16 bp, Homo sapiens
aagacagatgccccag

SEQ ID NO: 1693611 - DNA, 17 bp, Homo sapiens
aagacagatgccccaga

SEQ ID NO: 1693612 - DNA, 20 bp, Homo sapiens
aagacagatgccccagagct

SEQ ID NO: 1693613 - DNA, 13 bp, Homo sapiens
aagacagattgtg

SEQ ID NO: 1693614 - DNA, 12 bp, Homo sapiens
aagacagccttc

SEQ ID NO: 1693615 - DNA, 14 bp, Homo sapiens
aagacagtggcccc

SEQ ID NO: 1693616 - DNA, 13 bp, Homo sapiens
aagacagtgtaca

SEQ ID NO: 1693617 - DNA, 17 bp, Homo sapiens
aagacagtgtacaaaac

SEQ ID NO: 1693618 - DNA, 19 bp, Homo sapiens
aagacagtgtacaaaactg

SEQ ID NO: 1693619 - DNA, 13 bp, Homo sapiens
aagacatgaacca

SEQ ID NO: 1693620 - DNA, 14 bp, Homo sapiens
aagacatgcagcct

SEQ ID NO: 1693621 - DNA, 16 bp, Homo sapiens
aagacatgtaggtgtt

SEQ ID NO: 1693622 - DNA, 20 bp, Homo sapiens
aagacatgtgaggaggaaaa

SEQ ID NO: 1693623 - DNA, 13 bp, Homo sapiens
aagacatttgctg

SEQ ID NO: 1693624 - DNA, 14 bp, Homo sapiens
aagacatttgctga

SEQ ID NO: 1693625 - DNA, 15 bp, Homo sapiens
aagacatttgctgaa

SEQ ID NO: 1693626 - DNA, 12 bp, Homo sapiens
aagacatttgta

SEQ ID NO: 1693627 - DNA, 15 bp, Homo sapiens
aagacattttttgct

SEQ ID NO: 1693628 - DNA, 17 bp, Homo sapiens
aagacattttttgctat

SEQ ID NO: 1693629 - DNA, 18 bp, Homo sapiens
aagaccaccacttcgaaa

SEQ ID NO: 1693630 - DNA, 14 bp, Homo sapiens
aagaccagaaattc

SEQ ID NO: 1693631 - DNA, 17 bp, Homo sapiens
aagaccaggctgcagcc

SEQ ID NO: 1693632 - DNA, 12 bp, Homo sapiens
aagaccagggct

SEQ ID NO: 1693633 - DNA, 19 bp, Homo sapiens
aagaaacttttttattttt

SEQ ID NO: 1693634 - DNA, 15 bp, Homo sapiens
aagaaagaaatggct

SEQ ID NO: 1693635 - DNA, 15 bp, Homo sapiens
aagaaagaaggaagt

SEQ ID NO: 1693636 - DNA, 21 bp, Homo sapiens
aagaaagaatgcaagagtgga

SEQ ID NO: 1693637 - DNA, 22 bp, Homo sapiens
aagaaagactatctaaatgttg

SEQ ID NO: 1693638 - DNA, 17 bp, Homo sapiens
aagaaagaggagtgctt

SEQ ID NO: 1693639 - DNA, 23 bp, Homo sapiens
aagaaagatttgttactgtattt

SEQ ID NO: 1693640 - DNA, 12 bp, Homo sapiens
aagaaagcactt

SEQ ID NO: 1693641 - DNA, 23 bp, Homo sapiens
aagaaaggaagcattgtaaaata

SEQ ID NO: 1693642 - DNA, 16 bp, Homo sapiens
aagaaagtcagccata

SEQ ID NO: 1693643 - DNA, 12 bp, Homo sapiens
aagaaagtgtat

SEQ ID NO: 1693644 - DNA, 18 bp, Homo sapiens
aagaaagtgtatttggaa

SEQ ID NO: 1693645 - DNA, 17 bp, Homo sapiens
aagaaatactcatgtgc

SEQ ID NO: 1693646 - DNA, 15 bp, Homo sapiens
aagaaatatattttt

SEQ ID NO: 1693647 - DNA, 14 bp, Homo sapiens
aagaaatcacagaa

SEQ ID NO: 1693648 - DNA, 15 bp, Homo sapiens
aagaaatgatgttgg

SEQ ID NO: 1693649 - DNA, 13 bp, Homo sapiens
aagaaatgctaat

SEQ ID NO: 1693650 - DNA, 12 bp, Homo sapiens
aagaaatgtacc

SEQ ID NO: 1693651 - DNA, 12 bp, Homo sapiens
aagaaattcagg

SEQ ID NO: 1693652 - DNA, 21 bp, Homo sapiens
aagaaattccatacttctctc

SEQ ID NO: 1693653 - DNA, 14 bp, Homo sapiens
aagaacaacaaaga

SEQ ID NO: 1693654 - DNA, 14 bp, Homo sapiens
aagaacaagaattt

SEQ ID NO: 1693655 - DNA, 14 bp, Homo sapiens
aagaacaataatga

SEQ ID NO: 1693656 - DNA, 21 bp, Homo sapiens
aagaacaataatgagagcaaa

SEQ ID NO: 1693657 - DNA, 13 bp, Homo sapiens
aagaacacatttt

SEQ ID NO: 1693658 - DNA, 16 bp, Homo sapiens
aagaacagaaaacaag

SEQ ID NO: 1693659 - DNA, 18 bp, Homo sapiens
aagaacatggacttgtat

SEQ ID NO: 1693660 - DNA, 19 bp, Homo sapiens
aagaacatggacttgtata

SEQ ID NO: 1693661 - DNA, 21 bp, Homo sapiens
aagaacatggacttgtatatt

SEQ ID NO: 1693662 - DNA, 22 bp, Homo sapiens
aagaacatggacttgtatattt

SEQ ID NO: 1693663 - DNA, 14 bp, Homo sapiens
aagaaccaaaactt

SEQ ID NO: 1693664 - DNA, 16 bp, Homo sapiens
aagaaccaaaacttcc

SEQ ID NO: 1693665 - DNA, 17 bp, Homo sapiens
aagaaccagtcccccca

SEQ ID NO: 1693666 - DNA, 16 bp, Homo sapiens
aagaaccctatttaaa

SEQ ID NO: 1693667 - DNA, 18 bp, Homo sapiens
aagaaccggacaaataag

SEQ ID NO: 1693668 - DNA, 14 bp, Homo sapiens
aagaacctggaact

SEQ ID NO: 1693669 - DNA, 18 bp, Homo sapiens
aagaacggggctcttctc

SEQ ID NO: 1693670 - DNA, 23 bp, Homo sapiens
aagaacggggctcttctcatttc

SEQ ID NO: 1693671 - DNA, 21 bp, Homo sapiens
aagaacgttttttcctcagtg

SEQ ID NO: 1693672 - DNA, 21 bp, Homo sapiens
aagaactacaaacaaaatttc

SEQ ID NO: 1693673 - DNA, 16 bp, Homo sapiens
aagaactctaaccagt

SEQ ID NO: 1693674 - DNA, 18 bp, Homo sapiens
aagaactgcatggaccta

SEQ ID NO: 1693675 - DNA, 15 bp, Homo sapiens
aagaacttaagtctc

SEQ ID NO: 1693676 - DNA, 15 bp, Homo sapiens
aagaacttactgatt

SEQ ID NO: 1693677 - DNA, 17 bp, Homo sapiens
aagaacttgctgctgcc

SEQ ID NO: 1693678 - DNA, 21 bp, Homo sapiens
aagaactttaaagctcaggag

SEQ ID NO: 1693679 - DNA, 20 bp, Homo sapiens
aagaagaaagtctatgctta

SEQ ID NO: 1693680 - DNA, 21 bp, Homo sapiens
aagaagaaagtctatgcttag

SEQ ID NO: 1693681 - DNA, 12 bp, Homo sapiens
aggcccaagaga

SEQ ID NO: 1693682 - DNA, 14 bp, Homo sapiens
aggcccaaggagct

SEQ ID NO: 1693683 - DNA, 20 bp, Homo sapiens
aggcccacgcgcttccctgg

SEQ ID NO: 1693684 - DNA, 15 bp, Homo sapiens
aggcccactccccag

SEQ ID NO: 1693685 - DNA, 16 bp, Homo sapiens
aggcccactgtgcctc

SEQ ID NO: 1693686 - DNA, 16 bp, Homo sapiens
aggcccagagcgagga

SEQ ID NO: 1693687 - DNA, 18 bp, Homo sapiens
aggcccagaggagccaag

SEQ ID NO: 1693688 - DNA, 20 bp, Homo sapiens
aggcccagcattgctggttc

SEQ ID NO: 1693689 - DNA, 14 bp, Homo sapiens
aggcccagccctca

SEQ ID NO: 1693690 - DNA, 15 bp, Homo sapiens
aggcccagcgcggcc

SEQ ID NO: 1693691 - DNA, 19 bp, Homo sapiens
aggcccagcgcggccagcg

SEQ ID NO: 1693692 - DNA, 19 bp, Homo sapiens
aggcccagcgggcagatgg

SEQ ID NO: 1693693 - DNA, 12 bp, Homo sapiens
aggcccaggaga

SEQ ID NO: 1693694 - DNA, 18 bp, Homo sapiens
aggcccaggcaccaccag

SEQ ID NO: 1693695 - DNA, 21 bp, Homo sapiens
aggcccaggcaccaccaggag

SEQ ID NO: 1693696 - DNA, 15 bp, Homo sapiens
aggcccaggctggga

SEQ ID NO: 1693697 - DNA, 16 bp, Homo sapiens
aggcccaggctgggaa

SEQ ID NO: 1693698 - DNA, 13 bp, Homo sapiens
aggcccatagcag

SEQ ID NO: 1693699 - DNA, 22 bp, Homo sapiens
aggcccatctcaggtgccactc

SEQ ID NO: 1693700 - DNA, 12 bp, Homo sapiens
aggcccatgcta

SEQ ID NO: 1693701 - DNA, 23 bp, Homo sapiens
aggcccatgtatataagtactga

SEQ ID NO: 1693702 - DNA, 23 bp, Homo sapiens
aggcccattgtcctccttttcac

SEQ ID NO: 1693703 - DNA, 19 bp, Homo sapiens
aggcccatttgagaagctg

SEQ ID NO: 1693704 - DNA, 19 bp, Homo sapiens
aggccccagagagaccctg

SEQ ID NO: 1693705 - DNA, 15 bp, Homo sapiens
aggccccagaggccc

SEQ ID NO: 1693706 - DNA, 16 bp, Homo sapiens
aggccccagaggccct

SEQ ID NO: 1693707 - DNA, 17 bp, Homo sapiens
aggccccagaggccctg

SEQ ID NO: 1693708 - DNA, 18 bp, Homo sapiens
aggccccagaggccctgg

SEQ ID NO: 1693709 - DNA, 19 bp, Homo sapiens
aggccccagaggccctgga

SEQ ID NO: 1693710 - DNA, 13 bp, Homo sapiens
aggccccagcctc

SEQ ID NO: 1693711 - DNA, 12 bp, Homo sapiens
aggccccaggct

SEQ ID NO: 1693712 - DNA, 13 bp, Homo sapiens
aggcccccacttg

SEQ ID NO: 1693713 - DNA, 20 bp, Homo sapiens
aggcccccacttgcctcttc

SEQ ID NO: 1693714 - DNA, 17 bp, Homo sapiens
aggcccccagcccaggg

SEQ ID NO: 1693715 - DNA, 19 bp, Homo sapiens
aggcccccagcccagggct

SEQ ID NO: 1693716 - DNA, 22 bp, Homo sapiens
aggcccccagcccagggctcct

SEQ ID NO: 1693717 - DNA, 14 bp, Homo sapiens
aggccccccgcagc

SEQ ID NO: 1693718 - DNA, 18 bp, Homo sapiens
aggccccccgcagcaccc

SEQ ID NO: 1693719 - DNA, 19 bp, Homo sapiens
aggccccccgcagcaccct

SEQ ID NO: 1693720 - DNA, 22 bp, Homo sapiens
aggccccccgcagcaccctgca

SEQ ID NO: 1693721 - DNA, 15 bp, Homo sapiens
aggccccgcttgtcc

SEQ ID NO: 1693722 - DNA, 17 bp, Homo sapiens
aggccccgcttgtccag

SEQ ID NO: 1693723 - DNA, 21 bp, Homo sapiens
aggccccgcttgtccagcgcc

SEQ ID NO: 1693724 - DNA, 19 bp, Homo sapiens
aggcccctaggtgcccagg

SEQ ID NO: 1693725 - DNA, 19 bp, Homo sapiens
aggcccctcctagacccag

SEQ ID NO: 1693726 - DNA, 16 bp, Homo sapiens
aggcccctgaggactg

SEQ ID NO: 1693727 - DNA, 19 bp, Homo sapiens
aggcccctgaggcagccca

SEQ ID NO: 1693728 - DNA, 16 bp, Homo sapiens
aggcccctggagccag

SEQ ID NO: 1693729 - DNA, 15 bp, Homo sapiens
aggcccctggcccag

SEQ ID NO: 1693730 - DNA, 16 bp, Homo sapiens
aggcccctggcccagc

SEQ ID NO: 1693731 - DNA, 16 bp, Homo sapiens
aggcccctgggctctc

SEQ ID NO: 1693732 - DNA, 18 bp, Homo sapiens
aggcccctgggctctcac

SEQ ID NO: 1693733 - DNA, 14 bp, Homo sapiens
aggccccttccctg

SEQ ID NO: 1693734 - DNA, 23 bp, Homo sapiens
aggcccgagatgtgacccaccag

SEQ ID NO: 1693735 - DNA, 17 bp, Homo sapiens
aggcccggctgagcccc

SEQ ID NO: 1693736 - DNA, 20 bp, Homo sapiens
aggcccggctgagcccccca

SEQ ID NO: 1693737 - DNA, 21 bp, Homo sapiens
aggcccggctgagccccccat

SEQ ID NO: 1693738 - DNA, 15 bp, Homo sapiens
aggcccggggctggc

SEQ ID NO: 1693739 - DNA, 20 bp, Homo sapiens
aggcccgtcggagctgcctg

SEQ ID NO: 1693740 - DNA, 23 bp, Homo sapiens
aggcccgtcggagctgcctgcag

SEQ ID NO: 1693741 - DNA, 16 bp, Homo sapiens
aggccctccatgggct

SEQ ID NO: 1693742 - DNA, 17 bp, Homo sapiens
aggccctccatgggcta

SEQ ID NO: 1693743 - DNA, 20 bp, Homo sapiens
aggccctccctgttccccag

SEQ ID NO: 1693744 - DNA, 16 bp, Homo sapiens
aggccctctgcctgca

SEQ ID NO: 1693745 - DNA, 18 bp, Homo sapiens
aggccctgctttttttct

SEQ ID NO: 1693746 - DNA, 20 bp, Homo sapiens
aggccctgctttttttctta

SEQ ID NO: 1693747 - DNA, 21 bp, Homo sapiens
aggccctggaggtctccaggg

SEQ ID NO: 1693748 - DNA, 13 bp, Homo sapiens
aggccctgggtct

SEQ ID NO: 1693749 - DNA, 18 bp, Homo sapiens
aggccctggtcctggcct

SEQ ID NO: 1693750 - DNA, 20 bp, Homo sapiens
aggccctggtgtcaggcagg

SEQ ID NO: 1693751 - DNA, 17 bp, Homo sapiens
aggccctggttcctgct

SEQ ID NO: 1693752 - DNA, 15 bp, Homo sapiens
aggcccttcctctcc

SEQ ID NO: 1693753 - DNA, 19 bp, Homo sapiens
aggcccttcctctccactg

SEQ ID NO: 1693754 - DNA, 14 bp, Homo sapiens
aggcccttggctgc

SEQ ID NO: 1693755 - DNA, 16 bp, Homo sapiens
aggcccttggctgcag

SEQ ID NO: 1693756 - DNA, 19 bp, Homo sapiens
aggcccttggctgcaggca

SEQ ID NO: 1693757 - DNA, 15 bp, Homo sapiens
aggcccttgtcctgc

SEQ ID NO: 1693758 - DNA, 20 bp, Homo sapiens
aggcccttgtcctgccagct

SEQ ID NO: 1693759 - DNA, 22 bp, Homo sapiens
aggcccttgtcctgccagctgc

SEQ ID NO: 1693760 - DNA, 17 bp, Homo sapiens
aggcccttgtcgtggga

SEQ ID NO: 1693761 - DNA, 15 bp, Homo sapiens
aggccctttggcttc

SEQ ID NO: 1693762 - DNA, 15 bp, Homo sapiens
aggccgaagctctgg

SEQ ID NO: 1693763 - DNA, 23 bp, Homo sapiens
aggccgaagctctggctgaaccc

SEQ ID NO: 1693764 - DNA, 17 bp, Homo sapiens
aggccgaaggtgcctca

SEQ ID NO: 1693765 - DNA, 17 bp, Homo sapiens
aggccgaggaccaccag

SEQ ID NO: 1693766 - DNA, 16 bp, Homo sapiens
aggccgaggtgggcag

SEQ ID NO: 1693767 - DNA, 15 bp, Homo sapiens
aggccgagtggctgc

SEQ ID NO: 1693768 - DNA, 17 bp, Homo sapiens
aggccgcagctcttgcc

SEQ ID NO: 1693769 - DNA, 21 bp, Homo sapiens
aggccgccagcgtgtggagca

SEQ ID NO: 1693770 - DNA, 13 bp, Homo sapiens
aggccgcgcccag

SEQ ID NO: 1693771 - DNA, 14 bp, Homo sapiens
aggccgcgcccagc

SEQ ID NO: 1693772 - DNA, 18 bp, Homo sapiens
aggccgctagaggcctga

SEQ ID NO: 1693773 - DNA, 18 bp, Homo sapiens
aggccgctgccccagccc

SEQ ID NO: 1693774 - DNA, 19 bp, Homo sapiens
aggccgctgccccagcccc

SEQ ID NO: 1693775 - DNA, 17 bp, Homo sapiens
aggccgctgttcaccca

SEQ ID NO: 1693776 - DNA, 20 bp, Homo sapiens
aggccgctgttcacccacag

SEQ ID NO: 1693777 - DNA, 16 bp, Homo sapiens
aggccggcagcgggcg

SEQ ID NO: 1693778 - DNA, 18 bp, Homo sapiens
aggccgggcggtcacagc

SEQ ID NO: 1693779 - DNA, 21 bp, Homo sapiens
aggccgggcttgggccctgca

SEQ ID NO: 1693780 - DNA, 16 bp, Homo sapiens
aggccggggtccaggc

SEQ ID NO: 1693781 - DNA, 13 bp, Homo sapiens
aggccgtcctccc

SEQ ID NO: 1693782 - DNA, 13 bp, Homo sapiens
aggccgttcccct

SEQ ID NO: 1693783 - DNA, 22 bp, Homo sapiens
aggccgttccccttggcttcct

SEQ ID NO: 1693784 - DNA, 16 bp, Homo sapiens
aggcctaaaagtaaac

SEQ ID NO: 1693785 - DNA, 19 bp, Homo sapiens
aggcctaatctcatacctc

SEQ ID NO: 1693786 - DNA, 16 bp, Homo sapiens
aggcctataaccccag

SEQ ID NO: 1693787 - DNA, 22 bp, Homo sapiens
aggcctcagtttctccatcagc

SEQ ID NO: 1693788 - DNA, 14 bp, Homo sapiens
aggcctcatccctc

SEQ ID NO: 1693789 - DNA, 14 bp, Homo sapiens
aggcctcatctcct

SEQ ID NO: 1693790 - DNA, 20 bp, Homo sapiens
aggcctccaacgcccctgtg

SEQ ID NO: 1693791 - DNA, 21 bp, Homo sapiens
aggcctccaacgcccctgtgg

SEQ ID NO: 1693792 - DNA, 22 bp, Homo sapiens
aggcctccaacgcccctgtggc

SEQ ID NO: 1693793 - DNA, 24 bp, Homo sapiens
aggcctccaacgcccctgtggcca

SEQ ID NO: 1693794 - DNA, 14 bp, Homo sapiens
aggcctccagcctc

SEQ ID NO: 1693795 - DNA, 15 bp, Homo sapiens
aggcctccagcctct

SEQ ID NO: 1693796 - DNA, 16 bp, Homo sapiens
aggcctccagcctctc

SEQ ID NO: 1693797 - DNA, 16 bp, Homo sapiens
aggcaggaagggcagg

SEQ ID NO: 1693798 - DNA, 17 bp, Homo sapiens
aggcaggaagggcagga

SEQ ID NO: 1693799 - DNA, 20 bp, Homo sapiens
aggcaggaagggcaggaagg

SEQ ID NO: 1693800 - DNA, 13 bp, Homo sapiens
aggcaggagcctt

SEQ ID NO: 1693801 - DNA, 18 bp, Homo sapiens
aggcaggattgaaaatgt

SEQ ID NO: 1693802 - DNA, 14 bp, Homo sapiens
aggcaggcatggcc

SEQ ID NO: 1693803 - DNA, 15 bp, Homo sapiens
aggcaggcatggccc

SEQ ID NO: 1693804 - DNA, 19 bp, Homo sapiens
aggcaggcatggccctggg

SEQ ID NO: 1693805 - DNA, 20 bp, Homo sapiens
aggcaggcatggccctgggc

SEQ ID NO: 1693806 - DNA, 21 bp, Homo sapiens
aggcaggccaaggccttctcc

SEQ ID NO: 1693807 - DNA, 22 bp, Homo sapiens
aggcaggccaaggccttctcct

SEQ ID NO: 1693808 - DNA, 22 bp, Homo sapiens
aggcaggcgggggctgctcagc

SEQ ID NO: 1693809 - DNA, 13 bp, Homo sapiens
aggcagggcagag

SEQ ID NO: 1693810 - DNA, 15 bp, Homo sapiens
aggcagggcagaggg

SEQ ID NO: 1693811 - DNA, 19 bp, Homo sapiens
aggcagggcagagggaatg

SEQ ID NO: 1693812 - DNA, 16 bp, Homo sapiens
aggcagggctgggcca

SEQ ID NO: 1693813 - DNA, 17 bp, Homo sapiens
aggcagggctgggccag

SEQ ID NO: 1693814 - DNA, 20 bp, Homo sapiens
aggcagggctgggccaggtc

SEQ ID NO: 1693815 - DNA, 13 bp, Homo sapiens
aggcaggggcgga

SEQ ID NO: 1693816 - DNA, 16 bp, Homo sapiens
aggcaggggctctgct

SEQ ID NO: 1693817 - DNA, 16 bp, Homo sapiens
aggcaggggtgggggt

SEQ ID NO: 1693818 - DNA, 14 bp, Homo sapiens
aggcagggtcagga

SEQ ID NO: 1693819 - DNA, 13 bp, Homo sapiens
aggcaggtctgca

SEQ ID NO: 1693820 - DNA, 17 bp, Homo sapiens
aggcaggtctgcaaggg

SEQ ID NO: 1693821 - DNA, 17 bp, Homo sapiens
aggcaggtgagaaccca

SEQ ID NO: 1693822 - DNA, 18 bp, Homo sapiens
aggcaggtgcctccaggt

SEQ ID NO: 1693823 - DNA, 21 bp, Homo sapiens
aggcaggtgcctccaggtgtg

SEQ ID NO: 1693824 - DNA, 17 bp, Homo sapiens
aggcaggtggactgact

SEQ ID NO: 1693825 - DNA, 18 bp, Homo sapiens
aggcagtcgggggctggc

SEQ ID NO: 1693826 - DNA, 21 bp, Homo sapiens
aggcagtcgggggctggccta

SEQ ID NO: 1693827 - DNA, 22 bp, Homo sapiens
aggcagtcgggggctggcctag

SEQ ID NO: 1693828 - DNA, 14 bp, Homo sapiens
aggcagtgcatgtg

SEQ ID NO: 1693829 - DNA, 15 bp, Homo sapiens
aggcagtgcatgtga

SEQ ID NO: 1693830 - DNA, 12 bp, Homo sapiens
aggcagtggcta

SEQ ID NO: 1693831 - DNA, 13 bp, Homo sapiens
aggcagttctaga

SEQ ID NO: 1693832 - DNA, 13 bp, Homo sapiens
aggcagttttcta

SEQ ID NO: 1693833 - DNA, 18 bp, Homo sapiens
aggcataagatgacttag

SEQ ID NO: 1693834 - DNA, 20 bp, Homo sapiens
aggcatacactgtagttttt

SEQ ID NO: 1693835 - DNA, 20 bp, Homo sapiens
aggcatacgagagcagaggt

SEQ ID NO: 1693836 - DNA, 22 bp, Homo sapiens
aggcatagaggcttctccgcca

SEQ ID NO: 1693837 - DNA, 11 bp, Homo sapiens
aggcatcagga

SEQ ID NO: 1693838 - DNA, 13 bp, Homo sapiens
aggcatcaggaat

SEQ ID NO: 1693839 - DNA, 23 bp, Homo sapiens
aggcatcccaggggaccacacct

SEQ ID NO: 1693840 - DNA, 16 bp, Homo sapiens
aggcatccttgtcttt

SEQ ID NO: 1693841 - DNA, 23 bp, Homo sapiens
aggcatcgtcatgcacagtattt

SEQ ID NO: 1693842 - DNA, 22 bp, Homo sapiens
aggcatctacacagcctggact

SEQ ID NO: 1693843 - DNA, 21 bp, Homo sapiens
aggcatctctgtactttgctt

SEQ ID NO: 1693844 - DNA, 22 bp, Homo sapiens
aggcatcttttctagagacaca

SEQ ID NO: 1693845 - DNA, 14 bp, Homo sapiens
aggcatgcctctga

SEQ ID NO: 1693846 - DNA, 13 bp, Homo sapiens
aggcatggccctg

SEQ ID NO: 1693847 - DNA, 18 bp, Homo sapiens
aggcatgtcccacccacc

SEQ ID NO: 1693848 - DNA, 14 bp, Homo sapiens
aggcatgtggcctt

SEQ ID NO: 1693849 - DNA, 13 bp, Homo sapiens
aggcattaacaca

SEQ ID NO: 1693850 - DNA, 16 bp, Homo sapiens
aggcattaatgtttct

SEQ ID NO: 1693851 - DNA, 20 bp, Homo sapiens
aggcattaatgtttctatct

SEQ ID NO: 1693852 - DNA, 18 bp, Homo sapiens
aggcattcctgaagggaa

SEQ ID NO: 1693853 - DNA, 13 bp, Homo sapiens
aggcattctctga

SEQ ID NO: 1693854 - DNA, 19 bp, Homo sapiens
aggcattgcaggaccttgg

SEQ ID NO: 1693855 - DNA, 14 bp, Homo sapiens
aggcattgtttgag

SEQ ID NO: 1693856 - DNA, 12 bp, Homo sapiens
aggcatttcctg

SEQ ID NO: 1693857 - DNA, 14 bp, Homo sapiens
aggcatttcctgct

SEQ ID NO: 1693858 - DNA, 15 bp, Homo sapiens
aggcatttcctgctg

SEQ ID NO: 1693859 - DNA, 22 bp, Homo sapiens
aggcatttcctgctgaacgttt

SEQ ID NO: 1693860 - DNA, 18 bp, Homo sapiens
aggcatttgcagggtcct

SEQ ID NO: 1693861 - DNA, 21 bp, Homo sapiens
aggcatttgccaagggaggcg

SEQ ID NO: 1693862 - DNA, 19 bp, Homo sapiens
aggcatttggaacaacaaa

SEQ ID NO: 1693863 - DNA, 21 bp, Homo sapiens
aggcatttggaacaacaaatc

SEQ ID NO: 1693864 - DNA, 21 bp, Homo sapiens
aggccaaagagtctccagttt

SEQ ID NO: 1693865 - DNA, 14 bp, Homo sapiens
aggccaaatgcaca

SEQ ID NO: 1693866 - DNA, 13 bp, Homo sapiens
aggccaaccagcc

SEQ ID NO: 1693867 - DNA, 14 bp, Homo sapiens
aggccaaccagccc

SEQ ID NO: 1693868 - DNA, 14 bp, Homo sapiens
aggccaagaggctg

SEQ ID NO: 1693869 - DNA, 19 bp, Homo sapiens
aggccaagcagtgcctgcc

SEQ ID NO: 1693870 - DNA, 13 bp, Homo sapiens
aggccaaggcagg

SEQ ID NO: 1693871 - DNA, 13 bp, Homo sapiens
aggccaaggtgct

SEQ ID NO: 1693872 - DNA, 21 bp, Homo sapiens
aggccaagtctaatgaagaga

SEQ ID NO: 1693873 - DNA, 23 bp, Homo sapiens
aggccaagtctaatgaagagaaa

SEQ ID NO: 1693874 - DNA, 16 bp, Homo sapiens
aggccaatgttgctga

SEQ ID NO: 1693875 - DNA, 21 bp, Homo sapiens
aggccacaccatctcctttca

SEQ ID NO: 1693876 - DNA, 12 bp, Homo sapiens
aggccacccact

SEQ ID NO: 1693877 - DNA, 15 bp, Homo sapiens
aggccacccactgac

SEQ ID NO: 1693878 - DNA, 23 bp, Homo sapiens
aggccaccccctatcctctgagt

SEQ ID NO: 1693879 - DNA, 20 bp, Homo sapiens
aggccaccgggacagacctg

SEQ ID NO: 1693880 - DNA, 23 bp, Homo sapiens
aggccacctcccactcctgctgc

SEQ ID NO: 1693881 - DNA, 24 bp, Homo sapiens
aggccacctcccactcctgctgca

SEQ ID NO: 1693882 - DNA, 13 bp, Homo sapiens
aggccacctctcc

SEQ ID NO: 1693883 - DNA, 15 bp, Homo sapiens
aggccacctctccaa

SEQ ID NO: 1693884 - DNA, 23 bp, Homo sapiens
aggccacctctccaagggcttct

SEQ ID NO: 1693885 - DNA, 16 bp, Homo sapiens
aggccacctctgcctc

SEQ ID NO: 1693886 - DNA, 17 bp, Homo sapiens
aggccacctctgcctct

SEQ ID NO: 1693887 - DNA, 13 bp, Homo sapiens
aggccactcctcc

SEQ ID NO: 1693888 - DNA, 14 bp, Homo sapiens
aggccactgtggcc

SEQ ID NO: 1693889 - DNA, 17 bp, Homo sapiens
aggccactgtggccaga

SEQ ID NO: 1693890 - DNA, 19 bp, Homo sapiens
aggccactgtggccagagc

SEQ ID NO: 1693891 - DNA, 21 bp, Homo sapiens
aggccactgtggccagagctg

SEQ ID NO: 1693892 - DNA, 20 bp, Homo sapiens
aggccacttagtcgtctttt

SEQ ID NO: 1693893 - DNA, 15 bp, Homo sapiens
aggccagacatggtg

SEQ ID NO: 1693894 - DNA, 18 bp, Homo sapiens
aggccagagggcagtggc

SEQ ID NO: 1693895 - DNA, 22 bp, Homo sapiens
aggccagagtggcctggccagg

SEQ ID NO: 1693896 - DNA, 12 bp, Homo sapiens
aggccagcaacg

SEQ ID NO: 1693897 - DNA, 16 bp, Homo sapiens
aggccagccccaccca

SEQ ID NO: 1693898 - DNA, 22 bp, Homo sapiens
aggccagccctccctggctgtg

SEQ ID NO: 1693899 - DNA, 10 bp, Homo sapiens
aggccagcct

SEQ ID NO: 1693900 - DNA, 17 bp, Homo sapiens
aggccagcctccgagag

SEQ ID NO: 1693901 - DNA, 22 bp, Homo sapiens
aggccagcctccgagagggaga

SEQ ID NO: 1693902 - DNA, 17 bp, Homo sapiens
aggccaggctccttcct

SEQ ID NO: 1693903 - DNA, 14 bp, Homo sapiens
aggccagggaaagc

SEQ ID NO: 1693904 - DNA, 14 bp, Homo sapiens
aggccagggcctct

SEQ ID NO: 1693905 - DNA, 17 bp, Homo sapiens
aggccagggctcctgtg

SEQ ID NO: 1693906 - DNA, 16 bp, Homo sapiens
aggccagggctgatgg

SEQ ID NO: 1693907 - DNA, 10 bp, Homo sapiens
aggccaggtc

SEQ ID NO: 1693908 - DNA, 15 bp, Homo sapiens
aggccagtaggagac

SEQ ID NO: 1693909 - DNA, 16 bp, Homo sapiens
aggccatgtgagccac

SEQ ID NO: 1693910 - DNA, 20 bp, Homo sapiens
aggccatgtgagccaccgct

SEQ ID NO: 1693911 - DNA, 16 bp, Homo sapiens
aggccattctgccgcc

SEQ ID NO: 1693912 - DNA, 14 bp, Homo sapiens
aggccatttttggt

SEQ ID NO: 1693913 - DNA, 12 bp, Homo sapiens
aggcccaaatga

SEQ ID NO: 1693914 - DNA, 17 bp, Homo sapiens
aggcctccagcctctcc

SEQ ID NO: 1693915 - DNA, 21 bp, Homo sapiens
aggcctccagcctctcccggc

SEQ ID NO: 1693916 - DNA, 20 bp, Homo sapiens
aggcctcccccagccaggac

SEQ ID NO: 1693917 - DNA, 23 bp, Homo sapiens
aggcctccctgcagactccaatg

SEQ ID NO: 1693918 - DNA, 21 bp, Homo sapiens
aggcctctccatttgctcttc

SEQ ID NO: 1693919 - DNA, 13 bp, Homo sapiens
aggcctctctctg

SEQ ID NO: 1693920 - DNA, 16 bp, Homo sapiens
aggcctctctctgcct

SEQ ID NO: 1693921 - DNA, 17 bp, Homo sapiens
aggcctctctctgcctg

SEQ ID NO: 1693922 - DNA, 16 bp, Homo sapiens
aggcctctctgcctgg

SEQ ID NO: 1693923 - DNA, 15 bp, Homo sapiens
aggcctctgcagaag

SEQ ID NO: 1693924 - DNA, 15 bp, Homo sapiens
aggcctctgcctgct

SEQ ID NO: 1693925 - DNA, 15 bp, Homo sapiens
aggcctcttgtgctc

SEQ ID NO: 1693926 - DNA, 23 bp, Homo sapiens
aggcctgaaagaggctgaggcct

SEQ ID NO: 1693927 - DNA, 13 bp, Homo sapiens
aggcctgaagcca

SEQ ID NO: 1693928 - DNA, 19 bp, Homo sapiens
aggcctgaagccagctgcc

SEQ ID NO: 1693929 - DNA, 22 bp, Homo sapiens
aggcctgaatcatgagcctgct

SEQ ID NO: 1693930 - DNA, 23 bp, Homo sapiens
aggcctgaatcatgagcctgctg

SEQ ID NO: 1693931 - DNA, 19 bp, Homo sapiens
aggcctgacttctgctggc

SEQ ID NO: 1693932 - DNA, 19 bp, Homo sapiens
aggcctgagaatgagtggg

SEQ ID NO: 1693933 - DNA, 20 bp, Homo sapiens
aggcctgagaatgagtggga

SEQ ID NO: 1693934 - DNA, 22 bp, Homo sapiens
aggcctgagaatgagtgggaat

SEQ ID NO: 1693935 - DNA, 23 bp, Homo sapiens
aggcctgagaatgagtgggaatc

SEQ ID NO: 1693936 - DNA, 19 bp, Homo sapiens
aggcctgagatttcatctg

SEQ ID NO: 1693937 - DNA, 20 bp, Homo sapiens
aggcctgagatttcatctgc

SEQ ID NO: 1693938 - DNA, 14 bp, Homo sapiens
aggcctgaggatga

SEQ ID NO: 1693939 - DNA, 15 bp, Homo sapiens
aggcctgatgctgcc

SEQ ID NO: 1693940 - DNA, 16 bp, Homo sapiens
aggcctgatgctgccc

SEQ ID NO: 1693941 - DNA, 18 bp, Homo sapiens
aggcctgcctcccacttc

SEQ ID NO: 1693942 - DNA, 18 bp, Homo sapiens
aggcctgcgaccctgggg

SEQ ID NO: 1693943 - DNA, 21 bp, Homo sapiens
aggcctgcgaccctgggggca

SEQ ID NO: 1693944 - DNA, 17 bp, Homo sapiens
aggcctgcgtgcgctgg

SEQ ID NO: 1693945 - DNA, 20 bp, Homo sapiens
aggcctgctgccagtgcagc

SEQ ID NO: 1693946 - DNA, 12 bp, Homo sapiens
aggcctgcttcc

SEQ ID NO: 1693947 - DNA, 17 bp, Homo sapiens
aggcctgcttccccctc

SEQ ID NO: 1693948 - DNA, 19 bp, Homo sapiens
aggcctggaaccagggagg

SEQ ID NO: 1693949 - DNA, 17 bp, Homo sapiens
aggcctggactttcctg

SEQ ID NO: 1693950 - DNA, 18 bp, Homo sapiens
aggcctggactttcctgc

SEQ ID NO: 1693951 - DNA, 18 bp, Homo sapiens
aggcctggcatcttctgg

SEQ ID NO: 1693952 - DNA, 14 bp, Homo sapiens
aggcctggccaatg

SEQ ID NO: 1693953 - DNA, 20 bp, Homo sapiens
aggcctggccaatgcggccc

SEQ ID NO: 1693954 - DNA, 22 bp, Homo sapiens
aggcctggccaatgcggcccac

SEQ ID NO: 1693955 - DNA, 12 bp, Homo sapiens
aggcctggcctc

SEQ ID NO: 1693956 - DNA, 15 bp, Homo sapiens
aggcctggcctctgg

SEQ ID NO: 1693957 - DNA, 20 bp, Homo sapiens
aggcctgggacccagctact

SEQ ID NO: 1693958 - DNA, 23 bp, Homo sapiens
aggcctgggggacccctggctct

SEQ ID NO: 1693959 - DNA, 12 bp, Homo sapiens
aggcctgggtgc

SEQ ID NO: 1693960 - DNA, 17 bp, Homo sapiens
aggcctgggtgctggct

SEQ ID NO: 1693961 - DNA, 15 bp, Homo sapiens
aggcctgtccaccct

SEQ ID NO: 1693962 - DNA, 16 bp, Homo sapiens
aggcctgtccaccctg

SEQ ID NO: 1693963 - DNA, 18 bp, Homo sapiens
aggcctgtcccttgcctc

SEQ ID NO: 1693964 - DNA, 16 bp, Homo sapiens
aggcctgtgctgcatg

SEQ ID NO: 1693965 - DNA, 20 bp, Homo sapiens
aggcctgtggggagccgagg

SEQ ID NO: 1693966 - DNA, 21 bp, Homo sapiens
aggccttaacacactggccat

SEQ ID NO: 1693967 - DNA, 11 bp, Homo sapiens
aggccttcagt

SEQ ID NO: 1693968 - DNA, 18 bp, Homo sapiens
aggccttcatcctcctcc

SEQ ID NO: 1693969 - DNA, 19 bp, Homo sapiens
aggccttcatcctcctccc

SEQ ID NO: 1693970 - DNA, 22 bp, Homo sapiens
aggccttccagaaagcaggagc

SEQ ID NO: 1693971 - DNA, 16 bp, Homo sapiens
aggccttcctctctcc

SEQ ID NO: 1693972 - DNA, 19 bp, Homo sapiens
aggccttcctctctccaga

SEQ ID NO: 1693973 - DNA, 19 bp, Homo sapiens
aggccttggtggagcagcc

SEQ ID NO: 1693974 - DNA, 17 bp, Homo sapiens
aggccttgtgtgtcagg

SEQ ID NO: 1693975 - DNA, 12 bp, Homo sapiens
aggcctttcttc

SEQ ID NO: 1693976 - DNA, 14 bp, Homo sapiens
aggcctttcttctg

SEQ ID NO: 1693977 - DNA, 16 bp, Homo sapiens
aggccttttggaatgt

SEQ ID NO: 1693978 - DNA, 13 bp, Homo sapiens
aggcgagccaggc

SEQ ID NO: 1693979 - DNA, 15 bp, Homo sapiens
aggcgcctgccttgg

SEQ ID NO: 1693980 - DNA, 16 bp, Homo sapiens
aggcgctgcagggccg

SEQ ID NO: 1693981 - DNA, 19 bp, Homo sapiens
aggcggaggcgctcctccc

SEQ ID NO: 1693982 - DNA, 13 bp, Homo sapiens
aggcggcccggcc

SEQ ID NO: 1693983 - DNA, 21 bp, Homo sapiens
aggcggcccggccagcgggca

SEQ ID NO: 1693984 - DNA, 14 bp, Homo sapiens
aggcgggaaggagg

SEQ ID NO: 1693985 - DNA, 20 bp, Homo sapiens
aggcgggaggaggtgtgagg

SEQ ID NO: 1693986 - DNA, 14 bp, Homo sapiens
aggcgggagggcct

SEQ ID NO: 1693987 - DNA, 12 bp, Homo sapiens
aggcgggccagc

SEQ ID NO: 1693988 - DNA, 23 bp, Homo sapiens
aggcgggccagccaggcgggctc

SEQ ID NO: 1693989 - DNA, 14 bp, Homo sapiens
aggcgggctcaagg

SEQ ID NO: 1693990 - DNA, 17 bp, Homo sapiens
aggcgggggctgccctt

SEQ ID NO: 1693991 - DNA, 15 bp, Homo sapiens
aggcggtcatgtgtg

SEQ ID NO: 1693992 - DNA, 16 bp, Homo sapiens
aggcggtcatgtgtgc

SEQ ID NO: 1693993 - DNA, 18 bp, Homo sapiens
aggcggtcatgtgtgcat

SEQ ID NO: 1693994 - DNA, 20 bp, Homo sapiens
aggcggtcatgtgtgcatgt

SEQ ID NO: 1693995 - DNA, 15 bp, Homo sapiens
aggcgtactacccag

SEQ ID NO: 1693996 - DNA, 19 bp, Homo sapiens
aggcgtactacccagctct

SEQ ID NO: 1693997 - DNA, 21 bp, Homo sapiens
aggcgtactacccagctctgt

SEQ ID NO: 1693998 - DNA, 18 bp, Homo sapiens
aggcgtctgtatattttg

SEQ ID NO: 1693999 - DNA, 21 bp, Homo sapiens
aggcgtctgtatattttggga

SEQ ID NO: 1694000 - DNA, 12 bp, Homo sapiens
aggcgtgatcca

SEQ ID NO: 1694001 - DNA, 12 bp, Homo sapiens
aggcgtgccccc

SEQ ID NO: 1694002 - DNA, 18 bp, Homo sapiens
aggcgtgcccccctcctc

SEQ ID NO: 1694003 - DNA, 18 bp, Homo sapiens
aggcgtggtggtgcatgc

SEQ ID NO: 1694004 - DNA, 17 bp, Homo sapiens
aggcgttagtgggcagg

SEQ ID NO: 1694005 - DNA, 14 bp, Homo sapiens
aggcgttggtgcca

SEQ ID NO: 1694006 - DNA, 15 bp, Homo sapiens
aggcgttggtgccac

SEQ ID NO: 1694007 - DNA, 17 bp, Homo sapiens
aggctaacatcccactt

SEQ ID NO: 1694008 - DNA, 16 bp, Homo sapiens
aggctaagaccctgtg

SEQ ID NO: 1694009 - DNA, 21 bp, Homo sapiens
aggctaagatgagatttgcca

SEQ ID NO: 1694010 - DNA, 17 bp, Homo sapiens
aggctaattcagtgtca

SEQ ID NO: 1694011 - DNA, 19 bp, Homo sapiens
aggctaattcagtgtcaca

SEQ ID NO: 1694012 - DNA, 20 bp, Homo sapiens
aggctaattcagtgtcacat

SEQ ID NO: 1694013 - DNA, 22 bp, Homo sapiens
aggctatggacagggcatgcca

SEQ ID NO: 1694014 - DNA, 21 bp, Homo sapiens
aggctatggagggtcctcctc

SEQ ID NO: 1694015 - DNA, 15 bp, Homo sapiens
aggctattaaaaaag

SEQ ID NO: 1694016 - DNA, 17 bp, Homo sapiens
aggctattaaaagaatc

SEQ ID NO: 1694017 - DNA, 18 bp, Homo sapiens
aggctattatttattgta

SEQ ID NO: 1694018 - DNA, 14 bp, Homo sapiens
aggctatttgttca

SEQ ID NO: 1694019 - DNA, 18 bp, Homo sapiens
aggctatttgttcagaga

SEQ ID NO: 1694020 - DNA, 19 bp, Homo sapiens
aggctatttgttcagagag

SEQ ID NO: 1694021 - DNA, 23 bp, Homo sapiens
aggctcaaaaacttgatcacatg

SEQ ID NO: 1694022 - DNA, 18 bp, Homo sapiens
aggctcaaggctgtgcag

SEQ ID NO: 1694023 - DNA, 21 bp, Homo sapiens
aggctcactgagtgatacttt

SEQ ID NO: 1694024 - DNA, 20 bp, Homo sapiens
aggctcactgccaggccagc

SEQ ID NO: 1694025 - DNA, 22 bp, Homo sapiens
aggctcactgccaggccagcct

SEQ ID NO: 1694026 - DNA, 19 bp, Homo sapiens
aggctcagtctcaggagca

SEQ ID NO: 1694027 - DNA, 23 bp, Homo sapiens
aggctcagtctcaggagcatggg

SEQ ID NO: 1694028 - DNA, 20 bp, Homo sapiens
aggctcagtggtgggagaga

SEQ ID NO: 1694029 - DNA, 22 bp, Homo sapiens
aggctcatagggaagacctgct

SEQ ID NO: 1694030 - DNA, 15 bp, Homo sapiens
agggatcacagggcc

SEQ ID NO: 1694031 - DNA, 18 bp, Homo sapiens
agggatgaagggcgagtg

SEQ ID NO: 1694032 - DNA, 22 bp, Homo sapiens
agggatgatggcagagccaggc

SEQ ID NO: 1694033 - DNA, 23 bp, Homo sapiens
agggatgcggatcctgctggggc

SEQ ID NO: 1694034 - DNA, 18 bp, Homo sapiens
agggatgctgctccgccc

SEQ ID NO: 1694035 - DNA, 16 bp, Homo sapiens
agggatgctgggctgg

SEQ ID NO: 1694036 - DNA, 15 bp, Homo sapiens
agggatggaaaagga

SEQ ID NO: 1694037 - DNA, 22 bp, Homo sapiens
agggatggaaaaggaagactag

SEQ ID NO: 1694038 - DNA, 21 bp, Homo sapiens
agggatggacttgtgattggc

SEQ ID NO: 1694039 - DNA, 22 bp, Homo sapiens
agggatggacttgtgattggct

SEQ ID NO: 1694040 - DNA, 23 bp, Homo sapiens
agggatggacttgtgattggctg

SEQ ID NO: 1694041 - DNA, 15 bp, Homo sapiens
agggatggagaaaga

SEQ ID NO: 1694042 - DNA, 17 bp, Homo sapiens
agggatggagaaagaag

SEQ ID NO: 1694043 - DNA, 18 bp, Homo sapiens
agggatggagaaagaagt

SEQ ID NO: 1694044 - DNA, 19 bp, Homo sapiens
agggatggagatgggaagg

SEQ ID NO: 1694045 - DNA, 21 bp, Homo sapiens
agggatgttattatccttggg

SEQ ID NO: 1694046 - DNA, 18 bp, Homo sapiens
agggatgttctggccctc

SEQ ID NO: 1694047 - DNA, 18 bp, Homo sapiens
agggattaacctctgcac

SEQ ID NO: 1694048 - DNA, 19 bp, Homo sapiens
agggattaacctctgcact

SEQ ID NO: 1694049 - DNA, 18 bp, Homo sapiens
agggattcacatctgcat

SEQ ID NO: 1694050 - DNA, 23 bp, Homo sapiens
agggattctgggcttggggtgtg

SEQ ID NO: 1694051 - DNA, 20 bp, Homo sapiens
agggattctggttccagggt

SEQ ID NO: 1694052 - DNA, 18 bp, Homo sapiens
agggattgaggagttgcc

SEQ ID NO: 1694053 - DNA, 14 bp, Homo sapiens
agggattgatttta

SEQ ID NO: 1694054 - DNA, 14 bp, Homo sapiens
agggattgctgagg

SEQ ID NO: 1694055 - DNA, 16 bp, Homo sapiens
agggcaaacccaaaac

SEQ ID NO: 1694056 - DNA, 18 bp, Homo sapiens
agggcaaatgacatgcac

SEQ ID NO: 1694057 - DNA, 21 bp, Homo sapiens
agggcaaatgacatgcactga

SEQ ID NO: 1694058 - DNA, 23 bp, Homo sapiens
agggcaaatgacatgcactgacc

SEQ ID NO: 1694059 - DNA, 17 bp, Homo sapiens
agggcaacacagtgaga

SEQ ID NO: 1694060 - DNA, 20 bp, Homo sapiens
agggcaaggagtttattaca

SEQ ID NO: 1694061 - DNA, 20 bp, Homo sapiens
agggcaagggttaaggcctg

SEQ ID NO: 1694062 - DNA, 22 bp, Homo sapiens
agggcaagtggatgggaatttg

SEQ ID NO: 1694063 - DNA, 14 bp, Homo sapiens
agggcacagccctc

SEQ ID NO: 1694064 - DNA, 16 bp, Homo sapiens
agggcacagccctccg

SEQ ID NO: 1694065 - DNA, 20 bp, Homo sapiens
agggcacattaactccctcc

SEQ ID NO: 1694066 - DNA, 14 bp, Homo sapiens
agggcacattgccc

SEQ ID NO: 1694067 - DNA, 22 bp, Homo sapiens
agggcacattgcccatggctgg

SEQ ID NO: 1694068 - DNA, 15 bp, Homo sapiens
agggcaccagaggcc

SEQ ID NO: 1694069 - DNA, 19 bp, Homo sapiens
agggcaccaggggtttctc

SEQ ID NO: 1694070 - DNA, 19 bp, Homo sapiens
agggcaccccttgtttctg

SEQ ID NO: 1694071 - DNA, 13 bp, Homo sapiens
agggcactgggct

SEQ ID NO: 1694072 - DNA, 14 bp, Homo sapiens
agggcactgggctg

SEQ ID NO: 1694073 - DNA, 15 bp, Homo sapiens
agggcactgggctgt

SEQ ID NO: 1694074 - DNA, 18 bp, Homo sapiens
agggcactgggctgttgt

SEQ ID NO: 1694075 - DNA, 17 bp, Homo sapiens
agggcactggtggcccg

SEQ ID NO: 1694076 - DNA, 15 bp, Homo sapiens
agggcagactggggc

SEQ ID NO: 1694077 - DNA, 15 bp, Homo sapiens
agggcagagccatgg

SEQ ID NO: 1694078 - DNA, 18 bp, Homo sapiens
agggcagagccatgggcc

SEQ ID NO: 1694079 - DNA, 15 bp, Homo sapiens
agggcagagccggga

SEQ ID NO: 1694080 - DNA, 13 bp, Homo sapiens
agggcagaggaat

SEQ ID NO: 1694081 - DNA, 15 bp, Homo sapiens
agggcagaggaatgt

SEQ ID NO: 1694082 - DNA, 15 bp, Homo sapiens
agggcagaggctgga

SEQ ID NO: 1694083 - DNA, 17 bp, Homo sapiens
agggcagattttcatgc

SEQ ID NO: 1694084 - DNA, 21 bp, Homo sapiens
agggcagcagaagggggtggt

SEQ ID NO: 1694085 - DNA, 14 bp, Homo sapiens
agggcagcagatct

SEQ ID NO: 1694086 - DNA, 13 bp, Homo sapiens
agggcagcagccg

SEQ ID NO: 1694087 - DNA, 22 bp, Homo sapiens
agggcagcctccaccttgctct

SEQ ID NO: 1694088 - DNA, 12 bp, Homo sapiens
agggcagctgct

SEQ ID NO: 1694089 - DNA, 17 bp, Homo sapiens
agggcagcttgccccgg

SEQ ID NO: 1694090 - DNA, 23 bp, Homo sapiens
agggcagcttgccccggccccgg

SEQ ID NO: 1694091 - DNA, 16 bp, Homo sapiens
agggcaggaaggagag

SEQ ID NO: 1694092 - DNA, 19 bp, Homo sapiens
agggcaggaaggagagcct

SEQ ID NO: 1694093 - DNA, 13 bp, Homo sapiens
agggcagggcatc

SEQ ID NO: 1694094 - DNA, 15 bp, Homo sapiens
agggcagggctctga

SEQ ID NO: 1694095 - DNA, 14 bp, Homo sapiens
agggcaggggtgct

SEQ ID NO: 1694096 - DNA, 22 bp, Homo sapiens
agggcagggtccacgcctctgc

SEQ ID NO: 1694097 - DNA, 15 bp, Homo sapiens
agggcagtacctggg

SEQ ID NO: 1694098 - DNA, 17 bp, Homo sapiens
agggcagtacctgggaa

SEQ ID NO: 1694099 - DNA, 17 bp, Homo sapiens
agggcagtgtttccttt

SEQ ID NO: 1694100 - DNA, 18 bp, Homo sapiens
agggcagtgtttcctttt

SEQ ID NO: 1694101 - DNA, 16 bp, Homo sapiens
agggcatatacagtga

SEQ ID NO: 1694102 - DNA, 17 bp, Homo sapiens
agggcatcaggcactgg

SEQ ID NO: 1694103 - DNA, 18 bp, Homo sapiens
agggcatcttgctggcta

SEQ ID NO: 1694104 - DNA, 19 bp, Homo sapiens
agggcatgaagctgcatat

SEQ ID NO: 1694105 - DNA, 18 bp, Homo sapiens
agggcatgcattttgcag

SEQ ID NO: 1694106 - DNA, 14 bp, Homo sapiens
agggcattgctcag

SEQ ID NO: 1694107 - DNA, 20 bp, Homo sapiens
agggcattgctcagcccgct

SEQ ID NO: 1694108 - DNA, 22 bp, Homo sapiens
agggcatttgagaaatgcatat

SEQ ID NO: 1694109 - DNA, 24 bp, Homo sapiens
agggccacactattaccatgagaa

SEQ ID NO: 1694110 - DNA, 16 bp, Homo sapiens
agggccacgctccagc

SEQ ID NO: 1694111 - DNA, 18 bp, Homo sapiens
agggccacgtgccaggcc

SEQ ID NO: 1694112 - DNA, 12 bp, Homo sapiens
agggccagaagg

SEQ ID NO: 1694113 - DNA, 14 bp, Homo sapiens
agggccagaaggag

SEQ ID NO: 1694114 - DNA, 14 bp, Homo sapiens
agggccagagccag

SEQ ID NO: 1694115 - DNA, 16 bp, Homo sapiens
agggccagcaggctcc

SEQ ID NO: 1694116 - DNA, 16 bp, Homo sapiens
agggccagggacccag

SEQ ID NO: 1694117 - DNA, 17 bp, Homo sapiens
agggccagtcctgcctg

SEQ ID NO: 1694118 - DNA, 15 bp, Homo sapiens
agggccagtctgggc

SEQ ID NO: 1694119 - DNA, 23 bp, Homo sapiens
agggccatacttttgagaggggt

SEQ ID NO: 1694120 - DNA, 16 bp, Homo sapiens
agggccatgcagacct

SEQ ID NO: 1694121 - DNA, 17 bp, Homo sapiens
agggccatgcctgcccc

SEQ ID NO: 1694122 - DNA, 20 bp, Homo sapiens
agggccatgctgaggcctgg

SEQ ID NO: 1694123 - DNA, 17 bp, Homo sapiens
agggcccaagtccctgt

SEQ ID NO: 1694124 - DNA, 14 bp, Homo sapiens
agggcccacacctg

SEQ ID NO: 1694125 - DNA, 18 bp, Homo sapiens
agggcccacacctggtgg

SEQ ID NO: 1694126 - DNA, 12 bp, Homo sapiens
agggcccagagc

SEQ ID NO: 1694127 - DNA, 15 bp, Homo sapiens
agggcccagagccca

SEQ ID NO: 1694128 - DNA, 18 bp, Homo sapiens
agggcccagagcccagct

SEQ ID NO: 1694129 - DNA, 11 bp, Homo sapiens
agggcccagcc

SEQ ID NO: 1694130 - DNA, 15 bp, Homo sapiens
agggcccagcccaga

SEQ ID NO: 1694131 - DNA, 17 bp, Homo sapiens
agggcccagcccagagc

SEQ ID NO: 1694132 - DNA, 14 bp, Homo sapiens
agggcccagctgta

SEQ ID NO: 1694133 - DNA, 17 bp, Homo sapiens
agggcccagctgtagcc

SEQ ID NO: 1694134 - DNA, 14 bp, Homo sapiens
agggcccaggcagg

SEQ ID NO: 1694135 - DNA, 16 bp, Homo sapiens
agggcccatcaggcag

SEQ ID NO: 1694136 - DNA, 12 bp, Homo sapiens
agggccccagca

SEQ ID NO: 1694137 - DNA, 18 bp, Homo sapiens
agggccccagcactaaag

SEQ ID NO: 1694138 - DNA, 16 bp, Homo sapiens
agggccccaggggcag

SEQ ID NO: 1694139 - DNA, 18 bp, Homo sapiens
agggccccaggggcagca

SEQ ID NO: 1694140 - DNA, 11 bp, Homo sapiens
agggcccctcc

SEQ ID NO: 1694141 - DNA, 16 bp, Homo sapiens
agggcccctccctctg

SEQ ID NO: 1694142 - DNA, 18 bp, Homo sapiens
agggcccctccctctgcc

SEQ ID NO: 1694143 - DNA, 20 bp, Homo sapiens
agggcccctccctctgcccc

SEQ ID NO: 1694144 - DNA, 19 bp, Homo sapiens
agggcccctgcgtgggggc

SEQ ID NO: 1694145 - DNA, 18 bp, Homo sapiens
agggcccggccacaccca

SEQ ID NO: 1694146 - DNA, 13 bp, Homo sapiens
agggccctcccag

SEQ ID NO: 1694147 - DNA, 15 bp, Homo sapiens
aggctccatgcacct

SEQ ID NO: 1694148 - DNA, 17 bp, Homo sapiens
aggctccatgcacctcc

SEQ ID NO: 1694149 - DNA, 21 bp, Homo sapiens
aggctcccatgtgagtccctg

SEQ ID NO: 1694150 - DNA, 20 bp, Homo sapiens
aggctcccgaggggaagggg

SEQ ID NO: 1694151 - DNA, 14 bp, Homo sapiens
aggctccctcgccc

SEQ ID NO: 1694152 - DNA, 19 bp, Homo sapiens
aggctcctacctgtctgct

SEQ ID NO: 1694153 - DNA, 21 bp, Homo sapiens
aggctcctccttgcccagact

SEQ ID NO: 1694154 - DNA, 21 bp, Homo sapiens
aggctcctggctgtgcccagc

SEQ ID NO: 1694155 - DNA, 22 bp, Homo sapiens
aggctcctggctgtgcccagca

SEQ ID NO: 1694156 - DNA, 23 bp, Homo sapiens
aggctcctggctgtgcccagcag

SEQ ID NO: 1694157 - DNA, 16 bp, Homo sapiens
aggctccttcctgtct

SEQ ID NO: 1694158 - DNA, 20 bp, Homo sapiens
aggctcggaggaccctggaa

SEQ ID NO: 1694159 - DNA, 21 bp, Homo sapiens
aggctctatgagtctagatgt

SEQ ID NO: 1694160 - DNA, 23 bp, Homo sapiens
aggctctattccaataaactatg

SEQ ID NO: 1694161 - DNA, 21 bp, Homo sapiens
aggctctgagagtctagattc

SEQ ID NO: 1694162 - DNA, 15 bp, Homo sapiens
aggctctgcacagat

SEQ ID NO: 1694163 - DNA, 12 bp, Homo sapiens
aggctctgccct

SEQ ID NO: 1694164 - DNA, 22 bp, Homo sapiens
aggctctgcttctccaaggaaa

SEQ ID NO: 1694165 - DNA, 17 bp, Homo sapiens
aggctctgggctcaggg

SEQ ID NO: 1694166 - DNA, 22 bp, Homo sapiens
aggctctgggctcagggctgga

SEQ ID NO: 1694167 - DNA, 16 bp, Homo sapiens
aggctctgtgccttgg

SEQ ID NO: 1694168 - DNA, 18 bp, Homo sapiens
aggctctgtgccttggtc

SEQ ID NO: 1694169 - DNA, 22 bp, Homo sapiens
aggctcttaagcagcatggaaa

SEQ ID NO: 1694170 - DNA, 19 bp, Homo sapiens
aggctcttagcagcttcca

SEQ ID NO: 1694171 - DNA, 16 bp, Homo sapiens
aggctcttcctggacc

SEQ ID NO: 1694172 - DNA, 17 bp, Homo sapiens
aggctgaaagaggccaa

SEQ ID NO: 1694173 - DNA, 16 bp, Homo sapiens
aggctgaattacagtg

SEQ ID NO: 1694174 - DNA, 21 bp, Homo sapiens
aggctgacatgctcacacatt

SEQ ID NO: 1694175 - DNA, 14 bp, Homo sapiens
aggctgaccaagag

SEQ ID NO: 1694176 - DNA, 15 bp, Homo sapiens
aggctgaccaagaga

SEQ ID NO: 1694177 - DNA, 19 bp, Homo sapiens
aggctgaccaagagagaaa

SEQ ID NO: 1694178 - DNA, 16 bp, Homo sapiens
aggctgagccatgagg

SEQ ID NO: 1694179 - DNA, 17 bp, Homo sapiens
aggctgagccatgagga

SEQ ID NO: 1694180 - DNA, 13 bp, Homo sapiens
aggctgaggcctg

SEQ ID NO: 1694181 - DNA, 13 bp, Homo sapiens
aggctgaggtggt

SEQ ID NO: 1694182 - DNA, 14 bp, Homo sapiens
aggctgagtccaga

SEQ ID NO: 1694183 - DNA, 24 bp, Homo sapiens
aggctgagtccagagcttgtgctc

SEQ ID NO: 1694184 - DNA, 14 bp, Homo sapiens
aggctgagttctgg

SEQ ID NO: 1694185 - DNA, 18 bp, Homo sapiens
aggctgcaatgagccatg

SEQ ID NO: 1694186 - DNA, 21 bp, Homo sapiens
aggctgcacctctggctagag

SEQ ID NO: 1694187 - DNA, 24 bp, Homo sapiens
aggctgcacctctggctagagccg

SEQ ID NO: 1694188 - DNA, 11 bp, Homo sapiens
aggctgcactg

SEQ ID NO: 1694189 - DNA, 19 bp, Homo sapiens
aggctgcactgcagtgatg

SEQ ID NO: 1694190 - DNA, 11 bp, Homo sapiens
aggctgcagca

SEQ ID NO: 1694191 - DNA, 23 bp, Homo sapiens
aggctgcagcaggtgctgggctg

SEQ ID NO: 1694192 - DNA, 16 bp, Homo sapiens
aggctgcatgctctgg

SEQ ID NO: 1694193 - DNA, 18 bp, Homo sapiens
aggctgcatgctctggaa

SEQ ID NO: 1694194 - DNA, 12 bp, Homo sapiens
aggctgccccag

SEQ ID NO: 1694195 - DNA, 16 bp, Homo sapiens
aggctgccccaggccg

SEQ ID NO: 1694196 - DNA, 17 bp, Homo sapiens
aggctgcccctctcacc

SEQ ID NO: 1694197 - DNA, 12 bp, Homo sapiens
aggctgcctcag

SEQ ID NO: 1694198 - DNA, 17 bp, Homo sapiens
aggctgcctcagccagt

SEQ ID NO: 1694199 - DNA, 20 bp, Homo sapiens
aggctgcctcggactccatg

SEQ ID NO: 1694200 - DNA, 23 bp, Homo sapiens
aggctgcctgagcacctcccagc

SEQ ID NO: 1694201 - DNA, 16 bp, Homo sapiens
aggctgctctgcctgt

SEQ ID NO: 1694202 - DNA, 13 bp, Homo sapiens
aggctgctgccgg

SEQ ID NO: 1694203 - DNA, 15 bp, Homo sapiens
aggctggaaatagga

SEQ ID NO: 1694204 - DNA, 19 bp, Homo sapiens
aggctggacaccctctgcc

SEQ ID NO: 1694205 - DNA, 21 bp, Homo sapiens
aggctggagactggaccgctg

SEQ ID NO: 1694206 - DNA, 17 bp, Homo sapiens
aggctggaggcagggcc

SEQ ID NO: 1694207 - DNA, 23 bp, Homo sapiens
aggctggatcttggagaatgtga

SEQ ID NO: 1694208 - DNA, 20 bp, Homo sapiens
aggctggatggcacctcagg

SEQ ID NO: 1694209 - DNA, 21 bp, Homo sapiens
aggctggcaaaccctcccaga

SEQ ID NO: 1694210 - DNA, 22 bp, Homo sapiens
aggctggccaaggtgtccaggg

SEQ ID NO: 1694211 - DNA, 19 bp, Homo sapiens
aggctggccagtccaggct

SEQ ID NO: 1694212 - DNA, 20 bp, Homo sapiens
aggctggcgcagccaaggcc

SEQ ID NO: 1694213 - DNA, 22 bp, Homo sapiens
aggctgggcagcacaaggcctt

SEQ ID NO: 1694214 - DNA, 22 bp, Homo sapiens
aggctgggccatgtccaaagag

SEQ ID NO: 1694215 - DNA, 18 bp, Homo sapiens
aggctgggcctcccctgg

SEQ ID NO: 1694216 - DNA, 22 bp, Homo sapiens
aggctggggtcttgggttcctg

SEQ ID NO: 1694217 - DNA, 18 bp, Homo sapiens
aggctggtaagagaagtg

SEQ ID NO: 1694218 - DNA, 22 bp, Homo sapiens
aggctggtctcaaactcctgac

SEQ ID NO: 1694219 - DNA, 22 bp, Homo sapiens
aggctggttcggatttggggtg

SEQ ID NO: 1694220 - DNA, 12 bp, Homo sapiens
aggctgtaacta

SEQ ID NO: 1694221 - DNA, 18 bp, Homo sapiens
aggctgtagaaaggggag

SEQ ID NO: 1694222 - DNA, 14 bp, Homo sapiens
aggctgtattttct

SEQ ID NO: 1694223 - DNA, 22 bp, Homo sapiens
aggctgtccttaacccacctct

SEQ ID NO: 1694224 - DNA, 20 bp, Homo sapiens
aggctgtgcacctattctgt

SEQ ID NO: 1694225 - DNA, 22 bp, Homo sapiens
aggctgtgtccctcttctcttc

SEQ ID NO: 1694226 - DNA, 20 bp, Homo sapiens
aggctgttaaatacaggaaa

SEQ ID NO: 1694227 - DNA, 18 bp, Homo sapiens
aggctgttctgcactgaa

SEQ ID NO: 1694228 - DNA, 19 bp, Homo sapiens
aggctgttctgcactgaaa

SEQ ID NO: 1694229 - DNA, 23 bp, Homo sapiens
aggctgttggaaaatccagaact

SEQ ID NO: 1694230 - DNA, 17 bp, Homo sapiens
aggcttaccaaagtatt

SEQ ID NO: 1694231 - DNA, 16 bp, Homo sapiens
aggcttaggcatgttc

SEQ ID NO: 1694232 - DNA, 15 bp, Homo sapiens
aggcttaggcctctc

SEQ ID NO: 1694233 - DNA, 17 bp, Homo sapiens
aggcttcaattggtgga

SEQ ID NO: 1694234 - DNA, 18 bp, Homo sapiens
aggcttcaattggtggaa

SEQ ID NO: 1694235 - DNA, 24 bp, Homo sapiens
aggcttcacgccgggagaagccac

SEQ ID NO: 1694236 - DNA, 13 bp, Homo sapiens
aggcttccaggct

SEQ ID NO: 1694237 - DNA, 16 bp, Homo sapiens
aggcttccaggctctt

SEQ ID NO: 1694238 - DNA, 21 bp, Homo sapiens
aggcttccctgacttgcttta

SEQ ID NO: 1694239 - DNA, 16 bp, Homo sapiens
aggcttcctggtgaga

SEQ ID NO: 1694240 - DNA, 18 bp, Homo sapiens
aggcttctatgtccaaca

SEQ ID NO: 1694241 - DNA, 16 bp, Homo sapiens
aggcttctccgccagc

SEQ ID NO: 1694242 - DNA, 19 bp, Homo sapiens
aggcttctccgccagcctc

SEQ ID NO: 1694243 - DNA, 12 bp, Homo sapiens
aggcttctctcc

SEQ ID NO: 1694244 - DNA, 16 bp, Homo sapiens
aggcttcttcagatca

SEQ ID NO: 1694245 - DNA, 18 bp, Homo sapiens
aggcttgcataataagct

SEQ ID NO: 1694246 - DNA, 22 bp, Homo sapiens
aggcttggagggaagggagaaa

SEQ ID NO: 1694247 - DNA, 16 bp, Homo sapiens
aggcttggggaaaatg

SEQ ID NO: 1694248 - DNA, 21 bp, Homo sapiens
aggcttgtttacctttctctc

SEQ ID NO: 1694249 - DNA, 15 bp, Homo sapiens
aggctttcactattt

SEQ ID NO: 1694250 - DNA, 19 bp, Homo sapiens
aggctttcactatttcctt

SEQ ID NO: 1694251 - DNA, 18 bp, Homo sapiens
aggctttcccacttccca

SEQ ID NO: 1694252 - DNA, 20 bp, Homo sapiens
aggctttgggaacactggcc

SEQ ID NO: 1694253 - DNA, 22 bp, Homo sapiens
aggctttgggaacactggcctg

SEQ ID NO: 1694254 - DNA, 23 bp, Homo sapiens
aggctttgggtggctcactactg

SEQ ID NO: 1694255 - DNA, 18 bp, Homo sapiens
aggctttggtaactgcgg

SEQ ID NO: 1694256 - DNA, 16 bp, Homo sapiens
agggaaaaaaaatgta

SEQ ID NO: 1694257 - DNA, 24 bp, Homo sapiens
agggaaaaaaaatgtagcgacagc

SEQ ID NO: 1694258 - DNA, 19 bp, Homo sapiens
agggaaaaatttttatgta

SEQ ID NO: 1694259 - DNA, 22 bp, Homo sapiens
agggaaaaatttttatgtaaaa

SEQ ID NO: 1694260 - DNA, 16 bp, Homo sapiens
agggaaaaggggctcc

SEQ ID NO: 1694261 - DNA, 17 bp, Homo sapiens
agggaaaaggggctcct

SEQ ID NO: 1694262 - DNA, 20 bp, Homo sapiens
agggaaaataggcaggaagc

SEQ ID NO: 1694263 - DNA, 16 bp, Homo sapiens
agggaaaattgcccca

SEQ ID NO: 1694264 - DNA, 16 bp, Homo sapiens
agggaaaccttggaga

SEQ ID NO: 1694265 - DNA, 23 bp, Homo sapiens
agggaaactgccagcaacgcagg

SEQ ID NO: 1694266 - DNA, 13 bp, Homo sapiens
agggaaactggga

SEQ ID NO: 1694267 - DNA, 19 bp, Homo sapiens
agggaaagatgtagaaaga

SEQ ID NO: 1694268 - DNA, 18 bp, Homo sapiens
agggaaaggatattttct

SEQ ID NO: 1694269 - DNA, 17 bp, Homo sapiens
agggaaaggcaagcttg

SEQ ID NO: 1694270 - DNA, 15 bp, Homo sapiens
agggaaagttttttt

SEQ ID NO: 1694271 - DNA, 21 bp, Homo sapiens
agggaaattgtttatgtgtta

SEQ ID NO: 1694272 - DNA, 13 bp, Homo sapiens
agggaacagacag

SEQ ID NO: 1694273 - DNA, 20 bp, Homo sapiens
agggaacagacaggagaaat

SEQ ID NO: 1694274 - DNA, 21 bp, Homo sapiens
agggaacagacaggagaaatg

SEQ ID NO: 1694275 - DNA, 14 bp, Homo sapiens
agggaacagcccca

SEQ ID NO: 1694276 - DNA, 13 bp, Homo sapiens
agggaactgggga

SEQ ID NO: 1694277 - DNA, 13 bp, Homo sapiens
agggaagagggca

SEQ ID NO: 1694278 - DNA, 16 bp, Homo sapiens
agggaagagggcagta

SEQ ID NO: 1694279 - DNA, 13 bp, Homo sapiens
agggaagagtttt

SEQ ID NO: 1694280 - DNA, 13 bp, Homo sapiens
agggaagatggag

SEQ ID NO: 1694281 - DNA, 14 bp, Homo sapiens
agggaagcccagct

SEQ ID NO: 1694282 - DNA, 24 bp, Homo sapiens
agggaagcccagctccagggccag

SEQ ID NO: 1694283 - DNA, 13 bp, Homo sapiens
agggaaggaaaaa

SEQ ID NO: 1694284 - DNA, 13 bp, Homo sapiens
agggaaggagccc

SEQ ID NO: 1694285 - DNA, 12 bp, Homo sapiens
agggaaggcctg

SEQ ID NO: 1694286 - DNA, 14 bp, Homo sapiens
agggaaggctaagc

SEQ ID NO: 1694287 - DNA, 12 bp, Homo sapiens
agggaaggtggg

SEQ ID NO: 1694288 - DNA, 20 bp, Homo sapiens
agggaaggtggggccctgcc

SEQ ID NO: 1694289 - DNA, 23 bp, Homo sapiens
agggaaggtggggccctgcccct

SEQ ID NO: 1694290 - DNA, 17 bp, Homo sapiens
agggaagtgaggcccaa

SEQ ID NO: 1694291 - DNA, 22 bp, Homo sapiens
agggaagtgaggcccaaggagc

SEQ ID NO: 1694292 - DNA, 13 bp, Homo sapiens
agggaagtggtct

SEQ ID NO: 1694293 - DNA, 23 bp, Homo sapiens
agggaagttgctggaaagagcat

SEQ ID NO: 1694294 - DNA, 15 bp, Homo sapiens
agggaatagaaatgt

SEQ ID NO: 1694295 - DNA, 22 bp, Homo sapiens
agggaatccaagcctccacagc

SEQ ID NO: 1694296 - DNA, 23 bp, Homo sapiens
agggaatccattgaactggaaga

SEQ ID NO: 1694297 - DNA, 15 bp, Homo sapiens
agggaatcctcctcc

SEQ ID NO: 1694298 - DNA, 15 bp, Homo sapiens
agggaatctggatta

SEQ ID NO: 1694299 - DNA, 21 bp, Homo sapiens
agggaatgagagttccttctc

SEQ ID NO: 1694300 - DNA, 13 bp, Homo sapiens
agggaatgtgaaa

SEQ ID NO: 1694301 - DNA, 22 bp, Homo sapiens
agggaatgttccctgcaccctg

SEQ ID NO: 1694302 - DNA, 15 bp, Homo sapiens
agggaatttcaggaa

SEQ ID NO: 1694303 - DNA, 14 bp, Homo sapiens
agggacaagggatt

SEQ ID NO: 1694304 - DNA, 16 bp, Homo sapiens
agggacactcctcctc

SEQ ID NO: 1694305 - DNA, 18 bp, Homo sapiens
agggacagagacacctgc

SEQ ID NO: 1694306 - DNA, 16 bp, Homo sapiens
agggacagaggcccca

SEQ ID NO: 1694307 - DNA, 21 bp, Homo sapiens
agggacagaggccccagcctc

SEQ ID NO: 1694308 - DNA, 11 bp, Homo sapiens
agggacagcaa

SEQ ID NO: 1694309 - DNA, 19 bp, Homo sapiens
agggacagcaagtgagcag

SEQ ID NO: 1694310 - DNA, 12 bp, Homo sapiens
agggacagccca

SEQ ID NO: 1694311 - DNA, 23 bp, Homo sapiens
agggacagcccacggtctggagg

SEQ ID NO: 1694312 - DNA, 20 bp, Homo sapiens
agggacagcccactgagaag

SEQ ID NO: 1694313 - DNA, 16 bp, Homo sapiens
agggacagctgctggg

SEQ ID NO: 1694314 - DNA, 18 bp, Homo sapiens
agggacaggctgaagaga

SEQ ID NO: 1694315 - DNA, 19 bp, Homo sapiens
agggacaggctgaagagag

SEQ ID NO: 1694316 - DNA, 15 bp, Homo sapiens
agggacatgatgggg

SEQ ID NO: 1694317 - DNA, 18 bp, Homo sapiens
agggaccacaccctgtac

SEQ ID NO: 1694318 - DNA, 16 bp, Homo sapiens
agggaccactgggtga

SEQ ID NO: 1694319 - DNA, 18 bp, Homo sapiens
agggaccactgggtgaga

SEQ ID NO: 1694320 - DNA, 14 bp, Homo sapiens
agggaccagggcca

SEQ ID NO: 1694321 - DNA, 18 bp, Homo sapiens
agggaccatcaagaacct

SEQ ID NO: 1694322 - DNA, 22 bp, Homo sapiens
agggacccaggtgtgcctgtgc

SEQ ID NO: 1694323 - DNA, 13 bp, Homo sapiens
agggacccccaga

SEQ ID NO: 1694324 - DNA, 15 bp, Homo sapiens
agggaccgagcccag

SEQ ID NO: 1694325 - DNA, 22 bp, Homo sapiens
agggaccggtgctgcaggagtg

SEQ ID NO: 1694326 - DNA, 17 bp, Homo sapiens
agggaccgtccagggga

SEQ ID NO: 1694327 - DNA, 16 bp, Homo sapiens
agggaccttcatgccc

SEQ ID NO: 1694328 - DNA, 23 bp, Homo sapiens
agggaccttcatgcccttctgat

SEQ ID NO: 1694329 - DNA, 22 bp, Homo sapiens
agggacgcggctcccggggcag

SEQ ID NO: 1694330 - DNA, 20 bp, Homo sapiens
agggacggccaagaatgtac

SEQ ID NO: 1694331 - DNA, 19 bp, Homo sapiens
agggactacccatagacat

SEQ ID NO: 1694332 - DNA, 16 bp, Homo sapiens
agggactgtcagctga

SEQ ID NO: 1694333 - DNA, 16 bp, Homo sapiens
agggacttaacttgtt

SEQ ID NO: 1694334 - DNA, 22 bp, Homo sapiens
agggacttcaggatcaagtcct

SEQ ID NO: 1694335 - DNA, 23 bp, Homo sapiens
agggacttctgtcttcacaacag

SEQ ID NO: 1694336 - DNA, 14 bp, Homo sapiens
agggagaaaagaga

SEQ ID NO: 1694337 - DNA, 17 bp, Homo sapiens
agggagaagacaacaga

SEQ ID NO: 1694338 - DNA, 15 bp, Homo sapiens
agggagaagagaaaa

SEQ ID NO: 1694339 - DNA, 16 bp, Homo sapiens
agggagaagagaaaat

SEQ ID NO: 1694340 - DNA, 16 bp, Homo sapiens
agggagaatcctccct

SEQ ID NO: 1694341 - DNA, 19 bp, Homo sapiens
agggagaatcctcccttcc

SEQ ID NO: 1694342 - DNA, 20 bp, Homo sapiens
agggagaatcctcccttccc

SEQ ID NO: 1694343 - DNA, 14 bp, Homo sapiens
agggagaattgaga

SEQ ID NO: 1694344 - DNA, 14 bp, Homo sapiens
agggagacaccagt

SEQ ID NO: 1694345 - DNA, 20 bp, Homo sapiens
agggagacactggcccctca

SEQ ID NO: 1694346 - DNA, 21 bp, Homo sapiens
agggagactgggtaggaaaga

SEQ ID NO: 1694347 - DNA, 10 bp, Homo sapiens
agggagagag

SEQ ID NO: 1694348 - DNA, 22 bp, Homo sapiens
agggagagagagagagagagga

SEQ ID NO: 1694349 - DNA, 15 bp, Homo sapiens
agggagagctgagcc

SEQ ID NO: 1694350 - DNA, 18 bp, Homo sapiens
agggagaggtcaccagct

SEQ ID NO: 1694351 - DNA, 17 bp, Homo sapiens
agggagcaccctgccca

SEQ ID NO: 1694352 - DNA, 15 bp, Homo sapiens
agggagcactgttca

SEQ ID NO: 1694353 - DNA, 16 bp, Homo sapiens
agggagcagggaaggc

SEQ ID NO: 1694354 - DNA, 15 bp, Homo sapiens
agggagccatttgag

SEQ ID NO: 1694355 - DNA, 13 bp, Homo sapiens
agggagcccctcc

SEQ ID NO: 1694356 - DNA, 18 bp, Homo sapiens
agggagccggcggcctct

SEQ ID NO: 1694357 - DNA, 23 bp, Homo sapiens
agggagctctggggacagcttcc

SEQ ID NO: 1694358 - DNA, 15 bp, Homo sapiens
agggagctgctcaga

SEQ ID NO: 1694359 - DNA, 22 bp, Homo sapiens
agggaggaaggcctttcttctg

SEQ ID NO: 1694360 - DNA, 19 bp, Homo sapiens
agggaggaggccacctctc

SEQ ID NO: 1694361 - DNA, 19 bp, Homo sapiens
agggaggcactagtcaccg

SEQ ID NO: 1694362 - DNA, 15 bp, Homo sapiens
agggaggccccaggg

SEQ ID NO: 1694363 - DNA, 16 bp, Homo sapiens
agggaggccccagggg

SEQ ID NO: 1694364 - DNA, 16 bp, Homo sapiens
agggaggccgggcggt

SEQ ID NO: 1694365 - DNA, 13 bp, Homo sapiens
agggagggagctg

SEQ ID NO: 1694366 - DNA, 18 bp, Homo sapiens
agggaggggccggccctg

SEQ ID NO: 1694367 - DNA, 20 bp, Homo sapiens
agggagggggcgctcaggac

SEQ ID NO: 1694368 - DNA, 21 bp, Homo sapiens
agggagggggcgctcaggacc

SEQ ID NO: 1694369 - DNA, 14 bp, Homo sapiens
agggagggtgcagc

SEQ ID NO: 1694370 - DNA, 22 bp, Homo sapiens
agggaggtgaatactcttgaaa

SEQ ID NO: 1694371 - DNA, 17 bp, Homo sapiens
agggagtacctgctgcc

SEQ ID NO: 1694372 - DNA, 15 bp, Homo sapiens
agggagtcccctccc

SEQ ID NO: 1694373 - DNA, 19 bp, Homo sapiens
agggagttttgtctgtctc

SEQ ID NO: 1694374 - DNA, 20 bp, Homo sapiens
agggagttttgtctgtctcc

SEQ ID NO: 1694375 - DNA, 13 bp, Homo sapiens
agggagtttttga

SEQ ID NO: 1694376 - DNA, 16 bp, Homo sapiens
agggatacccagtgat

SEQ ID NO: 1694377 - DNA, 20 bp, Homo sapiens
agggatattgccttatttgt

SEQ ID NO: 1694378 - DNA, 14 bp, Homo sapiens
agggatcacagggc

SEQ ID NO: 1694379 - DNA, 14 bp, Homo sapiens
aggggaggcagatg

SEQ ID NO: 1694380 - DNA, 22 bp, Homo sapiens
aggggagggtgtatctagctct

SEQ ID NO: 1694381 - DNA, 13 bp, Homo sapiens
aggggatatttaa

SEQ ID NO: 1694382 - DNA, 16 bp, Homo sapiens
aggggatatttactgc

SEQ ID NO: 1694383 - DNA, 15 bp, Homo sapiens
aggggcacaccactg

SEQ ID NO: 1694384 - DNA, 22 bp, Homo sapiens
aggggcacaccactgccctgcc

SEQ ID NO: 1694385 - DNA, 14 bp, Homo sapiens
aggggcagaacagc

SEQ ID NO: 1694386 - DNA, 12 bp, Homo sapiens
aggggcagccct

SEQ ID NO: 1694387 - DNA, 14 bp, Homo sapiens
aggggcaggactga

SEQ ID NO: 1694388 - DNA, 20 bp, Homo sapiens
aggggcaggactgagtcccc

SEQ ID NO: 1694389 - DNA, 15 bp, Homo sapiens
aggggcaggcctggg

SEQ ID NO: 1694390 - DNA, 23 bp, Homo sapiens
aggggcaggcctgggacccagct

SEQ ID NO: 1694391 - DNA, 12 bp, Homo sapiens
aggggcagggag

SEQ ID NO: 1694392 - DNA, 13 bp, Homo sapiens
aggggcaggtcta

SEQ ID NO: 1694393 - DNA, 23 bp, Homo sapiens
aggggcatgtattggcctggagg

SEQ ID NO: 1694394 - DNA, 20 bp, Homo sapiens
aggggccaccacctttggct

SEQ ID NO: 1694395 - DNA, 17 bp, Homo sapiens
aggggcccaagccccat

SEQ ID NO: 1694396 - DNA, 15 bp, Homo sapiens
aggggccccagatct

SEQ ID NO: 1694397 - DNA, 19 bp, Homo sapiens
aggggccccagatctgcct

SEQ ID NO: 1694398 - DNA, 21 bp, Homo sapiens
aggggccccagatctgcctgg

SEQ ID NO: 1694399 - DNA, 22 bp, Homo sapiens
aggggccccagatctgcctggg

SEQ ID NO: 1694400 - DNA, 18 bp, Homo sapiens
aggggcccccgtgttcag

SEQ ID NO: 1694401 - DNA, 17 bp, Homo sapiens
aggggccccggggctgg

SEQ ID NO: 1694402 - DNA, 21 bp, Homo sapiens
aggggccggccctgtgtgcag

SEQ ID NO: 1694403 - DNA, 14 bp, Homo sapiens
aggggcctagggag

SEQ ID NO: 1694404 - DNA, 16 bp, Homo sapiens
aggggcctagggagcc

SEQ ID NO: 1694405 - DNA, 14 bp, Homo sapiens
aggggcctgagtgg

SEQ ID NO: 1694406 - DNA, 16 bp, Homo sapiens
aggggcctgcagaagg

SEQ ID NO: 1694407 - DNA, 20 bp, Homo sapiens
aggggcctgcagaaggaaag

SEQ ID NO: 1694408 - DNA, 13 bp, Homo sapiens
aggggcctggaga

SEQ ID NO: 1694409 - DNA, 21 bp, Homo sapiens
aggggcctggagatcctcctg

SEQ ID NO: 1694410 - DNA, 17 bp, Homo sapiens
aggggcctggaggtctg

SEQ ID NO: 1694411 - DNA, 22 bp, Homo sapiens
aggggcctggaggtctggctga

SEQ ID NO: 1694412 - DNA, 15 bp, Homo sapiens
aggggcctggcagcc

SEQ ID NO: 1694413 - DNA, 18 bp, Homo sapiens
aggggcctggcagccgtg

SEQ ID NO: 1694414 - DNA, 21 bp, Homo sapiens
aggggccttagggcactgggc

SEQ ID NO: 1694415 - DNA, 18 bp, Homo sapiens
aggggcgctggcccagcc

SEQ ID NO: 1694416 - DNA, 22 bp, Homo sapiens
aggggcgctggcccagccggcc

SEQ ID NO: 1694417 - DNA, 17 bp, Homo sapiens
aggggcggcaggaggga

SEQ ID NO: 1694418 - DNA, 20 bp, Homo sapiens
aggggcgggtggatcacctg

SEQ ID NO: 1694419 - DNA, 22 bp, Homo sapiens
aggggcgggtggatcacctgag

SEQ ID NO: 1694420 - DNA, 18 bp, Homo sapiens
aggggcggtgcccacacc

SEQ ID NO: 1694421 - DNA, 13 bp, Homo sapiens
aggggctcctgag

SEQ ID NO: 1694422 - DNA, 15 bp, Homo sapiens
aggggctcctgagtg

SEQ ID NO: 1694423 - DNA, 12 bp, Homo sapiens
aggggctgctgg

SEQ ID NO: 1694424 - DNA, 18 bp, Homo sapiens
aggggctgctggggcatg

SEQ ID NO: 1694425 - DNA, 20 bp, Homo sapiens
aggggctgctggggcatgtg

SEQ ID NO: 1694426 - DNA, 17 bp, Homo sapiens
aggggctggctggagtc

SEQ ID NO: 1694427 - DNA, 21 bp, Homo sapiens
aggggctgtggccgtctcctc

SEQ ID NO: 1694428 - DNA, 14 bp, Homo sapiens
aggggctgttcttc

SEQ ID NO: 1694429 - DNA, 15 bp, Homo sapiens
aggggcttcctgggt

SEQ ID NO: 1694430 - DNA, 14 bp, Homo sapiens
aggggcttgagaag

SEQ ID NO: 1694431 - DNA, 14 bp, Homo sapiens
aggggctttctctt

SEQ ID NO: 1694432 - DNA, 16 bp, Homo sapiens
aggggctttctcttcc

SEQ ID NO: 1694433 - DNA, 19 bp, Homo sapiens
aggggctttctcttcccct

SEQ ID NO: 1694434 - DNA, 23 bp, Homo sapiens
aggggctttctcttccccttcct

SEQ ID NO: 1694435 - DNA, 16 bp, Homo sapiens
aggggctttctggaga

SEQ ID NO: 1694436 - DNA, 20 bp, Homo sapiens
aggggctttctggagaggag

SEQ ID NO: 1694437 - DNA, 17 bp, Homo sapiens
agggggaagagaaattt

SEQ ID NO: 1694438 - DNA, 18 bp, Homo sapiens
agggggacggggctcagc

SEQ ID NO: 1694439 - DNA, 16 bp, Homo sapiens
agggggacgtttctgg

SEQ ID NO: 1694440 - DNA, 19 bp, Homo sapiens
agggggatccgactgcttt

SEQ ID NO: 1694441 - DNA, 20 bp, Homo sapiens
agggggccccgccagggctg

SEQ ID NO: 1694442 - DNA, 15 bp, Homo sapiens
agggggccctgcccc

SEQ ID NO: 1694443 - DNA, 21 bp, Homo sapiens
agggggccctgccccacccca

SEQ ID NO: 1694444 - DNA, 13 bp, Homo sapiens
agggggccctgct

SEQ ID NO: 1694445 - DNA, 15 bp, Homo sapiens
agggggcgctcagga

SEQ ID NO: 1694446 - DNA, 20 bp, Homo sapiens
agggggctctgccccaggcc

SEQ ID NO: 1694447 - DNA, 19 bp, Homo sapiens
agggggcttgaagccaaag

SEQ ID NO: 1694448 - DNA, 14 bp, Homo sapiens
aggggggctgtgcc

SEQ ID NO: 1694449 - DNA, 23 bp, Homo sapiens
aggggggggtatttcaattacct

SEQ ID NO: 1694450 - DNA, 19 bp, Homo sapiens
aggggggtaatagtgacat

SEQ ID NO: 1694451 - DNA, 19 bp, Homo sapiens
aggggggtgctggccccca

SEQ ID NO: 1694452 - DNA, 19 bp, Homo sapiens
agggggtcccagtgggagg

SEQ ID NO: 1694453 - DNA, 20 bp, Homo sapiens
agggggtcccagtgggaggg

SEQ ID NO: 1694454 - DNA, 24 bp, Homo sapiens
agggggtcccagtgggaggggcag

SEQ ID NO: 1694455 - DNA, 16 bp, Homo sapiens
agggggtccctgtgct

SEQ ID NO: 1694456 - DNA, 12 bp, Homo sapiens
agggggtggggg

SEQ ID NO: 1694457 - DNA, 19 bp, Homo sapiens
agggggttacaaactgcaa

SEQ ID NO: 1694458 - DNA, 18 bp, Homo sapiens
aggggtaggatgtacagg

SEQ ID NO: 1694459 - DNA, 13 bp, Homo sapiens
aggggtcaggctc

SEQ ID NO: 1694460 - DNA, 17 bp, Homo sapiens
aggggtcaggtgtcagg

SEQ ID NO: 1694461 - DNA, 19 bp, Homo sapiens
aggggtcccagccaccccg

SEQ ID NO: 1694462 - DNA, 15 bp, Homo sapiens
aggggtcccccctca

SEQ ID NO: 1694463 - DNA, 14 bp, Homo sapiens
aggggtccctagca

SEQ ID NO: 1694464 - DNA, 23 bp, Homo sapiens
aggggtccctagcagcccaccct

SEQ ID NO: 1694465 - DNA, 14 bp, Homo sapiens
aggggtctccctgg

SEQ ID NO: 1694466 - DNA, 15 bp, Homo sapiens
aggggtctccctggc

SEQ ID NO: 1694467 - DNA, 17 bp, Homo sapiens
aggggtctccctggctc

SEQ ID NO: 1694468 - DNA, 19 bp, Homo sapiens
aggggtctccctggctccc

SEQ ID NO: 1694469 - DNA, 19 bp, Homo sapiens
aggggtgagtcccctactc

SEQ ID NO: 1694470 - DNA, 23 bp, Homo sapiens
aggggtgcacccactcaccaggg

SEQ ID NO: 1694471 - DNA, 16 bp, Homo sapiens
aggggtgccccctcct

SEQ ID NO: 1694472 - DNA, 17 bp, Homo sapiens
aggggtgccccctcctc

SEQ ID NO: 1694473 - DNA, 23 bp, Homo sapiens
aggggtgccccctcctctcccat

SEQ ID NO: 1694474 - DNA, 22 bp, Homo sapiens
aggggtgcgctcacctgcagcc

SEQ ID NO: 1694475 - DNA, 14 bp, Homo sapiens
aggggtgctgtgga

SEQ ID NO: 1694476 - DNA, 21 bp, Homo sapiens
aggggtggccgggcacagtgg

SEQ ID NO: 1694477 - DNA, 20 bp, Homo sapiens
aggggtggctgcctcattta

SEQ ID NO: 1694478 - DNA, 20 bp, Homo sapiens
aggggtgggggtgccgctct

SEQ ID NO: 1694479 - DNA, 19 bp, Homo sapiens
aggggtgggggtggaggct

SEQ ID NO: 1694480 - DNA, 18 bp, Homo sapiens
aggggtggtcctgactca

SEQ ID NO: 1694481 - DNA, 14 bp, Homo sapiens
aggggtgtcttggg

SEQ ID NO: 1694482 - DNA, 16 bp, Homo sapiens
aggggtgtggcagtgg

SEQ ID NO: 1694483 - DNA, 15 bp, Homo sapiens
aggggtgtggctcct

SEQ ID NO: 1694484 - DNA, 21 bp, Homo sapiens
aggggttaacttggtcagagc

SEQ ID NO: 1694485 - DNA, 23 bp, Homo sapiens
aggggttaacttggtcagagcca

SEQ ID NO: 1694486 - DNA, 18 bp, Homo sapiens
aggggttaccatgtatca

SEQ ID NO: 1694487 - DNA, 17 bp, Homo sapiens
aggggttcattctcccg

SEQ ID NO: 1694488 - DNA, 14 bp, Homo sapiens
aggggttgttttgg

SEQ ID NO: 1694489 - DNA, 14 bp, Homo sapiens
agggtaaggtgcct

SEQ ID NO: 1694490 - DNA, 20 bp, Homo sapiens
agggtaggagggtgggaagg

SEQ ID NO: 1694491 - DNA, 19 bp, Homo sapiens
agggtagggataatttatt

SEQ ID NO: 1694492 - DNA, 21 bp, Homo sapiens
agggtatccaagttggactgg

SEQ ID NO: 1694493 - DNA, 22 bp, Homo sapiens
agggtatctgctgcctctgaaa

SEQ ID NO: 1694494 - DNA, 15 bp, Homo sapiens
agggtcaagcctctt

SEQ ID NO: 1694495 - DNA, 14 bp, Homo sapiens
agggccctcccagc

SEQ ID NO: 1694496 - DNA, 15 bp, Homo sapiens
agggccctcccagcc

SEQ ID NO: 1694497 - DNA, 14 bp, Homo sapiens
agggccctgtggag

SEQ ID NO: 1694498 - DNA, 14 bp, Homo sapiens
agggcccttcccct

SEQ ID NO: 1694499 - DNA, 23 bp, Homo sapiens
agggcccttcccctcccccactc

SEQ ID NO: 1694500 - DNA, 20 bp, Homo sapiens
agggccgcccgctcccttcc

SEQ ID NO: 1694501 - DNA, 19 bp, Homo sapiens
agggccgcccgggcccaga

SEQ ID NO: 1694502 - DNA, 14 bp, Homo sapiens
agggccggggatgg

SEQ ID NO: 1694503 - DNA, 17 bp, Homo sapiens
agggccgtaccccaccc

SEQ ID NO: 1694504 - DNA, 16 bp, Homo sapiens
agggccgtgcccttgc

SEQ ID NO: 1694505 - DNA, 20 bp, Homo sapiens
agggcctccattcctggagc

SEQ ID NO: 1694506 - DNA, 12 bp, Homo sapiens
agggcctcctca

SEQ ID NO: 1694507 - DNA, 16 bp, Homo sapiens
agggcctctgcctggg

SEQ ID NO: 1694508 - DNA, 16 bp, Homo sapiens
agggcctgcatggaga

SEQ ID NO: 1694509 - DNA, 23 bp, Homo sapiens
agggcctgcatggagaagggttc

SEQ ID NO: 1694510 - DNA, 12 bp, Homo sapiens
agggcctgctgg

SEQ ID NO: 1694511 - DNA, 18 bp, Homo sapiens
agggcctgctggaggcct

SEQ ID NO: 1694512 - DNA, 22 bp, Homo sapiens
agggcctgctggaggcctcagg

SEQ ID NO: 1694513 - DNA, 23 bp, Homo sapiens
agggcctgctggaggcctcaggt

SEQ ID NO: 1694514 - DNA, 21 bp, Homo sapiens
agggcctggagccccatcggc

SEQ ID NO: 1694515 - DNA, 11 bp, Homo sapiens
agggcctggcc

SEQ ID NO: 1694516 - DNA, 16 bp, Homo sapiens
agggcctggccagtcc

SEQ ID NO: 1694517 - DNA, 17 bp, Homo sapiens
agggcctggccagtcct

SEQ ID NO: 1694518 - DNA, 21 bp, Homo sapiens
agggcctggccagtcctggtc

SEQ ID NO: 1694519 - DNA, 17 bp, Homo sapiens
agggcctgggcctcatg

SEQ ID NO: 1694520 - DNA, 15 bp, Homo sapiens
agggcctgggggcag

SEQ ID NO: 1694521 - DNA, 21 bp, Homo sapiens
agggcctgggggcagtgactg

SEQ ID NO: 1694522 - DNA, 19 bp, Homo sapiens
agggcctgtgggagcctgc

SEQ ID NO: 1694523 - DNA, 17 bp, Homo sapiens
agggccttgcccagaga

SEQ ID NO: 1694524 - DNA, 18 bp, Homo sapiens
agggccttgcccagagat

SEQ ID NO: 1694525 - DNA, 19 bp, Homo sapiens
agggccttgcccagagatg

SEQ ID NO: 1694526 - DNA, 23 bp, Homo sapiens
agggcgcccattcgtctgtccca

SEQ ID NO: 1694527 - DNA, 13 bp, Homo sapiens
agggcgctcagac

SEQ ID NO: 1694528 - DNA, 14 bp, Homo sapiens
agggcgctcagacg

SEQ ID NO: 1694529 - DNA, 16 bp, Homo sapiens
agggcgctcagacggc

SEQ ID NO: 1694530 - DNA, 19 bp, Homo sapiens
agggcgctcagacggcggc

SEQ ID NO: 1694531 - DNA, 22 bp, Homo sapiens
agggcgctcagacggcggccag

SEQ ID NO: 1694532 - DNA, 23 bp, Homo sapiens
agggcgctcagacggcggccagg

SEQ ID NO: 1694533 - DNA, 13 bp, Homo sapiens
agggcggcagggg

SEQ ID NO: 1694534 - DNA, 16 bp, Homo sapiens
agggcggcaggggcct

SEQ ID NO: 1694535 - DNA, 18 bp, Homo sapiens
agggcggcaggggcctgg

SEQ ID NO: 1694536 - DNA, 19 bp, Homo sapiens
agggcggcaggggcctgga

SEQ ID NO: 1694537 - DNA, 23 bp, Homo sapiens
agggcggcaggggcctggagatc

SEQ ID NO: 1694538 - DNA, 17 bp, Homo sapiens
agggcgggcagagggct

SEQ ID NO: 1694539 - DNA, 19 bp, Homo sapiens
agggcgggcagagggctgg

SEQ ID NO: 1694540 - DNA, 15 bp, Homo sapiens
agggcgtgactcacc

SEQ ID NO: 1694541 - DNA, 16 bp, Homo sapiens
agggcgtgactcaccc

SEQ ID NO: 1694542 - DNA, 20 bp, Homo sapiens
agggctaattatatattttg

SEQ ID NO: 1694543 - DNA, 24 bp, Homo sapiens
agggctagtgacttgtgtcccatg

SEQ ID NO: 1694544 - DNA, 17 bp, Homo sapiens
agggctcaccagctggg

SEQ ID NO: 1694545 - DNA, 13 bp, Homo sapiens
agggctcactcag

SEQ ID NO: 1694546 - DNA, 14 bp, Homo sapiens
agggctcagcctgg

SEQ ID NO: 1694547 - DNA, 20 bp, Homo sapiens
agggctccagcatccagcct

SEQ ID NO: 1694548 - DNA, 23 bp, Homo sapiens
agggctccagcatccagcctgtg

SEQ ID NO: 1694549 - DNA, 15 bp, Homo sapiens
agggctccagcccct

SEQ ID NO: 1694550 - DNA, 19 bp, Homo sapiens
agggctcctctccagtctg

SEQ ID NO: 1694551 - DNA, 15 bp, Homo sapiens
agggctcctgtggca

SEQ ID NO: 1694552 - DNA, 23 bp, Homo sapiens
agggctctaaaaaaagccccaaa

SEQ ID NO: 1694553 - DNA, 17 bp, Homo sapiens
agggctctgatattcca

SEQ ID NO: 1694554 - DNA, 13 bp, Homo sapiens
agggctctgcagc

SEQ ID NO: 1694555 - DNA, 17 bp, Homo sapiens
agggctctgcaggccac

SEQ ID NO: 1694556 - DNA, 15 bp, Homo sapiens
agggctctttagcca

SEQ ID NO: 1694557 - DNA, 15 bp, Homo sapiens
agggctgacctgcct

SEQ ID NO: 1694558 - DNA, 17 bp, Homo sapiens
agggctgacctgcctct

SEQ ID NO: 1694559 - DNA, 14 bp, Homo sapiens
agggctgagtcctt

SEQ ID NO: 1694560 - DNA, 20 bp, Homo sapiens
agggctgagtccttgctgtg

SEQ ID NO: 1694561 - DNA, 17 bp, Homo sapiens
agggctgatggaggaaa

SEQ ID NO: 1694562 - DNA, 15 bp, Homo sapiens
agggctgcatgatgt

SEQ ID NO: 1694563 - DNA, 22 bp, Homo sapiens
agggctgcatgatgtttgccca

SEQ ID NO: 1694564 - DNA, 21 bp, Homo sapiens
agggctgcccctaatctctgt

SEQ ID NO: 1694565 - DNA, 15 bp, Homo sapiens
agggctgcttttctt

SEQ ID NO: 1694566 - DNA, 17 bp, Homo sapiens
agggctggactgaggcc

SEQ ID NO: 1694567 - DNA, 17 bp, Homo sapiens
agggctggaggcccagg

SEQ ID NO: 1694568 - DNA, 13 bp, Homo sapiens
agggctggctggc

SEQ ID NO: 1694569 - DNA, 17 bp, Homo sapiens
agggctggctggcctca

SEQ ID NO: 1694570 - DNA, 21 bp, Homo sapiens
agggctggtgtggctgctccc

SEQ ID NO: 1694571 - DNA, 21 bp, Homo sapiens
agggctgtgcttgaaggccct

SEQ ID NO: 1694572 - DNA, 22 bp, Homo sapiens
agggctgtgcttgaaggccctg

SEQ ID NO: 1694573 - DNA, 16 bp, Homo sapiens
agggctgttggacagc

SEQ ID NO: 1694574 - DNA, 22 bp, Homo sapiens
agggctgttggacagctgcttg

SEQ ID NO: 1694575 - DNA, 24 bp, Homo sapiens
agggctgttggacagctgcttgtg

SEQ ID NO: 1694576 - DNA, 23 bp, Homo sapiens
agggcttacctgtacactgactt

SEQ ID NO: 1694577 - DNA, 16 bp, Homo sapiens
agggcttctcctcctc

SEQ ID NO: 1694578 - DNA, 14 bp, Homo sapiens
agggcttctgcacc

SEQ ID NO: 1694579 - DNA, 16 bp, Homo sapiens
agggcttctgcaccct

SEQ ID NO: 1694580 - DNA, 19 bp, Homo sapiens
agggcttctgcaccctcca

SEQ ID NO: 1694581 - DNA, 15 bp, Homo sapiens
agggctttaaaattc

SEQ ID NO: 1694582 - DNA, 16 bp, Homo sapiens
agggctttaaaattct

SEQ ID NO: 1694583 - DNA, 17 bp, Homo sapiens
agggctttggttccttc

SEQ ID NO: 1694584 - DNA, 18 bp, Homo sapiens
agggctttggttccttct

SEQ ID NO: 1694585 - DNA, 21 bp, Homo sapiens
agggctttggttccttctctg

SEQ ID NO: 1694586 - DNA, 13 bp, Homo sapiens
agggcttttcaaa

SEQ ID NO: 1694587 - DNA, 13 bp, Homo sapiens
aggggaaaatgaa

SEQ ID NO: 1694588 - DNA, 20 bp, Homo sapiens
aggggaaaggcctgtgggga

SEQ ID NO: 1694589 - DNA, 14 bp, Homo sapiens
aggggaagaccaaa

SEQ ID NO: 1694590 - DNA, 17 bp, Homo sapiens
aggggaagcactcgtgt

SEQ ID NO: 1694591 - DNA, 15 bp, Homo sapiens
aggggaaggaaggag

SEQ ID NO: 1694592 - DNA, 13 bp, Homo sapiens
aggggaaggggct

SEQ ID NO: 1694593 - DNA, 16 bp, Homo sapiens
aggggaatcagaactc

SEQ ID NO: 1694594 - DNA, 22 bp, Homo sapiens
aggggaattccctccccctcct

SEQ ID NO: 1694595 - DNA, 22 bp, Homo sapiens
aggggaccccgagaaccctgag

SEQ ID NO: 1694596 - DNA, 19 bp, Homo sapiens
aggggactatttatgaagg

SEQ ID NO: 1694597 - DNA, 15 bp, Homo sapiens
aggggagacaggagc

SEQ ID NO: 1694598 - DNA, 16 bp, Homo sapiens
aggggagacaggagcc

SEQ ID NO: 1694599 - DNA, 15 bp, Homo sapiens
aggggagagagggac

SEQ ID NO: 1694600 - DNA, 22 bp, Homo sapiens
aggggagagcctgctggcaccc

SEQ ID NO: 1694601 - DNA, 15 bp, Homo sapiens
aggggagatatagat

SEQ ID NO: 1694602 - DNA, 17 bp, Homo sapiens
aggggagcacggagccg

SEQ ID NO: 1694603 - DNA, 19 bp, Homo sapiens
aggggagcacggagccgcg

SEQ ID NO: 1694604 - DNA, 11 bp, Homo sapiens
aggggagccag

SEQ ID NO: 1694605 - DNA, 13 bp, Homo sapiens
aggggagccagct

SEQ ID NO: 1694606 - DNA, 14 bp, Homo sapiens
aggggagccagctg

SEQ ID NO: 1694607 - DNA, 12 bp, Homo sapiens
aggggagcccac

SEQ ID NO: 1694608 - DNA, 13 bp, Homo sapiens
aggggagcccact

SEQ ID NO: 1694609 - DNA, 16 bp, Homo sapiens
aggggaggacactggt

SEQ ID NO: 1694610 - DNA, 19 bp, Homo sapiens
aggggaggatcactggagc

SEQ ID NO: 1694611 - DNA, 13 bp, Homo sapiens
aggggaggcacac

SEQ ID NO: 1694612 - DNA, 15 bp, Homo sapiens
aggtatctagagctt

SEQ ID NO: 1694613 - DNA, 13 bp, Homo sapiens
aggtatgaataag

SEQ ID NO: 1694614 - DNA, 21 bp, Homo sapiens
aggtatgcaatcaaatctgct

SEQ ID NO: 1694615 - DNA, 22 bp, Homo sapiens
aggtatggaagggtttgtggct

SEQ ID NO: 1694616 - DNA, 17 bp, Homo sapiens
aggtattacaagtaatg

SEQ ID NO: 1694617 - DNA, 19 bp, Homo sapiens
aggtattacaagtaatgta

SEQ ID NO: 1694618 - DNA, 14 bp, Homo sapiens
aggtatttatcttt

SEQ ID NO: 1694619 - DNA, 12 bp, Homo sapiens
aggtatttgaaa

SEQ ID NO: 1694620 - DNA, 14 bp, Homo sapiens
aggtattttgaata

SEQ ID NO: 1694621 - DNA, 17 bp, Homo sapiens
aggtatttttttaaatc

SEQ ID NO: 1694622 - DNA, 18 bp, Homo sapiens
aggtcaaacaggctgtaa

SEQ ID NO: 1694623 - DNA, 21 bp, Homo sapiens
aggtcaacagagaaggcagga

SEQ ID NO: 1694624 - DNA, 17 bp, Homo sapiens
aggtcaataaggtcaag

SEQ ID NO: 1694625 - DNA, 20 bp, Homo sapiens
aggtcaccaggggaggagcc

SEQ ID NO: 1694626 - DNA, 17 bp, Homo sapiens
aggtcacccatcaggac

SEQ ID NO: 1694627 - DNA, 21 bp, Homo sapiens
aggtcactcgtggtgaggctg

SEQ ID NO: 1694628 - DNA, 12 bp, Homo sapiens
aggtcactgcta

SEQ ID NO: 1694629 - DNA, 17 bp, Homo sapiens
aggtcactggctctcca

SEQ ID NO: 1694630 - DNA, 19 bp, Homo sapiens
aggtcactggctctccaag

SEQ ID NO: 1694631 - DNA, 21 bp, Homo sapiens
aggtcactggctctccaagtg

SEQ ID NO: 1694632 - DNA, 17 bp, Homo sapiens
aggtcactgtcactgcc

SEQ ID NO: 1694633 - DNA, 18 bp, Homo sapiens
aggtcagagatgggctga

SEQ ID NO: 1694634 - DNA, 21 bp, Homo sapiens
aggtcagcctggaagggacag

SEQ ID NO: 1694635 - DNA, 21 bp, Homo sapiens
aggtcaggagttagaggccag

SEQ ID NO: 1694636 - DNA, 16 bp, Homo sapiens
aggtcaggagttccta

SEQ ID NO: 1694637 - DNA, 19 bp, Homo sapiens
aggtcagttgtgtttttta

SEQ ID NO: 1694638 - DNA, 17 bp, Homo sapiens
aggtcatagctgagatt

SEQ ID NO: 1694639 - DNA, 19 bp, Homo sapiens
aggtcatattaatatattt

SEQ ID NO: 1694640 - DNA, 15 bp, Homo sapiens
aggtcatcagatgcc

SEQ ID NO: 1694641 - DNA, 15 bp, Homo sapiens
aggtcatctggcgga

SEQ ID NO: 1694642 - DNA, 14 bp, Homo sapiens
aggtccaaatgttt

SEQ ID NO: 1694643 - DNA, 16 bp, Homo sapiens
aggtccaagcagagtg

SEQ ID NO: 1694644 - DNA, 16 bp, Homo sapiens
aggtccaatttgtaaa

SEQ ID NO: 1694645 - DNA, 14 bp, Homo sapiens
aggtccacaggtct

SEQ ID NO: 1694646 - DNA, 15 bp, Homo sapiens
aggtccacaggtcta

SEQ ID NO: 1694647 - DNA, 18 bp, Homo sapiens
aggtccacaggtctagac

SEQ ID NO: 1694648 - DNA, 19 bp, Homo sapiens
aggtccacaggtctagact

SEQ ID NO: 1694649 - DNA, 15 bp, Homo sapiens
aggtccagctctgga

SEQ ID NO: 1694650 - DNA, 17 bp, Homo sapiens
aggtccagctctggagg

SEQ ID NO: 1694651 - DNA, 13 bp, Homo sapiens
aggtccagctggg

SEQ ID NO: 1694652 - DNA, 20 bp, Homo sapiens
aggtccagctgggcctcctg

SEQ ID NO: 1694653 - DNA, 16 bp, Homo sapiens
aggtccattattttgt

SEQ ID NO: 1694654 - DNA, 20 bp, Homo sapiens
aggtccattattttgtattc

SEQ ID NO: 1694655 - DNA, 12 bp, Homo sapiens
aggtcccaggca

SEQ ID NO: 1694656 - DNA, 14 bp, Homo sapiens
aggtcccaggcaga

SEQ ID NO: 1694657 - DNA, 15 bp, Homo sapiens
aggtcccatgctcca

SEQ ID NO: 1694658 - DNA, 19 bp, Homo sapiens
aggtcccccgactgcctgt

SEQ ID NO: 1694659 - DNA, 13 bp, Homo sapiens
aggtcccctggca

SEQ ID NO: 1694660 - DNA, 14 bp, Homo sapiens
aggtcccctggcag

SEQ ID NO: 1694661 - DNA, 15 bp, Homo sapiens
aggtcccctggcagt

SEQ ID NO: 1694662 - DNA, 16 bp, Homo sapiens
aggtcccggccagctc

SEQ ID NO: 1694663 - DNA, 22 bp, Homo sapiens
aggtcccggccagctctggagt

SEQ ID NO: 1694664 - DNA, 15 bp, Homo sapiens
aggtccctggaccag

SEQ ID NO: 1694665 - DNA, 16 bp, Homo sapiens
aggtcctacagggcca

SEQ ID NO: 1694666 - DNA, 22 bp, Homo sapiens
aggtcctcacttctgtctcctg

SEQ ID NO: 1694667 - DNA, 15 bp, Homo sapiens
aggtcctcagagaat

SEQ ID NO: 1694668 - DNA, 14 bp, Homo sapiens
aggtcctcatgggt

SEQ ID NO: 1694669 - DNA, 21 bp, Homo sapiens
aggtcctccgtagggtctttc

SEQ ID NO: 1694670 - DNA, 20 bp, Homo sapiens
aggtcctgctccgctgcctg

SEQ ID NO: 1694671 - DNA, 14 bp, Homo sapiens
aggtcctgctgtgg

SEQ ID NO: 1694672 - DNA, 21 bp, Homo sapiens
aggtcctggtgggtcagccca

SEQ ID NO: 1694673 - DNA, 20 bp, Homo sapiens
aggtccttaggcctctgaga

SEQ ID NO: 1694674 - DNA, 14 bp, Homo sapiens
aggtcctttagaaa

SEQ ID NO: 1694675 - DNA, 17 bp, Homo sapiens
aggtcggagtgcctgga

SEQ ID NO: 1694676 - DNA, 18 bp, Homo sapiens
aggtcggagtgcctggag

SEQ ID NO: 1694677 - DNA, 20 bp, Homo sapiens
aggtcgggcagtggaggctg

SEQ ID NO: 1694678 - DNA, 19 bp, Homo sapiens
aggtctattacgtgggtgc

SEQ ID NO: 1694679 - DNA, 22 bp, Homo sapiens
aggtctatttggattattcttt

SEQ ID NO: 1694680 - DNA, 14 bp, Homo sapiens
aggtctccaaggga

SEQ ID NO: 1694681 - DNA, 17 bp, Homo sapiens
aggtctccaagggaggg

SEQ ID NO: 1694682 - DNA, 18 bp, Homo sapiens
aggtctccaagggagggt

SEQ ID NO: 1694683 - DNA, 20 bp, Homo sapiens
aggtctccaagggagggtgc

SEQ ID NO: 1694684 - DNA, 21 bp, Homo sapiens
aggtctccaggggcctgcaga

SEQ ID NO: 1694685 - DNA, 22 bp, Homo sapiens
aggtctccaggggcctgcagaa

SEQ ID NO: 1694686 - DNA, 21 bp, Homo sapiens
aggtctccccatgtgcctgca

SEQ ID NO: 1694687 - DNA, 15 bp, Homo sapiens
aggtctcctcagggt

SEQ ID NO: 1694688 - DNA, 19 bp, Homo sapiens
aggtctcctcagggtgggg

SEQ ID NO: 1694689 - DNA, 12 bp, Homo sapiens
aggtctcctctt

SEQ ID NO: 1694690 - DNA, 15 bp, Homo sapiens
aggtctcctcttaaa

SEQ ID NO: 1694691 - DNA, 23 bp, Homo sapiens
aggtctcctcttaaaaaataaaa

SEQ ID NO: 1694692 - DNA, 15 bp, Homo sapiens
aggtctccttactct

SEQ ID NO: 1694693 - DNA, 17 bp, Homo sapiens
aggtctcttctgggcgt

SEQ ID NO: 1694694 - DNA, 15 bp, Homo sapiens
aggtctcttgaggga

SEQ ID NO: 1694695 - DNA, 16 bp, Homo sapiens
aggtctcttgagggag

SEQ ID NO: 1694696 - DNA, 21 bp, Homo sapiens
aggtctgaaatggaggtcctt

SEQ ID NO: 1694697 - DNA, 20 bp, Homo sapiens
aggtctgacacgtctgccta

SEQ ID NO: 1694698 - DNA, 16 bp, Homo sapiens
aggtctgattggctgc

SEQ ID NO: 1694699 - DNA, 17 bp, Homo sapiens
aggtctgattggctgct

SEQ ID NO: 1694700 - DNA, 16 bp, Homo sapiens
aggtctggctgagccc

SEQ ID NO: 1694701 - DNA, 20 bp, Homo sapiens
aggtctggctgagcccctgg

SEQ ID NO: 1694702 - DNA, 17 bp, Homo sapiens
aggtctgtttgctgttg

SEQ ID NO: 1694703 - DNA, 18 bp, Homo sapiens
aggtcttgactcatggca

SEQ ID NO: 1694704 - DNA, 22 bp, Homo sapiens
agggtcaccaggttgggaacat

SEQ ID NO: 1694705 - DNA, 14 bp, Homo sapiens
agggtcaggagagg

SEQ ID NO: 1694706 - DNA, 15 bp, Homo sapiens
agggtcaggagaggg

SEQ ID NO: 1694707 - DNA, 16 bp, Homo sapiens
agggtccacagctgga

SEQ ID NO: 1694708 - DNA, 18 bp, Homo sapiens
agggtccctctgtgtatt

SEQ ID NO: 1694709 - DNA, 20 bp, Homo sapiens
agggtccctctgtgtatttg

SEQ ID NO: 1694710 - DNA, 22 bp, Homo sapiens
agggtccgcaccagctgctctg

SEQ ID NO: 1694711 - DNA, 22 bp, Homo sapiens
agggtcctctagcccactccct

SEQ ID NO: 1694712 - DNA, 14 bp, Homo sapiens
agggtcctgccggt

SEQ ID NO: 1694713 - DNA, 20 bp, Homo sapiens
agggtcctgccggtgggacc

SEQ ID NO: 1694714 - DNA, 21 bp, Homo sapiens
agggtcctggctcctgagggg

SEQ ID NO: 1694715 - DNA, 22 bp, Homo sapiens
agggtcctgtcgaaggggaggc

SEQ ID NO: 1694716 - DNA, 18 bp, Homo sapiens
agggtcctttagtacctg

SEQ ID NO: 1694717 - DNA, 16 bp, Homo sapiens
agggtcgaaagctcta

SEQ ID NO: 1694718 - DNA, 18 bp, Homo sapiens
agggtcgaaagctctaga

SEQ ID NO: 1694719 - DNA, 22 bp, Homo sapiens
agggtcgaaagctctagaatct

SEQ ID NO: 1694720 - DNA, 14 bp, Homo sapiens
agggtcgagggttt

SEQ ID NO: 1694721 - DNA, 23 bp, Homo sapiens
agggtcggggaggaaataccaaa

SEQ ID NO: 1694722 - DNA, 23 bp, Homo sapiens
agggtctagggagagacccttgt

SEQ ID NO: 1694723 - DNA, 14 bp, Homo sapiens
agggtctcactgct

SEQ ID NO: 1694724 - DNA, 16 bp, Homo sapiens
agggtctcgaactcct

SEQ ID NO: 1694725 - DNA, 17 bp, Homo sapiens
agggtctgtttggactg

SEQ ID NO: 1694726 - DNA, 13 bp, Homo sapiens
agggtcttcttgg

SEQ ID NO: 1694727 - DNA, 18 bp, Homo sapiens
agggtcttcttggcagct

SEQ ID NO: 1694728 - DNA, 18 bp, Homo sapiens
agggtcttgactctaaat

SEQ ID NO: 1694729 - DNA, 21 bp, Homo sapiens
agggtcttgactctaaatgca

SEQ ID NO: 1694730 - DNA, 14 bp, Homo sapiens
agggtcttgggcta

SEQ ID NO: 1694731 - DNA, 17 bp, Homo sapiens
agggtcttgggctactg

SEQ ID NO: 1694732 - DNA, 22 bp, Homo sapiens
agggtcttgggctactggcagc

SEQ ID NO: 1694733 - DNA, 20 bp, Homo sapiens
agggtcttgggggtcagggg

SEQ ID NO: 1694734 - DNA, 13 bp, Homo sapiens
agggtgacgccca

SEQ ID NO: 1694735 - DNA, 14 bp, Homo sapiens
agggtgagaagcta

SEQ ID NO: 1694736 - DNA, 21 bp, Homo sapiens
agggtgagcagggtcaagcct

SEQ ID NO: 1694737 - DNA, 23 bp, Homo sapiens
agggtgattttatgatcagtgtt

SEQ ID NO: 1694738 - DNA, 20 bp, Homo sapiens
agggtgccccgcctgagtca

SEQ ID NO: 1694739 - DNA, 18 bp, Homo sapiens
agggtgcccttttccagc

SEQ ID NO: 1694740 - DNA, 24 bp, Homo sapiens
agggtgcccttttccagcctcagc

SEQ ID NO: 1694741 - DNA, 23 bp, Homo sapiens
agggtgctaaagccaaccagcct

SEQ ID NO: 1694742 - DNA, 12 bp, Homo sapiens
agggtggagact

SEQ ID NO: 1694743 - DNA, 18 bp, Homo sapiens
agggtggaggaaggtgct

SEQ ID NO: 1694744 - DNA, 19 bp, Homo sapiens
agggtggaggaaggtgctg

SEQ ID NO: 1694745 - DNA, 21 bp, Homo sapiens
agggtggaggaaggtgctgag

SEQ ID NO: 1694746 - DNA, 17 bp, Homo sapiens
agggtggcactgggagg

SEQ ID NO: 1694747 - DNA, 17 bp, Homo sapiens
agggtggcaggtcactg

SEQ ID NO: 1694748 - DNA, 13 bp, Homo sapiens
agggtggccagca

SEQ ID NO: 1694749 - DNA, 11 bp, Homo sapiens
agggtggccct

SEQ ID NO: 1694750 - DNA, 23 bp, Homo sapiens
agggtggcctgttccctagagag

SEQ ID NO: 1694751 - DNA, 18 bp, Homo sapiens
agggtggctttaattgta

SEQ ID NO: 1694752 - DNA, 20 bp, Homo sapiens
agggtggctttaattgtata

SEQ ID NO: 1694753 - DNA, 18 bp, Homo sapiens
agggtgggaagaaagaat

SEQ ID NO: 1694754 - DNA, 17 bp, Homo sapiens
agggtgggagagcccag

SEQ ID NO: 1694755 - DNA, 14 bp, Homo sapiens
agggtgggaggcaa

SEQ ID NO: 1694756 - DNA, 11 bp, Homo sapiens
agggtgggggg

SEQ ID NO: 1694757 - DNA, 18 bp, Homo sapiens
agggtgggggtgctctct

SEQ ID NO: 1694758 - DNA, 21 bp, Homo sapiens
agggtgggggtgctctctctg

SEQ ID NO: 1694759 - DNA, 14 bp, Homo sapiens
agggtggtgctggg

SEQ ID NO: 1694760 - DNA, 16 bp, Homo sapiens
agggtggtgctgggac

SEQ ID NO: 1694761 - DNA, 20 bp, Homo sapiens
agggtgtaggggccacctcc

SEQ ID NO: 1694762 - DNA, 20 bp, Homo sapiens
agggtgtatagtgttcacaa

SEQ ID NO: 1694763 - DNA, 22 bp, Homo sapiens
agggtgtggccctgccatcttc

SEQ ID NO: 1694764 - DNA, 14 bp, Homo sapiens
agggtgtgtgttca

SEQ ID NO: 1694765 - DNA, 20 bp, Homo sapiens
agggtgtgtgttcaccttca

SEQ ID NO: 1694766 - DNA, 22 bp, Homo sapiens
agggtgttggcattggtgtctg

SEQ ID NO: 1694767 - DNA, 16 bp, Homo sapiens
agggtgtttgcagctg

SEQ ID NO: 1694768 - DNA, 18 bp, Homo sapiens
agggttactatgcacaat

SEQ ID NO: 1694769 - DNA, 14 bp, Homo sapiens
agggttcaaaatgt

SEQ ID NO: 1694770 - DNA, 16 bp, Homo sapiens
agggttcagagactca

SEQ ID NO: 1694771 - DNA, 12 bp, Homo sapiens
agggttcccctg

SEQ ID NO: 1694772 - DNA, 13 bp, Homo sapiens
agggttcccctgg

SEQ ID NO: 1694773 - DNA, 17 bp, Homo sapiens
agggttcccctggcctt

SEQ ID NO: 1694774 - DNA, 18 bp, Homo sapiens
agggttctgccctgcctg

SEQ ID NO: 1694775 - DNA, 23 bp, Homo sapiens
agggttctgccctgcctgaggag

SEQ ID NO: 1694776 - DNA, 15 bp, Homo sapiens
agggttggggagggg

SEQ ID NO: 1694777 - DNA, 12 bp, Homo sapiens
agggttgtgctt

SEQ ID NO: 1694778 - DNA, 20 bp, Homo sapiens
agggtttcgactggtccagc

SEQ ID NO: 1694779 - DNA, 14 bp, Homo sapiens
agggtttctctatt

SEQ ID NO: 1694780 - DNA, 16 bp, Homo sapiens
agggtttgcagagtgg

SEQ ID NO: 1694781 - DNA, 18 bp, Homo sapiens
agggtttgtaatacttta

SEQ ID NO: 1694782 - DNA, 15 bp, Homo sapiens
agggttttcttttct

SEQ ID NO: 1694783 - DNA, 18 bp, Homo sapiens
agggttttgcaataactt

SEQ ID NO: 1694784 - DNA, 13 bp, Homo sapiens
agggttttgtatt

SEQ ID NO: 1694785 - DNA, 20 bp, Homo sapiens
agggtttttagagaatgtgt

SEQ ID NO: 1694786 - DNA, 12 bp, Homo sapiens
aggtaaaaagtt

SEQ ID NO: 1694787 - DNA, 19 bp, Homo sapiens
aggtaacacgggaatcaca

SEQ ID NO: 1694788 - DNA, 17 bp, Homo sapiens
aggtaatatacctggtt

SEQ ID NO: 1694789 - DNA, 15 bp, Homo sapiens
aggtaatatgtcttg

SEQ ID NO: 1694790 - DNA, 16 bp, Homo sapiens
aggtaattttttgtct

SEQ ID NO: 1694791 - DNA, 16 bp, Homo sapiens
aggtacacagctctag

SEQ ID NO: 1694792 - DNA, 18 bp, Homo sapiens
aggtaccaaacaaggaag

SEQ ID NO: 1694793 - DNA, 13 bp, Homo sapiens
aggtaccagctgc

SEQ ID NO: 1694794 - DNA, 19 bp, Homo sapiens
aggtaccccaaaactctgt

SEQ ID NO: 1694795 - DNA, 13 bp, Homo sapiens
aggtaccctgggt

SEQ ID NO: 1694796 - DNA, 19 bp, Homo sapiens
aggtacgattatacttgag

SEQ ID NO: 1694797 - DNA, 15 bp, Homo sapiens
aggtacggagaagaa

SEQ ID NO: 1694798 - DNA, 17 bp, Homo sapiens
aggtacggagaagaata

SEQ ID NO: 1694799 - DNA, 14 bp, Homo sapiens
aggtactctcctgg

SEQ ID NO: 1694800 - DNA, 21 bp, Homo sapiens
aggtactgcattctctcccat

SEQ ID NO: 1694801 - DNA, 17 bp, Homo sapiens
aggtagaaatatctgaa

SEQ ID NO: 1694802 - DNA, 15 bp, Homo sapiens
aggtagactttgctt

SEQ ID NO: 1694803 - DNA, 20 bp, Homo sapiens
aggtagatcgcttgagccca

SEQ ID NO: 1694804 - DNA, 12 bp, Homo sapiens
aggtagcacagc

SEQ ID NO: 1694805 - DNA, 14 bp, Homo sapiens
aggtagcacagcac

SEQ ID NO: 1694806 - DNA, 17 bp, Homo sapiens
aggtagcccagcactgt

SEQ ID NO: 1694807 - DNA, 18 bp, Homo sapiens
aggtagcttacctgacac

SEQ ID NO: 1694808 - DNA, 19 bp, Homo sapiens
aggtagcttacctgacaca

SEQ ID NO: 1694809 - DNA, 19 bp, Homo sapiens
aggtaggagaattgcttga

SEQ ID NO: 1694810 - DNA, 13 bp, Homo sapiens
aggtaggcccttg

SEQ ID NO: 1694811 - DNA, 19 bp, Homo sapiens
aggtaggcccttgtcctgc

SEQ ID NO: 1694812 - DNA, 22 bp, Homo sapiens
aggtaggcccttgtcctgccag

SEQ ID NO: 1694813 - DNA, 23 bp, Homo sapiens
aggtaggcccttgtcctgccagc

SEQ ID NO: 1694814 - DNA, 19 bp, Homo sapiens
aggtaggggccgtgtcccg

SEQ ID NO: 1694815 - DNA, 13 bp, Homo sapiens
aggtataaagaca

SEQ ID NO: 1694816 - DNA, 14 bp, Homo sapiens
aggtataaagacaa

SEQ ID NO: 1694817 - DNA, 12 bp, Homo sapiens
aggtataattgt

SEQ ID NO: 1694818 - DNA, 15 bp, Homo sapiens
aggtataattgtgtg

SEQ ID NO: 1694819 - DNA, 17 bp, Homo sapiens
aggtatactttagtaga

SEQ ID NO: 1694820 - DNA, 19 bp, Homo sapiens
aggtatatcattctaaaga

SEQ ID NO: 1694821 - DNA, 13 bp, Homo sapiens
agtattgtttaaa

SEQ ID NO: 1694822 - DNA, 19 bp, Homo sapiens
agtatttaagcctaaagat

SEQ ID NO: 1694823 - DNA, 12 bp, Homo sapiens
agtatttatata

SEQ ID NO: 1694824 - DNA, 15 bp, Homo sapiens
agtatttatatattt

SEQ ID NO: 1694825 - DNA, 23 bp, Homo sapiens
agtatttatatatttataactca

SEQ ID NO: 1694826 - DNA, 16 bp, Homo sapiens
agtatttatttatgta

SEQ ID NO: 1694827 - DNA, 17 bp, Homo sapiens
agtatttatttatgtac

SEQ ID NO: 1694828 - DNA, 12 bp, Homo sapiens
agtatttccctt

SEQ ID NO: 1694829 - DNA, 18 bp, Homo sapiens
agtatttcccttccaaag

SEQ ID NO: 1694830 - DNA, 13 bp, Homo sapiens
agtatttctcagg

SEQ ID NO: 1694831 - DNA, 13 bp, Homo sapiens
agtattttatctg

SEQ ID NO: 1694832 - DNA, 13 bp, Homo sapiens
agtatttttatac

SEQ ID NO: 1694833 - DNA, 19 bp, Homo sapiens
agtatttttatacaaacct

SEQ ID NO: 1694834 - DNA, 14 bp, Homo sapiens
agtatttttatacg

SEQ ID NO: 1694835 - DNA, 13 bp, Homo sapiens
agtatttttgaca

SEQ ID NO: 1694836 - DNA, 17 bp, Homo sapiens
agtatttttgacagaat

SEQ ID NO: 1694837 - DNA, 18 bp, Homo sapiens
agtatttttgacagaata

SEQ ID NO: 1694838 - DNA, 15 bp, Homo sapiens
agtatttttgtctct

SEQ ID NO: 1694839 - DNA, 19 bp, Homo sapiens
agtattttttcaagttgta

SEQ ID NO: 1694840 - DNA, 22 bp, Homo sapiens
agtattttttgtataattggat

SEQ ID NO: 1694841 - DNA, 14 bp, Homo sapiens
agtcaaaaaattat

SEQ ID NO: 1694842 - DNA, 14 bp, Homo sapiens
agtcaaaacagaga

SEQ ID NO: 1694843 - DNA, 15 bp, Homo sapiens
agtcaaaaggtgcct

SEQ ID NO: 1694844 - DNA, 16 bp, Homo sapiens
agtcaaaaggtgcctg

SEQ ID NO: 1694845 - DNA, 19 bp, Homo sapiens
agtcaaacacttgtgactt

SEQ ID NO: 1694846 - DNA, 18 bp, Homo sapiens
agtcaaacatttcaaagt

SEQ ID NO: 1694847 - DNA, 17 bp, Homo sapiens
agtcaaagtgttgctgt

SEQ ID NO: 1694848 - DNA, 13 bp, Homo sapiens
agtcaaatccagt

SEQ ID NO: 1694849 - DNA, 14 bp, Homo sapiens
agtcaaatccagtg

SEQ ID NO: 1694850 - DNA, 22 bp, Homo sapiens
agtcaaatccagtggtgggtaa

SEQ ID NO: 1694851 - DNA, 14 bp, Homo sapiens
agtcaaatgccaaa

SEQ ID NO: 1694852 - DNA, 13 bp, Homo sapiens
agtcaacagattc

SEQ ID NO: 1694853 - DNA, 14 bp, Homo sapiens
agtcaacagattca

SEQ ID NO: 1694854 - DNA, 18 bp, Homo sapiens
agtcaacagtaaaccact

SEQ ID NO: 1694855 - DNA, 22 bp, Homo sapiens
agtcaacagtaaaccactgaaa

SEQ ID NO: 1694856 - DNA, 21 bp, Homo sapiens
agtcaacttattctttgagta

SEQ ID NO: 1694857 - DNA, 15 bp, Homo sapiens
agtcaagaagaaaaa

SEQ ID NO: 1694858 - DNA, 15 bp, Homo sapiens
agtcaaggcctgctc

SEQ ID NO: 1694859 - DNA, 21 bp, Homo sapiens
agtcaatacatagtgctgctg

SEQ ID NO: 1694860 - DNA, 13 bp, Homo sapiens
agtcacaaagact

SEQ ID NO: 1694861 - DNA, 16 bp, Homo sapiens
agtcacaagagcccag

SEQ ID NO: 1694862 - DNA, 19 bp, Homo sapiens
agtactctctgctctagcc

SEQ ID NO: 1694863 - DNA, 22 bp, Homo sapiens
agtactctttaacatacaagaa

SEQ ID NO: 1694864 - DNA, 12 bp, Homo sapiens
agtactgtacta

SEQ ID NO: 1694865 - DNA, 16 bp, Homo sapiens
agtactgtgtacagaa

SEQ ID NO: 1694866 - DNA, 19 bp, Homo sapiens
agtacttccagatggctgc

SEQ ID NO: 1694867 - DNA, 23 bp, Homo sapiens
agtacttgggagacctgtaatca

SEQ ID NO: 1694868 - DNA, 18 bp, Homo sapiens
agtacttgtgaaacacag

SEQ ID NO: 1694869 - DNA, 20 bp, Homo sapiens
agtacttgtgaaacacagct

SEQ ID NO: 1694870 - DNA, 21 bp, Homo sapiens
agtacttgtgaaacacagctg

SEQ ID NO: 1694871 - DNA, 23 bp, Homo sapiens
agtacttgtgaaacacagctgtt

SEQ ID NO: 1694872 - DNA, 16 bp, Homo sapiens
agtactttaaaaagga

SEQ ID NO: 1694873 - DNA, 17 bp, Homo sapiens
agtactttaaaaaggaa

SEQ ID NO: 1694874 - DNA, 20 bp, Homo sapiens
agtactttagactaattgtg

SEQ ID NO: 1694875 - DNA, 23 bp, Homo sapiens
agtactttattgtacagactgtt

SEQ ID NO: 1694876 - DNA, 22 bp, Homo sapiens
agtagaaaagcagtcccattca

SEQ ID NO: 1694877 - DNA, 18 bp, Homo sapiens
agtagaaataatatgcat

SEQ ID NO: 1694878 - DNA, 19 bp, Homo sapiens
agtagaaataatatgcatt

SEQ ID NO: 1694879 - DNA, 24 bp, Homo sapiens
agtagacagcaataactcggtgtg

SEQ ID NO: 1694880 - DNA, 12 bp, Homo sapiens
agtagacattta

SEQ ID NO: 1694881 - DNA, 13 bp, Homo sapiens
agtagacatttgt

SEQ ID NO: 1694882 - DNA, 20 bp, Homo sapiens
agtagaccttgttacttctg

SEQ ID NO: 1694883 - DNA, 17 bp, Homo sapiens
agtagagctagctgcca

SEQ ID NO: 1694884 - DNA, 17 bp, Homo sapiens
agtagagtcatctccat

SEQ ID NO: 1694885 - DNA, 15 bp, Homo sapiens
agtagatcacctcct

SEQ ID NO: 1694886 - DNA, 16 bp, Homo sapiens
agtagatccatttcca

SEQ ID NO: 1694887 - DNA, 23 bp, Homo sapiens
agtagatctatattagatcaaat

SEQ ID NO: 1694888 - DNA, 14 bp, Homo sapiens
agtagcaatgtgcc

SEQ ID NO: 1694889 - DNA, 16 bp, Homo sapiens
agtagccgagagcctg

SEQ ID NO: 1694890 - DNA, 18 bp, Homo sapiens
agtagccgagagcctgct

SEQ ID NO: 1694891 - DNA, 19 bp, Homo sapiens
agtagccgagagcctgctc

SEQ ID NO: 1694892 - DNA, 21 bp, Homo sapiens
agtagcctgatctttctagag

SEQ ID NO: 1694893 - DNA, 19 bp, Homo sapiens
agtagctagtttgcttttt

SEQ ID NO: 1694894 - DNA, 18 bp, Homo sapiens
agtagctgaacctgtctg

SEQ ID NO: 1694895 - DNA, 15 bp, Homo sapiens
agtagctggcgccca

SEQ ID NO: 1694896 - DNA, 23 bp, Homo sapiens
agtagctgggactacagatgtgg

SEQ ID NO: 1694897 - DNA, 15 bp, Homo sapiens
aggtgcagatgggct

SEQ ID NO: 1694898 - DNA, 20 bp, Homo sapiens
aggtgcaggggaagaccaaa

SEQ ID NO: 1694899 - DNA, 18 bp, Homo sapiens
aggtgccaccaccctgcc

SEQ ID NO: 1694900 - DNA, 12 bp, Homo sapiens
aggtgccactcc

SEQ ID NO: 1694901 - DNA, 15 bp, Homo sapiens
aggtgccactccctg

SEQ ID NO: 1694902 - DNA, 23 bp, Homo sapiens
aggtgccactttacccacctaga

SEQ ID NO: 1694903 - DNA, 20 bp, Homo sapiens
aggtgcccacatgtgtccat

SEQ ID NO: 1694904 - DNA, 18 bp, Homo sapiens
aggtgccctttagccaga

SEQ ID NO: 1694905 - DNA, 13 bp, Homo sapiens
aggtgcctcagac

SEQ ID NO: 1694906 - DNA, 16 bp, Homo sapiens
aggtgcctcagactcc

SEQ ID NO: 1694907 - DNA, 21 bp, Homo sapiens
aggtgcctcagactccgccct

SEQ ID NO: 1694908 - DNA, 16 bp, Homo sapiens
aggtgcctcatagcat

SEQ ID NO: 1694909 - DNA, 12 bp, Homo sapiens
aggtgcctccag

SEQ ID NO: 1694910 - DNA, 14 bp, Homo sapiens
aggtgcctccaggt

SEQ ID NO: 1694911 - DNA, 15 bp, Homo sapiens
aggtgcctccaggtg

SEQ ID NO: 1694912 - DNA, 11 bp, Homo sapiens
aggtgcctgtg

SEQ ID NO: 1694913 - DNA, 21 bp, Homo sapiens
aggtgcgaatgacagtagcat

SEQ ID NO: 1694914 - DNA, 20 bp, Homo sapiens
aggtgcgctcacctcagagc

SEQ ID NO: 1694915 - DNA, 18 bp, Homo sapiens
aggtgctaacatagattt

SEQ ID NO: 1694916 - DNA, 20 bp, Homo sapiens
aggtgctaatttgttttgga

SEQ ID NO: 1694917 - DNA, 23 bp, Homo sapiens
aggtgctaatttgttttggatat

SEQ ID NO: 1694918 - DNA, 21 bp, Homo sapiens
aggtgctacaaaaacacagca

SEQ ID NO: 1694919 - DNA, 16 bp, Homo sapiens
aggtgctgacggccag

SEQ ID NO: 1694920 - DNA, 20 bp, Homo sapiens
aggtgctgacggccagggag

SEQ ID NO: 1694921 - DNA, 20 bp, Homo sapiens
aggtgctgagcttagccttg

SEQ ID NO: 1694922 - DNA, 23 bp, Homo sapiens
aggtgctgcggcgcgggcccctc

SEQ ID NO: 1694923 - DNA, 13 bp, Homo sapiens
aggtgctggactg

SEQ ID NO: 1694924 - DNA, 17 bp, Homo sapiens
aggtgctgggctggact

SEQ ID NO: 1694925 - DNA, 22 bp, Homo sapiens
aggtgctgggctggactggcca

SEQ ID NO: 1694926 - DNA, 14 bp, Homo sapiens
aggtgctgtccatg

SEQ ID NO: 1694927 - DNA, 20 bp, Homo sapiens
aggtgctgtgcgccttgtag

SEQ ID NO: 1694928 - DNA, 21 bp, Homo sapiens
aggtgctttagagataattgc

SEQ ID NO: 1694929 - DNA, 18 bp, Homo sapiens
aggtggaaaaacatctga

SEQ ID NO: 1694930 - DNA, 10 bp, Homo sapiens
aggtggaact

SEQ ID NO: 1694931 - DNA, 17 bp, Homo sapiens
aggtggaagaagggaga

SEQ ID NO: 1694932 - DNA, 14 bp, Homo sapiens
aggtggaagccctc

SEQ ID NO: 1694933 - DNA, 15 bp, Homo sapiens
aggtggaagccctcc

SEQ ID NO: 1694934 - DNA, 19 bp, Homo sapiens
aggtggaagccctccttcc

SEQ ID NO: 1694935 - DNA, 17 bp, Homo sapiens
aggtggagaaaattgga

SEQ ID NO: 1694936 - DNA, 17 bp, Homo sapiens
aggtggagccaagtggt

SEQ ID NO: 1694937 - DNA, 14 bp, Homo sapiens
aggtggagggaggg

SEQ ID NO: 1694938 - DNA, 15 bp, Homo sapiens
aggtggagggcacag

SEQ ID NO: 1694939 - DNA, 17 bp, Homo sapiens
aggtggagggcacagcc

SEQ ID NO: 1694940 - DNA, 18 bp, Homo sapiens
aggtggagggcacagccc

SEQ ID NO: 1694941 - DNA, 15 bp, Homo sapiens
aggtggatctatttc

SEQ ID NO: 1694942 - DNA, 23 bp, Homo sapiens
aggtggatggccccagcacagct

SEQ ID NO: 1694943 - DNA, 20 bp, Homo sapiens
aggtggatgttatgaacagc

SEQ ID NO: 1694944 - DNA, 19 bp, Homo sapiens
aggtggattttgtttaaaa

SEQ ID NO: 1694945 - DNA, 13 bp, Homo sapiens
aggtggcagccct

SEQ ID NO: 1694946 - DNA, 14 bp, Homo sapiens
aggtggcagccctg

SEQ ID NO: 1694947 - DNA, 21 bp, Homo sapiens
aggtggccacagtgtcactgg

SEQ ID NO: 1694948 - DNA, 14 bp, Homo sapiens
aggtggccactcca

SEQ ID NO: 1694949 - DNA, 17 bp, Homo sapiens
aggtggccagaagagct

SEQ ID NO: 1694950 - DNA, 14 bp, Homo sapiens
aggtggccaggcag

SEQ ID NO: 1694951 - DNA, 16 bp, Homo sapiens
aggtggccaggcaggc

SEQ ID NO: 1694952 - DNA, 20 bp, Homo sapiens
aggtggccatgttatgctgg

SEQ ID NO: 1694953 - DNA, 20 bp, Homo sapiens
aggtggccgcccctgaggct

SEQ ID NO: 1694954 - DNA, 15 bp, Homo sapiens
aggtggcctctgcct

SEQ ID NO: 1694955 - DNA, 18 bp, Homo sapiens
aggtggcctctgcctggg

SEQ ID NO: 1694956 - DNA, 18 bp, Homo sapiens
aggtggcgtgagaggcaa

SEQ ID NO: 1694957 - DNA, 19 bp, Homo sapiens
aggtggctgacccagtccc

SEQ ID NO: 1694958 - DNA, 16 bp, Homo sapiens
aggtggcttgagctag

SEQ ID NO: 1694959 - DNA, 12 bp, Homo sapiens
aggtgggagctg

SEQ ID NO: 1694960 - DNA, 23 bp, Homo sapiens
aggtgggaggaaagggcctggcc

SEQ ID NO: 1694961 - DNA, 16 bp, Homo sapiens
aggtgggatcctccct

SEQ ID NO: 1694962 - DNA, 13 bp, Homo sapiens
aggtgggcagctg

SEQ ID NO: 1694963 - DNA, 16 bp, Homo sapiens
aggtgggcagctgggc

SEQ ID NO: 1694964 - DNA, 18 bp, Homo sapiens
aggtgggcagctgggccc

SEQ ID NO: 1694965 - DNA, 12 bp, Homo sapiens
aggtgggcccag

SEQ ID NO: 1694966 - DNA, 22 bp, Homo sapiens
aggtgggcccaggaccagctgg

SEQ ID NO: 1694967 - DNA, 21 bp, Homo sapiens
aggtgggccttgctacctcaa

SEQ ID NO: 1694968 - DNA, 22 bp, Homo sapiens
aggtgggccttgctacctcaag

SEQ ID NO: 1694969 - DNA, 17 bp, Homo sapiens
aggtgggctgagccctg

SEQ ID NO: 1694970 - DNA, 14 bp, Homo sapiens
aggtgggctgcctg

SEQ ID NO: 1694971 - DNA, 21 bp, Homo sapiens
aggtgggctgggccctctctt

SEQ ID NO: 1694972 - DNA, 22 bp, Homo sapiens
aggtgggctgggccctctcttc

SEQ ID NO: 1694973 - DNA, 22 bp, Homo sapiens
aggtggggattgcccctggctt

SEQ ID NO: 1694974 - DNA, 15 bp, Homo sapiens
aggtggggccctgcc

SEQ ID NO: 1694975 - DNA, 18 bp, Homo sapiens
aggtggggccctgcccct

SEQ ID NO: 1694976 - DNA, 21 bp, Homo sapiens
aggtggggtacatttctctga

SEQ ID NO: 1694977 - DNA, 21 bp, Homo sapiens
aggtggggtctttgtgagagt

SEQ ID NO: 1694978 - DNA, 22 bp, Homo sapiens
aggtggggttgggattgggggc

SEQ ID NO: 1694979 - DNA, 17 bp, Homo sapiens
aggtgggttagagatgg

SEQ ID NO: 1694980 - DNA, 19 bp, Homo sapiens
aggtgggttttcttcccat

SEQ ID NO: 1694981 - DNA, 22 bp, Homo sapiens
aggtgggttttcttcccatcac

SEQ ID NO: 1694982 - DNA, 15 bp, Homo sapiens
aggtggtcagtaaat

SEQ ID NO: 1694983 - DNA, 19 bp, Homo sapiens
aggtggtggcactgagccc

SEQ ID NO: 1694984 - DNA, 13 bp, Homo sapiens
aggtggtggggct

SEQ ID NO: 1694985 - DNA, 17 bp, Homo sapiens
agtaaaaccacagcagt

SEQ ID NO: 1694986 - DNA, 19 bp, Homo sapiens
agtaaaaccacagcagttg

SEQ ID NO: 1694987 - DNA, 19 bp, Homo sapiens
agtaaaagtggtctctgct

SEQ ID NO: 1694988 - DNA, 23 bp, Homo sapiens
agtaaaatgaacattttgtggag

SEQ ID NO: 1694989 - DNA, 21 bp, Homo sapiens
agtaaacattaagtaaatgct

SEQ ID NO: 1694990 - DNA, 14 bp, Homo sapiens
agtaaacgggaaca

SEQ ID NO: 1694991 - DNA, 16 bp, Homo sapiens
agtaaacgggaacatg

SEQ ID NO: 1694992 - DNA, 19 bp, Homo sapiens
agtaaacgggaacatgccc

SEQ ID NO: 1694993 - DNA, 21 bp, Homo sapiens
agtaaacgggaacatgccccc

SEQ ID NO: 1694994 - DNA, 23 bp, Homo sapiens
agtaaacgggaacatgccccctg

SEQ ID NO: 1694995 - DNA, 14 bp, Homo sapiens
agtaaactatttat

SEQ ID NO: 1694996 - DNA, 16 bp, Homo sapiens
agtaaactatttatct

SEQ ID NO: 1694997 - DNA, 13 bp, Homo sapiens
agtaaaggaggaa

SEQ ID NO: 1694998 - DNA, 16 bp, Homo sapiens
agtaaaggcctcatct

SEQ ID NO: 1694999 - DNA, 19 bp, Homo sapiens
agtaaagtgataatttctg

SEQ ID NO: 1695000 - DNA, 19 bp, Homo sapiens
agtaaatagtttgaattca

SEQ ID NO: 1695001 - DNA, 24 bp, Homo sapiens
agtaaatcagaaagtaacaatcta

SEQ ID NO: 1695002 - DNA, 11 bp, Homo sapiens
agtaaatgcta

SEQ ID NO: 1695003 - DNA, 23 bp, Homo sapiens
agtaaatgctaggttaattccaa

SEQ ID NO: 1695004 - DNA, 17 bp, Homo sapiens
agtaaattaaacatttt

SEQ ID NO: 1695005 - DNA, 15 bp, Homo sapiens
agtaaattatgatgt

SEQ ID NO: 1695006 - DNA, 13 bp, Homo sapiens
agtaaattatgta

SEQ ID NO: 1695007 - DNA, 13 bp, Homo sapiens
agtaacaatctat

SEQ ID NO: 1695008 - DNA, 19 bp, Homo sapiens
agtaacaatgaagataaaa

SEQ ID NO: 1695009 - DNA, 14 bp, Homo sapiens
agtaacacaaacat

SEQ ID NO: 1695010 - DNA, 13 bp, Homo sapiens
agtaacacagtat

SEQ ID NO: 1695011 - DNA, 13 bp, Homo sapiens
agtaacacatttg

SEQ ID NO: 1695012 - DNA, 16 bp, Homo sapiens
agtaacactaatatat

SEQ ID NO: 1695013 - DNA, 23 bp, Homo sapiens
agtaacactaatatatttaaaaa

SEQ ID NO: 1695014 - DNA, 19 bp, Homo sapiens
agtaacataactgcttctt

SEQ ID NO: 1695015 - DNA, 15 bp, Homo sapiens
agtaacatttctgtt

SEQ ID NO: 1695016 - DNA, 22 bp, Homo sapiens
agtcattcgcgtggctcgggac

SEQ ID NO: 1695017 - DNA, 18 bp, Homo sapiens
agtcattctaggatgtgg

SEQ ID NO: 1695018 - DNA, 15 bp, Homo sapiens
agtcattgtaatgtt

SEQ ID NO: 1695019 - DNA, 16 bp, Homo sapiens
agtcattgtaatgttg

SEQ ID NO: 1695020 - DNA, 17 bp, Homo sapiens
agtcattgtaatgttgt

SEQ ID NO: 1695021 - DNA, 18 bp, Homo sapiens
agtcattgtatgttatta

SEQ ID NO: 1695022 - DNA, 22 bp, Homo sapiens
agtcatttgctgagcatgtact

SEQ ID NO: 1695023 - DNA, 21 bp, Homo sapiens
agtcattttaactttatcaca

SEQ ID NO: 1695024 - DNA, 15 bp, Homo sapiens
agtcattttcaagac

SEQ ID NO: 1695025 - DNA, 16 bp, Homo sapiens
agtcattttgtgttga

SEQ ID NO: 1695026 - DNA, 11 bp, Homo sapiens
agtccaaagtc

SEQ ID NO: 1695027 - DNA, 17 bp, Homo sapiens
agtccaacaatgttgtt

SEQ ID NO: 1695028 - DNA, 14 bp, Homo sapiens
agtccaagaatcca

SEQ ID NO: 1695029 - DNA, 13 bp, Homo sapiens
agtccaaggttta

SEQ ID NO: 1695030 - DNA, 20 bp, Homo sapiens
agtccacaggggccaccacc

SEQ ID NO: 1695031 - DNA, 13 bp, Homo sapiens
agtccactgttga

SEQ ID NO: 1695032 - DNA, 17 bp, Homo sapiens
agtccagccagctcctg

SEQ ID NO: 1695033 - DNA, 12 bp, Homo sapiens
agtccagctcta

SEQ ID NO: 1695034 - DNA, 13 bp, Homo sapiens
agtccagctctac

SEQ ID NO: 1695035 - DNA, 14 bp, Homo sapiens
agtccagctctact

SEQ ID NO: 1695036 - DNA, 16 bp, Homo sapiens
agtccagctctttaga

SEQ ID NO: 1695037 - DNA, 18 bp, Homo sapiens
agtccagctctttagaat

SEQ ID NO: 1695038 - DNA, 11 bp, Homo sapiens
agtccaggact

SEQ ID NO: 1695039 - DNA, 23 bp, Homo sapiens
agtccagttgtgttgacacatat

SEQ ID NO: 1695040 - DNA, 18 bp, Homo sapiens
agtccatcaccatttctt

SEQ ID NO: 1695041 - DNA, 13 bp, Homo sapiens
agtccatgctcca

SEQ ID NO: 1695042 - DNA, 13 bp, Homo sapiens
agtccatgttatt

SEQ ID NO: 1695043 - DNA, 19 bp, Homo sapiens
agtccattctcccaggtac

SEQ ID NO: 1695044 - DNA, 21 bp, Homo sapiens
agtccatttcccacatctttc

SEQ ID NO: 1695045 - DNA, 20 bp, Homo sapiens
agtcccaaggaaagccccag

SEQ ID NO: 1695046 - DNA, 21 bp, Homo sapiens
agtcccaaggaaagccccagc

SEQ ID NO: 1695047 - DNA, 19 bp, Homo sapiens
agtcccacaccgctggtcc

SEQ ID NO: 1695048 - DNA, 12 bp, Homo sapiens
agtcccagagca

SEQ ID NO: 1695049 - DNA, 19 bp, Homo sapiens
agtcccagagcacctcacc

SEQ ID NO: 1695050 - DNA, 11 bp, Homo sapiens
agtcccagcta

SEQ ID NO: 1695051 - DNA, 19 bp, Homo sapiens
agtcccagctactcaggag

SEQ ID NO: 1695052 - DNA, 23 bp, Homo sapiens
agtcccaggggcagccacaccac

SEQ ID NO: 1695053 - DNA, 21 bp, Homo sapiens
agtcccattcatattaagaca

SEQ ID NO: 1695054 - DNA, 13 bp, Homo sapiens
agtccccacccct

SEQ ID NO: 1695055 - DNA, 20 bp, Homo sapiens
agtccccacccgcctgcaga

SEQ ID NO: 1695056 - DNA, 20 bp, Homo sapiens
agtccccagcccttctgcct

SEQ ID NO: 1695057 - DNA, 19 bp, Homo sapiens
agtcccccaccacactgaa

SEQ ID NO: 1695058 - DNA, 23 bp, Homo sapiens
agtccccgtgccccgcctccccg

SEQ ID NO: 1695059 - DNA, 19 bp, Homo sapiens
agtcccctccccggcccta

SEQ ID NO: 1695060 - DNA, 21 bp, Homo sapiens
agtcccctccccggccctacc

SEQ ID NO: 1695061 - DNA, 21 bp, Homo sapiens
agtctgtctactgtggtgatc

SEQ ID NO: 1695062 - DNA, 17 bp, Homo sapiens
agtctgtctcaaaagaa

SEQ ID NO: 1695063 - DNA, 21 bp, Homo sapiens
agtctgtgatccttggtgctg

SEQ ID NO: 1695064 - DNA, 23 bp, Homo sapiens
agtctgtgatccttggtgctgtg

SEQ ID NO: 1695065 - DNA, 13 bp, Homo sapiens
agtctgttgtgtg

SEQ ID NO: 1695066 - DNA, 15 bp, Homo sapiens
agtcttaacaaacca

SEQ ID NO: 1695067 - DNA, 18 bp, Homo sapiens
agtcttactctgttgcca

SEQ ID NO: 1695068 - DNA, 18 bp, Homo sapiens
agtcttcagacccagaga

SEQ ID NO: 1695069 - DNA, 14 bp, Homo sapiens
agtcttcagtttca

SEQ ID NO: 1695070 - DNA, 15 bp, Homo sapiens
agtcttccaattaat

SEQ ID NO: 1695071 - DNA, 22 bp, Homo sapiens
agtcttccaattaatgcttttt

SEQ ID NO: 1695072 - DNA, 18 bp, Homo sapiens
agtcttcccttacctcaa

SEQ ID NO: 1695073 - DNA, 15 bp, Homo sapiens
agtcttcctgacact

SEQ ID NO: 1695074 - DNA, 12 bp, Homo sapiens
agtcttccttaa

SEQ ID NO: 1695075 - DNA, 21 bp, Homo sapiens
agtcttctgagcgagtgctct

SEQ ID NO: 1695076 - DNA, 19 bp, Homo sapiens
agtcttgaaatgaaaggga

SEQ ID NO: 1695077 - DNA, 22 bp, Homo sapiens
agtcttgaaatgaaagggaaac

SEQ ID NO: 1695078 - DNA, 23 bp, Homo sapiens
agtcttgaaatgaaagggaaact

SEQ ID NO: 1695079 - DNA, 19 bp, Homo sapiens
agtcttgaagttgggtgtt

SEQ ID NO: 1695080 - DNA, 14 bp, Homo sapiens
agtcttgcagctga

SEQ ID NO: 1695081 - DNA, 23 bp, Homo sapiens
agtcttgctctgttacccaggct

SEQ ID NO: 1695082 - DNA, 22 bp, Homo sapiens
agtcttggcggcagcagccatc

SEQ ID NO: 1695083 - DNA, 15 bp, Homo sapiens
agtcttggctcactg

SEQ ID NO: 1695084 - DNA, 20 bp, Homo sapiens
agtcttgtcttagctctgga

SEQ ID NO: 1695085 - DNA, 14 bp, Homo sapiens
agtctttaataaat

SEQ ID NO: 1695086 - DNA, 13 bp, Homo sapiens
agtctttgctcag

SEQ ID NO: 1695087 - DNA, 16 bp, Homo sapiens
agtctttgctcagtgg

SEQ ID NO: 1695088 - DNA, 18 bp, Homo sapiens
agtctttgctcagtggat

SEQ ID NO: 1695089 - DNA, 19 bp, Homo sapiens
agtctttgctcagtgtcca

SEQ ID NO: 1695090 - DNA, 17 bp, Homo sapiens
agtctttggaaccctaa

SEQ ID NO: 1695091 - DNA, 12 bp, Homo sapiens
agtcttttctgt

SEQ ID NO: 1695092 - DNA, 14 bp, Homo sapiens
agtcttttctgtca

SEQ ID NO: 1695093 - DNA, 16 bp, Homo sapiens
agtcttttctgttatt

SEQ ID NO: 1695094 - DNA, 20 bp, Homo sapiens
agtcttttgcttttggcaaa

SEQ ID NO: 1695095 - DNA, 15 bp, Homo sapiens
agtcttttgtaatat

SEQ ID NO: 1695096 - DNA, 20 bp, Homo sapiens
agtcttttgtaatatcaagc

SEQ ID NO: 1695097 - DNA, 17 bp, Homo sapiens
agtctttttataggttt

SEQ ID NO: 1695098 - DNA, 19 bp, Homo sapiens
agtctttttataggtttta

SEQ ID NO: 1695099 - DNA, 16 bp, Homo sapiens
agtcttttttttcctg

SEQ ID NO: 1695100 - DNA, 20 bp, Homo sapiens
agtgaaacctttagggcagc

SEQ ID NO: 1695101 - DNA, 17 bp, Homo sapiens
agtgaaagagattactt

SEQ ID NO: 1695102 - DNA, 16 bp, Homo sapiens
agtgaaagctagagat

SEQ ID NO: 1695103 - DNA, 18 bp, Homo sapiens
agtgaaataccattatta

SEQ ID NO: 1695104 - DNA, 15 bp, Homo sapiens
agtgaaatggctggg

SEQ ID NO: 1695105 - DNA, 17 bp, Homo sapiens
agtgaaattattttgga

SEQ ID NO: 1695106 - DNA, 11 bp, Homo sapiens
agtgaacacac

SEQ ID NO: 1695107 - DNA, 19 bp, Homo sapiens
agtgaacattcccagccca

SEQ ID NO: 1695108 - DNA, 20 bp, Homo sapiens
agtgaaccaaaaatagaaat

SEQ ID NO: 1695109 - DNA, 13 bp, Homo sapiens
agtgaagaataca

SEQ ID NO: 1695110 - DNA, 14 bp, Homo sapiens
agtgaagaatacat

SEQ ID NO: 1695111 - DNA, 15 bp, Homo sapiens
agtgaagaatacatc

SEQ ID NO: 1695112 - DNA, 19 bp, Homo sapiens
agtgaagaatacatcagaa

SEQ ID NO: 1695113 - DNA, 16 bp, Homo sapiens
agtgaagacttcttgg

SEQ ID NO: 1695114 - DNA, 17 bp, Homo sapiens
agtgaagacttcttggg

SEQ ID NO: 1695115 - DNA, 13 bp, Homo sapiens
agtgaagaggggc

SEQ ID NO: 1695116 - DNA, 17 bp, Homo sapiens
agtgaagaggggcagcc

SEQ ID NO: 1695117 - DNA, 20 bp, Homo sapiens
agtgaagatgcaatcagaca

SEQ ID NO: 1695118 - DNA, 17 bp, Homo sapiens
agtgaagatgctgtaaa

SEQ ID NO: 1695119 - DNA, 16 bp, Homo sapiens
agtgaagcagcactgt

SEQ ID NO: 1695120 - DNA, 17 bp, Homo sapiens
agtgaagtgagaagttc

SEQ ID NO: 1695121 - DNA, 18 bp, Homo sapiens
agtgaataactgcaaagt

SEQ ID NO: 1695122 - DNA, 23 bp, Homo sapiens
agtgaatacattaacggtgctaa

SEQ ID NO: 1695123 - DNA, 16 bp, Homo sapiens
agtgaatactgctaca

SEQ ID NO: 1695124 - DNA, 21 bp, Homo sapiens
agtgaatacttactataattt

SEQ ID NO: 1695125 - DNA, 21 bp, Homo sapiens
agtgcatttgtgctagaaatt

SEQ ID NO: 1695126 - DNA, 17 bp, Homo sapiens
agtgcattttcccagat

SEQ ID NO: 1695127 - DNA, 17 bp, Homo sapiens
agtgcattttgtttctg

SEQ ID NO: 1695128 - DNA, 17 bp, Homo sapiens
agtgcatttttaaactt

SEQ ID NO: 1695129 - DNA, 18 bp, Homo sapiens
agtgcatttttcttattt

SEQ ID NO: 1695130 - DNA, 14 bp, Homo sapiens
agtgccaagcacag

SEQ ID NO: 1695131 - DNA, 19 bp, Homo sapiens
agtgccaagcacagtgcct

SEQ ID NO: 1695132 - DNA, 21 bp, Homo sapiens
agtgccacccacctttgccac

SEQ ID NO: 1695133 - DNA, 22 bp, Homo sapiens
agtgccacccacctttgccaca

SEQ ID NO: 1695134 - DNA, 22 bp, Homo sapiens
agtgccacccatgcagctgctc

SEQ ID NO: 1695135 - DNA, 13 bp, Homo sapiens
agtgccactgccc

SEQ ID NO: 1695136 - DNA, 20 bp, Homo sapiens
agtgccacttaatgtatgtt

SEQ ID NO: 1695137 - DNA, 19 bp, Homo sapiens
agtgccacttgacattcct

SEQ ID NO: 1695138 - DNA, 20 bp, Homo sapiens
agtgccagaattttaggaac

SEQ ID NO: 1695139 - DNA, 14 bp, Homo sapiens
agtgccaggaccag

SEQ ID NO: 1695140 - DNA, 15 bp, Homo sapiens
agtgccaggaccagc

SEQ ID NO: 1695141 - DNA, 19 bp, Homo sapiens
agtgccaggaccagcctgt

SEQ ID NO: 1695142 - DNA, 18 bp, Homo sapiens
agtgccaggatggaatga

SEQ ID NO: 1695143 - DNA, 15 bp, Homo sapiens
agtgccatgtaaatc

SEQ ID NO: 1695144 - DNA, 17 bp, Homo sapiens
agtgcccaactgttata

SEQ ID NO: 1695145 - DNA, 11 bp, Homo sapiens
agtgcccagcc

SEQ ID NO: 1695146 - DNA, 18 bp, Homo sapiens
agtgcccagtggagcctg

SEQ ID NO: 1695147 - DNA, 23 bp, Homo sapiens
agtgcccagtggagcctgccgcc

SEQ ID NO: 1695148 - DNA, 14 bp, Homo sapiens
agtgcccccactga

SEQ ID NO: 1695149 - DNA, 16 bp, Homo sapiens
agtgccctccacagcc

SEQ ID NO: 1695150 - DNA, 17 bp, Homo sapiens
agtgccctccacagccg

SEQ ID NO: 1695151 - DNA, 22 bp, Homo sapiens
agtgccctggggctgatctcag

SEQ ID NO: 1695152 - DNA, 22 bp, Homo sapiens
agtgcctagactgttactttgg

SEQ ID NO: 1695153 - DNA, 17 bp, Homo sapiens
agtgcctcacctcgaaa

SEQ ID NO: 1695154 - DNA, 13 bp, Homo sapiens
agtgcctcgaggc

SEQ ID NO: 1695155 - DNA, 14 bp, Homo sapiens
agtgcctcgaggca

SEQ ID NO: 1695156 - DNA, 11 bp, Homo sapiens
agtgcctgcca

SEQ ID NO: 1695157 - DNA, 21 bp, Homo sapiens
agtgccttacctcctgcccag

SEQ ID NO: 1695158 - DNA, 22 bp, Homo sapiens
agtgccttacctcctgcccagg

SEQ ID NO: 1695159 - DNA, 20 bp, Homo sapiens
agtgccttatgctatgagac

SEQ ID NO: 1695160 - DNA, 13 bp, Homo sapiens
agtgccttctctc

SEQ ID NO: 1695161 - DNA, 20 bp, Homo sapiens
agtgccttctttagaccctc

SEQ ID NO: 1695162 - DNA, 19 bp, Homo sapiens
agtgcggtttactcactgc

SEQ ID NO: 1695163 - DNA, 20 bp, Homo sapiens
agtgcgtgtgtgtatgtgtg

SEQ ID NO: 1695164 - DNA, 21 bp, Homo sapiens
agtgctaaggttctaaggcct

SEQ ID NO: 1695165 - DNA, 19 bp, Homo sapiens
agtgctataaatgccagag

SEQ ID NO: 1695166 - DNA, 13 bp, Homo sapiens
agtgctcagctgt

SEQ ID NO: 1695167 - DNA, 16 bp, Homo sapiens
agtgctcagctgtggc

SEQ ID NO: 1695168 - DNA, 17 bp, Homo sapiens
agtgctcagctgtggct

SEQ ID NO: 1695169 - DNA, 19 bp, Homo sapiens
agtgctcagctgtggctgg

SEQ ID NO: 1695170 - DNA, 15 bp, Homo sapiens
agtgctcagtgaagt

SEQ ID NO: 1695171 - DNA, 12 bp, Homo sapiens
agtgctccctgg

SEQ ID NO: 1695172 - DNA, 14 bp, Homo sapiens
agtgctccctggag

SEQ ID NO: 1695173 - DNA, 14 bp, Homo sapiens
agtgctctcagctg

SEQ ID NO: 1695174 - DNA, 18 bp, Homo sapiens
agtgctctcagctggcag

SEQ ID NO: 1695175 - DNA, 17 bp, Homo sapiens
agtgctcttggctgacc

SEQ ID NO: 1695176 - DNA, 18 bp, Homo sapiens
agtgctcttggctgaccc

SEQ ID NO: 1695177 - DNA, 20 bp, Homo sapiens
agtgctctttgtggcagtgg

SEQ ID NO: 1695178 - DNA, 15 bp, Homo sapiens
agtgctgaacagtgg

SEQ ID NO: 1695179 - DNA, 16 bp, Homo sapiens
agtgctgaggccaggg

SEQ ID NO: 1695180 - DNA, 12 bp, Homo sapiens
agtgctgccatg

SEQ ID NO: 1695181 - DNA, 16 bp, Homo sapiens
agtgctgcccatgagc

SEQ ID NO: 1695182 - DNA, 11 bp, Homo sapiens
atcttaaacta

SEQ ID NO: 1695183 - DNA, 16 bp, Homo sapiens
atcttaaactaatacg

SEQ ID NO: 1695184 - DNA, 21 bp, Homo sapiens
atcttaaagaaacagctttca

SEQ ID NO: 1695185 - DNA, 22 bp, Homo sapiens
atcttaaagaaacagctttcaa

SEQ ID NO: 1695186 - DNA, 19 bp, Homo sapiens
atcttaaagtgtgtttcta

SEQ ID NO: 1695187 - DNA, 13 bp, Homo sapiens
atcttaaattcat

SEQ ID NO: 1695188 - DNA, 18 bp, Homo sapiens
atcttaagcaggtttgtt

SEQ ID NO: 1695189 - DNA, 13 bp, Homo sapiens
atcttaatactgt

SEQ ID NO: 1695190 - DNA, 17 bp, Homo sapiens
atcttaatactgttatt

SEQ ID NO: 1695191 - DNA, 13 bp, Homo sapiens
atcttaatgtaaa

SEQ ID NO: 1695192 - DNA, 22 bp, Homo sapiens
atcttaattactttcagaatat

SEQ ID NO: 1695193 - DNA, 19 bp, Homo sapiens
atcttaattttttttaatg

SEQ ID NO: 1695194 - DNA, 15 bp, Homo sapiens
atcttagattctctg

SEQ ID NO: 1695195 - DNA, 23 bp, Homo sapiens
atcttagattctctgtgtctaag

SEQ ID NO: 1695196 - DNA, 20 bp, Homo sapiens
atcttagcttttaatagtgt

SEQ ID NO: 1695197 - DNA, 15 bp, Homo sapiens
atcttagtgtatgat

SEQ ID NO: 1695198 - DNA, 19 bp, Homo sapiens
atcttagtgtatgattact

SEQ ID NO: 1695199 - DNA, 22 bp, Homo sapiens
atcttagtttggattcttatgt

SEQ ID NO: 1695200 - DNA, 15 bp, Homo sapiens
atcttatagttctag

SEQ ID NO: 1695201 - DNA, 19 bp, Homo sapiens
atcttatctcagatatttg

SEQ ID NO: 1695202 - DNA, 21 bp, Homo sapiens
atcttatctcagatatttgca

SEQ ID NO: 1695203 - DNA, 19 bp, Homo sapiens
atcttattgtttaatcttt

SEQ ID NO: 1695204 - DNA, 21 bp, Homo sapiens
atcttattgtttaatcttttt

SEQ ID NO: 1695205 - DNA, 15 bp, Homo sapiens
atcttattttatctt

SEQ ID NO: 1695206 - DNA, 16 bp, Homo sapiens
atcttattttcatgta

SEQ ID NO: 1695207 - DNA, 21 bp, Homo sapiens
atcttattttctcaatctcct

SEQ ID NO: 1695208 - DNA, 16 bp, Homo sapiens
atcttcaaactttcac

SEQ ID NO: 1695209 - DNA, 19 bp, Homo sapiens
atcttcaaagcttgaagat

SEQ ID NO: 1695210 - DNA, 18 bp, Homo sapiens
atcttcaccctcatcctt

SEQ ID NO: 1695211 - DNA, 14 bp, Homo sapiens
atcttcacctcaga

SEQ ID NO: 1695212 - DNA, 16 bp, Homo sapiens
atcttcacctcagagt

SEQ ID NO: 1695213 - DNA, 18 bp, Homo sapiens
atcttcacctcagagtgg

SEQ ID NO: 1695214 - DNA, 15 bp, Homo sapiens
atcttcagcccaggc

SEQ ID NO: 1695215 - DNA, 14 bp, Homo sapiens
atcttcagttttat

SEQ ID NO: 1695216 - DNA, 13 bp, Homo sapiens
atcttccacctgt

SEQ ID NO: 1695217 - DNA, 20 bp, Homo sapiens
atcttccagaagctgtactt

SEQ ID NO: 1695218 - DNA, 11 bp, Homo sapiens
atcttcccagc

SEQ ID NO: 1695219 - DNA, 14 bp, Homo sapiens
atcttcccatgcat

SEQ ID NO: 1695220 - DNA, 12 bp, Homo sapiens
atcttcctgctg

SEQ ID NO: 1695221 - DNA, 13 bp, Homo sapiens
atcttcctgtgtc

SEQ ID NO: 1695222 - DNA, 15 bp, Homo sapiens
atcttccttgtgagg

SEQ ID NO: 1695223 - DNA, 18 bp, Homo sapiens
atcttctatcattccaat

SEQ ID NO: 1695224 - DNA, 19 bp, Homo sapiens
atcttctatttttatcatg

SEQ ID NO: 1695225 - DNA, 20 bp, Homo sapiens
atcttctcaagttctaagat

SEQ ID NO: 1695226 - DNA, 13 bp, Homo sapiens
atcttctcattgt

SEQ ID NO: 1695227 - DNA, 22 bp, Homo sapiens
atcttctccatctggcagggtg

SEQ ID NO: 1695228 - DNA, 19 bp, Homo sapiens
atcttctccccgaggctgc

SEQ ID NO: 1695229 - DNA, 14 bp, Homo sapiens
atcttctctggcga

SEQ ID NO: 1695230 - DNA, 17 bp, Homo sapiens
atcttctctttgacaat

SEQ ID NO: 1695231 - DNA, 19 bp, Homo sapiens
atcttctgaaatgaaacaa

SEQ ID NO: 1695232 - DNA, 18 bp, Homo sapiens
atcttctgaagaggaaaa

SEQ ID NO: 1695233 - DNA, 21 bp, Homo sapiens
atcttctgccttagtctcagt

SEQ ID NO: 1695234 - DNA, 13 bp, Homo sapiens
atcttctggaata

SEQ ID NO: 1695235 - DNA, 22 bp, Homo sapiens
atcttctggtttaaacttgttt

SEQ ID NO: 1695236 - DNA, 17 bp, Homo sapiens
atcttctttataattct

SEQ ID NO: 1695237 - DNA, 16 bp, Homo sapiens
atcttgaagtcagcca

SEQ ID NO: 1695238 - DNA, 21 bp, Homo sapiens
atcttgaagtcagccacactg

SEQ ID NO: 1695239 - DNA, 22 bp, Homo sapiens
atcttgaagtcagccacactgg

SEQ ID NO: 1695240 - DNA, 15 bp, Homo sapiens
atcttgagaaccttt

SEQ ID NO: 1695241 - DNA, 22 bp, Homo sapiens
atcttgagccacagtcactgga

SEQ ID NO: 1695242 - DNA, 23 bp, Homo sapiens
atcttgagccacagtcactggat

SEQ ID NO: 1695243 - DNA, 17 bp, Homo sapiens
atcttgcagcatttact

SEQ ID NO: 1695244 - DNA, 20 bp, Homo sapiens
atcttgcagcatttactatg

SEQ ID NO: 1695245 - DNA, 16 bp, Homo sapiens
atgaacaaattcttta

SEQ ID NO: 1695246 - DNA, 20 bp, Homo sapiens
atgaacaaattctttagtac

SEQ ID NO: 1695247 - DNA, 21 bp, Homo sapiens
atgaacaaattctttagtact

SEQ ID NO: 1695248 - DNA, 23 bp, Homo sapiens
atgaacaaattctttagtactca

SEQ ID NO: 1695249 - DNA, 15 bp, Homo sapiens
atgaacacactgtgt

SEQ ID NO: 1695250 - DNA, 22 bp, Homo sapiens
atgaacacactgtgtcctggtg

SEQ ID NO: 1695251 - DNA, 12 bp, Homo sapiens
atgaacacagac

SEQ ID NO: 1695252 - DNA, 17 bp, Homo sapiens
atgaacacccttagaaa

SEQ ID NO: 1695253 - DNA, 12 bp, Homo sapiens
atgaacagctgt

SEQ ID NO: 1695254 - DNA, 13 bp, Homo sapiens
atgaacagctgtg

SEQ ID NO: 1695255 - DNA, 19 bp, Homo sapiens
atgaacagcttgccaggga

SEQ ID NO: 1695256 - DNA, 15 bp, Homo sapiens
atgaacatattcatg

SEQ ID NO: 1695257 - DNA, 17 bp, Homo sapiens
atgaacatctcttgaaa

SEQ ID NO: 1695258 - DNA, 13 bp, Homo sapiens
atgaacattgtac

SEQ ID NO: 1695259 - DNA, 18 bp, Homo sapiens
atgaacattgtactgttg

SEQ ID NO: 1695260 - DNA, 19 bp, Homo sapiens
atgaacattgtactgttgc

SEQ ID NO: 1695261 - DNA, 23 bp, Homo sapiens
atgaacattgtactgttgcttta

SEQ ID NO: 1695262 - DNA, 23 bp, Homo sapiens
atgaacattttgtggagtttgta

SEQ ID NO: 1695263 - DNA, 18 bp, Homo sapiens
atgaacctgcaagccttc

SEQ ID NO: 1695264 - DNA, 16 bp, Homo sapiens
atgaactcttaatcaa

SEQ ID NO: 1695265 - DNA, 12 bp, Homo sapiens
atgaactgaaag

SEQ ID NO: 1695266 - DNA, 18 bp, Homo sapiens
atgaactgcttttcctca

SEQ ID NO: 1695267 - DNA, 16 bp, Homo sapiens
atgaactgtactactc

SEQ ID NO: 1695268 - DNA, 17 bp, Homo sapiens
atgaacttattctgtag

SEQ ID NO: 1695269 - DNA, 16 bp, Homo sapiens
atgaactttttcctgg

SEQ ID NO: 1695270 - DNA, 14 bp, Homo sapiens
atgaagaaaatact

SEQ ID NO: 1695271 - DNA, 15 bp, Homo sapiens
atgaagaaaatactt

SEQ ID NO: 1695272 - DNA, 20 bp, Homo sapiens
atgaagaaaatacttaaatg

SEQ ID NO: 1695273 - DNA, 21 bp, Homo sapiens
atgaagaaaatacttaaatgt

SEQ ID NO: 1695274 - DNA, 22 bp, Homo sapiens
atgaagaaaatacttaaatgtt

SEQ ID NO: 1695275 - DNA, 23 bp, Homo sapiens
atgaagaaaatacttaaatgtta

SEQ ID NO: 1695276 - DNA, 14 bp, Homo sapiens
atgaagaactgagg

SEQ ID NO: 1695277 - DNA, 15 bp, Homo sapiens
atgaagaactgagga

SEQ ID NO: 1695278 - DNA, 16 bp, Homo sapiens
atgaagacaggacagt

SEQ ID NO: 1695279 - DNA, 21 bp, Homo sapiens
atgaagactgttaaatgaaac

SEQ ID NO: 1695280 - DNA, 13 bp, Homo sapiens
atgaagacttaaa

SEQ ID NO: 1695281 - DNA, 21 bp, Homo sapiens
atgaagagaaggcacacagag

SEQ ID NO: 1695282 - DNA, 21 bp, Homo sapiens
atgaagattggtgggattttt

SEQ ID NO: 1695283 - DNA, 17 bp, Homo sapiens
atgaagcaattagtctg

SEQ ID NO: 1695284 - DNA, 22 bp, Homo sapiens
atgaagcagctttaaacaaatt

SEQ ID NO: 1695285 - DNA, 13 bp, Homo sapiens
atgaagcaggagg

SEQ ID NO: 1695286 - DNA, 15 bp, Homo sapiens
atgaagcaggaggcc

SEQ ID NO: 1695287 - DNA, 12 bp, Homo sapiens
atgaagccagct

SEQ ID NO: 1695288 - DNA, 17 bp, Homo sapiens
atgaagcccaagtgaaa

SEQ ID NO: 1695289 - DNA, 16 bp, Homo sapiens
atgaagcccaataaac

SEQ ID NO: 1695290 - DNA, 14 bp, Homo sapiens
atgaagctacctca

SEQ ID NO: 1695291 - DNA, 17 bp, Homo sapiens
atgaagctgagcttttg

SEQ ID NO: 1695292 - DNA, 22 bp, Homo sapiens
atgaagctgccatccttgctgc

SEQ ID NO: 1695293 - DNA, 13 bp, Homo sapiens
atgaagctgttgt

SEQ ID NO: 1695294 - DNA, 17 bp, Homo sapiens
atgaaggcttttggtct

SEQ ID NO: 1695295 - DNA, 15 bp, Homo sapiens
atgaagggaaattgt

SEQ ID NO: 1695296 - DNA, 20 bp, Homo sapiens
atgaaggtaatattgataag

SEQ ID NO: 1695297 - DNA, 18 bp, Homo sapiens
atgaaggtcactcgtggt

SEQ ID NO: 1695298 - DNA, 18 bp, Homo sapiens
atgaaggtttttgtaaag

SEQ ID NO: 1695299 - DNA, 16 bp, Homo sapiens
atgaagtatataatgg

SEQ ID NO: 1695300 - DNA, 18 bp, Homo sapiens
atgaagttgctgtttatt

SEQ ID NO: 1695301 - DNA, 22 bp, Homo sapiens
atgaagttgctgtttatttttt

SEQ ID NO: 1695302 - DNA, 18 bp, Homo sapiens
atcaagatttttttcctg

SEQ ID NO: 1695303 - DNA, 15 bp, Homo sapiens
atcaagcacttccca

SEQ ID NO: 1695304 - DNA, 18 bp, Homo sapiens
atcaagcaggaattatgt

SEQ ID NO: 1695305 - DNA, 22 bp, Homo sapiens
atcaaggaaaggctcatttaaa

SEQ ID NO: 1695306 - DNA, 15 bp, Homo sapiens
atcaaggagcccaga

SEQ ID NO: 1695307 - DNA, 16 bp, Homo sapiens
atcaaggagcccagaa

SEQ ID NO: 1695308 - DNA, 23 bp, Homo sapiens
atcaagggaatgtaactgctgaa

SEQ ID NO: 1695309 - DNA, 18 bp, Homo sapiens
atcaagttgttgactgtg

SEQ ID NO: 1695310 - DNA, 21 bp, Homo sapiens
atcaagttgttgactgtgatt

SEQ ID NO: 1695311 - DNA, 17 bp, Homo sapiens
atcaataaaatgtgatt

SEQ ID NO: 1695312 - DNA, 20 bp, Homo sapiens
atcaataaaggacaggctgg

SEQ ID NO: 1695313 - DNA, 11 bp, Homo sapiens
atcaatacaca

SEQ ID NO: 1695314 - DNA, 17 bp, Homo sapiens
atcaatacagacaaggt

SEQ ID NO: 1695315 - DNA, 17 bp, Homo sapiens
atcaatacttttgtgta

SEQ ID NO: 1695316 - DNA, 23 bp, Homo sapiens
atcaatacttttgtgtattctgt

SEQ ID NO: 1695317 - DNA, 13 bp, Homo sapiens
atcaatagttgaa

SEQ ID NO: 1695318 - DNA, 18 bp, Homo sapiens
atcaatatctaatatata

SEQ ID NO: 1695319 - DNA, 13 bp, Homo sapiens
atcaatcaaataa

SEQ ID NO: 1695320 - DNA, 21 bp, Homo sapiens
atcaatcatgccctgccttgt

SEQ ID NO: 1695321 - DNA, 13 bp, Homo sapiens
atcaatcctgatt

SEQ ID NO: 1695322 - DNA, 22 bp, Homo sapiens
atcaatcctgggcaatcagaca

SEQ ID NO: 1695323 - DNA, 14 bp, Homo sapiens
atcaatcttgttac

SEQ ID NO: 1695324 - DNA, 15 bp, Homo sapiens
atcaatcttgttact

SEQ ID NO: 1695325 - DNA, 14 bp, Homo sapiens
atcaatgagtaaca

SEQ ID NO: 1695326 - DNA, 22 bp, Homo sapiens
atcaatgcaagagtgattgcag

SEQ ID NO: 1695327 - DNA, 15 bp, Homo sapiens
atcaattaaatgtag

SEQ ID NO: 1695328 - DNA, 18 bp, Homo sapiens
atcaattagatctaaaca

SEQ ID NO: 1695329 - DNA, 20 bp, Homo sapiens
atcaatttgtaattgcttac

SEQ ID NO: 1695330 - DNA, 23 bp, Homo sapiens
atcaattttcattaaacttgaag

SEQ ID NO: 1695331 - DNA, 15 bp, Homo sapiens
atcaatttttcccag

SEQ ID NO: 1695332 - DNA, 19 bp, Homo sapiens
atcaatttttcccagtatt

SEQ ID NO: 1695333 - DNA, 24 bp, Homo sapiens
atcacaaagtggaacgaaaatgaa

SEQ ID NO: 1695334 - DNA, 23 bp, Homo sapiens
atcacacatgaataaagcctttg

SEQ ID NO: 1695335 - DNA, 15 bp, Homo sapiens
atcacacctcagtgg

SEQ ID NO: 1695336 - DNA, 19 bp, Homo sapiens
atcacacctcagtgggaag

SEQ ID NO: 1695337 - DNA, 15 bp, Homo sapiens
atcacacttatattt

SEQ ID NO: 1695338 - DNA, 21 bp, Homo sapiens
atcacacttatattttatgaa

SEQ ID NO: 1695339 - DNA, 15 bp, Homo sapiens
atcacagaggcttct

SEQ ID NO: 1695340 - DNA, 21 bp, Homo sapiens
atcacagatgggtattaaact

SEQ ID NO: 1695341 - DNA, 13 bp, Homo sapiens
atcacagcccagc

SEQ ID NO: 1695342 - DNA, 15 bp, Homo sapiens
atcacagcccagccc

SEQ ID NO: 1695343 - DNA, 14 bp, Homo sapiens
atcacagcttcagc

SEQ ID NO: 1695344 - DNA, 22 bp, Homo sapiens
atcacagcttcagccaggagct

SEQ ID NO: 1695345 - DNA, 21 bp, Homo sapiens
atcacagggccccagaaggca

SEQ ID NO: 1695346 - DNA, 23 bp, Homo sapiens
atcacagtgactttacaggaggt

SEQ ID NO: 1695347 - DNA, 17 bp, Homo sapiens
atcacagtttttcctgg

SEQ ID NO: 1695348 - DNA, 17 bp, Homo sapiens
atcacattaatctcaaa

SEQ ID NO: 1695349 - DNA, 18 bp, Homo sapiens
atcacattaatctcaaag

SEQ ID NO: 1695350 - DNA, 15 bp, Homo sapiens
atcacattatttgca

SEQ ID NO: 1695351 - DNA, 22 bp, Homo sapiens
atcacattatttgcatgttacc

SEQ ID NO: 1695352 - DNA, 16 bp, Homo sapiens
atcacattttattaaa

SEQ ID NO: 1695353 - DNA, 21 bp, Homo sapiens
atcaccagcccggcctgctcc

SEQ ID NO: 1695354 - DNA, 14 bp, Homo sapiens
atcacccttccctg

SEQ ID NO: 1695355 - DNA, 13 bp, Homo sapiens
atcacctctctgt

SEQ ID NO: 1695356 - DNA, 14 bp, Homo sapiens
atcacctctcttca

SEQ ID NO: 1695357 - DNA, 14 bp, Homo sapiens
atcacctctttgcc

SEQ ID NO: 1695358 - DNA, 12 bp, Homo sapiens
atcacctgaggt

SEQ ID NO: 1695359 - DNA, 15 bp, Homo sapiens
atcacctgcctgtta

SEQ ID NO: 1695360 - DNA, 14 bp, Homo sapiens
atcacctgtcatca

SEQ ID NO: 1695361 - DNA, 14 bp, Homo sapiens
atcacgatttgcag

SEQ ID NO: 1695362 - DNA, 14 bp, Homo sapiens
atcacgccactgca

SEQ ID NO: 1695363 - DNA, 20 bp, Homo sapiens
atcacgccactgcactccag

SEQ ID NO: 1695364 - DNA, 23 bp, Homo sapiens
atcacgccattgtactccagcct

SEQ ID NO: 1695365 - DNA, 22 bp, Homo sapiens
atcacggatggtgcatgggctc

SEQ ID NO: 1695366 - DNA, 19 bp, Homo sapiens
atcacggtggtaaagaaag

SEQ ID NO: 1695367 - DNA, 17 bp, Homo sapiens
atcactagaagaaaagc

SEQ ID NO: 1695368 - DNA, 16 bp, Homo sapiens
atcactccctggatgt

SEQ ID NO: 1695369 - DNA, 16 bp, Homo sapiens
atcactctctgctggc

SEQ ID NO: 1695370 - DNA, 15 bp, Homo sapiens
atcactgaatttata

SEQ ID NO: 1695371 - DNA, 21 bp, Homo sapiens
atcactgccacactctccatc

SEQ ID NO: 1695372 - DNA, 22 bp, Homo sapiens
atcactgccctttttgaaatca

SEQ ID NO: 1695373 - DNA, 16 bp, Homo sapiens
atcactggagcccagg

SEQ ID NO: 1695374 - DNA, 17 bp, Homo sapiens
atcactggagcccagga

SEQ ID NO: 1695375 - DNA, 18 bp, Homo sapiens
atcactggcaatgaaaaa

SEQ ID NO: 1695376 - DNA, 12 bp, Homo sapiens
atcactgtaaag

SEQ ID NO: 1695377 - DNA, 18 bp, Homo sapiens
atcactgtatcattttct

SEQ ID NO: 1695378 - DNA, 22 bp, Homo sapiens
atcactgtgaaccaacccccat

SEQ ID NO: 1695379 - DNA, 15 bp, Homo sapiens
atcactgtgctcagc

SEQ ID NO: 1695380 - DNA, 13 bp, Homo sapiens
atcacttgttgtt

SEQ ID NO: 1695381 - DNA, 18 bp, Homo sapiens
atcacttgttttattgac

SEQ ID NO: 1695382 - DNA, 18 bp, Homo sapiens
atcagaaaataaaatatt

SEQ ID NO: 1695383 - DNA, 16 bp, Homo sapiens
atcagaaagctttatt

SEQ ID NO: 1695384 - DNA, 16 bp, Homo sapiens
atcagaaatacaaaaa

SEQ ID NO: 1695385 - DNA, 21 bp, Homo sapiens
atcagaacagggctatttgaa

SEQ ID NO: 1695386 - DNA, 13 bp, Homo sapiens
atcagaagaaagg

SEQ ID NO: 1695387 - DNA, 12 bp, Homo sapiens
atcagaaggaga

SEQ ID NO: 1695388 - DNA, 17 bp, Homo sapiens
atcagaagtatatctgt

SEQ ID NO: 1695389 - DNA, 11 bp, Homo sapiens
atcagaattct

SEQ ID NO: 1695390 - DNA, 12 bp, Homo sapiens
atcagaattctc

SEQ ID NO: 1695391 - DNA, 13 bp, Homo sapiens
atcagacaagcac

SEQ ID NO: 1695392 - DNA, 19 bp, Homo sapiens
atcagacaccctctcctta

SEQ ID NO: 1695393 - DNA, 13 bp, Homo sapiens
atcagacatacag

SEQ ID NO: 1695394 - DNA, 17 bp, Homo sapiens
atcagacatacagctgc

SEQ ID NO: 1695395 - DNA, 14 bp, Homo sapiens
atcagaccctaccc

SEQ ID NO: 1695396 - DNA, 15 bp, Homo sapiens
atcagaccctacccc

SEQ ID NO: 1695397 - DNA, 14 bp, Homo sapiens
atcagacctgtctt

SEQ ID NO: 1695398 - DNA, 15 bp, Homo sapiens
atcagacctgtcttc

SEQ ID NO: 1695399 - DNA, 21 bp, Homo sapiens
atcagacctgtcttccaagga

SEQ ID NO: 1695400 - DNA, 13 bp, Homo sapiens
atcagactgacag

SEQ ID NO: 1695401 - DNA, 16 bp, Homo sapiens
atcagagagtgtacat

SEQ ID NO: 1695402 - DNA, 22 bp, Homo sapiens
atcagagatgcaccaccaagcc

SEQ ID NO: 1695403 - DNA, 21 bp, Homo sapiens
atcagagctcttaatgttgct

SEQ ID NO: 1695404 - DNA, 17 bp, Homo sapiens
atcagagttgctgcaaa

SEQ ID NO: 1695405 - DNA, 14 bp, Homo sapiens
atcagatctgtctt

SEQ ID NO: 1695406 - DNA, 20 bp, Homo sapiens
atcagatgctccaagattct

SEQ ID NO: 1695407 - DNA, 21 bp, Homo sapiens
atcagatgctccaagattcta

SEQ ID NO: 1695408 - DNA, 22 bp, Homo sapiens
atcagatgctccaagattctag

SEQ ID NO: 1695409 - DNA, 23 bp, Homo sapiens
atcagcaaagaaaaaaaaaaaag

SEQ ID NO: 1695410 - DNA, 22 bp, Homo sapiens
atcagcactagaaattgggcag

SEQ ID NO: 1695411 - DNA, 22 bp, Homo sapiens
atcagcattcaaaatagttcta

SEQ ID NO: 1695412 - DNA, 15 bp, Homo sapiens
atcagccacattcta

SEQ ID NO: 1695413 - DNA, 14 bp, Homo sapiens
atcagccatgtttg

SEQ ID NO: 1695414 - DNA, 15 bp, Homo sapiens
atcagccccaccctg

SEQ ID NO: 1695415 - DNA, 22 bp, Homo sapiens
atcagcctgagtctcctgtgcc

SEQ ID NO: 1695416 - DNA, 17 bp, Homo sapiens
atcagcgggtctcctcc

SEQ ID NO: 1695417 - DNA, 18 bp, Homo sapiens
atcagcgggtctcctccc

SEQ ID NO: 1695418 - DNA, 21 bp, Homo sapiens
atcagcgggtctcctcccagc

SEQ ID NO: 1695419 - DNA, 14 bp, Homo sapiens
atcagctatttact

SEQ ID NO: 1695420 - DNA, 15 bp, Homo sapiens
atcagctatttactg

SEQ ID NO: 1695421 - DNA, 13 bp, Homo sapiens
atcagctgaattc

SEQ ID NO: 1695422 - DNA, 15 bp, Homo sapiens
atcagctgaattcac

SEQ ID NO: 1695423 - DNA, 18 bp, Homo sapiens
atcagctgaattcactta

SEQ ID NO: 1695424 - DNA, 12 bp, Homo sapiens
atcagctgctac

SEQ ID NO: 1695425 - DNA, 21 bp, Homo sapiens
atcaggaaatatatatgtgtg

SEQ ID NO: 1695426 - DNA, 14 bp, Homo sapiens
atcaggaagcctgt

SEQ ID NO: 1695427 - DNA, 22 bp, Homo sapiens
atcaggaattctaaataaattt

SEQ ID NO: 1695428 - DNA, 21 bp, Homo sapiens
atcaggatccagtctggaaaa

SEQ ID NO: 1695429 - DNA, 16 bp, Homo sapiens
atcaggccattgtccc

SEQ ID NO: 1695430 - DNA, 21 bp, Homo sapiens
atcagggcaatcccaacacat

SEQ ID NO: 1695431 - DNA, 23 bp, Homo sapiens
atcagggtataaattatatccgt

SEQ ID NO: 1695432 - DNA, 14 bp, Homo sapiens
atcaggtaactttc

SEQ ID NO: 1695433 - DNA, 14 bp, Homo sapiens
atcagtaaataact

SEQ ID NO: 1695434 - DNA, 18 bp, Homo sapiens
atcagtaaataactggaa

SEQ ID NO: 1695435 - DNA, 22 bp, Homo sapiens
atcagtaacccccttaaattta

SEQ ID NO: 1695436 - DNA, 15 bp, Homo sapiens
atcagtattctgaca

SEQ ID NO: 1695437 - DNA, 16 bp, Homo sapiens
atcagtattctgacat

SEQ ID NO: 1695438 - DNA, 20 bp, Homo sapiens
atcagtattctgacatgtaa

SEQ ID NO: 1695439 - DNA, 21 bp, Homo sapiens
atcagtatttttttttaattt

SEQ ID NO: 1695440 - DNA, 22 bp, Homo sapiens
atcagtatttttttttaatttt

SEQ ID NO: 1695441 - DNA, 23 bp, Homo sapiens
atcagtatttttttttaattttg

SEQ ID NO: 1695442 - DNA, 19 bp, Homo sapiens
atcagtcataactaaataa

SEQ ID NO: 1695443 - DNA, 17 bp, Homo sapiens
atcagtcccctcccatc

SEQ ID NO: 1695444 - DNA, 23 bp, Homo sapiens
atcagtcccctcccatctgggag

SEQ ID NO: 1695445 - DNA, 21 bp, Homo sapiens
atcagtcctctttcaaaggta

SEQ ID NO: 1695446 - DNA, 13 bp, Homo sapiens
atcagtgactgaa

SEQ ID NO: 1695447 - DNA, 12 bp, Homo sapiens
atcagtgaggag

SEQ ID NO: 1695448 - DNA, 17 bp, Homo sapiens
atcagtgataattggtt

SEQ ID NO: 1695449 - DNA, 15 bp, Homo sapiens
atcagtgatctatgt

SEQ ID NO: 1695450 - DNA, 19 bp, Homo sapiens
atcagtgatctatgtttgt

SEQ ID NO: 1695451 - DNA, 18 bp, Homo sapiens
atcagtgattttcaaacc

SEQ ID NO: 1695452 - DNA, 19 bp, Homo sapiens
atcagtgattttcaaacct

SEQ ID NO: 1695453 - DNA, 15 bp, Homo sapiens
atcagtgcagtgata

SEQ ID NO: 1695454 - DNA, 13 bp, Homo sapiens
atcagtgtccttt

SEQ ID NO: 1695455 - DNA, 20 bp, Homo sapiens
atcagtgtgtctaaatttga

SEQ ID NO: 1695456 - DNA, 13 bp, Homo sapiens
atcagtgttaaaa

SEQ ID NO: 1695457 - DNA, 19 bp, Homo sapiens
atcagtgttaaaaaatttt

SEQ ID NO: 1695458 - DNA, 10 bp, Homo sapiens
atcagtgttg

SEQ ID NO: 1695459 - DNA, 18 bp, Homo sapiens
atcagttactaagaagaa

SEQ ID NO: 1695460 - DNA, 21 bp, Homo sapiens
atcagttactcagccctgggc

SEQ ID NO: 1695461 - DNA, 18 bp, Homo sapiens
atcagttcattagaaata

SEQ ID NO: 1695462 - DNA, 15 bp, Homo sapiens
atcagttgactttaa

SEQ ID NO: 1695463 - DNA, 21 bp, Homo sapiens
atcagttgactttaagtgaaa

SEQ ID NO: 1695464 - DNA, 22 bp, Homo sapiens
atcagttgtgaatacattcttt

SEQ ID NO: 1695465 - DNA, 22 bp, Homo sapiens
atcagtttgctagcagaaatct

SEQ ID NO: 1695466 - DNA, 12 bp, Homo sapiens
atcataaagcat

SEQ ID NO: 1695467 - DNA, 23 bp, Homo sapiens
atcataactggcttctgcttgtc

SEQ ID NO: 1695468 - DNA, 13 bp, Homo sapiens
atcataaggcttc

SEQ ID NO: 1695469 - DNA, 16 bp, Homo sapiens
atcatacaaactctca

SEQ ID NO: 1695470 - DNA, 12 bp, Homo sapiens
atcatagaaatg

SEQ ID NO: 1695471 - DNA, 15 bp, Homo sapiens
atcatagaaatgtaa

SEQ ID NO: 1695472 - DNA, 21 bp, Homo sapiens
atcatagaattgcagtcattt

SEQ ID NO: 1695473 - DNA, 21 bp, Homo sapiens
atcatagcaagacctcatctc

SEQ ID NO: 1695474 - DNA, 18 bp, Homo sapiens
atcatatgattctgcttt

SEQ ID NO: 1695475 - DNA, 20 bp, Homo sapiens
atcatcaacaagatttcctt

SEQ ID NO: 1695476 - DNA, 16 bp, Homo sapiens
atcatcaagaagggct

SEQ ID NO: 1695477 - DNA, 17 bp, Homo sapiens
atcatcaagaagggctg

SEQ ID NO: 1695478 - DNA, 20 bp, Homo sapiens
atcatcaagaagggctgcat

SEQ ID NO: 1695479 - DNA, 22 bp, Homo sapiens
atcatcaagaagggctgcatga

SEQ ID NO: 1695480 - DNA, 12 bp, Homo sapiens
atcatcactgta

SEQ ID NO: 1695481 - DNA, 17 bp, Homo sapiens
atcatcactgtaaagac

SEQ ID NO: 1695482 - DNA, 21 bp, Homo sapiens
atcatcactgtaaagacaaat

SEQ ID NO: 1695483 - DNA, 14 bp, Homo sapiens
atcatcatcgttgt

SEQ ID NO: 1695484 - DNA, 15 bp, Homo sapiens
atcatcccaacagcc

SEQ ID NO: 1695485 - DNA, 18 bp, Homo sapiens
atcatcccaacagccaag

SEQ ID NO: 1695486 - DNA, 17 bp, Homo sapiens
atcatcctccattgctc

SEQ ID NO: 1695487 - DNA, 19 bp, Homo sapiens
atcatcctttgttctgagc

SEQ ID NO: 1695488 - DNA, 21 bp, Homo sapiens
atcatcctttgttctgagcat

SEQ ID NO: 1695489 - DNA, 24 bp, Homo sapiens
atcatcggagtcagccaggagctg

SEQ ID NO: 1695490 - DNA, 19 bp, Homo sapiens
atcatctaattctctgtgg

SEQ ID NO: 1695491 - DNA, 16 bp, Homo sapiens
atcatctataaagaag

SEQ ID NO: 1695492 - DNA, 18 bp, Homo sapiens
atcatctataaagaagaa

SEQ ID NO: 1695493 - DNA, 22 bp, Homo sapiens
atcatgaaacttgtttcactga

SEQ ID NO: 1695494 - DNA, 23 bp, Homo sapiens
atcatgaaacttgtttcactgaa

SEQ ID NO: 1695495 - DNA, 19 bp, Homo sapiens
atcatgaaaggttaaaaaa

SEQ ID NO: 1695496 - DNA, 16 bp, Homo sapiens
atcatgaaattactta

SEQ ID NO: 1695497 - DNA, 20 bp, Homo sapiens
atcatgaactggcttgtaca

SEQ ID NO: 1695498 - DNA, 21 bp, Homo sapiens
atcatgaactggcttgtacat

SEQ ID NO: 1695499 - DNA, 16 bp, Homo sapiens
atcatgaatgctttta

SEQ ID NO: 1695500 - DNA, 19 bp, Homo sapiens
atcatgaattcccttttaa

SEQ ID NO: 1695501 - DNA, 13 bp, Homo sapiens
atcatgagcctgc

SEQ ID NO: 1695502 - DNA, 16 bp, Homo sapiens
atcatgagcctgctgg

SEQ ID NO: 1695503 - DNA, 22 bp, Homo sapiens
atcatgcatcttactgaaggta

SEQ ID NO: 1695504 - DNA, 14 bp, Homo sapiens
atcatgcgttttat

SEQ ID NO: 1695505 - DNA, 17 bp, Homo sapiens
atcatggcactgcattc

SEQ ID NO: 1695506 - DNA, 19 bp, Homo sapiens
atcatgggaaaagaccagg

SEQ ID NO: 1695507 - DNA, 22 bp, Homo sapiens
atcatgggaaaagaccagggct

SEQ ID NO: 1695508 - DNA, 18 bp, Homo sapiens
atcatgtactttttagta

SEQ ID NO: 1695509 - DNA, 16 bp, Homo sapiens
atcatgtcgatcctgg

SEQ ID NO: 1695510 - DNA, 13 bp, Homo sapiens
atctcttctgcaa

SEQ ID NO: 1695511 - DNA, 20 bp, Homo sapiens
atctcttcttttggcttcca

SEQ ID NO: 1695512 - DNA, 14 bp, Homo sapiens
atctcttgaaacct

SEQ ID NO: 1695513 - DNA, 15 bp, Homo sapiens
atctcttgaggccag

SEQ ID NO: 1695514 - DNA, 19 bp, Homo sapiens
atctctttcacattgtttg

SEQ ID NO: 1695515 - DNA, 16 bp, Homo sapiens
atctctttgatctact

SEQ ID NO: 1695516 - DNA, 11 bp, Homo sapiens
atctcttttat

SEQ ID NO: 1695517 - DNA, 22 bp, Homo sapiens
atctcttttgaatccatgcttg

SEQ ID NO: 1695518 - DNA, 22 bp, Homo sapiens
atctctttttaaaaaactcttt

SEQ ID NO: 1695519 - DNA, 15 bp, Homo sapiens
atctctttttgtttg

SEQ ID NO: 1695520 - DNA, 16 bp, Homo sapiens
atctctttttgtttgc

SEQ ID NO: 1695521 - DNA, 13 bp, Homo sapiens
atctgaaaatatt

SEQ ID NO: 1695522 - DNA, 23 bp, Homo sapiens
atctgaaaatgtatgtgtaagta

SEQ ID NO: 1695523 - DNA, 15 bp, Homo sapiens
atctgaagccctccc

SEQ ID NO: 1695524 - DNA, 18 bp, Homo sapiens
atctgaagccctcccagg

SEQ ID NO: 1695525 - DNA, 15 bp, Homo sapiens
atctgaattttgcaa

SEQ ID NO: 1695526 - DNA, 22 bp, Homo sapiens
atctgaattttgcaatgtattt

SEQ ID NO: 1695527 - DNA, 13 bp, Homo sapiens
atctgacaaaatg

SEQ ID NO: 1695528 - DNA, 17 bp, Homo sapiens
atctgaccatctgtgac

SEQ ID NO: 1695529 - DNA, 15 bp, Homo sapiens
atctgacccactttg

SEQ ID NO: 1695530 - DNA, 21 bp, Homo sapiens
atctgacccactttgtaattt

SEQ ID NO: 1695531 - DNA, 14 bp, Homo sapiens
atctgactatgaca

SEQ ID NO: 1695532 - DNA, 12 bp, Homo sapiens
atctgactgcca

SEQ ID NO: 1695533 - DNA, 13 bp, Homo sapiens
atctgactgccaa

SEQ ID NO: 1695534 - DNA, 14 bp, Homo sapiens
atctgactgccaaa

SEQ ID NO: 1695535 - DNA, 15 bp, Homo sapiens
atctgactgccaagc

SEQ ID NO: 1695536 - DNA, 19 bp, Homo sapiens
atctgagagacctgtgtga

SEQ ID NO: 1695537 - DNA, 18 bp, Homo sapiens
atctgagcaaggagttta

SEQ ID NO: 1695538 - DNA, 23 bp, Homo sapiens
atctgaggaatcaacagggcagc

SEQ ID NO: 1695539 - DNA, 18 bp, Homo sapiens
atctgaggatgaccagaa

SEQ ID NO: 1695540 - DNA, 23 bp, Homo sapiens
atctgagggaggaggccacctct

SEQ ID NO: 1695541 - DNA, 21 bp, Homo sapiens
atctgaggttggatttgctca

SEQ ID NO: 1695542 - DNA, 20 bp, Homo sapiens
atctgatagaatgatgtttt

SEQ ID NO: 1695543 - DNA, 20 bp, Homo sapiens
atctgatcaagagtccggat

SEQ ID NO: 1695544 - DNA, 15 bp, Homo sapiens
atctgatctgtacca

SEQ ID NO: 1695545 - DNA, 22 bp, Homo sapiens
atctgcaaagcatgttttgcat

SEQ ID NO: 1695546 - DNA, 15 bp, Homo sapiens
atctgcaaatagttt

SEQ ID NO: 1695547 - DNA, 23 bp, Homo sapiens
atctgcaaatagtttcaaatgag

SEQ ID NO: 1695548 - DNA, 17 bp, Homo sapiens
atctgcaagaacactgg

SEQ ID NO: 1695549 - DNA, 15 bp, Homo sapiens
atctgcaatatgaat

SEQ ID NO: 1695550 - DNA, 21 bp, Homo sapiens
atctgcaattcaaaagttcca

SEQ ID NO: 1695551 - DNA, 18 bp, Homo sapiens
atctgcaccccttctctc

SEQ ID NO: 1695552 - DNA, 20 bp, Homo sapiens
atctgcaccccttctctcct

SEQ ID NO: 1695553 - DNA, 21 bp, Homo sapiens
atctgcaccccttctctcctc

SEQ ID NO: 1695554 - DNA, 21 bp, Homo sapiens
atctgcaccctcgatgaagcc

SEQ ID NO: 1695555 - DNA, 13 bp, Homo sapiens
atagtttctgagg

SEQ ID NO: 1695556 - DNA, 19 bp, Homo sapiens
atagtttctgaggctttat

SEQ ID NO: 1695557 - DNA, 15 bp, Homo sapiens
atagtttgtctattt

SEQ ID NO: 1695558 - DNA, 16 bp, Homo sapiens
atagtttgtctatttt

SEQ ID NO: 1695559 - DNA, 20 bp, Homo sapiens
atatatatgtgtgtgtatgt

SEQ ID NO: 1695560 - DNA, 14 bp, Homo sapiens
atatatattaagtg

SEQ ID NO: 1695561 - DNA, 10 bp, Homo sapiens
atatatattt

SEQ ID NO: 1695562 - DNA, 13 bp, Homo sapiens
atatatatttcta

SEQ ID NO: 1695563 - DNA, 15 bp, Homo sapiens
atatatattttaagg

SEQ ID NO: 1695564 - DNA, 16 bp, Homo sapiens
atatatcaaagtgaga

SEQ ID NO: 1695565 - DNA, 15 bp, Homo sapiens
atatatcaagaagtc

SEQ ID NO: 1695566 - DNA, 16 bp, Homo sapiens
atatatccctgataaa

SEQ ID NO: 1695567 - DNA, 20 bp, Homo sapiens
atatatccctgataaatatt

SEQ ID NO: 1695568 - DNA, 17 bp, Homo sapiens
atatatctacaatatat

SEQ ID NO: 1695569 - DNA, 19 bp, Homo sapiens
atatatctatatcatattt

SEQ ID NO: 1695570 - DNA, 23 bp, Homo sapiens
atatatctatatcatatttctgt

SEQ ID NO: 1695571 - DNA, 17 bp, Homo sapiens
atatatctctatttgag

SEQ ID NO: 1695572 - DNA, 21 bp, Homo sapiens
atatatctgttggagaaagaa

SEQ ID NO: 1695573 - DNA, 12 bp, Homo sapiens
atatatgaataa

SEQ ID NO: 1695574 - DNA, 12 bp, Homo sapiens
atatatgacttc

SEQ ID NO: 1695575 - DNA, 15 bp, Homo sapiens
atatatgcacacata

SEQ ID NO: 1695576 - DNA, 13 bp, Homo sapiens
atatatgcttttg

SEQ ID NO: 1695577 - DNA, 20 bp, Homo sapiens
atatatgtataatatatatc

SEQ ID NO: 1695578 - DNA, 19 bp, Homo sapiens
atatatgtatatgtatata

SEQ ID NO: 1695579 - DNA, 20 bp, Homo sapiens
atatatgtatatgtatatat

SEQ ID NO: 1695580 - DNA, 15 bp, Homo sapiens
atatatgtgtttttc

SEQ ID NO: 1695581 - DNA, 14 bp, Homo sapiens
atatatgtttacct

SEQ ID NO: 1695582 - DNA, 20 bp, Homo sapiens
atatatgtttaccttttaat

SEQ ID NO: 1695583 - DNA, 17 bp, Homo sapiens
atatattaaaacaataa

SEQ ID NO: 1695584 - DNA, 16 bp, Homo sapiens
atatattaaaattcca

SEQ ID NO: 1695585 - DNA, 20 bp, Homo sapiens
atatattaaaattccaaatt

SEQ ID NO: 1695586 - DNA, 16 bp, Homo sapiens
atatattattataatc

SEQ ID NO: 1695587 - DNA, 13 bp, Homo sapiens
atatattgtatta

SEQ ID NO: 1695588 - DNA, 14 bp, Homo sapiens
atatatttaaaggg

SEQ ID NO: 1695589 - DNA, 17 bp, Homo sapiens
atatatttaacaatgac

SEQ ID NO: 1695590 - DNA, 18 bp, Homo sapiens
atatatttaacaatgaca

SEQ ID NO: 1695591 - DNA, 10 bp, Homo sapiens
atatatttat

SEQ ID NO: 1695592 - DNA, 13 bp, Homo sapiens
atatatttataac

SEQ ID NO: 1695593 - DNA, 16 bp, Homo sapiens
atatatttataactca

SEQ ID NO: 1695594 - DNA, 14 bp, Homo sapiens
atatatttcccctt

SEQ ID NO: 1695595 - DNA, 13 bp, Homo sapiens
atatatttctatt

SEQ ID NO: 1695596 - DNA, 16 bp, Homo sapiens
atatatttgaaatagt

SEQ ID NO: 1695597 - DNA, 15 bp, Homo sapiens
atatatttgcagtat

SEQ ID NO: 1695598 - DNA, 11 bp, Homo sapiens
atatattttaa

SEQ ID NO: 1695599 - DNA, 20 bp, Homo sapiens
atatattttaaggttgcaca

SEQ ID NO: 1695600 - DNA, 16 bp, Homo sapiens
atatattttcagtaca

SEQ ID NO: 1695601 - DNA, 14 bp, Homo sapiens
atatatttttaaga

SEQ ID NO: 1695602 - DNA, 23 bp, Homo sapiens
atatatttttaagataataatat

SEQ ID NO: 1695603 - DNA, 14 bp, Homo sapiens
atatatttttcaca

SEQ ID NO: 1695604 - DNA, 15 bp, Homo sapiens
atatatttttcacag

SEQ ID NO: 1695605 - DNA, 17 bp, Homo sapiens
atatattttttaatttg

SEQ ID NO: 1695606 - DNA, 23 bp, Homo sapiens
atatattttttaatttgatgaaa

SEQ ID NO: 1695607 - DNA, 20 bp, Homo sapiens
atatcaaaaaacctttacag

SEQ ID NO: 1695608 - DNA, 21 bp, Homo sapiens
atatcaaaaaacctttacagt

SEQ ID NO: 1695609 - DNA, 17 bp, Homo sapiens
atatcaaacatgcacac

SEQ ID NO: 1695610 - DNA, 15 bp, Homo sapiens
atatcaaataaaata

SEQ ID NO: 1695611 - DNA, 21 bp, Homo sapiens
atatcaacagatagttgtgtt

SEQ ID NO: 1695612 - DNA, 18 bp, Homo sapiens
atatcaactctgaagcta

SEQ ID NO: 1695613 - DNA, 20 bp, Homo sapiens
atatcaactctgaagctaat

SEQ ID NO: 1695614 - DNA, 17 bp, Homo sapiens
atatcacacaatatagt

SEQ ID NO: 1695615 - DNA, 17 bp, Homo sapiens
atatcacctctcttcag

SEQ ID NO: 1695616 - DNA, 19 bp, Homo sapiens
atatcactaatttcttctt

SEQ ID NO: 1695617 - DNA, 12 bp, Homo sapiens
atatcacttaaa

SEQ ID NO: 1695618 - DNA, 14 bp, Homo sapiens
atatcagcctgagt

SEQ ID NO: 1695619 - DNA, 21 bp, Homo sapiens
atatcagcctgagtctcctgt

SEQ ID NO: 1695620 - DNA, 14 bp, Homo sapiens
atatcagctttgat

SEQ ID NO: 1695621 - DNA, 19 bp, Homo sapiens
atatcagctttgataattg

SEQ ID NO: 1695622 - DNA, 17 bp, Homo sapiens
atatcaggctattattt

SEQ ID NO: 1695623 - DNA, 23 bp, Homo sapiens
atatcaggctattatttattgta

SEQ ID NO: 1695624 - DNA, 23 bp, Homo sapiens
atatcagtaacccccttaaattt

SEQ ID NO: 1695625 - DNA, 14 bp, Homo sapiens
atatcagtattctg

SEQ ID NO: 1695626 - DNA, 15 bp, Homo sapiens
atatcagtattctga

SEQ ID NO: 1695627 - DNA, 21 bp, Homo sapiens
atatcagtattctgacatgta

SEQ ID NO: 1695628 - DNA, 17 bp, Homo sapiens
atatcagttactcagcc

SEQ ID NO: 1695629 - DNA, 18 bp, Homo sapiens
atatcagttactcagccc

SEQ ID NO: 1695630 - DNA, 21 bp, Homo sapiens
atatcagttactcagccctgg

SEQ ID NO: 1695631 - DNA, 13 bp, Homo sapiens
atatcatatgtat

SEQ ID NO: 1695632 - DNA, 14 bp, Homo sapiens
atatcatatgtata

SEQ ID NO: 1695633 - DNA, 14 bp, Homo sapiens
atatcatatttctg

SEQ ID NO: 1695634 - DNA, 23 bp, Homo sapiens
atatcattataactgaaggagaa

SEQ ID NO: 1695635 - DNA, 20 bp, Homo sapiens
atatcattcagcatctactc

SEQ ID NO: 1695636 - DNA, 15 bp, Homo sapiens
atatcattctaaaga

SEQ ID NO: 1695637 - DNA, 13 bp, Homo sapiens
atatcatttactc

SEQ ID NO: 1695638 - DNA, 12 bp, Homo sapiens
atatccaaaagc

SEQ ID NO: 1695639 - DNA, 15 bp, Homo sapiens
atatccaagtaccaa

SEQ ID NO: 1695640 - DNA, 12 bp, Homo sapiens
atatccatcttt

SEQ ID NO: 1695641 - DNA, 14 bp, Homo sapiens
atatccattctcgt

SEQ ID NO: 1695642 - DNA, 17 bp, Homo sapiens
atatccatttatctttt

SEQ ID NO: 1695643 - DNA, 15 bp, Homo sapiens
atatccctcttgtaa

SEQ ID NO: 1695644 - DNA, 16 bp, Homo sapiens
atatccctcttgtaag

SEQ ID NO: 1695645 - DNA, 16 bp, Homo sapiens
atatcctatactggtt

SEQ ID NO: 1695646 - DNA, 13 bp, Homo sapiens
atatcctgcctca

SEQ ID NO: 1695647 - DNA, 17 bp, Homo sapiens
atatcctggtgtctagt

SEQ ID NO: 1695648 - DNA, 19 bp, Homo sapiens
atatcctggtgtctagttt

SEQ ID NO: 1695649 - DNA, 20 bp, Homo sapiens
atatcctgtgactgtctcac

SEQ ID NO: 1695650 - DNA, 19 bp, Homo sapiens
atatcgctgatgcagacac

SEQ ID NO: 1695651 - DNA, 21 bp, Homo sapiens
atatcgctgatgcagacacag

SEQ ID NO: 1695652 - DNA, 22 bp, Homo sapiens
atatctaaagctttggacaagt

SEQ ID NO: 1695653 - DNA, 13 bp, Homo sapiens
atatctaatatat

SEQ ID NO: 1695654 - DNA, 14 bp, Homo sapiens
atatctagtatgaa

SEQ ID NO: 1695655 - DNA, 15 bp, Homo sapiens
atatctagtatgaaa

SEQ ID NO: 1695656 - DNA, 15 bp, Homo sapiens
atatctataaaatag

SEQ ID NO: 1695657 - DNA, 15 bp, Homo sapiens
atatctatatatata

SEQ ID NO: 1695658 - DNA, 17 bp, Homo sapiens
atatctatatatataat

SEQ ID NO: 1695659 - DNA, 15 bp, Homo sapiens
atatctatatcatat

SEQ ID NO: 1695660 - DNA, 16 bp, Homo sapiens
atatctatatcatatt

SEQ ID NO: 1695661 - DNA, 22 bp, Homo sapiens
atatctattaatatatgtatta

SEQ ID NO: 1695662 - DNA, 17 bp, Homo sapiens
atatctcctttgtattc

SEQ ID NO: 1695663 - DNA, 13 bp, Homo sapiens
atatctctatttg

SEQ ID NO: 1695664 - DNA, 14 bp, Homo sapiens
atatctctatttga

SEQ ID NO: 1695665 - DNA, 22 bp, Homo sapiens
atatctctgccaacatgaggac

SEQ ID NO: 1695666 - DNA, 14 bp, Homo sapiens
atatctgaaaatat

SEQ ID NO: 1695667 - DNA, 22 bp, Homo sapiens
atatctgaaaatgtatgtgtaa

SEQ ID NO: 1695668 - DNA, 15 bp, Homo sapiens
atatctgaagccctc

SEQ ID NO: 1695669 - DNA, 14 bp, Homo sapiens
atatctgagagacc

SEQ ID NO: 1695670 - DNA, 15 bp, Homo sapiens
atatctgagagacct

SEQ ID NO: 1695671 - DNA, 15 bp, Homo sapiens
atatctggacaagcc

SEQ ID NO: 1695672 - DNA, 19 bp, Homo sapiens
atatctggcactgttaata

SEQ ID NO: 1695673 - DNA, 21 bp, Homo sapiens
atatctgtaaatttaactgca

SEQ ID NO: 1695674 - DNA, 20 bp, Homo sapiens
atatctgtatttaattttga

SEQ ID NO: 1695675 - DNA, 15 bp, Homo sapiens
atagcttctgtgtgt

SEQ ID NO: 1695676 - DNA, 23 bp, Homo sapiens
atagctttattttttaagtattt

SEQ ID NO: 1695677 - DNA, 14 bp, Homo sapiens
atagcttttcctgt

SEQ ID NO: 1695678 - DNA, 22 bp, Homo sapiens
atagcttttcctgttaaggcag

SEQ ID NO: 1695679 - DNA, 18 bp, Homo sapiens
ataggaacatatgaaaat

SEQ ID NO: 1695680 - DNA, 21 bp, Homo sapiens
ataggaacatatgaaaataca

SEQ ID NO: 1695681 - DNA, 18 bp, Homo sapiens
ataggaagggatctgaga

SEQ ID NO: 1695682 - DNA, 19 bp, Homo sapiens
ataggaagggatctgagaa

SEQ ID NO: 1695683 - DNA, 21 bp, Homo sapiens
ataggaatgtccaccatgaac

SEQ ID NO: 1695684 - DNA, 12 bp, Homo sapiens
ataggaatttgt

SEQ ID NO: 1695685 - DNA, 14 bp, Homo sapiens
ataggacctttcca

SEQ ID NO: 1695686 - DNA, 17 bp, Homo sapiens
ataggactaccgcaggc

SEQ ID NO: 1695687 - DNA, 22 bp, Homo sapiens
ataggactcaaagtttcagaga

SEQ ID NO: 1695688 - DNA, 23 bp, Homo sapiens
ataggatattgctaattgtgtat

SEQ ID NO: 1695689 - DNA, 23 bp, Homo sapiens
ataggatcatttgttggaatgaa

SEQ ID NO: 1695690 - DNA, 22 bp, Homo sapiens
ataggatgattccgtgtgtgta

SEQ ID NO: 1695691 - DNA, 19 bp, Homo sapiens
ataggatgtcagacaatac

SEQ ID NO: 1695692 - DNA, 16 bp, Homo sapiens
ataggatttttagaat

SEQ ID NO: 1695693 - DNA, 20 bp, Homo sapiens
ataggcagactgggtttcta

SEQ ID NO: 1695694 - DNA, 17 bp, Homo sapiens
ataggcggtcatgtgtg

SEQ ID NO: 1695695 - DNA, 21 bp, Homo sapiens
ataggcggtcatgtgtgcatg

SEQ ID NO: 1695696 - DNA, 12 bp, Homo sapiens
ataggctctgca

SEQ ID NO: 1695697 - DNA, 19 bp, Homo sapiens
ataggctggtggccttggg

SEQ ID NO: 1695698 - DNA, 17 bp, Homo sapiens
atagggctgagctctct

SEQ ID NO: 1695699 - DNA, 17 bp, Homo sapiens
atagggcttttaaataa

SEQ ID NO: 1695700 - DNA, 14 bp, Homo sapiens
ataggggaaagaag

SEQ ID NO: 1695701 - DNA, 18 bp, Homo sapiens
atagggggaagacagata

SEQ ID NO: 1695702 - DNA, 14 bp, Homo sapiens
atagggtctaactc

SEQ ID NO: 1695703 - DNA, 18 bp, Homo sapiens
ataggtatatagaacaca

SEQ ID NO: 1695704 - DNA, 19 bp, Homo sapiens
ataggtatatagaacacaa

SEQ ID NO: 1695705 - DNA, 15 bp, Homo sapiens
ataggtcactggctc

SEQ ID NO: 1695706 - DNA, 19 bp, Homo sapiens
ataggtcactggctctcca

SEQ ID NO: 1695707 - DNA, 22 bp, Homo sapiens
ataggtcactggctctccaagt

SEQ ID NO: 1695708 - DNA, 17 bp, Homo sapiens
ataggtcagagatgggc

SEQ ID NO: 1695709 - DNA, 17 bp, Homo sapiens
ataggtctgtatggctg

SEQ ID NO: 1695710 - DNA, 19 bp, Homo sapiens
ataggtgatgtttgctctt

SEQ ID NO: 1695711 - DNA, 14 bp, Homo sapiens
ataggtgctacaaa

SEQ ID NO: 1695712 - DNA, 17 bp, Homo sapiens
ataggttactacctata

SEQ ID NO: 1695713 - DNA, 14 bp, Homo sapiens
ataggttatatgca

SEQ ID NO: 1695714 - DNA, 14 bp, Homo sapiens
atagtaaaatacct

SEQ ID NO: 1695715 - DNA, 23 bp, Homo sapiens
atagtaaacattaagtaaatgct

SEQ ID NO: 1695716 - DNA, 18 bp, Homo sapiens
atagtaacatcaaagatt

SEQ ID NO: 1695717 - DNA, 21 bp, Homo sapiens
atagtaactactttttatact

SEQ ID NO: 1695718 - DNA, 22 bp, Homo sapiens
atagtaactactttttatactc

SEQ ID NO: 1695719 - DNA, 13 bp, Homo sapiens
atagtaagattga

SEQ ID NO: 1695720 - DNA, 13 bp, Homo sapiens
atagtaagcatag

SEQ ID NO: 1695721 - DNA, 23 bp, Homo sapiens
atagtaatataatacacaaaatc

SEQ ID NO: 1695722 - DNA, 15 bp, Homo sapiens
atagtactaagcatt

SEQ ID NO: 1695723 - DNA, 15 bp, Homo sapiens
atagtagatttgaac

SEQ ID NO: 1695724 - DNA, 16 bp, Homo sapiens
atagtagcatacattt

SEQ ID NO: 1695725 - DNA, 17 bp, Homo sapiens
atagtagcatacattta

SEQ ID NO: 1695726 - DNA, 18 bp, Homo sapiens
atagtagttaaataactg

SEQ ID NO: 1695727 - DNA, 17 bp, Homo sapiens
atagtagttacttgtga

SEQ ID NO: 1695728 - DNA, 14 bp, Homo sapiens
atagtataacttta

SEQ ID NO: 1695729 - DNA, 15 bp, Homo sapiens
atagtataactttaa

SEQ ID NO: 1695730 - DNA, 14 bp, Homo sapiens
atagtatacattgt

SEQ ID NO: 1695731 - DNA, 16 bp, Homo sapiens
atagtatatttatact

SEQ ID NO: 1695732 - DNA, 22 bp, Homo sapiens
atagtatctgtatataagttgc

SEQ ID NO: 1695733 - DNA, 19 bp, Homo sapiens
atagtatgagggttgaaga

SEQ ID NO: 1695734 - DNA, 20 bp, Homo sapiens
atagtatgagggttgaagac

SEQ ID NO: 1695735 - DNA, 20 bp, Homo sapiens
atagtatttgagagttctaa

SEQ ID NO: 1695736 - DNA, 21 bp, Homo sapiens
atagtatttgagagttctaaa

SEQ ID NO: 1695737 - DNA, 23 bp, Homo sapiens
atagtatttgagagttctaaatt

SEQ ID NO: 1695738 - DNA, 13 bp, Homo sapiens
atagtcacctgct

SEQ ID NO: 1695739 - DNA, 14 bp, Homo sapiens
atagtcacctgctg

SEQ ID NO: 1695740 - DNA, 16 bp, Homo sapiens
atagtcacctgctggt

SEQ ID NO: 1695741 - DNA, 14 bp, Homo sapiens
atagtcagctctga

SEQ ID NO: 1695742 - DNA, 14 bp, Homo sapiens
atagtcagctgcct

SEQ ID NO: 1695743 - DNA, 16 bp, Homo sapiens
atagtcattccaaata

SEQ ID NO: 1695744 - DNA, 23 bp, Homo sapiens
atagtctaagactatatatataa

SEQ ID NO: 1695745 - DNA, 20 bp, Homo sapiens
atagtctgattttaatgaaa

SEQ ID NO: 1695746 - DNA, 23 bp, Homo sapiens
atagtcttgaaatgaaagggaaa

SEQ ID NO: 1695747 - DNA, 15 bp, Homo sapiens
atagtgaatacttac

SEQ ID NO: 1695748 - DNA, 23 bp, Homo sapiens
atagtgaatacttactataattt

SEQ ID NO: 1695749 - DNA, 17 bp, Homo sapiens
atagtgacttttcaagt

SEQ ID NO: 1695750 - DNA, 18 bp, Homo sapiens
atagtgacttttcaagta

SEQ ID NO: 1695751 - DNA, 18 bp, Homo sapiens
atagtgcaacatctctga

SEQ ID NO: 1695752 - DNA, 22 bp, Homo sapiens
atagtgccaggaaactaatttc

SEQ ID NO: 1695753 - DNA, 18 bp, Homo sapiens
atagtgcctaaaattgta

SEQ ID NO: 1695754 - DNA, 20 bp, Homo sapiens
atagtgggcaccccactgca

SEQ ID NO: 1695755 - DNA, 17 bp, Homo sapiens
atagtgggtacatcaag

SEQ ID NO: 1695756 - DNA, 19 bp, Homo sapiens
atagtgtaaactgaaacat

SEQ ID NO: 1695757 - DNA, 14 bp, Homo sapiens
atagtgtaacttgc

SEQ ID NO: 1695758 - DNA, 18 bp, Homo sapiens
atagtgtaagaactgtac

SEQ ID NO: 1695759 - DNA, 19 bp, Homo sapiens
atagtgtaagaactgtaca

SEQ ID NO: 1695760 - DNA, 19 bp, Homo sapiens
atagtgtagctgaggaggc

SEQ ID NO: 1695761 - DNA, 18 bp, Homo sapiens
atagtgtcatataaactc

SEQ ID NO: 1695762 - DNA, 21 bp, Homo sapiens
atagtgtcatataaactcatt

SEQ ID NO: 1695763 - DNA, 14 bp, Homo sapiens
atagtgtgaaatat

SEQ ID NO: 1695764 - DNA, 16 bp, Homo sapiens
atagtgttcacaaact

SEQ ID NO: 1695765 - DNA, 19 bp, Homo sapiens
atagtgttcacaaactgtg

SEQ ID NO: 1695766 - DNA, 20 bp, Homo sapiens
atagtgttcacaaactgtga

SEQ ID NO: 1695767 - DNA, 21 bp, Homo sapiens
atagtgttcacaaactgtgaa

SEQ ID NO: 1695768 - DNA, 16 bp, Homo sapiens
atagtgttctgctcct

SEQ ID NO: 1695769 - DNA, 17 bp, Homo sapiens
atagtgttctgctcctg

SEQ ID NO: 1695770 - DNA, 19 bp, Homo sapiens
atagtgttctgctcctgct

SEQ ID NO: 1695771 - DNA, 20 bp, Homo sapiens
atagtgttctgctcctgctt

SEQ ID NO: 1695772 - DNA, 22 bp, Homo sapiens
atagttaagcgtgcataagtta

SEQ ID NO: 1695773 - DNA, 18 bp, Homo sapiens
atagttactgtgtaatta

SEQ ID NO: 1695774 - DNA, 13 bp, Homo sapiens
atagttctagaca

SEQ ID NO: 1695775 - DNA, 14 bp, Homo sapiens
atagttctagacat

SEQ ID NO: 1695776 - DNA, 23 bp, Homo sapiens
atagttctagacatggaggttct

SEQ ID NO: 1695777 - DNA, 20 bp, Homo sapiens
atagttctatttctatctgc

SEQ ID NO: 1695778 - DNA, 16 bp, Homo sapiens
atagttgaacaagatt

SEQ ID NO: 1695779 - DNA, 18 bp, Homo sapiens
atagttgcatagcagtat

SEQ ID NO: 1695780 - DNA, 21 bp, Homo sapiens
atagttgcatagcagtatatg

SEQ ID NO: 1695781 - DNA, 18 bp, Homo sapiens
atagttgtagacaaagta

SEQ ID NO: 1695782 - DNA, 19 bp, Homo sapiens
atagtttcaaatctgtaat

SEQ ID NO: 1695783 - DNA, 23 bp, Homo sapiens
atactttgaaaggagatgtcttg

SEQ ID NO: 1695784 - DNA, 23 bp, Homo sapiens
atactttgacaaggaaaatctat

SEQ ID NO: 1695785 - DNA, 18 bp, Homo sapiens
atactttgcaatccaaat

SEQ ID NO: 1695786 - DNA, 9 bp, Homo sapiens
atactttgt

SEQ ID NO: 1695787 - DNA, 13 bp, Homo sapiens
atactttgtattt

SEQ ID NO: 1695788 - DNA, 18 bp, Homo sapiens
atactttgttctgttgtc

SEQ ID NO: 1695789 - DNA, 23 bp, Homo sapiens
atacttttaaagttttgtcagaa

SEQ ID NO: 1695790 - DNA, 18 bp, Homo sapiens
atacttttgtgtattctg

SEQ ID NO: 1695791 - DNA, 19 bp, Homo sapiens
atactttttaaatgtaaag

SEQ ID NO: 1695792 - DNA, 23 bp, Homo sapiens
atagaaaaattcagcaaaccatt

SEQ ID NO: 1695793 - DNA, 23 bp, Homo sapiens
atagaaaacctaattaaggaagt

SEQ ID NO: 1695794 - DNA, 14 bp, Homo sapiens
atagaaaattattt

SEQ ID NO: 1695795 - DNA, 14 bp, Homo sapiens
atagaaacatgaca

SEQ ID NO: 1695796 - DNA, 21 bp, Homo sapiens
atagaaacatgacactgacct

SEQ ID NO: 1695797 - DNA, 12 bp, Homo sapiens
atagaaagctat

SEQ ID NO: 1695798 - DNA, 17 bp, Homo sapiens
atagaaagctggactga

SEQ ID NO: 1695799 - DNA, 20 bp, Homo sapiens
atagaaagctggactgacca

SEQ ID NO: 1695800 - DNA, 21 bp, Homo sapiens
atagaaagctgtttatttatt

SEQ ID NO: 1695801 - DNA, 18 bp, Homo sapiens
atagaaataaattcctaa

SEQ ID NO: 1695802 - DNA, 19 bp, Homo sapiens
atagaaatggtttcctctg

SEQ ID NO: 1695803 - DNA, 22 bp, Homo sapiens
atagaaatggtttcctctggat

SEQ ID NO: 1695804 - DNA, 21 bp, Homo sapiens
atagaaatgtaggtcctcaga

SEQ ID NO: 1695805 - DNA, 19 bp, Homo sapiens
atagaacaggacctctgct

SEQ ID NO: 1695806 - DNA, 15 bp, Homo sapiens
atagaactctgggct

SEQ ID NO: 1695807 - DNA, 16 bp, Homo sapiens
atagaactgtactgtt

SEQ ID NO: 1695808 - DNA, 21 bp, Homo sapiens
atagaactgtcccacaaaata

SEQ ID NO: 1695809 - DNA, 23 bp, Homo sapiens
atagaactgtcccacaaaatatt

SEQ ID NO: 1695810 - DNA, 19 bp, Homo sapiens
atagaaggatgtacatttc

SEQ ID NO: 1695811 - DNA, 17 bp, Homo sapiens
atagaagtctggaaaaa

SEQ ID NO: 1695812 - DNA, 13 bp, Homo sapiens
atagaagttttat

SEQ ID NO: 1695813 - DNA, 18 bp, Homo sapiens
atagaataaaatataatt

SEQ ID NO: 1695814 - DNA, 14 bp, Homo sapiens
atagaataattctt

SEQ ID NO: 1695815 - DNA, 21 bp, Homo sapiens
atagaatacattttgtatatt

SEQ ID NO: 1695816 - DNA, 13 bp, Homo sapiens
atagaatagcaca

SEQ ID NO: 1695817 - DNA, 18 bp, Homo sapiens
atagaatagcacagccag

SEQ ID NO: 1695818 - DNA, 20 bp, Homo sapiens
atagaatagcacagccagac

SEQ ID NO: 1695819 - DNA, 13 bp, Homo sapiens
atagaatatttat

SEQ ID NO: 1695820 - DNA, 14 bp, Homo sapiens
atagaatgatgttt

SEQ ID NO: 1695821 - DNA, 24 bp, Homo sapiens
atagacagtaaaatactattctca

SEQ ID NO: 1695822 - DNA, 12 bp, Homo sapiens
atagacatgaaa

SEQ ID NO: 1695823 - DNA, 16 bp, Homo sapiens
atagacatttgtaaat

SEQ ID NO: 1695824 - DNA, 18 bp, Homo sapiens
atagacattttggggttt

SEQ ID NO: 1695825 - DNA, 13 bp, Homo sapiens
atagaccaaagca

SEQ ID NO: 1695826 - DNA, 15 bp, Homo sapiens
atagaccaaagcaaa

SEQ ID NO: 1695827 - DNA, 22 bp, Homo sapiens
atagaccctctttcttgtttgt

SEQ ID NO: 1695828 - DNA, 23 bp, Homo sapiens
atagaccctctttcttgtttgtc

SEQ ID NO: 1695829 - DNA, 17 bp, Homo sapiens
atagacgggttgaaaga

SEQ ID NO: 1695830 - DNA, 18 bp, Homo sapiens
atagacgggttgaaagac

SEQ ID NO: 1695831 - DNA, 22 bp, Homo sapiens
atagacgggttgaaagacatca

SEQ ID NO: 1695832 - DNA, 19 bp, Homo sapiens
atagactgaggtataaaga

SEQ ID NO: 1695833 - DNA, 20 bp, Homo sapiens
atagagacaggacagaatgt

SEQ ID NO: 1695834 - DNA, 17 bp, Homo sapiens
atagagagggggctctc

SEQ ID NO: 1695835 - DNA, 17 bp, Homo sapiens
atagagcaaaattgatg

SEQ ID NO: 1695836 - DNA, 19 bp, Homo sapiens
atagagcagaaattctgtt

SEQ ID NO: 1695837 - DNA, 12 bp, Homo sapiens
atagagctttta

SEQ ID NO: 1695838 - DNA, 22 bp, Homo sapiens
atagagctttttaatagcacta

SEQ ID NO: 1695839 - DNA, 14 bp, Homo sapiens
atagaggcccaggc

SEQ ID NO: 1695840 - DNA, 16 bp, Homo sapiens
atagaggcccaggcac

SEQ ID NO: 1695841 - DNA, 20 bp, Homo sapiens
atagaggctagcttctgctt

SEQ ID NO: 1695842 - DNA, 14 bp, Homo sapiens
atagaggtgagaaa

SEQ ID NO: 1695843 - DNA, 19 bp, Homo sapiens
atagagtgtacttaactat

SEQ ID NO: 1695844 - DNA, 14 bp, Homo sapiens
atagagtgttatca

SEQ ID NO: 1695845 - DNA, 15 bp, Homo sapiens
atagagtttgctatt

SEQ ID NO: 1695846 - DNA, 16 bp, Homo sapiens
atagatacaaaacctt

SEQ ID NO: 1695847 - DNA, 15 bp, Homo sapiens
atagatatataaata

SEQ ID NO: 1695848 - DNA, 16 bp, Homo sapiens
atagatcaataaatgt

SEQ ID NO: 1695849 - DNA, 17 bp, Homo sapiens
atagatcaataaatgtc

SEQ ID NO: 1695850 - DNA, 12 bp, Homo sapiens
atagatcttctg

SEQ ID NO: 1695851 - DNA, 18 bp, Homo sapiens
atagatgataaaagagaa

SEQ ID NO: 1695852 - DNA, 21 bp, Homo sapiens
atagatgcaagatatttatat

SEQ ID NO: 1695853 - DNA, 17 bp, Homo sapiens
atagatgtaatttttca

SEQ ID NO: 1695854 - DNA, 21 bp, Homo sapiens
atagatgtaatttttcaaaat

SEQ ID NO: 1695855 - DNA, 18 bp, Homo sapiens
atagatgtctaggtactt

SEQ ID NO: 1695856 - DNA, 16 bp, Homo sapiens
atagatgtctcaaaaa

SEQ ID NO: 1695857 - DNA, 15 bp, Homo sapiens
atagattataacttg

SEQ ID NO: 1695858 - DNA, 20 bp, Homo sapiens
atagattattataaactata

SEQ ID NO: 1695859 - DNA, 14 bp, Homo sapiens
atagattctaaaga

SEQ ID NO: 1695860 - DNA, 18 bp, Homo sapiens
atagattctaaagattct

SEQ ID NO: 1695861 - DNA, 19 bp, Homo sapiens
atagattctcttgtataag

SEQ ID NO: 1695862 - DNA, 22 bp, Homo sapiens
atagattgtccggccgctttgt

SEQ ID NO: 1695863 - DNA, 19 bp, Homo sapiens
atagcaaatgttttgacat

SEQ ID NO: 1695864 - DNA, 19 bp, Homo sapiens
atagcaagacacatcccta

SEQ ID NO: 1695865 - DNA, 19 bp, Homo sapiens
atagcagatctgttttgtg

SEQ ID NO: 1695866 - DNA, 17 bp, Homo sapiens
atagcagctttgtctct

SEQ ID NO: 1695867 - DNA, 18 bp, Homo sapiens
atagcatatgacaaatgt

SEQ ID NO: 1695868 - DNA, 19 bp, Homo sapiens
atagcatatgacaaatgtt

SEQ ID NO: 1695869 - DNA, 20 bp, Homo sapiens
atagcatgacaggctgttca

SEQ ID NO: 1695870 - DNA, 19 bp, Homo sapiens
atagcatgacatttctttg

SEQ ID NO: 1695871 - DNA, 21 bp, Homo sapiens
atagcatgcttcctttctctc

SEQ ID NO: 1695872 - DNA, 14 bp, Homo sapiens
atagcatgggaggt

SEQ ID NO: 1695873 - DNA, 15 bp, Homo sapiens
atagccaaagccagg

SEQ ID NO: 1695874 - DNA, 22 bp, Homo sapiens
atagccatcgactcctgcctga

SEQ ID NO: 1695875 - DNA, 18 bp, Homo sapiens
atagccccagactgggcc

SEQ ID NO: 1695876 - DNA, 21 bp, Homo sapiens
atagccccagactgggcccag

SEQ ID NO: 1695877 - DNA, 22 bp, Homo sapiens
atagccctgccctcccaagtcc

SEQ ID NO: 1695878 - DNA, 22 bp, Homo sapiens
atagccctgggtaccctgagcc

SEQ ID NO: 1695879 - DNA, 19 bp, Homo sapiens
atagcctatggcagaaaaa

SEQ ID NO: 1695880 - DNA, 12 bp, Homo sapiens
atagcctgaatt

SEQ ID NO: 1695881 - DNA, 16 bp, Homo sapiens
atagcctgaatttgag

SEQ ID NO: 1695882 - DNA, 20 bp, Homo sapiens
atagcgatgtgcaggaagaa

SEQ ID NO: 1695883 - DNA, 18 bp, Homo sapiens
atagcgtcctgccctgcc

SEQ ID NO: 1695884 - DNA, 14 bp, Homo sapiens
atagctaactgtaa

SEQ ID NO: 1695885 - DNA, 15 bp, Homo sapiens
atagctaactgtaaa

SEQ ID NO: 1695886 - DNA, 13 bp, Homo sapiens
atagctcagttta

SEQ ID NO: 1695887 - DNA, 19 bp, Homo sapiens
atagctctactgccctccc

SEQ ID NO: 1695888 - DNA, 17 bp, Homo sapiens
atacatgtgtacatata

SEQ ID NO: 1695889 - DNA, 18 bp, Homo sapiens
atacatgtgtacatatat

SEQ ID NO: 1695890 - DNA, 14 bp, Homo sapiens
atacatgtttatgt

SEQ ID NO: 1695891 - DNA, 16 bp, Homo sapiens
atacattctttttgct

SEQ ID NO: 1695892 - DNA, 21 bp, Homo sapiens
atacattctttttgctctaaa

SEQ ID NO: 1695893 - DNA, 15 bp, Homo sapiens
atacatttataatgt

SEQ ID NO: 1695894 - DNA, 20 bp, Homo sapiens
atacatttctcctttgataa

SEQ ID NO: 1695895 - DNA, 19 bp, Homo sapiens
atacatttgaggggaaaac

SEQ ID NO: 1695896 - DNA, 18 bp, Homo sapiens
atacatttgtattttgtg

SEQ ID NO: 1695897 - DNA, 22 bp, Homo sapiens
atacatttgtattttgtgatga

SEQ ID NO: 1695898 - DNA, 16 bp, Homo sapiens
atacattttctaaata

SEQ ID NO: 1695899 - DNA, 21 bp, Homo sapiens
atacattttgtatattaactt

SEQ ID NO: 1695900 - DNA, 21 bp, Homo sapiens
atacattttgttatagaatac

SEQ ID NO: 1695901 - DNA, 22 bp, Homo sapiens
atacattttgttatagaatact

SEQ ID NO: 1695902 - DNA, 24 bp, Homo sapiens
ataccaaatagcttctgttttgtt

SEQ ID NO: 1695903 - DNA, 20 bp, Homo sapiens
ataccacaaaccctgctgaa

SEQ ID NO: 1695904 - DNA, 20 bp, Homo sapiens
ataccacaagcctgagaact

SEQ ID NO: 1695905 - DNA, 13 bp, Homo sapiens
ataccacttgaat

SEQ ID NO: 1695906 - DNA, 21 bp, Homo sapiens
ataccagagccttcaagtgcc

SEQ ID NO: 1695907 - DNA, 23 bp, Homo sapiens
ataccagagccttcaagtgccaa

SEQ ID NO: 1695908 - DNA, 11 bp, Homo sapiens
ataccagggaa

SEQ ID NO: 1695909 - DNA, 15 bp, Homo sapiens
ataccatctgctgcc

SEQ ID NO: 1695910 - DNA, 15 bp, Homo sapiens
ataccatgtctctaa

SEQ ID NO: 1695911 - DNA, 17 bp, Homo sapiens
ataccattaaaactgct

SEQ ID NO: 1695912 - DNA, 18 bp, Homo sapiens
ataccattaaaactgctt

SEQ ID NO: 1695913 - DNA, 19 bp, Homo sapiens
ataccattaaaactgcttt

SEQ ID NO: 1695914 - DNA, 20 bp, Homo sapiens
ataccattattatcaagtag

SEQ ID NO: 1695915 - DNA, 22 bp, Homo sapiens
ataccattttttaaggaaacaa

SEQ ID NO: 1695916 - DNA, 18 bp, Homo sapiens
atacccatagcttccatg

SEQ ID NO: 1695917 - DNA, 15 bp, Homo sapiens
atacccccaggaaac

SEQ ID NO: 1695918 - DNA, 16 bp, Homo sapiens
atacccccaggaaact

SEQ ID NO: 1695919 - DNA, 12 bp, Homo sapiens
ataccctccccc

SEQ ID NO: 1695920 - DNA, 17 bp, Homo sapiens
ataccggacttgtcaca

SEQ ID NO: 1695921 - DNA, 18 bp, Homo sapiens
atacctcaacctatggta

SEQ ID NO: 1695922 - DNA, 18 bp, Homo sapiens
atacctccattaaatggt

SEQ ID NO: 1695923 - DNA, 21 bp, Homo sapiens
atacctcctccctaatgctca

SEQ ID NO: 1695924 - DNA, 17 bp, Homo sapiens
atacctctgtgtgctcc

SEQ ID NO: 1695925 - DNA, 19 bp, Homo sapiens
atacctggcttttacttta

SEQ ID NO: 1695926 - DNA, 20 bp, Homo sapiens
atacctggcttttactttat

SEQ ID NO: 1695927 - DNA, 13 bp, Homo sapiens
ataccttatttat

SEQ ID NO: 1695928 - DNA, 21 bp, Homo sapiens
ataccttatttatttttgtgt

SEQ ID NO: 1695929 - DNA, 13 bp, Homo sapiens
ataccttcttatt

SEQ ID NO: 1695930 - DNA, 19 bp, Homo sapiens
atacctttttcttaaaaaa

SEQ ID NO: 1695931 - DNA, 14 bp, Homo sapiens
atacgaaacacaaa

SEQ ID NO: 1695932 - DNA, 16 bp, Homo sapiens
atacgagagcagaggt

SEQ ID NO: 1695933 - DNA, 17 bp, Homo sapiens
atacgatttaaggtatt

SEQ ID NO: 1695934 - DNA, 21 bp, Homo sapiens
atacgcctgtagtcctagcca

SEQ ID NO: 1695935 - DNA, 20 bp, Homo sapiens
atacgctactataaagagaa

SEQ ID NO: 1695936 - DNA, 21 bp, Homo sapiens
atacggaaaaaattgtattga

SEQ ID NO: 1695937 - DNA, 15 bp, Homo sapiens
atacgtatacaataa

SEQ ID NO: 1695938 - DNA, 20 bp, Homo sapiens
atacgtccgtgtgtcccaga

SEQ ID NO: 1695939 - DNA, 20 bp, Homo sapiens
atacgtgccagatataactg

SEQ ID NO: 1695940 - DNA, 21 bp, Homo sapiens
atacgtgccagatataactgt

SEQ ID NO: 1695941 - DNA, 17 bp, Homo sapiens
atacgtgttaggaggct

SEQ ID NO: 1695942 - DNA, 21 bp, Homo sapiens
atacgtttgtgcagaatctct

SEQ ID NO: 1695943 - DNA, 16 bp, Homo sapiens
atacgttttggtgttg

SEQ ID NO: 1695944 - DNA, 19 bp, Homo sapiens
atactactgaaacagattt

SEQ ID NO: 1695945 - DNA, 16 bp, Homo sapiens
atactaggtgcctttt

SEQ ID NO: 1695946 - DNA, 14 bp, Homo sapiens
atactatatttatg

SEQ ID NO: 1695947 - DNA, 19 bp, Homo sapiens
atactattaagcaagaatg

SEQ ID NO: 1695948 - DNA, 21 bp, Homo sapiens
atactatttaaagcctcctca

SEQ ID NO: 1695949 - DNA, 18 bp, Homo sapiens
atactatttaagatgtga

SEQ ID NO: 1695950 - DNA, 19 bp, Homo sapiens
atactatttaagatgtgaa

SEQ ID NO: 1695951 - DNA, 20 bp, Homo sapiens
atactatttagtttttgtaa

SEQ ID NO: 1695952 - DNA, 15 bp, Homo sapiens
atactcaccaaaata

SEQ ID NO: 1695953 - DNA, 16 bp, Homo sapiens
atactcaccaaaatat

SEQ ID NO: 1695954 - DNA, 16 bp, Homo sapiens
atactcatttttcatt

SEQ ID NO: 1695955 - DNA, 17 bp, Homo sapiens
atactcatttttcatta

SEQ ID NO: 1695956 - DNA, 22 bp, Homo sapiens
atactcctcccctcttctcttt

SEQ ID NO: 1695957 - DNA, 14 bp, Homo sapiens
atactcctgtcacc

SEQ ID NO: 1695958 - DNA, 21 bp, Homo sapiens
atactcctgtcacctagaacg

SEQ ID NO: 1695959 - DNA, 22 bp, Homo sapiens
atactcctgtcacctagaacgt

SEQ ID NO: 1695960 - DNA, 18 bp, Homo sapiens
atactctagaacatgcac

SEQ ID NO: 1695961 - DNA, 20 bp, Homo sapiens
atactctagaacatgcacat

SEQ ID NO: 1695962 - DNA, 15 bp, Homo sapiens
atactctcagcacca

SEQ ID NO: 1695963 - DNA, 22 bp, Homo sapiens
atactctgctatttctcttgct

SEQ ID NO: 1695964 - DNA, 16 bp, Homo sapiens
atactctgtcagatgg

SEQ ID NO: 1695965 - DNA, 13 bp, Homo sapiens
atactcttgaaag

SEQ ID NO: 1695966 - DNA, 17 bp, Homo sapiens
atactgattgggaggtg

SEQ ID NO: 1695967 - DNA, 14 bp, Homo sapiens
atactgatttaatt

SEQ ID NO: 1695968 - DNA, 19 bp, Homo sapiens
atactgcacagtggcacaa

SEQ ID NO: 1695969 - DNA, 21 bp, Homo sapiens
atactgcatactttttaaatg

SEQ ID NO: 1695970 - DNA, 22 bp, Homo sapiens
atactgcatatcctggtgtcta

SEQ ID NO: 1695971 - DNA, 23 bp, Homo sapiens
atactgcatgtaagccaagtcat

SEQ ID NO: 1695972 - DNA, 23 bp, Homo sapiens
atactgcccaaggataggtattt

SEQ ID NO: 1695973 - DNA, 22 bp, Homo sapiens
atactgctacagcaatttctaa

SEQ ID NO: 1695974 - DNA, 12 bp, Homo sapiens
atactgctctga

SEQ ID NO: 1695975 - DNA, 23 bp, Homo sapiens
atactgcttgtcatctgcatgtc

SEQ ID NO: 1695976 - DNA, 16 bp, Homo sapiens
atactggaagttttgc

SEQ ID NO: 1695977 - DNA, 20 bp, Homo sapiens
atactggaagttttgcattt

SEQ ID NO: 1695978 - DNA, 12 bp, Homo sapiens
atactggactca

SEQ ID NO: 1695979 - DNA, 16 bp, Homo sapiens
atactggactcaggaa

SEQ ID NO: 1695980 - DNA, 20 bp, Homo sapiens
atactggactcaggaacttt

SEQ ID NO: 1695981 - DNA, 15 bp, Homo sapiens
atactggaggaacac

SEQ ID NO: 1695982 - DNA, 16 bp, Homo sapiens
atactgggttcttgtt

SEQ ID NO: 1695983 - DNA, 23 bp, Homo sapiens
atactgggttcttgttttatata

SEQ ID NO: 1695984 - DNA, 14 bp, Homo sapiens
atactggtctcagg

SEQ ID NO: 1695985 - DNA, 14 bp, Homo sapiens
atactggttatagt

SEQ ID NO: 1695986 - DNA, 21 bp, Homo sapiens
atactggttatagttgatatg

SEQ ID NO: 1695987 - DNA, 17 bp, Homo sapiens
atactgtacttaataaa

SEQ ID NO: 1695988 - DNA, 14 bp, Homo sapiens
atactgtgaaatac

SEQ ID NO: 1695989 - DNA, 16 bp, Homo sapiens
atactgttattctttg

SEQ ID NO: 1695990 - DNA, 22 bp, Homo sapiens
atactgttattctttgcacttt

SEQ ID NO: 1695991 - DNA, 16 bp, Homo sapiens
atactgtttgtaatat

SEQ ID NO: 1695992 - DNA, 14 bp, Homo sapiens
atacttaaatgtta

SEQ ID NO: 1695993 - DNA, 17 bp, Homo sapiens
atacttaaatgttatgt

SEQ ID NO: 1695994 - DNA, 20 bp, Homo sapiens
atacttaaatgttatgtata

SEQ ID NO: 1695995 - DNA, 21 bp, Homo sapiens
atacttaaatgttatgtatat

SEQ ID NO: 1695996 - DNA, 16 bp, Homo sapiens
atacttaagcaaaagt

SEQ ID NO: 1695997 - DNA, 22 bp, Homo sapiens
atacttagcaaagttttacctg

SEQ ID NO: 1695998 - DNA, 22 bp, Homo sapiens
atacttatgcaagatatttttg

SEQ ID NO: 1695999 - DNA, 17 bp, Homo sapiens
atacttcaaaactgttt

SEQ ID NO: 1696000 - DNA, 12 bp, Homo sapiens
atacttcctgga

SEQ ID NO: 1696001 - DNA, 22 bp, Homo sapiens
atacttcctggattttctttct

SEQ ID NO: 1696002 - DNA, 21 bp, Homo sapiens
atacttctcaaacctgtttaa

SEQ ID NO: 1696003 - DNA, 19 bp, Homo sapiens
ataattaacacttaaggtt

SEQ ID NO: 1696004 - DNA, 22 bp, Homo sapiens
ataattacagtgcctaaaataa

SEQ ID NO: 1696005 - DNA, 12 bp, Homo sapiens
ataattacattc

SEQ ID NO: 1696006 - DNA, 15 bp, Homo sapiens
ataattacattccta

SEQ ID NO: 1696007 - DNA, 13 bp, Homo sapiens
ataattacattgg

SEQ ID NO: 1696008 - DNA, 22 bp, Homo sapiens
ataattacattggcacaatgta

SEQ ID NO: 1696009 - DNA, 17 bp, Homo sapiens
ataattatccagagttt

SEQ ID NO: 1696010 - DNA, 16 bp, Homo sapiens
ataattcatttgtatt

SEQ ID NO: 1696011 - DNA, 22 bp, Homo sapiens
ataattcctatatcctgtgact

SEQ ID NO: 1696012 - DNA, 15 bp, Homo sapiens
ataattccttggtga

SEQ ID NO: 1696013 - DNA, 14 bp, Homo sapiens
ataattctactttg

SEQ ID NO: 1696014 - DNA, 23 bp, Homo sapiens
ataattctgagttttgtgtttgt

SEQ ID NO: 1696015 - DNA, 19 bp, Homo sapiens
ataattcttgtatattatg

SEQ ID NO: 1696016 - DNA, 14 bp, Homo sapiens
ataattgcattcat

SEQ ID NO: 1696017 - DNA, 13 bp, Homo sapiens
ataattgtacaaa

SEQ ID NO: 1696018 - DNA, 22 bp, Homo sapiens
ataattgtgaccaatacatttg

SEQ ID NO: 1696019 - DNA, 23 bp, Homo sapiens
ataattgtgaccaatacatttgt

SEQ ID NO: 1696020 - DNA, 20 bp, Homo sapiens
ataattgtgattagacagaa

SEQ ID NO: 1696021 - DNA, 15 bp, Homo sapiens
ataattgtggattat

SEQ ID NO: 1696022 - DNA, 14 bp, Homo sapiens
ataattgtgtgata

SEQ ID NO: 1696023 - DNA, 17 bp, Homo sapiens
ataattgtgtgatattt

SEQ ID NO: 1696024 - DNA, 19 bp, Homo sapiens
ataattgtgtgatatttca

SEQ ID NO: 1696025 - DNA, 12 bp, Homo sapiens
ataattgtttcc

SEQ ID NO: 1696026 - DNA, 15 bp, Homo sapiens
ataatttaatgcatg

SEQ ID NO: 1696027 - DNA, 17 bp, Homo sapiens
ataatttacaagatatt

SEQ ID NO: 1696028 - DNA, 23 bp, Homo sapiens
ataatttacctaagattacaaat

SEQ ID NO: 1696029 - DNA, 19 bp, Homo sapiens
ataatttatacaggtcata

SEQ ID NO: 1696030 - DNA, 21 bp, Homo sapiens
ataatttatacaggtcatatt

SEQ ID NO: 1696031 - DNA, 21 bp, Homo sapiens
ataatttcccaattaggaagt

SEQ ID NO: 1696032 - DNA, 22 bp, Homo sapiens
ataatttcccaattaggaagtg

SEQ ID NO: 1696033 - DNA, 14 bp, Homo sapiens
ataatttgaatgta

SEQ ID NO: 1696034 - DNA, 19 bp, Homo sapiens
ataatttgtacaatggttt

SEQ ID NO: 1696035 - DNA, 20 bp, Homo sapiens
ataatttgtacaatggttta

SEQ ID NO: 1696036 - DNA, 14 bp, Homo sapiens
ataattttaagaaa

SEQ ID NO: 1696037 - DNA, 15 bp, Homo sapiens
ataattttaagaaat

SEQ ID NO: 1696038 - DNA, 15 bp, Homo sapiens
ataattttatgaatg

SEQ ID NO: 1696039 - DNA, 15 bp, Homo sapiens
ataatttttaaagta

SEQ ID NO: 1696040 - DNA, 16 bp, Homo sapiens
ataatttttacctaat

SEQ ID NO: 1696041 - DNA, 17 bp, Homo sapiens
atacaaaagctttttaa

SEQ ID NO: 1696042 - DNA, 17 bp, Homo sapiens
atacaaatggattttgg

SEQ ID NO: 1696043 - DNA, 18 bp, Homo sapiens
atacaaattaattttact

SEQ ID NO: 1696044 - DNA, 19 bp, Homo sapiens
atacaaatttggccttaag

SEQ ID NO: 1696045 - DNA, 19 bp, Homo sapiens
atacaaattttcagaaggt

SEQ ID NO: 1696046 - DNA, 13 bp, Homo sapiens
atacaacacatct

SEQ ID NO: 1696047 - DNA, 17 bp, Homo sapiens
atacaacaccaaaaaat

SEQ ID NO: 1696048 - DNA, 15 bp, Homo sapiens
atacaactgcctggg

SEQ ID NO: 1696049 - DNA, 17 bp, Homo sapiens
atacaagaaaatgtatc

SEQ ID NO: 1696050 - DNA, 17 bp, Homo sapiens
atacaagattgaaaatc

SEQ ID NO: 1696051 - DNA, 22 bp, Homo sapiens
atacaagccattctaaggaaat

SEQ ID NO: 1696052 - DNA, 19 bp, Homo sapiens
atacaaggcaagcattttt

SEQ ID NO: 1696053 - DNA, 19 bp, Homo sapiens
atacaagttcttggtccct

SEQ ID NO: 1696054 - DNA, 19 bp, Homo sapiens
atacaagtttcagacaggg

SEQ ID NO: 1696055 - DNA, 12 bp, Homo sapiens
atacaataaact

SEQ ID NO: 1696056 - DNA, 20 bp, Homo sapiens
atacaataaactattggaaa

SEQ ID NO: 1696057 - DNA, 21 bp, Homo sapiens
atacaatcagcccagtgcaaa

SEQ ID NO: 1696058 - DNA, 17 bp, Homo sapiens
atacaatgaacacttat

SEQ ID NO: 1696059 - DNA, 18 bp, Homo sapiens
atacaatgaacacttata

SEQ ID NO: 1696060 - DNA, 17 bp, Homo sapiens
atacaatggaataaatt

SEQ ID NO: 1696061 - DNA, 17 bp, Homo sapiens
atacaatgtacaattat

SEQ ID NO: 1696062 - DNA, 18 bp, Homo sapiens
atacaatgtatgtacaat

SEQ ID NO: 1696063 - DNA, 12 bp, Homo sapiens
atacaatttgta

SEQ ID NO: 1696064 - DNA, 14 bp, Homo sapiens
atacaatttgtact

SEQ ID NO: 1696065 - DNA, 20 bp, Homo sapiens
atacacacatgccctcctgg

SEQ ID NO: 1696066 - DNA, 19 bp, Homo sapiens
atacacagtactttattgt

SEQ ID NO: 1696067 - DNA, 22 bp, Homo sapiens
atacacatttgctactgttgta

SEQ ID NO: 1696068 - DNA, 21 bp, Homo sapiens
atacaccacctcactcctgtt

SEQ ID NO: 1696069 - DNA, 18 bp, Homo sapiens
atacaccgggcctggaga

SEQ ID NO: 1696070 - DNA, 19 bp, Homo sapiens
atacactccacttgaagca

SEQ ID NO: 1696071 - DNA, 21 bp, Homo sapiens
atacactgtagtttttgaaaa

SEQ ID NO: 1696072 - DNA, 22 bp, Homo sapiens
atacactgtagtttttgaaaat

SEQ ID NO: 1696073 - DNA, 14 bp, Homo sapiens
atacactgtatcta

SEQ ID NO: 1696074 - DNA, 14 bp, Homo sapiens
atacactgtgaact

SEQ ID NO: 1696075 - DNA, 13 bp, Homo sapiens
atacacttacact

SEQ ID NO: 1696076 - DNA, 15 bp, Homo sapiens
atacactttgttgca

SEQ ID NO: 1696077 - DNA, 21 bp, Homo sapiens
atacactttgttgcaagatgt

SEQ ID NO: 1696078 - DNA, 20 bp, Homo sapiens
atacagaatcttgttttgaa

SEQ ID NO: 1696079 - DNA, 23 bp, Homo sapiens
atacagacactaagttatagtat

SEQ ID NO: 1696080 - DNA, 13 bp, Homo sapiens
atacagacattca

SEQ ID NO: 1696081 - DNA, 18 bp, Homo sapiens
atacagataattcatttg

SEQ ID NO: 1696082 - DNA, 21 bp, Homo sapiens
atacagataattcatttgtat

SEQ ID NO: 1696083 - DNA, 15 bp, Homo sapiens
atacagctgcactga

SEQ ID NO: 1696084 - DNA, 13 bp, Homo sapiens
atacaggaaacag

SEQ ID NO: 1696085 - DNA, 15 bp, Homo sapiens
atacaggaaacagtt

SEQ ID NO: 1696086 - DNA, 16 bp, Homo sapiens
atacaggaaacagttg

SEQ ID NO: 1696087 - DNA, 17 bp, Homo sapiens
atacaggaggatgtgaa

SEQ ID NO: 1696088 - DNA, 21 bp, Homo sapiens
atacagggcatgcattttgca

SEQ ID NO: 1696089 - DNA, 21 bp, Homo sapiens
atacaggtcatattaatatat

SEQ ID NO: 1696090 - DNA, 20 bp, Homo sapiens
atacagtaactttatgtgta

SEQ ID NO: 1696091 - DNA, 14 bp, Homo sapiens
atacagtgtacatg

SEQ ID NO: 1696092 - DNA, 18 bp, Homo sapiens
atacagtgtacatgtaca

SEQ ID NO: 1696093 - DNA, 21 bp, Homo sapiens
atacataatatatgacttcct

SEQ ID NO: 1696094 - DNA, 23 bp, Homo sapiens
atacataggtctgtatggctgta

SEQ ID NO: 1696095 - DNA, 19 bp, Homo sapiens
atacatatttttgtagcac

SEQ ID NO: 1696096 - DNA, 17 bp, Homo sapiens
atacatgccacatcaaa

SEQ ID NO: 1696097 - DNA, 20 bp, Homo sapiens
atacatggaatcgaagtgtt

SEQ ID NO: 1696098 - DNA, 22 bp, Homo sapiens
atacatgtaattctaccaaggt

SEQ ID NO: 1696099 - DNA, 18 bp, Homo sapiens
atacatgtgatacatttt

SEQ ID NO: 1696100 - DNA, 13 bp, Homo sapiens
atacatgtgtaca

SEQ ID NO: 1696101 - DNA, 14 bp, Homo sapiens
atacatgtgtacat

SEQ ID NO: 1696102 - DNA, 18 bp, Homo sapiens
atgccagagccaacctgg

SEQ ID NO: 1696103 - DNA, 21 bp, Homo sapiens
atgccagagccaacctggact

SEQ ID NO: 1696104 - DNA, 24 bp, Homo sapiens
atgccagagccaacctggacttcc

SEQ ID NO: 1696105 - DNA, 11 bp, Homo sapiens
atgccagaggg

SEQ ID NO: 1696106 - DNA, 17 bp, Homo sapiens
atgccagagggccagca

SEQ ID NO: 1696107 - DNA, 18 bp, Homo sapiens
atgccagagggccagcag

SEQ ID NO: 1696108 - DNA, 20 bp, Homo sapiens
atgccagagggccagcaggc

SEQ ID NO: 1696109 - DNA, 18 bp, Homo sapiens
atgccagctcagtcccat

SEQ ID NO: 1696110 - DNA, 17 bp, Homo sapiens
atgccagcttctctctc

SEQ ID NO: 1696111 - DNA, 21 bp, Homo sapiens
atgccagcttctctctccagg

SEQ ID NO: 1696112 - DNA, 15 bp, Homo sapiens
atgccaggacccgcc

SEQ ID NO: 1696113 - DNA, 19 bp, Homo sapiens
atgccaggacccgccagcc

SEQ ID NO: 1696114 - DNA, 22 bp, Homo sapiens
atgccaggccagagggcagtgg

SEQ ID NO: 1696115 - DNA, 12 bp, Homo sapiens
atgccaggtgca

SEQ ID NO: 1696116 - DNA, 22 bp, Homo sapiens
atgccagtaacgcgtcttcctg

SEQ ID NO: 1696117 - DNA, 23 bp, Homo sapiens
atgccagtaacgcgtcttcctga

SEQ ID NO: 1696118 - DNA, 13 bp, Homo sapiens
atgccagtatttt

SEQ ID NO: 1696119 - DNA, 15 bp, Homo sapiens
atgccatgaacaaat

SEQ ID NO: 1696120 - DNA, 18 bp, Homo sapiens
atgccatgaacaaattct

SEQ ID NO: 1696121 - DNA, 13 bp, Homo sapiens
atgccatgaatga

SEQ ID NO: 1696122 - DNA, 21 bp, Homo sapiens
atgccatggcctgtgctgggc

SEQ ID NO: 1696123 - DNA, 16 bp, Homo sapiens
atgccattacagaacc

SEQ ID NO: 1696124 - DNA, 18 bp, Homo sapiens
atgccatttagaatctag

SEQ ID NO: 1696125 - DNA, 20 bp, Homo sapiens
atgccatttagaatctagaa

SEQ ID NO: 1696126 - DNA, 18 bp, Homo sapiens
atgcccaccccctgccct

SEQ ID NO: 1696127 - DNA, 20 bp, Homo sapiens
atgcccaccccctgccctgc

SEQ ID NO: 1696128 - DNA, 21 bp, Homo sapiens
atgcccacctgcccatcacag

SEQ ID NO: 1696129 - DNA, 22 bp, Homo sapiens
atgcccagagggcccaggcagg

SEQ ID NO: 1696130 - DNA, 19 bp, Homo sapiens
atgcccagatgaactgact

SEQ ID NO: 1696131 - DNA, 21 bp, Homo sapiens
atgcccagctaatttttgtat

SEQ ID NO: 1696132 - DNA, 13 bp, Homo sapiens
atgcccagctctc

SEQ ID NO: 1696133 - DNA, 20 bp, Homo sapiens
atgccccaggatcactctct

SEQ ID NO: 1696134 - DNA, 12 bp, Homo sapiens
atgccccagtcg

SEQ ID NO: 1696135 - DNA, 13 bp, Homo sapiens
atgcccccctcaa

SEQ ID NO: 1696136 - DNA, 10 bp, Homo sapiens
atgccccctg

SEQ ID NO: 1696137 - DNA, 14 bp, Homo sapiens
atgccccctgctta

SEQ ID NO: 1696138 - DNA, 13 bp, Homo sapiens
atgccccctttca

SEQ ID NO: 1696139 - DNA, 19 bp, Homo sapiens
atgccccctttcagatgtc

SEQ ID NO: 1696140 - DNA, 21 bp, Homo sapiens
atgccccctttcagatgtctt

SEQ ID NO: 1696141 - DNA, 22 bp, Homo sapiens
atgcccctgcagtttggccctg

SEQ ID NO: 1696142 - DNA, 14 bp, Homo sapiens
atgcccgcctagtt

SEQ ID NO: 1696143 - DNA, 16 bp, Homo sapiens
atgcccgttgtctagg

SEQ ID NO: 1696144 - DNA, 22 bp, Homo sapiens
atgcccgttgtctaggagacag

SEQ ID NO: 1696145 - DNA, 19 bp, Homo sapiens
atgccctcatacccatgca

SEQ ID NO: 1696146 - DNA, 12 bp, Homo sapiens
atgcccttcact

SEQ ID NO: 1696147 - DNA, 16 bp, Homo sapiens
atgcccttctgattcc

SEQ ID NO: 1696148 - DNA, 16 bp, Homo sapiens
atgccggatgtgcttt

SEQ ID NO: 1696149 - DNA, 17 bp, Homo sapiens
atgccggatgtgctttt

SEQ ID NO: 1696150 - DNA, 14 bp, Homo sapiens
atgccgtcttctgc

SEQ ID NO: 1696151 - DNA, 20 bp, Homo sapiens
atgccgtcttctgccctaac

SEQ ID NO: 1696152 - DNA, 22 bp, Homo sapiens
atgccgtggattgcacgtggcc

SEQ ID NO: 1696153 - DNA, 21 bp, Homo sapiens
atgccgttctgttccaacctc

SEQ ID NO: 1696154 - DNA, 18 bp, Homo sapiens
atgcctcagcctctcaag

SEQ ID NO: 1696155 - DNA, 18 bp, Homo sapiens
atgcctcatgccacacct

SEQ ID NO: 1696156 - DNA, 16 bp, Homo sapiens
atgcctcgctcccttc

SEQ ID NO: 1696157 - DNA, 15 bp, Homo sapiens
atgcctctcccgcac

SEQ ID NO: 1696158 - DNA, 23 bp, Homo sapiens
atgcctctcccgcaccaggccgg

SEQ ID NO: 1696159 - DNA, 21 bp, Homo sapiens
atgcctctgatatgggactga

SEQ ID NO: 1696160 - DNA, 13 bp, Homo sapiens
atgcctcttaaat

SEQ ID NO: 1696161 - DNA, 22 bp, Homo sapiens
atgcctgagttataaatatttt

SEQ ID NO: 1696162 - DNA, 20 bp, Homo sapiens
atgcctgattcggacggcca

SEQ ID NO: 1696163 - DNA, 18 bp, Homo sapiens
atgcctgcccgcaccctg

SEQ ID NO: 1696164 - DNA, 17 bp, Homo sapiens
atgcctgctccctgtct

SEQ ID NO: 1696165 - DNA, 18 bp, Homo sapiens
atgcctgctccctgtctg

SEQ ID NO: 1696166 - DNA, 21 bp, Homo sapiens
atgcctgctccctgtctgtgt

SEQ ID NO: 1696167 - DNA, 22 bp, Homo sapiens
atgcctgctccctgtctgtgtc

SEQ ID NO: 1696168 - DNA, 16 bp, Homo sapiens
atgcctgcttgataat

SEQ ID NO: 1696169 - DNA, 18 bp, Homo sapiens
atgcctgctttttggaaa

SEQ ID NO: 1696170 - DNA, 19 bp, Homo sapiens
atgcctgctttttggaaag

SEQ ID NO: 1696171 - DNA, 18 bp, Homo sapiens
atgcctgtaatcccagaa

SEQ ID NO: 1696172 - DNA, 19 bp, Homo sapiens
atgcctgtaatcccagaac

SEQ ID NO: 1696173 - DNA, 22 bp, Homo sapiens
atgcctgtagctttcctggtcc

SEQ ID NO: 1696174 - DNA, 24 bp, Homo sapiens
atgcctgtagctttcctggtccct

SEQ ID NO: 1696175 - DNA, 20 bp, Homo sapiens
atgcctgtatttccaacaaa

SEQ ID NO: 1696176 - DNA, 18 bp, Homo sapiens
atgctattgttgtgggct

SEQ ID NO: 1696177 - DNA, 22 bp, Homo sapiens
atgctatttatgcaagttaggg

SEQ ID NO: 1696178 - DNA, 15 bp, Homo sapiens
atgctatttgaacaa

SEQ ID NO: 1696179 - DNA, 17 bp, Homo sapiens
atgctcaaccactgtgg

SEQ ID NO: 1696180 - DNA, 15 bp, Homo sapiens
atgctcattttctgg

SEQ ID NO: 1696181 - DNA, 17 bp, Homo sapiens
atgctccaagattctag

SEQ ID NO: 1696182 - DNA, 18 bp, Homo sapiens
atgctccaagattctaga

SEQ ID NO: 1696183 - DNA, 14 bp, Homo sapiens
atgctccactattt

SEQ ID NO: 1696184 - DNA, 22 bp, Homo sapiens
atgctccagcaacacagcctgg

SEQ ID NO: 1696185 - DNA, 22 bp, Homo sapiens
atgctccaggatctttgactga

SEQ ID NO: 1696186 - DNA, 17 bp, Homo sapiens
atgctccagggtcaggc

SEQ ID NO: 1696187 - DNA, 24 bp, Homo sapiens
atgctccagtcaacaaactatttc

SEQ ID NO: 1696188 - DNA, 14 bp, Homo sapiens
atgctccccacagc

SEQ ID NO: 1696189 - DNA, 21 bp, Homo sapiens
atgctccccacagcgtccctg

SEQ ID NO: 1696190 - DNA, 23 bp, Homo sapiens
atgctccccacagcgtccctggc

SEQ ID NO: 1696191 - DNA, 22 bp, Homo sapiens
atgctccctcccctgccctggt

SEQ ID NO: 1696192 - DNA, 13 bp, Homo sapiens
atgctcctagttt

SEQ ID NO: 1696193 - DNA, 15 bp, Homo sapiens
atgctcgtgtgattt

SEQ ID NO: 1696194 - DNA, 17 bp, Homo sapiens
atgctcgtgtgatttcc

SEQ ID NO: 1696195 - DNA, 21 bp, Homo sapiens
atgctcgtgtgatttcctaca

SEQ ID NO: 1696196 - DNA, 18 bp, Homo sapiens
atgctctaactggacatg

SEQ ID NO: 1696197 - DNA, 19 bp, Homo sapiens
atgctctctgcagccagcc

SEQ ID NO: 1696198 - DNA, 22 bp, Homo sapiens
atgctctctgcagccagcccag

SEQ ID NO: 1696199 - DNA, 12 bp, Homo sapiens
atgctctgcccc

SEQ ID NO: 1696200 - DNA, 23 bp, Homo sapiens
atgctctgtgcgagggttactat

SEQ ID NO: 1696201 - DNA, 14 bp, Homo sapiens
atgctcttctgtgg

SEQ ID NO: 1696202 - DNA, 20 bp, Homo sapiens
atgctcttgaaatattcaga

SEQ ID NO: 1696203 - DNA, 21 bp, Homo sapiens
atgctcttgaaatattcagaa

SEQ ID NO: 1696204 - DNA, 16 bp, Homo sapiens
atgctcttttgcacaa

SEQ ID NO: 1696205 - DNA, 17 bp, Homo sapiens
atgctgaacgcagaaga

SEQ ID NO: 1696206 - DNA, 17 bp, Homo sapiens
atgctgacaaaaatatt

SEQ ID NO: 1696207 - DNA, 16 bp, Homo sapiens
atgctgacctcacctg

SEQ ID NO: 1696208 - DNA, 21 bp, Homo sapiens
atgctgactgtactcctccca

SEQ ID NO: 1696209 - DNA, 15 bp, Homo sapiens
atgctgaggccaccc

SEQ ID NO: 1696210 - DNA, 18 bp, Homo sapiens
atgctgaggccacccact

SEQ ID NO: 1696211 - DNA, 14 bp, Homo sapiens
atgctgaggcccct

SEQ ID NO: 1696212 - DNA, 14 bp, Homo sapiens
atgctgaggcctgg

SEQ ID NO: 1696213 - DNA, 22 bp, Homo sapiens
atgctgatcatcgccagaggtg

SEQ ID NO: 1696214 - DNA, 24 bp, Homo sapiens
atgctgatcatcgccagaggtgct

SEQ ID NO: 1696215 - DNA, 15 bp, Homo sapiens
atgctgatcttttaa

SEQ ID NO: 1696216 - DNA, 15 bp, Homo sapiens
atgctgatgatcaaa

SEQ ID NO: 1696217 - DNA, 16 bp, Homo sapiens
atgctgcaaaggagaa

SEQ ID NO: 1696218 - DNA, 17 bp, Homo sapiens
atgctgcccagccactc

SEQ ID NO: 1696219 - DNA, 21 bp, Homo sapiens
atgctgccccgttccctgtca

SEQ ID NO: 1696220 - DNA, 13 bp, Homo sapiens
atgctgcctgcct

SEQ ID NO: 1696221 - DNA, 18 bp, Homo sapiens
atgctgcctgcctgtctg

SEQ ID NO: 1696222 - DNA, 11 bp, Homo sapiens
atgctgctctc

SEQ ID NO: 1696223 - DNA, 19 bp, Homo sapiens
atgctgctggggaagacag

SEQ ID NO: 1696224 - DNA, 20 bp, Homo sapiens
atgctgctggggaagacagt

SEQ ID NO: 1696225 - DNA, 13 bp, Homo sapiens
atgctgctttccc

SEQ ID NO: 1696226 - DNA, 20 bp, Homo sapiens
atgctgctttcccctgtggg

SEQ ID NO: 1696227 - DNA, 20 bp, Homo sapiens
atgctgctttttggcacagt

SEQ ID NO: 1696228 - DNA, 22 bp, Homo sapiens
atgctggatgtctgccaatttt

SEQ ID NO: 1696229 - DNA, 23 bp, Homo sapiens
atgctggcatttgcacctacctc

SEQ ID NO: 1696230 - DNA, 13 bp, Homo sapiens
atgctggcccagg

SEQ ID NO: 1696231 - DNA, 16 bp, Homo sapiens
atgctggcccagggcc

SEQ ID NO: 1696232 - DNA, 18 bp, Homo sapiens
atgctggcccagggccca

SEQ ID NO: 1696233 - DNA, 19 bp, Homo sapiens
atgctggcccagggcccag

SEQ ID NO: 1696234 - DNA, 22 bp, Homo sapiens
atgctggcccagggcccagagc

SEQ ID NO: 1696235 - DNA, 23 bp, Homo sapiens
atgctggcccagggcccagagcc

SEQ ID NO: 1696236 - DNA, 19 bp, Homo sapiens
atgctgggccactggggac

SEQ ID NO: 1696237 - DNA, 14 bp, Homo sapiens
atgctgggctgggc

SEQ ID NO: 1696238 - DNA, 17 bp, Homo sapiens
atgctgggctgggccct

SEQ ID NO: 1696239 - DNA, 18 bp, Homo sapiens
atgctgggctgggccctc

SEQ ID NO: 1696240 - DNA, 19 bp, Homo sapiens
atgctgggttggtgcacag

SEQ ID NO: 1696241 - DNA, 17 bp, Homo sapiens
atgctggtagatgctga

SEQ ID NO: 1696242 - DNA, 13 bp, Homo sapiens
atgctgtaaatag

SEQ ID NO: 1696243 - DNA, 17 bp, Homo sapiens
atgctgtctggccctgg

SEQ ID NO: 1696244 - DNA, 15 bp, Homo sapiens
atgctgtgctctttg

SEQ ID NO: 1696245 - DNA, 19 bp, Homo sapiens
atgctgtgggggactggct

SEQ ID NO: 1696246 - DNA, 16 bp, Homo sapiens
atgctgttgcctcatc

SEQ ID NO: 1696247 - DNA, 13 bp, Homo sapiens
atgctgtttctaa

SEQ ID NO: 1696248 - DNA, 16 bp, Homo sapiens
atgcttaaaataagca

SEQ ID NO: 1696249 - DNA, 23 bp, Homo sapiens
atgcttagtcactgcctgcagag

SEQ ID NO: 1696250 - DNA, 21 bp, Homo sapiens
atgcttagtccctcatgcaaa

SEQ ID NO: 1696251 - DNA, 16 bp, Homo sapiens
atgcttcaagtgttgc

SEQ ID NO: 1696252 - DNA, 15 bp, Homo sapiens
atgcttcctttctct

SEQ ID NO: 1696253 - DNA, 20 bp, Homo sapiens
atgcttcctttctctcctgg

SEQ ID NO: 1696254 - DNA, 23 bp, Homo sapiens
atgcttctataattttgccttta

SEQ ID NO: 1696255 - DNA, 17 bp, Homo sapiens
atgcttgaatggagctg

SEQ ID NO: 1696256 - DNA, 22 bp, Homo sapiens
atgcttgggctgacccagcatc

SEQ ID NO: 1696257 - DNA, 21 bp, Homo sapiens
atgcttgtaacaagaaaacat

SEQ ID NO: 1696258 - DNA, 14 bp, Homo sapiens
atgctttacagtca

SEQ ID NO: 1696259 - DNA, 17 bp, Homo sapiens
atgctttccctgaggaa

SEQ ID NO: 1696260 - DNA, 22 bp, Homo sapiens
atgctttctgaagctttaccag

SEQ ID NO: 1696261 - DNA, 14 bp, Homo sapiens
atgctttgctgcta

SEQ ID NO: 1696262 - DNA, 20 bp, Homo sapiens
atgctttgggaggccaaggc

SEQ ID NO: 1696263 - DNA, 20 bp, Homo sapiens
atgcttttggaagttaaaat

SEQ ID NO: 1696264 - DNA, 14 bp, Homo sapiens
atgctttttagaaa

SEQ ID NO: 1696265 - DNA, 15 bp, Homo sapiens
atgctttttctcaga

SEQ ID NO: 1696266 - DNA, 16 bp, Homo sapiens
atgctttttctcagat

SEQ ID NO: 1696267 - DNA, 21 bp, Homo sapiens
atggaaaaaaacataaaaagc

SEQ ID NO: 1696268 - DNA, 21 bp, Homo sapiens
atggaaaaatggttgatggaa

SEQ ID NO: 1696269 - DNA, 21 bp, Homo sapiens
atggaaaacaaaccatctcta

SEQ ID NO: 1696270 - DNA, 14 bp, Homo sapiens
atggaaaaggaaga

SEQ ID NO: 1696271 - DNA, 15 bp, Homo sapiens
atggaaactgaatgc

SEQ ID NO: 1696272 - DNA, 16 bp, Homo sapiens
atggaaactgaatgct

SEQ ID NO: 1696273 - DNA, 11 bp, Homo sapiens
atggaaagaat

SEQ ID NO: 1696274 - DNA, 18 bp, Homo sapiens
atggaaaggtcctgctgt

SEQ ID NO: 1696275 - DNA, 16 bp, Homo sapiens
atggaaagtaactcat

SEQ ID NO: 1696276 - DNA, 16 bp, Homo sapiens
atggaaattttgctat

SEQ ID NO: 1696277 - DNA, 15 bp, Homo sapiens
atggaacaggctcag

SEQ ID NO: 1696278 - DNA, 23 bp, Homo sapiens
atggaactactgtactttgccat

SEQ ID NO: 1696279 - DNA, 19 bp, Homo sapiens
atggaactcattcctgcct

SEQ ID NO: 1696280 - DNA, 19 bp, Homo sapiens
atggaagatggtccgtgcc

SEQ ID NO: 1696281 - DNA, 16 bp, Homo sapiens
atggaagattttaaat

SEQ ID NO: 1696282 - DNA, 17 bp, Homo sapiens
atggaagattttaaatt

SEQ ID NO: 1696283 - DNA, 18 bp, Homo sapiens
atggaaggggcttctgga

SEQ ID NO: 1696284 - DNA, 13 bp, Homo sapiens
atggaataaaagg

SEQ ID NO: 1696285 - DNA, 14 bp, Homo sapiens
atggaataaattat

SEQ ID NO: 1696286 - DNA, 15 bp, Homo sapiens
atggaataaattatg

SEQ ID NO: 1696287 - DNA, 20 bp, Homo sapiens
atggaataaattatggcatt

SEQ ID NO: 1696288 - DNA, 16 bp, Homo sapiens
atggaatacagtgtta

SEQ ID NO: 1696289 - DNA, 19 bp, Homo sapiens
atggaatcgaagtgtttat

SEQ ID NO: 1696290 - DNA, 17 bp, Homo sapiens
atggaatgctgtgttaa

SEQ ID NO: 1696291 - DNA, 23 bp, Homo sapiens
atggaatggcaggtgtcatatga

SEQ ID NO: 1696292 - DNA, 19 bp, Homo sapiens
atggaattttgcaaagatt

SEQ ID NO: 1696293 - DNA, 20 bp, Homo sapiens
atggacaacttatttaaaaa

SEQ ID NO: 1696294 - DNA, 21 bp, Homo sapiens
atggacaacttatttaaaaat

SEQ ID NO: 1696295 - DNA, 22 bp, Homo sapiens
atggacaacttatttaaaaata

SEQ ID NO: 1696296 - DNA, 23 bp, Homo sapiens
atggacaacttatttaaaaatat

SEQ ID NO: 1696297 - DNA, 15 bp, Homo sapiens
atggacacgagccac

SEQ ID NO: 1696298 - DNA, 16 bp, Homo sapiens
atggacacgagccaca

SEQ ID NO: 1696299 - DNA, 23 bp, Homo sapiens
atggacactttgaaatgtgtttc

SEQ ID NO: 1696300 - DNA, 23 bp, Homo sapiens
atggacaggatggggttctggaa

SEQ ID NO: 1696301 - DNA, 18 bp, Homo sapiens
atggacagggcatgccac

SEQ ID NO: 1696302 - DNA, 20 bp, Homo sapiens
atggacatttagaagaaaga

SEQ ID NO: 1696303 - DNA, 22 bp, Homo sapiens
atggaccgggtgggcctggcct

SEQ ID NO: 1696304 - DNA, 14 bp, Homo sapiens
atggacctaacatt

SEQ ID NO: 1696305 - DNA, 18 bp, Homo sapiens
atggacctgcctgcatag

SEQ ID NO: 1696306 - DNA, 16 bp, Homo sapiens
atggacgtgtgtgaat

SEQ ID NO: 1696307 - DNA, 21 bp, Homo sapiens
atggactatctgtctggtggc

SEQ ID NO: 1696308 - DNA, 18 bp, Homo sapiens
atggactcagaaactcca

SEQ ID NO: 1696309 - DNA, 23 bp, Homo sapiens
atggacttgtatatttgtacaaa

SEQ ID NO: 1696310 - DNA, 18 bp, Homo sapiens
atggacttgtgattggct

SEQ ID NO: 1696311 - DNA, 13 bp, Homo sapiens
atggactttcttg

SEQ ID NO: 1696312 - DNA, 14 bp, Homo sapiens
atggagaaagaagt

SEQ ID NO: 1696313 - DNA, 14 bp, Homo sapiens
atggagactcctgc

SEQ ID NO: 1696314 - DNA, 17 bp, Homo sapiens
atggagagaggggaata

SEQ ID NO: 1696315 - DNA, 23 bp, Homo sapiens
atggagagcagccagcacccacc

SEQ ID NO: 1696316 - DNA, 13 bp, Homo sapiens
atggagaggctga

SEQ ID NO: 1696317 - DNA, 19 bp, Homo sapiens
atggagcagtacatgggaa

SEQ ID NO: 1696318 - DNA, 11 bp, Homo sapiens
atggagccagc

SEQ ID NO: 1696319 - DNA, 18 bp, Homo sapiens
atggagccagctccctct

SEQ ID NO: 1696320 - DNA, 21 bp, Homo sapiens
atggagccccaccttgtctgc

SEQ ID NO: 1696321 - DNA, 17 bp, Homo sapiens
atggagccccctctgcc

SEQ ID NO: 1696322 - DNA, 20 bp, Homo sapiens
atggagcctggcacaggact

SEQ ID NO: 1696323 - DNA, 17 bp, Homo sapiens
atggagcgcacctgccc

SEQ ID NO: 1696324 - DNA, 16 bp, Homo sapiens
atggaggaaaaccaag

SEQ ID NO: 1696325 - DNA, 15 bp, Homo sapiens
atggaggagaagaat

SEQ ID NO: 1696326 - DNA, 17 bp, Homo sapiens
atggaggagaagaattt

SEQ ID NO: 1696327 - DNA, 17 bp, Homo sapiens
atggaggattctttccc

SEQ ID NO: 1696328 - DNA, 23 bp, Homo sapiens
atggaggattctttccccagagg

SEQ ID NO: 1696329 - DNA, 16 bp, Homo sapiens
atggagggaataatac

SEQ ID NO: 1696330 - DNA, 18 bp, Homo sapiens
atggagggcttggcccag

SEQ ID NO: 1696331 - DNA, 22 bp, Homo sapiens
atggagggtggaaataatttga

SEQ ID NO: 1696332 - DNA, 12 bp, Homo sapiens
atggaggttcta

SEQ ID NO: 1696333 - DNA, 16 bp, Homo sapiens
atggaggttctaaggc

SEQ ID NO: 1696334 - DNA, 18 bp, Homo sapiens
atggagtgagtcacctgc

SEQ ID NO: 1696335 - DNA, 19 bp, Homo sapiens
atggagtgagtcacctgct

SEQ ID NO: 1696336 - DNA, 20 bp, Homo sapiens
atggagtgagtcacctgctc

SEQ ID NO: 1696337 - DNA, 19 bp, Homo sapiens
atggagtgtgcagacagcc

SEQ ID NO: 1696338 - DNA, 12 bp, Homo sapiens
atggagttaaat

SEQ ID NO: 1696339 - DNA, 17 bp, Homo sapiens
atggagttaacgggtga

SEQ ID NO: 1696340 - DNA, 15 bp, Homo sapiens
atggagttcttgtgc

SEQ ID NO: 1696341 - DNA, 16 bp, Homo sapiens
atggagtttctaaggt

SEQ ID NO: 1696342 - DNA, 14 bp, Homo sapiens
atggatatatttga

SEQ ID NO: 1696343 - DNA, 18 bp, Homo sapiens
atggatatatttgaaata

SEQ ID NO: 1696344 - DNA, 23 bp, Homo sapiens
atggatatatttgaaatagtata

SEQ ID NO: 1696345 - DNA, 15 bp, Homo sapiens
atggatcacaagatg

SEQ ID NO: 1696346 - DNA, 16 bp, Homo sapiens
atggatcacaagatgg

SEQ ID NO: 1696347 - DNA, 16 bp, Homo sapiens
atggatcctggaggat

SEQ ID NO: 1696348 - DNA, 18 bp, Homo sapiens
atggatccttccatcttg

SEQ ID NO: 1696349 - DNA, 23 bp, Homo sapiens
atggatcttttctaaatgttatt

SEQ ID NO: 1696350 - DNA, 16 bp, Homo sapiens
atggatgaactgaaag

SEQ ID NO: 1696351 - DNA, 18 bp, Homo sapiens
atggatgattcagaaatt

SEQ ID NO: 1696352 - DNA, 14 bp, Homo sapiens
atggatggcaccct

SEQ ID NO: 1696353 - DNA, 14 bp, Homo sapiens
atggatggcttcta

SEQ ID NO: 1696354 - DNA, 23 bp, Homo sapiens
atggattcacccccctctgctgc

SEQ ID NO: 1696355 - DNA, 17 bp, Homo sapiens
atggattgattcagtct

SEQ ID NO: 1696356 - DNA, 20 bp, Homo sapiens
atggatttgaagtttgccaa

SEQ ID NO: 1696357 - DNA, 17 bp, Homo sapiens
atggatttgatgctgtt

SEQ ID NO: 1696358 - DNA, 22 bp, Homo sapiens
atggatttggcactagccaaag

SEQ ID NO: 1696359 - DNA, 13 bp, Homo sapiens
atggatttttaaa

SEQ ID NO: 1696360 - DNA, 22 bp, Homo sapiens
atggatttttaaattatactgt

SEQ ID NO: 1696361 - DNA, 19 bp, Homo sapiens
atggatttttctttaactg

SEQ ID NO: 1696362 - DNA, 20 bp, Homo sapiens
atggatttttctttaactgc

SEQ ID NO: 1696363 - DNA, 15 bp, Homo sapiens
atggcaacagatctg

SEQ ID NO: 1696364 - DNA, 21 bp, Homo sapiens
atggcaagtgatatcacctct

SEQ ID NO: 1696365 - DNA, 17 bp, Homo sapiens
atggcaccagccccctg

SEQ ID NO: 1696366 - DNA, 22 bp, Homo sapiens
atggcaccctggaaccgggaag

SEQ ID NO: 1696367 - DNA, 18 bp, Homo sapiens
atggcacctcaggctgag

SEQ ID NO: 1696368 - DNA, 20 bp, Homo sapiens
atggcacctcaggctgaggg

SEQ ID NO: 1696369 - DNA, 22 bp, Homo sapiens
atggcacttgatgtgtagacat

SEQ ID NO: 1696370 - DNA, 13 bp, Homo sapiens
atggcagaaggga

SEQ ID NO: 1696371 - DNA, 14 bp, Homo sapiens
atgtaacattggtg

SEQ ID NO: 1696372 - DNA, 16 bp, Homo sapiens
atgtaacattggtgaa

SEQ ID NO: 1696373 - DNA, 15 bp, Homo sapiens
atgtaaccaagctgt

SEQ ID NO: 1696374 - DNA, 19 bp, Homo sapiens
atgtaactaggtttttgct

SEQ ID NO: 1696375 - DNA, 24 bp, Homo sapiens
atgtaactccagatagagaaatag

SEQ ID NO: 1696376 - DNA, 14 bp, Homo sapiens
atgtaactgctgaa

SEQ ID NO: 1696377 - DNA, 16 bp, Homo sapiens
atgtaacttttgtaag

SEQ ID NO: 1696378 - DNA, 16 bp, Homo sapiens
atgtaagaaaatgtta

SEQ ID NO: 1696379 - DNA, 14 bp, Homo sapiens
atgtaagaacacat

SEQ ID NO: 1696380 - DNA, 19 bp, Homo sapiens
atgtaagaattcagaagac

SEQ ID NO: 1696381 - DNA, 15 bp, Homo sapiens
atgtaagattataga

SEQ ID NO: 1696382 - DNA, 17 bp, Homo sapiens
atgtaagattatagatt

SEQ ID NO: 1696383 - DNA, 19 bp, Homo sapiens
atgtaagattatagattct

SEQ ID NO: 1696384 - DNA, 20 bp, Homo sapiens
atgtaagattatagattcta

SEQ ID NO: 1696385 - DNA, 21 bp, Homo sapiens
atgtaagcaaaggctctgaaa

SEQ ID NO: 1696386 - DNA, 19 bp, Homo sapiens
atgtaagcatactttgtaa

SEQ ID NO: 1696387 - DNA, 12 bp, Homo sapiens
atgtaaggactg

SEQ ID NO: 1696388 - DNA, 14 bp, Homo sapiens
atgtaagggaaact

SEQ ID NO: 1696389 - DNA, 14 bp, Homo sapiens
atggcccctccagc

SEQ ID NO: 1696390 - DNA, 19 bp, Homo sapiens
atggcccctccagcacaca

SEQ ID NO: 1696391 - DNA, 12 bp, Homo sapiens
atggccctcgga

SEQ ID NO: 1696392 - DNA, 17 bp, Homo sapiens
atggcccttcaaattgg

SEQ ID NO: 1696393 - DNA, 20 bp, Homo sapiens
atggccgaagccccttggag

SEQ ID NO: 1696394 - DNA, 19 bp, Homo sapiens
atggccgggccctgctgag

SEQ ID NO: 1696395 - DNA, 17 bp, Homo sapiens
atggccgggctgctgct

SEQ ID NO: 1696396 - DNA, 14 bp, Homo sapiens
atggccgtggatgc

SEQ ID NO: 1696397 - DNA, 18 bp, Homo sapiens
atggcctatgcacatatg

SEQ ID NO: 1696398 - DNA, 18 bp, Homo sapiens
atggcctcagctgcctca

SEQ ID NO: 1696399 - DNA, 17 bp, Homo sapiens
atggcctcatgtggctg

SEQ ID NO: 1696400 - DNA, 20 bp, Homo sapiens
atggcctcatgtggctggaa

SEQ ID NO: 1696401 - DNA, 20 bp, Homo sapiens
atggcctgccttgaagccac

SEQ ID NO: 1696402 - DNA, 14 bp, Homo sapiens
atggcctggaggga

SEQ ID NO: 1696403 - DNA, 19 bp, Homo sapiens
atggcctggagggactttt

SEQ ID NO: 1696404 - DNA, 19 bp, Homo sapiens
atggcgtaatgggcctgcc

SEQ ID NO: 1696405 - DNA, 15 bp, Homo sapiens
atggcgtctgctctg

SEQ ID NO: 1696406 - DNA, 17 bp, Homo sapiens
atggctaagaccacaga

SEQ ID NO: 1696407 - DNA, 18 bp, Homo sapiens
atggctactttggtttct

SEQ ID NO: 1696408 - DNA, 13 bp, Homo sapiens
atggctataaata

SEQ ID NO: 1696409 - DNA, 14 bp, Homo sapiens
atggctataaatat

SEQ ID NO: 1696410 - DNA, 19 bp, Homo sapiens
atggctataggtgctacaa

SEQ ID NO: 1696411 - DNA, 21 bp, Homo sapiens
atggctataggtgctacaaaa

SEQ ID NO: 1696412 - DNA, 17 bp, Homo sapiens
atggctatttttgaagc

SEQ ID NO: 1696413 - DNA, 16 bp, Homo sapiens
atggctcaggcaagcc

SEQ ID NO: 1696414 - DNA, 22 bp, Homo sapiens
atggctcaggcaagcccctcag

SEQ ID NO: 1696415 - DNA, 13 bp, Homo sapiens
atggctcagggtg

SEQ ID NO: 1696416 - DNA, 15 bp, Homo sapiens
atggctccagaaatg

SEQ ID NO: 1696417 - DNA, 17 bp, Homo sapiens
atggctcccaaggttcc

SEQ ID NO: 1696418 - DNA, 15 bp, Homo sapiens
atggctcctgtctgg

SEQ ID NO: 1696419 - DNA, 17 bp, Homo sapiens
atggctgaagctggagc

SEQ ID NO: 1696420 - DNA, 18 bp, Homo sapiens
atggctgaagctggagca

SEQ ID NO: 1696421 - DNA, 14 bp, Homo sapiens
atggctgagatgga

SEQ ID NO: 1696422 - DNA, 15 bp, Homo sapiens
atggctgcccaggag

SEQ ID NO: 1696423 - DNA, 17 bp, Homo sapiens
atggctgcccaggagac

SEQ ID NO: 1696424 - DNA, 17 bp, Homo sapiens
atggctgcccccaggaa

SEQ ID NO: 1696425 - DNA, 13 bp, Homo sapiens
atggctgcctgca

SEQ ID NO: 1696426 - DNA, 22 bp, Homo sapiens
atggctgctagattttaattta

SEQ ID NO: 1696427 - DNA, 15 bp, Homo sapiens
atggctgctgcctgc

SEQ ID NO: 1696428 - DNA, 18 bp, Homo sapiens
atggctgctgcctgctca

SEQ ID NO: 1696429 - DNA, 14 bp, Homo sapiens
atggctggcctggt

SEQ ID NO: 1696430 - DNA, 21 bp, Homo sapiens
atggctggggccgctggggtc

SEQ ID NO: 1696431 - DNA, 20 bp, Homo sapiens
atggctgtgtttgcagcctg

SEQ ID NO: 1696432 - DNA, 21 bp, Homo sapiens
atggcttatttctatgacaaa

SEQ ID NO: 1696433 - DNA, 14 bp, Homo sapiens
atggcttctaacaa

SEQ ID NO: 1696434 - DNA, 20 bp, Homo sapiens
atggcttttcttacccagat

SEQ ID NO: 1696435 - DNA, 14 bp, Homo sapiens
atgggaaaatattt

SEQ ID NO: 1696436 - DNA, 23 bp, Homo sapiens
atgggaaactgcttttccacaag

SEQ ID NO: 1696437 - DNA, 23 bp, Homo sapiens
atgggaaaggaggcatgcctctg

SEQ ID NO: 1696438 - DNA, 14 bp, Homo sapiens
atgggaaatagtct

SEQ ID NO: 1696439 - DNA, 23 bp, Homo sapiens
atgggaacctagtactctctgct

SEQ ID NO: 1696440 - DNA, 17 bp, Homo sapiens
atgggaatgaggtggga

SEQ ID NO: 1696441 - DNA, 22 bp, Homo sapiens
atgggacaaagttccaaaatgc

SEQ ID NO: 1696442 - DNA, 15 bp, Homo sapiens
atgggacagcaacaa

SEQ ID NO: 1696443 - DNA, 12 bp, Homo sapiens
atgggactgatg

SEQ ID NO: 1696444 - DNA, 18 bp, Homo sapiens
atgggactgatgtcatct

SEQ ID NO: 1696445 - DNA, 21 bp, Homo sapiens
atgggactgatgtcatcttga

SEQ ID NO: 1696446 - DNA, 22 bp, Homo sapiens
atgggactttccttccctctcc

SEQ ID NO: 1696447 - DNA, 14 bp, Homo sapiens
atgggagccaggag

SEQ ID NO: 1696448 - DNA, 18 bp, Homo sapiens
atgggagccaggcccaga

SEQ ID NO: 1696449 - DNA, 13 bp, Homo sapiens
atgggagccccag

SEQ ID NO: 1696450 - DNA, 22 bp, Homo sapiens
atgggagccccagggtcttccc

SEQ ID NO: 1696451 - DNA, 15 bp, Homo sapiens
atgggaggccgggag

SEQ ID NO: 1696452 - DNA, 20 bp, Homo sapiens
atgggagggggcttgaagcc

SEQ ID NO: 1696453 - DNA, 19 bp, Homo sapiens
atgggatcccaggccaggg

SEQ ID NO: 1696454 - DNA, 20 bp, Homo sapiens
atgggcagtcattttgcaga

SEQ ID NO: 1696455 - DNA, 17 bp, Homo sapiens
atgggcatcttttgtat

SEQ ID NO: 1696456 - DNA, 18 bp, Homo sapiens
atgggcattgggctgaca

SEQ ID NO: 1696457 - DNA, 16 bp, Homo sapiens
atgggcccctggcact

SEQ ID NO: 1696458 - DNA, 14 bp, Homo sapiens
atgggcctgcccaa

SEQ ID NO: 1696459 - DNA, 18 bp, Homo sapiens
atgggcctgccgggctga

SEQ ID NO: 1696460 - DNA, 22 bp, Homo sapiens
atgggcctgccgggctgagggc

SEQ ID NO: 1696461 - DNA, 12 bp, Homo sapiens
atgggcctgggc

SEQ ID NO: 1696462 - DNA, 12 bp, Homo sapiens
atgggccttgct

SEQ ID NO: 1696463 - DNA, 21 bp, Homo sapiens
atgggccttgctttgggcttt

SEQ ID NO: 1696464 - DNA, 23 bp, Homo sapiens
atgggctcgccgtgtctcagcct

SEQ ID NO: 1696465 - DNA, 13 bp, Homo sapiens
atgggcttggact

SEQ ID NO: 1696466 - DNA, 23 bp, Homo sapiens
atggggacagactgaagacagag

SEQ ID NO: 1696467 - DNA, 20 bp, Homo sapiens
atggggacatttcttcccca

SEQ ID NO: 1696468 - DNA, 12 bp, Homo sapiens
atggggagaaag

SEQ ID NO: 1696469 - DNA, 22 bp, Homo sapiens
atggggagaaagggcaaattat

SEQ ID NO: 1696470 - DNA, 16 bp, Homo sapiens
atggggaggcagcaga

SEQ ID NO: 1696471 - DNA, 18 bp, Homo sapiens
atggggaggcagcagagc

SEQ ID NO: 1696472 - DNA, 23 bp, Homo sapiens
atggggagtgagtgatcactggt

SEQ ID NO: 1696473 - DNA, 20 bp, Homo sapiens
atggggcagaagagaaagga

SEQ ID NO: 1696474 - DNA, 14 bp, Homo sapiens
atggggccagcact

SEQ ID NO: 1696475 - DNA, 20 bp, Homo sapiens
atggggctgcgggacagagg

SEQ ID NO: 1696476 - DNA, 23 bp, Homo sapiens
atggggctggggtcctcctgtgc

SEQ ID NO: 1696477 - DNA, 16 bp, Homo sapiens
atgggggcacttgagt

SEQ ID NO: 1696478 - DNA, 16 bp, Homo sapiens
atgggggcagggctgt

SEQ ID NO: 1696479 - DNA, 14 bp, Homo sapiens
atgggggctgccag

SEQ ID NO: 1696480 - DNA, 18 bp, Homo sapiens
atggggggcgggccaggg

SEQ ID NO: 1696481 - DNA, 18 bp, Homo sapiens
atggggtctgtgactgga

SEQ ID NO: 1696482 - DNA, 19 bp, Homo sapiens
atggggtctgtgactggat

SEQ ID NO: 1696483 - DNA, 15 bp, Homo sapiens
atggggttcctggtt

SEQ ID NO: 1696484 - DNA, 14 bp, Homo sapiens
atggggttctggaa

SEQ ID NO: 1696485 - DNA, 16 bp, Homo sapiens
atgggtagggtaaatc

SEQ ID NO: 1696486 - DNA, 17 bp, Homo sapiens
atgggtagggtaaatca

SEQ ID NO: 1696487 - DNA, 14 bp, Homo sapiens
atgggtcacaggaa

SEQ ID NO: 1696488 - DNA, 15 bp, Homo sapiens
atgggtcatgacaag

SEQ ID NO: 1696489 - DNA, 15 bp, Homo sapiens
atgggtccagggcct

SEQ ID NO: 1696490 - DNA, 13 bp, Homo sapiens
atgggtcctgcaa

SEQ ID NO: 1696491 - DNA, 19 bp, Homo sapiens
atgggtccttgatgccaga

SEQ ID NO: 1696492 - DNA, 16 bp, Homo sapiens
atgggtctgatattaa

SEQ ID NO: 1696493 - DNA, 19 bp, Homo sapiens
atgggtctgatattaatca

SEQ ID NO: 1696494 - DNA, 20 bp, Homo sapiens
atgggtgcaaggaaaattag

SEQ ID NO: 1696495 - DNA, 19 bp, Homo sapiens
atgggtgcccgtatccaga

SEQ ID NO: 1696496 - DNA, 21 bp, Homo sapiens
atgggtgcccgtatccagagt

SEQ ID NO: 1696497 - DNA, 17 bp, Homo sapiens
atgggtggaaagtgctc

SEQ ID NO: 1696498 - DNA, 13 bp, Homo sapiens
atgggttccagag

SEQ ID NO: 1696499 - DNA, 16 bp, Homo sapiens
atggtaaaaaatttat

SEQ ID NO: 1696500 - DNA, 22 bp, Homo sapiens
atggtaacactttgctttctga

SEQ ID NO: 1696501 - DNA, 23 bp, Homo sapiens
atggtaacactttgctttctgaa

SEQ ID NO: 1696502 - DNA, 23 bp, Homo sapiens
atggtaatctttacctgtataca

SEQ ID NO: 1696503 - DNA, 20 bp, Homo sapiens
attaatgtttcttaaatgga

SEQ ID NO: 1696504 - DNA, 15 bp, Homo sapiens
attaatgttttcaaa

SEQ ID NO: 1696505 - DNA, 18 bp, Homo sapiens
attaatgttttgtacaat

SEQ ID NO: 1696506 - DNA, 20 bp, Homo sapiens
attaattgtaatctgaataa

SEQ ID NO: 1696507 - DNA, 14 bp, Homo sapiens
attaattgtcatta

SEQ ID NO: 1696508 - DNA, 23 bp, Homo sapiens
attaatttctgataaagttcctt

SEQ ID NO: 1696509 - DNA, 18 bp, Homo sapiens
attaattttagtttttca

SEQ ID NO: 1696510 - DNA, 14 bp, Homo sapiens
attaattttgtgca

SEQ ID NO: 1696511 - DNA, 19 bp, Homo sapiens
attaattttgtgcattctt

SEQ ID NO: 1696512 - DNA, 15 bp, Homo sapiens
attacaaaaggctcg

SEQ ID NO: 1696513 - DNA, 19 bp, Homo sapiens
attacaaatcagaagtcat

SEQ ID NO: 1696514 - DNA, 13 bp, Homo sapiens
attacaaatggtt

SEQ ID NO: 1696515 - DNA, 12 bp, Homo sapiens
attacaacattt

SEQ ID NO: 1696516 - DNA, 18 bp, Homo sapiens
attacaactgaccaagtt

SEQ ID NO: 1696517 - DNA, 14 bp, Homo sapiens
attacaatgtatct

SEQ ID NO: 1696518 - DNA, 17 bp, Homo sapiens
attacaattttctgtaa

SEQ ID NO: 1696519 - DNA, 12 bp, Homo sapiens
attacaattttt

SEQ ID NO: 1696520 - DNA, 13 bp, Homo sapiens
attacaattttta

SEQ ID NO: 1696521 - DNA, 21 bp, Homo sapiens
attacaccaccggccccctcc

SEQ ID NO: 1696522 - DNA, 17 bp, Homo sapiens
attacactaaattatta

SEQ ID NO: 1696523 - DNA, 16 bp, Homo sapiens
attacagactctgatt

SEQ ID NO: 1696524 - DNA, 21 bp, Homo sapiens
attacagatgggcaaattaag

SEQ ID NO: 1696525 - DNA, 13 bp, Homo sapiens
attacagattaaa

SEQ ID NO: 1696526 - DNA, 16 bp, Homo sapiens
attacagattaaaaaa

SEQ ID NO: 1696527 - DNA, 15 bp, Homo sapiens
attacagctggagaa

SEQ ID NO: 1696528 - DNA, 22 bp, Homo sapiens
attacagtatccaatgtctttt

SEQ ID NO: 1696529 - DNA, 15 bp, Homo sapiens
attacagttctttcc

SEQ ID NO: 1696530 - DNA, 15 bp, Homo sapiens
attacattattaaac

SEQ ID NO: 1696531 - DNA, 22 bp, Homo sapiens
attacattggcacaatgtatac

SEQ ID NO: 1696532 - DNA, 12 bp, Homo sapiens
attaccaaaata

SEQ ID NO: 1696533 - DNA, 20 bp, Homo sapiens
attaccagacggttcaccag

SEQ ID NO: 1696534 - DNA, 13 bp, Homo sapiens
attaccaggtttc

SEQ ID NO: 1696535 - DNA, 19 bp, Homo sapiens
attaccaggtttcattttg

SEQ ID NO: 1696536 - DNA, 20 bp, Homo sapiens
attaccatgagaagagggcc

SEQ ID NO: 1696537 - DNA, 15 bp, Homo sapiens
attaccatggagaca

SEQ ID NO: 1696538 - DNA, 14 bp, Homo sapiens
attacccagtgccg

SEQ ID NO: 1696539 - DNA, 23 bp, Homo sapiens
attacccagtgccgaggacatgc

SEQ ID NO: 1696540 - DNA, 22 bp, Homo sapiens
attaccccctcattgtttatta

SEQ ID NO: 1696541 - DNA, 21 bp, Homo sapiens
attaccccctccttcagacac

SEQ ID NO: 1696542 - DNA, 20 bp, Homo sapiens
attaccgtcacactcttcag

SEQ ID NO: 1696543 - DNA, 15 bp, Homo sapiens
attaccgtgtaccac

SEQ ID NO: 1696544 - DNA, 14 bp, Homo sapiens
attacctaattttt

SEQ ID NO: 1696545 - DNA, 14 bp, Homo sapiens
attacctgtggata

SEQ ID NO: 1696546 - DNA, 16 bp, Homo sapiens
attacctgtggatatt

SEQ ID NO: 1696547 - DNA, 19 bp, Homo sapiens
attacctgtggatatttgt

SEQ ID NO: 1696548 - DNA, 19 bp, Homo sapiens
attaccttctattggtctc

SEQ ID NO: 1696549 - DNA, 19 bp, Homo sapiens
attacctttaattttaatg

SEQ ID NO: 1696550 - DNA, 20 bp, Homo sapiens
attacgtgggtgccctctcc

SEQ ID NO: 1696551 - DNA, 13 bp, Homo sapiens
attactaaattgt

SEQ ID NO: 1696552 - DNA, 16 bp, Homo sapiens
attactatctgttgaa

SEQ ID NO: 1696553 - DNA, 14 bp, Homo sapiens
attactcaggtttg

SEQ ID NO: 1696554 - DNA, 23 bp, Homo sapiens
attactcgatcaaaaccttcctt

SEQ ID NO: 1696555 - DNA, 19 bp, Homo sapiens
attactctttttcaataaa

SEQ ID NO: 1696556 - DNA, 15 bp, Homo sapiens
attactgaattgtat

SEQ ID NO: 1696557 - DNA, 15 bp, Homo sapiens
attactgacatttct

SEQ ID NO: 1696558 - DNA, 21 bp, Homo sapiens
attactgacatttcttctagt

SEQ ID NO: 1696559 - DNA, 20 bp, Homo sapiens
attactgccattcacttcat

SEQ ID NO: 1696560 - DNA, 14 bp, Homo sapiens
attactgccttgaa

SEQ ID NO: 1696561 - DNA, 15 bp, Homo sapiens
attactgccttgaaa

SEQ ID NO: 1696562 - DNA, 21 bp, Homo sapiens
attactgctaagtatttccca

SEQ ID NO: 1696563 - DNA, 18 bp, Homo sapiens
attactgctttaatcaga

SEQ ID NO: 1696564 - DNA, 21 bp, Homo sapiens
attactgctttaatcagaaac

SEQ ID NO: 1696565 - DNA, 15 bp, Homo sapiens
attactgtacacatt

SEQ ID NO: 1696566 - DNA, 17 bp, Homo sapiens
attactgtcaataaaca

SEQ ID NO: 1696567 - DNA, 12 bp, Homo sapiens
attactgtcccc

SEQ ID NO: 1696568 - DNA, 10 bp, Homo sapiens
attactgtga

SEQ ID NO: 1696569 - DNA, 18 bp, Homo sapiens
attactgttttgggcctc

SEQ ID NO: 1696570 - DNA, 23 bp, Homo sapiens
attacttaggttattttgctttg

SEQ ID NO: 1696571 - DNA, 19 bp, Homo sapiens
attacttatcatccacatt

SEQ ID NO: 1696572 - DNA, 19 bp, Homo sapiens
attacttatttatcctagt

SEQ ID NO: 1696573 - DNA, 19 bp, Homo sapiens
attacttgtgttacttgcc

SEQ ID NO: 1696574 - DNA, 22 bp, Homo sapiens
attactttcgtaatagctcaga

SEQ ID NO: 1696575 - DNA, 14 bp, Homo sapiens
attactttttatgg

SEQ ID NO: 1696576 - DNA, 22 bp, Homo sapiens
attagaaaaaaattactaattt

SEQ ID NO: 1696577 - DNA, 14 bp, Homo sapiens
attagaaaattttg

SEQ ID NO: 1696578 - DNA, 16 bp, Homo sapiens
attagaaatagacagt

SEQ ID NO: 1696579 - DNA, 12 bp, Homo sapiens
attagaaatatt

SEQ ID NO: 1696580 - DNA, 14 bp, Homo sapiens
attagaaatatttt

SEQ ID NO: 1696581 - DNA, 20 bp, Homo sapiens
attagaatgaatttatcttt

SEQ ID NO: 1696582 - DNA, 15 bp, Homo sapiens
attagacaaatttgt

SEQ ID NO: 1696583 - DNA, 15 bp, Homo sapiens
attagactgaattta

SEQ ID NO: 1696584 - DNA, 13 bp, Homo sapiens
attagagatatag

SEQ ID NO: 1696585 - DNA, 13 bp, Homo sapiens
attagagcctgta

SEQ ID NO: 1696586 - DNA, 12 bp, Homo sapiens
attagagtattt

SEQ ID NO: 1696587 - DNA, 15 bp, Homo sapiens
attagataaacacag

SEQ ID NO: 1696588 - DNA, 18 bp, Homo sapiens
attagataaacacaggca

SEQ ID NO: 1696589 - DNA, 18 bp, Homo sapiens
attagataaattactata

SEQ ID NO: 1696590 - DNA, 19 bp, Homo sapiens
attagatcaaatagttgca

SEQ ID NO: 1696591 - DNA, 19 bp, Homo sapiens
attagatcctaagatgtgt

SEQ ID NO: 1696592 - DNA, 20 bp, Homo sapiens
attagatcttcaaacagaat

SEQ ID NO: 1696593 - DNA, 20 bp, Homo sapiens
attagatttgtgcaaacatg

SEQ ID NO: 1696594 - DNA, 22 bp, Homo sapiens
attagcaattgactgtcactgt

SEQ ID NO: 1696595 - DNA, 18 bp, Homo sapiens
attagcagtccctccaca

SEQ ID NO: 1696596 - DNA, 17 bp, Homo sapiens
attagcagtttgctttg

SEQ ID NO: 1696597 - DNA, 22 bp, Homo sapiens
attagcatttgttttagcatta

SEQ ID NO: 1696598 - DNA, 18 bp, Homo sapiens
attagccgggcatgatgg

SEQ ID NO: 1696599 - DNA, 21 bp, Homo sapiens
attagccgggcatggtggcag

SEQ ID NO: 1696600 - DNA, 16 bp, Homo sapiens
attagctgtgtgaaat

SEQ ID NO: 1696601 - DNA, 13 bp, Homo sapiens
attaggaaaataa

SEQ ID NO: 1696602 - DNA, 21 bp, Homo sapiens
attaggaagtgtaacagctga

SEQ ID NO: 1696603 - DNA, 21 bp, Homo sapiens
attaggcaaggctatgtgatt

SEQ ID NO: 1696604 - DNA, 14 bp, Homo sapiens
attaggctgtaact

SEQ ID NO: 1696605 - DNA, 23 bp, Homo sapiens
attaggctgtaactactttataa

SEQ ID NO: 1696606 - DNA, 12 bp, Homo sapiens
attaggctgttg

SEQ ID NO: 1696607 - DNA, 18 bp, Homo sapiens
attagggcatttgagaaa

SEQ ID NO: 1696608 - DNA, 15 bp, Homo sapiens
attaggggttgctaa

SEQ ID NO: 1696609 - DNA, 22 bp, Homo sapiens
attaggggttgctaagaagcga

SEQ ID NO: 1696610 - DNA, 14 bp, Homo sapiens
attaggtagcacag

SEQ ID NO: 1696611 - DNA, 19 bp, Homo sapiens
attaggtattacaagtaat

SEQ ID NO: 1696612 - DNA, 19 bp, Homo sapiens
attagtactgctcttgttt

SEQ ID NO: 1696613 - DNA, 21 bp, Homo sapiens
attagtatggttcaagattgt

SEQ ID NO: 1696614 - DNA, 13 bp, Homo sapiens
attagtatgtctg

SEQ ID NO: 1696615 - DNA, 20 bp, Homo sapiens
attagtctattattttagag

SEQ ID NO: 1696616 - DNA, 17 bp, Homo sapiens
attagtgattctgattt

SEQ ID NO: 1696617 - DNA, 23 bp, Homo sapiens
attagtgattctgatttcagttt

SEQ ID NO: 1696618 - DNA, 20 bp, Homo sapiens
attagtgccacttaatgtat

SEQ ID NO: 1696619 - DNA, 17 bp, Homo sapiens
attagtggtcataaaat

SEQ ID NO: 1696620 - DNA, 19 bp, Homo sapiens
atgtgggtggagaagggag

SEQ ID NO: 1696621 - DNA, 20 bp, Homo sapiens
atgtgggtggagaagggagg

SEQ ID NO: 1696622 - DNA, 23 bp, Homo sapiens
atgtgggtggagaagggagggtg

SEQ ID NO: 1696623 - DNA, 16 bp, Homo sapiens
atgtgggtgtcctgca

SEQ ID NO: 1696624 - DNA, 21 bp, Homo sapiens
atgtggtagtacccagggcca

SEQ ID NO: 1696625 - DNA, 21 bp, Homo sapiens
atgtggtgggacagggaccca

SEQ ID NO: 1696626 - DNA, 15 bp, Homo sapiens
atgtgtaaaatgtga

SEQ ID NO: 1696627 - DNA, 14 bp, Homo sapiens
atgtgtaaacaggt

SEQ ID NO: 1696628 - DNA, 20 bp, Homo sapiens
atgtgtaatattccagtttt

SEQ ID NO: 1696629 - DNA, 21 bp, Homo sapiens
atgtgtacagtgaattgtctt

SEQ ID NO: 1696630 - DNA, 14 bp, Homo sapiens
atgtgtagcctgtg

SEQ ID NO: 1696631 - DNA, 16 bp, Homo sapiens
atgtgtagcctgtgca

SEQ ID NO: 1696632 - DNA, 22 bp, Homo sapiens
atgtgtatccatgcattatata

SEQ ID NO: 1696633 - DNA, 15 bp, Homo sapiens
atgtgtatgcacagt

SEQ ID NO: 1696634 - DNA, 12 bp, Homo sapiens
atgtgtatgtga

SEQ ID NO: 1696635 - DNA, 21 bp, Homo sapiens
atgtgtcactactcacagtct

SEQ ID NO: 1696636 - DNA, 19 bp, Homo sapiens
atgtgtcactgcatggctt

SEQ ID NO: 1696637 - DNA, 18 bp, Homo sapiens
atgtgtcagaataggaaa

SEQ ID NO: 1696638 - DNA, 15 bp, Homo sapiens
atgtgtcatgaagaa

SEQ ID NO: 1696639 - DNA, 16 bp, Homo sapiens
atgtgtccatcccagc

SEQ ID NO: 1696640 - DNA, 16 bp, Homo sapiens
atgtgtccatgtgaaa

SEQ ID NO: 1696641 - DNA, 21 bp, Homo sapiens
atgtgtccatgtgaaatttac

SEQ ID NO: 1696642 - DNA, 22 bp, Homo sapiens
atgtgtcctatctatcttccaa

SEQ ID NO: 1696643 - DNA, 17 bp, Homo sapiens
atgtgtcctcagggagc

SEQ ID NO: 1696644 - DNA, 18 bp, Homo sapiens
atgtgtcctcagggagca

SEQ ID NO: 1696645 - DNA, 15 bp, Homo sapiens
atgtgtgaaacaatg

SEQ ID NO: 1696646 - DNA, 19 bp, Homo sapiens
atgtgtgaggagctgctgg

SEQ ID NO: 1696647 - DNA, 15 bp, Homo sapiens
atgtgtgcatgtgtg

SEQ ID NO: 1696648 - DNA, 12 bp, Homo sapiens
atgtgtgcctgt

SEQ ID NO: 1696649 - DNA, 16 bp, Homo sapiens
atgtgtgcctgtggca

SEQ ID NO: 1696650 - DNA, 23 bp, Homo sapiens
atgtgtgcctgtggcagaaaaga

SEQ ID NO: 1696651 - DNA, 20 bp, Homo sapiens
atgtgtggctcattcttttc

SEQ ID NO: 1696652 - DNA, 17 bp, Homo sapiens
atgtgtgtaagtgtgtg

SEQ ID NO: 1696653 - DNA, 19 bp, Homo sapiens
atgtgtgtagacaaatatt

SEQ ID NO: 1696654 - DNA, 20 bp, Homo sapiens
atgtgtgtagacaaatattt

SEQ ID NO: 1696655 - DNA, 18 bp, Homo sapiens
atgtgtgtgtgtggcagg

SEQ ID NO: 1696656 - DNA, 18 bp, Homo sapiens
atgtgtgtgtgttgtgtg

SEQ ID NO: 1696657 - DNA, 22 bp, Homo sapiens
atgtgtgtgtgttgtgtgtggg

SEQ ID NO: 1696658 - DNA, 23 bp, Homo sapiens
atgtgtgtgtgttgtgtgtggga

SEQ ID NO: 1696659 - DNA, 20 bp, Homo sapiens
atgtgttaaacatgctaaat

SEQ ID NO: 1696660 - DNA, 23 bp, Homo sapiens
atgtgttctaagcaatgcaaatg

SEQ ID NO: 1696661 - DNA, 13 bp, Homo sapiens
atgtgttcttatt

SEQ ID NO: 1696662 - DNA, 23 bp, Homo sapiens
atgtgttcttttctcctttacca

SEQ ID NO: 1696663 - DNA, 14 bp, Homo sapiens
atgtgttgaaaaaa

SEQ ID NO: 1696664 - DNA, 16 bp, Homo sapiens
atgtgttgcaaattat

SEQ ID NO: 1696665 - DNA, 20 bp, Homo sapiens
atgtgttgtgtttgtagtct

SEQ ID NO: 1696666 - DNA, 20 bp, Homo sapiens
atgtgtttaaaacatgcacg

SEQ ID NO: 1696667 - DNA, 22 bp, Homo sapiens
atgtgttttgcacgtcttgcta

SEQ ID NO: 1696668 - DNA, 16 bp, Homo sapiens
atgttaaaaatagcag

SEQ ID NO: 1696669 - DNA, 16 bp, Homo sapiens
atgttaaagagaatga

SEQ ID NO: 1696670 - DNA, 17 bp, Homo sapiens
atgttaaagagaatgag

SEQ ID NO: 1696671 - DNA, 18 bp, Homo sapiens
atgttaaagcatcagaga

SEQ ID NO: 1696672 - DNA, 22 bp, Homo sapiens
atgttaactgagctactagaga

SEQ ID NO: 1696673 - DNA, 18 bp, Homo sapiens
atgttaagaaatgggttt

SEQ ID NO: 1696674 - DNA, 13 bp, Homo sapiens
atgttaagcagat

SEQ ID NO: 1696675 - DNA, 14 bp, Homo sapiens
atgttaagcattta

SEQ ID NO: 1696676 - DNA, 12 bp, Homo sapiens
atgttaatttat

SEQ ID NO: 1696677 - DNA, 17 bp, Homo sapiens
atgttacaagtttatat

SEQ ID NO: 1696678 - DNA, 19 bp, Homo sapiens
atgttacacattaaacagg

SEQ ID NO: 1696679 - DNA, 14 bp, Homo sapiens
atgttacattatta

SEQ ID NO: 1696680 - DNA, 14 bp, Homo sapiens
atgttacctaatta

SEQ ID NO: 1696681 - DNA, 22 bp, Homo sapiens
atgttactcagtgttagagaaa

SEQ ID NO: 1696682 - DNA, 18 bp, Homo sapiens
atgttagaatcaaatact

SEQ ID NO: 1696683 - DNA, 15 bp, Homo sapiens
atgttagcaaagagt

SEQ ID NO: 1696684 - DNA, 18 bp, Homo sapiens
atgttagcagacccagct

SEQ ID NO: 1696685 - DNA, 21 bp, Homo sapiens
atgttagcagacccagcttag

SEQ ID NO: 1696686 - DNA, 18 bp, Homo sapiens
atgttaggaaaatttcac

SEQ ID NO: 1696687 - DNA, 19 bp, Homo sapiens
atgttaggaaaatttcaca

SEQ ID NO: 1696688 - DNA, 23 bp, Homo sapiens
atgttagttaccttatagttact

SEQ ID NO: 1696689 - DNA, 16 bp, Homo sapiens
atgttatatcatatgt

SEQ ID NO: 1696690 - DNA, 19 bp, Homo sapiens
atgttatatcatatgtata

SEQ ID NO: 1696691 - DNA, 17 bp, Homo sapiens
atgttatcggattactg

SEQ ID NO: 1696692 - DNA, 19 bp, Homo sapiens
atgttatcggattactgaa

SEQ ID NO: 1696693 - DNA, 16 bp, Homo sapiens
atgttatcttctcaag

SEQ ID NO: 1696694 - DNA, 22 bp, Homo sapiens
atgttatcttctcaagttctaa

SEQ ID NO: 1696695 - DNA, 14 bp, Homo sapiens
atgttatgaacagc

SEQ ID NO: 1696696 - DNA, 17 bp, Homo sapiens
atgttatgaacagctgt

SEQ ID NO: 1696697 - DNA, 13 bp, Homo sapiens
atgttatgctggt

SEQ ID NO: 1696698 - DNA, 18 bp, Homo sapiens
atgttatgggatgtaaac

SEQ ID NO: 1696699 - DNA, 21 bp, Homo sapiens
atgttattactgttttgggcc

SEQ ID NO: 1696700 - DNA, 15 bp, Homo sapiens
atgttattacttgta

SEQ ID NO: 1696701 - DNA, 15 bp, Homo sapiens
atgttattctctcac

SEQ ID NO: 1696702 - DNA, 22 bp, Homo sapiens
atgttcaactggagacactatt

SEQ ID NO: 1696703 - DNA, 17 bp, Homo sapiens
atgttcagaagaaattc

SEQ ID NO: 1696704 - DNA, 23 bp, Homo sapiens
atgttcagaaggttgctctagat

SEQ ID NO: 1696705 - DNA, 16 bp, Homo sapiens
atgttcagattattgg

SEQ ID NO: 1696706 - DNA, 17 bp, Homo sapiens
atgttcaggaaatgaaa

SEQ ID NO: 1696707 - DNA, 19 bp, Homo sapiens
atgttcatatttattgatt

SEQ ID NO: 1696708 - DNA, 15 bp, Homo sapiens
atgttcatgtgatta

SEQ ID NO: 1696709 - DNA, 12 bp, Homo sapiens
atgttcattata

SEQ ID NO: 1696710 - DNA, 15 bp, Homo sapiens
atgttcattataatc

SEQ ID NO: 1696711 - DNA, 16 bp, Homo sapiens
atgttccacctgccac

SEQ ID NO: 1696712 - DNA, 17 bp, Homo sapiens
atgttccacctgccaca

SEQ ID NO: 1696713 - DNA, 17 bp, Homo sapiens
atgttccagtgaggaac

SEQ ID NO: 1696714 - DNA, 20 bp, Homo sapiens
atgttccagtgaggaaccct

SEQ ID NO: 1696715 - DNA, 19 bp, Homo sapiens
atgttccctcttgtccctt

SEQ ID NO: 1696716 - DNA, 19 bp, Homo sapiens
atgttccctgcaccctgga

SEQ ID NO: 1696717 - DNA, 16 bp, Homo sapiens
atgttcctaacaaaat

SEQ ID NO: 1696718 - DNA, 18 bp, Homo sapiens
atgttcctaacaaaatga

SEQ ID NO: 1696719 - DNA, 12 bp, Homo sapiens
atgttcctcctt

SEQ ID NO: 1696720 - DNA, 19 bp, Homo sapiens
atgttcctgaattctattt

SEQ ID NO: 1696721 - DNA, 23 bp, Homo sapiens
atgttcctgaattctatttgctg

SEQ ID NO: 1696722 - DNA, 12 bp, Homo sapiens
atgttcctgctg

SEQ ID NO: 1696723 - DNA, 13 bp, Homo sapiens
atgttcctgctgt

SEQ ID NO: 1696724 - DNA, 14 bp, Homo sapiens
atgttcctgctgta

SEQ ID NO: 1696725 - DNA, 14 bp, Homo sapiens
atgttccttaccaa

SEQ ID NO: 1696726 - DNA, 17 bp, Homo sapiens
atgttccttttttgtat

SEQ ID NO: 1696727 - DNA, 18 bp, Homo sapiens
atgttccttttttgtata

SEQ ID NO: 1696728 - DNA, 18 bp, Homo sapiens
atgttctaaaattattat

SEQ ID NO: 1696729 - DNA, 14 bp, Homo sapiens
atgttctaaggctc

SEQ ID NO: 1696730 - DNA, 16 bp, Homo sapiens
atatcttaaagaaaca

SEQ ID NO: 1696731 - DNA, 19 bp, Homo sapiens
atatcttggacaaatcaca

SEQ ID NO: 1696732 - DNA, 23 bp, Homo sapiens
atatcttggcctaaacctcagtt

SEQ ID NO: 1696733 - DNA, 20 bp, Homo sapiens
atatctttctcttacctgtt

SEQ ID NO: 1696734 - DNA, 19 bp, Homo sapiens
atatcttttgtaagacatt

SEQ ID NO: 1696735 - DNA, 21 bp, Homo sapiens
atatgaacctattttcatttg

SEQ ID NO: 1696736 - DNA, 23 bp, Homo sapiens
atatgaacctattttcatttgta

SEQ ID NO: 1696737 - DNA, 17 bp, Homo sapiens
atatgaatttaaatata

SEQ ID NO: 1696738 - DNA, 21 bp, Homo sapiens
atatgaatttaaatataattc

SEQ ID NO: 1696739 - DNA, 17 bp, Homo sapiens
atatgacccacactgcc

SEQ ID NO: 1696740 - DNA, 22 bp, Homo sapiens
atatgacccacactgccagaag

SEQ ID NO: 1696741 - DNA, 22 bp, Homo sapiens
atatgacctaaatccattttct

SEQ ID NO: 1696742 - DNA, 23 bp, Homo sapiens
atatgacctaaatccattttcta

SEQ ID NO: 1696743 - DNA, 16 bp, Homo sapiens
atatgacggaagaaca

SEQ ID NO: 1696744 - DNA, 23 bp, Homo sapiens
atatgacggaagaacatagaact

SEQ ID NO: 1696745 - DNA, 15 bp, Homo sapiens
atatgactttttata

SEQ ID NO: 1696746 - DNA, 23 bp, Homo sapiens
atatgagaaggtgcctcaagaat

SEQ ID NO: 1696747 - DNA, 23 bp, Homo sapiens
atatgagcttcaatataagaagc

SEQ ID NO: 1696748 - DNA, 20 bp, Homo sapiens
atatgagtagatactctcag

SEQ ID NO: 1696749 - DNA, 13 bp, Homo sapiens
atatgataaaaca

SEQ ID NO: 1696750 - DNA, 15 bp, Homo sapiens
atatgattctgcttt

SEQ ID NO: 1696751 - DNA, 14 bp, Homo sapiens
atatgattgaaaag

SEQ ID NO: 1696752 - DNA, 16 bp, Homo sapiens
atatgattgaaaagaa

SEQ ID NO: 1696753 - DNA, 13 bp, Homo sapiens
atatgatttaaaa

SEQ ID NO: 1696754 - DNA, 22 bp, Homo sapiens
atatgattttatttgacaaaat

SEQ ID NO: 1696755 - DNA, 13 bp, Homo sapiens
atatgcaaagcac

SEQ ID NO: 1696756 - DNA, 15 bp, Homo sapiens
atatgcaaagcactg

SEQ ID NO: 1696757 - DNA, 16 bp, Homo sapiens
atatgcaaagcactga

SEQ ID NO: 1696758 - DNA, 16 bp, Homo sapiens
atatgcacacatatat

SEQ ID NO: 1696759 - DNA, 21 bp, Homo sapiens
atatgcaccttgtgtctgtac

SEQ ID NO: 1696760 - DNA, 16 bp, Homo sapiens
atatgcactatgtata

SEQ ID NO: 1696761 - DNA, 18 bp, Homo sapiens
atatgcatatatatatgt

SEQ ID NO: 1696762 - DNA, 14 bp, Homo sapiens
atatgcatatttgt

SEQ ID NO: 1696763 - DNA, 19 bp, Homo sapiens
atatgctgaacgcagaaga

SEQ ID NO: 1696764 - DNA, 22 bp, Homo sapiens
atatgctgaacgcagaagaaag

SEQ ID NO: 1696765 - DNA, 16 bp, Homo sapiens
atatgctgatctttta

SEQ ID NO: 1696766 - DNA, 18 bp, Homo sapiens
atatgctgccaaattttg

SEQ ID NO: 1696767 - DNA, 22 bp, Homo sapiens
atatgctgccaaattttggcca

SEQ ID NO: 1696768 - DNA, 14 bp, Homo sapiens
atatgctgttatgt

SEQ ID NO: 1696769 - DNA, 16 bp, Homo sapiens
atatgcttttggaagt

SEQ ID NO: 1696770 - DNA, 15 bp, Homo sapiens
atatggaagaaagta

SEQ ID NO: 1696771 - DNA, 22 bp, Homo sapiens
atatggaggattctttccccag

SEQ ID NO: 1696772 - DNA, 23 bp, Homo sapiens
atatggaggattctttccccaga

SEQ ID NO: 1696773 - DNA, 11 bp, Homo sapiens
atatggctgcc

SEQ ID NO: 1696774 - DNA, 14 bp, Homo sapiens
atatgggactgagc

SEQ ID NO: 1696775 - DNA, 18 bp, Homo sapiens
atatggtatatatacata

SEQ ID NO: 1696776 - DNA, 12 bp, Homo sapiens
atatggtgaagg

SEQ ID NO: 1696777 - DNA, 16 bp, Homo sapiens
atatggtgaagggaag

SEQ ID NO: 1696778 - DNA, 21 bp, Homo sapiens
atatggtggtaataagggaaa

SEQ ID NO: 1696779 - DNA, 12 bp, Homo sapiens
atatgtaaaata

SEQ ID NO: 1696780 - DNA, 14 bp, Homo sapiens
atatgtaaaataaa

SEQ ID NO: 1696781 - DNA, 16 bp, Homo sapiens
atatgtaaaataaaat

SEQ ID NO: 1696782 - DNA, 18 bp, Homo sapiens
atatgtaatataaattta

SEQ ID NO: 1696783 - DNA, 18 bp, Homo sapiens
atatgtaattctttccat

SEQ ID NO: 1696784 - DNA, 13 bp, Homo sapiens
atatgtaatttca

SEQ ID NO: 1696785 - DNA, 14 bp, Homo sapiens
atatgtaatttcaa

SEQ ID NO: 1696786 - DNA, 23 bp, Homo sapiens
atatgtaatttcaaaatacattt

SEQ ID NO: 1696787 - DNA, 23 bp, Homo sapiens
atatgtactaagaatgtccttat

SEQ ID NO: 1696788 - DNA, 20 bp, Homo sapiens
atatgtagatattgttttct

SEQ ID NO: 1696789 - DNA, 23 bp, Homo sapiens
atatgtagatattgttttctgta

SEQ ID NO: 1696790 - DNA, 23 bp, Homo sapiens
atatgtagtgcatttttaaactt

SEQ ID NO: 1696791 - DNA, 20 bp, Homo sapiens
atatgtataatatatatcta

SEQ ID NO: 1696792 - DNA, 13 bp, Homo sapiens
atatgtatatata

SEQ ID NO: 1696793 - DNA, 16 bp, Homo sapiens
atatgtatatatacat

SEQ ID NO: 1696794 - DNA, 21 bp, Homo sapiens
atatgtatatgacatttaaat

SEQ ID NO: 1696795 - DNA, 13 bp, Homo sapiens
atatgtatatgta

SEQ ID NO: 1696796 - DNA, 23 bp, Homo sapiens
atatgtatatttttttaatttaa

SEQ ID NO: 1696797 - DNA, 23 bp, Homo sapiens
atatgtatggatctatattttca

SEQ ID NO: 1696798 - DNA, 17 bp, Homo sapiens
atatgtattacaaatgg

SEQ ID NO: 1696799 - DNA, 16 bp, Homo sapiens
atatgtattataggag

SEQ ID NO: 1696800 - DNA, 16 bp, Homo sapiens
atatgtattatttata

SEQ ID NO: 1696801 - DNA, 17 bp, Homo sapiens
atatgtattatttataa

SEQ ID NO: 1696802 - DNA, 18 bp, Homo sapiens
atatgtattatttataat

SEQ ID NO: 1696803 - DNA, 22 bp, Homo sapiens
atatgtattatttataattcct

SEQ ID NO: 1696804 - DNA, 23 bp, Homo sapiens
atatgtattatttataattccta

SEQ ID NO: 1696805 - DNA, 15 bp, Homo sapiens
atatgtattcccttg

SEQ ID NO: 1696806 - DNA, 18 bp, Homo sapiens
atatgtattcccttgtat

SEQ ID NO: 1696807 - DNA, 11 bp, Homo sapiens
atatgtcctgg

SEQ ID NO: 1696808 - DNA, 16 bp, Homo sapiens
atatgtgaacatttat

SEQ ID NO: 1696809 - DNA, 18 bp, Homo sapiens
atatgtgccacattttct

SEQ ID NO: 1696810 - DNA, 16 bp, Homo sapiens
atatgtgtatgtacgt

SEQ ID NO: 1696811 - DNA, 21 bp, Homo sapiens
atatgtgtgcctatttgtgtg

SEQ ID NO: 1696812 - DNA, 20 bp, Homo sapiens
atatgtgtgtgtatgtttgc

SEQ ID NO: 1696813 - DNA, 15 bp, Homo sapiens
atatgtgtgtgtttg

SEQ ID NO: 1696814 - DNA, 19 bp, Homo sapiens
atatgtgtttttcacattt

SEQ ID NO: 1696815 - DNA, 13 bp, Homo sapiens
atatgttgatcag

SEQ ID NO: 1696816 - DNA, 20 bp, Homo sapiens
atatgttgctataataaaga

SEQ ID NO: 1696817 - DNA, 20 bp, Homo sapiens
atatgtttaccttttaatta

SEQ ID NO: 1696818 - DNA, 14 bp, Homo sapiens
atatgtttcaaact

SEQ ID NO: 1696819 - DNA, 20 bp, Homo sapiens
atatgtttctgctagctata

SEQ ID NO: 1696820 - DNA, 17 bp, Homo sapiens
atatgtttttaaaggtg

SEQ ID NO: 1696821 - DNA, 22 bp, Homo sapiens
atattaaaattgttaatatgca

SEQ ID NO: 1696822 - DNA, 17 bp, Homo sapiens
atattaaacatccacaa

SEQ ID NO: 1696823 - DNA, 21 bp, Homo sapiens
atattaaagattctctttaaa

SEQ ID NO: 1696824 - DNA, 19 bp, Homo sapiens
atattaaatacagacacta

SEQ ID NO: 1696825 - DNA, 23 bp, Homo sapiens
atattaaatatgttagcaaagag

SEQ ID NO: 1696826 - DNA, 16 bp, Homo sapiens
atattaaatttcaaat

SEQ ID NO: 1696827 - DNA, 18 bp, Homo sapiens
atattaactcaaaagttg

SEQ ID NO: 1696828 - DNA, 15 bp, Homo sapiens
atattaagaaagact

SEQ ID NO: 1696829 - DNA, 19 bp, Homo sapiens
atattaagaagcaataact

SEQ ID NO: 1696830 - DNA, 16 bp, Homo sapiens
atattaagacagtgta

SEQ ID NO: 1696831 - DNA, 20 bp, Homo sapiens
atattaagacagtgtacaaa

SEQ ID NO: 1696832 - DNA, 15 bp, Homo sapiens
atattaagcacttta

SEQ ID NO: 1696833 - DNA, 12 bp, Homo sapiens
atattaatcaaa

SEQ ID NO: 1696834 - DNA, 19 bp, Homo sapiens
atattaatcaaaattgtct

SEQ ID NO: 1696835 - DNA, 17 bp, Homo sapiens
atattaatgcctttaaa

SEQ ID NO: 1696836 - DNA, 14 bp, Homo sapiens
atattacctggatt

SEQ ID NO: 1696837 - DNA, 15 bp, Homo sapiens
atattacctggatta

SEQ ID NO: 1696838 - DNA, 23 bp, Homo sapiens
atattactctcattctttgaaca

SEQ ID NO: 1696839 - DNA, 16 bp, Homo sapiens
atattactgacatttc

SEQ ID NO: 1696840 - DNA, 21 bp, Homo sapiens
atgtgaagacattttttgcta

SEQ ID NO: 1696841 - DNA, 15 bp, Homo sapiens
atgtgaagaggtctg

SEQ ID NO: 1696842 - DNA, 21 bp, Homo sapiens
atgtgaagaggtctgattggc

SEQ ID NO: 1696843 - DNA, 13 bp, Homo sapiens
atgtgaagcatgc

SEQ ID NO: 1696844 - DNA, 14 bp, Homo sapiens
atgtgaagcatgct

SEQ ID NO: 1696845 - DNA, 16 bp, Homo sapiens
atgtgaagcatgcttt

SEQ ID NO: 1696846 - DNA, 22 bp, Homo sapiens
atgtgaagcatgctttgctgct

SEQ ID NO: 1696847 - DNA, 19 bp, Homo sapiens
atgtgaagttcatcttgca

SEQ ID NO: 1696848 - DNA, 20 bp, Homo sapiens
atgtgaataggttatatgca

SEQ ID NO: 1696849 - DNA, 21 bp, Homo sapiens
atgtgaatcagaccctacccc

SEQ ID NO: 1696850 - DNA, 20 bp, Homo sapiens
atgtgaatgatctctctgaa

SEQ ID NO: 1696851 - DNA, 20 bp, Homo sapiens
atgtgaattattgacactga

SEQ ID NO: 1696852 - DNA, 11 bp, Homo sapiens
atgtgaatttt

SEQ ID NO: 1696853 - DNA, 15 bp, Homo sapiens
atgtgaatttttaag

SEQ ID NO: 1696854 - DNA, 16 bp, Homo sapiens
atgtgaatttttaagc

SEQ ID NO: 1696855 - DNA, 19 bp, Homo sapiens
atgtgaatttttaagctgc

SEQ ID NO: 1696856 - DNA, 17 bp, Homo sapiens
atgtgaatttttattgt

SEQ ID NO: 1696857 - DNA, 18 bp, Homo sapiens
atgtgaatttttattgtt

SEQ ID NO: 1696858 - DNA, 19 bp, Homo sapiens
atgtgaatttttatttctt

SEQ ID NO: 1696859 - DNA, 21 bp, Homo sapiens
atgtgacaattttgtacaaat

SEQ ID NO: 1696860 - DNA, 18 bp, Homo sapiens
atgtgacacctaactctt

SEQ ID NO: 1696861 - DNA, 19 bp, Homo sapiens
atgtgacacctaactcttt

SEQ ID NO: 1696862 - DNA, 16 bp, Homo sapiens
atgtgacaggtaaact

SEQ ID NO: 1696863 - DNA, 16 bp, Homo sapiens
atgtgaccataatgta

SEQ ID NO: 1696864 - DNA, 14 bp, Homo sapiens
atgtgacccaccag

SEQ ID NO: 1696865 - DNA, 17 bp, Homo sapiens
atgtgacccaccagtgc

SEQ ID NO: 1696866 - DNA, 14 bp, Homo sapiens
atgtgactgcatca

SEQ ID NO: 1696867 - DNA, 19 bp, Homo sapiens
atgtgactgcatcatatat

SEQ ID NO: 1696868 - DNA, 14 bp, Homo sapiens
atgtgagagaaagt

SEQ ID NO: 1696869 - DNA, 16 bp, Homo sapiens
atgtgagcacatgcgt

SEQ ID NO: 1696870 - DNA, 18 bp, Homo sapiens
atgtgagcacatgcgtat

SEQ ID NO: 1696871 - DNA, 15 bp, Homo sapiens
atgtgagctcttcct

SEQ ID NO: 1696872 - DNA, 16 bp, Homo sapiens
atgtgaggaggaaaag

SEQ ID NO: 1696873 - DNA, 19 bp, Homo sapiens
atgtgaggggtccctagca

SEQ ID NO: 1696874 - DNA, 23 bp, Homo sapiens
atgtgagtgccttttgcagaaga

SEQ ID NO: 1696875 - DNA, 21 bp, Homo sapiens
atgtgatacattttttaagct

SEQ ID NO: 1696876 - DNA, 22 bp, Homo sapiens
atgtgatacattttttaagctt

SEQ ID NO: 1696877 - DNA, 21 bp, Homo sapiens
atgtgatacccatagcttcca

SEQ ID NO: 1696878 - DNA, 17 bp, Homo sapiens
atgtgatcaactgttca

SEQ ID NO: 1696879 - DNA, 13 bp, Homo sapiens
atgtgatcactga

SEQ ID NO: 1696880 - DNA, 23 bp, Homo sapiens
atgtgatcagctttcaaagcatt

SEQ ID NO: 1696881 - DNA, 19 bp, Homo sapiens
atgtgatcatgtgtggaag

SEQ ID NO: 1696882 - DNA, 16 bp, Homo sapiens
atgtgatctcattgtt

SEQ ID NO: 1696883 - DNA, 15 bp, Homo sapiens
atgtgatgttctaag

SEQ ID NO: 1696884 - DNA, 17 bp, Homo sapiens
atgtgattaactcttag

SEQ ID NO: 1696885 - DNA, 18 bp, Homo sapiens
atgtgattaactcttaga

SEQ ID NO: 1696886 - DNA, 15 bp, Homo sapiens
atgtgattacaaggc

SEQ ID NO: 1696887 - DNA, 16 bp, Homo sapiens
atgtgattccttttga

SEQ ID NO: 1696888 - DNA, 14 bp, Homo sapiens
atgtgcaaatgcaa

SEQ ID NO: 1696889 - DNA, 19 bp, Homo sapiens
atgtgcaaggattgtacac

SEQ ID NO: 1696890 - DNA, 10 bp, Homo sapiens
atgtgcaata

SEQ ID NO: 1696891 - DNA, 14 bp, Homo sapiens
atgtgcaataattt

SEQ ID NO: 1696892 - DNA, 18 bp, Homo sapiens
atgtgcaataatttgtac

SEQ ID NO: 1696893 - DNA, 19 bp, Homo sapiens
atgtgcaataatttgtaca

SEQ ID NO: 1696894 - DNA, 13 bp, Homo sapiens
atgtgcaatagaa

SEQ ID NO: 1696895 - DNA, 16 bp, Homo sapiens
atgtgcacacacacgc

SEQ ID NO: 1696896 - DNA, 18 bp, Homo sapiens
atgtgcagaaaatattta

SEQ ID NO: 1696897 - DNA, 21 bp, Homo sapiens
atgtgcagactgattggcctg

SEQ ID NO: 1696898 - DNA, 17 bp, Homo sapiens
atgtgcaggaagaaaag

SEQ ID NO: 1696899 - DNA, 19 bp, Homo sapiens
atgtgcaggaagaaaagcc

SEQ ID NO: 1696900 - DNA, 19 bp, Homo sapiens
atgtgcagggatattgcct

SEQ ID NO: 1696901 - DNA, 20 bp, Homo sapiens
atgtgcagggatattgcctt

SEQ ID NO: 1696902 - DNA, 22 bp, Homo sapiens
atgtgcagggatattgccttat

SEQ ID NO: 1696903 - DNA, 23 bp, Homo sapiens
atgtgcatttcacctgtgacaaa

SEQ ID NO: 1696904 - DNA, 21 bp, Homo sapiens
atgtgcatttttgtgaaatga

SEQ ID NO: 1696905 - DNA, 15 bp, Homo sapiens
atgtgccaaagcttt

SEQ ID NO: 1696906 - DNA, 22 bp, Homo sapiens
atgtgccaagattctactcttg

SEQ ID NO: 1696907 - DNA, 15 bp, Homo sapiens
atgtgccaccaacat

SEQ ID NO: 1696908 - DNA, 16 bp, Homo sapiens
atgtgccagttcctgt

SEQ ID NO: 1696909 - DNA, 17 bp, Homo sapiens
atgtgccagttcctgta

SEQ ID NO: 1696910 - DNA, 19 bp, Homo sapiens
atgtgccatctgtacatat

SEQ ID NO: 1696911 - DNA, 19 bp, Homo sapiens
atgtgcctgcaccaggaga

SEQ ID NO: 1696912 - DNA, 20 bp, Homo sapiens
atgtgccttaagttttagtc

SEQ ID NO: 1696913 - DNA, 23 bp, Homo sapiens
atgtgccttaagttttagtcttt

SEQ ID NO: 1696914 - DNA, 10 bp, Homo sapiens
atgtgccttt

SEQ ID NO: 1696915 - DNA, 11 bp, Homo sapiens
atgtgcctttc

SEQ ID NO: 1696916 - DNA, 14 bp, Homo sapiens
atgtgcctttcttt

SEQ ID NO: 1696917 - DNA, 20 bp, Homo sapiens
atgtgcctttctttgcctct

SEQ ID NO: 1696918 - DNA, 22 bp, Homo sapiens
atgtgcctttctttgcctctgc

SEQ ID NO: 1696919 - DNA, 14 bp, Homo sapiens
atgtgccttttctg

SEQ ID NO: 1696920 - DNA, 14 bp, Homo sapiens
atgtgctactgatt

SEQ ID NO: 1696921 - DNA, 17 bp, Homo sapiens
atgtgctatacacacac

SEQ ID NO: 1696922 - DNA, 19 bp, Homo sapiens
atgtgctatacacacacac

SEQ ID NO: 1696923 - DNA, 13 bp, Homo sapiens
atgtgctatgcaa

SEQ ID NO: 1696924 - DNA, 16 bp, Homo sapiens
atgtgctatgcaaaat

SEQ ID NO: 1696925 - DNA, 20 bp, Homo sapiens
atgtgctatgcaaaatagac

SEQ ID NO: 1696926 - DNA, 22 bp, Homo sapiens
atgtgctatgcaaaatagacat

SEQ ID NO: 1696927 - DNA, 18 bp, Homo sapiens
atgtgctcagccaaattt

SEQ ID NO: 1696928 - DNA, 15 bp, Homo sapiens
atgtgctgtaattta

SEQ ID NO: 1696929 - DNA, 19 bp, Homo sapiens
atgtgctgtgtgagtgagc

SEQ ID NO: 1696930 - DNA, 21 bp, Homo sapiens
atgtgctttgctgcacaaaca

SEQ ID NO: 1696931 - DNA, 20 bp, Homo sapiens
atgtgcttttccatctaaaa

SEQ ID NO: 1696932 - DNA, 21 bp, Homo sapiens
atgtgcttttccatctaaaat

SEQ ID NO: 1696933 - DNA, 15 bp, Homo sapiens
atgtgcttttctcca

SEQ ID NO: 1696934 - DNA, 12 bp, Homo sapiens
atgtggaagagc

SEQ ID NO: 1696935 - DNA, 16 bp, Homo sapiens
atgtggacttaggaag

SEQ ID NO: 1696936 - DNA, 14 bp, Homo sapiens
atgtggaggaagag

SEQ ID NO: 1696937 - DNA, 22 bp, Homo sapiens
atgtggaggaagagccacctgc

SEQ ID NO: 1696938 - DNA, 15 bp, Homo sapiens
atgtggcagaagtgc

SEQ ID NO: 1696939 - DNA, 22 bp, Homo sapiens
atgtggcagctggggagcagct

SEQ ID NO: 1696940 - DNA, 22 bp, Homo sapiens
atgtggcccctgaacaagaatt

SEQ ID NO: 1696941 - DNA, 13 bp, Homo sapiens
atgtggccctggc

SEQ ID NO: 1696942 - DNA, 15 bp, Homo sapiens
atgtggccctggcct

SEQ ID NO: 1696943 - DNA, 19 bp, Homo sapiens
atgtggccctggcctgctg

SEQ ID NO: 1696944 - DNA, 19 bp, Homo sapiens
atgtggcctaaaaatgcaa

SEQ ID NO: 1696945 - DNA, 19 bp, Homo sapiens
atgtggctgaaaatgcaaa

SEQ ID NO: 1696946 - DNA, 14 bp, Homo sapiens
atgtggctggaaga

SEQ ID NO: 1696947 - DNA, 15 bp, Homo sapiens
atgtgggaaaaaaag

SEQ ID NO: 1696948 - DNA, 19 bp, Homo sapiens
atgtgggatattgaatgtt

SEQ ID NO: 1696949 - DNA, 13 bp, Homo sapiens
atgtgggattatg

SEQ ID NO: 1696950 - DNA, 22 bp, Homo sapiens
atgtgggattatgggtcacagg

SEQ ID NO: 1696951 - DNA, 20 bp, Homo sapiens
atgtgggcgcccaccctggg

SEQ ID NO: 1696952 - DNA, 16 bp, Homo sapiens
atgtggggccaggtca

SEQ ID NO: 1696953 - DNA, 13 bp, Homo sapiens
atgtggggctgag

SEQ ID NO: 1696954 - DNA, 17 bp, Homo sapiens
atgtggggctgagctgg

SEQ ID NO: 1696955 - DNA, 18 bp, Homo sapiens
atgtgggggtctgtgtgt

SEQ ID NO: 1696956 - DNA, 16 bp, Homo sapiens
atgtatatgtttatat

SEQ ID NO: 1696957 - DNA, 15 bp, Homo sapiens
atgtatcctgataaa

SEQ ID NO: 1696958 - DNA, 22 bp, Homo sapiens
atgtatcctgataaacattaaa

SEQ ID NO: 1696959 - DNA, 16 bp, Homo sapiens
atgtatctatttgtac

SEQ ID NO: 1696960 - DNA, 17 bp, Homo sapiens
atgtatctatttgtaca

SEQ ID NO: 1696961 - DNA, 13 bp, Homo sapiens
atgtatgaaattg

SEQ ID NO: 1696962 - DNA, 14 bp, Homo sapiens
atgtatgcattcac

SEQ ID NO: 1696963 - DNA, 23 bp, Homo sapiens
atgtatgcctgcaatatgggaac

SEQ ID NO: 1696964 - DNA, 18 bp, Homo sapiens
atgtatggaatacagtgt

SEQ ID NO: 1696965 - DNA, 20 bp, Homo sapiens
atgtatggaatacagtgtta

SEQ ID NO: 1696966 - DNA, 21 bp, Homo sapiens
atgtatggaatacagtgttat

SEQ ID NO: 1696967 - DNA, 22 bp, Homo sapiens
atgtatggaatcccactgtatg

SEQ ID NO: 1696968 - DNA, 17 bp, Homo sapiens
aggacacctggccgcct

SEQ ID NO: 1696969 - DNA, 19 bp, Homo sapiens
aggacagaaggactggtgc

SEQ ID NO: 1696970 - DNA, 13 bp, Homo sapiens
aggacagaatgtg

SEQ ID NO: 1696971 - DNA, 14 bp, Homo sapiens
aggacagaatgtgt

SEQ ID NO: 1696972 - DNA, 12 bp, Homo sapiens
aggacagagcca

SEQ ID NO: 1696973 - DNA, 13 bp, Homo sapiens
aggacagagccag

SEQ ID NO: 1696974 - DNA, 17 bp, Homo sapiens
aggacagaggccggggt

SEQ ID NO: 1696975 - DNA, 22 bp, Homo sapiens
aggacagaggccggggtccagg

SEQ ID NO: 1696976 - DNA, 12 bp, Homo sapiens
aggacagcagct

SEQ ID NO: 1696977 - DNA, 14 bp, Homo sapiens
aggacagcagctgg

SEQ ID NO: 1696978 - DNA, 18 bp, Homo sapiens
aggacagcagctggtgcc

SEQ ID NO: 1696979 - DNA, 23 bp, Homo sapiens
aggacagcctgtggcggtgcctg

SEQ ID NO: 1696980 - DNA, 12 bp, Homo sapiens
aggacagctctt

SEQ ID NO: 1696981 - DNA, 13 bp, Homo sapiens
aggacagctcttg

SEQ ID NO: 1696982 - DNA, 19 bp, Homo sapiens
aggacaggaagctggcaga

SEQ ID NO: 1696983 - DNA, 16 bp, Homo sapiens
aggacaggaggcggcc

SEQ ID NO: 1696984 - DNA, 12 bp, Homo sapiens
aggacaggcccg

SEQ ID NO: 1696985 - DNA, 12 bp, Homo sapiens
aggacagtattt

SEQ ID NO: 1696986 - DNA, 13 bp, Homo sapiens
aggacagtctgga

SEQ ID NO: 1696987 - DNA, 20 bp, Homo sapiens
aggacagtctggagaaggta

SEQ ID NO: 1696988 - DNA, 16 bp, Homo sapiens
aggacagtttttttgt

SEQ ID NO: 1696989 - DNA, 22 bp, Homo sapiens
aggacatgcaataaaatttaaa

SEQ ID NO: 1696990 - DNA, 21 bp, Homo sapiens
aggacattgtatgcagggagc

SEQ ID NO: 1696991 - DNA, 19 bp, Homo sapiens
aggaccaactggcttctgt

SEQ ID NO: 1696992 - DNA, 22 bp, Homo sapiens
aggaccacagtgggtggcacct

SEQ ID NO: 1696993 - DNA, 21 bp, Homo sapiens
aggaccaccagcaggcaggtg

SEQ ID NO: 1696994 - DNA, 13 bp, Homo sapiens
aggaccagcctgt

SEQ ID NO: 1696995 - DNA, 12 bp, Homo sapiens
aggaccagctca

SEQ ID NO: 1696996 - DNA, 15 bp, Homo sapiens
aggaccagctcagga

SEQ ID NO: 1696997 - DNA, 24 bp, Homo sapiens
aggaccagctcaggacagatgcca

SEQ ID NO: 1696998 - DNA, 14 bp, Homo sapiens
aggaccagctgggg

SEQ ID NO: 1696999 - DNA, 12 bp, Homo sapiens
aggaccaggact

SEQ ID NO: 1697000 - DNA, 17 bp, Homo sapiens
aggaccaggactccctc

SEQ ID NO: 1697001 - DNA, 15 bp, Homo sapiens
aggaccagggccttt

SEQ ID NO: 1697002 - DNA, 20 bp, Homo sapiens
aggaccagggccttttctgg

SEQ ID NO: 1697003 - DNA, 14 bp, Homo sapiens
aggacccaggaaag

SEQ ID NO: 1697004 - DNA, 15 bp, Homo sapiens
aggacccaggccctc

SEQ ID NO: 1697005 - DNA, 19 bp, Homo sapiens
aggacccaggccctccatg

SEQ ID NO: 1697006 - DNA, 18 bp, Homo sapiens
aggacccatcacgcctgt

SEQ ID NO: 1697007 - DNA, 20 bp, Homo sapiens
aggaccccttaatcttgctt

SEQ ID NO: 1697008 - DNA, 17 bp, Homo sapiens
aggacccgccagccccg

SEQ ID NO: 1697009 - DNA, 21 bp, Homo sapiens
aggacccggaggggcctggca

SEQ ID NO: 1697010 - DNA, 20 bp, Homo sapiens
aggacccgggaccacagctg

SEQ ID NO: 1697011 - DNA, 22 bp, Homo sapiens
agctggtttcctcattcctgaa

SEQ ID NO: 1697012 - DNA, 22 bp, Homo sapiens
agctgtaagaagagactgggaa

SEQ ID NO: 1697013 - DNA, 17 bp, Homo sapiens
agctgtaagggcagtgc

SEQ ID NO: 1697014 - DNA, 19 bp, Homo sapiens
agctgtaatgtttcacaga

SEQ ID NO: 1697015 - DNA, 22 bp, Homo sapiens
agctgtaatttcgccttaaact

SEQ ID NO: 1697016 - DNA, 18 bp, Homo sapiens
agctgtacgaaaaagagc

SEQ ID NO: 1697017 - DNA, 19 bp, Homo sapiens
agctgtactcagagcagag

SEQ ID NO: 1697018 - DNA, 21 bp, Homo sapiens
agctgtacttcgtcttctaat

SEQ ID NO: 1697019 - DNA, 19 bp, Homo sapiens
agctgtacttcttgaatat

SEQ ID NO: 1697020 - DNA, 16 bp, Homo sapiens
agctgtagaaatgtat

SEQ ID NO: 1697021 - DNA, 19 bp, Homo sapiens
agctgtagaaatgtatcct

SEQ ID NO: 1697022 - DNA, 21 bp, Homo sapiens
agctgtataattaattgtcat

SEQ ID NO: 1697023 - DNA, 16 bp, Homo sapiens
agctgtatgatttgtt

SEQ ID NO: 1697024 - DNA, 20 bp, Homo sapiens
agctgtcacttttgctccga

SEQ ID NO: 1697025 - DNA, 16 bp, Homo sapiens
agctgtcccctctgtc

SEQ ID NO: 1697026 - DNA, 15 bp, Homo sapiens
agctgtccctgtcac

SEQ ID NO: 1697027 - DNA, 15 bp, Homo sapiens
agctgtcctgcagca

SEQ ID NO: 1697028 - DNA, 22 bp, Homo sapiens
agctgtcctgcagcaaacactc

SEQ ID NO: 1697029 - DNA, 14 bp, Homo sapiens
agctgtgaaatcca

SEQ ID NO: 1697030 - DNA, 14 bp, Homo sapiens
agctgtgcaggcat

SEQ ID NO: 1697031 - DNA, 17 bp, Homo sapiens
agctgtgcaggcatggt

SEQ ID NO: 1697032 - DNA, 15 bp, Homo sapiens
agctgtgccagcagg

SEQ ID NO: 1697033 - DNA, 14 bp, Homo sapiens
agctgtgcctgctc

SEQ ID NO: 1697034 - DNA, 15 bp, Homo sapiens
agctgtgcctgctca

SEQ ID NO: 1697035 - DNA, 17 bp, Homo sapiens
agctgtgcctgctcagc

SEQ ID NO: 1697036 - DNA, 21 bp, Homo sapiens
agctgtgcctgctcagcagcc

SEQ ID NO: 1697037 - DNA, 22 bp, Homo sapiens
agctgtggaggattgctatctg

SEQ ID NO: 1697038 - DNA, 21 bp, Homo sapiens
agctgtggcagagttacagtt

SEQ ID NO: 1697039 - DNA, 23 bp, Homo sapiens
agctgtggctggaggagctggcc

SEQ ID NO: 1697040 - DNA, 21 bp, Homo sapiens
agctgtgtctgacatgtttgt

SEQ ID NO: 1697041 - DNA, 14 bp, Homo sapiens
agctgtgtctgcca

SEQ ID NO: 1697042 - DNA, 15 bp, Homo sapiens
agctgtgtctgccaa

SEQ ID NO: 1697043 - DNA, 21 bp, Homo sapiens
agctgtgtctgccaaacacat

SEQ ID NO: 1697044 - DNA, 23 bp, Homo sapiens
agctgtgtgaaataccagtgtgg

SEQ ID NO: 1697045 - DNA, 21 bp, Homo sapiens
agctgtgtgaatacctgctca

SEQ ID NO: 1697046 - DNA, 23 bp, Homo sapiens
agctgtgtgacatttggagaggg

SEQ ID NO: 1697047 - DNA, 21 bp, Homo sapiens
agctgtgttttgtctgagcct

SEQ ID NO: 1697048 - DNA, 22 bp, Homo sapiens
agctgtgttttgtctgagcctc

SEQ ID NO: 1697049 - DNA, 23 bp, Homo sapiens
agctgtgttttgtctgagcctct

SEQ ID NO: 1697050 - DNA, 16 bp, Homo sapiens
agctgttagggctgaa

SEQ ID NO: 1697051 - DNA, 15 bp, Homo sapiens
agctgttatttcttc

SEQ ID NO: 1697052 - DNA, 14 bp, Homo sapiens
agctgttctggact

SEQ ID NO: 1697053 - DNA, 13 bp, Homo sapiens
agctgttgagctg

SEQ ID NO: 1697054 - DNA, 14 bp, Homo sapiens
agctgttgagctgt

SEQ ID NO: 1697055 - DNA, 14 bp, Homo sapiens
agctgttggaagaa

SEQ ID NO: 1697056 - DNA, 17 bp, Homo sapiens
agctgttggaagaaaag

SEQ ID NO: 1697057 - DNA, 16 bp, Homo sapiens
agctgttgtgagcttt

SEQ ID NO: 1697058 - DNA, 19 bp, Homo sapiens
agctgtttatggcctcagc

SEQ ID NO: 1697059 - DNA, 21 bp, Homo sapiens
agctgtttatggcctcagctg

SEQ ID NO: 1697060 - DNA, 13 bp, Homo sapiens
agctgtttctcat

SEQ ID NO: 1697061 - DNA, 22 bp, Homo sapiens
agctgtttctcatgaagctaat

SEQ ID NO: 1697062 - DNA, 13 bp, Homo sapiens
agctgtttggaaa

SEQ ID NO: 1697063 - DNA, 14 bp, Homo sapiens
agcttaaaacactt

SEQ ID NO: 1697064 - DNA, 19 bp, Homo sapiens
agcttaaacccatacaatg

SEQ ID NO: 1697065 - DNA, 21 bp, Homo sapiens
aggaaagggggtcccagtggg

SEQ ID NO: 1697066 - DNA, 17 bp, Homo sapiens
aggaaagtacatttttt

SEQ ID NO: 1697067 - DNA, 19 bp, Homo sapiens
aggaaataacagagagaat

SEQ ID NO: 1697068 - DNA, 21 bp, Homo sapiens
aggaaatagtaccttcaatac

SEQ ID NO: 1697069 - DNA, 20 bp, Homo sapiens
aggaaatcaaatatgcaaag

SEQ ID NO: 1697070 - DNA, 16 bp, Homo sapiens
aggaaatctcacccca

SEQ ID NO: 1697071 - DNA, 16 bp, Homo sapiens
aggaaatgttggaact

SEQ ID NO: 1697072 - DNA, 13 bp, Homo sapiens
aggaacaaacagg

SEQ ID NO: 1697073 - DNA, 14 bp, Homo sapiens
aggaacaaagacag

SEQ ID NO: 1697074 - DNA, 16 bp, Homo sapiens
aggaacaagcatgtct

SEQ ID NO: 1697075 - DNA, 21 bp, Homo sapiens
aggaacagaaggatgaatgag

SEQ ID NO: 1697076 - DNA, 22 bp, Homo sapiens
aggaacagccacaaaatacaca

SEQ ID NO: 1697077 - DNA, 17 bp, Homo sapiens
aggaacagtattacagt

SEQ ID NO: 1697078 - DNA, 16 bp, Homo sapiens
aggaacattgtgtcta

SEQ ID NO: 1697079 - DNA, 23 bp, Homo sapiens
aggaaccacaatgtttcttcatt

SEQ ID NO: 1697080 - DNA, 22 bp, Homo sapiens
aggaaccgtggtatgtctgcca

SEQ ID NO: 1697081 - DNA, 20 bp, Homo sapiens
aggaaccttccttcctgctt

SEQ ID NO: 1697082 - DNA, 16 bp, Homo sapiens
aggaacgagcactggc

SEQ ID NO: 1697083 - DNA, 21 bp, Homo sapiens
aggaacgagcactggccagag

SEQ ID NO: 1697084 - DNA, 22 bp, Homo sapiens
aggaacgagcactggccagaga

SEQ ID NO: 1697085 - DNA, 16 bp, Homo sapiens
aggaactagaaagaag

SEQ ID NO: 1697086 - DNA, 15 bp, Homo sapiens
aggaactcgcctcag

SEQ ID NO: 1697087 - DNA, 16 bp, Homo sapiens
aggaactcgcctcagc

SEQ ID NO: 1697088 - DNA, 13 bp, Homo sapiens
aggaacttcagag

SEQ ID NO: 1697089 - DNA, 14 bp, Homo sapiens
aggaactttctggt

SEQ ID NO: 1697090 - DNA, 15 bp, Homo sapiens
aggaagaaatcacag

SEQ ID NO: 1697091 - DNA, 15 bp, Homo sapiens
aggaagaaattcagg

SEQ ID NO: 1697092 - DNA, 19 bp, Homo sapiens
aggaagaaattcaggtaca

SEQ ID NO: 1697093 - DNA, 12 bp, Homo sapiens
aggaagaacggg

SEQ ID NO: 1697094 - DNA, 15 bp, Homo sapiens
aggaagaaggcagtg

SEQ ID NO: 1697095 - DNA, 12 bp, Homo sapiens
aggaagagcagg

SEQ ID NO: 1697096 - DNA, 11 bp, Homo sapiens
aggaagagcca

SEQ ID NO: 1697097 - DNA, 18 bp, Homo sapiens
aggaagagccacctgcaa

SEQ ID NO: 1697098 - DNA, 19 bp, Homo sapiens
aggaagagccacctgcaag

SEQ ID NO: 1697099 - DNA, 20 bp, Homo sapiens
aggaagagccacctgcaaga

SEQ ID NO: 1697100 - DNA, 19 bp, Homo sapiens
aggaagagcccgcagggcc

SEQ ID NO: 1697101 - DNA, 12 bp, Homo sapiens
aggaagaggccc

SEQ ID NO: 1697102 - DNA, 12 bp, Homo sapiens
aggaagagttta

SEQ ID NO: 1697103 - DNA, 19 bp, Homo sapiens
aggaagatcttgagagctg

SEQ ID NO: 1697104 - DNA, 21 bp, Homo sapiens
aggaagatcttgagagctgct

SEQ ID NO: 1697105 - DNA, 20 bp, Homo sapiens
aggaagcagcctcagagtgg

SEQ ID NO: 1697106 - DNA, 15 bp, Homo sapiens
aggaagcattgtaaa

SEQ ID NO: 1697107 - DNA, 16 bp, Homo sapiens
aggaagcattgtaaaa

SEQ ID NO: 1697108 - DNA, 15 bp, Homo sapiens
aggaagccaggctga

SEQ ID NO: 1697109 - DNA, 16 bp, Homo sapiens
aggaagccaggctgag

SEQ ID NO: 1697110 - DNA, 14 bp, Homo sapiens
aggaagcccacata

SEQ ID NO: 1697111 - DNA, 20 bp, Homo sapiens
aggaagcctgcagtcctgga

SEQ ID NO: 1697112 - DNA, 13 bp, Homo sapiens
agcttgaggccaa

SEQ ID NO: 1697113 - DNA, 21 bp, Homo sapiens
agcttgaggccaagatggctg

SEQ ID NO: 1697114 - DNA, 15 bp, Homo sapiens
agcttgattaaatca

SEQ ID NO: 1697115 - DNA, 21 bp, Homo sapiens
agcttgcaagaagcaggaagg

SEQ ID NO: 1697116 - DNA, 14 bp, Homo sapiens
agcttgcagctgga

SEQ ID NO: 1697117 - DNA, 18 bp, Homo sapiens
agcttgccctgttaaaag

SEQ ID NO: 1697118 - DNA, 14 bp, Homo sapiens
agcttgctccagat

SEQ ID NO: 1697119 - DNA, 21 bp, Homo sapiens
agcttgctccagattctgatg

SEQ ID NO: 1697120 - DNA, 22 bp, Homo sapiens
agcttgctccagattctgatgc

SEQ ID NO: 1697121 - DNA, 14 bp, Homo sapiens
agcttgctcttcag

SEQ ID NO: 1697122 - DNA, 20 bp, Homo sapiens
agcttgctgtcacttcttca

SEQ ID NO: 1697123 - DNA, 21 bp, Homo sapiens
agcttgcttgctttctttttt

SEQ ID NO: 1697124 - DNA, 23 bp, Homo sapiens
agcttgcttgctttcttttttaa

SEQ ID NO: 1697125 - DNA, 21 bp, Homo sapiens
agcttggcaattcatggggca

SEQ ID NO: 1697126 - DNA, 21 bp, Homo sapiens
agcttggcagccgagctcgtg

SEQ ID NO: 1697127 - DNA, 12 bp, Homo sapiens
agcttggctcac

SEQ ID NO: 1697128 - DNA, 15 bp, Homo sapiens
agcttggcttcctct

SEQ ID NO: 1697129 - DNA, 10 bp, Homo sapiens
agcttgggcc

SEQ ID NO: 1697130 - DNA, 16 bp, Homo sapiens
agcttgggcccagctg

SEQ ID NO: 1697131 - DNA, 18 bp, Homo sapiens
agcttgggcccagctggg

SEQ ID NO: 1697132 - DNA, 23 bp, Homo sapiens
agcttggggccaccaaagctgcc

SEQ ID NO: 1697133 - DNA, 22 bp, Homo sapiens
agcttgggtccaccatgcagaa

SEQ ID NO: 1697134 - DNA, 18 bp, Homo sapiens
agcttgggtttttgttac

SEQ ID NO: 1697135 - DNA, 14 bp, Homo sapiens
agcttggttccagg

SEQ ID NO: 1697136 - DNA, 22 bp, Homo sapiens
agcttgtccaacccgaggcccg

SEQ ID NO: 1697137 - DNA, 14 bp, Homo sapiens
agcttgtggcccct

SEQ ID NO: 1697138 - DNA, 17 bp, Homo sapiens
agcttgtggtgttcctg

SEQ ID NO: 1697139 - DNA, 23 bp, Homo sapiens
agcttgtggtgttcctgaagcaa

SEQ ID NO: 1697140 - DNA, 17 bp, Homo sapiens
agcttgtgtcctgtcct

SEQ ID NO: 1697141 - DNA, 15 bp, Homo sapiens
agcttgttgaaaacc

SEQ ID NO: 1697142 - DNA, 18 bp, Homo sapiens
agcttgtttaacggcagt

SEQ ID NO: 1697143 - DNA, 14 bp, Homo sapiens
agcttgtttctata

SEQ ID NO: 1697144 - DNA, 20 bp, Homo sapiens
agctttaaaaaaataattgg

SEQ ID NO: 1697145 - DNA, 18 bp, Homo sapiens
agctttaaaaccacagct

SEQ ID NO: 1697146 - DNA, 19 bp, Homo sapiens
agctttaaaaccacagctg

SEQ ID NO: 1697147 - DNA, 23 bp, Homo sapiens
agctttaaaaccacagctgggca

SEQ ID NO: 1697148 - DNA, 15 bp, Homo sapiens
agctttaaacaaatt

SEQ ID NO: 1697149 - DNA, 19 bp, Homo sapiens
agctttaccaggttgtcct

SEQ ID NO: 1697150 - DNA, 17 bp, Homo sapiens
agctttactactgtgga

SEQ ID NO: 1697151 - DNA, 13 bp, Homo sapiens
agctttagaccct

SEQ ID NO: 1697152 - DNA, 18 bp, Homo sapiens
agctttatgttcatttgt

SEQ ID NO: 1697153 - DNA, 21 bp, Homo sapiens
agctttattttgagatgtaaa

SEQ ID NO: 1697154 - DNA, 16 bp, Homo sapiens
agctttcaagtgcctt

SEQ ID NO: 1697155 - DNA, 13 bp, Homo sapiens
agctttcagagcc

SEQ ID NO: 1697156 - DNA, 16 bp, Homo sapiens
agctttccctgcctct

SEQ ID NO: 1697157 - DNA, 14 bp, Homo sapiens
agctttcctgcccc

SEQ ID NO: 1697158 - DNA, 14 bp, Homo sapiens
agctttcctggtcc

SEQ ID NO: 1697159 - DNA, 16 bp, Homo sapiens
agctttccttctccag

SEQ ID NO: 1697160 - DNA, 18 bp, Homo sapiens
agctttctcaatgtcttc

SEQ ID NO: 1697161 - DNA, 21 bp, Homo sapiens
agctttctcaatgtcttccca

SEQ ID NO: 1697162 - DNA, 18 bp, Homo sapiens
agctttctcgcgccctcc

SEQ ID NO: 1697163 - DNA, 20 bp, Homo sapiens
agctttctgtccttttggca

SEQ ID NO: 1697164 - DNA, 22 bp, Homo sapiens
agctttctgtccttttggcact

SEQ ID NO: 1697165 - DNA, 12 bp, Homo sapiens
agctttgaaact

SEQ ID NO: 1697166 - DNA, 12 bp, Homo sapiens
agctttgaagta

SEQ ID NO: 1697167 - DNA, 20 bp, Homo sapiens
agctttgaatgcagaagcaa

SEQ ID NO: 1697168 - DNA, 19 bp, Homo sapiens
agctttgactctataagca

SEQ ID NO: 1697169 - DNA, 22 bp, Homo sapiens
agctttgagttgacttctgaca

SEQ ID NO: 1697170 - DNA, 21 bp, Homo sapiens
agctttgcaaacccattaagg

SEQ ID NO: 1697171 - DNA, 17 bp, Homo sapiens
agctttgctacaaattt

SEQ ID NO: 1697172 - DNA, 21 bp, Homo sapiens
agctttgctaccaaagcacct

SEQ ID NO: 1697173 - DNA, 18 bp, Homo sapiens
agctttgctccgctccca

SEQ ID NO: 1697174 - DNA, 19 bp, Homo sapiens
agctttgctccgctcccac

SEQ ID NO: 1697175 - DNA, 16 bp, Homo sapiens
agctttggaaacagga

SEQ ID NO: 1697176 - DNA, 22 bp, Homo sapiens
agctttggaaagttactgtaaa

SEQ ID NO: 1697177 - DNA, 12 bp, Homo sapiens
agctttggaata

SEQ ID NO: 1697178 - DNA, 13 bp, Homo sapiens
agctttggaatat

SEQ ID NO: 1697179 - DNA, 14 bp, Homo sapiens
agctttggaatatt

SEQ ID NO: 1697180 - DNA, 19 bp, Homo sapiens
agctttggacctaatccaa

SEQ ID NO: 1697181 - DNA, 13 bp, Homo sapiens
agctttggctgag

SEQ ID NO: 1697182 - DNA, 23 bp, Homo sapiens
agctttgggtgaccagccactca

SEQ ID NO: 1697183 - DNA, 14 bp, Homo sapiens
agcttttaaaaatg

SEQ ID NO: 1697184 - DNA, 17 bp, Homo sapiens
agcttttgcctgcaaga

SEQ ID NO: 1697185 - DNA, 17 bp, Homo sapiens
agcttttggtctccttg

SEQ ID NO: 1697186 - DNA, 23 bp, Homo sapiens
agcttttgttctagacttcccca

SEQ ID NO: 1697187 - DNA, 15 bp, Homo sapiens
agctttttaaaattt

SEQ ID NO: 1697188 - DNA, 12 bp, Homo sapiens
agctttttctca

SEQ ID NO: 1697189 - DNA, 15 bp, Homo sapiens
aggaaaaaaatgact

SEQ ID NO: 1697190 - DNA, 12 bp, Homo sapiens
aggaaaaaataa

SEQ ID NO: 1697191 - DNA, 17 bp, Homo sapiens
aggaaaaaataaaaaga

SEQ ID NO: 1697192 - DNA, 15 bp, Homo sapiens
aggaaaaaattgaaa

SEQ ID NO: 1697193 - DNA, 20 bp, Homo sapiens
aggaaaaacaaaacaaagaa

SEQ ID NO: 1697194 - DNA, 12 bp, Homo sapiens
aggaaaaaggtc

SEQ ID NO: 1697195 - DNA, 15 bp, Homo sapiens
aggaaaaataatcaa

SEQ ID NO: 1697196 - DNA, 13 bp, Homo sapiens
aggaaaaatgagg

SEQ ID NO: 1697197 - DNA, 21 bp, Homo sapiens
aggaaaaccaagccgtggctt

SEQ ID NO: 1697198 - DNA, 16 bp, Homo sapiens
aggaaaacctgcagag

SEQ ID NO: 1697199 - DNA, 21 bp, Homo sapiens
aggaaaagcaagaaacagttt

SEQ ID NO: 1697200 - DNA, 13 bp, Homo sapiens
aggaaaaggagga

SEQ ID NO: 1697201 - DNA, 22 bp, Homo sapiens
aggaaaaggcccctgcaatgtg

SEQ ID NO: 1697202 - DNA, 17 bp, Homo sapiens
aggaaaaggttgaataa

SEQ ID NO: 1697203 - DNA, 15 bp, Homo sapiens
aggaaaagttaaact

SEQ ID NO: 1697204 - DNA, 16 bp, Homo sapiens
aggaaaatagtaatgt

SEQ ID NO: 1697205 - DNA, 19 bp, Homo sapiens
aggaaaatagtttaggaga

SEQ ID NO: 1697206 - DNA, 17 bp, Homo sapiens
aggaaaatgtattgatt

SEQ ID NO: 1697207 - DNA, 20 bp, Homo sapiens
aggaaaatgtattgattcaa

SEQ ID NO: 1697208 - DNA, 16 bp, Homo sapiens
aggaaaattcttaaaa

SEQ ID NO: 1697209 - DNA, 13 bp, Homo sapiens
aggaaacaagtga

SEQ ID NO: 1697210 - DNA, 17 bp, Homo sapiens
aggaaacacttctattt

SEQ ID NO: 1697211 - DNA, 17 bp, Homo sapiens
aggaaacagttgcatgt

SEQ ID NO: 1697212 - DNA, 19 bp, Homo sapiens
aggaaacagttgcatgtag

SEQ ID NO: 1697213 - DNA, 20 bp, Homo sapiens
aggaaacagttgcatgtagt

SEQ ID NO: 1697214 - DNA, 20 bp, Homo sapiens
aggaaaccgcctagtttact

SEQ ID NO: 1697215 - DNA, 21 bp, Homo sapiens
aggaaactctgcattctagta

SEQ ID NO: 1697216 - DNA, 16 bp, Homo sapiens
aggaaagaagggggcc

SEQ ID NO: 1697217 - DNA, 18 bp, Homo sapiens
aggaaagaagggggccct

SEQ ID NO: 1697218 - DNA, 23 bp, Homo sapiens
aggaaagaagggggccctgctac

SEQ ID NO: 1697219 - DNA, 16 bp, Homo sapiens
aggaaagcaataaatg

SEQ ID NO: 1697220 - DNA, 18 bp, Homo sapiens
aggaaagcaataaatgaa

SEQ ID NO: 1697221 - DNA, 19 bp, Homo sapiens
aggaaagccccagcactaa

SEQ ID NO: 1697222 - DNA, 20 bp, Homo sapiens
aggaaagccccagcactaac

SEQ ID NO: 1697223 - DNA, 12 bp, Homo sapiens
aggaaaggattt

SEQ ID NO: 1697224 - DNA, 21 bp, Homo sapiens
aggaaaggattttaccaaagc

SEQ ID NO: 1697225 - DNA, 15 bp, Homo sapiens
aggaaaggctcattt

SEQ ID NO: 1697226 - DNA, 17 bp, Homo sapiens
aggaaaggctcatttaa

SEQ ID NO: 1697227 - DNA, 18 bp, Homo sapiens
aggaaaggctcatttaaa

SEQ ID NO: 1697228 - DNA, 20 bp, Homo sapiens
agctgcctctgctccctctg

SEQ ID NO: 1697229 - DNA, 15 bp, Homo sapiens
agctgcctctgggcc

SEQ ID NO: 1697230 - DNA, 19 bp, Homo sapiens
agctgcctgcagcacatgc

SEQ ID NO: 1697231 - DNA, 17 bp, Homo sapiens
agctgcctggatgagaa

SEQ ID NO: 1697232 - DNA, 11 bp, Homo sapiens
agctgcctggg

SEQ ID NO: 1697233 - DNA, 13 bp, Homo sapiens
agctgcctgggcc

SEQ ID NO: 1697234 - DNA, 14 bp, Homo sapiens
agctgcctgggccc

SEQ ID NO: 1697235 - DNA, 15 bp, Homo sapiens
agctgcctggtatat

SEQ ID NO: 1697236 - DNA, 14 bp, Homo sapiens
agctgcctgtgcct

SEQ ID NO: 1697237 - DNA, 18 bp, Homo sapiens
agctgccttcaaggactg

SEQ ID NO: 1697238 - DNA, 14 bp, Homo sapiens
agctgccttgagct

SEQ ID NO: 1697239 - DNA, 16 bp, Homo sapiens
agctgccttggctcag

SEQ ID NO: 1697240 - DNA, 19 bp, Homo sapiens
agctgccttggctcagaca

SEQ ID NO: 1697241 - DNA, 20 bp, Homo sapiens
agctgccttggctcagacat

SEQ ID NO: 1697242 - DNA, 14 bp, Homo sapiens
agctgcgggtctga

SEQ ID NO: 1697243 - DNA, 23 bp, Homo sapiens
agctgcgtttattaatgcctctc

SEQ ID NO: 1697244 - DNA, 21 bp, Homo sapiens
agctgctatccccatctccct

SEQ ID NO: 1697245 - DNA, 23 bp, Homo sapiens
agctgctatgctaaacctcctgc

SEQ ID NO: 1697246 - DNA, 19 bp, Homo sapiens
agctgctatttattttcct

SEQ ID NO: 1697247 - DNA, 20 bp, Homo sapiens
agctgctatttattttccta

SEQ ID NO: 1697248 - DNA, 21 bp, Homo sapiens
agctgctatttattttcctaa

SEQ ID NO: 1697249 - DNA, 10 bp, Homo sapiens
agctgctcag

SEQ ID NO: 1697250 - DNA, 12 bp, Homo sapiens
agctgctcccca

SEQ ID NO: 1697251 - DNA, 18 bp, Homo sapiens
agctgctccgaggaccca

SEQ ID NO: 1697252 - DNA, 19 bp, Homo sapiens
agctgctccgaggacccag

SEQ ID NO: 1697253 - DNA, 20 bp, Homo sapiens
agctgctccgaggacccagg

SEQ ID NO: 1697254 - DNA, 21 bp, Homo sapiens
agctgctctgaaatctccttt

SEQ ID NO: 1697255 - DNA, 15 bp, Homo sapiens
agctgctctgagcca

SEQ ID NO: 1697256 - DNA, 18 bp, Homo sapiens
agctgctctgagccacag

SEQ ID NO: 1697257 - DNA, 12 bp, Homo sapiens
agctgctctgcc

SEQ ID NO: 1697258 - DNA, 15 bp, Homo sapiens
agctgctctgcccct

SEQ ID NO: 1697259 - DNA, 23 bp, Homo sapiens
agctgctcttgcatctgggccag

SEQ ID NO: 1697260 - DNA, 14 bp, Homo sapiens
agctgctgaaacaa

SEQ ID NO: 1697261 - DNA, 14 bp, Homo sapiens
agctgctgaaattt

SEQ ID NO: 1697262 - DNA, 21 bp, Homo sapiens
agctgctgaccaattgtgctg

SEQ ID NO: 1697263 - DNA, 22 bp, Homo sapiens
agctgctgaccaattgtgctgc

SEQ ID NO: 1697264 - DNA, 23 bp, Homo sapiens
agctgctgaccaattgtgctgcc

SEQ ID NO: 1697265 - DNA, 15 bp, Homo sapiens
agctgctgagtgaca

SEQ ID NO: 1697266 - DNA, 14 bp, Homo sapiens
agctgctgcagccc

SEQ ID NO: 1697267 - DNA, 19 bp, Homo sapiens
agctgctgcagccctgcca

SEQ ID NO: 1697268 - DNA, 15 bp, Homo sapiens
agctgctggccaggg

SEQ ID NO: 1697269 - DNA, 17 bp, Homo sapiens
agctgctgggacccacc

SEQ ID NO: 1697270 - DNA, 23 bp, Homo sapiens
agctgctgggacgatcgcccagg

SEQ ID NO: 1697271 - DNA, 15 bp, Homo sapiens
agctgctgtgcccca

SEQ ID NO: 1697272 - DNA, 18 bp, Homo sapiens
agctgctgtgccccacca

SEQ ID NO: 1697273 - DNA, 19 bp, Homo sapiens
agctgctgtgccccaccac

SEQ ID NO: 1697274 - DNA, 17 bp, Homo sapiens
agctgcttgacctagct

SEQ ID NO: 1697275 - DNA, 15 bp, Homo sapiens
agctgcttgtgggcc

SEQ ID NO: 1697276 - DNA, 17 bp, Homo sapiens
agctggaaagttgggcc

SEQ ID NO: 1697277 - DNA, 18 bp, Homo sapiens
agctggaaagttgggccc

SEQ ID NO: 1697278 - DNA, 16 bp, Homo sapiens
agctggaacatttgat

SEQ ID NO: 1697279 - DNA, 18 bp, Homo sapiens
agctggaagactgtgcag

SEQ ID NO: 1697280 - DNA, 15 bp, Homo sapiens
agctggaagcctgcc

SEQ ID NO: 1697281 - DNA, 15 bp, Homo sapiens
agctggaaggcaggg

SEQ ID NO: 1697282 - DNA, 20 bp, Homo sapiens
agctggaaggcagggcagag

SEQ ID NO: 1697283 - DNA, 21 bp, Homo sapiens
agctggaaggcagggcagagg

SEQ ID NO: 1697284 - DNA, 13 bp, Homo sapiens
agctggaaggggc

SEQ ID NO: 1697285 - DNA, 20 bp, Homo sapiens
agctggaaggggccacgtgg

SEQ ID NO: 1697286 - DNA, 12 bp, Homo sapiens
agctggactgac

SEQ ID NO: 1697287 - DNA, 15 bp, Homo sapiens
agctcagttttcaac

SEQ ID NO: 1697288 - DNA, 20 bp, Homo sapiens
agctcatagaggtgagaaaa

SEQ ID NO: 1697289 - DNA, 13 bp, Homo sapiens
agctcatcccccc

SEQ ID NO: 1697290 - DNA, 18 bp, Homo sapiens
agctcatcccccctgctg

SEQ ID NO: 1697291 - DNA, 22 bp, Homo sapiens
agctcatcccccctgctgccca

SEQ ID NO: 1697292 - DNA, 16 bp, Homo sapiens
agctcattaaactttt

SEQ ID NO: 1697293 - DNA, 14 bp, Homo sapiens
agctccaacctgca

SEQ ID NO: 1697294 - DNA, 22 bp, Homo sapiens
agctccacaccctctcccagga

SEQ ID NO: 1697295 - DNA, 23 bp, Homo sapiens
agctccacaccctctcccaggac

SEQ ID NO: 1697296 - DNA, 14 bp, Homo sapiens
agctccacctctgg

SEQ ID NO: 1697297 - DNA, 23 bp, Homo sapiens
agctccacggtgcgtggctgtgg

SEQ ID NO: 1697298 - DNA, 13 bp, Homo sapiens
agctccactctgc

SEQ ID NO: 1697299 - DNA, 17 bp, Homo sapiens
agctccactctgcttct

SEQ ID NO: 1697300 - DNA, 18 bp, Homo sapiens
agctccactctgcttctc

SEQ ID NO: 1697301 - DNA, 13 bp, Homo sapiens
agctccagcgatg

SEQ ID NO: 1697302 - DNA, 19 bp, Homo sapiens
agctccagcgatggtgctg

SEQ ID NO: 1697303 - DNA, 13 bp, Homo sapiens
agctcccacccca

SEQ ID NO: 1697304 - DNA, 15 bp, Homo sapiens
agctcccaccccacc

SEQ ID NO: 1697305 - DNA, 23 bp, Homo sapiens
agctcccaccccacccccttcag

SEQ ID NO: 1697306 - DNA, 14 bp, Homo sapiens
agctcccacctccc

SEQ ID NO: 1697307 - DNA, 19 bp, Homo sapiens
agctcccacctcccttccc

SEQ ID NO: 1697308 - DNA, 14 bp, Homo sapiens
agctcccaggccaa

SEQ ID NO: 1697309 - DNA, 23 bp, Homo sapiens
agctccccacaccttccagggcc

SEQ ID NO: 1697310 - DNA, 15 bp, Homo sapiens
agctccccaggactc

SEQ ID NO: 1697311 - DNA, 23 bp, Homo sapiens
agctccccaggactcaccctcat

SEQ ID NO: 1697312 - DNA, 14 bp, Homo sapiens
agctcccctccaca

SEQ ID NO: 1697313 - DNA, 19 bp, Homo sapiens
agctcccctccacagctgc

SEQ ID NO: 1697314 - DNA, 21 bp, Homo sapiens
agctcccctccacagctgcag

SEQ ID NO: 1697315 - DNA, 20 bp, Homo sapiens
agctcccctgctgaggcagt

SEQ ID NO: 1697316 - DNA, 17 bp, Homo sapiens
agctccctaggagacca

SEQ ID NO: 1697317 - DNA, 21 bp, Homo sapiens
agctccctcctcccatctcct

SEQ ID NO: 1697318 - DNA, 21 bp, Homo sapiens
agctccctcctgcacacagaa

SEQ ID NO: 1697319 - DNA, 18 bp, Homo sapiens
agctccgggatcagcaac

SEQ ID NO: 1697320 - DNA, 16 bp, Homo sapiens
agctcctcaactcacc

SEQ ID NO: 1697321 - DNA, 23 bp, Homo sapiens
agctcctcaactcacctaatgtt

SEQ ID NO: 1697322 - DNA, 12 bp, Homo sapiens
agctcctcccac

SEQ ID NO: 1697323 - DNA, 19 bp, Homo sapiens
agctcctccccttcctctt

SEQ ID NO: 1697324 - DNA, 17 bp, Homo sapiens
agctcctctccccagcc

SEQ ID NO: 1697325 - DNA, 20 bp, Homo sapiens
agctcctctccccagcccag

SEQ ID NO: 1697326 - DNA, 21 bp, Homo sapiens
agctcctctccccagcccaga

SEQ ID NO: 1697327 - DNA, 24 bp, Homo sapiens
agctcctctccccagcccagagac

SEQ ID NO: 1697328 - DNA, 15 bp, Homo sapiens
agctcctctccttgg

SEQ ID NO: 1697329 - DNA, 19 bp, Homo sapiens
agctcctctccttgggctc

SEQ ID NO: 1697330 - DNA, 22 bp, Homo sapiens
agctcctctccttgggctcctg

SEQ ID NO: 1697331 - DNA, 14 bp, Homo sapiens
agctcctcttccat

SEQ ID NO: 1697332 - DNA, 13 bp, Homo sapiens
agctcctgaataa

SEQ ID NO: 1697333 - DNA, 13 bp, Homo sapiens
agctcctgccaca

SEQ ID NO: 1697334 - DNA, 20 bp, Homo sapiens
agctcctgccacatggagcc

SEQ ID NO: 1697335 - DNA, 21 bp, Homo sapiens
agctcctgccacatggagccc

SEQ ID NO: 1697336 - DNA, 14 bp, Homo sapiens
agctcctgccaggg

SEQ ID NO: 1697337 - DNA, 13 bp, Homo sapiens
agctcctggaagc

SEQ ID NO: 1697338 - DNA, 22 bp, Homo sapiens
agctcctggtcttgagatgtct

SEQ ID NO: 1697339 - DNA, 11 bp, Homo sapiens
agctcctgtaa

SEQ ID NO: 1697340 - DNA, 16 bp, Homo sapiens
agctcctgtggcccca

SEQ ID NO: 1697341 - DNA, 22 bp, Homo sapiens
agctcctgtggccccaccctgg

SEQ ID NO: 1697342 - DNA, 20 bp, Homo sapiens
agctccttggggcagggcct

SEQ ID NO: 1697343 - DNA, 18 bp, Homo sapiens
agctccttttgtccccag

SEQ ID NO: 1697344 - DNA, 22 bp, Homo sapiens
agctccttttgtccccagggcc

SEQ ID NO: 1697345 - DNA, 14 bp, Homo sapiens
agctcgcggggcag

SEQ ID NO: 1697346 - DNA, 20 bp, Homo sapiens
agctcgctggctttctctct

SEQ ID NO: 1697347 - DNA, 21 bp, Homo sapiens
agctcgctggctttctctctg

SEQ ID NO: 1697348 - DNA, 16 bp, Homo sapiens
agctcggggggctctg

SEQ ID NO: 1697349 - DNA, 18 bp, Homo sapiens
agctcggggggctctgcc

SEQ ID NO: 1697350 - DNA, 12 bp, Homo sapiens
agctcggtggac

SEQ ID NO: 1697351 - DNA, 14 bp, Homo sapiens
agctcggtggaccc

SEQ ID NO: 1697352 - DNA, 19 bp, Homo sapiens
agctcgtgtatcctggggc

SEQ ID NO: 1697353 - DNA, 20 bp, Homo sapiens
agctcgtgtatcctggggct

SEQ ID NO: 1697354 - DNA, 19 bp, Homo sapiens
agctaagatagaaagctgg

SEQ ID NO: 1697355 - DNA, 20 bp, Homo sapiens
agctaagatagaaagctgga

SEQ ID NO: 1697356 - DNA, 21 bp, Homo sapiens
agctaagatagaaagctggac

SEQ ID NO: 1697357 - DNA, 23 bp, Homo sapiens
agctaagctcacgtcctgagaaa

SEQ ID NO: 1697358 - DNA, 10 bp, Homo sapiens
agctaaggct

SEQ ID NO: 1697359 - DNA, 15 bp, Homo sapiens
agctaaggctctatg

SEQ ID NO: 1697360 - DNA, 13 bp, Homo sapiens
agctaataaacca

SEQ ID NO: 1697361 - DNA, 14 bp, Homo sapiens
agctaataaaccag

SEQ ID NO: 1697362 - DNA, 21 bp, Homo sapiens
agctaatcagcattctcactc

SEQ ID NO: 1697363 - DNA, 20 bp, Homo sapiens
agctaatctgtagggctgga

SEQ ID NO: 1697364 - DNA, 21 bp, Homo sapiens
agctaattctactcacagtgc

SEQ ID NO: 1697365 - DNA, 13 bp, Homo sapiens
agctaattggact

SEQ ID NO: 1697366 - DNA, 17 bp, Homo sapiens
agctaatttttgtattt

SEQ ID NO: 1697367 - DNA, 19 bp, Homo sapiens
agctacaaccctaccctgg

SEQ ID NO: 1697368 - DNA, 17 bp, Homo sapiens
agctacagcttgtttaa

SEQ ID NO: 1697369 - DNA, 22 bp, Homo sapiens
agctacagcttgtttaacggca

SEQ ID NO: 1697370 - DNA, 18 bp, Homo sapiens
agctacagtgcatagttg

SEQ ID NO: 1697371 - DNA, 16 bp, Homo sapiens
agctacattcctcagc

SEQ ID NO: 1697372 - DNA, 18 bp, Homo sapiens
agctacattcctcagctg

SEQ ID NO: 1697373 - DNA, 21 bp, Homo sapiens
agctacattcctcagctgcca

SEQ ID NO: 1697374 - DNA, 22 bp, Homo sapiens
agctacccaggaggctgaggtg

SEQ ID NO: 1697375 - DNA, 18 bp, Homo sapiens
agctaccctcagcctcca

SEQ ID NO: 1697376 - DNA, 21 bp, Homo sapiens
agctaccctttttctccagct

SEQ ID NO: 1697377 - DNA, 19 bp, Homo sapiens
agctaccgtggatctcctt

SEQ ID NO: 1697378 - DNA, 18 bp, Homo sapiens
agctactaatgatgtttt

SEQ ID NO: 1697379 - DNA, 21 bp, Homo sapiens
agctactagagatattcttat

SEQ ID NO: 1697380 - DNA, 19 bp, Homo sapiens
agctactcagaagcctgag

SEQ ID NO: 1697381 - DNA, 15 bp, Homo sapiens
agctactcaggaggc

SEQ ID NO: 1697382 - DNA, 18 bp, Homo sapiens
agctactcaggaggctga

SEQ ID NO: 1697383 - DNA, 22 bp, Homo sapiens
agctactcaggaggctgagaca

SEQ ID NO: 1697384 - DNA, 23 bp, Homo sapiens
agctactcagtggggctggcatc

SEQ ID NO: 1697385 - DNA, 17 bp, Homo sapiens
agctactctgtccaggc

SEQ ID NO: 1697386 - DNA, 20 bp, Homo sapiens
agctactctgtccaggccac

SEQ ID NO: 1697387 - DNA, 21 bp, Homo sapiens
agctactctgtccaggccact

SEQ ID NO: 1697388 - DNA, 22 bp, Homo sapiens
agctactctgtccaggccactg

SEQ ID NO: 1697389 - DNA, 17 bp, Homo sapiens
agctactggaatggtgt

SEQ ID NO: 1697390 - DNA, 21 bp, Homo sapiens
agctacttcctcctccccact

SEQ ID NO: 1697391 - DNA, 21 bp, Homo sapiens
agctacttctgggaaaaacaa

SEQ ID NO: 1697392 - DNA, 17 bp, Homo sapiens
agctacttgggaggctg

SEQ ID NO: 1697393 - DNA, 16 bp, Homo sapiens
agctacttggtttgtg

SEQ ID NO: 1697394 - DNA, 17 bp, Homo sapiens
agctacttggtttgtgt

SEQ ID NO: 1697395 - DNA, 21 bp, Homo sapiens
agctacttggtttgtgttctt

SEQ ID NO: 1697396 - DNA, 22 bp, Homo sapiens
agctagaagtgggccaggacag

SEQ ID NO: 1697397 - DNA, 24 bp, Homo sapiens
agctagaagtgggccaggacaggc

SEQ ID NO: 1697398 - DNA, 17 bp, Homo sapiens
agctagactggagtgag

SEQ ID NO: 1697399 - DNA, 21 bp, Homo sapiens
agctagactggagtgaggctt

SEQ ID NO: 1697400 - DNA, 16 bp, Homo sapiens
agctagatactggaaa

SEQ ID NO: 1697401 - DNA, 15 bp, Homo sapiens
agctagatgcccctg

SEQ ID NO: 1697402 - DNA, 23 bp, Homo sapiens
agctagcccagtccctggagctg

SEQ ID NO: 1697403 - DNA, 13 bp, Homo sapiens
agctagctgccac

SEQ ID NO: 1697404 - DNA, 17 bp, Homo sapiens
agctagctgccactttc

SEQ ID NO: 1697405 - DNA, 12 bp, Homo sapiens
agctaggaatga

SEQ ID NO: 1697406 - DNA, 21 bp, Homo sapiens
agctaggatggttctgtgacc

SEQ ID NO: 1697407 - DNA, 19 bp, Homo sapiens
agctagtaggaatgtacat

SEQ ID NO: 1697408 - DNA, 22 bp, Homo sapiens
agctagtatcttcaaactttca

SEQ ID NO: 1697409 - DNA, 17 bp, Homo sapiens
agctagtgcctttagag

SEQ ID NO: 1697410 - DNA, 19 bp, Homo sapiens
agctagtggcttcaaaata

SEQ ID NO: 1697411 - DNA, 18 bp, Homo sapiens
agctagtgtacctcctct

SEQ ID NO: 1697412 - DNA, 23 bp, Homo sapiens
agctagtgtacctcctctcagtg

SEQ ID NO: 1697413 - DNA, 16 bp, Homo sapiens
agctagttctcagctt

SEQ ID NO: 1697414 - DNA, 22 bp, Homo sapiens
agctataaagcagtatttttct

SEQ ID NO: 1697415 - DNA, 17 bp, Homo sapiens
agctataacaactctat

SEQ ID NO: 1697416 - DNA, 19 bp, Homo sapiens
agctataacaactctattt

SEQ ID NO: 1697417 - DNA, 16 bp, Homo sapiens
agctatatatttagga

SEQ ID NO: 1697418 - DNA, 15 bp, Homo sapiens
agctatcacctagca

SEQ ID NO: 1697419 - DNA, 15 bp, Homo sapiens
agctatctaggtgga

SEQ ID NO: 1697420 - DNA, 17 bp, Homo sapiens
agctatgggagccccag

SEQ ID NO: 1697421 - DNA, 19 bp, Homo sapiens
agctatgggagccccaggg

SEQ ID NO: 1697422 - DNA, 22 bp, Homo sapiens
agctatgggagccccagggtct

SEQ ID NO: 1697423 - DNA, 22 bp, Homo sapiens
agctatttaatatctggcactg

SEQ ID NO: 1697424 - DNA, 15 bp, Homo sapiens
agctatttatgggcc

SEQ ID NO: 1697425 - DNA, 19 bp, Homo sapiens
agccatgatttgtcccagc

SEQ ID NO: 1697426 - DNA, 21 bp, Homo sapiens
agccatgatttgtcccagcct

SEQ ID NO: 1697427 - DNA, 22 bp, Homo sapiens
agccatgatttgtcccagcctg

SEQ ID NO: 1697428 - DNA, 15 bp, Homo sapiens
agccatggctcaggc

SEQ ID NO: 1697429 - DNA, 16 bp, Homo sapiens
agccatggctcaggca

SEQ ID NO: 1697430 - DNA, 18 bp, Homo sapiens
agccatggctcaggcaag

SEQ ID NO: 1697431 - DNA, 22 bp, Homo sapiens
agccatgggcctgggcctgctt

SEQ ID NO: 1697432 - DNA, 20 bp, Homo sapiens
agccatgtactcaagtacca

SEQ ID NO: 1697433 - DNA, 12 bp, Homo sapiens
agccatgtgctg

SEQ ID NO: 1697434 - DNA, 20 bp, Homo sapiens
agccattcctggtacccagc

SEQ ID NO: 1697435 - DNA, 22 bp, Homo sapiens
agccattcctggtacccagcca

SEQ ID NO: 1697436 - DNA, 23 bp, Homo sapiens
agccattcctggtacccagccat

SEQ ID NO: 1697437 - DNA, 14 bp, Homo sapiens
agccattggagagc

SEQ ID NO: 1697438 - DNA, 18 bp, Homo sapiens
agccattggagagctgtc

SEQ ID NO: 1697439 - DNA, 14 bp, Homo sapiens
agccatttttaatg

SEQ ID NO: 1697440 - DNA, 15 bp, Homo sapiens
agcccaacagcactt

SEQ ID NO: 1697441 - DNA, 22 bp, Homo sapiens
agcccaagaggtctgagccctg

SEQ ID NO: 1697442 - DNA, 21 bp, Homo sapiens
agcccaagttcatgcagctgt

SEQ ID NO: 1697443 - DNA, 9 bp, Homo sapiens
agcccaata

SEQ ID NO: 1697444 - DNA, 22 bp, Homo sapiens
agcccacaaccttcggctccgg

SEQ ID NO: 1697445 - DNA, 16 bp, Homo sapiens
agcccaccaccctggc

SEQ ID NO: 1697446 - DNA, 12 bp, Homo sapiens
agcccacccagc

SEQ ID NO: 1697447 - DNA, 13 bp, Homo sapiens
agcccaccctgct

SEQ ID NO: 1697448 - DNA, 22 bp, Homo sapiens
agcccaccctgctgctggtgca

SEQ ID NO: 1697449 - DNA, 17 bp, Homo sapiens
agcccacggtctggagg

SEQ ID NO: 1697450 - DNA, 22 bp, Homo sapiens
agcccacgttctctctgcctgt

SEQ ID NO: 1697451 - DNA, 17 bp, Homo sapiens
agcccactccctgccta

SEQ ID NO: 1697452 - DNA, 20 bp, Homo sapiens
agcccactgcccaccccctc

SEQ ID NO: 1697453 - DNA, 20 bp, Homo sapiens
agcccactgtcctgggcctg

SEQ ID NO: 1697454 - DNA, 23 bp, Homo sapiens
agcccactgtcctgggcctgcag

SEQ ID NO: 1697455 - DNA, 24 bp, Homo sapiens
agcccagaaagtgataagtgcagg

SEQ ID NO: 1697456 - DNA, 10 bp, Homo sapiens
agcccagaga

SEQ ID NO: 1697457 - DNA, 14 bp, Homo sapiens
agcccagagaagct

SEQ ID NO: 1697458 - DNA, 11 bp, Homo sapiens
agcccagagac

SEQ ID NO: 1697459 - DNA, 18 bp, Homo sapiens
agcccagagccacctgga

SEQ ID NO: 1697460 - DNA, 12 bp, Homo sapiens
agcccagaggag

SEQ ID NO: 1697461 - DNA, 14 bp, Homo sapiens
agcccagaggaggg

SEQ ID NO: 1697462 - DNA, 15 bp, Homo sapiens
agcccagaggagggc

SEQ ID NO: 1697463 - DNA, 18 bp, Homo sapiens
agcccagattcccctgtg

SEQ ID NO: 1697464 - DNA, 18 bp, Homo sapiens
agcccagcacctgctccc

SEQ ID NO: 1697465 - DNA, 14 bp, Homo sapiens
agcccagcactgtg

SEQ ID NO: 1697466 - DNA, 17 bp, Homo sapiens
agcccagcactgtgaag

SEQ ID NO: 1697467 - DNA, 15 bp, Homo sapiens
agcccagcagggcct

SEQ ID NO: 1697468 - DNA, 11 bp, Homo sapiens
agcccagccac

SEQ ID NO: 1697469 - DNA, 15 bp, Homo sapiens
agcccagccagaaag

SEQ ID NO: 1697470 - DNA, 20 bp, Homo sapiens
agcccagcccctactgctgt

SEQ ID NO: 1697471 - DNA, 13 bp, Homo sapiens
agcccagccctcc

SEQ ID NO: 1697472 - DNA, 16 bp, Homo sapiens
agcccagcctgggagc

SEQ ID NO: 1697473 - DNA, 17 bp, Homo sapiens
agcccagctacattcct

SEQ ID NO: 1697474 - DNA, 12 bp, Homo sapiens
agcccagctcca

SEQ ID NO: 1697475 - DNA, 16 bp, Homo sapiens
agcccagctccagggc

SEQ ID NO: 1697476 - DNA, 18 bp, Homo sapiens
agcccagctccagggcca

SEQ ID NO: 1697477 - DNA, 13 bp, Homo sapiens
agcccagctcttg

SEQ ID NO: 1697478 - DNA, 19 bp, Homo sapiens
agcccagctggccacctag

SEQ ID NO: 1697479 - DNA, 14 bp, Homo sapiens
agcccagcttcctg

SEQ ID NO: 1697480 - DNA, 18 bp, Homo sapiens
agcccagcttcctggtgt

SEQ ID NO: 1697481 - DNA, 12 bp, Homo sapiens
agcccaggagct

SEQ ID NO: 1697482 - DNA, 16 bp, Homo sapiens
agcccaggagctgagt

SEQ ID NO: 1697483 - DNA, 19 bp, Homo sapiens
agcccaggagtttgaggct

SEQ ID NO: 1697484 - DNA, 19 bp, Homo sapiens
agcccaggatactggcaca

SEQ ID NO: 1697485 - DNA, 20 bp, Homo sapiens
agcccaggccagagtgcagt

SEQ ID NO: 1697486 - DNA, 22 bp, Homo sapiens
agcccaggccggggtggagcat

SEQ ID NO: 1697487 - DNA, 13 bp, Homo sapiens
agcccaggccgtt

SEQ ID NO: 1697488 - DNA, 15 bp, Homo sapiens
agcccaggcttcctg

SEQ ID NO: 1697489 - DNA, 23 bp, Homo sapiens
agcccagggcatcttgctggcta

SEQ ID NO: 1697490 - DNA, 14 bp, Homo sapiens
agcccagggctcct

SEQ ID NO: 1697491 - DNA, 15 bp, Homo sapiens
agcccagtagacctt

SEQ ID NO: 1697492 - DNA, 18 bp, Homo sapiens
agcccagtccctggagct

SEQ ID NO: 1697493 - DNA, 21 bp, Homo sapiens
agcccagtccctggagctgtc

SEQ ID NO: 1697494 - DNA, 17 bp, Homo sapiens
agcccagtgaagcctct

SEQ ID NO: 1697495 - DNA, 18 bp, Homo sapiens
agcccagtgaagcctctg

SEQ ID NO: 1697496 - DNA, 14 bp, Homo sapiens
agcccagtgcaaac

SEQ ID NO: 1697497 - DNA, 22 bp, Homo sapiens
agcccagtgttttctttgagga

SEQ ID NO: 1697498 - DNA, 14 bp, Homo sapiens
agcccatcctgacc

SEQ ID NO: 1697499 - DNA, 23 bp, Homo sapiens
agcccatcctgaccagctgctcc

SEQ ID NO: 1697500 - DNA, 17 bp, Homo sapiens
agcccatggacttcaca

SEQ ID NO: 1697501 - DNA, 13 bp, Homo sapiens
agcccatggcccc

SEQ ID NO: 1697502 - DNA, 15 bp, Homo sapiens
agcccatggccccca

SEQ ID NO: 1697503 - DNA, 19 bp, Homo sapiens
agcccattctctctcctgt

SEQ ID NO: 1697504 - DNA, 15 bp, Homo sapiens
agccccacacggagg

SEQ ID NO: 1697505 - DNA, 20 bp, Homo sapiens
agccccaccacatagcatgc

SEQ ID NO: 1697506 - DNA, 15 bp, Homo sapiens
agccccacccaggag

SEQ ID NO: 1697507 - DNA, 16 bp, Homo sapiens
agccccacccaggagg

SEQ ID NO: 1697508 - DNA, 22 bp, Homo sapiens
agccccacccctaagtgcccaa

SEQ ID NO: 1697509 - DNA, 17 bp, Homo sapiens
agccccaccctggccta

SEQ ID NO: 1697510 - DNA, 12 bp, Homo sapiens
agccccactgcc

SEQ ID NO: 1697511 - DNA, 17 bp, Homo sapiens
agccccagaaaatgaaa

SEQ ID NO: 1697512 - DNA, 12 bp, Homo sapiens
agccccagctga

SEQ ID NO: 1697513 - DNA, 15 bp, Homo sapiens
agccccagggcctgg

SEQ ID NO: 1697514 - DNA, 20 bp, Homo sapiens
agccccagggtcttccctac

SEQ ID NO: 1697515 - DNA, 21 bp, Homo sapiens
agcccccaaccccgcggtgct

SEQ ID NO: 1697516 - DNA, 22 bp, Homo sapiens
agcccccagccctgggaaccac

SEQ ID NO: 1697517 - DNA, 17 bp, Homo sapiens
agcccccagggcctcca

SEQ ID NO: 1697518 - DNA, 20 bp, Homo sapiens
agcccccagggcctccaggg

SEQ ID NO: 1697519 - DNA, 21 bp, Homo sapiens
agcccccagggcctccagggc

SEQ ID NO: 1697520 - DNA, 15 bp, Homo sapiens
agccccccatgcccc

SEQ ID NO: 1697521 - DNA, 16 bp, Homo sapiens
agccccctccagctca

SEQ ID NO: 1697522 - DNA, 15 bp, Homo sapiens
agccccctcttcctc

SEQ ID NO: 1697523 - DNA, 13 bp, Homo sapiens
agccccctgcacc

SEQ ID NO: 1697524 - DNA, 14 bp, Homo sapiens
agccccctgcaccc

SEQ ID NO: 1697525 - DNA, 22 bp, Homo sapiens
agccccctgcacccacccctgc

SEQ ID NO: 1697526 - DNA, 20 bp, Homo sapiens
agccccctggatgggcattg

SEQ ID NO: 1697527 - DNA, 14 bp, Homo sapiens
agccccgacttcct

SEQ ID NO: 1697528 - DNA, 19 bp, Homo sapiens
agccccgagacaccatcct

SEQ ID NO: 1697529 - DNA, 23 bp, Homo sapiens
agccccgagacaccatcctgagc

SEQ ID NO: 1697530 - DNA, 24 bp, Homo sapiens
agccccgagacaccatcctgagcc

SEQ ID NO: 1697531 - DNA, 23 bp, Homo sapiens
agccccgccccgttgtgagctgg

SEQ ID NO: 1697532 - DNA, 15 bp, Homo sapiens
agccccgcgcctcct

SEQ ID NO: 1697533 - DNA, 18 bp, Homo sapiens
agccttgtgccctgcccc

SEQ ID NO: 1697534 - DNA, 16 bp, Homo sapiens
agcctttacctgtgaa

SEQ ID NO: 1697535 - DNA, 13 bp, Homo sapiens
agcctttcatttt

SEQ ID NO: 1697536 - DNA, 17 bp, Homo sapiens
agcctttcattttgctt

SEQ ID NO: 1697537 - DNA, 19 bp, Homo sapiens
agcctttcattttgcttta

SEQ ID NO: 1697538 - DNA, 20 bp, Homo sapiens
agcctttcattttgctttaa

SEQ ID NO: 1697539 - DNA, 23 bp, Homo sapiens
agcctttcattttgctttaattt

SEQ ID NO: 1697540 - DNA, 23 bp, Homo sapiens
agcctttcttgtagccatggctg

SEQ ID NO: 1697541 - DNA, 13 bp, Homo sapiens
agcctttgccctg

SEQ ID NO: 1697542 - DNA, 22 bp, Homo sapiens
agcctttggaagtctgcgccct

SEQ ID NO: 1697543 - DNA, 21 bp, Homo sapiens
agcctttgggtcctgggcagg

SEQ ID NO: 1697544 - DNA, 22 bp, Homo sapiens
agcctttgggtcctgggcaggt

SEQ ID NO: 1697545 - DNA, 15 bp, Homo sapiens
agcctttgtatcttt

SEQ ID NO: 1697546 - DNA, 15 bp, Homo sapiens
agcctttgttgaact

SEQ ID NO: 1697547 - DNA, 19 bp, Homo sapiens
agcctttgttgaactgtta

SEQ ID NO: 1697548 - DNA, 18 bp, Homo sapiens
agccttttccctctttgg

SEQ ID NO: 1697549 - DNA, 14 bp, Homo sapiens
agccttttgctctc

SEQ ID NO: 1697550 - DNA, 16 bp, Homo sapiens
agccttttgctctctg

SEQ ID NO: 1697551 - DNA, 18 bp, Homo sapiens
agcctttttaaaacacat

SEQ ID NO: 1697552 - DNA, 16 bp, Homo sapiens
agcgaactgcactgct

SEQ ID NO: 1697553 - DNA, 22 bp, Homo sapiens
agcgaacttcacataggaaggg

SEQ ID NO: 1697554 - DNA, 19 bp, Homo sapiens
agcgaagtctttgccttct

SEQ ID NO: 1697555 - DNA, 24 bp, Homo sapiens
agcgacagcattttaaggttctca

SEQ ID NO: 1697556 - DNA, 22 bp, Homo sapiens
agcgaccccaggacctcttctg

SEQ ID NO: 1697557 - DNA, 17 bp, Homo sapiens
agcgactccgttggcca

SEQ ID NO: 1697558 - DNA, 17 bp, Homo sapiens
agcgagaggcagcaagg

SEQ ID NO: 1697559 - DNA, 13 bp, Homo sapiens
agcgaggaaagga

SEQ ID NO: 1697560 - DNA, 15 bp, Homo sapiens
agcgagggcagctgc

SEQ ID NO: 1697561 - DNA, 16 bp, Homo sapiens
agcgagggcagctgct

SEQ ID NO: 1697562 - DNA, 17 bp, Homo sapiens
agcgagggcagctgcta

SEQ ID NO: 1697563 - DNA, 14 bp, Homo sapiens
agcgagtgctctca

SEQ ID NO: 1697564 - DNA, 17 bp, Homo sapiens
agcgagtgctctcactg

SEQ ID NO: 1697565 - DNA, 21 bp, Homo sapiens
agcgagttgtggaaagcctct

SEQ ID NO: 1697566 - DNA, 17 bp, Homo sapiens
agcgatctctcctggcc

SEQ ID NO: 1697567 - DNA, 18 bp, Homo sapiens
agcgatgggcccctggcc

SEQ ID NO: 1697568 - DNA, 14 bp, Homo sapiens
agcgatgtgcagga

SEQ ID NO: 1697569 - DNA, 17 bp, Homo sapiens
agcgatgtgcaggaaga

SEQ ID NO: 1697570 - DNA, 19 bp, Homo sapiens
agcgcacctgccccctggt

SEQ ID NO: 1697571 - DNA, 13 bp, Homo sapiens
agcgccagctcct

SEQ ID NO: 1697572 - DNA, 17 bp, Homo sapiens
agcgcccacccaggtcc

SEQ ID NO: 1697573 - DNA, 20 bp, Homo sapiens
agcgccccgcccccacccct

SEQ ID NO: 1697574 - DNA, 22 bp, Homo sapiens
agcgcccctcactcctgcgctg

SEQ ID NO: 1697575 - DNA, 23 bp, Homo sapiens
agcgcctagtggggtctccctct

SEQ ID NO: 1697576 - DNA, 18 bp, Homo sapiens
agcgcctccatccaaggc

SEQ ID NO: 1697577 - DNA, 23 bp, Homo sapiens
agcgcctccatccaaggccaggt

SEQ ID NO: 1697578 - DNA, 22 bp, Homo sapiens
agcgcctgaccctggtgggctg

SEQ ID NO: 1697579 - DNA, 20 bp, Homo sapiens
agcgctcctgccgcagagct

SEQ ID NO: 1697580 - DNA, 12 bp, Homo sapiens
agcgctctcctg

SEQ ID NO: 1697581 - DNA, 20 bp, Homo sapiens
agcgctggctccctgggcag

SEQ ID NO: 1697582 - DNA, 20 bp, Homo sapiens
agcgctgtggactgtcctga

SEQ ID NO: 1697583 - DNA, 15 bp, Homo sapiens
agcgcttaaaaaaac

SEQ ID NO: 1697584 - DNA, 15 bp, Homo sapiens
agcgcttctgctgaa

SEQ ID NO: 1697585 - DNA, 19 bp, Homo sapiens
agcggagagagccaagacg

SEQ ID NO: 1697586 - DNA, 17 bp, Homo sapiens
agcggagcccagcctgg

SEQ ID NO: 1697587 - DNA, 18 bp, Homo sapiens
agcggagcccagcctggg

SEQ ID NO: 1697588 - DNA, 23 bp, Homo sapiens
agcggaggttgcagggagccgag

SEQ ID NO: 1697589 - DNA, 21 bp, Homo sapiens
agcggaggttgcagtgagctg

SEQ ID NO: 1697590 - DNA, 22 bp, Homo sapiens
agcggaggttgcagtgagctga

SEQ ID NO: 1697591 - DNA, 22 bp, Homo sapiens
agcggcagagcaattccaggct

SEQ ID NO: 1697592 - DNA, 13 bp, Homo sapiens
agcggcccctccc

SEQ ID NO: 1697593 - DNA, 14 bp, Homo sapiens
agcggccctgtcat

SEQ ID NO: 1697594 - DNA, 18 bp, Homo sapiens
agcggccctgtcatccag

SEQ ID NO: 1697595 - DNA, 22 bp, Homo sapiens
agcggcctccggcgtcttgccc

SEQ ID NO: 1697596 - DNA, 20 bp, Homo sapiens
agcggccttgaagacagagc

SEQ ID NO: 1697597 - DNA, 16 bp, Homo sapiens
agcggcgcagagccct

SEQ ID NO: 1697598 - DNA, 18 bp, Homo sapiens
agcggcgcagagccctcc

SEQ ID NO: 1697599 - DNA, 20 bp, Homo sapiens
agcggcgcagagccctccag

SEQ ID NO: 1697600 - DNA, 16 bp, Homo sapiens
agcggctgagtcatga

SEQ ID NO: 1697601 - DNA, 16 bp, Homo sapiens
agcggctgctcaagcc

SEQ ID NO: 1697602 - DNA, 13 bp, Homo sapiens
agcggctggagaa

SEQ ID NO: 1697603 - DNA, 14 bp, Homo sapiens
agcggctgtttact

SEQ ID NO: 1697604 - DNA, 16 bp, Homo sapiens
agcgggacaccctggt

SEQ ID NO: 1697605 - DNA, 13 bp, Homo sapiens
agcgggactcagt

SEQ ID NO: 1697606 - DNA, 14 bp, Homo sapiens
agcgggagcccgtg

SEQ ID NO: 1697607 - DNA, 22 bp, Homo sapiens
agcgggatctcgtatctttaaa

SEQ ID NO: 1697608 - DNA, 16 bp, Homo sapiens
agcctctctctccctc

SEQ ID NO: 1697609 - DNA, 13 bp, Homo sapiens
agcctctgccagg

SEQ ID NO: 1697610 - DNA, 14 bp, Homo sapiens
agcctctgctgcca

SEQ ID NO: 1697611 - DNA, 11 bp, Homo sapiens
agcctctggat

SEQ ID NO: 1697612 - DNA, 14 bp, Homo sapiens
agcctctggatcta

SEQ ID NO: 1697613 - DNA, 22 bp, Homo sapiens
agcctctggcattagaattatt

SEQ ID NO: 1697614 - DNA, 13 bp, Homo sapiens
agcctctggccgt

SEQ ID NO: 1697615 - DNA, 11 bp, Homo sapiens
agcctctgtcc

SEQ ID NO: 1697616 - DNA, 22 bp, Homo sapiens
agcctcttagtgattgtgtctg

SEQ ID NO: 1697617 - DNA, 21 bp, Homo sapiens
agcctcttattccaggagaag

SEQ ID NO: 1697618 - DNA, 15 bp, Homo sapiens
agcctcttctgaaga

SEQ ID NO: 1697619 - DNA, 21 bp, Homo sapiens
agcctcttgtgtaactaattt

SEQ ID NO: 1697620 - DNA, 16 bp, Homo sapiens
agcctctttttgatac

SEQ ID NO: 1697621 - DNA, 15 bp, Homo sapiens
agcctgaactgaggc

SEQ ID NO: 1697622 - DNA, 16 bp, Homo sapiens
agcctgaagcctggat

SEQ ID NO: 1697623 - DNA, 11 bp, Homo sapiens
agcctgaggct

SEQ ID NO: 1697624 - DNA, 16 bp, Homo sapiens
agcctgagtctcctgt

SEQ ID NO: 1697625 - DNA, 22 bp, Homo sapiens
agcctgatactttagccatcat

SEQ ID NO: 1697626 - DNA, 21 bp, Homo sapiens
agcctgatcaggcttcctggt

SEQ ID NO: 1697627 - DNA, 14 bp, Homo sapiens
agcctgatccagcc

SEQ ID NO: 1697628 - DNA, 17 bp, Homo sapiens
agcctgatctttctaga

SEQ ID NO: 1697629 - DNA, 17 bp, Homo sapiens
agcctgcaaactcactg

SEQ ID NO: 1697630 - DNA, 19 bp, Homo sapiens
agcctgcaatttcatatgc

SEQ ID NO: 1697631 - DNA, 20 bp, Homo sapiens
agcctgcacacacctgcctg

SEQ ID NO: 1697632 - DNA, 15 bp, Homo sapiens
agcctgcattcttaa

SEQ ID NO: 1697633 - DNA, 15 bp, Homo sapiens
agcctgcattgagct

SEQ ID NO: 1697634 - DNA, 23 bp, Homo sapiens
agcctgcattgagcttgcatgct

SEQ ID NO: 1697635 - DNA, 20 bp, Homo sapiens
agcctgccctcactccctct

SEQ ID NO: 1697636 - DNA, 16 bp, Homo sapiens
agcctgccgcccccgc

SEQ ID NO: 1697637 - DNA, 21 bp, Homo sapiens
agcctgccgcccccgcctggg

SEQ ID NO: 1697638 - DNA, 23 bp, Homo sapiens
agcctgccgcccccgcctgggca

SEQ ID NO: 1697639 - DNA, 15 bp, Homo sapiens
agcctgcctcccaag

SEQ ID NO: 1697640 - DNA, 17 bp, Homo sapiens
agcctgcctgatccctg

SEQ ID NO: 1697641 - DNA, 10 bp, Homo sapiens
agcctgctca

SEQ ID NO: 1697642 - DNA, 19 bp, Homo sapiens
agcctgctcccccaccccc

SEQ ID NO: 1697643 - DNA, 13 bp, Homo sapiens
agcctgctctgga

SEQ ID NO: 1697644 - DNA, 12 bp, Homo sapiens
agcctgctgcat

SEQ ID NO: 1697645 - DNA, 14 bp, Homo sapiens
agcctgctggaagc

SEQ ID NO: 1697646 - DNA, 12 bp, Homo sapiens
agcctgctggct

SEQ ID NO: 1697647 - DNA, 15 bp, Homo sapiens
agcctgctggctgcg

SEQ ID NO: 1697648 - DNA, 21 bp, Homo sapiens
agcctgcttcttcccctctgc

SEQ ID NO: 1697649 - DNA, 13 bp, Homo sapiens
agcctggactttg

SEQ ID NO: 1697650 - DNA, 16 bp, Homo sapiens
agcctggcacaggact

SEQ ID NO: 1697651 - DNA, 20 bp, Homo sapiens
agcctggcacagggcagtgg

SEQ ID NO: 1697652 - DNA, 18 bp, Homo sapiens
agcctggccaacatggtg

SEQ ID NO: 1697653 - DNA, 19 bp, Homo sapiens
agcctggccaacatggtga

SEQ ID NO: 1697654 - DNA, 20 bp, Homo sapiens
agcctggccacgcagccagg

SEQ ID NO: 1697655 - DNA, 21 bp, Homo sapiens
agcctggccagacacaggccc

SEQ ID NO: 1697656 - DNA, 22 bp, Homo sapiens
agcctggccagacacaggccct

SEQ ID NO: 1697657 - DNA, 19 bp, Homo sapiens
agcctggcccatagaaaca

SEQ ID NO: 1697658 - DNA, 17 bp, Homo sapiens
agcctggctcccaggac

SEQ ID NO: 1697659 - DNA, 18 bp, Homo sapiens
agcctggctcccaggaca

SEQ ID NO: 1697660 - DNA, 13 bp, Homo sapiens
agcctggctctgc

SEQ ID NO: 1697661 - DNA, 18 bp, Homo sapiens
agcctgggagcccagagg

SEQ ID NO: 1697662 - DNA, 17 bp, Homo sapiens
agcctgggcaacagagc

SEQ ID NO: 1697663 - DNA, 17 bp, Homo sapiens
agcctgggcagcatagc

SEQ ID NO: 1697664 - DNA, 20 bp, Homo sapiens
agcctgggcagccaggctgc

SEQ ID NO: 1697665 - DNA, 15 bp, Homo sapiens
agcctgggcgacaga

SEQ ID NO: 1697666 - DNA, 18 bp, Homo sapiens
agcctgggctcactgtgc

SEQ ID NO: 1697667 - DNA, 19 bp, Homo sapiens
agcctgggctcactgtgct

SEQ ID NO: 1697668 - DNA, 20 bp, Homo sapiens
agcctgggctcactgtgctg

SEQ ID NO: 1697669 - DNA, 15 bp, Homo sapiens
agcctggggacccca

SEQ ID NO: 1697670 - DNA, 18 bp, Homo sapiens
agcctggggctccctctc

SEQ ID NO: 1697671 - DNA, 21 bp, Homo sapiens
agcctggggctccctctctgg

SEQ ID NO: 1697672 - DNA, 14 bp, Homo sapiens
agcctgggtcacag

SEQ ID NO: 1697673 - DNA, 18 bp, Homo sapiens
agcctgggtcacagagtg

SEQ ID NO: 1697674 - DNA, 21 bp, Homo sapiens
agcctgggtcacagagtgaga

SEQ ID NO: 1697675 - DNA, 18 bp, Homo sapiens
agcctggtttagcctgga

SEQ ID NO: 1697676 - DNA, 21 bp, Homo sapiens
agcctggtttagcctggatgt

SEQ ID NO: 1697677 - DNA, 15 bp, Homo sapiens
agcctgtaatcccag

SEQ ID NO: 1697678 - DNA, 16 bp, Homo sapiens
agcctgtaatcccagc

SEQ ID NO: 1697679 - DNA, 18 bp, Homo sapiens
agcctgtatgtggtgtgg

SEQ ID NO: 1697680 - DNA, 21 bp, Homo sapiens
agcctgtatgtggtgtggggc

SEQ ID NO: 1697681 - DNA, 13 bp, Homo sapiens
agcctgtcaccag

SEQ ID NO: 1697682 - DNA, 19 bp, Homo sapiens
agcctgtcaccagagcttc

SEQ ID NO: 1697683 - DNA, 22 bp, Homo sapiens
agcctgtcaccagagcttctct

SEQ ID NO: 1697684 - DNA, 24 bp, Homo sapiens
agcctgtcaccagagcttctctgg

SEQ ID NO: 1697685 - DNA, 14 bp, Homo sapiens
agcctgtgccagca

SEQ ID NO: 1697686 - DNA, 17 bp, Homo sapiens
agcctgtgccagcacct

SEQ ID NO: 1697687 - DNA, 18 bp, Homo sapiens
agcctgtgcctctgggac

SEQ ID NO: 1697688 - DNA, 18 bp, Homo sapiens
agcctgtgcgtcccagct

SEQ ID NO: 1697689 - DNA, 21 bp, Homo sapiens
agcctgtggcatctttgcctt

SEQ ID NO: 1697690 - DNA, 22 bp, Homo sapiens
agccttaaagacaaaaatcctt

SEQ ID NO: 1697691 - DNA, 22 bp, Homo sapiens
agccttaacttcttaaaccatt

SEQ ID NO: 1697692 - DNA, 12 bp, Homo sapiens
agccttaatttt

SEQ ID NO: 1697693 - DNA, 15 bp, Homo sapiens
agccttagggaagct

SEQ ID NO: 1697694 - DNA, 14 bp, Homo sapiens
agccttatttctag

SEQ ID NO: 1697695 - DNA, 16 bp, Homo sapiens
agccttcaagtgccaa

SEQ ID NO: 1697696 - DNA, 17 bp, Homo sapiens
agccttcacttttctga

SEQ ID NO: 1697697 - DNA, 21 bp, Homo sapiens
agccttcagaatgctcctgag

SEQ ID NO: 1697698 - DNA, 13 bp, Homo sapiens
agccttcagcagc

SEQ ID NO: 1697699 - DNA, 13 bp, Homo sapiens
agccttccaacat

SEQ ID NO: 1697700 - DNA, 18 bp, Homo sapiens
agccttccaacatttctt

SEQ ID NO: 1697701 - DNA, 20 bp, Homo sapiens
agccttccccttgcccaggg

SEQ ID NO: 1697702 - DNA, 18 bp, Homo sapiens
agccttcctctgcagctg

SEQ ID NO: 1697703 - DNA, 22 bp, Homo sapiens
agccttcctctgcagctgacct

SEQ ID NO: 1697704 - DNA, 18 bp, Homo sapiens
agccttctcagaagcaca

SEQ ID NO: 1697705 - DNA, 12 bp, Homo sapiens
agccttctccct

SEQ ID NO: 1697706 - DNA, 20 bp, Homo sapiens
agccttctccctagctcctc

SEQ ID NO: 1697707 - DNA, 21 bp, Homo sapiens
agccttcttccctcggggagc

SEQ ID NO: 1697708 - DNA, 15 bp, Homo sapiens
agccttgaaaaacaa

SEQ ID NO: 1697709 - DNA, 17 bp, Homo sapiens
agccttgagccctggct

SEQ ID NO: 1697710 - DNA, 13 bp, Homo sapiens
agccttgccagag

SEQ ID NO: 1697711 - DNA, 19 bp, Homo sapiens
agccttgccagagatccaa

SEQ ID NO: 1697712 - DNA, 21 bp, Homo sapiens
agccttgcctaaatttaatgc

SEQ ID NO: 1697713 - DNA, 20 bp, Homo sapiens
agccttgctagacagccagg

SEQ ID NO: 1697714 - DNA, 10 bp, Homo sapiens
agccttgctg

SEQ ID NO: 1697715 - DNA, 12 bp, Homo sapiens
agccttgcttgt

SEQ ID NO: 1697716 - DNA, 22 bp, Homo sapiens
agccttggggggtgggggctgt

SEQ ID NO: 1697717 - DNA, 17 bp, Homo sapiens
agccttggtgtccacct

SEQ ID NO: 1697718 - DNA, 22 bp, Homo sapiens
agccttggtgtccacctggccc

SEQ ID NO: 1697719 - DNA, 20 bp, Homo sapiens
agccttggttcatcagtgtt

SEQ ID NO: 1697720 - DNA, 18 bp, Homo sapiens
agccttgtaattctaaat

SEQ ID NO: 1697721 - DNA, 15 bp, Homo sapiens
agccttgtccccctc

SEQ ID NO: 1697722 - DNA, 21 bp, Homo sapiens
agccttgtgagatccttcaca

SEQ ID NO: 1697723 - DNA, 14 bp, Homo sapiens
agccttgtgccctg

SEQ ID NO: 1697724 - DNA, 15 bp, Homo sapiens
agccttgtgccctgc

SEQ ID NO: 1697725 - DNA, 15 bp, Homo sapiens
agattctactttgaa

SEQ ID NO: 1697726 - DNA, 14 bp, Homo sapiens
agattctagatcag

SEQ ID NO: 1697727 - DNA, 19 bp, Homo sapiens
agattctatagttctagac

SEQ ID NO: 1697728 - DNA, 20 bp, Homo sapiens
agattctatagttctagaca

SEQ ID NO: 1697729 - DNA, 21 bp, Homo sapiens
agattctatagttctagacat

SEQ ID NO: 1697730 - DNA, 13 bp, Homo sapiens
agattctcaaagg

SEQ ID NO: 1697731 - DNA, 14 bp, Homo sapiens
agattctctgccca

SEQ ID NO: 1697732 - DNA, 17 bp, Homo sapiens
agattctctgcccagcc

SEQ ID NO: 1697733 - DNA, 21 bp, Homo sapiens
agattctctgcccagccgggc

SEQ ID NO: 1697734 - DNA, 21 bp, Homo sapiens
agattctctggctgtaaggct

SEQ ID NO: 1697735 - DNA, 23 bp, Homo sapiens
agattctctggctgtaaggctct

SEQ ID NO: 1697736 - DNA, 16 bp, Homo sapiens
agattctctgtgtcta

SEQ ID NO: 1697737 - DNA, 19 bp, Homo sapiens
agattctctgtgtctaaga

SEQ ID NO: 1697738 - DNA, 20 bp, Homo sapiens
agattctctgtgtctaagat

SEQ ID NO: 1697739 - DNA, 16 bp, Homo sapiens
agattctcttgaataa

SEQ ID NO: 1697740 - DNA, 18 bp, Homo sapiens
agattctctttaaaaaag

SEQ ID NO: 1697741 - DNA, 14 bp, Homo sapiens
agattctgatgcat

SEQ ID NO: 1697742 - DNA, 14 bp, Homo sapiens
agattctggatctc

SEQ ID NO: 1697743 - DNA, 15 bp, Homo sapiens
agattctgttgcata

SEQ ID NO: 1697744 - DNA, 14 bp, Homo sapiens
agattctttaagga

SEQ ID NO: 1697745 - DNA, 20 bp, Homo sapiens
agattctttaaggagataga

SEQ ID NO: 1697746 - DNA, 21 bp, Homo sapiens
agattctttcagttctttgga

SEQ ID NO: 1697747 - DNA, 18 bp, Homo sapiens
agattgaaaatcttgtgt

SEQ ID NO: 1697748 - DNA, 17 bp, Homo sapiens
agattgacgacaagtgc

SEQ ID NO: 1697749 - DNA, 21 bp, Homo sapiens
agattgactaactcaaataca

SEQ ID NO: 1697750 - DNA, 15 bp, Homo sapiens
agcagccagctctca

SEQ ID NO: 1697751 - DNA, 16 bp, Homo sapiens
agcagccagctctcag

SEQ ID NO: 1697752 - DNA, 19 bp, Homo sapiens
agcagccagctctcagcca

SEQ ID NO: 1697753 - DNA, 14 bp, Homo sapiens
agcagccagggacc

SEQ ID NO: 1697754 - DNA, 18 bp, Homo sapiens
agcagccagtctcagaga

SEQ ID NO: 1697755 - DNA, 23 bp, Homo sapiens
agcagccagtctcagagaccagc

SEQ ID NO: 1697756 - DNA, 16 bp, Homo sapiens
agcagcccagggccta

SEQ ID NO: 1697757 - DNA, 17 bp, Homo sapiens
agcagcccatggcctct

SEQ ID NO: 1697758 - DNA, 14 bp, Homo sapiens
agcagccccctgtg

SEQ ID NO: 1697759 - DNA, 16 bp, Homo sapiens
agcagccccctgtggc

SEQ ID NO: 1697760 - DNA, 12 bp, Homo sapiens
agcagccctcct

SEQ ID NO: 1697761 - DNA, 12 bp, Homo sapiens
agcagccgccag

SEQ ID NO: 1697762 - DNA, 20 bp, Homo sapiens
agcagccgccttaagctgat

SEQ ID NO: 1697763 - DNA, 20 bp, Homo sapiens
agcagcctcagagtggtcga

SEQ ID NO: 1697764 - DNA, 17 bp, Homo sapiens
agcagcctcgcacaggc

SEQ ID NO: 1697765 - DNA, 21 bp, Homo sapiens
agcagcctctccccaggtcca

SEQ ID NO: 1697766 - DNA, 16 bp, Homo sapiens
agcagcctctgccagg

SEQ ID NO: 1697767 - DNA, 20 bp, Homo sapiens
agcagcctgatggccaaggg

SEQ ID NO: 1697768 - DNA, 15 bp, Homo sapiens
agcagcgcgcaggcc

SEQ ID NO: 1697769 - DNA, 17 bp, Homo sapiens
agcagcgcgcaggcctg

SEQ ID NO: 1697770 - DNA, 19 bp, Homo sapiens
agcagcggattgctctgga

SEQ ID NO: 1697771 - DNA, 20 bp, Homo sapiens
agcagcggattgctctggag

SEQ ID NO: 1697772 - DNA, 11 bp, Homo sapiens
agcagctacca

SEQ ID NO: 1697773 - DNA, 12 bp, Homo sapiens
agcagctcaggc

SEQ ID NO: 1697774 - DNA, 21 bp, Homo sapiens
agcagctccttcctagccttg

SEQ ID NO: 1697775 - DNA, 22 bp, Homo sapiens
agcagctgattcagcagtgcct

SEQ ID NO: 1697776 - DNA, 19 bp, Homo sapiens
agcagctgcaggggcctct

SEQ ID NO: 1697777 - DNA, 13 bp, Homo sapiens
agcagctggacta

SEQ ID NO: 1697778 - DNA, 18 bp, Homo sapiens
agcagctggactacccac

SEQ ID NO: 1697779 - DNA, 20 bp, Homo sapiens
agcagctggtcagtctttgc

SEQ ID NO: 1697780 - DNA, 22 bp, Homo sapiens
agcagctggtcagtctttgctc

SEQ ID NO: 1697781 - DNA, 20 bp, Homo sapiens
agcagctggtgccccacctg

SEQ ID NO: 1697782 - DNA, 22 bp, Homo sapiens
agcagctggtgccccacctgcc

SEQ ID NO: 1697783 - DNA, 12 bp, Homo sapiens
agcagcttccag

SEQ ID NO: 1697784 - DNA, 16 bp, Homo sapiens
agcagcttccttctgg

SEQ ID NO: 1697785 - DNA, 21 bp, Homo sapiens
agcagcttccttctgggactg

SEQ ID NO: 1697786 - DNA, 21 bp, Homo sapiens
agcagctttgtctctgtcaca

SEQ ID NO: 1697787 - DNA, 23 bp, Homo sapiens
agcaggacttgctaaagcacttt

SEQ ID NO: 1697788 - DNA, 13 bp, Homo sapiens
agcaggagcccct

SEQ ID NO: 1697789 - DNA, 16 bp, Homo sapiens
agcaggaggcccctgg

SEQ ID NO: 1697790 - DNA, 20 bp, Homo sapiens
agcaggaggcccctggccca

SEQ ID NO: 1697791 - DNA, 21 bp, Homo sapiens
agcaggaggcccttgtcgtgg

SEQ ID NO: 1697792 - DNA, 20 bp, Homo sapiens
agcaggatgaattttctgca

SEQ ID NO: 1697793 - DNA, 23 bp, Homo sapiens
agcaggatgaattttctgcagct

SEQ ID NO: 1697794 - DNA, 24 bp, Homo sapiens
agcaggatgaattttctgcagctg

SEQ ID NO: 1697795 - DNA, 15 bp, Homo sapiens
agcaggcacaggaca

SEQ ID NO: 1697796 - DNA, 19 bp, Homo sapiens
agcaggcacatggaggagc

SEQ ID NO: 1697797 - DNA, 16 bp, Homo sapiens
agcaggcaccgccacg

SEQ ID NO: 1697798 - DNA, 20 bp, Homo sapiens
agcaggcacgggtggtcccc

SEQ ID NO: 1697799 - DNA, 23 bp, Homo sapiens
agcaggcagataagttggagcag

SEQ ID NO: 1697800 - DNA, 23 bp, Homo sapiens
agcaggcagggctgggccaggtc

SEQ ID NO: 1697801 - DNA, 23 bp, Homo sapiens
agcaggcaggtggactgactgtg

SEQ ID NO: 1697802 - DNA, 15 bp, Homo sapiens
agcaggccagcccgg

SEQ ID NO: 1697803 - DNA, 19 bp, Homo sapiens
agcaggcccagcatgcagg

SEQ ID NO: 1697804 - DNA, 14 bp, Homo sapiens
agcaggctactgtc

SEQ ID NO: 1697805 - DNA, 20 bp, Homo sapiens
agcaggctactgtcagctcc

SEQ ID NO: 1697806 - DNA, 18 bp, Homo sapiens
agcaggctcctggctgtg

SEQ ID NO: 1697807 - DNA, 23 bp, Homo sapiens
agcaggctcctggctgtgcccag

SEQ ID NO: 1697808 - DNA, 12 bp, Homo sapiens
agcagggaaggc

SEQ ID NO: 1697809 - DNA, 15 bp, Homo sapiens
agcagggaaggcctg

SEQ ID NO: 1697810 - DNA, 20 bp, Homo sapiens
agcagggattaacctctgca

SEQ ID NO: 1697811 - DNA, 21 bp, Homo sapiens
agcagggattaacctctgcac

SEQ ID NO: 1697812 - DNA, 16 bp, Homo sapiens
agcagggccaaagcac

SEQ ID NO: 1697813 - DNA, 20 bp, Homo sapiens
agcagggccaaagcacagct

SEQ ID NO: 1697814 - DNA, 17 bp, Homo sapiens
agcaggggggctgtgcc

SEQ ID NO: 1697815 - DNA, 18 bp, Homo sapiens
agcaggggggctgtgcca

SEQ ID NO: 1697816 - DNA, 13 bp, Homo sapiens
agcagggtccaca

SEQ ID NO: 1697817 - DNA, 16 bp, Homo sapiens
agcagggtccacagct

SEQ ID NO: 1697818 - DNA, 14 bp, Homo sapiens
agcaggtcacactg

SEQ ID NO: 1697819 - DNA, 13 bp, Homo sapiens
agcaggtgactgt

SEQ ID NO: 1697820 - DNA, 23 bp, Homo sapiens
agcaggtgattggaccaggccat

SEQ ID NO: 1697821 - DNA, 16 bp, Homo sapiens
agcaggtgctgggctg

SEQ ID NO: 1697822 - DNA, 20 bp, Homo sapiens
agcaggtgctgggctggact

SEQ ID NO: 1697823 - DNA, 22 bp, Homo sapiens
agcaggtgtggtggctcatggc

SEQ ID NO: 1697824 - DNA, 15 bp, Homo sapiens
agcaggttcttgatg

SEQ ID NO: 1697825 - DNA, 20 bp, Homo sapiens
agcaggttgaggggctcctg

SEQ ID NO: 1697826 - DNA, 22 bp, Homo sapiens
agcaggttgaggggctcctgga

SEQ ID NO: 1697827 - DNA, 19 bp, Homo sapiens
agcagtaaatttgctagca

SEQ ID NO: 1697828 - DNA, 14 bp, Homo sapiens
agcagtatatgtta

SEQ ID NO: 1697829 - DNA, 15 bp, Homo sapiens
agcagtatatgttaa

SEQ ID NO: 1697830 - DNA, 13 bp, Homo sapiens
agcagtcacactg

SEQ ID NO: 1697831 - DNA, 14 bp, Homo sapiens
agcagtcacactgt

SEQ ID NO: 1697832 - DNA, 13 bp, Homo sapiens
agcagtcagccct

SEQ ID NO: 1697833 - DNA, 23 bp, Homo sapiens
agcagtcaggggtcaggtgtcag

SEQ ID NO: 1697834 - DNA, 20 bp, Homo sapiens
agcagtcccattcatattaa

SEQ ID NO: 1697835 - DNA, 14 bp, Homo sapiens
agcagtcctcttat

SEQ ID NO: 1697836 - DNA, 22 bp, Homo sapiens
agcagtcctgcctcagcctccg

SEQ ID NO: 1697837 - DNA, 17 bp, Homo sapiens
agcagtcgtgcctgtgt

SEQ ID NO: 1697838 - DNA, 17 bp, Homo sapiens
agcagtctccttcagca

SEQ ID NO: 1697839 - DNA, 13 bp, Homo sapiens
agcagtcttgctc

SEQ ID NO: 1697840 - DNA, 13 bp, Homo sapiens
agcagtgatctca

SEQ ID NO: 1697841 - DNA, 20 bp, Homo sapiens
agcagtgatctcagggcaga

SEQ ID NO: 1697842 - DNA, 16 bp, Homo sapiens
agcagtgcctcgaggc

SEQ ID NO: 1697843 - DNA, 20 bp, Homo sapiens
agcagtgcctcgaggcaccg

SEQ ID NO: 1697844 - DNA, 13 bp, Homo sapiens
agcagtgcctgcc

SEQ ID NO: 1697845 - DNA, 16 bp, Homo sapiens
agcagtgccttccata

SEQ ID NO: 1697846 - DNA, 20 bp, Homo sapiens
agcagtgccttccataatta

SEQ ID NO: 1697847 - DNA, 23 bp, Homo sapiens
agcagtgccttccataattatga

SEQ ID NO: 1697848 - DNA, 12 bp, Homo sapiens
agcagtggcctt

SEQ ID NO: 1697849 - DNA, 19 bp, Homo sapiens
agcagtggccttattgcat

SEQ ID NO: 1697850 - DNA, 13 bp, Homo sapiens
agcagtgggcagg

SEQ ID NO: 1697851 - DNA, 14 bp, Homo sapiens
agcagtgggcaggt

SEQ ID NO: 1697852 - DNA, 23 bp, Homo sapiens
agcagtgtcccctgccccagagg

SEQ ID NO: 1697853 - DNA, 16 bp, Homo sapiens
agcagtgtcttccata

SEQ ID NO: 1697854 - DNA, 20 bp, Homo sapiens
agcagtgtcttccataatgt

SEQ ID NO: 1697855 - DNA, 11 bp, Homo sapiens
agcagtgtgag

SEQ ID NO: 1697856 - DNA, 17 bp, Homo sapiens
agcagtgttacttgcag

SEQ ID NO: 1697857 - DNA, 18 bp, Homo sapiens
agcagttcatgtctgaaa

SEQ ID NO: 1697858 - DNA, 16 bp, Homo sapiens
agcagttgaaaagact

SEQ ID NO: 1697859 - DNA, 23 bp, Homo sapiens
agcagttgaaaagactccaaaga

SEQ ID NO: 1697860 - DNA, 22 bp, Homo sapiens
agcagttgacatccaaatctag

SEQ ID NO: 1697861 - DNA, 20 bp, Homo sapiens
agcagttggccaagcagaaa

SEQ ID NO: 1697862 - DNA, 14 bp, Homo sapiens
agcagtttgctttg

SEQ ID NO: 1697863 - DNA, 17 bp, Homo sapiens
agcagttttcccctggc

SEQ ID NO: 1697864 - DNA, 18 bp, Homo sapiens
agcagttttgtaaatgta

SEQ ID NO: 1697865 - DNA, 24 bp, Homo sapiens
agcagttttgtaaatgtactggta

SEQ ID NO: 1697866 - DNA, 20 bp, Homo sapiens
agcataacaaggtccaagat

SEQ ID NO: 1697867 - DNA, 21 bp, Homo sapiens
agcataatgctcccatctcct

SEQ ID NO: 1697868 - DNA, 14 bp, Homo sapiens
agcatacatttata

SEQ ID NO: 1697869 - DNA, 20 bp, Homo sapiens
agcatacatttataatgttt

SEQ ID NO: 1697870 - DNA, 15 bp, Homo sapiens
agcatacttctagga

SEQ ID NO: 1697871 - DNA, 13 bp, Homo sapiens
agcatactttgta

SEQ ID NO: 1697872 - DNA, 14 bp, Homo sapiens
agcatactttgtaa

SEQ ID NO: 1697873 - DNA, 15 bp, Homo sapiens
agcatagataatatt

SEQ ID NO: 1697874 - DNA, 19 bp, Homo sapiens
agcatagataatattgttt

SEQ ID NO: 1697875 - DNA, 13 bp, Homo sapiens
agcatagcctgcc

SEQ ID NO: 1697876 - DNA, 20 bp, Homo sapiens
agcatatgacaaatgtttct

SEQ ID NO: 1697877 - DNA, 21 bp, Homo sapiens
agcatatgacaaatgtttcta

SEQ ID NO: 1697878 - DNA, 20 bp, Homo sapiens
agcatatgattgctccagag

SEQ ID NO: 1697879 - DNA, 20 bp, Homo sapiens
agcatatttgccaataaagc

SEQ ID NO: 1697880 - DNA, 21 bp, Homo sapiens
agcatatttgccaataaagct

SEQ ID NO: 1697881 - DNA, 19 bp, Homo sapiens
agcatcacctcaggccagg

SEQ ID NO: 1697882 - DNA, 16 bp, Homo sapiens
agcatcagagagtgta

SEQ ID NO: 1697883 - DNA, 12 bp, Homo sapiens
agcatcagagat

SEQ ID NO: 1697884 - DNA, 21 bp, Homo sapiens
agcatcagaggtttgcttcct

SEQ ID NO: 1697885 - DNA, 12 bp, Homo sapiens
agcatccaggct

SEQ ID NO: 1697886 - DNA, 13 bp, Homo sapiens
agcatccaggctg

SEQ ID NO: 1697887 - DNA, 14 bp, Homo sapiens
agcatccaggctgg

SEQ ID NO: 1697888 - DNA, 15 bp, Homo sapiens
agcatccaggctggc

SEQ ID NO: 1697889 - DNA, 15 bp, Homo sapiens
agcatccctcaccca

SEQ ID NO: 1697890 - DNA, 12 bp, Homo sapiens
agcatccctgga

SEQ ID NO: 1697891 - DNA, 12 bp, Homo sapiens
agcatcctcctc

SEQ ID NO: 1697892 - DNA, 21 bp, Homo sapiens
agcatcctgattattgaatgt

SEQ ID NO: 1697893 - DNA, 22 bp, Homo sapiens
agcatcgggagcacccagagca

SEQ ID NO: 1697894 - DNA, 18 bp, Homo sapiens
agcatcgtgacccttcag

SEQ ID NO: 1697895 - DNA, 20 bp, Homo sapiens
agcatcgtgacccttcaggg

SEQ ID NO: 1697896 - DNA, 23 bp, Homo sapiens
agcatctaagttataagactctc

SEQ ID NO: 1697897 - DNA, 14 bp, Homo sapiens
agcatctaatgaat

SEQ ID NO: 1697898 - DNA, 20 bp, Homo sapiens
agcatctcagcctaccatga

SEQ ID NO: 1697899 - DNA, 12 bp, Homo sapiens
agcatctcccag

SEQ ID NO: 1697900 - DNA, 20 bp, Homo sapiens
agcatctccctcactgaaac

SEQ ID NO: 1697901 - DNA, 22 bp, Homo sapiens
agcatctcttgaggccaggagt

SEQ ID NO: 1697902 - DNA, 22 bp, Homo sapiens
agcatctgagaaggccctgtgc

SEQ ID NO: 1697903 - DNA, 22 bp, Homo sapiens
agcatctgatagaatgatgttt

SEQ ID NO: 1697904 - DNA, 23 bp, Homo sapiens
agcatctggctgtctagaatgtg

SEQ ID NO: 1697905 - DNA, 23 bp, Homo sapiens
agcatcttcacttctaaatgcat

SEQ ID NO: 1697906 - DNA, 19 bp, Homo sapiens
agcatcttgcatccaaacc

SEQ ID NO: 1697907 - DNA, 13 bp, Homo sapiens
agcatgaaaaagc

SEQ ID NO: 1697908 - DNA, 15 bp, Homo sapiens
agcatgaaatgtgaa

SEQ ID NO: 1697909 - DNA, 16 bp, Homo sapiens
agcatgaaatgtgaat

SEQ ID NO: 1697910 - DNA, 15 bp, Homo sapiens
agcatgaataaaaca

SEQ ID NO: 1697911 - DNA, 20 bp, Homo sapiens
agcatgaatttttttcatct

SEQ ID NO: 1697912 - DNA, 13 bp, Homo sapiens
agcatgagacttt

SEQ ID NO: 1697913 - DNA, 16 bp, Homo sapiens
agcatgagactttctg

SEQ ID NO: 1697914 - DNA, 19 bp, Homo sapiens
agcatgagagaattgtatc

SEQ ID NO: 1697915 - DNA, 20 bp, Homo sapiens
agcatgatgggaaaatattt

SEQ ID NO: 1697916 - DNA, 20 bp, Homo sapiens
agcatgattctttaatagaa

SEQ ID NO: 1697917 - DNA, 16 bp, Homo sapiens
agcatgcacagctgct

SEQ ID NO: 1697918 - DNA, 17 bp, Homo sapiens
agcatgcacagctgctt

SEQ ID NO: 1697919 - DNA, 13 bp, Homo sapiens
agcatgcacatgc

SEQ ID NO: 1697920 - DNA, 17 bp, Homo sapiens
agcatgcagctttgcaa

SEQ ID NO: 1697921 - DNA, 19 bp, Homo sapiens
agcatgcgcgctgtgggca

SEQ ID NO: 1697922 - DNA, 14 bp, Homo sapiens
agcatgctgctttg

SEQ ID NO: 1697923 - DNA, 18 bp, Homo sapiens
agcatgcttcctttctct

SEQ ID NO: 1697924 - DNA, 22 bp, Homo sapiens
agcatgcttcctttctctcctg

SEQ ID NO: 1697925 - DNA, 21 bp, Homo sapiens
agcatgcttgggctgacccag

SEQ ID NO: 1697926 - DNA, 17 bp, Homo sapiens
agcatgcttgtgaaaat

SEQ ID NO: 1697927 - DNA, 18 bp, Homo sapiens
agcatgctttgctgctat

SEQ ID NO: 1697928 - DNA, 15 bp, Homo sapiens
agcatggaaaaatgg

SEQ ID NO: 1697929 - DNA, 20 bp, Homo sapiens
agcatggaaaaatggttgat

SEQ ID NO: 1697930 - DNA, 22 bp, Homo sapiens
agcatggaaaaatggttgatgg

SEQ ID NO: 1697931 - DNA, 19 bp, Homo sapiens
agcatggaacacttcgagt

SEQ ID NO: 1697932 - DNA, 17 bp, Homo sapiens
agcatggacatttagaa

SEQ ID NO: 1697933 - DNA, 23 bp, Homo sapiens
agcatggactaaccccaacgcac

SEQ ID NO: 1697934 - DNA, 15 bp, Homo sapiens
agcatggagagcctc

SEQ ID NO: 1697935 - DNA, 20 bp, Homo sapiens
agcatggagagcctcttagt

SEQ ID NO: 1697936 - DNA, 17 bp, Homo sapiens
agcatggcatagccccg

SEQ ID NO: 1697937 - DNA, 20 bp, Homo sapiens
agcatggcatagccccggcc

SEQ ID NO: 1697938 - DNA, 14 bp, Homo sapiens
agcatgggcctggc

SEQ ID NO: 1697939 - DNA, 19 bp, Homo sapiens
agcatgggcctggccacct

SEQ ID NO: 1697940 - DNA, 16 bp, Homo sapiens
agcatggggcccctgg

SEQ ID NO: 1697941 - DNA, 21 bp, Homo sapiens
agcatggggcccctggcccag

SEQ ID NO: 1697942 - DNA, 23 bp, Homo sapiens
agcatgtccaacatggtaattca

SEQ ID NO: 1697943 - DNA, 14 bp, Homo sapiens
agcatgtctactgc

SEQ ID NO: 1697944 - DNA, 15 bp, Homo sapiens
agcatgtctactgct

SEQ ID NO: 1697945 - DNA, 17 bp, Homo sapiens
agcatgtctactgcttg

SEQ ID NO: 1697946 - DNA, 15 bp, Homo sapiens
agcatgtctctctgc

SEQ ID NO: 1697947 - DNA, 18 bp, Homo sapiens
agcatgtctctctgccaa

SEQ ID NO: 1697948 - DNA, 19 bp, Homo sapiens
agcatgtgtatttccagtg

SEQ ID NO: 1697949 - DNA, 16 bp, Homo sapiens
agcatgtgtcccagga

SEQ ID NO: 1697950 - DNA, 18 bp, Homo sapiens
agcatgttgctgaggagt

SEQ ID NO: 1697951 - DNA, 16 bp, Homo sapiens
agcatgttttgcatgt

SEQ ID NO: 1697952 - DNA, 15 bp, Homo sapiens
agcattacctaattt

SEQ ID NO: 1697953 - DNA, 16 bp, Homo sapiens
agcattacctaatttt

SEQ ID NO: 1697954 - DNA, 14 bp, Homo sapiens
agcattaggctttt

SEQ ID NO: 1697955 - DNA, 21 bp, Homo sapiens
agcattaggcttttaagaaac

SEQ ID NO: 1697956 - DNA, 20 bp, Homo sapiens
agcattcaaaatagttctat

SEQ ID NO: 1697957 - DNA, 20 bp, Homo sapiens
agcattccagcccctctggt

SEQ ID NO: 1697958 - DNA, 20 bp, Homo sapiens
agcattccagctctgccccc

SEQ ID NO: 1697959 - DNA, 20 bp, Homo sapiens
agcattctcactcctacctg

SEQ ID NO: 1697960 - DNA, 14 bp, Homo sapiens
agcattctggaggg

SEQ ID NO: 1697961 - DNA, 18 bp, Homo sapiens
agcattctggaggggaga

SEQ ID NO: 1697962 - DNA, 21 bp, Homo sapiens
agcattcttgtcacaataaat

SEQ ID NO: 1697963 - DNA, 22 bp, Homo sapiens
agccactcaggaggctgaggca

SEQ ID NO: 1697964 - DNA, 14 bp, Homo sapiens
agccactctatgag

SEQ ID NO: 1697965 - DNA, 17 bp, Homo sapiens
agccactctgtcccttc

SEQ ID NO: 1697966 - DNA, 15 bp, Homo sapiens
agccactgagcctgg

SEQ ID NO: 1697967 - DNA, 20 bp, Homo sapiens
agccactgagcctggccctg

SEQ ID NO: 1697968 - DNA, 14 bp, Homo sapiens
agccactggaagga

SEQ ID NO: 1697969 - DNA, 16 bp, Homo sapiens
agccactggaaggagc

SEQ ID NO: 1697970 - DNA, 18 bp, Homo sapiens
agccactggaaggagcac

SEQ ID NO: 1697971 - DNA, 14 bp, Homo sapiens
agccacttccccct

SEQ ID NO: 1697972 - DNA, 22 bp, Homo sapiens
agccacttccccctcttcttct

SEQ ID NO: 1697973 - DNA, 18 bp, Homo sapiens
agccacttctccccagaa

SEQ ID NO: 1697974 - DNA, 20 bp, Homo sapiens
agccacttctggcttcagcc

SEQ ID NO: 1697975 - DNA, 21 bp, Homo sapiens
agccacttctggcttcagccc

SEQ ID NO: 1697976 - DNA, 23 bp, Homo sapiens
agccagaattcactaggaggtca

SEQ ID NO: 1697977 - DNA, 21 bp, Homo sapiens
agccagacaaaatttgagaat

SEQ ID NO: 1697978 - DNA, 21 bp, Homo sapiens
agccagaccccacgctgacca

SEQ ID NO: 1697979 - DNA, 13 bp, Homo sapiens
agccagactctgc

SEQ ID NO: 1697980 - DNA, 19 bp, Homo sapiens
agccagagcccttcactgc

SEQ ID NO: 1697981 - DNA, 23 bp, Homo sapiens
agccagagcccttcactgccatg

SEQ ID NO: 1697982 - DNA, 12 bp, Homo sapiens
agccagagcctg

SEQ ID NO: 1697983 - DNA, 15 bp, Homo sapiens
agccagagcctgggg

SEQ ID NO: 1697984 - DNA, 20 bp, Homo sapiens
agccagagcctgtctttcag

SEQ ID NO: 1697985 - DNA, 15 bp, Homo sapiens
agccagagctgtgcc

SEQ ID NO: 1697986 - DNA, 17 bp, Homo sapiens
agccagagctgtgcctg

SEQ ID NO: 1697987 - DNA, 20 bp, Homo sapiens
agccagagctgtgcctgctc

SEQ ID NO: 1697988 - DNA, 21 bp, Homo sapiens
agccagagctgtgcctgctca

SEQ ID NO: 1697989 - DNA, 23 bp, Homo sapiens
agccagagctgtgcctgctcagc

SEQ ID NO: 1697990 - DNA, 19 bp, Homo sapiens
agccagagggtgggagcct

SEQ ID NO: 1697991 - DNA, 14 bp, Homo sapiens
agccagagttaggt

SEQ ID NO: 1697992 - DNA, 15 bp, Homo sapiens
agccagatgcaggac

SEQ ID NO: 1697993 - DNA, 22 bp, Homo sapiens
agccagatgcaggacaggaggc

SEQ ID NO: 1697994 - DNA, 16 bp, Homo sapiens
agccagatgcctcccc

SEQ ID NO: 1697995 - DNA, 22 bp, Homo sapiens
agccagatgctaggctgtctgc

SEQ ID NO: 1697996 - DNA, 14 bp, Homo sapiens
agccagattctctt

SEQ ID NO: 1697997 - DNA, 18 bp, Homo sapiens
agccagatttgtcttttt

SEQ ID NO: 1697998 - DNA, 13 bp, Homo sapiens
agccagcaccacc

SEQ ID NO: 1697999 - DNA, 21 bp, Homo sapiens
agccagcaccacctacacagg

SEQ ID NO: 1698000 - DNA, 15 bp, Homo sapiens
agccagcacccacct

SEQ ID NO: 1698001 - DNA, 14 bp, Homo sapiens
agccagcagaggtc

SEQ ID NO: 1698002 - DNA, 21 bp, Homo sapiens
agccagcagcagcccaagctt

SEQ ID NO: 1698003 - DNA, 13 bp, Homo sapiens
agccagcagccag

SEQ ID NO: 1698004 - DNA, 16 bp, Homo sapiens
agccagcagggctgtg

SEQ ID NO: 1698005 - DNA, 20 bp, Homo sapiens
agccagcattcagcacacac

SEQ ID NO: 1698006 - DNA, 9 bp, Homo sapiens
agccagcca

SEQ ID NO: 1698007 - DNA, 20 bp, Homo sapiens
agccagccaagctttaaatt

SEQ ID NO: 1698008 - DNA, 24 bp, Homo sapiens
agccagccaagctttaaattatgt

SEQ ID NO: 1698009 - DNA, 23 bp, Homo sapiens
agccagccacagacccctgggag

SEQ ID NO: 1698010 - DNA, 14 bp, Homo sapiens
agccagcccagccc

SEQ ID NO: 1698011 - DNA, 16 bp, Homo sapiens
agccagccccctccag

SEQ ID NO: 1698012 - DNA, 20 bp, Homo sapiens
agccagccccctccagctca

SEQ ID NO: 1698013 - DNA, 16 bp, Homo sapiens
agccagcccctcttcc

SEQ ID NO: 1698014 - DNA, 15 bp, Homo sapiens
agccagccctccctg

SEQ ID NO: 1698015 - DNA, 10 bp, Homo sapiens
agccagcctc

SEQ ID NO: 1698016 - DNA, 21 bp, Homo sapiens
agccagcctggctctgccccc

SEQ ID NO: 1698017 - DNA, 13 bp, Homo sapiens
agccagcctggga

SEQ ID NO: 1698018 - DNA, 14 bp, Homo sapiens
agccagcggctcca

SEQ ID NO: 1698019 - DNA, 15 bp, Homo sapiens
agccagcggctccaa

SEQ ID NO: 1698020 - DNA, 15 bp, Homo sapiens
agccagctcacagtg

SEQ ID NO: 1698021 - DNA, 19 bp, Homo sapiens
agccagctccctctattta

SEQ ID NO: 1698022 - DNA, 22 bp, Homo sapiens
agccagctccctctatttatgt

SEQ ID NO: 1698023 - DNA, 20 bp, Homo sapiens
agccagctcctgggcagctt

SEQ ID NO: 1698024 - DNA, 15 bp, Homo sapiens
agccagctctcagcc

SEQ ID NO: 1698025 - DNA, 14 bp, Homo sapiens
agccagctgcccta

SEQ ID NO: 1698026 - DNA, 20 bp, Homo sapiens
agccagctgccgaccagagc

SEQ ID NO: 1698027 - DNA, 11 bp, Homo sapiens
agccagctgct

SEQ ID NO: 1698028 - DNA, 13 bp, Homo sapiens
agccagctgcttt

SEQ ID NO: 1698029 - DNA, 22 bp, Homo sapiens
agccagcttaaacccatacaat

SEQ ID NO: 1698030 - DNA, 12 bp, Homo sapiens
agccagcttggg

SEQ ID NO: 1698031 - DNA, 14 bp, Homo sapiens
agccagctttccct

SEQ ID NO: 1698032 - DNA, 16 bp, Homo sapiens
agccagctttccctgc

SEQ ID NO: 1698033 - DNA, 18 bp, Homo sapiens
agccagctttccctgcct

SEQ ID NO: 1698034 - DNA, 17 bp, Homo sapiens
agccaggaatttcccag

SEQ ID NO: 1698035 - DNA, 14 bp, Homo sapiens
agccaggagacctg

SEQ ID NO: 1698036 - DNA, 15 bp, Homo sapiens
agccaggagctgtca

SEQ ID NO: 1698037 - DNA, 20 bp, Homo sapiens
agccaggagtaagacaagtg

SEQ ID NO: 1698038 - DNA, 16 bp, Homo sapiens
agccaggagtctgtgc

SEQ ID NO: 1698039 - DNA, 21 bp, Homo sapiens
agccaggagtctgtgctcttt

SEQ ID NO: 1698040 - DNA, 15 bp, Homo sapiens
agccaggcgggctca

SEQ ID NO: 1698041 - DNA, 22 bp, Homo sapiens
agccaggctgagtgagccacag

SEQ ID NO: 1698042 - DNA, 21 bp, Homo sapiens
agccaggctgccaaggccaga

SEQ ID NO: 1698043 - DNA, 17 bp, Homo sapiens
agccagggacccccaga

SEQ ID NO: 1698044 - DNA, 19 bp, Homo sapiens
agccagggcagaggaatgt

SEQ ID NO: 1698045 - DNA, 11 bp, Homo sapiens
agccagggcct

SEQ ID NO: 1698046 - DNA, 20 bp, Homo sapiens
agccagggcttacctgtaca

SEQ ID NO: 1698047 - DNA, 20 bp, Homo sapiens
agccagggggatgccactcc

SEQ ID NO: 1698048 - DNA, 15 bp, Homo sapiens
agccaggtacaggag

SEQ ID NO: 1698049 - DNA, 18 bp, Homo sapiens
agccaggtacaggagagg

SEQ ID NO: 1698050 - DNA, 21 bp, Homo sapiens
agccaggtacaggagaggcag

SEQ ID NO: 1698051 - DNA, 23 bp, Homo sapiens
agccaggttagcctttgccctgt

SEQ ID NO: 1698052 - DNA, 14 bp, Homo sapiens
agccagtctcagag

SEQ ID NO: 1698053 - DNA, 16 bp, Homo sapiens
agccagtctcagagac

SEQ ID NO: 1698054 - DNA, 19 bp, Homo sapiens
agccagtctcagagaccag

SEQ ID NO: 1698055 - DNA, 18 bp, Homo sapiens
agccagtcttgcctaggc

SEQ ID NO: 1698056 - DNA, 13 bp, Homo sapiens
agccagtgaagga

SEQ ID NO: 1698057 - DNA, 15 bp, Homo sapiens
agccagtgacttttt

SEQ ID NO: 1698058 - DNA, 18 bp, Homo sapiens
agccagtggcacaggaga

SEQ ID NO: 1698059 - DNA, 19 bp, Homo sapiens
agccagtggcacaggagac

SEQ ID NO: 1698060 - DNA, 16 bp, Homo sapiens
agccagttttcatttt

SEQ ID NO: 1698061 - DNA, 17 bp, Homo sapiens
agccatagacctacaga

SEQ ID NO: 1698062 - DNA, 14 bp, Homo sapiens
agccatcaagcact

SEQ ID NO: 1698063 - DNA, 16 bp, Homo sapiens
agccatcaagcacttc

SEQ ID NO: 1698064 - DNA, 20 bp, Homo sapiens
agccatcacttctccccgca

SEQ ID NO: 1698065 - DNA, 14 bp, Homo sapiens
agccatcagaagtt

SEQ ID NO: 1698066 - DNA, 18 bp, Homo sapiens
agccatcataggaaggga

SEQ ID NO: 1698067 - DNA, 18 bp, Homo sapiens
agccatccaaagaaacac

SEQ ID NO: 1698068 - DNA, 15 bp, Homo sapiens
agccatccatttgtg

SEQ ID NO: 1698069 - DNA, 19 bp, Homo sapiens
agccatcccatgaacacac

SEQ ID NO: 1698070 - DNA, 18 bp, Homo sapiens
agccatcccttcggagcc

SEQ ID NO: 1698071 - DNA, 21 bp, Homo sapiens
agccatctcatgaggggagag

SEQ ID NO: 1698072 - DNA, 23 bp, Homo sapiens
agccatctcatgaggggagagga

SEQ ID NO: 1698073 - DNA, 14 bp, Homo sapiens
agccatctgcccag

SEQ ID NO: 1698074 - DNA, 15 bp, Homo sapiens
agccatctgcccagg

SEQ ID NO: 1698075 - DNA, 16 bp, Homo sapiens
agcattgcctggactg

SEQ ID NO: 1698076 - DNA, 20 bp, Homo sapiens
agcattgcctggactgacca

SEQ ID NO: 1698077 - DNA, 21 bp, Homo sapiens
agcattgcctggactgaccac

SEQ ID NO: 1698078 - DNA, 15 bp, Homo sapiens
agcattgctggttct

SEQ ID NO: 1698079 - DNA, 16 bp, Homo sapiens
agcattgctggttcta

SEQ ID NO: 1698080 - DNA, 23 bp, Homo sapiens
agcattgctggttctatttaatg

SEQ ID NO: 1698081 - DNA, 13 bp, Homo sapiens
agcattgctttct

SEQ ID NO: 1698082 - DNA, 14 bp, Homo sapiens
agcattgctttctg

SEQ ID NO: 1698083 - DNA, 15 bp, Homo sapiens
agcattgtaaaataa

SEQ ID NO: 1698084 - DNA, 18 bp, Homo sapiens
agcattgtctttgctgta

SEQ ID NO: 1698085 - DNA, 23 bp, Homo sapiens
agcattgtctttgctgtactctt

SEQ ID NO: 1698086 - DNA, 15 bp, Homo sapiens
agcattgtttttgtc

SEQ ID NO: 1698087 - DNA, 13 bp, Homo sapiens
agcatttaaaatg

SEQ ID NO: 1698088 - DNA, 18 bp, Homo sapiens
agcatttactatgcacaa

SEQ ID NO: 1698089 - DNA, 18 bp, Homo sapiens
agcatttagtcttgccag

SEQ ID NO: 1698090 - DNA, 13 bp, Homo sapiens
agcatttatgttt

SEQ ID NO: 1698091 - DNA, 17 bp, Homo sapiens
agcatttcaaagccctg

SEQ ID NO: 1698092 - DNA, 18 bp, Homo sapiens
agcatttcaaagccctgc

SEQ ID NO: 1698093 - DNA, 22 bp, Homo sapiens
agcatttcaaagccctgcctct

SEQ ID NO: 1698094 - DNA, 11 bp, Homo sapiens
agcatttcatg

SEQ ID NO: 1698095 - DNA, 18 bp, Homo sapiens
agcatttcatgaaaaagc

SEQ ID NO: 1698096 - DNA, 14 bp, Homo sapiens
agcatttccaacac

SEQ ID NO: 1698097 - DNA, 11 bp, Homo sapiens
agcatttccta

SEQ ID NO: 1698098 - DNA, 13 bp, Homo sapiens
agcatttgatttc

SEQ ID NO: 1698099 - DNA, 16 bp, Homo sapiens
agcatttgatttccat

SEQ ID NO: 1698100 - DNA, 23 bp, Homo sapiens
agcatttggaccaatagcccaca

SEQ ID NO: 1698101 - DNA, 23 bp, Homo sapiens
agcatttgtataaagaaactggt

SEQ ID NO: 1698102 - DNA, 14 bp, Homo sapiens
agcatttgttttag

SEQ ID NO: 1698103 - DNA, 17 bp, Homo sapiens
agcatttgttttagcat

SEQ ID NO: 1698104 - DNA, 14 bp, Homo sapiens
agcattttgaaaca

SEQ ID NO: 1698105 - DNA, 19 bp, Homo sapiens
agcatttttataaactacc

SEQ ID NO: 1698106 - DNA, 16 bp, Homo sapiens
agcatttttatgcaga

SEQ ID NO: 1698107 - DNA, 19 bp, Homo sapiens
agcatttttatgcagacag

SEQ ID NO: 1698108 - DNA, 20 bp, Homo sapiens
agcatttttattcatgccat

SEQ ID NO: 1698109 - DNA, 20 bp, Homo sapiens
agcatttttcaatatattga

SEQ ID NO: 1698110 - DNA, 23 bp, Homo sapiens
agcatttttcaatatattgaact

SEQ ID NO: 1698111 - DNA, 19 bp, Homo sapiens
agcatttttttaaaagaag

SEQ ID NO: 1698112 - DNA, 17 bp, Homo sapiens
agccaaaaaggcaaata

SEQ ID NO: 1698113 - DNA, 23 bp, Homo sapiens
agccaaaaggattcctctttgtt

SEQ ID NO: 1698114 - DNA, 12 bp, Homo sapiens
agccaaaccagg

SEQ ID NO: 1698115 - DNA, 19 bp, Homo sapiens
agccaaacccatgaggcaa

SEQ ID NO: 1698116 - DNA, 15 bp, Homo sapiens
agccaaacccctaga

SEQ ID NO: 1698117 - DNA, 14 bp, Homo sapiens
agccaaaccctgtc

SEQ ID NO: 1698118 - DNA, 14 bp, Homo sapiens
agccaaactctgcc

SEQ ID NO: 1698119 - DNA, 15 bp, Homo sapiens
agccaaactctgcca

SEQ ID NO: 1698120 - DNA, 19 bp, Homo sapiens
agccaaagaaacaagctgt

SEQ ID NO: 1698121 - DNA, 21 bp, Homo sapiens
agccaaagaaacaagctgtgc

SEQ ID NO: 1698122 - DNA, 22 bp, Homo sapiens
agccaaagaaacaagctgtgca

SEQ ID NO: 1698123 - DNA, 12 bp, Homo sapiens
agccaaagccag

SEQ ID NO: 1698124 - DNA, 13 bp, Homo sapiens
agccaaaggcagc

SEQ ID NO: 1698125 - DNA, 14 bp, Homo sapiens
agccaaaggcagct

SEQ ID NO: 1698126 - DNA, 20 bp, Homo sapiens
agccaaatgtaattgaataa

SEQ ID NO: 1698127 - DNA, 12 bp, Homo sapiens
agccaaatttaa

SEQ ID NO: 1698128 - DNA, 14 bp, Homo sapiens
agccaacaagaccg

SEQ ID NO: 1698129 - DNA, 16 bp, Homo sapiens
agccaacaagaccgcc

SEQ ID NO: 1698130 - DNA, 24 bp, Homo sapiens
agccaacaagaccgccccagggct

SEQ ID NO: 1698131 - DNA, 23 bp, Homo sapiens
agccaacaccctgtctaaaaaac

SEQ ID NO: 1698132 - DNA, 18 bp, Homo sapiens
agccaacagaagcttcca

SEQ ID NO: 1698133 - DNA, 14 bp, Homo sapiens
agccaaccagcctt

SEQ ID NO: 1698134 - DNA, 16 bp, Homo sapiens
agccaacctggacttc

SEQ ID NO: 1698135 - DNA, 17 bp, Homo sapiens
agccaacctggacttcc

SEQ ID NO: 1698136 - DNA, 15 bp, Homo sapiens
agccaacgagacaca

SEQ ID NO: 1698137 - DNA, 16 bp, Homo sapiens
agccaacgagacacat

SEQ ID NO: 1698138 - DNA, 22 bp, Homo sapiens
agccaacgagacacattgcctt

SEQ ID NO: 1698139 - DNA, 17 bp, Homo sapiens
agccaactatgattatt

SEQ ID NO: 1698140 - DNA, 20 bp, Homo sapiens
agccaactatgattattaac

SEQ ID NO: 1698141 - DNA, 19 bp, Homo sapiens
agccaactgtttccctgct

SEQ ID NO: 1698142 - DNA, 15 bp, Homo sapiens
agccaacttttgcat

SEQ ID NO: 1698143 - DNA, 16 bp, Homo sapiens
agccaagaagcctgca

SEQ ID NO: 1698144 - DNA, 14 bp, Homo sapiens
agccaagcactgct

SEQ ID NO: 1698145 - DNA, 20 bp, Homo sapiens
agccaaggacagggctggct

SEQ ID NO: 1698146 - DNA, 21 bp, Homo sapiens
agccaaggacagggctggctc

SEQ ID NO: 1698147 - DNA, 22 bp, Homo sapiens
agccaaggacagggctggctcc

SEQ ID NO: 1698148 - DNA, 19 bp, Homo sapiens
agccaaggcagcgacccca

SEQ ID NO: 1698149 - DNA, 16 bp, Homo sapiens
agccaagggaaagggg

SEQ ID NO: 1698150 - DNA, 23 bp, Homo sapiens
agccaagggaaaggggtgctttt

SEQ ID NO: 1698151 - DNA, 17 bp, Homo sapiens
agccaagggaacctgtg

SEQ ID NO: 1698152 - DNA, 21 bp, Homo sapiens
agccaagggaacctgtgtccg

SEQ ID NO: 1698153 - DNA, 17 bp, Homo sapiens
agccaagggtatccaag

SEQ ID NO: 1698154 - DNA, 18 bp, Homo sapiens
agccaagggttcagagac

SEQ ID NO: 1698155 - DNA, 19 bp, Homo sapiens
agccaaggtgggctgagcc

SEQ ID NO: 1698156 - DNA, 18 bp, Homo sapiens
agccaagtggtccagcgt

SEQ ID NO: 1698157 - DNA, 13 bp, Homo sapiens
agccaatcccctc

SEQ ID NO: 1698158 - DNA, 15 bp, Homo sapiens
agccaatcccctcct

SEQ ID NO: 1698159 - DNA, 18 bp, Homo sapiens
agccaatcccctccttgg

SEQ ID NO: 1698160 - DNA, 20 bp, Homo sapiens
agccaatcccctccttgggc

SEQ ID NO: 1698161 - DNA, 16 bp, Homo sapiens
agccaatgtctcctcc

SEQ ID NO: 1698162 - DNA, 20 bp, Homo sapiens
agccaatgtctcctcccctt

SEQ ID NO: 1698163 - DNA, 17 bp, Homo sapiens
agccacaagctgcactg

SEQ ID NO: 1698164 - DNA, 16 bp, Homo sapiens
agccacaagtcttcca

SEQ ID NO: 1698165 - DNA, 15 bp, Homo sapiens
agccacacccaggca

SEQ ID NO: 1698166 - DNA, 21 bp, Homo sapiens
agccacactgtgggactcttc

SEQ ID NO: 1698167 - DNA, 16 bp, Homo sapiens
agccacagaccacctg

SEQ ID NO: 1698168 - DNA, 19 bp, Homo sapiens
agccacagacccctgggag

SEQ ID NO: 1698169 - DNA, 12 bp, Homo sapiens
agccacaggcca

SEQ ID NO: 1698170 - DNA, 14 bp, Homo sapiens
agccacaggcctga

SEQ ID NO: 1698171 - DNA, 17 bp, Homo sapiens
agccacaggcctgagat

SEQ ID NO: 1698172 - DNA, 22 bp, Homo sapiens
agccacaggcctgagatttcat

SEQ ID NO: 1698173 - DNA, 14 bp, Homo sapiens
agccacagtacata

SEQ ID NO: 1698174 - DNA, 16 bp, Homo sapiens
agccacagtacatatg

SEQ ID NO: 1698175 - DNA, 16 bp, Homo sapiens
agccacagtcactgga

SEQ ID NO: 1698176 - DNA, 13 bp, Homo sapiens
agccacagtggga

SEQ ID NO: 1698177 - DNA, 14 bp, Homo sapiens
agccacattatttc

SEQ ID NO: 1698178 - DNA, 21 bp, Homo sapiens
agccaccaaagtcacatccac

SEQ ID NO: 1698179 - DNA, 12 bp, Homo sapiens
agccaccagttc

SEQ ID NO: 1698180 - DNA, 18 bp, Homo sapiens
agccaccatccccaccct

SEQ ID NO: 1698181 - DNA, 23 bp, Homo sapiens
agccaccatgcctggcccggata

SEQ ID NO: 1698182 - DNA, 23 bp, Homo sapiens
agccacccaagcctgctggctgc

SEQ ID NO: 1698183 - DNA, 23 bp, Homo sapiens
agccacccgtggggtgctgccct

SEQ ID NO: 1698184 - DNA, 16 bp, Homo sapiens
agccaccctaccatga

SEQ ID NO: 1698185 - DNA, 15 bp, Homo sapiens
agccaccgaagccgc

SEQ ID NO: 1698186 - DNA, 22 bp, Homo sapiens
agccacctcccaccccactcca

SEQ ID NO: 1698187 - DNA, 12 bp, Homo sapiens
agccacctgcaa

SEQ ID NO: 1698188 - DNA, 19 bp, Homo sapiens
agccacctgcaagatggac

SEQ ID NO: 1698189 - DNA, 14 bp, Homo sapiens
agccacgactgcca

SEQ ID NO: 1698190 - DNA, 16 bp, Homo sapiens
agccacgcagggccat

SEQ ID NO: 1698191 - DNA, 16 bp, Homo sapiens
aagttctaagattctg

SEQ ID NO: 1698192 - DNA, 14 bp, Homo sapiens
aagttctataacta

SEQ ID NO: 1698193 - DNA, 19 bp, Homo sapiens
aagttctccttttgaactt

SEQ ID NO: 1698194 - DNA, 15 bp, Homo sapiens
aagttcttattttag

SEQ ID NO: 1698195 - DNA, 17 bp, Homo sapiens
aagttcttattttagta

SEQ ID NO: 1698196 - DNA, 21 bp, Homo sapiens
aagttgattaaaaatgctttt

SEQ ID NO: 1698197 - DNA, 13 bp, Homo sapiens
aagttgctgttta

SEQ ID NO: 1698198 - DNA, 20 bp, Homo sapiens
aagttggaaaggaaaaaaga

SEQ ID NO: 1698199 - DNA, 19 bp, Homo sapiens
aagttggaccagaggaagc

SEQ ID NO: 1698200 - DNA, 13 bp, Homo sapiens
aagttggactggg

SEQ ID NO: 1698201 - DNA, 18 bp, Homo sapiens
aagttgggcccctgagga

SEQ ID NO: 1698202 - DNA, 17 bp, Homo sapiens
aagttggggtctgttct

SEQ ID NO: 1698203 - DNA, 19 bp, Homo sapiens
aagttggtttagctttgga

SEQ ID NO: 1698204 - DNA, 17 bp, Homo sapiens
aagttgtaaagtatgta

SEQ ID NO: 1698205 - DNA, 20 bp, Homo sapiens
aagttgtactttaaaaattt

SEQ ID NO: 1698206 - DNA, 21 bp, Homo sapiens
aagttgtcaaagaagcttcca

SEQ ID NO: 1698207 - DNA, 18 bp, Homo sapiens
aagttgtgcttttctgtt

SEQ ID NO: 1698208 - DNA, 15 bp, Homo sapiens
aagttgttaaaacat

SEQ ID NO: 1698209 - DNA, 21 bp, Homo sapiens
aagtttattttttctacacag

SEQ ID NO: 1698210 - DNA, 20 bp, Homo sapiens
agatggagacaccctctggg

SEQ ID NO: 1698211 - DNA, 13 bp, Homo sapiens
agatggagcccat

SEQ ID NO: 1698212 - DNA, 22 bp, Homo sapiens
agatggagcccataggccaccc

SEQ ID NO: 1698213 - DNA, 18 bp, Homo sapiens
agatggagggcttggccc

SEQ ID NO: 1698214 - DNA, 22 bp, Homo sapiens
agatggagggcttggcccagcg

SEQ ID NO: 1698215 - DNA, 15 bp, Homo sapiens
agatggagtttctaa

SEQ ID NO: 1698216 - DNA, 16 bp, Homo sapiens
agatggagtttctaag

SEQ ID NO: 1698217 - DNA, 18 bp, Homo sapiens
agatggagtttctaaggt

SEQ ID NO: 1698218 - DNA, 15 bp, Homo sapiens
agatggatgtaaagt

SEQ ID NO: 1698219 - DNA, 21 bp, Homo sapiens
agatggcataacctgtctcac

SEQ ID NO: 1698220 - DNA, 18 bp, Homo sapiens
agatggcccccagctggt

SEQ ID NO: 1698221 - DNA, 14 bp, Homo sapiens
agatggcctttgct

SEQ ID NO: 1698222 - DNA, 15 bp, Homo sapiens
agatggcctttgctt

SEQ ID NO: 1698223 - DNA, 23 bp, Homo sapiens
agatggcctttgcttatgaatat

SEQ ID NO: 1698224 - DNA, 14 bp, Homo sapiens
agatggctgctgcc

SEQ ID NO: 1698225 - DNA, 15 bp, Homo sapiens
agatggctgctgcct

SEQ ID NO: 1698226 - DNA, 21 bp, Homo sapiens
agatggctggaaggggtccag

SEQ ID NO: 1698227 - DNA, 12 bp, Homo sapiens
agatggctgtgg

SEQ ID NO: 1698228 - DNA, 14 bp, Homo sapiens
agatggctgtggca

SEQ ID NO: 1698229 - DNA, 21 bp, Homo sapiens
agatgggaaggttagaaaggc

SEQ ID NO: 1698230 - DNA, 13 bp, Homo sapiens
agatgggacaagc

SEQ ID NO: 1698231 - DNA, 16 bp, Homo sapiens
agatgggacagcaaca

SEQ ID NO: 1698232 - DNA, 21 bp, Homo sapiens
agatgggcatcttttgtatta

SEQ ID NO: 1698233 - DNA, 22 bp, Homo sapiens
agatgggctgaactgagcctag

SEQ ID NO: 1698234 - DNA, 19 bp, Homo sapiens
agatgggcttgttttcttg

SEQ ID NO: 1698235 - DNA, 14 bp, Homo sapiens
agatggggtctgtg

SEQ ID NO: 1698236 - DNA, 18 bp, Homo sapiens
agatggggtctgtgactg

SEQ ID NO: 1698237 - DNA, 20 bp, Homo sapiens
agatggggtctgtgactgga

SEQ ID NO: 1698238 - DNA, 22 bp, Homo sapiens
agatggggtctgtgactggatc

SEQ ID NO: 1698239 - DNA, 16 bp, Homo sapiens
agatgggtattaaact

SEQ ID NO: 1698240 - DNA, 20 bp, Homo sapiens
agatgggtccctggccacca

SEQ ID NO: 1698241 - DNA, 16 bp, Homo sapiens
agatgggtgatatata

SEQ ID NO: 1698242 - DNA, 20 bp, Homo sapiens
agatggtaatctacagctca

SEQ ID NO: 1698243 - DNA, 16 bp, Homo sapiens
agatggtccatttgtt

SEQ ID NO: 1698244 - DNA, 21 bp, Homo sapiens
agatggtgtgggtgtcctgcc

SEQ ID NO: 1698245 - DNA, 22 bp, Homo sapiens
agatggtgtgggtgtcctgcct

SEQ ID NO: 1698246 - DNA, 17 bp, Homo sapiens
agatgtaaaaggtatta

SEQ ID NO: 1698247 - DNA, 23 bp, Homo sapiens
agatgtaccaattgtcaaattac

SEQ ID NO: 1698248 - DNA, 22 bp, Homo sapiens
agatgtaggggaagagatgttt

SEQ ID NO: 1698249 - DNA, 23 bp, Homo sapiens
agatgtaggggaagagatgttta

SEQ ID NO: 1698250 - DNA, 23 bp, Homo sapiens
agatgtatttttgatgtatatat

SEQ ID NO: 1698251 - DNA, 18 bp, Homo sapiens
agatgtcagactggctgg

SEQ ID NO: 1698252 - DNA, 23 bp, Homo sapiens
agatgtcatttagttcagcatcc

SEQ ID NO: 1698253 - DNA, 20 bp, Homo sapiens
agatgtccctttcttggcca

SEQ ID NO: 1698254 - DNA, 14 bp, Homo sapiens
agatgtccgtctct

SEQ ID NO: 1698255 - DNA, 14 bp, Homo sapiens
agatgtctcaaaaa

SEQ ID NO: 1698256 - DNA, 18 bp, Homo sapiens
agatgtcttctgcctgtt

SEQ ID NO: 1698257 - DNA, 19 bp, Homo sapiens
agatgtcttctgcctgtta

SEQ ID NO: 1698258 - DNA, 13 bp, Homo sapiens
agatgtctttagg

SEQ ID NO: 1698259 - DNA, 14 bp, Homo sapiens
agatgtgaaaactc

SEQ ID NO: 1698260 - DNA, 22 bp, Homo sapiens
agatgtgaacacatcagcttgc

SEQ ID NO: 1698261 - DNA, 11 bp, Homo sapiens
agatgtgaatt

SEQ ID NO: 1698262 - DNA, 18 bp, Homo sapiens
agatgtgaattattgaca

SEQ ID NO: 1698263 - DNA, 23 bp, Homo sapiens
agatgtgaattattgacactgaa

SEQ ID NO: 1698264 - DNA, 20 bp, Homo sapiens
agatgtgacccaccagtgcc

SEQ ID NO: 1698265 - DNA, 21 bp, Homo sapiens
agatgtgacccaccagtgcct

SEQ ID NO: 1698266 - DNA, 16 bp, Homo sapiens
agatgtgatattctaa

SEQ ID NO: 1698267 - DNA, 16 bp, Homo sapiens
agatgtgcaaatgcaa

SEQ ID NO: 1698268 - DNA, 23 bp, Homo sapiens
agatgtgcatttcacctgtgaca

SEQ ID NO: 1698269 - DNA, 15 bp, Homo sapiens
agatgtgctttgctg

SEQ ID NO: 1698270 - DNA, 14 bp, Homo sapiens
agatgttaagcatt

SEQ ID NO: 1698271 - DNA, 16 bp, Homo sapiens
agatgttattactgtt

SEQ ID NO: 1698272 - DNA, 20 bp, Homo sapiens
agatgttcttttctatttat

SEQ ID NO: 1698273 - DNA, 23 bp, Homo sapiens
agatgttgatttttactgtgttt

SEQ ID NO: 1698274 - DNA, 17 bp, Homo sapiens
agatgttgccatgtgtt

SEQ ID NO: 1698275 - DNA, 14 bp, Homo sapiens
agatgttgtcttgc

SEQ ID NO: 1698276 - DNA, 12 bp, Homo sapiens
agatgtttaaca

SEQ ID NO: 1698277 - DNA, 17 bp, Homo sapiens
agatgtttaacaaatct

SEQ ID NO: 1698278 - DNA, 19 bp, Homo sapiens
agatgtttaacaaatctaa

SEQ ID NO: 1698279 - DNA, 15 bp, Homo sapiens
agatgtttacagtat

SEQ ID NO: 1698280 - DNA, 20 bp, Homo sapiens
agatgtttattggtatattt

SEQ ID NO: 1698281 - DNA, 16 bp, Homo sapiens
agatgtttatttcagg

SEQ ID NO: 1698282 - DNA, 23 bp, Homo sapiens
agatgtttccagacttccttgag

SEQ ID NO: 1698283 - DNA, 15 bp, Homo sapiens
agatgtttgtcagat

SEQ ID NO: 1698284 - DNA, 20 bp, Homo sapiens
agatgtttgtttacataaga

SEQ ID NO: 1698285 - DNA, 23 bp, Homo sapiens
agattaaaattatatagctgctc

SEQ ID NO: 1698286 - DNA, 11 bp, Homo sapiens
agattaaagga

SEQ ID NO: 1698287 - DNA, 14 bp, Homo sapiens
agattaaaggaagg

SEQ ID NO: 1698288 - DNA, 15 bp, Homo sapiens
agattaaaggaagga

SEQ ID NO: 1698289 - DNA, 17 bp, Homo sapiens
agattaaaggaaggaaa

SEQ ID NO: 1698290 - DNA, 18 bp, Homo sapiens
agattaaatgtgtcattg

SEQ ID NO: 1698291 - DNA, 14 bp, Homo sapiens
agattaatggcact

SEQ ID NO: 1698292 - DNA, 11 bp, Homo sapiens
agattaatttt

SEQ ID NO: 1698293 - DNA, 21 bp, Homo sapiens
agattaccccctcattgttta

SEQ ID NO: 1698294 - DNA, 21 bp, Homo sapiens
agattagagcctgtaaacttt

SEQ ID NO: 1698295 - DNA, 18 bp, Homo sapiens
agattagttctttttgcc

SEQ ID NO: 1698296 - DNA, 18 bp, Homo sapiens
agattataataaatatat

SEQ ID NO: 1698297 - DNA, 19 bp, Homo sapiens
agattataatatgtgcctt

SEQ ID NO: 1698298 - DNA, 18 bp, Homo sapiens
agattataattgttgcat

SEQ ID NO: 1698299 - DNA, 19 bp, Homo sapiens
agattatagattctaaaga

SEQ ID NO: 1698300 - DNA, 20 bp, Homo sapiens
agattatagattctaaagat

SEQ ID NO: 1698301 - DNA, 22 bp, Homo sapiens
agattatgttcctgctgtattt

SEQ ID NO: 1698302 - DNA, 21 bp, Homo sapiens
agattattgtagtgttcaaaa

SEQ ID NO: 1698303 - DNA, 22 bp, Homo sapiens
agattattgtgacttcactgta

SEQ ID NO: 1698304 - DNA, 16 bp, Homo sapiens
agattcaaaggttcta

SEQ ID NO: 1698305 - DNA, 14 bp, Homo sapiens
agattcaaggcccc

SEQ ID NO: 1698306 - DNA, 22 bp, Homo sapiens
agattcacacctgactctgaaa

SEQ ID NO: 1698307 - DNA, 17 bp, Homo sapiens
agattcaggccagccca

SEQ ID NO: 1698308 - DNA, 20 bp, Homo sapiens
agattcaggtatgttgcctt

SEQ ID NO: 1698309 - DNA, 20 bp, Homo sapiens
agattcatttttaatcatga

SEQ ID NO: 1698310 - DNA, 19 bp, Homo sapiens
agattccattggtccaaga

SEQ ID NO: 1698311 - DNA, 22 bp, Homo sapiens
agattccattggtccaagattc

SEQ ID NO: 1698312 - DNA, 12 bp, Homo sapiens
agattcccagag

SEQ ID NO: 1698313 - DNA, 14 bp, Homo sapiens
agattcccagagac

SEQ ID NO: 1698314 - DNA, 16 bp, Homo sapiens
agattcccagagcaaa

SEQ ID NO: 1698315 - DNA, 15 bp, Homo sapiens
agattccctgagcag

SEQ ID NO: 1698316 - DNA, 16 bp, Homo sapiens
agattccggatcctaa

SEQ ID NO: 1698317 - DNA, 20 bp, Homo sapiens
agattccggatcctaagcat

SEQ ID NO: 1698318 - DNA, 24 bp, Homo sapiens
agattccggatcctaagcatctaa

SEQ ID NO: 1698319 - DNA, 15 bp, Homo sapiens
agattctaaaacatt

SEQ ID NO: 1698320 - DNA, 17 bp, Homo sapiens
agattctaaaacattct

SEQ ID NO: 1698321 - DNA, 18 bp, Homo sapiens
agattctaaagattctat

SEQ ID NO: 1698322 - DNA, 17 bp, Homo sapiens
agattctaaagctcaat

SEQ ID NO: 1698323 - DNA, 13 bp, Homo sapiens
agattctaaaggt

SEQ ID NO: 1698324 - DNA, 10 bp, Homo sapiens
agattctaac

SEQ ID NO: 1698325 - DNA, 14 bp, Homo sapiens
agattctaatgatg

SEQ ID NO: 1698326 - DNA, 23 bp, Homo sapiens
agatccttcacaggcagtgcatg

SEQ ID NO: 1698327 - DNA, 14 bp, Homo sapiens
agatccttgtttca

SEQ ID NO: 1698328 - DNA, 18 bp, Homo sapiens
agatccttgtttcaaaca

SEQ ID NO: 1698329 - DNA, 20 bp, Homo sapiens
agatccttgtttcaaacaca

SEQ ID NO: 1698330 - DNA, 17 bp, Homo sapiens
agatcgagaccatcctg

SEQ ID NO: 1698331 - DNA, 13 bp, Homo sapiens
agatcgcatggca

SEQ ID NO: 1698332 - DNA, 19 bp, Homo sapiens
agatcgcgccactgcactc

SEQ ID NO: 1698333 - DNA, 14 bp, Homo sapiens
agatcgcttgagcc

SEQ ID NO: 1698334 - DNA, 18 bp, Homo sapiens
agatcgcttgagcccagg

SEQ ID NO: 1698335 - DNA, 19 bp, Homo sapiens
agatcgcttgagcccagga

SEQ ID NO: 1698336 - DNA, 16 bp, Homo sapiens
agatcgcttttctcag

SEQ ID NO: 1698337 - DNA, 22 bp, Homo sapiens
agatcgtgccgttactctccaa

SEQ ID NO: 1698338 - DNA, 16 bp, Homo sapiens
agatcgttagtatcta

SEQ ID NO: 1698339 - DNA, 16 bp, Homo sapiens
agatcgtttaaaaaca

SEQ ID NO: 1698340 - DNA, 14 bp, Homo sapiens
agatctaaacagtt

SEQ ID NO: 1698341 - DNA, 16 bp, Homo sapiens
agatctaaacagttat

SEQ ID NO: 1698342 - DNA, 20 bp, Homo sapiens
agatctaagcctttccataa

SEQ ID NO: 1698343 - DNA, 16 bp, Homo sapiens
agatctatgggaagat

SEQ ID NO: 1698344 - DNA, 18 bp, Homo sapiens
agatctcctgtattcttg

SEQ ID NO: 1698345 - DNA, 22 bp, Homo sapiens
agatctcggtttgccaaaattc

SEQ ID NO: 1698346 - DNA, 14 bp, Homo sapiens
agatctgactgcca

SEQ ID NO: 1698347 - DNA, 14 bp, Homo sapiens
agatctgatcaaga

SEQ ID NO: 1698348 - DNA, 18 bp, Homo sapiens
agatctgatggtgagctg

SEQ ID NO: 1698349 - DNA, 17 bp, Homo sapiens
agatctgcacagtcaga

SEQ ID NO: 1698350 - DNA, 12 bp, Homo sapiens
agatctgcctgg

SEQ ID NO: 1698351 - DNA, 13 bp, Homo sapiens
agatctgcctggg

SEQ ID NO: 1698352 - DNA, 16 bp, Homo sapiens
agatctgcctgggcct

SEQ ID NO: 1698353 - DNA, 17 bp, Homo sapiens
agatctgcctgggcctg

SEQ ID NO: 1698354 - DNA, 18 bp, Homo sapiens
agatctgcctgggcctgt

SEQ ID NO: 1698355 - DNA, 15 bp, Homo sapiens
agatctggaacctca

SEQ ID NO: 1698356 - DNA, 19 bp, Homo sapiens
agatctggaacctcagcct

SEQ ID NO: 1698357 - DNA, 20 bp, Homo sapiens
agatctggaacctcagcctg

SEQ ID NO: 1698358 - DNA, 17 bp, Homo sapiens
agatctggacttggcaa

SEQ ID NO: 1698359 - DNA, 12 bp, Homo sapiens
agatctgtgccc

SEQ ID NO: 1698360 - DNA, 16 bp, Homo sapiens
agatctgtgtggctcc

SEQ ID NO: 1698361 - DNA, 22 bp, Homo sapiens
agatctgttttgtggtttggaa

SEQ ID NO: 1698362 - DNA, 22 bp, Homo sapiens
agatcttccgtggtcagagtgc

SEQ ID NO: 1698363 - DNA, 16 bp, Homo sapiens
agatcttgagagctgc

SEQ ID NO: 1698364 - DNA, 14 bp, Homo sapiens
agatctttcagaaa

SEQ ID NO: 1698365 - DNA, 17 bp, Homo sapiens
agatctttcagaaatat

SEQ ID NO: 1698366 - DNA, 19 bp, Homo sapiens
agatctttcagaaatataa

SEQ ID NO: 1698367 - DNA, 20 bp, Homo sapiens
agatctttcagaaatataac

SEQ ID NO: 1698368 - DNA, 21 bp, Homo sapiens
agatctttcagaaatataaca

SEQ ID NO: 1698369 - DNA, 12 bp, Homo sapiens
agatctttcagg

SEQ ID NO: 1698370 - DNA, 13 bp, Homo sapiens
agatctttcagga

SEQ ID NO: 1698371 - DNA, 12 bp, Homo sapiens
agatctttctct

SEQ ID NO: 1698372 - DNA, 15 bp, Homo sapiens
agatctttctcttcc

SEQ ID NO: 1698373 - DNA, 17 bp, Homo sapiens
agatctttgtaaatgca

SEQ ID NO: 1698374 - DNA, 15 bp, Homo sapiens
agatcttttagaagt

SEQ ID NO: 1698375 - DNA, 13 bp, Homo sapiens
agatgaaaactag

SEQ ID NO: 1698376 - DNA, 11 bp, Homo sapiens
agatgaaactg

SEQ ID NO: 1698377 - DNA, 12 bp, Homo sapiens
agatgaaactga

SEQ ID NO: 1698378 - DNA, 14 bp, Homo sapiens
agatgaaactgaaa

SEQ ID NO: 1698379 - DNA, 17 bp, Homo sapiens
agatgaaactgaaagca

SEQ ID NO: 1698380 - DNA, 22 bp, Homo sapiens
agatgaactgactgaaggaaaa

SEQ ID NO: 1698381 - DNA, 22 bp, Homo sapiens
agatgaatacaaacaatggaaa

SEQ ID NO: 1698382 - DNA, 13 bp, Homo sapiens
agatgaatcaatg

SEQ ID NO: 1698383 - DNA, 16 bp, Homo sapiens
agatgaatgccgtgga

SEQ ID NO: 1698384 - DNA, 23 bp, Homo sapiens
agatgaattgataaaagagttcc

SEQ ID NO: 1698385 - DNA, 19 bp, Homo sapiens
agatgacacataaatctgt

SEQ ID NO: 1698386 - DNA, 14 bp, Homo sapiens
agatgacagctctt

SEQ ID NO: 1698387 - DNA, 15 bp, Homo sapiens
agatgacagctcttc

SEQ ID NO: 1698388 - DNA, 15 bp, Homo sapiens
agatgaccagggatg

SEQ ID NO: 1698389 - DNA, 15 bp, Homo sapiens
agatgactgagtcct

SEQ ID NO: 1698390 - DNA, 17 bp, Homo sapiens
agatgagaacagataaa

SEQ ID NO: 1698391 - DNA, 17 bp, Homo sapiens
agatgagatttgccagc

SEQ ID NO: 1698392 - DNA, 21 bp, Homo sapiens
agatgagccccacgtggagct

SEQ ID NO: 1698393 - DNA, 17 bp, Homo sapiens
agatgagggtgactgtc

SEQ ID NO: 1698394 - DNA, 20 bp, Homo sapiens
agatgattaaataagattct

SEQ ID NO: 1698395 - DNA, 21 bp, Homo sapiens
agatgattaaataagattcta

SEQ ID NO: 1698396 - DNA, 21 bp, Homo sapiens
agatgattttttaaggagctg

SEQ ID NO: 1698397 - DNA, 17 bp, Homo sapiens
agatgcaaatgttttga

SEQ ID NO: 1698398 - DNA, 15 bp, Homo sapiens
agatgcaaggaccag

SEQ ID NO: 1698399 - DNA, 18 bp, Homo sapiens
agatgcaatgtgctactg

SEQ ID NO: 1698400 - DNA, 18 bp, Homo sapiens
agatgcaattgctcccat

SEQ ID NO: 1698401 - DNA, 18 bp, Homo sapiens
agatgcaccaccaagcca

SEQ ID NO: 1698402 - DNA, 12 bp, Homo sapiens
agatgcactgaa

SEQ ID NO: 1698403 - DNA, 23 bp, Homo sapiens
agatgcacttaagttagcctcca

SEQ ID NO: 1698404 - DNA, 17 bp, Homo sapiens
agatgcagctactggaa

SEQ ID NO: 1698405 - DNA, 17 bp, Homo sapiens
agatgcaggacaggagg

SEQ ID NO: 1698406 - DNA, 17 bp, Homo sapiens
agatgccacttctaaga

SEQ ID NO: 1698407 - DNA, 22 bp, Homo sapiens
agatgccagcttctctctccag

SEQ ID NO: 1698408 - DNA, 16 bp, Homo sapiens
agatgccatggcctgt

SEQ ID NO: 1698409 - DNA, 18 bp, Homo sapiens
agatgccattttgtacat

SEQ ID NO: 1698410 - DNA, 21 bp, Homo sapiens
agatgcccagagggcccaggc

SEQ ID NO: 1698411 - DNA, 22 bp, Homo sapiens
agatgcccagagggcccaggca

SEQ ID NO: 1698412 - DNA, 14 bp, Homo sapiens
agatgccccctcca

SEQ ID NO: 1698413 - DNA, 23 bp, Homo sapiens
agatgccccctccaggagagagc

SEQ ID NO: 1698414 - DNA, 12 bp, Homo sapiens
agatgcctccac

SEQ ID NO: 1698415 - DNA, 14 bp, Homo sapiens
agatgcctccaccg

SEQ ID NO: 1698416 - DNA, 16 bp, Homo sapiens
agatgcctccaccgct

SEQ ID NO: 1698417 - DNA, 13 bp, Homo sapiens
agatgccttctag

SEQ ID NO: 1698418 - DNA, 13 bp, Homo sapiens
agatgctatggaa

SEQ ID NO: 1698419 - DNA, 15 bp, Homo sapiens
agatgctccaagatt

SEQ ID NO: 1698420 - DNA, 18 bp, Homo sapiens
agatgctccaagattcta

SEQ ID NO: 1698421 - DNA, 19 bp, Homo sapiens
agatgctccaagattctag

SEQ ID NO: 1698422 - DNA, 20 bp, Homo sapiens
agatgctccaagattctaga

SEQ ID NO: 1698423 - DNA, 23 bp, Homo sapiens
agatgctccaagattctagatga

SEQ ID NO: 1698424 - DNA, 20 bp, Homo sapiens
agatgctgactgtactcctc

SEQ ID NO: 1698425 - DNA, 23 bp, Homo sapiens
agatgctgactgtactcctccca

SEQ ID NO: 1698426 - DNA, 11 bp, Homo sapiens
agatgctgatg

SEQ ID NO: 1698427 - DNA, 18 bp, Homo sapiens
agatgctggcccagggcc

SEQ ID NO: 1698428 - DNA, 20 bp, Homo sapiens
agatgctggcccagggccca

SEQ ID NO: 1698429 - DNA, 21 bp, Homo sapiens
agatgctggcccagggcccag

SEQ ID NO: 1698430 - DNA, 23 bp, Homo sapiens
agatgctggcccagggcccagag

SEQ ID NO: 1698431 - DNA, 18 bp, Homo sapiens
agatgctgggttggtgca

SEQ ID NO: 1698432 - DNA, 23 bp, Homo sapiens
agatgctgggttggtgcacagtg

SEQ ID NO: 1698433 - DNA, 13 bp, Homo sapiens
agatgctgtaaat

SEQ ID NO: 1698434 - DNA, 20 bp, Homo sapiens
agatgctgtgagtctttggt

SEQ ID NO: 1698435 - DNA, 18 bp, Homo sapiens
agatgctgtgtatatggt

SEQ ID NO: 1698436 - DNA, 12 bp, Homo sapiens
agatgcttctgg

SEQ ID NO: 1698437 - DNA, 15 bp, Homo sapiens
agatgcttctgggag

SEQ ID NO: 1698438 - DNA, 16 bp, Homo sapiens
agatgcttctgggaga

SEQ ID NO: 1698439 - DNA, 18 bp, Homo sapiens
agatggaaaattcatttt

SEQ ID NO: 1698440 - DNA, 13 bp, Homo sapiens
agatggaaataca

SEQ ID NO: 1698441 - DNA, 22 bp, Homo sapiens
agatggaaattctgaaaactga

SEQ ID NO: 1698442 - DNA, 19 bp, Homo sapiens
agatggacacgagccacaa

SEQ ID NO: 1698443 - DNA, 13 bp, Homo sapiens
agataaaagcaat

SEQ ID NO: 1698444 - DNA, 18 bp, Homo sapiens
agataaaatatcctcagg

SEQ ID NO: 1698445 - DNA, 16 bp, Homo sapiens
agataaacgaccaaac

SEQ ID NO: 1698446 - DNA, 19 bp, Homo sapiens
agataaacgaccaaactca

SEQ ID NO: 1698447 - DNA, 19 bp, Homo sapiens
agataaactcagaaattta

SEQ ID NO: 1698448 - DNA, 17 bp, Homo sapiens
agataaagaccagaaat

SEQ ID NO: 1698449 - DNA, 16 bp, Homo sapiens
agataaagattgtgtg

SEQ ID NO: 1698450 - DNA, 23 bp, Homo sapiens
agataaagatttctagtaggcag

SEQ ID NO: 1698451 - DNA, 19 bp, Homo sapiens
agataaagtcaaatgccaa

SEQ ID NO: 1698452 - DNA, 13 bp, Homo sapiens
agataaattataa

SEQ ID NO: 1698453 - DNA, 18 bp, Homo sapiens
agataacaagatctttca

SEQ ID NO: 1698454 - DNA, 20 bp, Homo sapiens
agataactctctttccttga

SEQ ID NO: 1698455 - DNA, 12 bp, Homo sapiens
agataacttact

SEQ ID NO: 1698456 - DNA, 18 bp, Homo sapiens
agataacttactgtatat

SEQ ID NO: 1698457 - DNA, 19 bp, Homo sapiens
agataacttactgtatatg

SEQ ID NO: 1698458 - DNA, 22 bp, Homo sapiens
agataagaatgctggttttcct

SEQ ID NO: 1698459 - DNA, 13 bp, Homo sapiens
agataagcaagag

SEQ ID NO: 1698460 - DNA, 17 bp, Homo sapiens
agataagcaagagagat

SEQ ID NO: 1698461 - DNA, 20 bp, Homo sapiens
agataagcaagagagatgtt

SEQ ID NO: 1698462 - DNA, 21 bp, Homo sapiens
agataagtgttcttcagtgta

SEQ ID NO: 1698463 - DNA, 15 bp, Homo sapiens
agataataactgtct

SEQ ID NO: 1698464 - DNA, 14 bp, Homo sapiens
agataataatatat

SEQ ID NO: 1698465 - DNA, 17 bp, Homo sapiens
agataataatatatgtt

SEQ ID NO: 1698466 - DNA, 18 bp, Homo sapiens
agataatatctgtgaggt

SEQ ID NO: 1698467 - DNA, 12 bp, Homo sapiens
agataattataa

SEQ ID NO: 1698468 - DNA, 12 bp, Homo sapiens
agataattcatt

SEQ ID NO: 1698469 - DNA, 18 bp, Homo sapiens
agataattcatttgtatt

SEQ ID NO: 1698470 - DNA, 17 bp, Homo sapiens
agatacaagtttcagac

SEQ ID NO: 1698471 - DNA, 13 bp, Homo sapiens
agatacacagctc

SEQ ID NO: 1698472 - DNA, 13 bp, Homo sapiens
agatacagacatt

SEQ ID NO: 1698473 - DNA, 18 bp, Homo sapiens
agataccaggttgaaaga

SEQ ID NO: 1698474 - DNA, 15 bp, Homo sapiens
agatacgtctgtgac

SEQ ID NO: 1698475 - DNA, 22 bp, Homo sapiens
agatactgtgagcttacattga

SEQ ID NO: 1698476 - DNA, 17 bp, Homo sapiens
agatacttatgcaagat

SEQ ID NO: 1698477 - DNA, 17 bp, Homo sapiens
agatacttatttttctg

SEQ ID NO: 1698478 - DNA, 14 bp, Homo sapiens
agatacttcccaaa

SEQ ID NO: 1698479 - DNA, 12 bp, Homo sapiens
agatagaaagct

SEQ ID NO: 1698480 - DNA, 15 bp, Homo sapiens
agatagaaagctgga

SEQ ID NO: 1698481 - DNA, 17 bp, Homo sapiens
agatagaaagctggact

SEQ ID NO: 1698482 - DNA, 18 bp, Homo sapiens
agatagaaagctggactg

SEQ ID NO: 1698483 - DNA, 19 bp, Homo sapiens
agatagacgggttgaaaga

SEQ ID NO: 1698484 - DNA, 22 bp, Homo sapiens
agatagacgggttgaaagacat

SEQ ID NO: 1698485 - DNA, 15 bp, Homo sapiens
agatagaggatgggc

SEQ ID NO: 1698486 - DNA, 13 bp, Homo sapiens
agatagcatggga

SEQ ID NO: 1698487 - DNA, 21 bp, Homo sapiens
agataggacgtatttataata

SEQ ID NO: 1698488 - DNA, 13 bp, Homo sapiens
agataggctctgc

SEQ ID NO: 1698489 - DNA, 16 bp, Homo sapiens
agataggctctgcaca

SEQ ID NO: 1698490 - DNA, 22 bp, Homo sapiens
agataggctctgcacagatgga

SEQ ID NO: 1698491 - DNA, 12 bp, Homo sapiens
agatagggaaaa

SEQ ID NO: 1698492 - DNA, 21 bp, Homo sapiens
agatagtccataatgttctgc

SEQ ID NO: 1698493 - DNA, 18 bp, Homo sapiens
agatagttaaaagactgc

SEQ ID NO: 1698494 - DNA, 17 bp, Homo sapiens
agatataaatggctggt

SEQ ID NO: 1698495 - DNA, 17 bp, Homo sapiens
agatataactgtcttgt

SEQ ID NO: 1698496 - DNA, 22 bp, Homo sapiens
agatataactgtcttgtttcag

SEQ ID NO: 1698497 - DNA, 11 bp, Homo sapiens
agatatataaa

SEQ ID NO: 1698498 - DNA, 15 bp, Homo sapiens
agatatataaataat

SEQ ID NO: 1698499 - DNA, 19 bp, Homo sapiens
agatatatacatggaatcg

SEQ ID NO: 1698500 - DNA, 23 bp, Homo sapiens
agatatatttttaagataataat

SEQ ID NO: 1698501 - DNA, 19 bp, Homo sapiens
agatatcagagctcttaat

SEQ ID NO: 1698502 - DNA, 21 bp, Homo sapiens
agatatctgagggaggaggcc

SEQ ID NO: 1698503 - DNA, 18 bp, Homo sapiens
agatatctgcatgtgtca

SEQ ID NO: 1698504 - DNA, 18 bp, Homo sapiens
agatatgaacatattgtt

SEQ ID NO: 1698505 - DNA, 23 bp, Homo sapiens
agatatggagtgagtcacctgct

SEQ ID NO: 1698506 - DNA, 22 bp, Homo sapiens
agatattaggggggaaagtcat

SEQ ID NO: 1698507 - DNA, 19 bp, Homo sapiens
agatattcaggtggccaga

SEQ ID NO: 1698508 - DNA, 19 bp, Homo sapiens
agatattgtacataaaaga

SEQ ID NO: 1698509 - DNA, 17 bp, Homo sapiens
agatattgttttctgta

SEQ ID NO: 1698510 - DNA, 20 bp, Homo sapiens
agatattgttttctgtaaat

SEQ ID NO: 1698511 - DNA, 23 bp, Homo sapiens
agatatttacatgaattgcattt

SEQ ID NO: 1698512 - DNA, 14 bp, Homo sapiens
agatatttatatat

SEQ ID NO: 1698513 - DNA, 21 bp, Homo sapiens
agatatttgtatttatttcca

SEQ ID NO: 1698514 - DNA, 15 bp, Homo sapiens
agatattttatatgt

SEQ ID NO: 1698515 - DNA, 23 bp, Homo sapiens
agatattttatatgtatggatct

SEQ ID NO: 1698516 - DNA, 17 bp, Homo sapiens
agatatttttatcttta

SEQ ID NO: 1698517 - DNA, 18 bp, Homo sapiens
agatattttttcagaaat

SEQ ID NO: 1698518 - DNA, 22 bp, Homo sapiens
agatattttttcagaaatatgt

SEQ ID NO: 1698519 - DNA, 18 bp, Homo sapiens
agatcaaaaggttaataa

SEQ ID NO: 1698520 - DNA, 16 bp, Homo sapiens
agatcaacgcctcact

SEQ ID NO: 1698521 - DNA, 16 bp, Homo sapiens
agatcaagtgggcctt

SEQ ID NO: 1698522 - DNA, 14 bp, Homo sapiens
agatcaataaatgt

SEQ ID NO: 1698523 - DNA, 19 bp, Homo sapiens
agatcacaccactgtactc

SEQ ID NO: 1698524 - DNA, 14 bp, Homo sapiens
agatcaccagcccg

SEQ ID NO: 1698525 - DNA, 21 bp, Homo sapiens
agatcaccagcccggcctgct

SEQ ID NO: 1698526 - DNA, 12 bp, Homo sapiens
agatcaccttgt

SEQ ID NO: 1698527 - DNA, 14 bp, Homo sapiens
agatcaccttgtat

SEQ ID NO: 1698528 - DNA, 18 bp, Homo sapiens
agatcactgaatttataa

SEQ ID NO: 1698529 - DNA, 23 bp, Homo sapiens
agatcactttctcagttttcata

SEQ ID NO: 1698530 - DNA, 17 bp, Homo sapiens
agatcagaacattcagc

SEQ ID NO: 1698531 - DNA, 18 bp, Homo sapiens
agatcagaacattcagct

SEQ ID NO: 1698532 - DNA, 20 bp, Homo sapiens
agatcagaacattcagctct

SEQ ID NO: 1698533 - DNA, 22 bp, Homo sapiens
agatcagatgctccaagattct

SEQ ID NO: 1698534 - DNA, 23 bp, Homo sapiens
agatcagcagcgtgcacatctgc

SEQ ID NO: 1698535 - DNA, 24 bp, Homo sapiens
agatcagcattcaaaatagttcta

SEQ ID NO: 1698536 - DNA, 11 bp, Homo sapiens
agatcaggttt

SEQ ID NO: 1698537 - DNA, 12 bp, Homo sapiens
agatcaggtttg

SEQ ID NO: 1698538 - DNA, 13 bp, Homo sapiens
agatcataaggct

SEQ ID NO: 1698539 - DNA, 14 bp, Homo sapiens
agatcattaaaaaa

SEQ ID NO: 1698540 - DNA, 21 bp, Homo sapiens
agatccaaaagaagcccccag

SEQ ID NO: 1698541 - DNA, 18 bp, Homo sapiens
agatccacacacagagga

SEQ ID NO: 1698542 - DNA, 12 bp, Homo sapiens
agatccaggact

SEQ ID NO: 1698543 - DNA, 16 bp, Homo sapiens
agatccagtgcagttg

SEQ ID NO: 1698544 - DNA, 21 bp, Homo sapiens
agatccagtgcagttgtgatt

SEQ ID NO: 1698545 - DNA, 10 bp, Homo sapiens
agatcccaaa

SEQ ID NO: 1698546 - DNA, 21 bp, Homo sapiens
agatccccaagaccccctggg

SEQ ID NO: 1698547 - DNA, 15 bp, Homo sapiens
agatccccagggcag

SEQ ID NO: 1698548 - DNA, 16 bp, Homo sapiens
agatccccagggcagc

SEQ ID NO: 1698549 - DNA, 15 bp, Homo sapiens
agatcccgcctcttc

SEQ ID NO: 1698550 - DNA, 19 bp, Homo sapiens
agatcccgcctcttcttct

SEQ ID NO: 1698551 - DNA, 22 bp, Homo sapiens
agatcccgcctcttcttcttca

SEQ ID NO: 1698552 - DNA, 17 bp, Homo sapiens
agatccctgcagaaccc

SEQ ID NO: 1698553 - DNA, 16 bp, Homo sapiens
agatcctaagatgtgt

SEQ ID NO: 1698554 - DNA, 16 bp, Homo sapiens
agatcctaaggtccaa

SEQ ID NO: 1698555 - DNA, 14 bp, Homo sapiens
agatcctgaagcag

SEQ ID NO: 1698556 - DNA, 17 bp, Homo sapiens
agatcctgcaccccagc

SEQ ID NO: 1698557 - DNA, 12 bp, Homo sapiens
agatccttcaca

SEQ ID NO: 1698558 - DNA, 16 bp, Homo sapiens
agatccttcacaggca

SEQ ID NO: 1698559 - DNA, 17 bp, Homo sapiens
agatccttcacaggcag

SEQ ID NO: 1698560 - DNA, 16 bp, Homo sapiens
acttgcttaaatttct

SEQ ID NO: 1698561 - DNA, 19 bp, Homo sapiens
acttgcttagtatggttct

SEQ ID NO: 1698562 - DNA, 14 bp, Homo sapiens
acttgcttcagtgg

SEQ ID NO: 1698563 - DNA, 11 bp, Homo sapiens
acttgcttcct

SEQ ID NO: 1698564 - DNA, 14 bp, Homo sapiens
acttgcttcctgca

SEQ ID NO: 1698565 - DNA, 21 bp, Homo sapiens
acttggaaaaatccagaaaga

SEQ ID NO: 1698566 - DNA, 21 bp, Homo sapiens
acttggaagggggagacagga

SEQ ID NO: 1698567 - DNA, 22 bp, Homo sapiens
acttggagactcctggtctgtg

SEQ ID NO: 1698568 - DNA, 12 bp, Homo sapiens
acttggagcccg

SEQ ID NO: 1698569 - DNA, 16 bp, Homo sapiens
acttggagcccgtgca

SEQ ID NO: 1698570 - DNA, 17 bp, Homo sapiens
acttggatcccaaagca

SEQ ID NO: 1698571 - DNA, 19 bp, Homo sapiens
acttggcatacaaaatatt

SEQ ID NO: 1698572 - DNA, 20 bp, Homo sapiens
acttggcatacaaaatattt

SEQ ID NO: 1698573 - DNA, 13 bp, Homo sapiens
acttggcatttct

SEQ ID NO: 1698574 - DNA, 16 bp, Homo sapiens
acttggcctcatgctg

SEQ ID NO: 1698575 - DNA, 18 bp, Homo sapiens
acttggctcgaatctctg

SEQ ID NO: 1698576 - DNA, 21 bp, Homo sapiens
acttggctcgaatctctgtgc

SEQ ID NO: 1698577 - DNA, 13 bp, Homo sapiens
acttggctgtctg

SEQ ID NO: 1698578 - DNA, 14 bp, Homo sapiens
acttggctgtctga

SEQ ID NO: 1698579 - DNA, 21 bp, Homo sapiens
acttgggaggctgaggcagga

SEQ ID NO: 1698580 - DNA, 14 bp, Homo sapiens
acttggggaggcaa

SEQ ID NO: 1698581 - DNA, 19 bp, Homo sapiens
acttgggggttcaggcccg

SEQ ID NO: 1698582 - DNA, 16 bp, Homo sapiens
acttggtcagagccac

SEQ ID NO: 1698583 - DNA, 12 bp, Homo sapiens
actgctccaagt

SEQ ID NO: 1698584 - DNA, 13 bp, Homo sapiens
actgctcctgtgg

SEQ ID NO: 1698585 - DNA, 15 bp, Homo sapiens
actgctcctgtggca

SEQ ID NO: 1698586 - DNA, 19 bp, Homo sapiens
actgctcgtggactgtgct

SEQ ID NO: 1698587 - DNA, 12 bp, Homo sapiens
actgctctcagc

SEQ ID NO: 1698588 - DNA, 15 bp, Homo sapiens
actgctctcagcctc

SEQ ID NO: 1698589 - DNA, 21 bp, Homo sapiens
actgctctgaatattttgtaa

SEQ ID NO: 1698590 - DNA, 12 bp, Homo sapiens
actgctctgaga

SEQ ID NO: 1698591 - DNA, 18 bp, Homo sapiens
actgctcttgtttctttt

SEQ ID NO: 1698592 - DNA, 12 bp, Homo sapiens
actgctgagcca

SEQ ID NO: 1698593 - DNA, 14 bp, Homo sapiens
actgctgagccact

SEQ ID NO: 1698594 - DNA, 16 bp, Homo sapiens
actgctgattcttgta

SEQ ID NO: 1698595 - DNA, 17 bp, Homo sapiens
actgctgattcttgtaa

SEQ ID NO: 1698596 - DNA, 19 bp, Homo sapiens
actgctgcatactttgaca

SEQ ID NO: 1698597 - DNA, 12 bp, Homo sapiens
actgctggacat

SEQ ID NO: 1698598 - DNA, 12 bp, Homo sapiens
actgctggctgc

SEQ ID NO: 1698599 - DNA, 13 bp, Homo sapiens
actgctgggactg

SEQ ID NO: 1698600 - DNA, 18 bp, Homo sapiens
actgctgggactggccag

SEQ ID NO: 1698601 - DNA, 16 bp, Homo sapiens
actgctggggagtccc

SEQ ID NO: 1698602 - DNA, 22 bp, Homo sapiens
actgctgtccacatgacctcca

SEQ ID NO: 1698603 - DNA, 23 bp, Homo sapiens
actgctgtccacatgacctccat

SEQ ID NO: 1698604 - DNA, 12 bp, Homo sapiens
actgctgttaaa

SEQ ID NO: 1698605 - DNA, 13 bp, Homo sapiens
actgctgttcctg

SEQ ID NO: 1698606 - DNA, 19 bp, Homo sapiens
actgctgttcctgctccat

SEQ ID NO: 1698607 - DNA, 16 bp, Homo sapiens
actgcttcccatccta

SEQ ID NO: 1698608 - DNA, 19 bp, Homo sapiens
actgcttcccatcctaccc

SEQ ID NO: 1698609 - DNA, 19 bp, Homo sapiens
actgcttctaagatgccag

SEQ ID NO: 1698610 - DNA, 21 bp, Homo sapiens
actgcttctcttttgaaagta

SEQ ID NO: 1698611 - DNA, 15 bp, Homo sapiens
actgctttccagcct

SEQ ID NO: 1698612 - DNA, 18 bp, Homo sapiens
actgcttttttttttcca

SEQ ID NO: 1698613 - DNA, 20 bp, Homo sapiens
actggaaaacagaacactta

SEQ ID NO: 1698614 - DNA, 23 bp, Homo sapiens
actggaaaacagaacacttatgt

SEQ ID NO: 1698615 - DNA, 12 bp, Homo sapiens
actggaaaagtt

SEQ ID NO: 1698616 - DNA, 18 bp, Homo sapiens
actggaaaggatctgtga

SEQ ID NO: 1698617 - DNA, 19 bp, Homo sapiens
actggaacatgcttttact

SEQ ID NO: 1698618 - DNA, 21 bp, Homo sapiens
actggaacggtgaaggtgaca

SEQ ID NO: 1698619 - DNA, 15 bp, Homo sapiens
actggaagaaagcaa

SEQ ID NO: 1698620 - DNA, 16 bp, Homo sapiens
actggaagacacttca

SEQ ID NO: 1698621 - DNA, 19 bp, Homo sapiens
actggaagcatgtaggaga

SEQ ID NO: 1698622 - DNA, 20 bp, Homo sapiens
actggaagcatgtaggagaa

SEQ ID NO: 1698623 - DNA, 12 bp, Homo sapiens
actggaaggagc

SEQ ID NO: 1698624 - DNA, 18 bp, Homo sapiens
actggaaggggaagggac

SEQ ID NO: 1698625 - DNA, 13 bp, Homo sapiens
actggaagttttg

SEQ ID NO: 1698626 - DNA, 22 bp, Homo sapiens
actggaatggtgttttgtcaga

SEQ ID NO: 1698627 - DNA, 21 bp, Homo sapiens
actggacagctttgctccgct

SEQ ID NO: 1698628 - DNA, 13 bp, Homo sapiens
actggacatgaag

SEQ ID NO: 1698629 - DNA, 17 bp, Homo sapiens
actggaccgctgactgc

SEQ ID NO: 1698630 - DNA, 19 bp, Homo sapiens
actggaccgctgactgcac

SEQ ID NO: 1698631 - DNA, 16 bp, Homo sapiens
actggacgctgccctg

SEQ ID NO: 1698632 - DNA, 16 bp, Homo sapiens
actggactcaggaact

SEQ ID NO: 1698633 - DNA, 13 bp, Homo sapiens
actggactgcatg

SEQ ID NO: 1698634 - DNA, 13 bp, Homo sapiens
actggagcaccag

SEQ ID NO: 1698635 - DNA, 15 bp, Homo sapiens
actggagcaccaggc

SEQ ID NO: 1698636 - DNA, 14 bp, Homo sapiens
actggagcccagga

SEQ ID NO: 1698637 - DNA, 11 bp, Homo sapiens
actggagcccc

SEQ ID NO: 1698638 - DNA, 13 bp, Homo sapiens
actggagctttta

SEQ ID NO: 1698639 - DNA, 15 bp, Homo sapiens
actggaggagcagct

SEQ ID NO: 1698640 - DNA, 19 bp, Homo sapiens
actggaggggcccacccac

SEQ ID NO: 1698641 - DNA, 16 bp, Homo sapiens
actggaggttgaagcc

SEQ ID NO: 1698642 - DNA, 12 bp, Homo sapiens
actggagtccag

SEQ ID NO: 1698643 - DNA, 14 bp, Homo sapiens
actggagttacatt

SEQ ID NO: 1698644 - DNA, 15 bp, Homo sapiens
actggagttacatta

SEQ ID NO: 1698645 - DNA, 14 bp, Homo sapiens
actggatatgttgt

SEQ ID NO: 1698646 - DNA, 16 bp, Homo sapiens
actggatatttcaatc

SEQ ID NO: 1698647 - DNA, 13 bp, Homo sapiens
actggatgaagat

SEQ ID NO: 1698648 - DNA, 23 bp, Homo sapiens
actggattggccaaacatcagac

SEQ ID NO: 1698649 - DNA, 19 bp, Homo sapiens
actggcaattgtctattta

SEQ ID NO: 1698650 - DNA, 21 bp, Homo sapiens
actggcacagttttctgagaa

SEQ ID NO: 1698651 - DNA, 23 bp, Homo sapiens
actggcactggtggtttttgctc

SEQ ID NO: 1698652 - DNA, 22 bp, Homo sapiens
actggcagaagcattgcctgga

SEQ ID NO: 1698653 - DNA, 14 bp, Homo sapiens
actggcagcatctt

SEQ ID NO: 1698654 - DNA, 13 bp, Homo sapiens
actggcagcctgc

SEQ ID NO: 1698655 - DNA, 20 bp, Homo sapiens
actggcagcctgcacctggt

SEQ ID NO: 1698656 - DNA, 22 bp, Homo sapiens
actggcaggtgcagatgggctg

SEQ ID NO: 1698657 - DNA, 21 bp, Homo sapiens
actggcagtaacctagtgaat

SEQ ID NO: 1698658 - DNA, 22 bp, Homo sapiens
actggcatagccctcctgagca

SEQ ID NO: 1698659 - DNA, 16 bp, Homo sapiens
actggccaccaggctg

SEQ ID NO: 1698660 - DNA, 19 bp, Homo sapiens
actggccaccaggctggcg

SEQ ID NO: 1698661 - DNA, 23 bp, Homo sapiens
actggccaccaggctggcgcagc

SEQ ID NO: 1698662 - DNA, 17 bp, Homo sapiens
actggccagagagggcc

SEQ ID NO: 1698663 - DNA, 21 bp, Homo sapiens
actggccagagagggcccagc

SEQ ID NO: 1698664 - DNA, 22 bp, Homo sapiens
actggccagggccacgctccag

SEQ ID NO: 1698665 - DNA, 17 bp, Homo sapiens
actggccatttttctgg

SEQ ID NO: 1698666 - DNA, 19 bp, Homo sapiens
actggccatttttctgggg

SEQ ID NO: 1698667 - DNA, 20 bp, Homo sapiens
actggcctaggggccagggc

SEQ ID NO: 1698668 - DNA, 13 bp, Homo sapiens
actggctctccaa

SEQ ID NO: 1698669 - DNA, 16 bp, Homo sapiens
actggctctccaagtg

SEQ ID NO: 1698670 - DNA, 17 bp, Homo sapiens
actggctctccaagtgc

SEQ ID NO: 1698671 - DNA, 21 bp, Homo sapiens
actggctctccaagtgccaga

SEQ ID NO: 1698672 - DNA, 17 bp, Homo sapiens
actggctggctgcagtg

SEQ ID NO: 1698673 - DNA, 17 bp, Homo sapiens
actggctgtcagtatga

SEQ ID NO: 1698674 - DNA, 12 bp, Homo sapiens
actggctgtgcc

SEQ ID NO: 1698675 - DNA, 19 bp, Homo sapiens
actggctgtgcccctgatg

SEQ ID NO: 1698676 - DNA, 24 bp, Homo sapiens
actggctgtgcccctgatgcagcc

SEQ ID NO: 1698677 - DNA, 13 bp, Homo sapiens
actggcttcagca

SEQ ID NO: 1698678 - DNA, 23 bp, Homo sapiens
actggcttctgtgcactagcctg

SEQ ID NO: 1698679 - DNA, 13 bp, Homo sapiens
actggcttgtaca

SEQ ID NO: 1698680 - DNA, 14 bp, Homo sapiens
actggcttgtacat

SEQ ID NO: 1698681 - DNA, 15 bp, Homo sapiens
actggcttgtacatt

SEQ ID NO: 1698682 - DNA, 17 bp, Homo sapiens
actggcttttgcctgta

SEQ ID NO: 1698683 - DNA, 18 bp, Homo sapiens
actggcttttgcctgtaa

SEQ ID NO: 1698684 - DNA, 11 bp, Homo sapiens
actgggaaact

SEQ ID NO: 1698685 - DNA, 16 bp, Homo sapiens
actgggacagcccagg

SEQ ID NO: 1698686 - DNA, 14 bp, Homo sapiens
actgggacagctgg

SEQ ID NO: 1698687 - DNA, 23 bp, Homo sapiens
actgggaccaaccctggggaagg

SEQ ID NO: 1698688 - DNA, 19 bp, Homo sapiens
actgggagtgtgggctgcc

SEQ ID NO: 1698689 - DNA, 13 bp, Homo sapiens
actgggcaatgat

SEQ ID NO: 1698690 - DNA, 21 bp, Homo sapiens
actgggcacctgcgcacaggt

SEQ ID NO: 1698691 - DNA, 15 bp, Homo sapiens
actgggcagcaaggc

SEQ ID NO: 1698692 - DNA, 16 bp, Homo sapiens
actgggccacggagga

SEQ ID NO: 1698693 - DNA, 15 bp, Homo sapiens
actgggccagccctg

SEQ ID NO: 1698694 - DNA, 20 bp, Homo sapiens
actgggccagccctgcagcc

SEQ ID NO: 1698695 - DNA, 20 bp, Homo sapiens
actgggcccaggcaggtctg

SEQ ID NO: 1698696 - DNA, 16 bp, Homo sapiens
actgggctctggctct

SEQ ID NO: 1698697 - DNA, 19 bp, Homo sapiens
actggggaaaactccacct

SEQ ID NO: 1698698 - DNA, 12 bp, Homo sapiens
acttcctcctga

SEQ ID NO: 1698699 - DNA, 19 bp, Homo sapiens
acttcctgactctcacctg

SEQ ID NO: 1698700 - DNA, 21 bp, Homo sapiens
acttcctgactctcacctgta

SEQ ID NO: 1698701 - DNA, 15 bp, Homo sapiens
acttcctgctgcacc

SEQ ID NO: 1698702 - DNA, 17 bp, Homo sapiens
acttcctgctgcaccct

SEQ ID NO: 1698703 - DNA, 19 bp, Homo sapiens
acttcctgctgcaccctgc

SEQ ID NO: 1698704 - DNA, 22 bp, Homo sapiens
acttcctgctgcaccctgcgcc

SEQ ID NO: 1698705 - DNA, 22 bp, Homo sapiens
acttcctggattttctttctat

SEQ ID NO: 1698706 - DNA, 12 bp, Homo sapiens
acttcctgtact

SEQ ID NO: 1698707 - DNA, 15 bp, Homo sapiens
acttccttactttta

SEQ ID NO: 1698708 - DNA, 22 bp, Homo sapiens
acttccttattgggacttttct

SEQ ID NO: 1698709 - DNA, 22 bp, Homo sapiens
acttccttgagacacggagccc

SEQ ID NO: 1698710 - DNA, 19 bp, Homo sapiens
acttcgactcaggatccag

SEQ ID NO: 1698711 - DNA, 14 bp, Homo sapiens
acttcgatgatgat

SEQ ID NO: 1698712 - DNA, 17 bp, Homo sapiens
acttctaagaaaagcct

SEQ ID NO: 1698713 - DNA, 13 bp, Homo sapiens
acttctaagtaaa

SEQ ID NO: 1698714 - DNA, 19 bp, Homo sapiens
acttctaagtaaaaccaca

SEQ ID NO: 1698715 - DNA, 23 bp, Homo sapiens
acttctaagtaaaaccacagcag

SEQ ID NO: 1698716 - DNA, 15 bp, Homo sapiens
acttggttctgcttc

SEQ ID NO: 1698717 - DNA, 16 bp, Homo sapiens
acttggttctgcttca

SEQ ID NO: 1698718 - DNA, 17 bp, Homo sapiens
acttggttctgcttcaa

SEQ ID NO: 1698719 - DNA, 20 bp, Homo sapiens
acttggttggtagggtggga

SEQ ID NO: 1698720 - DNA, 19 bp, Homo sapiens
acttggtttttggctcttt

SEQ ID NO: 1698721 - DNA, 17 bp, Homo sapiens
acttgtaaataaagtct

SEQ ID NO: 1698722 - DNA, 15 bp, Homo sapiens
acttgtaaatacacc

SEQ ID NO: 1698723 - DNA, 18 bp, Homo sapiens
acttgtacaaaataaaca

SEQ ID NO: 1698724 - DNA, 17 bp, Homo sapiens
acttgtacaaacagtat

SEQ ID NO: 1698725 - DNA, 22 bp, Homo sapiens
acttgtacaaacagtatttctg

SEQ ID NO: 1698726 - DNA, 15 bp, Homo sapiens
acttgtatatttgta

SEQ ID NO: 1698727 - DNA, 19 bp, Homo sapiens
acttgtatatttgtacaaa

SEQ ID NO: 1698728 - DNA, 15 bp, Homo sapiens
acttgtatgctgccc

SEQ ID NO: 1698729 - DNA, 13 bp, Homo sapiens
acttgtcaaagaa

SEQ ID NO: 1698730 - DNA, 15 bp, Homo sapiens
acttgtctaaataag

SEQ ID NO: 1698731 - DNA, 15 bp, Homo sapiens
acttgtctgaggcct

SEQ ID NO: 1698732 - DNA, 22 bp, Homo sapiens
acttgtctgaggcctcatccct

SEQ ID NO: 1698733 - DNA, 18 bp, Homo sapiens
acttgtctgtcaaatgtt

SEQ ID NO: 1698734 - DNA, 17 bp, Homo sapiens
acttgtgaaacacagct

SEQ ID NO: 1698735 - DNA, 16 bp, Homo sapiens
acttgtgactgaaggg

SEQ ID NO: 1698736 - DNA, 15 bp, Homo sapiens
acttgtgagcatcag

SEQ ID NO: 1698737 - DNA, 16 bp, Homo sapiens
acttgtgattatttat

SEQ ID NO: 1698738 - DNA, 18 bp, Homo sapiens
acttgtgattggctgcag

SEQ ID NO: 1698739 - DNA, 20 bp, Homo sapiens
acttgtgattggctgcagga

SEQ ID NO: 1698740 - DNA, 15 bp, Homo sapiens
acttgtggtgtgacc

SEQ ID NO: 1698741 - DNA, 22 bp, Homo sapiens
acttgtggtgtgaccatgttca

SEQ ID NO: 1698742 - DNA, 23 bp, Homo sapiens
acttgtggtgtgaccatgttcat

SEQ ID NO: 1698743 - DNA, 12 bp, Homo sapiens
acttgtgtatat

SEQ ID NO: 1698744 - DNA, 21 bp, Homo sapiens
acttgtgtgtgggctgtgagt

SEQ ID NO: 1698745 - DNA, 14 bp, Homo sapiens
acttgttctagaga

SEQ ID NO: 1698746 - DNA, 17 bp, Homo sapiens
acttgtttagagagcct

SEQ ID NO: 1698747 - DNA, 13 bp, Homo sapiens
acttgtttgcact

SEQ ID NO: 1698748 - DNA, 14 bp, Homo sapiens
acttgtttgcactg

SEQ ID NO: 1698749 - DNA, 15 bp, Homo sapiens
acttgtttgcactgt

SEQ ID NO: 1698750 - DNA, 16 bp, Homo sapiens
acttgtttgcactgtg

SEQ ID NO: 1698751 - DNA, 12 bp, Homo sapiens
acttgttttaac

SEQ ID NO: 1698752 - DNA, 17 bp, Homo sapiens
acttgttttatgctcag

SEQ ID NO: 1698753 - DNA, 13 bp, Homo sapiens
acttgttttggat

SEQ ID NO: 1698754 - DNA, 16 bp, Homo sapiens
actttaaaaaggaaat

SEQ ID NO: 1698755 - DNA, 18 bp, Homo sapiens
actttaaaaaggaaattt

SEQ ID NO: 1698756 - DNA, 14 bp, Homo sapiens
actttaaaaattta

SEQ ID NO: 1698757 - DNA, 12 bp, Homo sapiens
actttaaaagtg

SEQ ID NO: 1698758 - DNA, 14 bp, Homo sapiens
actttaaactttcc

SEQ ID NO: 1698759 - DNA, 22 bp, Homo sapiens
actttaacttagttttgcatag

SEQ ID NO: 1698760 - DNA, 22 bp, Homo sapiens
actttaagctccttgagtaaaa

SEQ ID NO: 1698761 - DNA, 18 bp, Homo sapiens
actttaagttaaatatgt

SEQ ID NO: 1698762 - DNA, 13 bp, Homo sapiens
actttaatgtttt

SEQ ID NO: 1698763 - DNA, 19 bp, Homo sapiens
actttaattaccaacctgt

SEQ ID NO: 1698764 - DNA, 13 bp, Homo sapiens
actttacaggaaa

SEQ ID NO: 1698765 - DNA, 23 bp, Homo sapiens
actttacaggaggttgtggatgc

SEQ ID NO: 1698766 - DNA, 17 bp, Homo sapiens
actttacccacctagaa

SEQ ID NO: 1698767 - DNA, 14 bp, Homo sapiens
actttagaaataaa

SEQ ID NO: 1698768 - DNA, 15 bp, Homo sapiens
actttagaatgagag

SEQ ID NO: 1698769 - DNA, 17 bp, Homo sapiens
actttagactaattgtg

SEQ ID NO: 1698770 - DNA, 18 bp, Homo sapiens
actttagactaattgtgt

SEQ ID NO: 1698771 - DNA, 21 bp, Homo sapiens
actttagagtagcatgagaga

SEQ ID NO: 1698772 - DNA, 15 bp, Homo sapiens
actttagatgctgat

SEQ ID NO: 1698773 - DNA, 22 bp, Homo sapiens
actttagccactggtttctcag

SEQ ID NO: 1698774 - DNA, 21 bp, Homo sapiens
actttagttagcatgcgcgct

SEQ ID NO: 1698775 - DNA, 18 bp, Homo sapiens
actttataactaacatgt

SEQ ID NO: 1698776 - DNA, 19 bp, Homo sapiens
actttatacccagaaagtt

SEQ ID NO: 1698777 - DNA, 19 bp, Homo sapiens
actttatagttgttttata

SEQ ID NO: 1698778 - DNA, 15 bp, Homo sapiens
actttatcacttaaa

SEQ ID NO: 1698779 - DNA, 21 bp, Homo sapiens
actttatgccggatgtgcttt

SEQ ID NO: 1698780 - DNA, 13 bp, Homo sapiens
actttatgtagtt

SEQ ID NO: 1698781 - DNA, 13 bp, Homo sapiens
actttatgtgtaa

SEQ ID NO: 1698782 - DNA, 21 bp, Homo sapiens
actttatgtgtaaatacataa

SEQ ID NO: 1698783 - DNA, 16 bp, Homo sapiens
actttattcttgctgg

SEQ ID NO: 1698784 - DNA, 18 bp, Homo sapiens
actttatttatttctagt

SEQ ID NO: 1698785 - DNA, 15 bp, Homo sapiens
actttatttttctga

SEQ ID NO: 1698786 - DNA, 16 bp, Homo sapiens
actttcaagctgcact

SEQ ID NO: 1698787 - DNA, 20 bp, Homo sapiens
actttcaattgtcacttttt

SEQ ID NO: 1698788 - DNA, 15 bp, Homo sapiens
actttcacatagatg

SEQ ID NO: 1698789 - DNA, 15 bp, Homo sapiens
actttcacttcttcc

SEQ ID NO: 1698790 - DNA, 19 bp, Homo sapiens
actttcacttcttcctatt

SEQ ID NO: 1698791 - DNA, 14 bp, Homo sapiens
actttcactttgaa

SEQ ID NO: 1698792 - DNA, 15 bp, Homo sapiens
actttcatcttaaac

SEQ ID NO: 1698793 - DNA, 16 bp, Homo sapiens
actttcatcttaaact

SEQ ID NO: 1698794 - DNA, 15 bp, Homo sapiens
actttccagggatcc

SEQ ID NO: 1698795 - DNA, 16 bp, Homo sapiens
actttccatctctgcc

SEQ ID NO: 1698796 - DNA, 15 bp, Homo sapiens
actttcccccttccc

SEQ ID NO: 1698797 - DNA, 16 bp, Homo sapiens
actttcccccttcccg

SEQ ID NO: 1698798 - DNA, 20 bp, Homo sapiens
actttcccccttcccgcctt

SEQ ID NO: 1698799 - DNA, 15 bp, Homo sapiens
actttcccttggctg

SEQ ID NO: 1698800 - DNA, 12 bp, Homo sapiens
actttcctgagc

SEQ ID NO: 1698801 - DNA, 18 bp, Homo sapiens
actttccttccctctcct

SEQ ID NO: 1698802 - DNA, 20 bp, Homo sapiens
actttccttccctctcctgc

SEQ ID NO: 1698803 - DNA, 19 bp, Homo sapiens
actttcgtaatagctcaga

SEQ ID NO: 1698804 - DNA, 15 bp, Homo sapiens
actttcgtacattgg

SEQ ID NO: 1698805 - DNA, 16 bp, Homo sapiens
actttcgtacattggc

SEQ ID NO: 1698806 - DNA, 21 bp, Homo sapiens
agaaaacaaaaccaaaagtta

SEQ ID NO: 1698807 - DNA, 12 bp, Homo sapiens
agaaaacagaaa

SEQ ID NO: 1698808 - DNA, 23 bp, Homo sapiens
agaaaacataatcttctgccttc

SEQ ID NO: 1698809 - DNA, 12 bp, Homo sapiens
agaaaacatcta

SEQ ID NO: 1698810 - DNA, 19 bp, Homo sapiens
agaaaacccttgggccaga

SEQ ID NO: 1698811 - DNA, 22 bp, Homo sapiens
agaaaacccttgggccagaagt

SEQ ID NO: 1698812 - DNA, 20 bp, Homo sapiens
agaaaacggagagtgcttgg

SEQ ID NO: 1698813 - DNA, 21 bp, Homo sapiens
agaaaacggagagtgcttggg

SEQ ID NO: 1698814 - DNA, 13 bp, Homo sapiens
agaaaagagagaa

SEQ ID NO: 1698815 - DNA, 16 bp, Homo sapiens
agaaaagataaagatg

SEQ ID NO: 1698816 - DNA, 17 bp, Homo sapiens
agaaaagcaatactgtt

SEQ ID NO: 1698817 - DNA, 18 bp, Homo sapiens
agaaaagcacctgccgac

SEQ ID NO: 1698818 - DNA, 20 bp, Homo sapiens
agaaaagcagtcccattcat

SEQ ID NO: 1698819 - DNA, 13 bp, Homo sapiens
agaaaagcatttt

SEQ ID NO: 1698820 - DNA, 18 bp, Homo sapiens
agaaaaggatttaagcaa

SEQ ID NO: 1698821 - DNA, 16 bp, Homo sapiens
agaaaaggtgataaaa

SEQ ID NO: 1698822 - DNA, 21 bp, Homo sapiens
agaaaagtgcatatttatcca

SEQ ID NO: 1698823 - DNA, 19 bp, Homo sapiens
agaaaataaaatattcact

SEQ ID NO: 1698824 - DNA, 24 bp, Homo sapiens
agaaaataaaatattcactctcca

SEQ ID NO: 1698825 - DNA, 22 bp, Homo sapiens
agaaaataaggcacccatctgt

SEQ ID NO: 1698826 - DNA, 16 bp, Homo sapiens
agaaaatacaataaac

SEQ ID NO: 1698827 - DNA, 17 bp, Homo sapiens
agaaaatacttaaatgt

SEQ ID NO: 1698828 - DNA, 18 bp, Homo sapiens
agaaaatacttaaatgtt

SEQ ID NO: 1698829 - DNA, 19 bp, Homo sapiens
agaaaatacttaaatgtta

SEQ ID NO: 1698830 - DNA, 13 bp, Homo sapiens
agaaaatattact

SEQ ID NO: 1698831 - DNA, 19 bp, Homo sapiens
agaaaatatttaatatcaa

SEQ ID NO: 1698832 - DNA, 12 bp, Homo sapiens
agaaaatcatca

SEQ ID NO: 1698833 - DNA, 19 bp, Homo sapiens
agaaaatcatcaagaaggg

SEQ ID NO: 1698834 - DNA, 23 bp, Homo sapiens
agaaaatgacttatttctgctct

SEQ ID NO: 1698835 - DNA, 15 bp, Homo sapiens
agaaaatggacactg

SEQ ID NO: 1698836 - DNA, 23 bp, Homo sapiens
agaaaatggctaataaactgtat

SEQ ID NO: 1698837 - DNA, 21 bp, Homo sapiens
agaaaatgtaaaggagggaga

SEQ ID NO: 1698838 - DNA, 20 bp, Homo sapiens
agaaaattctaatgattggc

SEQ ID NO: 1698839 - DNA, 23 bp, Homo sapiens
agaaaattgatatttttatacaa

SEQ ID NO: 1698840 - DNA, 19 bp, Homo sapiens
agaaaattgttgtgcttag

SEQ ID NO: 1698841 - DNA, 23 bp, Homo sapiens
agaaaattgttgtgcttagaatt

SEQ ID NO: 1698842 - DNA, 14 bp, Homo sapiens
agaaaattttgtat

SEQ ID NO: 1698843 - DNA, 21 bp, Homo sapiens
agaaaattttgtattaatttc

SEQ ID NO: 1698844 - DNA, 15 bp, Homo sapiens
agaaacaaacaaaag

SEQ ID NO: 1698845 - DNA, 15 bp, Homo sapiens
agaaacaagctgtgc

SEQ ID NO: 1698846 - DNA, 16 bp, Homo sapiens
agaaacaagctgtgca

SEQ ID NO: 1698847 - DNA, 16 bp, Homo sapiens
agaaacaagtattttg

SEQ ID NO: 1698848 - DNA, 22 bp, Homo sapiens
agaaacaagtattttgctatat

SEQ ID NO: 1698849 - DNA, 22 bp, Homo sapiens
agaaacacagggttttgtattc

SEQ ID NO: 1698850 - DNA, 20 bp, Homo sapiens
agaaacacatcaaataaact

SEQ ID NO: 1698851 - DNA, 20 bp, Homo sapiens
agaaacaccacccatttcta

SEQ ID NO: 1698852 - DNA, 15 bp, Homo sapiens
agaaacacccctctg

SEQ ID NO: 1698853 - DNA, 18 bp, Homo sapiens
agaaacacccctctgtct

SEQ ID NO: 1698854 - DNA, 21 bp, Homo sapiens
agaaacacccctctgtctagg

SEQ ID NO: 1698855 - DNA, 15 bp, Homo sapiens
agaaacactgaaaag

SEQ ID NO: 1698856 - DNA, 18 bp, Homo sapiens
agaaacagagtggcctcc

SEQ ID NO: 1698857 - DNA, 22 bp, Homo sapiens
agaaacagagtggcctccctgc

SEQ ID NO: 1698858 - DNA, 11 bp, Homo sapiens
agaaacagctt

SEQ ID NO: 1698859 - DNA, 20 bp, Homo sapiens
agaaacagctttcaagtgcc

SEQ ID NO: 1698860 - DNA, 18 bp, Homo sapiens
agaaacagttggtaactt

SEQ ID NO: 1698861 - DNA, 19 bp, Homo sapiens
agaaacagttggtaacttt

SEQ ID NO: 1698862 - DNA, 21 bp, Homo sapiens
agaaacagttggtaacttttg

SEQ ID NO: 1698863 - DNA, 16 bp, Homo sapiens
agaaacatcagttact

SEQ ID NO: 1698864 - DNA, 23 bp, Homo sapiens
agaaacatcagttactctgaagg

SEQ ID NO: 1698865 - DNA, 15 bp, Homo sapiens
agaaacatctctggc

SEQ ID NO: 1698866 - DNA, 22 bp, Homo sapiens
agaaacatctctggcccagaaa

SEQ ID NO: 1698867 - DNA, 14 bp, Homo sapiens
agaaacatgacact

SEQ ID NO: 1698868 - DNA, 17 bp, Homo sapiens
agaaacatgacactgac

SEQ ID NO: 1698869 - DNA, 14 bp, Homo sapiens
agaaacatggtttt

SEQ ID NO: 1698870 - DNA, 19 bp, Homo sapiens
agaaaccaggagtaaaaga

SEQ ID NO: 1698871 - DNA, 18 bp, Homo sapiens
agaaacccaccagcctaa

SEQ ID NO: 1698872 - DNA, 13 bp, Homo sapiens
agaaaccctgcac

SEQ ID NO: 1698873 - DNA, 14 bp, Homo sapiens
agaaaccctgtctc

SEQ ID NO: 1698874 - DNA, 18 bp, Homo sapiens
agaaacctgttgaagatt

SEQ ID NO: 1698875 - DNA, 16 bp, Homo sapiens
agaaaccttattgtac

SEQ ID NO: 1698876 - DNA, 20 bp, Homo sapiens
agaaaccttattgtacctct

SEQ ID NO: 1698877 - DNA, 16 bp, Homo sapiens
agaaacgagatttgcc

SEQ ID NO: 1698878 - DNA, 15 bp, Homo sapiens
agaaactccatgatg

SEQ ID NO: 1698879 - DNA, 21 bp, Homo sapiens
agaaactccttttgctgtctt

SEQ ID NO: 1698880 - DNA, 18 bp, Homo sapiens
agaaactcgggcttgagt

SEQ ID NO: 1698881 - DNA, 14 bp, Homo sapiens
agaaactctcattt

SEQ ID NO: 1698882 - DNA, 23 bp, Homo sapiens
agaaacttaaatgttattatctg

SEQ ID NO: 1698883 - DNA, 20 bp, Homo sapiens
agaaacttatttctcatatc

SEQ ID NO: 1698884 - DNA, 23 bp, Homo sapiens
agaaacttgtgaagtggaaatgt

SEQ ID NO: 1698885 - DNA, 21 bp, Homo sapiens
agaaactttgagtacagatac

SEQ ID NO: 1698886 - DNA, 13 bp, Homo sapiens
agaaactttgcct

SEQ ID NO: 1698887 - DNA, 23 bp, Homo sapiens
agaaacttttatctattctgaga

SEQ ID NO: 1698888 - DNA, 17 bp, Homo sapiens
agaaagaaaagaccctg

SEQ ID NO: 1698889 - DNA, 21 bp, Homo sapiens
agaaagaaaagaccctgagac

SEQ ID NO: 1698890 - DNA, 15 bp, Homo sapiens
agaaagaagagaagg

SEQ ID NO: 1698891 - DNA, 12 bp, Homo sapiens
agaaagaaggaa

SEQ ID NO: 1698892 - DNA, 16 bp, Homo sapiens
agaaagaatgcaagag

SEQ ID NO: 1698893 - DNA, 22 bp, Homo sapiens
agaaagactatctaaatgttga

SEQ ID NO: 1698894 - DNA, 16 bp, Homo sapiens
agaaagactattcaaa

SEQ ID NO: 1698895 - DNA, 21 bp, Homo sapiens
agaaagagagaagccagccac

SEQ ID NO: 1698896 - DNA, 22 bp, Homo sapiens
agaaagagagaagccagccaca

SEQ ID NO: 1698897 - DNA, 12 bp, Homo sapiens
agaaagagctac

SEQ ID NO: 1698898 - DNA, 18 bp, Homo sapiens
agaaagagctcaaaataa

SEQ ID NO: 1698899 - DNA, 16 bp, Homo sapiens
agaaagaggagtgctt

SEQ ID NO: 1698900 - DNA, 19 bp, Homo sapiens
agaaagagtattgttatgt

SEQ ID NO: 1698901 - DNA, 17 bp, Homo sapiens
agaaagatacagacatt

SEQ ID NO: 1698902 - DNA, 24 bp, Homo sapiens
agaaagatgaaactgaaagcacat

SEQ ID NO: 1698903 - DNA, 15 bp, Homo sapiens
agaaagatggaaatt

SEQ ID NO: 1698904 - DNA, 14 bp, Homo sapiens
agaaagatgttcca

SEQ ID NO: 1698905 - DNA, 19 bp, Homo sapiens
agaaagatttgttactgta

SEQ ID NO: 1698906 - DNA, 20 bp, Homo sapiens
agaaagatttgttactgtat

SEQ ID NO: 1698907 - DNA, 14 bp, Homo sapiens
agaaagcaaaatac

SEQ ID NO: 1698908 - DNA, 15 bp, Homo sapiens
agaaagcaaaataca

SEQ ID NO: 1698909 - DNA, 20 bp, Homo sapiens
agaaagcactacaatcatgg

SEQ ID NO: 1698910 - DNA, 11 bp, Homo sapiens
agaaagcactt

SEQ ID NO: 1698911 - DNA, 18 bp, Homo sapiens
agaaagcagaaagttcaa

SEQ ID NO: 1698912 - DNA, 18 bp, Homo sapiens
agaaagcaggagcagctg

SEQ ID NO: 1698913 - DNA, 19 bp, Homo sapiens
agaaagcctccgctgggct

SEQ ID NO: 1698914 - DNA, 14 bp, Homo sapiens
agaaagcctctctc

SEQ ID NO: 1698915 - DNA, 15 bp, Homo sapiens
agaaagcctctctct

SEQ ID NO: 1698916 - DNA, 11 bp, Homo sapiens
agaaagctcaa

SEQ ID NO: 1698917 - DNA, 18 bp, Homo sapiens
agaaagctccttccagac

SEQ ID NO: 1698918 - DNA, 13 bp, Homo sapiens
agaaagctggact

SEQ ID NO: 1698919 - DNA, 14 bp, Homo sapiens
agaaaggaaaagaa

SEQ ID NO: 1698920 - DNA, 14 bp, Homo sapiens
agaagccttcagct

SEQ ID NO: 1698921 - DNA, 21 bp, Homo sapiens
agaagccttctttttctgaga

SEQ ID NO: 1698922 - DNA, 13 bp, Homo sapiens
agaagctaagctg

SEQ ID NO: 1698923 - DNA, 19 bp, Homo sapiens
agaagctagatgcccctgc

SEQ ID NO: 1698924 - DNA, 17 bp, Homo sapiens
agaagctcagctgcatt

SEQ ID NO: 1698925 - DNA, 19 bp, Homo sapiens
agaagctcctgctacttcc

SEQ ID NO: 1698926 - DNA, 17 bp, Homo sapiens
agaagctctccaggccc

SEQ ID NO: 1698927 - DNA, 23 bp, Homo sapiens
agaagctctggccccaggcttgt

SEQ ID NO: 1698928 - DNA, 23 bp, Homo sapiens
agaagctctgtttataaaaacaa

SEQ ID NO: 1698929 - DNA, 15 bp, Homo sapiens
agaagctgatccagt

SEQ ID NO: 1698930 - DNA, 11 bp, Homo sapiens
agaagctgctg

SEQ ID NO: 1698931 - DNA, 17 bp, Homo sapiens
agaagctgttgggagaa

SEQ ID NO: 1698932 - DNA, 18 bp, Homo sapiens
agaagcttccacaaaatt

SEQ ID NO: 1698933 - DNA, 19 bp, Homo sapiens
agaagcttccacaaaatta

SEQ ID NO: 1698934 - DNA, 17 bp, Homo sapiens
agaaggaatttgtactt

SEQ ID NO: 1698935 - DNA, 14 bp, Homo sapiens
agaaggactggtgc

SEQ ID NO: 1698936 - DNA, 15 bp, Homo sapiens
agaaggagaaggaag

SEQ ID NO: 1698937 - DNA, 22 bp, Homo sapiens
agaaggagaggcccggtgcagc

SEQ ID NO: 1698938 - DNA, 16 bp, Homo sapiens
agaaggagggcagagc

SEQ ID NO: 1698939 - DNA, 21 bp, Homo sapiens
agaaggagggcagagccatgg

SEQ ID NO: 1698940 - DNA, 21 bp, Homo sapiens
agaaggatgaatgaggtccca

SEQ ID NO: 1698941 - DNA, 17 bp, Homo sapiens
agaaggatgtacatttc

SEQ ID NO: 1698942 - DNA, 18 bp, Homo sapiens
agaaggcatttgcagggt

SEQ ID NO: 1698943 - DNA, 23 bp, Homo sapiens
agaaggcccataccttctggttg

SEQ ID NO: 1698944 - DNA, 18 bp, Homo sapiens
agaaggccccagagagac

SEQ ID NO: 1698945 - DNA, 22 bp, Homo sapiens
agaaggccccagagagaccctg

SEQ ID NO: 1698946 - DNA, 17 bp, Homo sapiens
agaaggccctgtgccct

SEQ ID NO: 1698947 - DNA, 16 bp, Homo sapiens
agaaggcttctctcca

SEQ ID NO: 1698948 - DNA, 22 bp, Homo sapiens
agaaggcttctctccacagtgt

SEQ ID NO: 1698949 - DNA, 14 bp, Homo sapiens
agaagggagaagaa

SEQ ID NO: 1698950 - DNA, 16 bp, Homo sapiens
agaagggagaagaaag

SEQ ID NO: 1698951 - DNA, 13 bp, Homo sapiens
agaagggagggtg

SEQ ID NO: 1698952 - DNA, 17 bp, Homo sapiens
agaaggggaaaaatggg

SEQ ID NO: 1698953 - DNA, 17 bp, Homo sapiens
agaaggggaggacactg

SEQ ID NO: 1698954 - DNA, 19 bp, Homo sapiens
agaagggggacgtttctgg

SEQ ID NO: 1698955 - DNA, 20 bp, Homo sapiens
agaagggggacgtttctgga

SEQ ID NO: 1698956 - DNA, 21 bp, Homo sapiens
agaagggggccctgctacctg

SEQ ID NO: 1698957 - DNA, 13 bp, Homo sapiens
agaagggggtggg

SEQ ID NO: 1698958 - DNA, 16 bp, Homo sapiens
agaagggggtgggggg

SEQ ID NO: 1698959 - DNA, 17 bp, Homo sapiens
agaagggggtgggggga

SEQ ID NO: 1698960 - DNA, 22 bp, Homo sapiens
agaagggtggatgacagggcag

SEQ ID NO: 1698961 - DNA, 16 bp, Homo sapiens
agaagggttctgccct

SEQ ID NO: 1698962 - DNA, 18 bp, Homo sapiens
agaagggttctgccctgc

SEQ ID NO: 1698963 - DNA, 20 bp, Homo sapiens
agaagggttttccaccctgg

SEQ ID NO: 1698964 - DNA, 21 bp, Homo sapiens
agaagggttttccaccctgga

SEQ ID NO: 1698965 - DNA, 23 bp, Homo sapiens
agaagggttttccaccctggaat

SEQ ID NO: 1698966 - DNA, 23 bp, Homo sapiens
agaaggtattaagattataattg

SEQ ID NO: 1698967 - DNA, 20 bp, Homo sapiens
agaaggtccttaatgatccg

SEQ ID NO: 1698968 - DNA, 14 bp, Homo sapiens
agaaggtctccaag

SEQ ID NO: 1698969 - DNA, 15 bp, Homo sapiens
agaaggtgccacttt

SEQ ID NO: 1698970 - DNA, 18 bp, Homo sapiens
agaaggtggacctggcag

SEQ ID NO: 1698971 - DNA, 19 bp, Homo sapiens
agaaggtggacctggcagt

SEQ ID NO: 1698972 - DNA, 20 bp, Homo sapiens
agaaggtggacctggcagtg

SEQ ID NO: 1698973 - DNA, 20 bp, Homo sapiens
agaaggttgctctagattga

SEQ ID NO: 1698974 - DNA, 23 bp, Homo sapiens
agaaggttggtggggggtccagt

SEQ ID NO: 1698975 - DNA, 16 bp, Homo sapiens
agaaggtttattgtta

SEQ ID NO: 1698976 - DNA, 17 bp, Homo sapiens
agaaggtttattgttaa

SEQ ID NO: 1698977 - DNA, 20 bp, Homo sapiens
agaagtaagaggctacctct

SEQ ID NO: 1698978 - DNA, 14 bp, Homo sapiens
agaagtaccagact

SEQ ID NO: 1698979 - DNA, 17 bp, Homo sapiens
agaagtaggcatgaggg

SEQ ID NO: 1698980 - DNA, 18 bp, Homo sapiens
agaagtaggggaagacat

SEQ ID NO: 1698981 - DNA, 19 bp, Homo sapiens
agaagtaggggaagacatg

SEQ ID NO: 1698982 - DNA, 14 bp, Homo sapiens
agaagtcaaagtaa

SEQ ID NO: 1698983 - DNA, 17 bp, Homo sapiens
agaagtcaaagtaaaac

SEQ ID NO: 1698984 - DNA, 22 bp, Homo sapiens
agaagtcactcacactggccac

SEQ ID NO: 1698985 - DNA, 18 bp, Homo sapiens
agaagtcactgaacaaaa

SEQ ID NO: 1698986 - DNA, 14 bp, Homo sapiens
agaagtcatggccc

SEQ ID NO: 1698987 - DNA, 18 bp, Homo sapiens
agaagtcctgctggatct

SEQ ID NO: 1698988 - DNA, 18 bp, Homo sapiens
agaagtcggaatgtcata

SEQ ID NO: 1698989 - DNA, 20 bp, Homo sapiens
agaagtctggaaaaaaacaa

SEQ ID NO: 1698990 - DNA, 13 bp, Homo sapiens
agaagtcttgaag

SEQ ID NO: 1698991 - DNA, 22 bp, Homo sapiens
agaagtcttgaagttgggtgtt

SEQ ID NO: 1698992 - DNA, 18 bp, Homo sapiens
agaagtgaataactgcaa

SEQ ID NO: 1698993 - DNA, 21 bp, Homo sapiens
agaagtgaatgctgggactca

SEQ ID NO: 1698994 - DNA, 18 bp, Homo sapiens
agaagtgagcaaaaaaga

SEQ ID NO: 1698995 - DNA, 19 bp, Homo sapiens
agaagtgagctttgctgct

SEQ ID NO: 1698996 - DNA, 19 bp, Homo sapiens
agaagtgagtttgtaaata

SEQ ID NO: 1698997 - DNA, 20 bp, Homo sapiens
agaagtgagtttgtaaatat

SEQ ID NO: 1698998 - DNA, 11 bp, Homo sapiens
agaagtgatat

SEQ ID NO: 1698999 - DNA, 22 bp, Homo sapiens
agaagtgatatggtgaagggaa

SEQ ID NO: 1699000 - DNA, 13 bp, Homo sapiens
agaagtgctccct

SEQ ID NO: 1699001 - DNA, 23 bp, Homo sapiens
agaagtgctctttgtggcagtgg

SEQ ID NO: 1699002 - DNA, 22 bp, Homo sapiens
agaagtggaagtgcttgatatg

SEQ ID NO: 1699003 - DNA, 15 bp, Homo sapiens
agaagtggaccagga

SEQ ID NO: 1699004 - DNA, 19 bp, Homo sapiens
agaagtggaccaggacagg

SEQ ID NO: 1699005 - DNA, 19 bp, Homo sapiens
agaagtgggccaggacagg

SEQ ID NO: 1699006 - DNA, 22 bp, Homo sapiens
agaagtgtttgatggtgccaga

SEQ ID NO: 1699007 - DNA, 14 bp, Homo sapiens
agaagttactgaat

SEQ ID NO: 1699008 - DNA, 16 bp, Homo sapiens
agaagttagtttgtat

SEQ ID NO: 1699009 - DNA, 19 bp, Homo sapiens
agaagttagtttgtatata

SEQ ID NO: 1699010 - DNA, 21 bp, Homo sapiens
agaagttctttgattctgtaa

SEQ ID NO: 1699011 - DNA, 20 bp, Homo sapiens
agaagttgctaagtgtgctt

SEQ ID NO: 1699012 - DNA, 21 bp, Homo sapiens
agaagttgtaaagtatgtatt

SEQ ID NO: 1699013 - DNA, 19 bp, Homo sapiens
agaagtttcagttgtcctt

SEQ ID NO: 1699014 - DNA, 21 bp, Homo sapiens
agaagtttcagttgtccttaa

SEQ ID NO: 1699015 - DNA, 19 bp, Homo sapiens
agaagtttctttaaagacg

SEQ ID NO: 1699016 - DNA, 15 bp, Homo sapiens
agaagtttttctttg

SEQ ID NO: 1699017 - DNA, 22 bp, Homo sapiens
agaataaaagctataaagtata

SEQ ID NO: 1699018 - DNA, 14 bp, Homo sapiens
agaataaaattcct

SEQ ID NO: 1699019 - DNA, 15 bp, Homo sapiens
agaataaaattccta

SEQ ID NO: 1699020 - DNA, 20 bp, Homo sapiens
agaataaaggcagttttcta

SEQ ID NO: 1699021 - DNA, 20 bp, Homo sapiens
agaataaaggtatgaaaggg

SEQ ID NO: 1699022 - DNA, 17 bp, Homo sapiens
agaataaagtccaaagt

SEQ ID NO: 1699023 - DNA, 15 bp, Homo sapiens
agaataaattgattt

SEQ ID NO: 1699024 - DNA, 21 bp, Homo sapiens
agaataaattggattattttc

SEQ ID NO: 1699025 - DNA, 22 bp, Homo sapiens
agaataaattggattattttct

SEQ ID NO: 1699026 - DNA, 22 bp, Homo sapiens
agaataagacaagagatctaca

SEQ ID NO: 1699027 - DNA, 21 bp, Homo sapiens
agaataagagaaagaaaatga

SEQ ID NO: 1699028 - DNA, 22 bp, Homo sapiens
agaataagagagtcataaacct

SEQ ID NO: 1699029 - DNA, 15 bp, Homo sapiens
agaataaggcttttt

SEQ ID NO: 1699030 - DNA, 23 bp, Homo sapiens
agaataatatgctgccaaatttt

SEQ ID NO: 1699031 - DNA, 17 bp, Homo sapiens
agaataatcacgctttc

SEQ ID NO: 1699032 - DNA, 13 bp, Homo sapiens
agaataatctttg

SEQ ID NO: 1699033 - DNA, 14 bp, Homo sapiens
accctacttctttt

SEQ ID NO: 1699034 - DNA, 17 bp, Homo sapiens
accctagccattcctgg

SEQ ID NO: 1699035 - DNA, 12 bp, Homo sapiens
accctagccttg

SEQ ID NO: 1699036 - DNA, 15 bp, Homo sapiens
accctagccttgctt

SEQ ID NO: 1699037 - DNA, 21 bp, Homo sapiens
accctagttagtgttttgcct

SEQ ID NO: 1699038 - DNA, 23 bp, Homo sapiens
accctatagagagggggctctcc

SEQ ID NO: 1699039 - DNA, 14 bp, Homo sapiens
accctatctcctga

SEQ ID NO: 1699040 - DNA, 18 bp, Homo sapiens
accctatctcctgacaga

SEQ ID NO: 1699041 - DNA, 22 bp, Homo sapiens
accctcactgctggggagtccc

SEQ ID NO: 1699042 - DNA, 18 bp, Homo sapiens
accctcagagccacccct

SEQ ID NO: 1699043 - DNA, 11 bp, Homo sapiens
accctcagcct

SEQ ID NO: 1699044 - DNA, 12 bp, Homo sapiens
accctcagcctt

SEQ ID NO: 1699045 - DNA, 13 bp, Homo sapiens
accctcatgaaaa

SEQ ID NO: 1699046 - DNA, 17 bp, Homo sapiens
accctcattctactgaa

SEQ ID NO: 1699047 - DNA, 15 bp, Homo sapiens
accctccacttcccg

SEQ ID NO: 1699048 - DNA, 15 bp, Homo sapiens
accctccagagacaa

SEQ ID NO: 1699049 - DNA, 19 bp, Homo sapiens
accctccagtgctggattt

SEQ ID NO: 1699050 - DNA, 16 bp, Homo sapiens
accctccatgctcctc

SEQ ID NO: 1699051 - DNA, 19 bp, Homo sapiens
accctcccaagtagctggg

SEQ ID NO: 1699052 - DNA, 13 bp, Homo sapiens
accctcccacccc

SEQ ID NO: 1699053 - DNA, 16 bp, Homo sapiens
accctcccatggcacc

SEQ ID NO: 1699054 - DNA, 11 bp, Homo sapiens
accctccccac

SEQ ID NO: 1699055 - DNA, 20 bp, Homo sapiens
accctcccctatgctggtag

SEQ ID NO: 1699056 - DNA, 13 bp, Homo sapiens
accctcccctctc

SEQ ID NO: 1699057 - DNA, 19 bp, Homo sapiens
accctcccctctcttgcac

SEQ ID NO: 1699058 - DNA, 11 bp, Homo sapiens
accctccctcc

SEQ ID NO: 1699059 - DNA, 23 bp, Homo sapiens
accctccggccagcgagtggtca

SEQ ID NO: 1699060 - DNA, 14 bp, Homo sapiens
accctccggcgggt

SEQ ID NO: 1699061 - DNA, 11 bp, Homo sapiens
accctcctggc

SEQ ID NO: 1699062 - DNA, 13 bp, Homo sapiens
accctcctggctc

SEQ ID NO: 1699063 - DNA, 21 bp, Homo sapiens
accctcctgggaaggccacct

SEQ ID NO: 1699064 - DNA, 22 bp, Homo sapiens
accctcctgggaaggccacctc

SEQ ID NO: 1699065 - DNA, 13 bp, Homo sapiens
accctcgggccca

SEQ ID NO: 1699066 - DNA, 14 bp, Homo sapiens
accctcgggcccac

SEQ ID NO: 1699067 - DNA, 15 bp, Homo sapiens
accctcgggcccacc

SEQ ID NO: 1699068 - DNA, 19 bp, Homo sapiens
accctcgggcccacctggc

SEQ ID NO: 1699069 - DNA, 19 bp, Homo sapiens
accctcgggccccatcctc

SEQ ID NO: 1699070 - DNA, 15 bp, Homo sapiens
accctctgaccctag

SEQ ID NO: 1699071 - DNA, 11 bp, Homo sapiens
accctctgggg

SEQ ID NO: 1699072 - DNA, 23 bp, Homo sapiens
accctctgggggtcctctctgag

SEQ ID NO: 1699073 - DNA, 16 bp, Homo sapiens
accctcttcctgtgat

SEQ ID NO: 1699074 - DNA, 19 bp, Homo sapiens
accctcttcctgtgatcca

SEQ ID NO: 1699075 - DNA, 20 bp, Homo sapiens
accctcttcctgtgatccac

SEQ ID NO: 1699076 - DNA, 23 bp, Homo sapiens
accctcttgcccatcctgactga

SEQ ID NO: 1699077 - DNA, 23 bp, Homo sapiens
accctctttcttgtttgtcagca

SEQ ID NO: 1699078 - DNA, 15 bp, Homo sapiens
accctctttgctgca

SEQ ID NO: 1699079 - DNA, 21 bp, Homo sapiens
accctgaagatttcagaggct

SEQ ID NO: 1699080 - DNA, 19 bp, Homo sapiens
accctgaagccattggaga

SEQ ID NO: 1699081 - DNA, 12 bp, Homo sapiens
accctgaagggg

SEQ ID NO: 1699082 - DNA, 22 bp, Homo sapiens
accctgaatggttccatgcctg

SEQ ID NO: 1699083 - DNA, 17 bp, Homo sapiens
accctgacctccgcccc

SEQ ID NO: 1699084 - DNA, 20 bp, Homo sapiens
accctgagatacttcccaaa

SEQ ID NO: 1699085 - DNA, 19 bp, Homo sapiens
accctgagcttaaataaca

SEQ ID NO: 1699086 - DNA, 18 bp, Homo sapiens
accctgaggcctctggaa

SEQ ID NO: 1699087 - DNA, 17 bp, Homo sapiens
accctgaggtcactgct

SEQ ID NO: 1699088 - DNA, 16 bp, Homo sapiens
accctgagttgctttt

SEQ ID NO: 1699089 - DNA, 19 bp, Homo sapiens
accctgagttgcttttcag

SEQ ID NO: 1699090 - DNA, 20 bp, Homo sapiens
accctgatctctcagcccca

SEQ ID NO: 1699091 - DNA, 14 bp, Homo sapiens
accctgatctggac

SEQ ID NO: 1699092 - DNA, 15 bp, Homo sapiens
accctgatctggacc

SEQ ID NO: 1699093 - DNA, 14 bp, Homo sapiens
accctgatgaaaac

SEQ ID NO: 1699094 - DNA, 14 bp, Homo sapiens
accctgattcttga

SEQ ID NO: 1699095 - DNA, 13 bp, Homo sapiens
accctgcaagacc

SEQ ID NO: 1699096 - DNA, 23 bp, Homo sapiens
accctgcacctgctgcgtcccca

SEQ ID NO: 1699097 - DNA, 15 bp, Homo sapiens
accctgcattttcct

SEQ ID NO: 1699098 - DNA, 20 bp, Homo sapiens
accctgccaagactcctcag

SEQ ID NO: 1699099 - DNA, 17 bp, Homo sapiens
accctgcccctcagaga

SEQ ID NO: 1699100 - DNA, 16 bp, Homo sapiens
accctgccctgggcga

SEQ ID NO: 1699101 - DNA, 14 bp, Homo sapiens
accctgcctgagcc

SEQ ID NO: 1699102 - DNA, 15 bp, Homo sapiens
accctgcctgagccc

SEQ ID NO: 1699103 - DNA, 18 bp, Homo sapiens
accctgcgaaggggccct

SEQ ID NO: 1699104 - DNA, 22 bp, Homo sapiens
accctgcgaaggggccctggtc

SEQ ID NO: 1699105 - DNA, 22 bp, Homo sapiens
accctgctgaacacagtgtctg

SEQ ID NO: 1699106 - DNA, 16 bp, Homo sapiens
accctgctgctggtgc

SEQ ID NO: 1699107 - DNA, 16 bp, Homo sapiens
accctggaaaggggag

SEQ ID NO: 1699108 - DNA, 22 bp, Homo sapiens
accctggaattcagcaccctgg

SEQ ID NO: 1699109 - DNA, 14 bp, Homo sapiens
accctggagccatc

SEQ ID NO: 1699110 - DNA, 23 bp, Homo sapiens
accctggcagggacctgagagca

SEQ ID NO: 1699111 - DNA, 18 bp, Homo sapiens
accctggcccgcccctcg

SEQ ID NO: 1699112 - DNA, 21 bp, Homo sapiens
accctggcccgcccctcgctg

SEQ ID NO: 1699113 - DNA, 16 bp, Homo sapiens
accctggccgccccct

SEQ ID NO: 1699114 - DNA, 22 bp, Homo sapiens
accctggccgccccctgccccc

SEQ ID NO: 1699115 - DNA, 23 bp, Homo sapiens
accctggcctagaccagcagaca

SEQ ID NO: 1699116 - DNA, 20 bp, Homo sapiens
accctggcctgaactgagga

SEQ ID NO: 1699117 - DNA, 22 bp, Homo sapiens
accctgggagccagtcctccac

SEQ ID NO: 1699118 - DNA, 14 bp, Homo sapiens
accctgggccctgg

SEQ ID NO: 1699119 - DNA, 19 bp, Homo sapiens
accctgggctggggaggag

SEQ ID NO: 1699120 - DNA, 17 bp, Homo sapiens
accctggggcctggacc

SEQ ID NO: 1699121 - DNA, 22 bp, Homo sapiens
accctgggggcacaggaggcag

SEQ ID NO: 1699122 - DNA, 19 bp, Homo sapiens
accctgggtgggctctgtg

SEQ ID NO: 1699123 - DNA, 16 bp, Homo sapiens
accctgtcccccagct

SEQ ID NO: 1699124 - DNA, 19 bp, Homo sapiens
accctgtcccccagctctg

SEQ ID NO: 1699125 - DNA, 20 bp, Homo sapiens
accctgtcccccagctctgg

SEQ ID NO: 1699126 - DNA, 23 bp, Homo sapiens
accctgtccggcccagtgccact

SEQ ID NO: 1699127 - DNA, 21 bp, Homo sapiens
accctgtctcttaaagaaaaa

SEQ ID NO: 1699128 - DNA, 14 bp, Homo sapiens
accctgtctgtccc

SEQ ID NO: 1699129 - DNA, 22 bp, Homo sapiens
accctgtctgtcccttttcttt

SEQ ID NO: 1699130 - DNA, 23 bp, Homo sapiens
accctgtcttctgggcacagtgg

SEQ ID NO: 1699131 - DNA, 21 bp, Homo sapiens
accctgtgacatggtgcctga

SEQ ID NO: 1699132 - DNA, 14 bp, Homo sapiens
accctgtgctggtg

SEQ ID NO: 1699133 - DNA, 14 bp, Homo sapiens
accctgtggctcac

SEQ ID NO: 1699134 - DNA, 18 bp, Homo sapiens
accctgtgtcctccacca

SEQ ID NO: 1699135 - DNA, 16 bp, Homo sapiens
accctgttttatactg

SEQ ID NO: 1699136 - DNA, 18 bp, Homo sapiens
acccttaccccttagcct

SEQ ID NO: 1699137 - DNA, 12 bp, Homo sapiens
acccttagaaaa

SEQ ID NO: 1699138 - DNA, 13 bp, Homo sapiens
acccttagaaaat

SEQ ID NO: 1699139 - DNA, 15 bp, Homo sapiens
acccttattgctgtc

SEQ ID NO: 1699140 - DNA, 21 bp, Homo sapiens
acccttcagtgctacattttg

SEQ ID NO: 1699141 - DNA, 15 bp, Homo sapiens
acccttcatcttcct

SEQ ID NO: 1699142 - DNA, 22 bp, Homo sapiens
acccttcccaatcagcactgaa

SEQ ID NO: 1699143 - DNA, 22 bp, Homo sapiens
acccttcccctccttctccctt

SEQ ID NO: 1699144 - DNA, 16 bp, Homo sapiens
acccttccctcttccc

SEQ ID NO: 1699145 - DNA, 17 bp, Homo sapiens
acccttccctcttccct

SEQ ID NO: 1699146 - DNA, 12 bp, Homo sapiens
acccttccctgc

SEQ ID NO: 1699147 - DNA, 20 bp, Homo sapiens
acccttcccttgagccctct

SEQ ID NO: 1699148 - DNA, 14 bp, Homo sapiens
acccttctcctttc

SEQ ID NO: 1699149 - DNA, 18 bp, Homo sapiens
acccttctcctttccttc

SEQ ID NO: 1699150 - DNA, 17 bp, Homo sapiens
acccaccgtccgccctg

SEQ ID NO: 1699151 - DNA, 22 bp, Homo sapiens
acccaccgtggaggaggaaggc

SEQ ID NO: 1699152 - DNA, 14 bp, Homo sapiens
acccacctccaccc

SEQ ID NO: 1699153 - DNA, 13 bp, Homo sapiens
acccacctgctga

SEQ ID NO: 1699154 - DNA, 17 bp, Homo sapiens
acccacctgctgagaga

SEQ ID NO: 1699155 - DNA, 16 bp, Homo sapiens
acccacctggtactga

SEQ ID NO: 1699156 - DNA, 18 bp, Homo sapiens
acccacctgttttctgaa

SEQ ID NO: 1699157 - DNA, 19 bp, Homo sapiens
acccaccttgttggagcct

SEQ ID NO: 1699158 - DNA, 17 bp, Homo sapiens
acccactcaccagggtc

SEQ ID NO: 1699159 - DNA, 18 bp, Homo sapiens
acccactcaccagggtcc

SEQ ID NO: 1699160 - DNA, 19 bp, Homo sapiens
acccactgaaatgaccaag

SEQ ID NO: 1699161 - DNA, 18 bp, Homo sapiens
acccacttatttttcaag

SEQ ID NO: 1699162 - DNA, 21 bp, Homo sapiens
acccactttgtaatttttgct

SEQ ID NO: 1699163 - DNA, 20 bp, Homo sapiens
acccagaatgagacatccag

SEQ ID NO: 1699164 - DNA, 21 bp, Homo sapiens
acccagaatggagcctgctct

SEQ ID NO: 1699165 - DNA, 15 bp, Homo sapiens
acccagactcagaca

SEQ ID NO: 1699166 - DNA, 20 bp, Homo sapiens
acccagactggaatgcagtg

SEQ ID NO: 1699167 - DNA, 14 bp, Homo sapiens
acccagagaatata

SEQ ID NO: 1699168 - DNA, 20 bp, Homo sapiens
acccagagagaggggcctgc

SEQ ID NO: 1699169 - DNA, 13 bp, Homo sapiens
acccagaggtgga

SEQ ID NO: 1699170 - DNA, 19 bp, Homo sapiens
acccagagtggagtctgag

SEQ ID NO: 1699171 - DNA, 20 bp, Homo sapiens
acccagagtggagtctgagt

SEQ ID NO: 1699172 - DNA, 15 bp, Homo sapiens
acccagatctcatgg

SEQ ID NO: 1699173 - DNA, 16 bp, Homo sapiens
acccagattgtgtaca

SEQ ID NO: 1699174 - DNA, 19 bp, Homo sapiens
acccagattgtgtacatag

SEQ ID NO: 1699175 - DNA, 22 bp, Homo sapiens
acccagcaggaagccaggctga

SEQ ID NO: 1699176 - DNA, 18 bp, Homo sapiens
acccagccatctgcccag

SEQ ID NO: 1699177 - DNA, 11 bp, Homo sapiens
acccagcccat

SEQ ID NO: 1699178 - DNA, 19 bp, Homo sapiens
acccagcccattctctctc

SEQ ID NO: 1699179 - DNA, 16 bp, Homo sapiens
acccagccccttgaga

SEQ ID NO: 1699180 - DNA, 21 bp, Homo sapiens
acccagccccttgagaaacct

SEQ ID NO: 1699181 - DNA, 12 bp, Homo sapiens
acccagcctgaa

SEQ ID NO: 1699182 - DNA, 17 bp, Homo sapiens
acccagcggccccccgc

SEQ ID NO: 1699183 - DNA, 23 bp, Homo sapiens
acccagcgggcaggttctgcctg

SEQ ID NO: 1699184 - DNA, 20 bp, Homo sapiens
acccagctactctgtccagg

SEQ ID NO: 1699185 - DNA, 14 bp, Homo sapiens
acccaggaccaagc

SEQ ID NO: 1699186 - DNA, 19 bp, Homo sapiens
acccaggaccatcctggag

SEQ ID NO: 1699187 - DNA, 23 bp, Homo sapiens
acccaggagatggaagttgcagt

SEQ ID NO: 1699188 - DNA, 19 bp, Homo sapiens
acccaggagggagggggct

SEQ ID NO: 1699189 - DNA, 20 bp, Homo sapiens
acccaggccctccatgggct

SEQ ID NO: 1699190 - DNA, 15 bp, Homo sapiens
acccaggccgcagct

SEQ ID NO: 1699191 - DNA, 14 bp, Homo sapiens
acccaggctgcact

SEQ ID NO: 1699192 - DNA, 16 bp, Homo sapiens
acccaggctgcactgc

SEQ ID NO: 1699193 - DNA, 18 bp, Homo sapiens
acccaggctgcactgcag

SEQ ID NO: 1699194 - DNA, 22 bp, Homo sapiens
acccaggtcccccgactgcctg

SEQ ID NO: 1699195 - DNA, 23 bp, Homo sapiens
acccaggtcccccgactgcctgt

SEQ ID NO: 1699196 - DNA, 18 bp, Homo sapiens
acccaggtggagggcaca

SEQ ID NO: 1699197 - DNA, 20 bp, Homo sapiens
acccaggtggagggcacagc

SEQ ID NO: 1699198 - DNA, 17 bp, Homo sapiens
acccaggtgtgcctgtg

SEQ ID NO: 1699199 - DNA, 16 bp, Homo sapiens
acccagtccatgctcc

SEQ ID NO: 1699200 - DNA, 21 bp, Homo sapiens
acccagtccccgtgccccgcc

SEQ ID NO: 1699201 - DNA, 13 bp, Homo sapiens
acccagtccctgg

SEQ ID NO: 1699202 - DNA, 19 bp, Homo sapiens
acccagtctcctctccatt

SEQ ID NO: 1699203 - DNA, 12 bp, Homo sapiens
acccagtgcaga

SEQ ID NO: 1699204 - DNA, 18 bp, Homo sapiens
acccagtgcccccactga

SEQ ID NO: 1699205 - DNA, 22 bp, Homo sapiens
acccagtgcccccactgaccag

SEQ ID NO: 1699206 - DNA, 13 bp, Homo sapiens
acccagtgctgcc

SEQ ID NO: 1699207 - DNA, 16 bp, Homo sapiens
acccagtgctgccatg

SEQ ID NO: 1699208 - DNA, 17 bp, Homo sapiens
acccagtgctgccatgc

SEQ ID NO: 1699209 - DNA, 16 bp, Homo sapiens
acccataaacagcaca

SEQ ID NO: 1699210 - DNA, 23 bp, Homo sapiens
acccataaacagcacacctgtgt

SEQ ID NO: 1699211 - DNA, 17 bp, Homo sapiens
acccatacaatgtatgt

SEQ ID NO: 1699212 - DNA, 20 bp, Homo sapiens
acccatattgtaaaacaggt

SEQ ID NO: 1699213 - DNA, 15 bp, Homo sapiens
acccatcgctgtgtg

SEQ ID NO: 1699214 - DNA, 17 bp, Homo sapiens
acccatcgctgtgtgtt

SEQ ID NO: 1699215 - DNA, 13 bp, Homo sapiens
acccatctccccc

SEQ ID NO: 1699216 - DNA, 17 bp, Homo sapiens
acccatcttcctgctgc

SEQ ID NO: 1699217 - DNA, 20 bp, Homo sapiens
acccatgaagacaggacagt

SEQ ID NO: 1699218 - DNA, 13 bp, Homo sapiens
acccatgaggcaa

SEQ ID NO: 1699219 - DNA, 21 bp, Homo sapiens
acccatgtgggcgcccaccct

SEQ ID NO: 1699220 - DNA, 22 bp, Homo sapiens
acccatgtgggcgcccaccctg

SEQ ID NO: 1699221 - DNA, 22 bp, Homo sapiens
acccattaaggggaagaatgaa

SEQ ID NO: 1699222 - DNA, 19 bp, Homo sapiens
acccattccagtacagtat

SEQ ID NO: 1699223 - DNA, 15 bp, Homo sapiens
acccattctgttttc

SEQ ID NO: 1699224 - DNA, 16 bp, Homo sapiens
accccaaacttccagg

SEQ ID NO: 1699225 - DNA, 17 bp, Homo sapiens
accccaaagctttcctg

SEQ ID NO: 1699226 - DNA, 16 bp, Homo sapiens
accccaacgcacagga

SEQ ID NO: 1699227 - DNA, 15 bp, Homo sapiens
accccaactctcccc

SEQ ID NO: 1699228 - DNA, 17 bp, Homo sapiens
accccaactctccccag

SEQ ID NO: 1699229 - DNA, 18 bp, Homo sapiens
accccaagccagcccggc

SEQ ID NO: 1699230 - DNA, 21 bp, Homo sapiens
accccaaggactgagggcagt

SEQ ID NO: 1699231 - DNA, 13 bp, Homo sapiens
accccaaggccag

SEQ ID NO: 1699232 - DNA, 20 bp, Homo sapiens
accccacaccaggccgtcct

SEQ ID NO: 1699233 - DNA, 22 bp, Homo sapiens
accccacaccaggccgtcctcc

SEQ ID NO: 1699234 - DNA, 13 bp, Homo sapiens
accccacacctgc

SEQ ID NO: 1699235 - DNA, 11 bp, Homo sapiens
accccacactt

SEQ ID NO: 1699236 - DNA, 21 bp, Homo sapiens
accccacacttgttccagctc

SEQ ID NO: 1699237 - DNA, 14 bp, Homo sapiens
accccaccccaccc

SEQ ID NO: 1699238 - DNA, 21 bp, Homo sapiens
accccaccctcagcacccctt

SEQ ID NO: 1699239 - DNA, 19 bp, Homo sapiens
accccacccttcccctcct

SEQ ID NO: 1699240 - DNA, 15 bp, Homo sapiens
accccacctcacagc

SEQ ID NO: 1699241 - DNA, 15 bp, Homo sapiens
accccactccagccc

SEQ ID NO: 1699242 - DNA, 14 bp, Homo sapiens
accccagaggcaga

SEQ ID NO: 1699243 - DNA, 16 bp, Homo sapiens
accccagaggcagagg

SEQ ID NO: 1699244 - DNA, 17 bp, Homo sapiens
accccagattcttcagc

SEQ ID NO: 1699245 - DNA, 24 bp, Homo sapiens
accccagattcttcagcttgatcc

SEQ ID NO: 1699246 - DNA, 13 bp, Homo sapiens
accccagcatcct

SEQ ID NO: 1699247 - DNA, 19 bp, Homo sapiens
accccagcattccagctct

SEQ ID NO: 1699248 - DNA, 20 bp, Homo sapiens
accccagcattccagctctg

SEQ ID NO: 1699249 - DNA, 21 bp, Homo sapiens
accccagcattccagctctgc

SEQ ID NO: 1699250 - DNA, 13 bp, Homo sapiens
accccagcggctg

SEQ ID NO: 1699251 - DNA, 10 bp, Homo sapiens
accccagctg

SEQ ID NO: 1699252 - DNA, 11 bp, Homo sapiens
accccagctgg

SEQ ID NO: 1699253 - DNA, 12 bp, Homo sapiens
accccagctggg

SEQ ID NO: 1699254 - DNA, 14 bp, Homo sapiens
accccagctgggag

SEQ ID NO: 1699255 - DNA, 15 bp, Homo sapiens
accccagctgggagg

SEQ ID NO: 1699256 - DNA, 19 bp, Homo sapiens
accccagggcccccacagg

SEQ ID NO: 1699257 - DNA, 20 bp, Homo sapiens
accccagggcccccacaggc

SEQ ID NO: 1699258 - DNA, 22 bp, Homo sapiens
accccaggtttttcatctgaaa

SEQ ID NO: 1699259 - DNA, 15 bp, Homo sapiens
accccagtttttgtt

SEQ ID NO: 1699260 - DNA, 22 bp, Homo sapiens
accccatatcttctgtttcata

SEQ ID NO: 1699261 - DNA, 13 bp, Homo sapiens
accccatgggctt

SEQ ID NO: 1699262 - DNA, 12 bp, Homo sapiens
accccattcctg

SEQ ID NO: 1699263 - DNA, 20 bp, Homo sapiens
acccccaaaatccaaaactt

SEQ ID NO: 1699264 - DNA, 18 bp, Homo sapiens
acccccaaagacctgcct

SEQ ID NO: 1699265 - DNA, 17 bp, Homo sapiens
acccccaacttcaccac

SEQ ID NO: 1699266 - DNA, 18 bp, Homo sapiens
acccccacaagctgtccc

SEQ ID NO: 1699267 - DNA, 15 bp, Homo sapiens
actcttttaagtgcc

SEQ ID NO: 1699268 - DNA, 18 bp, Homo sapiens
actgaaaaaaaaaaagaa

SEQ ID NO: 1699269 - DNA, 13 bp, Homo sapiens
actgaaaaaatat

SEQ ID NO: 1699270 - DNA, 17 bp, Homo sapiens
actgaaaagaaggaaag

SEQ ID NO: 1699271 - DNA, 19 bp, Homo sapiens
actgaaaagactcagtgtt

SEQ ID NO: 1699272 - DNA, 15 bp, Homo sapiens
actgaaaatgtgcta

SEQ ID NO: 1699273 - DNA, 22 bp, Homo sapiens
actgaaacatgcacattttgta

SEQ ID NO: 1699274 - DNA, 17 bp, Homo sapiens
actgaaacatggctgtg

SEQ ID NO: 1699275 - DNA, 15 bp, Homo sapiens
actgaaaccattttc

SEQ ID NO: 1699276 - DNA, 21 bp, Homo sapiens
actgaaagaagaaaacagtac

SEQ ID NO: 1699277 - DNA, 17 bp, Homo sapiens
actgaaagcacatgaat

SEQ ID NO: 1699278 - DNA, 18 bp, Homo sapiens
actgaaaggaaaaatgta

SEQ ID NO: 1699279 - DNA, 16 bp, Homo sapiens
actgaaagttttgtaa

SEQ ID NO: 1699280 - DNA, 18 bp, Homo sapiens
actgaaagttttgtaaaa

SEQ ID NO: 1699281 - DNA, 22 bp, Homo sapiens
actgaaattgttttaccagctc

SEQ ID NO: 1699282 - DNA, 23 bp, Homo sapiens
actgaaattgttttaccagctcc

SEQ ID NO: 1699283 - DNA, 21 bp, Homo sapiens
acccccacaagctgtccctgc

SEQ ID NO: 1699284 - DNA, 15 bp, Homo sapiens
acccccacacctcag

SEQ ID NO: 1699285 - DNA, 12 bp, Homo sapiens
acccccacccca

SEQ ID NO: 1699286 - DNA, 17 bp, Homo sapiens
acccccaccccacactt

SEQ ID NO: 1699287 - DNA, 15 bp, Homo sapiens
acccccacccccagc

SEQ ID NO: 1699288 - DNA, 13 bp, Homo sapiens
acccccactctca

SEQ ID NO: 1699289 - DNA, 12 bp, Homo sapiens
acccccagctca

SEQ ID NO: 1699290 - DNA, 14 bp, Homo sapiens
acccccaggtggcc

SEQ ID NO: 1699291 - DNA, 14 bp, Homo sapiens
acccccatccagcc

SEQ ID NO: 1699292 - DNA, 21 bp, Homo sapiens
acccccatccagcctccaggg

SEQ ID NO: 1699293 - DNA, 18 bp, Homo sapiens
acccccatcttccacctg

SEQ ID NO: 1699294 - DNA, 21 bp, Homo sapiens
acccccatcttccacctgtgc

SEQ ID NO: 1699295 - DNA, 20 bp, Homo sapiens
accccccagaacctgtcctt

SEQ ID NO: 1699296 - DNA, 14 bp, Homo sapiens
accccccgtgggct

SEQ ID NO: 1699297 - DNA, 19 bp, Homo sapiens
acccccctccccaactccc

SEQ ID NO: 1699298 - DNA, 12 bp, Homo sapiens
acccccctcctg

SEQ ID NO: 1699299 - DNA, 16 bp, Homo sapiens
acccccctcctgctcc

SEQ ID NO: 1699300 - DNA, 20 bp, Homo sapiens
acccccctctctttctctgg

SEQ ID NO: 1699301 - DNA, 11 bp, Homo sapiens
acccccctctg

SEQ ID NO: 1699302 - DNA, 19 bp, Homo sapiens
acccccgaccctgccctgg

SEQ ID NO: 1699303 - DNA, 15 bp, Homo sapiens
acccccgccacctca

SEQ ID NO: 1699304 - DNA, 21 bp, Homo sapiens
acccccgccacctcagggcac

SEQ ID NO: 1699305 - DNA, 19 bp, Homo sapiens
acccccgtcctcttcgaga

SEQ ID NO: 1699306 - DNA, 13 bp, Homo sapiens
accccctccccag

SEQ ID NO: 1699307 - DNA, 23 bp, Homo sapiens
accccctccccgcccctgtggcc

SEQ ID NO: 1699308 - DNA, 12 bp, Homo sapiens
accccctccctt

SEQ ID NO: 1699309 - DNA, 12 bp, Homo sapiens
accccctccttc

SEQ ID NO: 1699310 - DNA, 15 bp, Homo sapiens
accccctccttcaga

SEQ ID NO: 1699311 - DNA, 19 bp, Homo sapiens
accccctccttcagacacc

SEQ ID NO: 1699312 - DNA, 13 bp, Homo sapiens
accccctggccct

SEQ ID NO: 1699313 - DNA, 20 bp, Homo sapiens
accccctgtcccattctaga

SEQ ID NO: 1699314 - DNA, 18 bp, Homo sapiens
acccccttcagtgcccac

SEQ ID NO: 1699315 - DNA, 19 bp, Homo sapiens
acccccttctctgctccac

SEQ ID NO: 1699316 - DNA, 15 bp, Homo sapiens
accccgagaagtgct

SEQ ID NO: 1699317 - DNA, 22 bp, Homo sapiens
accccgagaagtgctcttggct

SEQ ID NO: 1699318 - DNA, 17 bp, Homo sapiens
accccgcagacaccttg

SEQ ID NO: 1699319 - DNA, 14 bp, Homo sapiens
accccgcagcccgt

SEQ ID NO: 1699320 - DNA, 19 bp, Homo sapiens
accccgcaggatccctcct

SEQ ID NO: 1699321 - DNA, 20 bp, Homo sapiens
accccgcaggatccctcctg

SEQ ID NO: 1699322 - DNA, 22 bp, Homo sapiens
accccgcctgcctcctggctca

SEQ ID NO: 1699323 - DNA, 15 bp, Homo sapiens
accccgcggtgctct

SEQ ID NO: 1699324 - DNA, 14 bp, Homo sapiens
accccgctctggca

SEQ ID NO: 1699325 - DNA, 18 bp, Homo sapiens
accccgctgatggagccc

SEQ ID NO: 1699326 - DNA, 23 bp, Homo sapiens
accccgctgatggagccccacct

SEQ ID NO: 1699327 - DNA, 13 bp, Homo sapiens
accccggcctcag

SEQ ID NO: 1699328 - DNA, 16 bp, Homo sapiens
accccggcctcagggc

SEQ ID NO: 1699329 - DNA, 17 bp, Homo sapiens
accccggcctcagggcg

SEQ ID NO: 1699330 - DNA, 15 bp, Homo sapiens
accccggggaccctg

SEQ ID NO: 1699331 - DNA, 17 bp, Homo sapiens
accccggggaccctgtg

SEQ ID NO: 1699332 - DNA, 23 bp, Homo sapiens
accccgtctggggttcagcccct

SEQ ID NO: 1699333 - DNA, 14 bp, Homo sapiens
accccgtgccaccc

SEQ ID NO: 1699334 - DNA, 22 bp, Homo sapiens
acccctaaaagaaaccctgcac

SEQ ID NO: 1699335 - DNA, 22 bp, Homo sapiens
acccctaaagagatactttgat

SEQ ID NO: 1699336 - DNA, 14 bp, Homo sapiens
acccctaagtgccc

SEQ ID NO: 1699337 - DNA, 15 bp, Homo sapiens
acccctaatgtcagc

SEQ ID NO: 1699338 - DNA, 14 bp, Homo sapiens
acccctacagcctg

SEQ ID NO: 1699339 - DNA, 19 bp, Homo sapiens
acccctacagcctgcacac

SEQ ID NO: 1699340 - DNA, 17 bp, Homo sapiens
acccctagagacagtga

SEQ ID NO: 1699341 - DNA, 13 bp, Homo sapiens
acccctagccctg

SEQ ID NO: 1699342 - DNA, 19 bp, Homo sapiens
acccctatacctgagcctc

SEQ ID NO: 1699343 - DNA, 15 bp, Homo sapiens
acccctcactcccca

SEQ ID NO: 1699344 - DNA, 17 bp, Homo sapiens
acccctcactccccagg

SEQ ID NO: 1699345 - DNA, 18 bp, Homo sapiens
acccctcactccccaggg

SEQ ID NO: 1699346 - DNA, 16 bp, Homo sapiens
acccctccacgtgtcc

SEQ ID NO: 1699347 - DNA, 21 bp, Homo sapiens
acccctccacgtgtccgtcca

SEQ ID NO: 1699348 - DNA, 21 bp, Homo sapiens
acccctccctgcttgcacact

SEQ ID NO: 1699349 - DNA, 16 bp, Homo sapiens
acccctgactcatcat

SEQ ID NO: 1699350 - DNA, 12 bp, Homo sapiens
acccctgcactt

SEQ ID NO: 1699351 - DNA, 19 bp, Homo sapiens
acccctgccagttctctgt

SEQ ID NO: 1699352 - DNA, 15 bp, Homo sapiens
acccctgccctggga

SEQ ID NO: 1699353 - DNA, 23 bp, Homo sapiens
acccctgctcccattcctccctc

SEQ ID NO: 1699354 - DNA, 12 bp, Homo sapiens
acccctggaaga

SEQ ID NO: 1699355 - DNA, 11 bp, Homo sapiens
acccctggcca

SEQ ID NO: 1699356 - DNA, 12 bp, Homo sapiens
acccctggccag

SEQ ID NO: 1699357 - DNA, 12 bp, Homo sapiens
acccctggcttt

SEQ ID NO: 1699358 - DNA, 15 bp, Homo sapiens
acccctggttctcat

SEQ ID NO: 1699359 - DNA, 22 bp, Homo sapiens
acccctgtagggaaaccttgga

SEQ ID NO: 1699360 - DNA, 18 bp, Homo sapiens
acccctgtgctcccctgc

SEQ ID NO: 1699361 - DNA, 21 bp, Homo sapiens
acccctgtgctccgtgcctcc

SEQ ID NO: 1699362 - DNA, 17 bp, Homo sapiens
accccttagcctccctg

SEQ ID NO: 1699363 - DNA, 12 bp, Homo sapiens
accccttcccca

SEQ ID NO: 1699364 - DNA, 13 bp, Homo sapiens
accccttccccag

SEQ ID NO: 1699365 - DNA, 15 bp, Homo sapiens
accccttccccaggc

SEQ ID NO: 1699366 - DNA, 19 bp, Homo sapiens
accccttccccaggcccac

SEQ ID NO: 1699367 - DNA, 21 bp, Homo sapiens
accccttccccaggcccacca

SEQ ID NO: 1699368 - DNA, 20 bp, Homo sapiens
accccttggaaatgtctgct

SEQ ID NO: 1699369 - DNA, 22 bp, Homo sapiens
accccttggaaatgtctgctgg

SEQ ID NO: 1699370 - DNA, 18 bp, Homo sapiens
accccttggaggagagag

SEQ ID NO: 1699371 - DNA, 19 bp, Homo sapiens
accccttggaggagagaga

SEQ ID NO: 1699372 - DNA, 21 bp, Homo sapiens
accccttggaggagagagacc

SEQ ID NO: 1699373 - DNA, 14 bp, Homo sapiens
acccctttcactta

SEQ ID NO: 1699374 - DNA, 12 bp, Homo sapiens
acccctttcctg

SEQ ID NO: 1699375 - DNA, 12 bp, Homo sapiens
acccctttgatt

SEQ ID NO: 1699376 - DNA, 14 bp, Homo sapiens
acccgagcccagct

SEQ ID NO: 1699377 - DNA, 19 bp, Homo sapiens
acccgagcccagctacatt

SEQ ID NO: 1699378 - DNA, 19 bp, Homo sapiens
acccgagttcctctgggtt

SEQ ID NO: 1699379 - DNA, 15 bp, Homo sapiens
acccgccagccccgc

SEQ ID NO: 1699380 - DNA, 19 bp, Homo sapiens
acccgccctttccttgcct

SEQ ID NO: 1699381 - DNA, 21 bp, Homo sapiens
acccgccctttccttgccttc

SEQ ID NO: 1699382 - DNA, 16 bp, Homo sapiens
acccgccgcctcccac

SEQ ID NO: 1699383 - DNA, 19 bp, Homo sapiens
acccgccgcctcccacggc

SEQ ID NO: 1699384 - DNA, 13 bp, Homo sapiens
acccgcctctccc

SEQ ID NO: 1699385 - DNA, 18 bp, Homo sapiens
acccgctcatcactggat

SEQ ID NO: 1699386 - DNA, 17 bp, Homo sapiens
acccggccacagctgct

SEQ ID NO: 1699387 - DNA, 14 bp, Homo sapiens
acccggctgcagag

SEQ ID NO: 1699388 - DNA, 15 bp, Homo sapiens
acccgggaaggaagg

SEQ ID NO: 1699389 - DNA, 19 bp, Homo sapiens
acccgggggagcccagtga

SEQ ID NO: 1699390 - DNA, 17 bp, Homo sapiens
acccgtaggcagcctct

SEQ ID NO: 1699391 - DNA, 20 bp, Homo sapiens
acccgtaggcagcctctctg

SEQ ID NO: 1699392 - DNA, 17 bp, Homo sapiens
acccgtggggtgctgcc

SEQ ID NO: 1699393 - DNA, 12 bp, Homo sapiens
accctaaaaaga

SEQ ID NO: 1699394 - DNA, 15 bp, Homo sapiens
accctaaagggagaa

SEQ ID NO: 1699395 - DNA, 16 bp, Homo sapiens
accctaaataataaaa

SEQ ID NO: 1699396 - DNA, 16 bp, Homo sapiens
accctaaccaagttcc

SEQ ID NO: 1699397 - DNA, 17 bp, Homo sapiens
accctaaccaagttcct

SEQ ID NO: 1699398 - DNA, 14 bp, Homo sapiens
accctaagatgaag

SEQ ID NO: 1699399 - DNA, 21 bp, Homo sapiens
accctaatagactaaatgaaa

SEQ ID NO: 1699400 - DNA, 15 bp, Homo sapiens
accctaccctggcag

SEQ ID NO: 1699401 - DNA, 14 bp, Homo sapiens
accagtgagtggcc

SEQ ID NO: 1699402 - DNA, 18 bp, Homo sapiens
accagtgggaattgctgg

SEQ ID NO: 1699403 - DNA, 17 bp, Homo sapiens
accagttatgtgaatga

SEQ ID NO: 1699404 - DNA, 20 bp, Homo sapiens
accagttgggagcactggag

SEQ ID NO: 1699405 - DNA, 13 bp, Homo sapiens
accataatgttac

SEQ ID NO: 1699406 - DNA, 16 bp, Homo sapiens
accatacattatttct

SEQ ID NO: 1699407 - DNA, 16 bp, Homo sapiens
accataccttccttcc

SEQ ID NO: 1699408 - DNA, 12 bp, Homo sapiens
accatactcaga

SEQ ID NO: 1699409 - DNA, 15 bp, Homo sapiens
accatactgagggac

SEQ ID NO: 1699410 - DNA, 16 bp, Homo sapiens
accatagaaaaatgta

SEQ ID NO: 1699411 - DNA, 13 bp, Homo sapiens
accatagaactgt

SEQ ID NO: 1699412 - DNA, 14 bp, Homo sapiens
accatagaactgtc

SEQ ID NO: 1699413 - DNA, 14 bp, Homo sapiens
accatattacctgg

SEQ ID NO: 1699414 - DNA, 16 bp, Homo sapiens
accatattttttatga

SEQ ID NO: 1699415 - DNA, 15 bp, Homo sapiens
accatcaagaaccta

SEQ ID NO: 1699416 - DNA, 16 bp, Homo sapiens
accatcaatcctgatt

SEQ ID NO: 1699417 - DNA, 13 bp, Homo sapiens
accatcaccaccg

SEQ ID NO: 1699418 - DNA, 19 bp, Homo sapiens
accatcaccaccgcctctg

SEQ ID NO: 1699419 - DNA, 19 bp, Homo sapiens
accatccaccttcccttct

SEQ ID NO: 1699420 - DNA, 12 bp, Homo sapiens
accatccagtgg

SEQ ID NO: 1699421 - DNA, 17 bp, Homo sapiens
accatccccaccccacc

SEQ ID NO: 1699422 - DNA, 13 bp, Homo sapiens
accatcctgagcc

SEQ ID NO: 1699423 - DNA, 14 bp, Homo sapiens
accatcctgagcca

SEQ ID NO: 1699424 - DNA, 22 bp, Homo sapiens
accatctctagttggccagcgt

SEQ ID NO: 1699425 - DNA, 11 bp, Homo sapiens
accatctgcat

SEQ ID NO: 1699426 - DNA, 15 bp, Homo sapiens
accatgaaacaaagc

SEQ ID NO: 1699427 - DNA, 23 bp, Homo sapiens
accatgaacagaaaacattctga

SEQ ID NO: 1699428 - DNA, 17 bp, Homo sapiens
accatgaccctacataa

SEQ ID NO: 1699429 - DNA, 21 bp, Homo sapiens
accatgagaagagggcctgtg

SEQ ID NO: 1699430 - DNA, 16 bp, Homo sapiens
accatgcaaatgctat

SEQ ID NO: 1699431 - DNA, 19 bp, Homo sapiens
accatgcctcactaatttt

SEQ ID NO: 1699432 - DNA, 20 bp, Homo sapiens
accatgcctcactaattttt

SEQ ID NO: 1699433 - DNA, 20 bp, Homo sapiens
accatgctcatctgctggtc

SEQ ID NO: 1699434 - DNA, 21 bp, Homo sapiens
accatgctgctggggaagaca

SEQ ID NO: 1699435 - DNA, 22 bp, Homo sapiens
accatgctgctttttggcacag

SEQ ID NO: 1699436 - DNA, 23 bp, Homo sapiens
accatgctgctttttggcacagt

SEQ ID NO: 1699437 - DNA, 20 bp, Homo sapiens
accatggtcatcaccaccct

SEQ ID NO: 1699438 - DNA, 17 bp, Homo sapiens
accatggttaagagtcc

SEQ ID NO: 1699439 - DNA, 16 bp, Homo sapiens
accatgtgagctcttc

SEQ ID NO: 1699440 - DNA, 14 bp, Homo sapiens
accatgtgcaataa

SEQ ID NO: 1699441 - DNA, 21 bp, Homo sapiens
accatgtgccatctgtacata

SEQ ID NO: 1699442 - DNA, 12 bp, Homo sapiens
accatgttcatt

SEQ ID NO: 1699443 - DNA, 16 bp, Homo sapiens
accatgttcattataa

SEQ ID NO: 1699444 - DNA, 18 bp, Homo sapiens
accatgttcattataatc

SEQ ID NO: 1699445 - DNA, 12 bp, Homo sapiens
accatgtttgag

SEQ ID NO: 1699446 - DNA, 19 bp, Homo sapiens
accatgtttgagctcagac

SEQ ID NO: 1699447 - DNA, 13 bp, Homo sapiens
accattaaaactg

SEQ ID NO: 1699448 - DNA, 17 bp, Homo sapiens
accattaaaactgcttt

SEQ ID NO: 1699449 - DNA, 13 bp, Homo sapiens
accattaaagtca

SEQ ID NO: 1699450 - DNA, 15 bp, Homo sapiens
accattataatttat

SEQ ID NO: 1699451 - DNA, 15 bp, Homo sapiens
accattccccatggg

SEQ ID NO: 1699452 - DNA, 14 bp, Homo sapiens
accattcctgcctt

SEQ ID NO: 1699453 - DNA, 21 bp, Homo sapiens
accattctcaccctgtgaaac

SEQ ID NO: 1699454 - DNA, 16 bp, Homo sapiens
accattctcctgcctc

SEQ ID NO: 1699455 - DNA, 18 bp, Homo sapiens
accattctcctgcctcac

SEQ ID NO: 1699456 - DNA, 24 bp, Homo sapiens
accattctgactcggtttctccaa

SEQ ID NO: 1699457 - DNA, 17 bp, Homo sapiens
accattgacctcagctg

SEQ ID NO: 1699458 - DNA, 20 bp, Homo sapiens
accattgacctcagctgcac

SEQ ID NO: 1699459 - DNA, 21 bp, Homo sapiens
accattgcactctagcctggc

SEQ ID NO: 1699460 - DNA, 15 bp, Homo sapiens
accattgctggaaaa

SEQ ID NO: 1699461 - DNA, 13 bp, Homo sapiens
accatttatcttg

SEQ ID NO: 1699462 - DNA, 15 bp, Homo sapiens
accatttatcttgaa

SEQ ID NO: 1699463 - DNA, 16 bp, Homo sapiens
accatttatcttgaag

SEQ ID NO: 1699464 - DNA, 22 bp, Homo sapiens
accatttcctcagcttatctct

SEQ ID NO: 1699465 - DNA, 22 bp, Homo sapiens
accatttgcatggctccagaaa

SEQ ID NO: 1699466 - DNA, 13 bp, Homo sapiens
accatttgtaata

SEQ ID NO: 1699467 - DNA, 14 bp, Homo sapiens
accatttgtaataa

SEQ ID NO: 1699468 - DNA, 18 bp, Homo sapiens
accatttgtaataaagta

SEQ ID NO: 1699469 - DNA, 21 bp, Homo sapiens
accatttgtaataaagtatat

SEQ ID NO: 1699470 - DNA, 20 bp, Homo sapiens
accattttatagactaccaa

SEQ ID NO: 1699471 - DNA, 17 bp, Homo sapiens
accattttcccatcatc

SEQ ID NO: 1699472 - DNA, 19 bp, Homo sapiens
accattttcccatcatcct

SEQ ID NO: 1699473 - DNA, 18 bp, Homo sapiens
accatttttgctgaattc

SEQ ID NO: 1699474 - DNA, 22 bp, Homo sapiens
accattttttaaggaaacaata

SEQ ID NO: 1699475 - DNA, 18 bp, Homo sapiens
acccaaaaactgtcttta

SEQ ID NO: 1699476 - DNA, 20 bp, Homo sapiens
acccaaaaccctgaagccat

SEQ ID NO: 1699477 - DNA, 13 bp, Homo sapiens
acccaaacacttc

SEQ ID NO: 1699478 - DNA, 17 bp, Homo sapiens
acccaaacacttctgct

SEQ ID NO: 1699479 - DNA, 13 bp, Homo sapiens
acccaaaccccca

SEQ ID NO: 1699480 - DNA, 18 bp, Homo sapiens
acccaaagaggtatttat

SEQ ID NO: 1699481 - DNA, 14 bp, Homo sapiens
acccaaagcatgga

SEQ ID NO: 1699482 - DNA, 17 bp, Homo sapiens
acccaaagcggtccctg

SEQ ID NO: 1699483 - DNA, 11 bp, Homo sapiens
acccaaagctg

SEQ ID NO: 1699484 - DNA, 17 bp, Homo sapiens
acccaaagctgagcctg

SEQ ID NO: 1699485 - DNA, 22 bp, Homo sapiens
acccaaagctgagcctgcaggg

SEQ ID NO: 1699486 - DNA, 15 bp, Homo sapiens
acccaacccaaacca

SEQ ID NO: 1699487 - DNA, 19 bp, Homo sapiens
acccaaccccaagccagcc

SEQ ID NO: 1699488 - DNA, 20 bp, Homo sapiens
acccaaccctatctcctgac

SEQ ID NO: 1699489 - DNA, 16 bp, Homo sapiens
acccaaccctgccctg

SEQ ID NO: 1699490 - DNA, 19 bp, Homo sapiens
acccaactagctctatgtt

SEQ ID NO: 1699491 - DNA, 20 bp, Homo sapiens
acccaactgatcctgctcca

SEQ ID NO: 1699492 - DNA, 16 bp, Homo sapiens
acccaagacatgacat

SEQ ID NO: 1699493 - DNA, 17 bp, Homo sapiens
acccaagataaaagaat

SEQ ID NO: 1699494 - DNA, 22 bp, Homo sapiens
acccaagatgggcatcttttgt

SEQ ID NO: 1699495 - DNA, 17 bp, Homo sapiens
acccaagcctgatccag

SEQ ID NO: 1699496 - DNA, 21 bp, Homo sapiens
acccaagcctgatccagcctt

SEQ ID NO: 1699497 - DNA, 17 bp, Homo sapiens
acccaagcctgctggct

SEQ ID NO: 1699498 - DNA, 18 bp, Homo sapiens
acccaattttaaaaaata

SEQ ID NO: 1699499 - DNA, 21 bp, Homo sapiens
acccaattttaaaaaataaca

SEQ ID NO: 1699500 - DNA, 17 bp, Homo sapiens
acccacacagctgccct

SEQ ID NO: 1699501 - DNA, 19 bp, Homo sapiens
acccacacagctgccctag

SEQ ID NO: 1699502 - DNA, 20 bp, Homo sapiens
acccacactgccagaagaga

SEQ ID NO: 1699503 - DNA, 12 bp, Homo sapiens
acccacagccat

SEQ ID NO: 1699504 - DNA, 14 bp, Homo sapiens
acccacagctcagc

SEQ ID NO: 1699505 - DNA, 20 bp, Homo sapiens
acccacagctcagctgccca

SEQ ID NO: 1699506 - DNA, 20 bp, Homo sapiens
acccacatggggttcctggt

SEQ ID NO: 1699507 - DNA, 21 bp, Homo sapiens
acccacatggggttcctggtt

SEQ ID NO: 1699508 - DNA, 15 bp, Homo sapiens
acccacatgtgacac

SEQ ID NO: 1699509 - DNA, 17 bp, Homo sapiens
acccaccaaactgcaca

SEQ ID NO: 1699510 - DNA, 15 bp, Homo sapiens
acccaccaccatgcc

SEQ ID NO: 1699511 - DNA, 11 bp, Homo sapiens
acccaccagtg

SEQ ID NO: 1699512 - DNA, 21 bp, Homo sapiens
acccacccatcttcctgctgc

SEQ ID NO: 1699513 - DNA, 15 bp, Homo sapiens
acccaccccaactct

SEQ ID NO: 1699514 - DNA, 23 bp, Homo sapiens
acccaccccctttggtttgacaa

SEQ ID NO: 1699515 - DNA, 13 bp, Homo sapiens
acccacccctgcc

SEQ ID NO: 1699516 - DNA, 15 bp, Homo sapiens
acccaccctgtggct

SEQ ID NO: 1699517 - DNA, 22 bp, Homo sapiens
acccaccctgtggctcacagtg

SEQ ID NO: 1699518 - DNA, 20 bp, Homo sapiens
acctgctgtgatacgatgct

SEQ ID NO: 1699519 - DNA, 16 bp, Homo sapiens
acctgcttccttcagt

SEQ ID NO: 1699520 - DNA, 17 bp, Homo sapiens
acctggaaaaattccag

SEQ ID NO: 1699521 - DNA, 23 bp, Homo sapiens
acctggaaacagaccaatagaca

SEQ ID NO: 1699522 - DNA, 23 bp, Homo sapiens
acctggaagaacaggcctctcca

SEQ ID NO: 1699523 - DNA, 17 bp, Homo sapiens
acctggagatgcagcta

SEQ ID NO: 1699524 - DNA, 18 bp, Homo sapiens
acctggaggggcaccagg

SEQ ID NO: 1699525 - DNA, 18 bp, Homo sapiens
acctggatccagcactgg

SEQ ID NO: 1699526 - DNA, 17 bp, Homo sapiens
acctggcagctctggac

SEQ ID NO: 1699527 - DNA, 17 bp, Homo sapiens
acctggccctgcttcct

SEQ ID NO: 1699528 - DNA, 19 bp, Homo sapiens
acctggccgcctccaggag

SEQ ID NO: 1699529 - DNA, 14 bp, Homo sapiens
acctggcctgctgg

SEQ ID NO: 1699530 - DNA, 16 bp, Homo sapiens
acctggcctgctggga

SEQ ID NO: 1699531 - DNA, 17 bp, Homo sapiens
acctggcctgctgggaa

SEQ ID NO: 1699532 - DNA, 15 bp, Homo sapiens
acctggcctgggcca

SEQ ID NO: 1699533 - DNA, 17 bp, Homo sapiens
acctggctctcagagga

SEQ ID NO: 1699534 - DNA, 19 bp, Homo sapiens
acctggctgaggttcctct

SEQ ID NO: 1699535 - DNA, 21 bp, Homo sapiens
acctggctgaggttcctctgc

SEQ ID NO: 1699536 - DNA, 23 bp, Homo sapiens
acctggctgaggttcctctgcct

SEQ ID NO: 1699537 - DNA, 16 bp, Homo sapiens
acctggcttttacttt

SEQ ID NO: 1699538 - DNA, 18 bp, Homo sapiens
acctggcttttactttat

SEQ ID NO: 1699539 - DNA, 22 bp, Homo sapiens
acctgggaaagagatttaaact

SEQ ID NO: 1699540 - DNA, 17 bp, Homo sapiens
acctgggattatatatc

SEQ ID NO: 1699541 - DNA, 21 bp, Homo sapiens
acctggggtcatcgattcaaa

SEQ ID NO: 1699542 - DNA, 21 bp, Homo sapiens
acctgggtatcccctgcctcc

SEQ ID NO: 1699543 - DNA, 18 bp, Homo sapiens
acctggtaccctcctggc

SEQ ID NO: 1699544 - DNA, 21 bp, Homo sapiens
acctggtactccctctcagga

SEQ ID NO: 1699545 - DNA, 22 bp, Homo sapiens
acctggtcctccgcctactgtc

SEQ ID NO: 1699546 - DNA, 16 bp, Homo sapiens
acctggtgcgggcctg

SEQ ID NO: 1699547 - DNA, 17 bp, Homo sapiens
acctggtgcgggcctgg

SEQ ID NO: 1699548 - DNA, 16 bp, Homo sapiens
acctggtgtgtttctt

SEQ ID NO: 1699549 - DNA, 15 bp, Homo sapiens
acctggttcatattt

SEQ ID NO: 1699550 - DNA, 15 bp, Homo sapiens
acctgtaatcccagc

SEQ ID NO: 1699551 - DNA, 20 bp, Homo sapiens
acctgtaatcccagctactt

SEQ ID NO: 1699552 - DNA, 16 bp, Homo sapiens
acctgtacactgactt

SEQ ID NO: 1699553 - DNA, 14 bp, Homo sapiens
acctgtagtcccag

SEQ ID NO: 1699554 - DNA, 15 bp, Homo sapiens
acctgtagtgagaaa

SEQ ID NO: 1699555 - DNA, 20 bp, Homo sapiens
acctgtagtgagaaactgat

SEQ ID NO: 1699556 - DNA, 17 bp, Homo sapiens
acctgtatgtctccagt

SEQ ID NO: 1699557 - DNA, 12 bp, Homo sapiens
acctgtcaatac

SEQ ID NO: 1699558 - DNA, 14 bp, Homo sapiens
acctgtcaatacta

SEQ ID NO: 1699559 - DNA, 19 bp, Homo sapiens
acctgtcatgcccccctca

SEQ ID NO: 1699560 - DNA, 18 bp, Homo sapiens
acctgtcattttgcactg

SEQ ID NO: 1699561 - DNA, 14 bp, Homo sapiens
acctgtcgcccagt

SEQ ID NO: 1699562 - DNA, 16 bp, Homo sapiens
acctgtcgtctctccc

SEQ ID NO: 1699563 - DNA, 23 bp, Homo sapiens
acctgtctataagagaattatat

SEQ ID NO: 1699564 - DNA, 16 bp, Homo sapiens
acctgtcttgaataag

SEQ ID NO: 1699565 - DNA, 15 bp, Homo sapiens
acctgtcttggcctc

SEQ ID NO: 1699566 - DNA, 20 bp, Homo sapiens
acctgtgacaaaggatgaag

SEQ ID NO: 1699567 - DNA, 13 bp, Homo sapiens
acctgtgaccagc

SEQ ID NO: 1699568 - DNA, 14 bp, Homo sapiens
acctgtgaccagca

SEQ ID NO: 1699569 - DNA, 14 bp, Homo sapiens
acctgtgccaggct

SEQ ID NO: 1699570 - DNA, 15 bp, Homo sapiens
acctgtgtgcccagc

SEQ ID NO: 1699571 - DNA, 17 bp, Homo sapiens
acctgtgtgcccagcac

SEQ ID NO: 1699572 - DNA, 19 bp, Homo sapiens
acctgttaaaatgtacact

SEQ ID NO: 1699573 - DNA, 16 bp, Homo sapiens
acctgttacactgggc

SEQ ID NO: 1699574 - DNA, 17 bp, Homo sapiens
acctgttacctactttg

SEQ ID NO: 1699575 - DNA, 14 bp, Homo sapiens
acctgttagctccc

SEQ ID NO: 1699576 - DNA, 15 bp, Homo sapiens
acctgttcacagaaa

SEQ ID NO: 1699577 - DNA, 22 bp, Homo sapiens
acctgttcacagaaaaagcatg

SEQ ID NO: 1699578 - DNA, 19 bp, Homo sapiens
acctgttcagtgtcccggg

SEQ ID NO: 1699579 - DNA, 20 bp, Homo sapiens
acctgttcagtgtcccgggc

SEQ ID NO: 1699580 - DNA, 16 bp, Homo sapiens
acctgttcttgggcct

SEQ ID NO: 1699581 - DNA, 21 bp, Homo sapiens
acctgttcttgggcctcaggc

SEQ ID NO: 1699582 - DNA, 16 bp, Homo sapiens
acctgtttaaatattt

SEQ ID NO: 1699583 - DNA, 15 bp, Homo sapiens
acctgtttaaattgc

SEQ ID NO: 1699584 - DNA, 15 bp, Homo sapiens
acctgttttctgaaa

SEQ ID NO: 1699585 - DNA, 21 bp, Homo sapiens
acctgttttctgaaacacacg

SEQ ID NO: 1699586 - DNA, 21 bp, Homo sapiens
acctgttttctgactagttta

SEQ ID NO: 1699587 - DNA, 13 bp, Homo sapiens
acctgttttgcag

SEQ ID NO: 1699588 - DNA, 14 bp, Homo sapiens
accttaaatgctta

SEQ ID NO: 1699589 - DNA, 22 bp, Homo sapiens
accttaagacctactgttctaa

SEQ ID NO: 1699590 - DNA, 21 bp, Homo sapiens
accttaagtaagcaacagcat

SEQ ID NO: 1699591 - DNA, 19 bp, Homo sapiens
accttaagtaatcatctaa

SEQ ID NO: 1699592 - DNA, 13 bp, Homo sapiens
accttactaatta

SEQ ID NO: 1699593 - DNA, 21 bp, Homo sapiens
accttagaaggtattaagatt

SEQ ID NO: 1699594 - DNA, 16 bp, Homo sapiens
accttagcgttctgga

SEQ ID NO: 1699595 - DNA, 18 bp, Homo sapiens
accttagcgttctggact

SEQ ID NO: 1699596 - DNA, 13 bp, Homo sapiens
accttaggccttc

SEQ ID NO: 1699597 - DNA, 14 bp, Homo sapiens
accttaggccttcc

SEQ ID NO: 1699598 - DNA, 18 bp, Homo sapiens
accttaggccttcctctc

SEQ ID NO: 1699599 - DNA, 18 bp, Homo sapiens
accttaggctttgtatga

SEQ ID NO: 1699600 - DNA, 18 bp, Homo sapiens
accttatagttactgtgt

SEQ ID NO: 1699601 - DNA, 20 bp, Homo sapiens
accttatagttactgtgtaa

SEQ ID NO: 1699602 - DNA, 22 bp, Homo sapiens
accttatagttactgtgtaatt

SEQ ID NO: 1699603 - DNA, 22 bp, Homo sapiens
accttattgtacctctcttata

SEQ ID NO: 1699604 - DNA, 17 bp, Homo sapiens
accttatttatttttgt

SEQ ID NO: 1699605 - DNA, 16 bp, Homo sapiens
accttattttttccca

SEQ ID NO: 1699606 - DNA, 18 bp, Homo sapiens
accttattttttcccaaa

SEQ ID NO: 1699607 - DNA, 17 bp, Homo sapiens
accttcaattcctgggc

SEQ ID NO: 1699608 - DNA, 18 bp, Homo sapiens
accttcacctcggaggga

SEQ ID NO: 1699609 - DNA, 19 bp, Homo sapiens
accttcagttatgattttt

SEQ ID NO: 1699610 - DNA, 20 bp, Homo sapiens
accttcattctgagaccaaa

SEQ ID NO: 1699611 - DNA, 14 bp, Homo sapiens
accttccagctcct

SEQ ID NO: 1699612 - DNA, 17 bp, Homo sapiens
accttccagctcctgta

SEQ ID NO: 1699613 - DNA, 13 bp, Homo sapiens
accttccagggcc

SEQ ID NO: 1699614 - DNA, 14 bp, Homo sapiens
accttcccaaacgc

SEQ ID NO: 1699615 - DNA, 14 bp, Homo sapiens
accttcccacccct

SEQ ID NO: 1699616 - DNA, 12 bp, Homo sapiens
accttcccagct

SEQ ID NO: 1699617 - DNA, 15 bp, Homo sapiens
accttccccagactt

SEQ ID NO: 1699618 - DNA, 22 bp, Homo sapiens
accttccccagacttgcactgg

SEQ ID NO: 1699619 - DNA, 16 bp, Homo sapiens
accttcccgcctcggc

SEQ ID NO: 1699620 - DNA, 22 bp, Homo sapiens
accttcccttctacaaggactc

SEQ ID NO: 1699621 - DNA, 16 bp, Homo sapiens
accttcctcctccccg

SEQ ID NO: 1699622 - DNA, 18 bp, Homo sapiens
accttcctcctccccgct

SEQ ID NO: 1699623 - DNA, 19 bp, Homo sapiens
accttccttccctgggctg

SEQ ID NO: 1699624 - DNA, 16 bp, Homo sapiens
accttccttcctgctt

SEQ ID NO: 1699625 - DNA, 21 bp, Homo sapiens
accttcctttctaaagttttt

SEQ ID NO: 1699626 - DNA, 15 bp, Homo sapiens
accttcgagtagaga

SEQ ID NO: 1699627 - DNA, 14 bp, Homo sapiens
accttcgggctgtg

SEQ ID NO: 1699628 - DNA, 15 bp, Homo sapiens
accttcgggctgtgc

SEQ ID NO: 1699629 - DNA, 17 bp, Homo sapiens
accttcgggctgtgccc

SEQ ID NO: 1699630 - DNA, 18 bp, Homo sapiens
accttcgggctgtgcccg

SEQ ID NO: 1699631 - DNA, 18 bp, Homo sapiens
accttctaaaagccatta

SEQ ID NO: 1699632 - DNA, 21 bp, Homo sapiens
accttctaattggtttttact

SEQ ID NO: 1699633 - DNA, 23 bp, Homo sapiens
acgcagggccatccactgtgacg

SEQ ID NO: 1699634 - DNA, 11 bp, Homo sapiens
acgcaggtgct

SEQ ID NO: 1699635 - DNA, 22 bp, Homo sapiens
acgcatacacacatgccctcct

SEQ ID NO: 1699636 - DNA, 22 bp, Homo sapiens
acgcatagactgaggtataaag

SEQ ID NO: 1699637 - DNA, 22 bp, Homo sapiens
acgcatctcaaaacagagggct

SEQ ID NO: 1699638 - DNA, 14 bp, Homo sapiens
acgccagtctccca

SEQ ID NO: 1699639 - DNA, 15 bp, Homo sapiens
acgccagtctcccag

SEQ ID NO: 1699640 - DNA, 22 bp, Homo sapiens
acgccagtctcccaggccccct

SEQ ID NO: 1699641 - DNA, 15 bp, Homo sapiens
acgccattggttgga

SEQ ID NO: 1699642 - DNA, 19 bp, Homo sapiens
acgccattgtactccagcc

SEQ ID NO: 1699643 - DNA, 21 bp, Homo sapiens
acgccattgtactccagcctg

SEQ ID NO: 1699644 - DNA, 13 bp, Homo sapiens
acgcccagctccg

SEQ ID NO: 1699645 - DNA, 12 bp, Homo sapiens
acgcccaggaca

SEQ ID NO: 1699646 - DNA, 12 bp, Homo sapiens
acgcccctgtgg

SEQ ID NO: 1699647 - DNA, 13 bp, Homo sapiens
acgcccctgtggc

SEQ ID NO: 1699648 - DNA, 16 bp, Homo sapiens
acgcccctgtggccaa

SEQ ID NO: 1699649 - DNA, 17 bp, Homo sapiens
acgcccctgtggccaac

SEQ ID NO: 1699650 - DNA, 16 bp, Homo sapiens
acgccctactccactg

SEQ ID NO: 1699651 - DNA, 24 bp, Homo sapiens
acgccctactccactgccctggca

SEQ ID NO: 1699652 - DNA, 22 bp, Homo sapiens
acgccctatttctatgtcattt

SEQ ID NO: 1699653 - DNA, 20 bp, Homo sapiens
acgccgggagaagccacctt

SEQ ID NO: 1699654 - DNA, 21 bp, Homo sapiens
acgccgggagaagccaccttc

SEQ ID NO: 1699655 - DNA, 18 bp, Homo sapiens
acgccgtaattctttctg

SEQ ID NO: 1699656 - DNA, 23 bp, Homo sapiens
acgccgtaattctttctgtctcc

SEQ ID NO: 1699657 - DNA, 23 bp, Homo sapiens
acgcctgatggtgctgctcaggc

SEQ ID NO: 1699658 - DNA, 12 bp, Homo sapiens
acgcctgcaggc

SEQ ID NO: 1699659 - DNA, 19 bp, Homo sapiens
acgcctgtaatcccagcac

SEQ ID NO: 1699660 - DNA, 19 bp, Homo sapiens
acgcgaggggaaaggcctg

SEQ ID NO: 1699661 - DNA, 21 bp, Homo sapiens
acgcgaggggaaaggcctgtg

SEQ ID NO: 1699662 - DNA, 16 bp, Homo sapiens
acgctaaagagccctt

SEQ ID NO: 1699663 - DNA, 18 bp, Homo sapiens
acgctaaagagcccttgc

SEQ ID NO: 1699664 - DNA, 19 bp, Homo sapiens
acgctaacaatttctcata

SEQ ID NO: 1699665 - DNA, 15 bp, Homo sapiens
acgctacctctctgt

SEQ ID NO: 1699666 - DNA, 20 bp, Homo sapiens
acgctacctctctgtccctt

SEQ ID NO: 1699667 - DNA, 18 bp, Homo sapiens
acgctactataaagagaa

SEQ ID NO: 1699668 - DNA, 16 bp, Homo sapiens
acgctcatgtcctgtc

SEQ ID NO: 1699669 - DNA, 13 bp, Homo sapiens
acgctccctggaa

SEQ ID NO: 1699670 - DNA, 20 bp, Homo sapiens
acgctccgctgccgtgccgc

SEQ ID NO: 1699671 - DNA, 11 bp, Homo sapiens
acgctgcctct

SEQ ID NO: 1699672 - DNA, 15 bp, Homo sapiens
acgctgcctggtctg

SEQ ID NO: 1699673 - DNA, 20 bp, Homo sapiens
acgctgcctggtctgtctgg

SEQ ID NO: 1699674 - DNA, 21 bp, Homo sapiens
acgctgctgtcacaaccaaga

SEQ ID NO: 1699675 - DNA, 12 bp, Homo sapiens
acgctggctact

SEQ ID NO: 1699676 - DNA, 16 bp, Homo sapiens
acgcttactagatgtg

SEQ ID NO: 1699677 - DNA, 20 bp, Homo sapiens
acgcttgtagaactcactct

SEQ ID NO: 1699678 - DNA, 18 bp, Homo sapiens
acgcttgtgacagtgcct

SEQ ID NO: 1699679 - DNA, 17 bp, Homo sapiens
acgctttctagctgttg

SEQ ID NO: 1699680 - DNA, 17 bp, Homo sapiens
acgctttgggagaatgt

SEQ ID NO: 1699681 - DNA, 11 bp, Homo sapiens
acgctttgtca

SEQ ID NO: 1699682 - DNA, 12 bp, Homo sapiens
acggaaaacaat

SEQ ID NO: 1699683 - DNA, 19 bp, Homo sapiens
acggaaaatgcttaaaaaa

SEQ ID NO: 1699684 - DNA, 23 bp, Homo sapiens
acggaagctcatagaggtgagaa

SEQ ID NO: 1699685 - DNA, 16 bp, Homo sapiens
acggacactgtggaga

SEQ ID NO: 1699686 - DNA, 20 bp, Homo sapiens
acggacatccaggcgtggga

SEQ ID NO: 1699687 - DNA, 16 bp, Homo sapiens
acggacgtttccatca

SEQ ID NO: 1699688 - DNA, 14 bp, Homo sapiens
acggagagaaaaaa

SEQ ID NO: 1699689 - DNA, 14 bp, Homo sapiens
acggagatgtttca

SEQ ID NO: 1699690 - DNA, 19 bp, Homo sapiens
acggagcagttcagagtgg

SEQ ID NO: 1699691 - DNA, 15 bp, Homo sapiens
acggagcccagccct

SEQ ID NO: 1699692 - DNA, 23 bp, Homo sapiens
acggaggcaaagctggctcacct

SEQ ID NO: 1699693 - DNA, 20 bp, Homo sapiens
acggaggcctgcgaccctgg

SEQ ID NO: 1699694 - DNA, 13 bp, Homo sapiens
acggagtcttgct

SEQ ID NO: 1699695 - DNA, 21 bp, Homo sapiens
acggatccatgtagcaggact

SEQ ID NO: 1699696 - DNA, 19 bp, Homo sapiens
acggatggtgcatgggctc

SEQ ID NO: 1699697 - DNA, 22 bp, Homo sapiens
acggatggtgcatgggctcgcc

SEQ ID NO: 1699698 - DNA, 20 bp, Homo sapiens
acggcaacgtagcctgggct

SEQ ID NO: 1699699 - DNA, 20 bp, Homo sapiens
acggcaggagtgtcctggct

SEQ ID NO: 1699700 - DNA, 18 bp, Homo sapiens
acggcaggctcactgcca

SEQ ID NO: 1699701 - DNA, 23 bp, Homo sapiens
acggccaagaatgtacgtccagc

SEQ ID NO: 1699702 - DNA, 22 bp, Homo sapiens
acggccaatggtgcttccccca

SEQ ID NO: 1699703 - DNA, 15 bp, Homo sapiens
acggccaccctcctt

SEQ ID NO: 1699704 - DNA, 18 bp, Homo sapiens
acggccagggttgtgctt

SEQ ID NO: 1699705 - DNA, 17 bp, Homo sapiens
acggccccgggtccagg

SEQ ID NO: 1699706 - DNA, 20 bp, Homo sapiens
acggcctgcccagtcgaccc

SEQ ID NO: 1699707 - DNA, 12 bp, Homo sapiens
acggcctggctg

SEQ ID NO: 1699708 - DNA, 17 bp, Homo sapiens
acggcctggctggtggg

SEQ ID NO: 1699709 - DNA, 22 bp, Homo sapiens
acggcgaccaataaacagctcc

SEQ ID NO: 1699710 - DNA, 17 bp, Homo sapiens
acggcgcccccagtgtg

SEQ ID NO: 1699711 - DNA, 17 bp, Homo sapiens
acggcggccaggcacag

SEQ ID NO: 1699712 - DNA, 23 bp, Homo sapiens
acggcgggatcctccacagagag

SEQ ID NO: 1699713 - DNA, 19 bp, Homo sapiens
acggcgttgtacctgtagg

SEQ ID NO: 1699714 - DNA, 16 bp, Homo sapiens
acggctgatgtggact

SEQ ID NO: 1699715 - DNA, 21 bp, Homo sapiens
acggctggtcactctgccctc

SEQ ID NO: 1699716 - DNA, 22 bp, Homo sapiens
acggctggtcactctgccctct

SEQ ID NO: 1699717 - DNA, 21 bp, Homo sapiens
acggctgtgacgcagccggag

SEQ ID NO: 1699718 - DNA, 20 bp, Homo sapiens
acggctgtggaccgtggaca

SEQ ID NO: 1699719 - DNA, 21 bp, Homo sapiens
acggctgttcccctcacccaa

SEQ ID NO: 1699720 - DNA, 16 bp, Homo sapiens
acggcttgctttcctg

SEQ ID NO: 1699721 - DNA, 15 bp, Homo sapiens
acgggactgacgcaa

SEQ ID NO: 1699722 - DNA, 16 bp, Homo sapiens
acgggcagtagctgtg

SEQ ID NO: 1699723 - DNA, 19 bp, Homo sapiens
acgggcgctgcagcctccc

SEQ ID NO: 1699724 - DNA, 13 bp, Homo sapiens
acgggctccttcc

SEQ ID NO: 1699725 - DNA, 12 bp, Homo sapiens
acggggagaaaa

SEQ ID NO: 1699726 - DNA, 15 bp, Homo sapiens
acggggctcttctca

SEQ ID NO: 1699727 - DNA, 12 bp, Homo sapiens
acgggggcagtg

SEQ ID NO: 1699728 - DNA, 14 bp, Homo sapiens
acgggggctgcttc

SEQ ID NO: 1699729 - DNA, 21 bp, Homo sapiens
acgggtgcccgtaatcccagc

SEQ ID NO: 1699730 - DNA, 23 bp, Homo sapiens
acgggtgcccgtaatcccagcta

SEQ ID NO: 1699731 - DNA, 15 bp, Homo sapiens
acgggttgaaagaca

SEQ ID NO: 1699732 - DNA, 19 bp, Homo sapiens
acgggttgaaagacatcaa

SEQ ID NO: 1699733 - DNA, 21 bp, Homo sapiens
acgggttgaaagacatcaatg

SEQ ID NO: 1699734 - DNA, 19 bp, Homo sapiens
acggtgactctgtccagct

SEQ ID NO: 1699735 - DNA, 20 bp, Homo sapiens
acggtgccaagggccccagg

SEQ ID NO: 1699736 - DNA, 23 bp, Homo sapiens
acggtgccaagggccccaggggc

SEQ ID NO: 1699737 - DNA, 18 bp, Homo sapiens
acggtgcgtggctgtggc

SEQ ID NO: 1699738 - DNA, 19 bp, Homo sapiens
acggtgcgtggctgtggca

SEQ ID NO: 1699739 - DNA, 17 bp, Homo sapiens
acggtgttaattttgct

SEQ ID NO: 1699740 - DNA, 15 bp, Homo sapiens
acggttaacttgtat

SEQ ID NO: 1699741 - DNA, 18 bp, Homo sapiens
acggttaacttgtatatt

SEQ ID NO: 1699742 - DNA, 20 bp, Homo sapiens
acggttaacttgtatattcc

SEQ ID NO: 1699743 - DNA, 16 bp, Homo sapiens
acggttcaccagcctc

SEQ ID NO: 1699744 - DNA, 22 bp, Homo sapiens
acggtttttttctttggctgca

SEQ ID NO: 1699745 - DNA, 13 bp, Homo sapiens
acgtaaaacattt

SEQ ID NO: 1699746 - DNA, 21 bp, Homo sapiens
acgtacaaaactctgtataag

SEQ ID NO: 1699747 - DNA, 17 bp, Homo sapiens
actaagcaatttccccc

SEQ ID NO: 1699748 - DNA, 18 bp, Homo sapiens
actaagccctgtcgagac

SEQ ID NO: 1699749 - DNA, 22 bp, Homo sapiens
actaagccctgtcgagacactt

SEQ ID NO: 1699750 - DNA, 18 bp, Homo sapiens
actaagctctctgggcct

SEQ ID NO: 1699751 - DNA, 20 bp, Homo sapiens
actaagctctctgggcctgg

SEQ ID NO: 1699752 - DNA, 17 bp, Homo sapiens
actaagctctttgagaa

SEQ ID NO: 1699753 - DNA, 15 bp, Homo sapiens
actaagtcaggagtg

SEQ ID NO: 1699754 - DNA, 18 bp, Homo sapiens
actaagttatagtatatc

SEQ ID NO: 1699755 - DNA, 13 bp, Homo sapiens
actaagttcacat

SEQ ID NO: 1699756 - DNA, 20 bp, Homo sapiens
actaatatatttaaaaataa

SEQ ID NO: 1699757 - DNA, 18 bp, Homo sapiens
actaatcttgaatgtttg

SEQ ID NO: 1699758 - DNA, 14 bp, Homo sapiens
actaatctttctgc

SEQ ID NO: 1699759 - DNA, 21 bp, Homo sapiens
actaatgagggaaatctgtaa

SEQ ID NO: 1699760 - DNA, 17 bp, Homo sapiens
actaattatactacttt

SEQ ID NO: 1699761 - DNA, 21 bp, Homo sapiens
actaattatactactttgtta

SEQ ID NO: 1699762 - DNA, 22 bp, Homo sapiens
actaattattattttaaaatat

SEQ ID NO: 1699763 - DNA, 18 bp, Homo sapiens
actaatttaaagatgctg

SEQ ID NO: 1699764 - DNA, 21 bp, Homo sapiens
actaattttagtattcattct

SEQ ID NO: 1699765 - DNA, 16 bp, Homo sapiens
actacaaaatttgaaa

SEQ ID NO: 1699766 - DNA, 21 bp, Homo sapiens
actacaaacaaaatttctatt

SEQ ID NO: 1699767 - DNA, 22 bp, Homo sapiens
actacaaacaaaatttctatta

SEQ ID NO: 1699768 - DNA, 16 bp, Homo sapiens
actacaaagctttgct

SEQ ID NO: 1699769 - DNA, 18 bp, Homo sapiens
actacaatatgtacattt

SEQ ID NO: 1699770 - DNA, 11 bp, Homo sapiens
actacacaata

SEQ ID NO: 1699771 - DNA, 17 bp, Homo sapiens
actacacaatacagtat

SEQ ID NO: 1699772 - DNA, 19 bp, Homo sapiens
actacacaatacagtatta

SEQ ID NO: 1699773 - DNA, 13 bp, Homo sapiens
actacacacagta

SEQ ID NO: 1699774 - DNA, 14 bp, Homo sapiens
actacacatttgaa

SEQ ID NO: 1699775 - DNA, 23 bp, Homo sapiens
actacaccatgtttgagctcaga

SEQ ID NO: 1699776 - DNA, 19 bp, Homo sapiens
actacactcaactaatttt

SEQ ID NO: 1699777 - DNA, 20 bp, Homo sapiens
actacactccagcctgagca

SEQ ID NO: 1699778 - DNA, 15 bp, Homo sapiens
actacagaataatgt

SEQ ID NO: 1699779 - DNA, 19 bp, Homo sapiens
actacagctatatttgatt

SEQ ID NO: 1699780 - DNA, 20 bp, Homo sapiens
actacaggcacacaccacca

SEQ ID NO: 1699781 - DNA, 15 bp, Homo sapiens
actacattttaaaaa

SEQ ID NO: 1699782 - DNA, 23 bp, Homo sapiens
actaccaaacactcagtccactg

SEQ ID NO: 1699783 - DNA, 16 bp, Homo sapiens
actaccaatcccaact

SEQ ID NO: 1699784 - DNA, 13 bp, Homo sapiens
actaccacaagga

SEQ ID NO: 1699785 - DNA, 14 bp, Homo sapiens
actaccagccagcc

SEQ ID NO: 1699786 - DNA, 22 bp, Homo sapiens
actacccaggttaagaaaataa

SEQ ID NO: 1699787 - DNA, 15 bp, Homo sapiens
actacccatagacat

SEQ ID NO: 1699788 - DNA, 19 bp, Homo sapiens
actacccatagacatgaaa

SEQ ID NO: 1699789 - DNA, 20 bp, Homo sapiens
actacccgagcccagctaca

SEQ ID NO: 1699790 - DNA, 14 bp, Homo sapiens
actacccttctcct

SEQ ID NO: 1699791 - DNA, 15 bp, Homo sapiens
actacccttctcctt

SEQ ID NO: 1699792 - DNA, 16 bp, Homo sapiens
actacccttctccttt

SEQ ID NO: 1699793 - DNA, 23 bp, Homo sapiens
actacccttctcctttccttccc

SEQ ID NO: 1699794 - DNA, 15 bp, Homo sapiens
actaccgcaggcccg

SEQ ID NO: 1699795 - DNA, 16 bp, Homo sapiens
actacctagaagtaag

SEQ ID NO: 1699796 - DNA, 21 bp, Homo sapiens
actacctagaagtaagaagag

SEQ ID NO: 1699797 - DNA, 12 bp, Homo sapiens
actacctcctca

SEQ ID NO: 1699798 - DNA, 21 bp, Homo sapiens
actaccttccactctggaacc

SEQ ID NO: 1699799 - DNA, 14 bp, Homo sapiens
actacgtgccagct

SEQ ID NO: 1699800 - DNA, 21 bp, Homo sapiens
actactcatacttaagcaaaa

SEQ ID NO: 1699801 - DNA, 16 bp, Homo sapiens
actactcctaattatt

SEQ ID NO: 1699802 - DNA, 21 bp, Homo sapiens
actactgaataatgctaccag

SEQ ID NO: 1699803 - DNA, 23 bp, Homo sapiens
actactgacatgtggggccaggt

SEQ ID NO: 1699804 - DNA, 12 bp, Homo sapiens
actactgcagca

SEQ ID NO: 1699805 - DNA, 17 bp, Homo sapiens
actactgctcctgtggc

SEQ ID NO: 1699806 - DNA, 23 bp, Homo sapiens
actactgctcctgtggcaggagg

SEQ ID NO: 1699807 - DNA, 12 bp, Homo sapiens
actactttataa

SEQ ID NO: 1699808 - DNA, 13 bp, Homo sapiens
actactttgcctt

SEQ ID NO: 1699809 - DNA, 15 bp, Homo sapiens
actactttttatact

SEQ ID NO: 1699810 - DNA, 23 bp, Homo sapiens
actactttttatactccatacat

SEQ ID NO: 1699811 - DNA, 15 bp, Homo sapiens
actagaaatctgcca

SEQ ID NO: 1699812 - DNA, 18 bp, Homo sapiens
actagaagatgaatacaa

SEQ ID NO: 1699813 - DNA, 17 bp, Homo sapiens
actagaaggcttctctc

SEQ ID NO: 1699814 - DNA, 21 bp, Homo sapiens
actagaaggcttctctccaca

SEQ ID NO: 1699815 - DNA, 14 bp, Homo sapiens
actagaagggccag

SEQ ID NO: 1699816 - DNA, 20 bp, Homo sapiens
actagaattctagtgctgct

SEQ ID NO: 1699817 - DNA, 14 bp, Homo sapiens
actagagatattct

SEQ ID NO: 1699818 - DNA, 15 bp, Homo sapiens
actagagctttcttt

SEQ ID NO: 1699819 - DNA, 14 bp, Homo sapiens
actagaggcaggga

SEQ ID NO: 1699820 - DNA, 16 bp, Homo sapiens
actagaggcagggagg

SEQ ID NO: 1699821 - DNA, 11 bp, Homo sapiens
actagagggcc

SEQ ID NO: 1699822 - DNA, 21 bp, Homo sapiens
actagaggtgttacagaggac

SEQ ID NO: 1699823 - DNA, 22 bp, Homo sapiens
actagataacatacttcttact

SEQ ID NO: 1699824 - DNA, 20 bp, Homo sapiens
actagatcaaggagcccaga

SEQ ID NO: 1699825 - DNA, 20 bp, Homo sapiens
actagatggacctgcctgca

SEQ ID NO: 1699826 - DNA, 12 bp, Homo sapiens
actagatgtagt

SEQ ID NO: 1699827 - DNA, 13 bp, Homo sapiens
actagcagctgca

SEQ ID NO: 1699828 - DNA, 19 bp, Homo sapiens
actagcatacttaaaatat

SEQ ID NO: 1699829 - DNA, 17 bp, Homo sapiens
actagcattacattatt

SEQ ID NO: 1699830 - DNA, 18 bp, Homo sapiens
actagccaaaccaggacc

SEQ ID NO: 1699831 - DNA, 16 bp, Homo sapiens
actagccaaggctagt

SEQ ID NO: 1699832 - DNA, 15 bp, Homo sapiens
actagcccaatgaaa

SEQ ID NO: 1699833 - DNA, 17 bp, Homo sapiens
actaggactctgaggct

SEQ ID NO: 1699834 - DNA, 17 bp, Homo sapiens
actaggatacagaaatg

SEQ ID NO: 1699835 - DNA, 21 bp, Homo sapiens
actaggatacagaaatgcaaa

SEQ ID NO: 1699836 - DNA, 17 bp, Homo sapiens
actaggatcccactggc

SEQ ID NO: 1699837 - DNA, 18 bp, Homo sapiens
actaggcccccacttgcc

SEQ ID NO: 1699838 - DNA, 20 bp, Homo sapiens
actaggcccccacttgcctc

SEQ ID NO: 1699839 - DNA, 22 bp, Homo sapiens
actaggcccccacttgcctctt

SEQ ID NO: 1699840 - DNA, 22 bp, Homo sapiens
actaggctcttatgtgtgcctt

SEQ ID NO: 1699841 - DNA, 16 bp, Homo sapiens
actagggattcaggct

SEQ ID NO: 1699842 - DNA, 13 bp, Homo sapiens
actaggtaaaatt

SEQ ID NO: 1699843 - DNA, 13 bp, Homo sapiens
actaggtgccttt

SEQ ID NO: 1699844 - DNA, 19 bp, Homo sapiens
actaggtgtccccaacgtc

SEQ ID NO: 1699845 - DNA, 18 bp, Homo sapiens
actaggttggacagcccc

SEQ ID NO: 1699846 - DNA, 16 bp, Homo sapiens
actaggtttttgcttc

SEQ ID NO: 1699847 - DNA, 19 bp, Homo sapiens
actagtaataccaaagact

SEQ ID NO: 1699848 - DNA, 15 bp, Homo sapiens
actagtgacagcttg

SEQ ID NO: 1699849 - DNA, 17 bp, Homo sapiens
actagtgagtcagcacc

SEQ ID NO: 1699850 - DNA, 20 bp, Homo sapiens
actagtgagtcagcaccttg

SEQ ID NO: 1699851 - DNA, 22 bp, Homo sapiens
actagtgagtcagcaccttggc

SEQ ID NO: 1699852 - DNA, 23 bp, Homo sapiens
actagtgtacatttctataaata

SEQ ID NO: 1699853 - DNA, 17 bp, Homo sapiens
actagttttagttttct

SEQ ID NO: 1699854 - DNA, 17 bp, Homo sapiens
actagttttgtgccagc

SEQ ID NO: 1699855 - DNA, 20 bp, Homo sapiens
actataaacttaagggcaag

SEQ ID NO: 1699856 - DNA, 14 bp, Homo sapiens
actataaagagaag

SEQ ID NO: 1699857 - DNA, 20 bp, Homo sapiens
actataaagttttatttgaa

SEQ ID NO: 1699858 - DNA, 17 bp, Homo sapiens
actataaggtgcctcag

SEQ ID NO: 1699859 - DNA, 13 bp, Homo sapiens
actataagtagtt

SEQ ID NO: 1699860 - DNA, 12 bp, Homo sapiens
actataatttga

SEQ ID NO: 1699861 - DNA, 13 bp, Homo sapiens
actcactctgggc

SEQ ID NO: 1699862 - DNA, 14 bp, Homo sapiens
actcactctgggct

SEQ ID NO: 1699863 - DNA, 16 bp, Homo sapiens
actcactctgggctgt

SEQ ID NO: 1699864 - DNA, 12 bp, Homo sapiens
actcactgccta

SEQ ID NO: 1699865 - DNA, 13 bp, Homo sapiens
actcactgcctag

SEQ ID NO: 1699866 - DNA, 15 bp, Homo sapiens
actcactgcctagga

SEQ ID NO: 1699867 - DNA, 15 bp, Homo sapiens
actcactgctcaaga

SEQ ID NO: 1699868 - DNA, 22 bp, Homo sapiens
actcacttgatgtttcctggaa

SEQ ID NO: 1699869 - DNA, 21 bp, Homo sapiens
actcactttcccttgtgtcaa

SEQ ID NO: 1699870 - DNA, 14 bp, Homo sapiens
actcagaaacatca

SEQ ID NO: 1699871 - DNA, 13 bp, Homo sapiens
actcagaaattca

SEQ ID NO: 1699872 - DNA, 21 bp, Homo sapiens
actcagaaatttaattcatgt

SEQ ID NO: 1699873 - DNA, 14 bp, Homo sapiens
actcagaaattttt

SEQ ID NO: 1699874 - DNA, 18 bp, Homo sapiens
actcagaattatttttaa

SEQ ID NO: 1699875 - DNA, 20 bp, Homo sapiens
actcagacgtgtgacctcca

SEQ ID NO: 1699876 - DNA, 11 bp, Homo sapiens
actcagagcag

SEQ ID NO: 1699877 - DNA, 11 bp, Homo sapiens
actcagatcca

SEQ ID NO: 1699878 - DNA, 12 bp, Homo sapiens
actcagatccag

SEQ ID NO: 1699879 - DNA, 23 bp, Homo sapiens
actcagatctgatcaagagtccg

SEQ ID NO: 1699880 - DNA, 19 bp, Homo sapiens
actcagatttaagccttac

SEQ ID NO: 1699881 - DNA, 14 bp, Homo sapiens
actcagcagccctc

SEQ ID NO: 1699882 - DNA, 17 bp, Homo sapiens
actcagcagccctcctc

SEQ ID NO: 1699883 - DNA, 14 bp, Homo sapiens
actcagcagtgacc

SEQ ID NO: 1699884 - DNA, 22 bp, Homo sapiens
actcagcatttgattaacattt

SEQ ID NO: 1699885 - DNA, 17 bp, Homo sapiens
actcagccaccctgagt

SEQ ID NO: 1699886 - DNA, 21 bp, Homo sapiens
actcagccatttccccctcct

SEQ ID NO: 1699887 - DNA, 23 bp, Homo sapiens
actcagccatttccccctcctca

SEQ ID NO: 1699888 - DNA, 12 bp, Homo sapiens
actcagcccagc

SEQ ID NO: 1699889 - DNA, 13 bp, Homo sapiens
actcagcccagct

SEQ ID NO: 1699890 - DNA, 15 bp, Homo sapiens
actcagccctgaggt

SEQ ID NO: 1699891 - DNA, 12 bp, Homo sapiens
actcagccctgg

SEQ ID NO: 1699892 - DNA, 21 bp, Homo sapiens
actcagccctgggccccacca

SEQ ID NO: 1699893 - DNA, 11 bp, Homo sapiens
actcagccttc

SEQ ID NO: 1699894 - DNA, 20 bp, Homo sapiens
actcagctattaagaaaatc

SEQ ID NO: 1699895 - DNA, 20 bp, Homo sapiens
actcagctgagaaggccagc

SEQ ID NO: 1699896 - DNA, 14 bp, Homo sapiens
actcagctgtcctg

SEQ ID NO: 1699897 - DNA, 17 bp, Homo sapiens
actcagctgtcctgcag

SEQ ID NO: 1699898 - DNA, 19 bp, Homo sapiens
actcaggaggctgaggcag

SEQ ID NO: 1699899 - DNA, 18 bp, Homo sapiens
actcaggaggctgagggg

SEQ ID NO: 1699900 - DNA, 14 bp, Homo sapiens
actcaggatgccca

SEQ ID NO: 1699901 - DNA, 15 bp, Homo sapiens
actcaggatgcccag

SEQ ID NO: 1699902 - DNA, 22 bp, Homo sapiens
actcaggatttaaaaactggaa

SEQ ID NO: 1699903 - DNA, 14 bp, Homo sapiens
actcaggcccagaa

SEQ ID NO: 1699904 - DNA, 23 bp, Homo sapiens
actcaggcctctgcagaagccaa

SEQ ID NO: 1699905 - DNA, 23 bp, Homo sapiens
actcaggctttcactatttcctt

SEQ ID NO: 1699906 - DNA, 17 bp, Homo sapiens
actcagggaccggtgct

SEQ ID NO: 1699907 - DNA, 23 bp, Homo sapiens
actcagggaccggtgctgcagga

SEQ ID NO: 1699908 - DNA, 14 bp, Homo sapiens
actcagggccccag

SEQ ID NO: 1699909 - DNA, 15 bp, Homo sapiens
actcagggccccagc

SEQ ID NO: 1699910 - DNA, 18 bp, Homo sapiens
actcagggccccagcact

SEQ ID NO: 1699911 - DNA, 14 bp, Homo sapiens
actcaggttccaga

SEQ ID NO: 1699912 - DNA, 23 bp, Homo sapiens
actcaggttccagaacagccctc

SEQ ID NO: 1699913 - DNA, 20 bp, Homo sapiens
actcagtatgctttccctga

SEQ ID NO: 1699914 - DNA, 19 bp, Homo sapiens
actcagtctctcttctctc

SEQ ID NO: 1699915 - DNA, 11 bp, Homo sapiens
actcagtgagc

SEQ ID NO: 1699916 - DNA, 16 bp, Homo sapiens
actcagtggggctggc

SEQ ID NO: 1699917 - DNA, 23 bp, Homo sapiens
actcagtgtgtgatccggtttct

SEQ ID NO: 1699918 - DNA, 22 bp, Homo sapiens
actcagttttaactagaattta

SEQ ID NO: 1699919 - DNA, 21 bp, Homo sapiens
actcataaaaagcctgcaatt

SEQ ID NO: 1699920 - DNA, 23 bp, Homo sapiens
actcataagttggaccagaggaa

SEQ ID NO: 1699921 - DNA, 18 bp, Homo sapiens
actcatagccacttttat

SEQ ID NO: 1699922 - DNA, 13 bp, Homo sapiens
actcatagttttt

SEQ ID NO: 1699923 - DNA, 20 bp, Homo sapiens
actcatattctgggctcctg

SEQ ID NO: 1699924 - DNA, 9 bp, Homo sapiens
actcatcat

SEQ ID NO: 1699925 - DNA, 13 bp, Homo sapiens
actcatcataaaa

SEQ ID NO: 1699926 - DNA, 23 bp, Homo sapiens
actcatcctcttttaatggcatt

SEQ ID NO: 1699927 - DNA, 13 bp, Homo sapiens
actcatctgttat

SEQ ID NO: 1699928 - DNA, 23 bp, Homo sapiens
actcatctgttatcctgctagct

SEQ ID NO: 1699929 - DNA, 19 bp, Homo sapiens
actcatggcagctgtttct

SEQ ID NO: 1699930 - DNA, 21 bp, Homo sapiens
actcatgtgcaataggtgaga

SEQ ID NO: 1699931 - DNA, 21 bp, Homo sapiens
actcattctcttcttgctata

SEQ ID NO: 1699932 - DNA, 15 bp, Homo sapiens
actcattctgaatta

SEQ ID NO: 1699933 - DNA, 15 bp, Homo sapiens
actcattgctgagcc

SEQ ID NO: 1699934 - DNA, 22 bp, Homo sapiens
actcatttgttaaaattatcaa

SEQ ID NO: 1699935 - DNA, 14 bp, Homo sapiens
actccaaacctgtc

SEQ ID NO: 1699936 - DNA, 14 bp, Homo sapiens
actccaaagaaatg

SEQ ID NO: 1699937 - DNA, 15 bp, Homo sapiens
actccaaagaaatgt

SEQ ID NO: 1699938 - DNA, 18 bp, Homo sapiens
actccaaggagctactga

SEQ ID NO: 1699939 - DNA, 22 bp, Homo sapiens
actccacaccttttatgaatca

SEQ ID NO: 1699940 - DNA, 20 bp, Homo sapiens
actccacagcggaggagacc

SEQ ID NO: 1699941 - DNA, 14 bp, Homo sapiens
actccacatctgcc

SEQ ID NO: 1699942 - DNA, 16 bp, Homo sapiens
actccacatctgcctt

SEQ ID NO: 1699943 - DNA, 17 bp, Homo sapiens
actccacatctgcctta

SEQ ID NO: 1699944 - DNA, 13 bp, Homo sapiens
actccaccaccca

SEQ ID NO: 1699945 - DNA, 16 bp, Homo sapiens
actccaccctccacct

SEQ ID NO: 1699946 - DNA, 17 bp, Homo sapiens
actccaccgaccaactg

SEQ ID NO: 1699947 - DNA, 21 bp, Homo sapiens
actccaccgaccaactgccct

SEQ ID NO: 1699948 - DNA, 22 bp, Homo sapiens
actccaccgaccaactgcccta

SEQ ID NO: 1699949 - DNA, 13 bp, Homo sapiens
actccaccttccc

SEQ ID NO: 1699950 - DNA, 14 bp, Homo sapiens
actccactcccagc

SEQ ID NO: 1699951 - DNA, 14 bp, Homo sapiens
actccactctcctt

SEQ ID NO: 1699952 - DNA, 16 bp, Homo sapiens
actccactctccttcg

SEQ ID NO: 1699953 - DNA, 23 bp, Homo sapiens
actccactctccttcgtgtctct

SEQ ID NO: 1699954 - DNA, 13 bp, Homo sapiens
actccactctgat

SEQ ID NO: 1699955 - DNA, 22 bp, Homo sapiens
actccactctgattcacctctt

SEQ ID NO: 1699956 - DNA, 13 bp, Homo sapiens
actccactgccct

SEQ ID NO: 1699957 - DNA, 17 bp, Homo sapiens
actccactgccctggca

SEQ ID NO: 1699958 - DNA, 22 bp, Homo sapiens
actccactgccctggcagcagc

SEQ ID NO: 1699959 - DNA, 19 bp, Homo sapiens
actccagacccctggcttt

SEQ ID NO: 1699960 - DNA, 17 bp, Homo sapiens
actccagagtctgagcc

SEQ ID NO: 1699961 - DNA, 17 bp, Homo sapiens
actccagatagagaaat

SEQ ID NO: 1699962 - DNA, 12 bp, Homo sapiens
actccagccctg

SEQ ID NO: 1699963 - DNA, 14 bp, Homo sapiens
actccagcctgagc

SEQ ID NO: 1699964 - DNA, 20 bp, Homo sapiens
actccagcctgagcaacaga

SEQ ID NO: 1699965 - DNA, 12 bp, Homo sapiens
actccagcctgg

SEQ ID NO: 1699966 - DNA, 14 bp, Homo sapiens
actccagcctgggc

SEQ ID NO: 1699967 - DNA, 15 bp, Homo sapiens
actccagcctgggca

SEQ ID NO: 1699968 - DNA, 23 bp, Homo sapiens
actccagcctgggcgacaaaaac

SEQ ID NO: 1699969 - DNA, 20 bp, Homo sapiens
actccagcctgggcgacaga

SEQ ID NO: 1699970 - DNA, 15 bp, Homo sapiens
actccagcctgggga

SEQ ID NO: 1699971 - DNA, 19 bp, Homo sapiens
actccagcctgggtcacag

SEQ ID NO: 1699972 - DNA, 23 bp, Homo sapiens
actccaggatttaggccttaaca

SEQ ID NO: 1699973 - DNA, 15 bp, Homo sapiens
actccaggccctcct

SEQ ID NO: 1699974 - DNA, 16 bp, Homo sapiens
actccaggcctgacca

SEQ ID NO: 1699975 - DNA, 21 bp, Homo sapiens
actccagtgctcagctgtggc

SEQ ID NO: 1699976 - DNA, 15 bp, Homo sapiens
attaatggcactgat

SEQ ID NO: 1699977 - DNA, 18 bp, Homo sapiens
attaatgttaattcagca

SEQ ID NO: 1699978 - DNA, 20 bp, Homo sapiens
attaatgtttctatctgatt

SEQ ID NO: 1699979 - DNA, 14 bp, Homo sapiens
actgaaagcagcag

SEQ ID NO: 1699980 - DNA, 15 bp, Homo sapiens
actgaaagcagcagc

SEQ ID NO: 1699981 - DNA, 20 bp, Homo sapiens
actgaaagccttagggaagc

SEQ ID NO: 1699982 - DNA, 17 bp, Homo sapiens
actgaaaggaaaaatgt

SEQ ID NO: 1699983 - DNA, 21 bp, Homo sapiens
actgaaaggtgattgcagctt

SEQ ID NO: 1699984 - DNA, 17 bp, Homo sapiens
actgaaagttttgtaaa

SEQ ID NO: 1699985 - DNA, 19 bp, Homo sapiens
actgaacaccattgaaggc

SEQ ID NO: 1699986 - DNA, 21 bp, Homo sapiens
actgaacaccattgaaggctt

SEQ ID NO: 1699987 - DNA, 15 bp, Homo sapiens
actgaacatgtttac

SEQ ID NO: 1699988 - DNA, 23 bp, Homo sapiens
actgaaccttaggctttgtatga

SEQ ID NO: 1699989 - DNA, 14 bp, Homo sapiens
actgaactccatcg

SEQ ID NO: 1699990 - DNA, 18 bp, Homo sapiens
actgaagaagatgagcct

SEQ ID NO: 1699991 - DNA, 21 bp, Homo sapiens
actgaagcagcctctccccag

SEQ ID NO: 1699992 - DNA, 21 bp, Homo sapiens
actgaagccggacagctgccc

SEQ ID NO: 1699993 - DNA, 15 bp, Homo sapiens
actgaagcctgcagg

SEQ ID NO: 1699994 - DNA, 18 bp, Homo sapiens
actgaaggaaaaacacaa

SEQ ID NO: 1699995 - DNA, 23 bp, Homo sapiens
actgaaggaaaagcaagaaacag

SEQ ID NO: 1699996 - DNA, 13 bp, Homo sapiens
actgaaggagaag

SEQ ID NO: 1699997 - DNA, 14 bp, Homo sapiens
actgaaggagaagg

SEQ ID NO: 1699998 - DNA, 20 bp, Homo sapiens
actgaaggggcacaccactg

SEQ ID NO: 1699999 - DNA, 22 bp, Homo sapiens
actgaaggggtgcacccacctg

SEQ ID NO: 1700000 - DNA, 16 bp, Homo sapiens
actgaaggtgattcac

SEQ ID NO: 1700001 - DNA, 19 bp, Homo sapiens
actgaagtcttttctgtca

SEQ ID NO: 1700002 - DNA, 15 bp, Homo sapiens
actgaagtggctggt

SEQ ID NO: 1700003 - DNA, 18 bp, Homo sapiens
actgaataatatcaaata

SEQ ID NO: 1700004 - DNA, 21 bp, Homo sapiens
actgaatctcccctcctcaca

SEQ ID NO: 1700005 - DNA, 14 bp, Homo sapiens
actgaatcttcacg

SEQ ID NO: 1700006 - DNA, 21 bp, Homo sapiens
actgaatgaagcagtattttg

SEQ ID NO: 1700007 - DNA, 12 bp, Homo sapiens
actgaatgaggt

SEQ ID NO: 1700008 - DNA, 20 bp, Homo sapiens
actgaatgaggtcagcatgt

SEQ ID NO: 1700009 - DNA, 18 bp, Homo sapiens
actgaatgtcaagaaaag

SEQ ID NO: 1700010 - DNA, 13 bp, Homo sapiens
actgaatgtgttt

SEQ ID NO: 1700011 - DNA, 22 bp, Homo sapiens
actgaattaatgacagagccag

SEQ ID NO: 1700012 - DNA, 19 bp, Homo sapiens
actgaattgtatcaatttg

SEQ ID NO: 1700013 - DNA, 13 bp, Homo sapiens
actgaatttggag

SEQ ID NO: 1700014 - DNA, 18 bp, Homo sapiens
actgaattttgggacttc

SEQ ID NO: 1700015 - DNA, 16 bp, Homo sapiens
actgaatttttttgta

SEQ ID NO: 1700016 - DNA, 20 bp, Homo sapiens
actgaatttttttgtaataa

SEQ ID NO: 1700017 - DNA, 15 bp, Homo sapiens
actgacaaacgtccc

SEQ ID NO: 1700018 - DNA, 19 bp, Homo sapiens
actgacaatgaagggaaat

SEQ ID NO: 1700019 - DNA, 13 bp, Homo sapiens
actgacacaggaa

SEQ ID NO: 1700020 - DNA, 14 bp, Homo sapiens
actgacaccctggt

SEQ ID NO: 1700021 - DNA, 19 bp, Homo sapiens
actgacagaggctcactga

SEQ ID NO: 1700022 - DNA, 16 bp, Homo sapiens
actgacagatttccat

SEQ ID NO: 1700023 - DNA, 18 bp, Homo sapiens
actgacagcctcccaccc

SEQ ID NO: 1700024 - DNA, 16 bp, Homo sapiens
actgacataggcttca

SEQ ID NO: 1700025 - DNA, 22 bp, Homo sapiens
actgacatgtggggccaggtca

SEQ ID NO: 1700026 - DNA, 21 bp, Homo sapiens
actgacattcctaagagtgga

SEQ ID NO: 1700027 - DNA, 15 bp, Homo sapiens
actgacatttcttct

SEQ ID NO: 1700028 - DNA, 16 bp, Homo sapiens
actgaccaaagactgc

SEQ ID NO: 1700029 - DNA, 18 bp, Homo sapiens
actgaccaaagactgcag

SEQ ID NO: 1700030 - DNA, 19 bp, Homo sapiens
actgaccaaagactgcaga

SEQ ID NO: 1700031 - DNA, 15 bp, Homo sapiens
actgaccagcggctg

SEQ ID NO: 1700032 - DNA, 22 bp, Homo sapiens
actgaccatccactctaccctc

SEQ ID NO: 1700033 - DNA, 13 bp, Homo sapiens
actgacccttcca

SEQ ID NO: 1700034 - DNA, 15 bp, Homo sapiens
actgacccttccaga

SEQ ID NO: 1700035 - DNA, 19 bp, Homo sapiens
actgacccttccagacata

SEQ ID NO: 1700036 - DNA, 21 bp, Homo sapiens
actgaccttggagagacacag

SEQ ID NO: 1700037 - DNA, 22 bp, Homo sapiens
actgaccttggagagacacagc

SEQ ID NO: 1700038 - DNA, 15 bp, Homo sapiens
actgacgtcctccct

SEQ ID NO: 1700039 - DNA, 16 bp, Homo sapiens
actgacgtttctgggc

SEQ ID NO: 1700040 - DNA, 23 bp, Homo sapiens
actgacgtttctgggcggccagt

SEQ ID NO: 1700041 - DNA, 18 bp, Homo sapiens
actgactattcttgatgt

SEQ ID NO: 1700042 - DNA, 14 bp, Homo sapiens
actgactccttaga

SEQ ID NO: 1700043 - DNA, 22 bp, Homo sapiens
actgactgaatgctgttaatat

SEQ ID NO: 1700044 - DNA, 13 bp, Homo sapiens
actgactgagata

SEQ ID NO: 1700045 - DNA, 13 bp, Homo sapiens
actgactgcagcc

SEQ ID NO: 1700046 - DNA, 16 bp, Homo sapiens
actgactgcagccccc

SEQ ID NO: 1700047 - DNA, 15 bp, Homo sapiens
actgactgcagggac

SEQ ID NO: 1700048 - DNA, 13 bp, Homo sapiens
actgactgtgttg

SEQ ID NO: 1700049 - DNA, 13 bp, Homo sapiens
actgacttgctgt

SEQ ID NO: 1700050 - DNA, 20 bp, Homo sapiens
actgacttggatcccaaagc

SEQ ID NO: 1700051 - DNA, 22 bp, Homo sapiens
actgacttggatcccaaagcaa

SEQ ID NO: 1700052 - DNA, 23 bp, Homo sapiens
actgacttggatcccaaagcaag

SEQ ID NO: 1700053 - DNA, 13 bp, Homo sapiens
actgactttgctt

SEQ ID NO: 1700054 - DNA, 15 bp, Homo sapiens
actgagactttcccc

SEQ ID NO: 1700055 - DNA, 12 bp, Homo sapiens
actgagaggcct

SEQ ID NO: 1700056 - DNA, 13 bp, Homo sapiens
actgagataagaa

SEQ ID NO: 1700057 - DNA, 16 bp, Homo sapiens
actgagataagaaaag

SEQ ID NO: 1700058 - DNA, 19 bp, Homo sapiens
actgagataagaaaagcct

SEQ ID NO: 1700059 - DNA, 17 bp, Homo sapiens
actgagatgtgaacaca

SEQ ID NO: 1700060 - DNA, 20 bp, Homo sapiens
actctccattagaaaatttt

SEQ ID NO: 1700061 - DNA, 14 bp, Homo sapiens
actctcccaggcct

SEQ ID NO: 1700062 - DNA, 21 bp, Homo sapiens
actctccccacgagggctggc

SEQ ID NO: 1700063 - DNA, 10 bp, Homo sapiens
actctccccc

SEQ ID NO: 1700064 - DNA, 14 bp, Homo sapiens
actctcccccaccc

SEQ ID NO: 1700065 - DNA, 18 bp, Homo sapiens
actctccccctttcaagg

SEQ ID NO: 1700066 - DNA, 15 bp, Homo sapiens
actctccccgctcag

SEQ ID NO: 1700067 - DNA, 23 bp, Homo sapiens
actctccccgctcaggggcctgg

SEQ ID NO: 1700068 - DNA, 22 bp, Homo sapiens
actctcctcccctccctcagag

SEQ ID NO: 1700069 - DNA, 20 bp, Homo sapiens
actctcctcctcccctcctc

SEQ ID NO: 1700070 - DNA, 23 bp, Homo sapiens
actctccttcgtgtctctcccac

SEQ ID NO: 1700071 - DNA, 18 bp, Homo sapiens
actctcctttgtgtggct

SEQ ID NO: 1700072 - DNA, 22 bp, Homo sapiens
actctcggggcccttggggcct

SEQ ID NO: 1700073 - DNA, 14 bp, Homo sapiens
actctctccctggt

SEQ ID NO: 1700074 - DNA, 17 bp, Homo sapiens
actctctccgatttgct

SEQ ID NO: 1700075 - DNA, 13 bp, Homo sapiens
actctctgctcta

SEQ ID NO: 1700076 - DNA, 16 bp, Homo sapiens
actctctgctctagcc

SEQ ID NO: 1700077 - DNA, 18 bp, Homo sapiens
actctctgctctagccag

SEQ ID NO: 1700078 - DNA, 24 bp, Homo sapiens
actctctgctctagccaggagtct

SEQ ID NO: 1700079 - DNA, 17 bp, Homo sapiens
actctctgggactctcc

SEQ ID NO: 1700080 - DNA, 18 bp, Homo sapiens
actctctgggactctcct

SEQ ID NO: 1700081 - DNA, 12 bp, Homo sapiens
actctctttcct

SEQ ID NO: 1700082 - DNA, 10 bp, Homo sapiens
actctgaaaa

SEQ ID NO: 1700083 - DNA, 17 bp, Homo sapiens
actctgaaatctgaaga

SEQ ID NO: 1700084 - DNA, 22 bp, Homo sapiens
actctgaagctaattgtactaa

SEQ ID NO: 1700085 - DNA, 15 bp, Homo sapiens
actctgaatttatct

SEQ ID NO: 1700086 - DNA, 17 bp, Homo sapiens
actctgaatttatcttt

SEQ ID NO: 1700087 - DNA, 14 bp, Homo sapiens
actctgacaagggc

SEQ ID NO: 1700088 - DNA, 12 bp, Homo sapiens
actctgagccca

SEQ ID NO: 1700089 - DNA, 16 bp, Homo sapiens
actctgagcccaggcc

SEQ ID NO: 1700090 - DNA, 18 bp, Homo sapiens
actctgagcccaggccgt

SEQ ID NO: 1700091 - DNA, 21 bp, Homo sapiens
actctgaggctctttctgggc

SEQ ID NO: 1700092 - DNA, 22 bp, Homo sapiens
actctgagtaactggttgctgt

SEQ ID NO: 1700093 - DNA, 17 bp, Homo sapiens
actctgattcacctctt

SEQ ID NO: 1700094 - DNA, 20 bp, Homo sapiens
actctgattcacctcttcct

SEQ ID NO: 1700095 - DNA, 21 bp, Homo sapiens
actctgcacatgtcttgtaca

SEQ ID NO: 1700096 - DNA, 14 bp, Homo sapiens
actctgcactactc

SEQ ID NO: 1700097 - DNA, 22 bp, Homo sapiens
actctgcactccatggccaccc

SEQ ID NO: 1700098 - DNA, 23 bp, Homo sapiens
actctgcactccatggccacccc

SEQ ID NO: 1700099 - DNA, 14 bp, Homo sapiens
actctgcatgtaga

SEQ ID NO: 1700100 - DNA, 13 bp, Homo sapiens
actctgccagcca

SEQ ID NO: 1700101 - DNA, 23 bp, Homo sapiens
actctgccccaatcgggtccaga

SEQ ID NO: 1700102 - DNA, 16 bp, Homo sapiens
actctgccctctgctg

SEQ ID NO: 1700103 - DNA, 19 bp, Homo sapiens
actctgccctctgctgctg

SEQ ID NO: 1700104 - DNA, 22 bp, Homo sapiens
actctgccctctgctgctgccc

SEQ ID NO: 1700105 - DNA, 23 bp, Homo sapiens
actctgccctctgctgctgcccg

SEQ ID NO: 1700106 - DNA, 12 bp, Homo sapiens
actctgcctctg

SEQ ID NO: 1700107 - DNA, 16 bp, Homo sapiens
actctgcctctgcctg

SEQ ID NO: 1700108 - DNA, 14 bp, Homo sapiens
actctgcctgcctg

SEQ ID NO: 1700109 - DNA, 21 bp, Homo sapiens
actctgcctttatgatgctaa

SEQ ID NO: 1700110 - DNA, 19 bp, Homo sapiens
actctgctatttctcttgc

SEQ ID NO: 1700111 - DNA, 20 bp, Homo sapiens
actctgctatttctcttgct

SEQ ID NO: 1700112 - DNA, 20 bp, Homo sapiens
actctgctctgcccttgttc

SEQ ID NO: 1700113 - DNA, 16 bp, Homo sapiens
actctgcttctctgac

SEQ ID NO: 1700114 - DNA, 20 bp, Homo sapiens
actctgcttctctgacttct

SEQ ID NO: 1700115 - DNA, 16 bp, Homo sapiens
actctgcttgattttt

SEQ ID NO: 1700116 - DNA, 22 bp, Homo sapiens
actctggaaccttattccagca

SEQ ID NO: 1700117 - DNA, 22 bp, Homo sapiens
actctggaggtcatctggcgga

SEQ ID NO: 1700118 - DNA, 21 bp, Homo sapiens
actctggaggtttgtttagaa

SEQ ID NO: 1700119 - DNA, 17 bp, Homo sapiens
actctggccctggccct

SEQ ID NO: 1700120 - DNA, 12 bp, Homo sapiens
actctgggctgt

SEQ ID NO: 1700121 - DNA, 14 bp, Homo sapiens
actctggtgcctcc

SEQ ID NO: 1700122 - DNA, 17 bp, Homo sapiens
actctggtgttctattg

SEQ ID NO: 1700123 - DNA, 22 bp, Homo sapiens
actctgtaattgcactttttaa

SEQ ID NO: 1700124 - DNA, 21 bp, Homo sapiens
actctgtataagttgaaggaa

SEQ ID NO: 1700125 - DNA, 13 bp, Homo sapiens
actctgtccaggc

SEQ ID NO: 1700126 - DNA, 20 bp, Homo sapiens
actctgtgcaggtgctgcct

SEQ ID NO: 1700127 - DNA, 17 bp, Homo sapiens
actctgtggggccttgg

SEQ ID NO: 1700128 - DNA, 18 bp, Homo sapiens
actctgtgtaatctctga

SEQ ID NO: 1700129 - DNA, 20 bp, Homo sapiens
actctgtgtaatctctgatt

SEQ ID NO: 1700130 - DNA, 16 bp, Homo sapiens
actctgttatttagac

SEQ ID NO: 1700131 - DNA, 18 bp, Homo sapiens
actctgttcccccaccct

SEQ ID NO: 1700132 - DNA, 19 bp, Homo sapiens
actctgttcccccaccctc

SEQ ID NO: 1700133 - DNA, 17 bp, Homo sapiens
actcttacagagccttg

SEQ ID NO: 1700134 - DNA, 14 bp, Homo sapiens
actcttactcctta

SEQ ID NO: 1700135 - DNA, 19 bp, Homo sapiens
actcttagatggattctcc

SEQ ID NO: 1700136 - DNA, 23 bp, Homo sapiens
actcttagttttttttttttaca

SEQ ID NO: 1700137 - DNA, 16 bp, Homo sapiens
actcttattttttaaa

SEQ ID NO: 1700138 - DNA, 14 bp, Homo sapiens
actggatgaagatt

SEQ ID NO: 1700139 - DNA, 15 bp, Homo sapiens
actggatggaaagac

SEQ ID NO: 1700140 - DNA, 12 bp, Homo sapiens
actggcacagag

SEQ ID NO: 1700141 - DNA, 14 bp, Homo sapiens
actggcacagaggt

SEQ ID NO: 1700142 - DNA, 13 bp, Homo sapiens
actggcacagttt

SEQ ID NO: 1700143 - DNA, 19 bp, Homo sapiens
actggcacagttttctgag

SEQ ID NO: 1700144 - DNA, 22 bp, Homo sapiens
actggcacagttttctgagaaa

SEQ ID NO: 1700145 - DNA, 13 bp, Homo sapiens
actggcagaagca

SEQ ID NO: 1700146 - DNA, 12 bp, Homo sapiens
actggcagcctg

SEQ ID NO: 1700147 - DNA, 13 bp, Homo sapiens
actggcagctcct

SEQ ID NO: 1700148 - DNA, 22 bp, Homo sapiens
actggcaggggagacaggagcc

SEQ ID NO: 1700149 - DNA, 12 bp, Homo sapiens
actggcaggtgc

SEQ ID NO: 1700150 - DNA, 22 bp, Homo sapiens
actggcagttttccattggttt

SEQ ID NO: 1700151 - DNA, 20 bp, Homo sapiens
actggcatctgacacaaaaa

SEQ ID NO: 1700152 - DNA, 15 bp, Homo sapiens
actggcatctgctct

SEQ ID NO: 1700153 - DNA, 22 bp, Homo sapiens
actggcatgagccactgtgccc

SEQ ID NO: 1700154 - DNA, 21 bp, Homo sapiens
actggcatggatatagtttta

SEQ ID NO: 1700155 - DNA, 17 bp, Homo sapiens
actggccaccaggctgg

SEQ ID NO: 1700156 - DNA, 13 bp, Homo sapiens
actggccagagag

SEQ ID NO: 1700157 - DNA, 23 bp, Homo sapiens
actggccagtggctggatctgtg

SEQ ID NO: 1700158 - DNA, 18 bp, Homo sapiens
actggccatttttctggg

SEQ ID NO: 1700159 - DNA, 18 bp, Homo sapiens
actggcctttttcattta

SEQ ID NO: 1700160 - DNA, 21 bp, Homo sapiens
actggcgccttctcggagctg

SEQ ID NO: 1700161 - DNA, 18 bp, Homo sapiens
actggctagagtcctcac

SEQ ID NO: 1700162 - DNA, 22 bp, Homo sapiens
actggctctccaagtgccagag

SEQ ID NO: 1700163 - DNA, 21 bp, Homo sapiens
actggctgtcagtatgacatt

SEQ ID NO: 1700164 - DNA, 14 bp, Homo sapiens
actggctgtctgcc

SEQ ID NO: 1700165 - DNA, 16 bp, Homo sapiens
actggctgtctgcctg

SEQ ID NO: 1700166 - DNA, 13 bp, Homo sapiens
actggctgtgaga

SEQ ID NO: 1700167 - DNA, 18 bp, Homo sapiens
actgtcatgtggcttggt

SEQ ID NO: 1700168 - DNA, 22 bp, Homo sapiens
actgtcccacaaaatatttcta

SEQ ID NO: 1700169 - DNA, 12 bp, Homo sapiens
actgtcccagct

SEQ ID NO: 1700170 - DNA, 21 bp, Homo sapiens
actgtcccagctaccaagtca

SEQ ID NO: 1700171 - DNA, 22 bp, Homo sapiens
actgtccctctcagtgccttct

SEQ ID NO: 1700172 - DNA, 18 bp, Homo sapiens
actgtcctgaggagccct

SEQ ID NO: 1700173 - DNA, 14 bp, Homo sapiens
actgtcctgggcct

SEQ ID NO: 1700174 - DNA, 17 bp, Homo sapiens
actgtcctgtcctgctc

SEQ ID NO: 1700175 - DNA, 18 bp, Homo sapiens
actgtccttccctgccac

SEQ ID NO: 1700176 - DNA, 14 bp, Homo sapiens
actgtcctttcctt

SEQ ID NO: 1700177 - DNA, 22 bp, Homo sapiens
actgtctaagcagttttgtaaa

SEQ ID NO: 1700178 - DNA, 18 bp, Homo sapiens
actgtctagagcaacttt

SEQ ID NO: 1700179 - DNA, 17 bp, Homo sapiens
actgtctattaatattc

SEQ ID NO: 1700180 - DNA, 23 bp, Homo sapiens
actgtctcaagagggcactggtg

SEQ ID NO: 1700181 - DNA, 21 bp, Homo sapiens
actgtctcactcgttctgtta

SEQ ID NO: 1700182 - DNA, 12 bp, Homo sapiens
actgtctcactg

SEQ ID NO: 1700183 - DNA, 16 bp, Homo sapiens
actgtctgcttctctc

SEQ ID NO: 1700184 - DNA, 23 bp, Homo sapiens
actgtctgcttctctctctctca

SEQ ID NO: 1700185 - DNA, 14 bp, Homo sapiens
actgtctgtccctg

SEQ ID NO: 1700186 - DNA, 14 bp, Homo sapiens
actgtcttcccgat

SEQ ID NO: 1700187 - DNA, 17 bp, Homo sapiens
actgtcttctccctgca

SEQ ID NO: 1700188 - DNA, 23 bp, Homo sapiens
actgtcttctggacttggtcttg

SEQ ID NO: 1700189 - DNA, 17 bp, Homo sapiens
actgtctttaaaagaga

SEQ ID NO: 1700190 - DNA, 15 bp, Homo sapiens
actgtctttattctt

SEQ ID NO: 1700191 - DNA, 12 bp, Homo sapiens
actgtctttcag

SEQ ID NO: 1700192 - DNA, 16 bp, Homo sapiens
actgtgaaaatagtgt

SEQ ID NO: 1700193 - DNA, 13 bp, Homo sapiens
actgtgaacttga

SEQ ID NO: 1700194 - DNA, 17 bp, Homo sapiens
actgtgaagacccagca

SEQ ID NO: 1700195 - DNA, 21 bp, Homo sapiens
actgtgaagacccagcaggaa

SEQ ID NO: 1700196 - DNA, 22 bp, Homo sapiens
actgtgaagacccagcaggaag

SEQ ID NO: 1700197 - DNA, 20 bp, Homo sapiens
actgtgactaggcatacact

SEQ ID NO: 1700198 - DNA, 20 bp, Homo sapiens
actgtgataaaaagaggagc

SEQ ID NO: 1700199 - DNA, 21 bp, Homo sapiens
actgtgataaaaagaggagct

SEQ ID NO: 1700200 - DNA, 22 bp, Homo sapiens
actgtgatgccacacagagtgg

SEQ ID NO: 1700201 - DNA, 15 bp, Homo sapiens
actgtgattagatca

SEQ ID NO: 1700202 - DNA, 19 bp, Homo sapiens
actgtgattagatcacatc

SEQ ID NO: 1700203 - DNA, 13 bp, Homo sapiens
actgtgatttatt

SEQ ID NO: 1700204 - DNA, 14 bp, Homo sapiens
actgtgatttctgg

SEQ ID NO: 1700205 - DNA, 12 bp, Homo sapiens
actgtgcagaag

SEQ ID NO: 1700206 - DNA, 21 bp, Homo sapiens
actgtgcagagtctagaagtt

SEQ ID NO: 1700207 - DNA, 20 bp, Homo sapiens
actgtgccaactactactgg

SEQ ID NO: 1700208 - DNA, 14 bp, Homo sapiens
actgtgccctggtg

SEQ ID NO: 1700209 - DNA, 17 bp, Homo sapiens
actgtgccctggtggag

SEQ ID NO: 1700210 - DNA, 18 bp, Homo sapiens
actgtgccctggtggaga

SEQ ID NO: 1700211 - DNA, 16 bp, Homo sapiens
actgtgcctagttcct

SEQ ID NO: 1700212 - DNA, 20 bp, Homo sapiens
actgtgcctcagagaccagg

SEQ ID NO: 1700213 - DNA, 23 bp, Homo sapiens
actgtgcctcagagaccagggct

SEQ ID NO: 1700214 - DNA, 21 bp, Homo sapiens
actgtgcctcaggccagggct

SEQ ID NO: 1700215 - DNA, 20 bp, Homo sapiens
actgtgcttatttttttaag

SEQ ID NO: 1700216 - DNA, 19 bp, Homo sapiens
actgtggcacttgcctggg

SEQ ID NO: 1700217 - DNA, 15 bp, Homo sapiens
actgtggccacagcc

SEQ ID NO: 1700218 - DNA, 18 bp, Homo sapiens
actgtggccacagccccc

SEQ ID NO: 1700219 - DNA, 14 bp, Homo sapiens
actgtggccagagc

SEQ ID NO: 1700220 - DNA, 21 bp, Homo sapiens
actgtggccagagctggaagg

SEQ ID NO: 1700221 - DNA, 23 bp, Homo sapiens
actgtggccgttatctggaagta

SEQ ID NO: 1700222 - DNA, 17 bp, Homo sapiens
actgtggcgttctgctg

SEQ ID NO: 1700223 - DNA, 18 bp, Homo sapiens
actgtggcgttctgctgc

SEQ ID NO: 1700224 - DNA, 19 bp, Homo sapiens
actgtggctgctagcactt

SEQ ID NO: 1700225 - DNA, 18 bp, Homo sapiens
actgtggtagctccagcg

SEQ ID NO: 1700226 - DNA, 17 bp, Homo sapiens
actgtggtaggggcagg

SEQ ID NO: 1700227 - DNA, 18 bp, Homo sapiens
actgtggtaggggcaggg

SEQ ID NO: 1700228 - DNA, 16 bp, Homo sapiens
actgtgtattccaaga

SEQ ID NO: 1700229 - DNA, 21 bp, Homo sapiens
actgtgtattccaagacatgt

SEQ ID NO: 1700230 - DNA, 14 bp, Homo sapiens
actgtgtcctggtg

SEQ ID NO: 1700231 - DNA, 16 bp, Homo sapiens
actgtgtcctggtgct

SEQ ID NO: 1700232 - DNA, 19 bp, Homo sapiens
actgtgtgctgactgaaca

SEQ ID NO: 1700233 - DNA, 17 bp, Homo sapiens
actgtgtggactgtgat

SEQ ID NO: 1700234 - DNA, 18 bp, Homo sapiens
actgtgtggactgtgatg

SEQ ID NO: 1700235 - DNA, 20 bp, Homo sapiens
actgtgtgggatacttagtg

SEQ ID NO: 1700236 - DNA, 12 bp, Homo sapiens
actgtgttactg

SEQ ID NO: 1700237 - DNA, 21 bp, Homo sapiens
actgtgttactgctttgcaaa

SEQ ID NO: 1700238 - DNA, 22 bp, Homo sapiens
actgtgttttagtgtaaaattg

SEQ ID NO: 1700239 - DNA, 19 bp, Homo sapiens
actgtgttttataaaatag

SEQ ID NO: 1700240 - DNA, 22 bp, Homo sapiens
actgttacaacttgtatttcca

SEQ ID NO: 1700241 - DNA, 13 bp, Homo sapiens
actgttactttgg

SEQ ID NO: 1700242 - DNA, 14 bp, Homo sapiens
actgttagtgacag

SEQ ID NO: 1700243 - DNA, 14 bp, Homo sapiens
actgttatcatttt

SEQ ID NO: 1700244 - DNA, 12 bp, Homo sapiens
actgttattctt

SEQ ID NO: 1700245 - DNA, 13 bp, Homo sapiens
actgttattcttt

SEQ ID NO: 1700246 - DNA, 17 bp, Homo sapiens
actgttcagcttttatt

SEQ ID NO: 1700247 - DNA, 15 bp, Homo sapiens
actgttccctctggc

SEQ ID NO: 1700248 - DNA, 23 bp, Homo sapiens
actgttcggaaggggttcctcaa

SEQ ID NO: 1700249 - DNA, 16 bp, Homo sapiens
actgttctaaagctct

SEQ ID NO: 1700250 - DNA, 23 bp, Homo sapiens
actgttctctttaaaatatttgt

SEQ ID NO: 1700251 - DNA, 13 bp, Homo sapiens
actgttctgtgtc

SEQ ID NO: 1700252 - DNA, 15 bp, Homo sapiens
actgttctgtgtctt

SEQ ID NO: 1700253 - DNA, 20 bp, Homo sapiens
actgttgagccccagtgctg

SEQ ID NO: 1700254 - DNA, 16 bp, Homo sapiens
actgttgcagtggcct

SEQ ID NO: 1700255 - DNA, 20 bp, Homo sapiens
actgttgcagtggcctggcc

SEQ ID NO: 1700256 - DNA, 13 bp, Homo sapiens
actgatcaaaaat

SEQ ID NO: 1700257 - DNA, 16 bp, Homo sapiens
actgatcaaaaataaa

SEQ ID NO: 1700258 - DNA, 18 bp, Homo sapiens
actgatcctgctccagca

SEQ ID NO: 1700259 - DNA, 19 bp, Homo sapiens
actgatcctgctccagcag

SEQ ID NO: 1700260 - DNA, 21 bp, Homo sapiens
actgatgaaatctgctagaaa

SEQ ID NO: 1700261 - DNA, 23 bp, Homo sapiens
actgatgaaatctgctagaaagt

SEQ ID NO: 1700262 - DNA, 11 bp, Homo sapiens
actgatgctgc

SEQ ID NO: 1700263 - DNA, 12 bp, Homo sapiens
actgatgctgcc

SEQ ID NO: 1700264 - DNA, 15 bp, Homo sapiens
actgatgctgcccct

SEQ ID NO: 1700265 - DNA, 20 bp, Homo sapiens
actgatggctcaagacaagg

SEQ ID NO: 1700266 - DNA, 19 bp, Homo sapiens
actgatgtcatcttgagct

SEQ ID NO: 1700267 - DNA, 13 bp, Homo sapiens
actgatgttgtgt

SEQ ID NO: 1700268 - DNA, 17 bp, Homo sapiens
actgatgttgtgttttt

SEQ ID NO: 1700269 - DNA, 14 bp, Homo sapiens
actgattcaagaac

SEQ ID NO: 1700270 - DNA, 17 bp, Homo sapiens
actgattctgtggctta

SEQ ID NO: 1700271 - DNA, 13 bp, Homo sapiens
actgattgtttca

SEQ ID NO: 1700272 - DNA, 21 bp, Homo sapiens
actgattgttttagagactat

SEQ ID NO: 1700273 - DNA, 13 bp, Homo sapiens
actgatttcacaa

SEQ ID NO: 1700274 - DNA, 17 bp, Homo sapiens
actgatttcacaacaga

SEQ ID NO: 1700275 - DNA, 20 bp, Homo sapiens
actgatttcacaacagatca

SEQ ID NO: 1700276 - DNA, 18 bp, Homo sapiens
actgatttttgtaagaca

SEQ ID NO: 1700277 - DNA, 15 bp, Homo sapiens
actgcaaaggcgcag

SEQ ID NO: 1700278 - DNA, 20 bp, Homo sapiens
actgcaaatcaggcttttgt

SEQ ID NO: 1700279 - DNA, 19 bp, Homo sapiens
actgcaacctcacctcccg

SEQ ID NO: 1700280 - DNA, 17 bp, Homo sapiens
actgcaacctccacctc

SEQ ID NO: 1700281 - DNA, 20 bp, Homo sapiens
actgcaacctccacctcgca

SEQ ID NO: 1700282 - DNA, 13 bp, Homo sapiens
actgcaacctccg

SEQ ID NO: 1700283 - DNA, 17 bp, Homo sapiens
actgcaacctctgcctc

SEQ ID NO: 1700284 - DNA, 15 bp, Homo sapiens
actgcaagagccttg

SEQ ID NO: 1700285 - DNA, 17 bp, Homo sapiens
actgcaagagccttggt

SEQ ID NO: 1700286 - DNA, 18 bp, Homo sapiens
actgcaagagccttggtg

SEQ ID NO: 1700287 - DNA, 15 bp, Homo sapiens
actgcaatagagact

SEQ ID NO: 1700288 - DNA, 16 bp, Homo sapiens
actgcaatagagactg

SEQ ID NO: 1700289 - DNA, 20 bp, Homo sapiens
actgcaatcctgtctttctg

SEQ ID NO: 1700290 - DNA, 17 bp, Homo sapiens
actgcacacacagctcc

SEQ ID NO: 1700291 - DNA, 16 bp, Homo sapiens
actgcacacagtgact

SEQ ID NO: 1700292 - DNA, 22 bp, Homo sapiens
actgcacagtgcatctcagccc

SEQ ID NO: 1700293 - DNA, 14 bp, Homo sapiens
actgcaccagcgcc

SEQ ID NO: 1700294 - DNA, 21 bp, Homo sapiens
actgcaccagcgcccccagaa

SEQ ID NO: 1700295 - DNA, 13 bp, Homo sapiens
actgcactccagc

SEQ ID NO: 1700296 - DNA, 17 bp, Homo sapiens
actgcactccagcctga

SEQ ID NO: 1700297 - DNA, 21 bp, Homo sapiens
actgcactccagcctgggcga

SEQ ID NO: 1700298 - DNA, 20 bp, Homo sapiens
actgcactccagcctggggg

SEQ ID NO: 1700299 - DNA, 19 bp, Homo sapiens
actgcactccagcctgggt

SEQ ID NO: 1700300 - DNA, 21 bp, Homo sapiens
actgcagaacccccaggtggc

SEQ ID NO: 1700301 - DNA, 12 bp, Homo sapiens
actgcagcacct

SEQ ID NO: 1700302 - DNA, 16 bp, Homo sapiens
actgcagcacctccag

SEQ ID NO: 1700303 - DNA, 21 bp, Homo sapiens
actgcagcacctccaggcctg

SEQ ID NO: 1700304 - DNA, 16 bp, Homo sapiens
actgcagccctctcca

SEQ ID NO: 1700305 - DNA, 13 bp, Homo sapiens
actgcagctgctg

SEQ ID NO: 1700306 - DNA, 21 bp, Homo sapiens
actgcaggccccgcttgtcca

SEQ ID NO: 1700307 - DNA, 12 bp, Homo sapiens
actgcaggccct

SEQ ID NO: 1700308 - DNA, 13 bp, Homo sapiens
actgcaggccctg

SEQ ID NO: 1700309 - DNA, 16 bp, Homo sapiens
actgcaggccctggcc

SEQ ID NO: 1700310 - DNA, 18 bp, Homo sapiens
actgcaggccctggcctc

SEQ ID NO: 1700311 - DNA, 19 bp, Homo sapiens
actgcaggccctggcctcc

SEQ ID NO: 1700312 - DNA, 14 bp, Homo sapiens
actgcagtgtggag

SEQ ID NO: 1700313 - DNA, 20 bp, Homo sapiens
actgcatactttttaaatgt

SEQ ID NO: 1700314 - DNA, 23 bp, Homo sapiens
actgcatactttttaaatgtaaa

SEQ ID NO: 1700315 - DNA, 20 bp, Homo sapiens
actgcataggaatttagaac

SEQ ID NO: 1700316 - DNA, 15 bp, Homo sapiens
actgcatctcaaaaa

SEQ ID NO: 1700317 - DNA, 21 bp, Homo sapiens
actgcatcttggttatttctg

SEQ ID NO: 1700318 - DNA, 21 bp, Homo sapiens
actgcatggacctaacattcg

SEQ ID NO: 1700319 - DNA, 12 bp, Homo sapiens
actgcatggctt

SEQ ID NO: 1700320 - DNA, 16 bp, Homo sapiens
actgcatggcttctga

SEQ ID NO: 1700321 - DNA, 16 bp, Homo sapiens
actgcatggggaggca

SEQ ID NO: 1700322 - DNA, 18 bp, Homo sapiens
actgcatggggaggcagc

SEQ ID NO: 1700323 - DNA, 15 bp, Homo sapiens
actgcatgtgacttc

SEQ ID NO: 1700324 - DNA, 10 bp, Homo sapiens
actgcatttt

SEQ ID NO: 1700325 - DNA, 17 bp, Homo sapiens
actgccaagccagattc

SEQ ID NO: 1700326 - DNA, 18 bp, Homo sapiens
actgccaagccagattct

SEQ ID NO: 1700327 - DNA, 21 bp, Homo sapiens
actgccaagccagattctctt

SEQ ID NO: 1700328 - DNA, 23 bp, Homo sapiens
actgccagaagagaattcagtat

SEQ ID NO: 1700329 - DNA, 19 bp, Homo sapiens
actgccagcagcagcaggt

SEQ ID NO: 1700330 - DNA, 17 bp, Homo sapiens
actgccaggcacctggc

SEQ ID NO: 1700331 - DNA, 18 bp, Homo sapiens
actgccaggcacctggcc

SEQ ID NO: 1700332 - DNA, 17 bp, Homo sapiens
actgccaggccagcctc

SEQ ID NO: 1700333 - DNA, 23 bp, Homo sapiens
actgccaggccagcctccgagag

SEQ ID NO: 1700334 - DNA, 13 bp, Homo sapiens
actgccaggctgc

SEQ ID NO: 1700335 - DNA, 15 bp, Homo sapiens
actgccaggctgcct

SEQ ID NO: 1700336 - DNA, 17 bp, Homo sapiens
actgccaggctgtttca

SEQ ID NO: 1700337 - DNA, 22 bp, Homo sapiens
actgccatacataatatatgac

SEQ ID NO: 1700338 - DNA, 14 bp, Homo sapiens
actgccatattgtg

SEQ ID NO: 1700339 - DNA, 21 bp, Homo sapiens
actgccatgatagctggggct

SEQ ID NO: 1700340 - DNA, 20 bp, Homo sapiens
actgccatgcaccaggactg

SEQ ID NO: 1700341 - DNA, 18 bp, Homo sapiens
actgccattacccagtgc

SEQ ID NO: 1700342 - DNA, 16 bp, Homo sapiens
actgccattagactga

SEQ ID NO: 1700343 - DNA, 19 bp, Homo sapiens
actgccattagactgaatt

SEQ ID NO: 1700344 - DNA, 18 bp, Homo sapiens
actgcccacatttgggct

SEQ ID NO: 1700345 - DNA, 21 bp, Homo sapiens
actgccccccgaggctgctag

SEQ ID NO: 1700346 - DNA, 17 bp, Homo sapiens
actgccctaagccccca

SEQ ID NO: 1700347 - DNA, 21 bp, Homo sapiens
actgccctaagcccccagggc

SEQ ID NO: 1700348 - DNA, 22 bp, Homo sapiens
actgccctaagcccccagggcc

SEQ ID NO: 1700349 - DNA, 13 bp, Homo sapiens
actgccctcccct

SEQ ID NO: 1700350 - DNA, 12 bp, Homo sapiens
actgccctgcct

SEQ ID NO: 1700351 - DNA, 15 bp, Homo sapiens
actgccctgcctgcc

SEQ ID NO: 1700352 - DNA, 16 bp, Homo sapiens
actgccctgcctgccc

SEQ ID NO: 1700353 - DNA, 17 bp, Homo sapiens
actgccctgcctgccca

SEQ ID NO: 1700354 - DNA, 18 bp, Homo sapiens
actgccctgcctgcccac

SEQ ID NO: 1700355 - DNA, 12 bp, Homo sapiens
actgccctggca

SEQ ID NO: 1700356 - DNA, 18 bp, Homo sapiens
actgccctggcagcagca

SEQ ID NO: 1700357 - DNA, 19 bp, Homo sapiens
actgccgcctactggacgc

SEQ ID NO: 1700358 - DNA, 15 bp, Homo sapiens
actgccgtaatttaa

SEQ ID NO: 1700359 - DNA, 17 bp, Homo sapiens
actgccgtaatttaact

SEQ ID NO: 1700360 - DNA, 14 bp, Homo sapiens
actgcctaagccct

SEQ ID NO: 1700361 - DNA, 11 bp, Homo sapiens
actgcctagga

SEQ ID NO: 1700362 - DNA, 17 bp, Homo sapiens
actgcctctccctggcc

SEQ ID NO: 1700363 - DNA, 21 bp, Homo sapiens
actgcctgcatgagctggcaa

SEQ ID NO: 1700364 - DNA, 22 bp, Homo sapiens
actgcctgcctcccctccgcag

SEQ ID NO: 1700365 - DNA, 12 bp, Homo sapiens
actgcctgggct

SEQ ID NO: 1700366 - DNA, 16 bp, Homo sapiens
actgccttcgcttctt

SEQ ID NO: 1700367 - DNA, 21 bp, Homo sapiens
actgccttcgcttcttgcctc

SEQ ID NO: 1700368 - DNA, 14 bp, Homo sapiens
actgccttgtactt

SEQ ID NO: 1700369 - DNA, 16 bp, Homo sapiens
actgcgaggacatcaa

SEQ ID NO: 1700370 - DNA, 15 bp, Homo sapiens
actgcgcaggtctct

SEQ ID NO: 1700371 - DNA, 23 bp, Homo sapiens
ctcctggaccttgacagagcagc

SEQ ID NO: 1700372 - DNA, 17 bp, Homo sapiens
ctcctggactcccctcc

SEQ ID NO: 1700373 - DNA, 13 bp, Homo sapiens
ctcctggctcggg

SEQ ID NO: 1700374 - DNA, 12 bp, Homo sapiens
ctcctggctgcc

SEQ ID NO: 1700375 - DNA, 13 bp, Homo sapiens
ctcctggctgcca

SEQ ID NO: 1700376 - DNA, 15 bp, Homo sapiens
ctcctggctgccagg

SEQ ID NO: 1700377 - DNA, 18 bp, Homo sapiens
ctcctggctgccaggcgt

SEQ ID NO: 1700378 - DNA, 12 bp, Homo sapiens
ctcctggctgtg

SEQ ID NO: 1700379 - DNA, 15 bp, Homo sapiens
ctcctggctgtgaca

SEQ ID NO: 1700380 - DNA, 16 bp, Homo sapiens
ctcctggctgtgacac

SEQ ID NO: 1700381 - DNA, 19 bp, Homo sapiens
ctcctggctgtgcccagca

SEQ ID NO: 1700382 - DNA, 22 bp, Homo sapiens
ctcctggctgtgcccagcaggc

SEQ ID NO: 1700383 - DNA, 23 bp, Homo sapiens
ctcctggctgtgcccagcaggcc

SEQ ID NO: 1700384 - DNA, 23 bp, Homo sapiens
ctcctgggaaggagggagctgct

SEQ ID NO: 1700385 - DNA, 18 bp, Homo sapiens
ctcctgggaaggccacct

SEQ ID NO: 1700386 - DNA, 19 bp, Homo sapiens
ctcctgggaaggccacctc

SEQ ID NO: 1700387 - DNA, 21 bp, Homo sapiens
ctcctgggaaggccacctccc

SEQ ID NO: 1700388 - DNA, 19 bp, Homo sapiens
ctcctgggccggctgagtg

SEQ ID NO: 1700389 - DNA, 15 bp, Homo sapiens
ctcctgggctatatt

SEQ ID NO: 1700390 - DNA, 13 bp, Homo sapiens
ctcctgggctcaa

SEQ ID NO: 1700391 - DNA, 20 bp, Homo sapiens
ctcctggggaaggtcgccct

SEQ ID NO: 1700392 - DNA, 16 bp, Homo sapiens
ctcctggggcgtccag

SEQ ID NO: 1700393 - DNA, 18 bp, Homo sapiens
ctcctggtgttctgcagt

SEQ ID NO: 1700394 - DNA, 22 bp, Homo sapiens
ctcctgtccaaagtagggatgc

SEQ ID NO: 1700395 - DNA, 14 bp, Homo sapiens
ctcctgtccctcca

SEQ ID NO: 1700396 - DNA, 20 bp, Homo sapiens
ctcctgtccctgtagctcag

SEQ ID NO: 1700397 - DNA, 21 bp, Homo sapiens
ctcctgtccctgtagctcagt

SEQ ID NO: 1700398 - DNA, 17 bp, Homo sapiens
ctcctgtctaactgctg

SEQ ID NO: 1700399 - DNA, 22 bp, Homo sapiens
ctcctgtctgccagccagcagc

SEQ ID NO: 1700400 - DNA, 14 bp, Homo sapiens
ctcctgtctggctc

SEQ ID NO: 1700401 - DNA, 19 bp, Homo sapiens
ctcctgtcttatggtccag

SEQ ID NO: 1700402 - DNA, 15 bp, Homo sapiens
ctcctgtcttcagag

SEQ ID NO: 1700403 - DNA, 23 bp, Homo sapiens
ctcctgtgctatttgtacaaata

SEQ ID NO: 1700404 - DNA, 16 bp, Homo sapiens
ctcctgtggcagctgc

SEQ ID NO: 1700405 - DNA, 15 bp, Homo sapiens
ctcctgtggcaggag

SEQ ID NO: 1700406 - DNA, 22 bp, Homo sapiens
ctcctgtggccccaccctgggc

SEQ ID NO: 1700407 - DNA, 16 bp, Homo sapiens
ctcctgttctgcccac

SEQ ID NO: 1700408 - DNA, 22 bp, Homo sapiens
ctcctgtttgcaggcccagagg

SEQ ID NO: 1700409 - DNA, 23 bp, Homo sapiens
ctccttaagctgcagagatttct

SEQ ID NO: 1700410 - DNA, 19 bp, Homo sapiens
ctccttaccaatagcctga

SEQ ID NO: 1700411 - DNA, 16 bp, Homo sapiens
ctccttactctgagcc

SEQ ID NO: 1700412 - DNA, 17 bp, Homo sapiens
ctccttactctgagccc

SEQ ID NO: 1700413 - DNA, 21 bp, Homo sapiens
ctccttactctgagcccaggc

SEQ ID NO: 1700414 - DNA, 20 bp, Homo sapiens
ctccttagagacatcaaaat

SEQ ID NO: 1700415 - DNA, 17 bp, Homo sapiens
ctccttagccctgtctg

SEQ ID NO: 1700416 - DNA, 18 bp, Homo sapiens
ctccttaggtgcccagaa

SEQ ID NO: 1700417 - DNA, 17 bp, Homo sapiens
ctccttagttggctgga

SEQ ID NO: 1700418 - DNA, 20 bp, Homo sapiens
ctccttatagacacttgctc

SEQ ID NO: 1700419 - DNA, 16 bp, Homo sapiens
ctccttattttgtatt

SEQ ID NO: 1700420 - DNA, 22 bp, Homo sapiens
ctccttcactgttccctctggc

SEQ ID NO: 1700421 - DNA, 19 bp, Homo sapiens
ctccttcatgacagcctcc

SEQ ID NO: 1700422 - DNA, 15 bp, Homo sapiens
ctccttccagacctt

SEQ ID NO: 1700423 - DNA, 13 bp, Homo sapiens
ctccttcccatgc

SEQ ID NO: 1700424 - DNA, 10 bp, Homo sapiens
ctccttcccc

SEQ ID NO: 1700425 - DNA, 15 bp, Homo sapiens
ctccttcccccagcc

SEQ ID NO: 1700426 - DNA, 21 bp, Homo sapiens
ctccttcccccagcccaataa

SEQ ID NO: 1700427 - DNA, 23 bp, Homo sapiens
ctccttcccccagcccaataaag

SEQ ID NO: 1700428 - DNA, 23 bp, Homo sapiens
ctccttcccctacacctccctcc

SEQ ID NO: 1700429 - DNA, 12 bp, Homo sapiens
ctccttcccctg

SEQ ID NO: 1700430 - DNA, 15 bp, Homo sapiens
ctccttcccctgcac

SEQ ID NO: 1700431 - DNA, 16 bp, Homo sapiens
ctccttcccctgcacc

SEQ ID NO: 1700432 - DNA, 17 bp, Homo sapiens
ctccttcccctgcacct

SEQ ID NO: 1700433 - DNA, 14 bp, Homo sapiens
ctccttcccttctc

SEQ ID NO: 1700434 - DNA, 15 bp, Homo sapiens
ctccttcccttctct

SEQ ID NO: 1700435 - DNA, 17 bp, Homo sapiens
ctccttcccttctcttg

SEQ ID NO: 1700436 - DNA, 20 bp, Homo sapiens
ctccttcctggagcccagag

SEQ ID NO: 1700437 - DNA, 16 bp, Homo sapiens
ctccttcctggcctga

SEQ ID NO: 1700438 - DNA, 15 bp, Homo sapiens
ctccttcctgtcttc

SEQ ID NO: 1700439 - DNA, 17 bp, Homo sapiens
ctccttcctgtcttcct

SEQ ID NO: 1700440 - DNA, 13 bp, Homo sapiens
ctccttcctgtgt

SEQ ID NO: 1700441 - DNA, 15 bp, Homo sapiens
ctccttcgtgtctct

SEQ ID NO: 1700442 - DNA, 20 bp, Homo sapiens
ctccttcgtgtctctcccac

SEQ ID NO: 1700443 - DNA, 10 bp, Homo sapiens
ctccttctcc

SEQ ID NO: 1700444 - DNA, 12 bp, Homo sapiens
ctccttctcccc

SEQ ID NO: 1700445 - DNA, 14 bp, Homo sapiens
ctccttctcccctg

SEQ ID NO: 1700446 - DNA, 15 bp, Homo sapiens
ctccttctcccctgc

SEQ ID NO: 1700447 - DNA, 15 bp, Homo sapiens
ctccttctccttccc

SEQ ID NO: 1700448 - DNA, 14 bp, Homo sapiens
ctccttcttccact

SEQ ID NO: 1700449 - DNA, 15 bp, Homo sapiens
ctccttcttccactt

SEQ ID NO: 1700450 - DNA, 14 bp, Homo sapiens
ctccttgcccagac

SEQ ID NO: 1700451 - DNA, 15 bp, Homo sapiens
ctccttggccacaga

SEQ ID NO: 1700452 - DNA, 16 bp, Homo sapiens
ctccttggctgtctgt

SEQ ID NO: 1700453 - DNA, 15 bp, Homo sapiens
ctccttgggcacttt

SEQ ID NO: 1700454 - DNA, 22 bp, Homo sapiens
ctccttgggccctttttccctt

SEQ ID NO: 1700455 - DNA, 15 bp, Homo sapiens
ctccttgggctcctg

SEQ ID NO: 1700456 - DNA, 17 bp, Homo sapiens
ctccttgggctcctggc

SEQ ID NO: 1700457 - DNA, 18 bp, Homo sapiens
ctccttgggctcctggct

SEQ ID NO: 1700458 - DNA, 17 bp, Homo sapiens
ctccttggggcagggcc

SEQ ID NO: 1700459 - DNA, 19 bp, Homo sapiens
ctccttggtgcctggcctg

SEQ ID NO: 1700460 - DNA, 22 bp, Homo sapiens
ctccttggtgcctggcctggca

SEQ ID NO: 1700461 - DNA, 13 bp, Homo sapiens
ctccttgtgcaat

SEQ ID NO: 1700462 - DNA, 14 bp, Homo sapiens
ctccttgtgcaatt

SEQ ID NO: 1700463 - DNA, 20 bp, Homo sapiens
ctccttgtgcaattgtcttt

SEQ ID NO: 1700464 - DNA, 20 bp, Homo sapiens
ctccttgtggactggctgtg

SEQ ID NO: 1700465 - DNA, 23 bp, Homo sapiens
ctcctttaccagtcctatttttc

SEQ ID NO: 1700466 - DNA, 16 bp, Homo sapiens
ctcctttaccctcttg

SEQ ID NO: 1700467 - DNA, 20 bp, Homo sapiens
ctcctttcccttattgcctc

SEQ ID NO: 1700468 - DNA, 21 bp, Homo sapiens
ctcctttcccttattgcctcc

SEQ ID NO: 1700469 - DNA, 19 bp, Homo sapiens
ctcctttccttcccaggcc

SEQ ID NO: 1700470 - DNA, 19 bp, Homo sapiens
ctcctttcttattaatttc

SEQ ID NO: 1700471 - DNA, 20 bp, Homo sapiens
ctcctttcttattctgtgag

SEQ ID NO: 1700472 - DNA, 16 bp, Homo sapiens
ctcctttgcactgagg

SEQ ID NO: 1700473 - DNA, 18 bp, Homo sapiens
ctcctttgcactgagggc

SEQ ID NO: 1700474 - DNA, 20 bp, Homo sapiens
ctcctttgcactgagggcca

SEQ ID NO: 1700475 - DNA, 22 bp, Homo sapiens
ctcctttgcactgagggccaca

SEQ ID NO: 1700476 - DNA, 16 bp, Homo sapiens
ctcctttgcaggctca

SEQ ID NO: 1700477 - DNA, 14 bp, Homo sapiens
ctcctttgctcttg

SEQ ID NO: 1700478 - DNA, 17 bp, Homo sapiens
ctcctttggccattcca

SEQ ID NO: 1700479 - DNA, 19 bp, Homo sapiens
ctcctttgtattctgtctt

SEQ ID NO: 1700480 - DNA, 15 bp, Homo sapiens
ctccttttcacttta

SEQ ID NO: 1700481 - DNA, 20 bp, Homo sapiens
ctccttttcttcaccctccc

SEQ ID NO: 1700482 - DNA, 13 bp, Homo sapiens
ctccttttgaact

SEQ ID NO: 1700483 - DNA, 17 bp, Homo sapiens
ctcgaaccaaggcagcc

SEQ ID NO: 1700484 - DNA, 20 bp, Homo sapiens
ctcgaaccaaggcagcctcc

SEQ ID NO: 1700485 - DNA, 23 bp, Homo sapiens
ctcgaaccaaggcagcctccaga

SEQ ID NO: 1700486 - DNA, 21 bp, Homo sapiens
ctcgaactattttcaaagact

SEQ ID NO: 1700487 - DNA, 23 bp, Homo sapiens
ctcccttgcctttcgaggcctga

SEQ ID NO: 1700488 - DNA, 16 bp, Homo sapiens
ctcccttgtcctgctt

SEQ ID NO: 1700489 - DNA, 20 bp, Homo sapiens
ctccctttagtggagccagg

SEQ ID NO: 1700490 - DNA, 15 bp, Homo sapiens
ctccctttcactaaa

SEQ ID NO: 1700491 - DNA, 15 bp, Homo sapiens
ctccctttctcccct

SEQ ID NO: 1700492 - DNA, 14 bp, Homo sapiens
ctccctttttatat

SEQ ID NO: 1700493 - DNA, 20 bp, Homo sapiens
ctccgacagcgtctccaatt

SEQ ID NO: 1700494 - DNA, 15 bp, Homo sapiens
ctccgaccctcatgg

SEQ ID NO: 1700495 - DNA, 14 bp, Homo sapiens
ctcctccccagctc

SEQ ID NO: 1700496 - DNA, 11 bp, Homo sapiens
ctcctccccca

SEQ ID NO: 1700497 - DNA, 14 bp, Homo sapiens
ctcctcccccagtg

SEQ ID NO: 1700498 - DNA, 14 bp, Homo sapiens
ctcctcccccggct

SEQ ID NO: 1700499 - DNA, 19 bp, Homo sapiens
ctcctcccccggctgggcc

SEQ ID NO: 1700500 - DNA, 21 bp, Homo sapiens
ctcctcccccggctgggcctc

SEQ ID NO: 1700501 - DNA, 21 bp, Homo sapiens
ctcctccccgctccgtctctg

SEQ ID NO: 1700502 - DNA, 20 bp, Homo sapiens
ctcctcccgccccgcccctc

SEQ ID NO: 1700503 - DNA, 16 bp, Homo sapiens
ctcctcccgcccttcc

SEQ ID NO: 1700504 - DNA, 20 bp, Homo sapiens
ctcctcccgcccttccatgt

SEQ ID NO: 1700505 - DNA, 15 bp, Homo sapiens
ctcctcccggtgccc

SEQ ID NO: 1700506 - DNA, 13 bp, Homo sapiens
ctcctccctgccc

SEQ ID NO: 1700507 - DNA, 17 bp, Homo sapiens
ctcctccctgcccccca

SEQ ID NO: 1700508 - DNA, 20 bp, Homo sapiens
ctcctccctgccccccaagg

SEQ ID NO: 1700509 - DNA, 20 bp, Homo sapiens
ctcctccctggctgccctgg

SEQ ID NO: 1700510 - DNA, 15 bp, Homo sapiens
ctcctcccttccttt

SEQ ID NO: 1700511 - DNA, 16 bp, Homo sapiens
ctcctccgcagaaggt

SEQ ID NO: 1700512 - DNA, 13 bp, Homo sapiens
ctcctcctcctgg

SEQ ID NO: 1700513 - DNA, 14 bp, Homo sapiens
ctcctcctcctggg

SEQ ID NO: 1700514 - DNA, 13 bp, Homo sapiens
ctcctccttgccc

SEQ ID NO: 1700515 - DNA, 18 bp, Homo sapiens
ctcctcgaacccactccg

SEQ ID NO: 1700516 - DNA, 14 bp, Homo sapiens
ctcctcggaagagc

SEQ ID NO: 1700517 - DNA, 23 bp, Homo sapiens
ctcctcggagagcagcagcacca

SEQ ID NO: 1700518 - DNA, 18 bp, Homo sapiens
ctcctcggccccctccat

SEQ ID NO: 1700519 - DNA, 19 bp, Homo sapiens
ctcctcggccccctccatc

SEQ ID NO: 1700520 - DNA, 20 bp, Homo sapiens
ctcctcggccccctccatcg

SEQ ID NO: 1700521 - DNA, 17 bp, Homo sapiens
ctcctcgggccgaggcc

SEQ ID NO: 1700522 - DNA, 17 bp, Homo sapiens
ctcctctagctgtgggg

SEQ ID NO: 1700523 - DNA, 20 bp, Homo sapiens
ctcctctcacctctccctcg

SEQ ID NO: 1700524 - DNA, 22 bp, Homo sapiens
ctcctctcagagtgacagtcat

SEQ ID NO: 1700525 - DNA, 15 bp, Homo sapiens
ctcctctcagtgttt

SEQ ID NO: 1700526 - DNA, 12 bp, Homo sapiens
ctcctctcccat

SEQ ID NO: 1700527 - DNA, 18 bp, Homo sapiens
ctcctctcccatccttga

SEQ ID NO: 1700528 - DNA, 17 bp, Homo sapiens
ctcctctccccagccca

SEQ ID NO: 1700529 - DNA, 18 bp, Homo sapiens
ctcctctccccagcccag

SEQ ID NO: 1700530 - DNA, 19 bp, Homo sapiens
ctcctctccccagcccaga

SEQ ID NO: 1700531 - DNA, 22 bp, Homo sapiens
ctcctctccccagcccagagac

SEQ ID NO: 1700532 - DNA, 20 bp, Homo sapiens
ctcctctccttgggctcctg

SEQ ID NO: 1700533 - DNA, 14 bp, Homo sapiens
ctcctctctctcag

SEQ ID NO: 1700534 - DNA, 15 bp, Homo sapiens
ctcctctctctttcc

SEQ ID NO: 1700535 - DNA, 11 bp, Homo sapiens
ctcctctctga

SEQ ID NO: 1700536 - DNA, 13 bp, Homo sapiens
ctcctctctttgt

SEQ ID NO: 1700537 - DNA, 16 bp, Homo sapiens
ctcctctgcagtgcct

SEQ ID NO: 1700538 - DNA, 17 bp, Homo sapiens
ctcctctgcagtgcctt

SEQ ID NO: 1700539 - DNA, 11 bp, Homo sapiens
ctcctctgcca

SEQ ID NO: 1700540 - DNA, 14 bp, Homo sapiens
ctcctctgccacct

SEQ ID NO: 1700541 - DNA, 15 bp, Homo sapiens
ctcctctgccacctc

SEQ ID NO: 1700542 - DNA, 17 bp, Homo sapiens
ctcctctgccacctccc

SEQ ID NO: 1700543 - DNA, 17 bp, Homo sapiens
ctcctctgtccagggcc

SEQ ID NO: 1700544 - DNA, 18 bp, Homo sapiens
ctcctctgtccagggccc

SEQ ID NO: 1700545 - DNA, 20 bp, Homo sapiens
ctcctcttaaaaaataaaaa

SEQ ID NO: 1700546 - DNA, 21 bp, Homo sapiens
ctcctcttaccgtagcctccg

SEQ ID NO: 1700547 - DNA, 11 bp, Homo sapiens
ctcctcttcca

SEQ ID NO: 1700548 - DNA, 19 bp, Homo sapiens
ctcctgaaccgcacagctc

SEQ ID NO: 1700549 - DNA, 20 bp, Homo sapiens
ctcctgaaccgcacagctca

SEQ ID NO: 1700550 - DNA, 23 bp, Homo sapiens
ctcctgaaccgcacagctcagga

SEQ ID NO: 1700551 - DNA, 11 bp, Homo sapiens
ctcctgaataa

SEQ ID NO: 1700552 - DNA, 21 bp, Homo sapiens
ctcctgaatctaacacatttc

SEQ ID NO: 1700553 - DNA, 19 bp, Homo sapiens
ctcctgacagaaggtgcca

SEQ ID NO: 1700554 - DNA, 16 bp, Homo sapiens
ctcctgacccagtccc

SEQ ID NO: 1700555 - DNA, 20 bp, Homo sapiens
ctcctgacgtctgaagcttg

SEQ ID NO: 1700556 - DNA, 15 bp, Homo sapiens
ctcctgactggtgct

SEQ ID NO: 1700557 - DNA, 22 bp, Homo sapiens
ctcctgagctcggggggctctg

SEQ ID NO: 1700558 - DNA, 16 bp, Homo sapiens
ctcctgaggggcatct

SEQ ID NO: 1700559 - DNA, 19 bp, Homo sapiens
ctcctgagtagctgggact

SEQ ID NO: 1700560 - DNA, 15 bp, Homo sapiens
ctcctgatggccaag

SEQ ID NO: 1700561 - DNA, 19 bp, Homo sapiens
ctcctgatggccaagagca

SEQ ID NO: 1700562 - DNA, 19 bp, Homo sapiens
ctcctgatttctctgaaca

SEQ ID NO: 1700563 - DNA, 15 bp, Homo sapiens
ctcctgattttgtag

SEQ ID NO: 1700564 - DNA, 14 bp, Homo sapiens
ctcctgcaggctgg

SEQ ID NO: 1700565 - DNA, 11 bp, Homo sapiens
ctcctgccagg

SEQ ID NO: 1700566 - DNA, 19 bp, Homo sapiens
ctcctgccattcttctggt

SEQ ID NO: 1700567 - DNA, 12 bp, Homo sapiens
ctcctgcccagg

SEQ ID NO: 1700568 - DNA, 14 bp, Homo sapiens
ctcctgcccaggag

SEQ ID NO: 1700569 - DNA, 15 bp, Homo sapiens
ctcctgcccaggagc

SEQ ID NO: 1700570 - DNA, 18 bp, Homo sapiens
ctcctgcccaggagcagc

SEQ ID NO: 1700571 - DNA, 12 bp, Homo sapiens
ctcctgccccaa

SEQ ID NO: 1700572 - DNA, 22 bp, Homo sapiens
ctcctgccccaagggcccagac

SEQ ID NO: 1700573 - DNA, 12 bp, Homo sapiens
ctcctgccctct

SEQ ID NO: 1700574 - DNA, 13 bp, Homo sapiens
ctcctgccctctg

SEQ ID NO: 1700575 - DNA, 14 bp, Homo sapiens
ctcctgccctctgc

SEQ ID NO: 1700576 - DNA, 12 bp, Homo sapiens
ctcctgccctgt

SEQ ID NO: 1700577 - DNA, 14 bp, Homo sapiens
ctcctgccgcagac

SEQ ID NO: 1700578 - DNA, 17 bp, Homo sapiens
ctcctgccgcagagctg

SEQ ID NO: 1700579 - DNA, 18 bp, Homo sapiens
ctcctgccgcagagctgg

SEQ ID NO: 1700580 - DNA, 13 bp, Homo sapiens
ctcctgcctactc

SEQ ID NO: 1700581 - DNA, 14 bp, Homo sapiens
ctcctgcctactca

SEQ ID NO: 1700582 - DNA, 16 bp, Homo sapiens
ctcctgcctactcacg

SEQ ID NO: 1700583 - DNA, 19 bp, Homo sapiens
ctcctgcctgagtttccag

SEQ ID NO: 1700584 - DNA, 14 bp, Homo sapiens
ctcctgcctgtgct

SEQ ID NO: 1700585 - DNA, 18 bp, Homo sapiens
ctcctgcctgtgctgtga

SEQ ID NO: 1700586 - DNA, 19 bp, Homo sapiens
ctcctgcgtctgtttttaa

SEQ ID NO: 1700587 - DNA, 16 bp, Homo sapiens
ctcctgctcctccctg

SEQ ID NO: 1700588 - DNA, 18 bp, Homo sapiens
ctcctgctcctccctgcc

SEQ ID NO: 1700589 - DNA, 12 bp, Homo sapiens
ctcctgctctgg

SEQ ID NO: 1700590 - DNA, 14 bp, Homo sapiens
ctcctgctgccaca

SEQ ID NO: 1700591 - DNA, 23 bp, Homo sapiens
ctcctgctgccttttctggagtt

SEQ ID NO: 1700592 - DNA, 14 bp, Homo sapiens
ctcctgctgggcgt

SEQ ID NO: 1700593 - DNA, 11 bp, Homo sapiens
ctcctgctgtg

SEQ ID NO: 1700594 - DNA, 13 bp, Homo sapiens
ctcctgctgtgct

SEQ ID NO: 1700595 - DNA, 15 bp, Homo sapiens
ctcctgctgtgctgg

SEQ ID NO: 1700596 - DNA, 17 bp, Homo sapiens
ctcctgctgtgctggaa

SEQ ID NO: 1700597 - DNA, 19 bp, Homo sapiens
ctcctgcttaatcttcaaa

SEQ ID NO: 1700598 - DNA, 13 bp, Homo sapiens
ctcctgcttttct

SEQ ID NO: 1700599 - DNA, 18 bp, Homo sapiens
ctcctgcttttctgtcct

SEQ ID NO: 1700600 - DNA, 19 bp, Homo sapiens
ctcctgcttttctgtcctg

SEQ ID NO: 1700601 - DNA, 20 bp, Homo sapiens
ctcctgcttttctgtcctgg

SEQ ID NO: 1700602 - DNA, 17 bp, Homo sapiens
ctcctggaaaggctcag

SEQ ID NO: 1700603 - DNA, 18 bp, Homo sapiens
ctcctggaaaggctcagt

SEQ ID NO: 1700604 - DNA, 24 bp, Homo sapiens
ctcctggaaaggctcagtctcagg

SEQ ID NO: 1700605 - DNA, 14 bp, Homo sapiens
ctcctggaaatatt

SEQ ID NO: 1700606 - DNA, 15 bp, Homo sapiens
ctcctggaagcacag

SEQ ID NO: 1700607 - DNA, 18 bp, Homo sapiens
ctccagaagcctctggct

SEQ ID NO: 1700608 - DNA, 12 bp, Homo sapiens
ctccagaagctg

SEQ ID NO: 1700609 - DNA, 21 bp, Homo sapiens
ctccagaatctaaagccagtg

SEQ ID NO: 1700610 - DNA, 14 bp, Homo sapiens
ctccagaatctgct

SEQ ID NO: 1700611 - DNA, 15 bp, Homo sapiens
ctccagaatctgctg

SEQ ID NO: 1700612 - DNA, 17 bp, Homo sapiens
ctccagaatctgctgtt

SEQ ID NO: 1700613 - DNA, 20 bp, Homo sapiens
ctccagaatctgctgttgcc

SEQ ID NO: 1700614 - DNA, 21 bp, Homo sapiens
ctccagaatctgctgttgcca

SEQ ID NO: 1700615 - DNA, 17 bp, Homo sapiens
ctccagacccaccacac

SEQ ID NO: 1700616 - DNA, 18 bp, Homo sapiens
ctccagacccctggcttt

SEQ ID NO: 1700617 - DNA, 13 bp, Homo sapiens
ctccagaccctgc

SEQ ID NO: 1700618 - DNA, 21 bp, Homo sapiens
ctccagaccctgcctgagccc

SEQ ID NO: 1700619 - DNA, 19 bp, Homo sapiens
ctccagacctgatcctgga

SEQ ID NO: 1700620 - DNA, 18 bp, Homo sapiens
ctccagagacagggaaag

SEQ ID NO: 1700621 - DNA, 20 bp, Homo sapiens
ctccagagatgagtgtctgg

SEQ ID NO: 1700622 - DNA, 21 bp, Homo sapiens
ctccagagccagcctgggact

SEQ ID NO: 1700623 - DNA, 15 bp, Homo sapiens
ctccagatagagaaa

SEQ ID NO: 1700624 - DNA, 17 bp, Homo sapiens
ctccagatgtttccaga

SEQ ID NO: 1700625 - DNA, 14 bp, Homo sapiens
ctccagattctgat

SEQ ID NO: 1700626 - DNA, 21 bp, Homo sapiens
ctccagcaacttcttctccat

SEQ ID NO: 1700627 - DNA, 22 bp, Homo sapiens
ctccagcagcacacctcagccc

SEQ ID NO: 1700628 - DNA, 16 bp, Homo sapiens
ctccagcatccagcct

SEQ ID NO: 1700629 - DNA, 13 bp, Homo sapiens
ctccagccccatg

SEQ ID NO: 1700630 - DNA, 12 bp, Homo sapiens
ctccagcccctg

SEQ ID NO: 1700631 - DNA, 20 bp, Homo sapiens
ctccagcctccctgtctcca

SEQ ID NO: 1700632 - DNA, 23 bp, Homo sapiens
ctccagcctccctgtctccagct

SEQ ID NO: 1700633 - DNA, 17 bp, Homo sapiens
ctccagcctctcccggc

SEQ ID NO: 1700634 - DNA, 18 bp, Homo sapiens
ctccagcctctcccggct

SEQ ID NO: 1700635 - DNA, 24 bp, Homo sapiens
ctccagcctctcccggctgcctgc

SEQ ID NO: 1700636 - DNA, 11 bp, Homo sapiens
ctccagcctga

SEQ ID NO: 1700637 - DNA, 20 bp, Homo sapiens
ctccagcctgaacagaagct

SEQ ID NO: 1700638 - DNA, 15 bp, Homo sapiens
ctccagcctgggcaa

SEQ ID NO: 1700639 - DNA, 20 bp, Homo sapiens
ctccagcctgggcaacacag

SEQ ID NO: 1700640 - DNA, 16 bp, Homo sapiens
ctccagcctgggggac

SEQ ID NO: 1700641 - DNA, 23 bp, Homo sapiens
ctccagcgatggtgctgcccagg

SEQ ID NO: 1700642 - DNA, 19 bp, Homo sapiens
ctccagcggccctgtcatc

SEQ ID NO: 1700643 - DNA, 20 bp, Homo sapiens
ctccagctaaacaccaaccc

SEQ ID NO: 1700644 - DNA, 10 bp, Homo sapiens
ctccagctca

SEQ ID NO: 1700645 - DNA, 11 bp, Homo sapiens
ctccagctccc

SEQ ID NO: 1700646 - DNA, 16 bp, Homo sapiens
ctccagctcccactcc

SEQ ID NO: 1700647 - DNA, 12 bp, Homo sapiens
ctccagctctga

SEQ ID NO: 1700648 - DNA, 20 bp, Homo sapiens
ctccagctgactaaactttt

SEQ ID NO: 1700649 - DNA, 13 bp, Homo sapiens
ctccagctgcccc

SEQ ID NO: 1700650 - DNA, 18 bp, Homo sapiens
ctccagctgcctgggccc

SEQ ID NO: 1700651 - DNA, 19 bp, Homo sapiens
ctccagcttttctttttct

SEQ ID NO: 1700652 - DNA, 19 bp, Homo sapiens
ctccaggaaggtagcccag

SEQ ID NO: 1700653 - DNA, 23 bp, Homo sapiens
ctccaggaaggtagcccagcact

SEQ ID NO: 1700654 - DNA, 20 bp, Homo sapiens
ctccaggaatgcctcctccc

SEQ ID NO: 1700655 - DNA, 16 bp, Homo sapiens
ctccaggagcctaccc

SEQ ID NO: 1700656 - DNA, 17 bp, Homo sapiens
ctccaggagcctacccc

SEQ ID NO: 1700657 - DNA, 17 bp, Homo sapiens
ctccaggagcttcttgt

SEQ ID NO: 1700658 - DNA, 23 bp, Homo sapiens
ctccaggattttaatttcaggaa

SEQ ID NO: 1700659 - DNA, 15 bp, Homo sapiens
ctccaggccaggtgg

SEQ ID NO: 1700660 - DNA, 12 bp, Homo sapiens
ctccaggcccaa

SEQ ID NO: 1700661 - DNA, 15 bp, Homo sapiens
ctccaggcccatctc

SEQ ID NO: 1700662 - DNA, 16 bp, Homo sapiens
ctccaggcccatctca

SEQ ID NO: 1700663 - DNA, 19 bp, Homo sapiens
ctccaggcctgaccagggg

SEQ ID NO: 1700664 - DNA, 13 bp, Homo sapiens
ctccaggcctgca

SEQ ID NO: 1700665 - DNA, 13 bp, Homo sapiens
ctccaggcctgcc

SEQ ID NO: 1700666 - DNA, 15 bp, Homo sapiens
ctccaggcctgcctc

SEQ ID NO: 1700667 - DNA, 16 bp, Homo sapiens
ctccaggcctgcctcc

SEQ ID NO: 1700668 - DNA, 18 bp, Homo sapiens
ctccaggcctgcctccca

SEQ ID NO: 1700669 - DNA, 13 bp, Homo sapiens
ctccaggcctgtt

SEQ ID NO: 1700670 - DNA, 13 bp, Homo sapiens
ctccaggcgccgg

SEQ ID NO: 1700671 - DNA, 14 bp, Homo sapiens
ctccaggcgccggc

SEQ ID NO: 1700672 - DNA, 18 bp, Homo sapiens
ctccaggcgccggcgggc

SEQ ID NO: 1700673 - DNA, 16 bp, Homo sapiens
ctccagggaatccaag

SEQ ID NO: 1700674 - DNA, 20 bp, Homo sapiens
ctccagggagtcccctcccc

SEQ ID NO: 1700675 - DNA, 16 bp, Homo sapiens
ctccagggcattgctc

SEQ ID NO: 1700676 - DNA, 15 bp, Homo sapiens
ctccagggctggact

SEQ ID NO: 1700677 - DNA, 19 bp, Homo sapiens
ctccagggctggactgagg

SEQ ID NO: 1700678 - DNA, 20 bp, Homo sapiens
ctccagggctggactgaggc

SEQ ID NO: 1700679 - DNA, 18 bp, Homo sapiens
ctccaggggcctgcagaa

SEQ ID NO: 1700680 - DNA, 19 bp, Homo sapiens
ctccaggggcctgcagaag

SEQ ID NO: 1700681 - DNA, 21 bp, Homo sapiens
ctccaggggcctgcagaagga

SEQ ID NO: 1700682 - DNA, 14 bp, Homo sapiens
ctccaggggctgct

SEQ ID NO: 1700683 - DNA, 21 bp, Homo sapiens
ctccaggggctgcttcctcct

SEQ ID NO: 1700684 - DNA, 21 bp, Homo sapiens
ctccagggtcttgggctactg

SEQ ID NO: 1700685 - DNA, 23 bp, Homo sapiens
ctccagggtcttgggctactggc

SEQ ID NO: 1700686 - DNA, 16 bp, Homo sapiens
ctccaggtcagcctgg

SEQ ID NO: 1700687 - DNA, 22 bp, Homo sapiens
ctccagtacgtcccgctgctgt

SEQ ID NO: 1700688 - DNA, 17 bp, Homo sapiens
ctccagtgagtacctgc

SEQ ID NO: 1700689 - DNA, 19 bp, Homo sapiens
ctccagtgagtacctgcaa

SEQ ID NO: 1700690 - DNA, 15 bp, Homo sapiens
ctccagtgctcagct

SEQ ID NO: 1700691 - DNA, 14 bp, Homo sapiens
ctccagtggtgacc

SEQ ID NO: 1700692 - DNA, 18 bp, Homo sapiens
ctccagtttgcacctgtc

SEQ ID NO: 1700693 - DNA, 15 bp, Homo sapiens
ctccataaacagact

SEQ ID NO: 1700694 - DNA, 19 bp, Homo sapiens
ctccataaagtacaaatga

SEQ ID NO: 1700695 - DNA, 13 bp, Homo sapiens
ctccatacagcct

SEQ ID NO: 1700696 - DNA, 21 bp, Homo sapiens
ctccatacagcctctacagcc

SEQ ID NO: 1700697 - DNA, 20 bp, Homo sapiens
ctccataccttttctctttt

SEQ ID NO: 1700698 - DNA, 22 bp, Homo sapiens
ctccatatcagctctctgcaga

SEQ ID NO: 1700699 - DNA, 18 bp, Homo sapiens
actgttgcatttactttt

SEQ ID NO: 1700700 - DNA, 21 bp, Homo sapiens
actgttgctcaaatctattca

SEQ ID NO: 1700701 - DNA, 22 bp, Homo sapiens
actgttgtaagaattctgattg

SEQ ID NO: 1700702 - DNA, 19 bp, Homo sapiens
actgtttatacactgtgta

SEQ ID NO: 1700703 - DNA, 18 bp, Homo sapiens
actgtttatttaaggatg

SEQ ID NO: 1700704 - DNA, 23 bp, Homo sapiens
actgtttatttaaggatggatgg

SEQ ID NO: 1700705 - DNA, 15 bp, Homo sapiens
actgtttcactgaaa

SEQ ID NO: 1700706 - DNA, 16 bp, Homo sapiens
actgtttccctgctga

SEQ ID NO: 1700707 - DNA, 17 bp, Homo sapiens
actgtttccctgctgaa

SEQ ID NO: 1700708 - DNA, 18 bp, Homo sapiens
actgtttctcttgagctg

SEQ ID NO: 1700709 - DNA, 23 bp, Homo sapiens
actgtttgatataccaaattaaa

SEQ ID NO: 1700710 - DNA, 17 bp, Homo sapiens
actgtttgtaatataca

SEQ ID NO: 1700711 - DNA, 22 bp, Homo sapiens
actgtttgtaatatacagtttt

SEQ ID NO: 1700712 - DNA, 21 bp, Homo sapiens
actgtttgtttttatttaaat

SEQ ID NO: 1700713 - DNA, 16 bp, Homo sapiens
actgttttaattgtag

SEQ ID NO: 1700714 - DNA, 17 bp, Homo sapiens
actgttttaattgtagt

SEQ ID NO: 1700715 - DNA, 24 bp, Homo sapiens
actgttttatctctgtgaatcttg

SEQ ID NO: 1700716 - DNA, 13 bp, Homo sapiens
actgttttcatgt

SEQ ID NO: 1700717 - DNA, 15 bp, Homo sapiens
actgttttcatgtgt

SEQ ID NO: 1700718 - DNA, 22 bp, Homo sapiens
actgttttctctcggctcccca

SEQ ID NO: 1700719 - DNA, 14 bp, Homo sapiens
actgttttgggcct

SEQ ID NO: 1700720 - DNA, 15 bp, Homo sapiens
actgttttgggcctc

SEQ ID NO: 1700721 - DNA, 22 bp, Homo sapiens
ctccatgcagactgttagcttt

SEQ ID NO: 1700722 - DNA, 20 bp, Homo sapiens
ctccatgccccagctctgga

SEQ ID NO: 1700723 - DNA, 12 bp, Homo sapiens
ctccatgctgca

SEQ ID NO: 1700724 - DNA, 21 bp, Homo sapiens
ctccatgcttagtcactgcct

SEQ ID NO: 1700725 - DNA, 21 bp, Homo sapiens
ctccatggcagcagccaggga

SEQ ID NO: 1700726 - DNA, 13 bp, Homo sapiens
ctccatggccacc

SEQ ID NO: 1700727 - DNA, 16 bp, Homo sapiens
ctccatggccaccccg

SEQ ID NO: 1700728 - DNA, 18 bp, Homo sapiens
ctccatggggttcgagac

SEQ ID NO: 1700729 - DNA, 22 bp, Homo sapiens
ctccatggggttcgagactcca

SEQ ID NO: 1700730 - DNA, 23 bp, Homo sapiens
ctccatggggttcgagactccat

SEQ ID NO: 1700731 - DNA, 16 bp, Homo sapiens
ctccattcatccttcc

SEQ ID NO: 1700732 - DNA, 21 bp, Homo sapiens
ctccattcatccttccatcca

SEQ ID NO: 1700733 - DNA, 21 bp, Homo sapiens
ctccatttcccaaagtcctct

SEQ ID NO: 1700734 - DNA, 17 bp, Homo sapiens
ctccatttgctcttcag

SEQ ID NO: 1700735 - DNA, 15 bp, Homo sapiens
ctccattttagccca

SEQ ID NO: 1700736 - DNA, 20 bp, Homo sapiens
ctccatttttctcccaagaa

SEQ ID NO: 1700737 - DNA, 23 bp, Homo sapiens
ctccattttttcttcccttttcc

SEQ ID NO: 1700738 - DNA, 18 bp, Homo sapiens
ctcccaaacgccctttcc

SEQ ID NO: 1700739 - DNA, 23 bp, Homo sapiens
ctcccaaagctcagacttgccag

SEQ ID NO: 1700740 - DNA, 21 bp, Homo sapiens
ctcccaacatgcttgatgttt

SEQ ID NO: 1700741 - DNA, 15 bp, Homo sapiens
ctcccaacccattca

SEQ ID NO: 1700742 - DNA, 23 bp, Homo sapiens
ctcccaacccccctcctgctcct

SEQ ID NO: 1700743 - DNA, 14 bp, Homo sapiens
ctcccaaccctggc

SEQ ID NO: 1700744 - DNA, 16 bp, Homo sapiens
ctcccaaccctggctt

SEQ ID NO: 1700745 - DNA, 22 bp, Homo sapiens
ctcccaaccctgggctggggag

SEQ ID NO: 1700746 - DNA, 12 bp, Homo sapiens
ctcccaacctca

SEQ ID NO: 1700747 - DNA, 17 bp, Homo sapiens
ctcccaacttcttcctg

SEQ ID NO: 1700748 - DNA, 17 bp, Homo sapiens
ctcccaagcgttcctgg

SEQ ID NO: 1700749 - DNA, 21 bp, Homo sapiens
ctcccaagggtgccctttggg

SEQ ID NO: 1700750 - DNA, 17 bp, Homo sapiens
ctcccaaggtcctctca

SEQ ID NO: 1700751 - DNA, 19 bp, Homo sapiens
ctcccaaggtcctctcagt

SEQ ID NO: 1700752 - DNA, 17 bp, Homo sapiens
ctcccaatcagcttttg

SEQ ID NO: 1700753 - DNA, 23 bp, Homo sapiens
ctcccaatcagcttttgttctag

SEQ ID NO: 1700754 - DNA, 18 bp, Homo sapiens
ctcccaatcctctctccc

SEQ ID NO: 1700755 - DNA, 21 bp, Homo sapiens
ctcccaatttcagactcccat

SEQ ID NO: 1700756 - DNA, 15 bp, Homo sapiens
ctcccacagagacaa

SEQ ID NO: 1700757 - DNA, 14 bp, Homo sapiens
ctcccacagcctcc

SEQ ID NO: 1700758 - DNA, 20 bp, Homo sapiens
ctcccacaggcccttcctct

SEQ ID NO: 1700759 - DNA, 21 bp, Homo sapiens
ctcccacatgaggccatctca

SEQ ID NO: 1700760 - DNA, 13 bp, Homo sapiens
ctcccacccacag

SEQ ID NO: 1700761 - DNA, 17 bp, Homo sapiens
ctcccacccacagccat

SEQ ID NO: 1700762 - DNA, 13 bp, Homo sapiens
ctcccaccccacc

SEQ ID NO: 1700763 - DNA, 19 bp, Homo sapiens
ctcccaccccacccccttc

SEQ ID NO: 1700764 - DNA, 13 bp, Homo sapiens
ctcccaccccact

SEQ ID NO: 1700765 - DNA, 15 bp, Homo sapiens
ctcccaccccactcc

SEQ ID NO: 1700766 - DNA, 21 bp, Homo sapiens
ctcccaccccactccagccct

SEQ ID NO: 1700767 - DNA, 19 bp, Homo sapiens
ctcccacccccatctctcc

SEQ ID NO: 1700768 - DNA, 18 bp, Homo sapiens
ctcccacccccttctctg

SEQ ID NO: 1700769 - DNA, 18 bp, Homo sapiens
ctcccaccccggcctcca

SEQ ID NO: 1700770 - DNA, 15 bp, Homo sapiens
ctcccacccgatgct

SEQ ID NO: 1700771 - DNA, 18 bp, Homo sapiens
ctcccacccgatgctgct

SEQ ID NO: 1700772 - DNA, 15 bp, Homo sapiens
ctcccacccggccac

SEQ ID NO: 1700773 - DNA, 18 bp, Homo sapiens
ctcccacccggccacagc

SEQ ID NO: 1700774 - DNA, 21 bp, Homo sapiens
ctcccacccggccacagctgc

SEQ ID NO: 1700775 - DNA, 22 bp, Homo sapiens
ctcccacccggccacagctgct

SEQ ID NO: 1700776 - DNA, 23 bp, Homo sapiens
ctcccacccggccacagctgctg

SEQ ID NO: 1700777 - DNA, 17 bp, Homo sapiens
ctcccacccggctgcag

SEQ ID NO: 1700778 - DNA, 19 bp, Homo sapiens
ctcccacccggctgcagag

SEQ ID NO: 1700779 - DNA, 19 bp, Homo sapiens
ctcccaccgcagcgtcccc

SEQ ID NO: 1700780 - DNA, 12 bp, Homo sapiens
ctcccaccgccc

SEQ ID NO: 1700781 - DNA, 15 bp, Homo sapiens
ctcccacctagtgcc

SEQ ID NO: 1700782 - DNA, 14 bp, Homo sapiens
ctcccacctcagcc

SEQ ID NO: 1700783 - DNA, 12 bp, Homo sapiens
ctcccacctccc

SEQ ID NO: 1700784 - DNA, 15 bp, Homo sapiens
ctcccacctcccttc

SEQ ID NO: 1700785 - DNA, 16 bp, Homo sapiens
ctcccacctcccttcc

SEQ ID NO: 1700786 - DNA, 18 bp, Homo sapiens
ctcccacctcccttccca

SEQ ID NO: 1700787 - DNA, 14 bp, Homo sapiens
ctcccaccttggcc

SEQ ID NO: 1700788 - DNA, 21 bp, Homo sapiens
ctcccactcagaactctccag

SEQ ID NO: 1700789 - DNA, 15 bp, Homo sapiens
ctcccactccctttc

SEQ ID NO: 1700790 - DNA, 17 bp, Homo sapiens
ctcccactcctgctgca

SEQ ID NO: 1700791 - DNA, 22 bp, Homo sapiens
ctcccactcctgctgcacaggc

SEQ ID NO: 1700792 - DNA, 14 bp, Homo sapiens
ctcccactcctgtt

SEQ ID NO: 1700793 - DNA, 16 bp, Homo sapiens
ctcccactctttgaat

SEQ ID NO: 1700794 - DNA, 19 bp, Homo sapiens
ctcccagaggagccaccag

SEQ ID NO: 1700795 - DNA, 21 bp, Homo sapiens
ctcccagaggagccaccagtt

SEQ ID NO: 1700796 - DNA, 19 bp, Homo sapiens
ctcccagcagccctaagga

SEQ ID NO: 1700797 - DNA, 20 bp, Homo sapiens
ctcccagcccattgctgcca

SEQ ID NO: 1700798 - DNA, 18 bp, Homo sapiens
ctcccagcccctgcccct

SEQ ID NO: 1700799 - DNA, 22 bp, Homo sapiens
ctcccaggacctcggatgacca

SEQ ID NO: 1700800 - DNA, 19 bp, Homo sapiens
ctcccaggagacagttcaa

SEQ ID NO: 1700801 - DNA, 21 bp, Homo sapiens
ctcccaggccaggctccttcc

SEQ ID NO: 1700802 - DNA, 22 bp, Homo sapiens
ctcccaggcgccccttccccct

SEQ ID NO: 1700803 - DNA, 16 bp, Homo sapiens
ctcccagggccagggc

SEQ ID NO: 1700804 - DNA, 23 bp, Homo sapiens
ctcccagggccagggccctgcag

SEQ ID NO: 1700805 - DNA, 16 bp, Homo sapiens
ctcccaggggagccag

SEQ ID NO: 1700806 - DNA, 20 bp, Homo sapiens
ctcccaggggagccagctgc

SEQ ID NO: 1700807 - DNA, 18 bp, Homo sapiens
ctcccaggggtctccctg

SEQ ID NO: 1700808 - DNA, 23 bp, Homo sapiens
ctcccaggggtctccctggctcc

SEQ ID NO: 1700809 - DNA, 22 bp, Homo sapiens
ctcccaggtaccagctgcgctt

SEQ ID NO: 1700810 - DNA, 21 bp, Homo sapiens
ctcccaggtgttaacattcca

SEQ ID NO: 1700811 - DNA, 19 bp, Homo sapiens
ctcccaggttcccccagca

SEQ ID NO: 1700812 - DNA, 21 bp, Homo sapiens
ctcccaggttcccccagcaag

SEQ ID NO: 1700813 - DNA, 20 bp, Homo sapiens
ctcccagtccaaatgtcctc

SEQ ID NO: 1700814 - DNA, 14 bp, Homo sapiens
ctcccagtgccttc

SEQ ID NO: 1700815 - DNA, 20 bp, Homo sapiens
ctcccagtgggagcttcccg

SEQ ID NO: 1700816 - DNA, 14 bp, Homo sapiens
acttcacactgcaa

SEQ ID NO: 1700817 - DNA, 19 bp, Homo sapiens
acttcacactgcaagagcc

SEQ ID NO: 1700818 - DNA, 19 bp, Homo sapiens
acttcacagcgtctgctca

SEQ ID NO: 1700819 - DNA, 20 bp, Homo sapiens
acttcacagcgtctgctcat

SEQ ID NO: 1700820 - DNA, 15 bp, Homo sapiens
acttcaccaccccct

SEQ ID NO: 1700821 - DNA, 17 bp, Homo sapiens
acttcaccaccccctgt

SEQ ID NO: 1700822 - DNA, 21 bp, Homo sapiens
acttcaccaccccctgtccca

SEQ ID NO: 1700823 - DNA, 23 bp, Homo sapiens
acttcaccaccccctgtcccatt

SEQ ID NO: 1700824 - DNA, 15 bp, Homo sapiens
acttcacccccaact

SEQ ID NO: 1700825 - DNA, 15 bp, Homo sapiens
acttcacccgagttc

SEQ ID NO: 1700826 - DNA, 14 bp, Homo sapiens
acttcactgtatat

SEQ ID NO: 1700827 - DNA, 17 bp, Homo sapiens
acttcactgtatataaa

SEQ ID NO: 1700828 - DNA, 18 bp, Homo sapiens
acttcactgtatataaac

SEQ ID NO: 1700829 - DNA, 21 bp, Homo sapiens
acttcactgtatataaacata

SEQ ID NO: 1700830 - DNA, 12 bp, Homo sapiens
acttcactgtga

SEQ ID NO: 1700831 - DNA, 14 bp, Homo sapiens
acttcactgtgagg

SEQ ID NO: 1700832 - DNA, 17 bp, Homo sapiens
acttcactgtgagggga

SEQ ID NO: 1700833 - DNA, 16 bp, Homo sapiens
acttcagaaagacttg

SEQ ID NO: 1700834 - DNA, 20 bp, Homo sapiens
acttcagagtcctcattata

SEQ ID NO: 1700835 - DNA, 13 bp, Homo sapiens
ctccccaactccc

SEQ ID NO: 1700836 - DNA, 21 bp, Homo sapiens
ctccccacactaacctgggtt

SEQ ID NO: 1700837 - DNA, 15 bp, Homo sapiens
ctccccacactccac

SEQ ID NO: 1700838 - DNA, 18 bp, Homo sapiens
ctccccacactccactct

SEQ ID NO: 1700839 - DNA, 17 bp, Homo sapiens
ctccccacagtgccacc

SEQ ID NO: 1700840 - DNA, 16 bp, Homo sapiens
ctccccacgagggctg

SEQ ID NO: 1700841 - DNA, 16 bp, Homo sapiens
ctccccacgagtcacc

SEQ ID NO: 1700842 - DNA, 20 bp, Homo sapiens
ctccccacgagtcacctgca

SEQ ID NO: 1700843 - DNA, 21 bp, Homo sapiens
ctccccacgagtcacctgcaa

SEQ ID NO: 1700844 - DNA, 21 bp, Homo sapiens
ctccccagcattccagcccct

SEQ ID NO: 1700845 - DNA, 23 bp, Homo sapiens
ctccccagcattccagcccctct

SEQ ID NO: 1700846 - DNA, 13 bp, Homo sapiens
ctccccagcccag

SEQ ID NO: 1700847 - DNA, 16 bp, Homo sapiens
ctccccagcccagaga

SEQ ID NO: 1700848 - DNA, 16 bp, Homo sapiens
ctccccagccccaccc

SEQ ID NO: 1700849 - DNA, 17 bp, Homo sapiens
ctccccagctcttctct

SEQ ID NO: 1700850 - DNA, 22 bp, Homo sapiens
ctccccaggccaccccgctgat

SEQ ID NO: 1700851 - DNA, 16 bp, Homo sapiens
ctccccaggcctccag

SEQ ID NO: 1700852 - DNA, 18 bp, Homo sapiens
ctccccaggcctccagcc

SEQ ID NO: 1700853 - DNA, 20 bp, Homo sapiens
ctccccaggcctccagcctc

SEQ ID NO: 1700854 - DNA, 22 bp, Homo sapiens
ctccccagggagctctggggac

SEQ ID NO: 1700855 - DNA, 21 bp, Homo sapiens
ctccccaggggagagggtctg

SEQ ID NO: 1700856 - DNA, 17 bp, Homo sapiens
ctccccaggtccagctc

SEQ ID NO: 1700857 - DNA, 23 bp, Homo sapiens
ctccccaggtccagctctggagg

SEQ ID NO: 1700858 - DNA, 13 bp, Homo sapiens
ctccccagtgcct

SEQ ID NO: 1700859 - DNA, 19 bp, Homo sapiens
ctccccagtgcctgccact

SEQ ID NO: 1700860 - DNA, 14 bp, Homo sapiens
ctccccatgtgtcc

SEQ ID NO: 1700861 - DNA, 17 bp, Homo sapiens
ctccccattcacagagc

SEQ ID NO: 1700862 - DNA, 19 bp, Homo sapiens
ctccccattcacagagcct

SEQ ID NO: 1700863 - DNA, 17 bp, Homo sapiens
ctccccattcagacact

SEQ ID NO: 1700864 - DNA, 17 bp, Homo sapiens
ctccccatttcccatct

SEQ ID NO: 1700865 - DNA, 19 bp, Homo sapiens
ctccccatttcccatctgc

SEQ ID NO: 1700866 - DNA, 17 bp, Homo sapiens
ctcccccaaaccctgct

SEQ ID NO: 1700867 - DNA, 12 bp, Homo sapiens
ctcccccaaagc

SEQ ID NO: 1700868 - DNA, 14 bp, Homo sapiens
ctcccccaccccct

SEQ ID NO: 1700869 - DNA, 19 bp, Homo sapiens
ctcccccaccccctcccca

SEQ ID NO: 1700870 - DNA, 16 bp, Homo sapiens
ctcccccactcctcta

SEQ ID NO: 1700871 - DNA, 14 bp, Homo sapiens
ctccccccactgca

SEQ ID NO: 1700872 - DNA, 16 bp, Homo sapiens
ctccccccactgcagg

SEQ ID NO: 1700873 - DNA, 15 bp, Homo sapiens
ctccccccagactct

SEQ ID NO: 1700874 - DNA, 16 bp, Homo sapiens
ctccccccagactctt

SEQ ID NO: 1700875 - DNA, 15 bp, Homo sapiens
ctcccccgacactgc

SEQ ID NO: 1700876 - DNA, 14 bp, Homo sapiens
ctccccctcctgct

SEQ ID NO: 1700877 - DNA, 17 bp, Homo sapiens
ctccccctccttgtgcc

SEQ ID NO: 1700878 - DNA, 13 bp, Homo sapiens
ctccccctctgct

SEQ ID NO: 1700879 - DNA, 15 bp, Homo sapiens
ctccccctctgcttc

SEQ ID NO: 1700880 - DNA, 17 bp, Homo sapiens
ctccccctctgcttctc

SEQ ID NO: 1700881 - DNA, 12 bp, Homo sapiens
ctccccctgcaa

SEQ ID NO: 1700882 - DNA, 19 bp, Homo sapiens
ctccccctgccagtgcctt

SEQ ID NO: 1700883 - DNA, 13 bp, Homo sapiens
ctccccctgctgc

SEQ ID NO: 1700884 - DNA, 13 bp, Homo sapiens
ctccccctgggct

SEQ ID NO: 1700885 - DNA, 12 bp, Homo sapiens
ctccccctgttc

SEQ ID NO: 1700886 - DNA, 17 bp, Homo sapiens
ctccccgaggctgcccc

SEQ ID NO: 1700887 - DNA, 20 bp, Homo sapiens
ctccccgcccctgtggccct

SEQ ID NO: 1700888 - DNA, 16 bp, Homo sapiens
ctccccgcctccactc

SEQ ID NO: 1700889 - DNA, 13 bp, Homo sapiens
ctccccgctcagg

SEQ ID NO: 1700890 - DNA, 14 bp, Homo sapiens
ctccccgctcaggg

SEQ ID NO: 1700891 - DNA, 19 bp, Homo sapiens
ctccccgctcaggggcctg

SEQ ID NO: 1700892 - DNA, 17 bp, Homo sapiens
ctccccgctctccctgt

SEQ ID NO: 1700893 - DNA, 18 bp, Homo sapiens
ctccccgctctccctgtc

SEQ ID NO: 1700894 - DNA, 15 bp, Homo sapiens
ctccccggcaggcct

SEQ ID NO: 1700895 - DNA, 16 bp, Homo sapiens
ctccccggcaggcctg

SEQ ID NO: 1700896 - DNA, 17 bp, Homo sapiens
ctccccggcaggcctga

SEQ ID NO: 1700897 - DNA, 21 bp, Homo sapiens
ctccccggcaggcctgagaat

SEQ ID NO: 1700898 - DNA, 15 bp, Homo sapiens
ctccccggccacatg

SEQ ID NO: 1700899 - DNA, 16 bp, Homo sapiens
ctccccggccctacca

SEQ ID NO: 1700900 - DNA, 19 bp, Homo sapiens
ctcccctagctcaccaggc

SEQ ID NO: 1700901 - DNA, 22 bp, Homo sapiens
ctcccctagctcaccaggcctg

SEQ ID NO: 1700902 - DNA, 17 bp, Homo sapiens
ctcccctatgctggtag

SEQ ID NO: 1700903 - DNA, 18 bp, Homo sapiens
ctcccctatgctggtaga

SEQ ID NO: 1700904 - DNA, 15 bp, Homo sapiens
ctcccctccaacctg

SEQ ID NO: 1700905 - DNA, 14 bp, Homo sapiens
ctcccctccacagc

SEQ ID NO: 1700906 - DNA, 18 bp, Homo sapiens
ctcccctccacagctgca

SEQ ID NO: 1700907 - DNA, 16 bp, Homo sapiens
ctcccctcccacccac

SEQ ID NO: 1700908 - DNA, 17 bp, Homo sapiens
ctcccctcctcttccct

SEQ ID NO: 1700909 - DNA, 22 bp, Homo sapiens
ctcccctcctggcgagttctct

SEQ ID NO: 1700910 - DNA, 14 bp, Homo sapiens
ctcccctctcagaa

SEQ ID NO: 1700911 - DNA, 22 bp, Homo sapiens
ctcccctctcagaacatactga

SEQ ID NO: 1700912 - DNA, 15 bp, Homo sapiens
ctcccctctcttgca

SEQ ID NO: 1700913 - DNA, 21 bp, Homo sapiens
ctcccctgcactggagtccag

SEQ ID NO: 1700914 - DNA, 14 bp, Homo sapiens
ctcccctgcactgt

SEQ ID NO: 1700915 - DNA, 14 bp, Homo sapiens
ctcccctgccattt

SEQ ID NO: 1700916 - DNA, 22 bp, Homo sapiens
ctcccctgcccccaggactggg

SEQ ID NO: 1700917 - DNA, 23 bp, Homo sapiens
ctcccctgcccccaggactgggc

SEQ ID NO: 1700918 - DNA, 12 bp, Homo sapiens
ctcccctgccct

SEQ ID NO: 1700919 - DNA, 12 bp, Homo sapiens
ctcccctgctcc

SEQ ID NO: 1700920 - DNA, 15 bp, Homo sapiens
ctcccctgctcccag

SEQ ID NO: 1700921 - DNA, 18 bp, Homo sapiens
ctcccctggagccagcag

SEQ ID NO: 1700922 - DNA, 21 bp, Homo sapiens
ctcccctgggttaacaaatga

SEQ ID NO: 1700923 - DNA, 22 bp, Homo sapiens
ctccccttcccctttactcagc

SEQ ID NO: 1700924 - DNA, 19 bp, Homo sapiens
ctccccttcctcactgccc

SEQ ID NO: 1700925 - DNA, 12 bp, Homo sapiens
ctcccctttctt

SEQ ID NO: 1700926 - DNA, 15 bp, Homo sapiens
ctcccgcaccaggcc

SEQ ID NO: 1700927 - DNA, 18 bp, Homo sapiens
ctcccgcaccaggccggg

SEQ ID NO: 1700928 - DNA, 13 bp, Homo sapiens
ctcccgccccgcc

SEQ ID NO: 1700929 - DNA, 18 bp, Homo sapiens
ctcccgccccgcccctcc

SEQ ID NO: 1700930 - DNA, 21 bp, Homo sapiens
ctcccgcccttccatgtgcct

SEQ ID NO: 1700931 - DNA, 22 bp, Homo sapiens
ctcccgcccttccatgtgcctt

SEQ ID NO: 1700932 - DNA, 17 bp, Homo sapiens
ctcccgctgctgctgct

SEQ ID NO: 1700933 - DNA, 14 bp, Homo sapiens
ctcccgcttcctgg

SEQ ID NO: 1700934 - DNA, 18 bp, Homo sapiens
ctcccgcttcctggcctc

SEQ ID NO: 1700935 - DNA, 17 bp, Homo sapiens
acttctttttaatctta

SEQ ID NO: 1700936 - DNA, 11 bp, Homo sapiens
acttgaaatat

SEQ ID NO: 1700937 - DNA, 14 bp, Homo sapiens
acttgaaatatata

SEQ ID NO: 1700938 - DNA, 17 bp, Homo sapiens
acttgaaatatataata

SEQ ID NO: 1700939 - DNA, 14 bp, Homo sapiens
acttgaaatgttag

SEQ ID NO: 1700940 - DNA, 17 bp, Homo sapiens
acttgaacccgggaggc

SEQ ID NO: 1700941 - DNA, 22 bp, Homo sapiens
acttgaacccgggggacagagg

SEQ ID NO: 1700942 - DNA, 13 bp, Homo sapiens
acttgaagcagtc

SEQ ID NO: 1700943 - DNA, 15 bp, Homo sapiens
acttgaagggccaga

SEQ ID NO: 1700944 - DNA, 20 bp, Homo sapiens
acttgaagggccagagccag

SEQ ID NO: 1700945 - DNA, 22 bp, Homo sapiens
acttgaagggccagagccaggg

SEQ ID NO: 1700946 - DNA, 24 bp, Homo sapiens
acttgaatgctagttatacttatt

SEQ ID NO: 1700947 - DNA, 19 bp, Homo sapiens
acttgacaacatcccacag

SEQ ID NO: 1700948 - DNA, 13 bp, Homo sapiens
acttgacattcct

SEQ ID NO: 1700949 - DNA, 14 bp, Homo sapiens
acttgaccattctc

SEQ ID NO: 1700950 - DNA, 19 bp, Homo sapiens
ctcccgtcagggcccaagt

SEQ ID NO: 1700951 - DNA, 22 bp, Homo sapiens
ctccctaacagtgaaaagagag

SEQ ID NO: 1700952 - DNA, 18 bp, Homo sapiens
ctccctactcccctgggc

SEQ ID NO: 1700953 - DNA, 21 bp, Homo sapiens
ctccctagccagcacttgtat

SEQ ID NO: 1700954 - DNA, 19 bp, Homo sapiens
ctccctagtgtagagcaag

SEQ ID NO: 1700955 - DNA, 22 bp, Homo sapiens
ctccctagttagcatccaggct

SEQ ID NO: 1700956 - DNA, 23 bp, Homo sapiens
ctccctatctaaccctcccatgg

SEQ ID NO: 1700957 - DNA, 17 bp, Homo sapiens
ctccctcacccccaggt

SEQ ID NO: 1700958 - DNA, 17 bp, Homo sapiens
ctccctcagctctctgg

SEQ ID NO: 1700959 - DNA, 14 bp, Homo sapiens
ctccctcagtgccc

SEQ ID NO: 1700960 - DNA, 23 bp, Homo sapiens
ctccctcagtgccctcattttat

SEQ ID NO: 1700961 - DNA, 14 bp, Homo sapiens
ctccctcatggctc

SEQ ID NO: 1700962 - DNA, 14 bp, Homo sapiens
ctccctccaccagc

SEQ ID NO: 1700963 - DNA, 15 bp, Homo sapiens
ctccctccaccagcc

SEQ ID NO: 1700964 - DNA, 16 bp, Homo sapiens
ctccctccaccagcct

SEQ ID NO: 1700965 - DNA, 14 bp, Homo sapiens
ctccctcccaagga

SEQ ID NO: 1700966 - DNA, 17 bp, Homo sapiens
ctccctcccaaggagcc

SEQ ID NO: 1700967 - DNA, 21 bp, Homo sapiens
ctccctcccctgccctggtcc

SEQ ID NO: 1700968 - DNA, 23 bp, Homo sapiens
ctccctcccctgccctggtccag

SEQ ID NO: 1700969 - DNA, 21 bp, Homo sapiens
ctccctcctcacctctggact

SEQ ID NO: 1700970 - DNA, 14 bp, Homo sapiens
ctccctcctccagg

SEQ ID NO: 1700971 - DNA, 23 bp, Homo sapiens
ctccctcctgcaggctggctgtt

SEQ ID NO: 1700972 - DNA, 14 bp, Homo sapiens
ctccctcgccctgt

SEQ ID NO: 1700973 - DNA, 16 bp, Homo sapiens
ctccctcgccctgtga

SEQ ID NO: 1700974 - DNA, 15 bp, Homo sapiens
ctccctcgctgtatg

SEQ ID NO: 1700975 - DNA, 12 bp, Homo sapiens
ctccctctccca

SEQ ID NO: 1700976 - DNA, 12 bp, Homo sapiens
ctccctctcctg

SEQ ID NO: 1700977 - DNA, 13 bp, Homo sapiens
ctccctctcctgc

SEQ ID NO: 1700978 - DNA, 14 bp, Homo sapiens
ctccctctcctgcc

SEQ ID NO: 1700979 - DNA, 17 bp, Homo sapiens
ctccctctctcatgaga

SEQ ID NO: 1700980 - DNA, 15 bp, Homo sapiens
ctccctctctcttct

SEQ ID NO: 1700981 - DNA, 20 bp, Homo sapiens
ctccctctctcttctgctcc

SEQ ID NO: 1700982 - DNA, 21 bp, Homo sapiens
ctccctctctcttctgctcca

SEQ ID NO: 1700983 - DNA, 16 bp, Homo sapiens
ctccctctctggtttc

SEQ ID NO: 1700984 - DNA, 13 bp, Homo sapiens
ctccctctgacct

SEQ ID NO: 1700985 - DNA, 18 bp, Homo sapiens
ctccctctgacctgcagg

SEQ ID NO: 1700986 - DNA, 14 bp, Homo sapiens
ctccctctgcccca

SEQ ID NO: 1700987 - DNA, 23 bp, Homo sapiens
ctccctctgccccaagcagccag

SEQ ID NO: 1700988 - DNA, 15 bp, Homo sapiens
ctccctctggccctg

SEQ ID NO: 1700989 - DNA, 17 bp, Homo sapiens
ctccctctggccctgcc

SEQ ID NO: 1700990 - DNA, 18 bp, Homo sapiens
ctccctctggccctgcct

SEQ ID NO: 1700991 - DNA, 23 bp, Homo sapiens
ctccctcttcactgtggccacag

SEQ ID NO: 1700992 - DNA, 21 bp, Homo sapiens
ctccctgaccttagcgttctg

SEQ ID NO: 1700993 - DNA, 16 bp, Homo sapiens
ctccctgagctttggg

SEQ ID NO: 1700994 - DNA, 11 bp, Homo sapiens
ctccctgcaca

SEQ ID NO: 1700995 - DNA, 17 bp, Homo sapiens
ctccctgcacagcctct

SEQ ID NO: 1700996 - DNA, 18 bp, Homo sapiens
ctccctgcacagcctcta

SEQ ID NO: 1700997 - DNA, 19 bp, Homo sapiens
ctccctgccaagtctcaga

SEQ ID NO: 1700998 - DNA, 21 bp, Homo sapiens
ctccctgccaagtctcagaag

SEQ ID NO: 1700999 - DNA, 22 bp, Homo sapiens
ctccctgccaagtctcagaaga

SEQ ID NO: 1701000 - DNA, 14 bp, Homo sapiens
ctccctgcccccca

SEQ ID NO: 1701001 - DNA, 14 bp, Homo sapiens
ctccctgcccctcc

SEQ ID NO: 1701002 - DNA, 18 bp, Homo sapiens
ctccctgccccttaaccc

SEQ ID NO: 1701003 - DNA, 23 bp, Homo sapiens
ctccctgcctacacacacagcct

SEQ ID NO: 1701004 - DNA, 16 bp, Homo sapiens
ctccctgcctggcccc

SEQ ID NO: 1701005 - DNA, 18 bp, Homo sapiens
ctccctgcctggccccca

SEQ ID NO: 1701006 - DNA, 18 bp, Homo sapiens
ctccctggaagctggaag

SEQ ID NO: 1701007 - DNA, 20 bp, Homo sapiens
ctccctggaggcacgcacca

SEQ ID NO: 1701008 - DNA, 22 bp, Homo sapiens
ctccctggaggcacgcaccact

SEQ ID NO: 1701009 - DNA, 16 bp, Homo sapiens
ctccctggatcacata

SEQ ID NO: 1701010 - DNA, 17 bp, Homo sapiens
ctccctggcagacacaa

SEQ ID NO: 1701011 - DNA, 18 bp, Homo sapiens
ctccctggccttgcccgt

SEQ ID NO: 1701012 - DNA, 11 bp, Homo sapiens
ctccctggctc

SEQ ID NO: 1701013 - DNA, 15 bp, Homo sapiens
ctccctggctccctc

SEQ ID NO: 1701014 - DNA, 16 bp, Homo sapiens
ctccctggctctcaga

SEQ ID NO: 1701015 - DNA, 13 bp, Homo sapiens
ctccctggctgcc

SEQ ID NO: 1701016 - DNA, 14 bp, Homo sapiens
ctccctggctgccc

SEQ ID NO: 1701017 - DNA, 17 bp, Homo sapiens
ctccctggctgccctgg

SEQ ID NO: 1701018 - DNA, 18 bp, Homo sapiens
ctccctggctgccctggc

SEQ ID NO: 1701019 - DNA, 21 bp, Homo sapiens
ctccctggctgccctggccct

SEQ ID NO: 1701020 - DNA, 17 bp, Homo sapiens
ctccctggctgtgagca

SEQ ID NO: 1701021 - DNA, 18 bp, Homo sapiens
ctccctggctgtgagcag

SEQ ID NO: 1701022 - DNA, 19 bp, Homo sapiens
ctccctggctgtgagcagc

SEQ ID NO: 1701023 - DNA, 19 bp, Homo sapiens
ctccctggggaccaggagc

SEQ ID NO: 1701024 - DNA, 18 bp, Homo sapiens
ctccctgtagctctgcct

SEQ ID NO: 1701025 - DNA, 21 bp, Homo sapiens
ctccctgtaggaagtcatcct

SEQ ID NO: 1701026 - DNA, 22 bp, Homo sapiens
ctccctgtagggtccaaccaga

SEQ ID NO: 1701027 - DNA, 11 bp, Homo sapiens
ctccctgtcct

SEQ ID NO: 1701028 - DNA, 20 bp, Homo sapiens
ctccctgtctccagctgcct

SEQ ID NO: 1701029 - DNA, 16 bp, Homo sapiens
ctccctgtctgtgtcc

SEQ ID NO: 1701030 - DNA, 21 bp, Homo sapiens
ctccctgtctgtgtcccagcc

SEQ ID NO: 1701031 - DNA, 22 bp, Homo sapiens
ctccctgtctgtgtcccagcca

SEQ ID NO: 1701032 - DNA, 23 bp, Homo sapiens
ctccctgttatttttctgccctg

SEQ ID NO: 1701033 - DNA, 18 bp, Homo sapiens
ctccctgttccccagaga

SEQ ID NO: 1701034 - DNA, 12 bp, Homo sapiens
ctcccttcaacc

SEQ ID NO: 1701035 - DNA, 18 bp, Homo sapiens
ctcccttcaaccattccc

SEQ ID NO: 1701036 - DNA, 19 bp, Homo sapiens
ctcccttcaaccattcccc

SEQ ID NO: 1701037 - DNA, 19 bp, Homo sapiens
ctcccttccatgccccagg

SEQ ID NO: 1701038 - DNA, 20 bp, Homo sapiens
ctcccttccatgccccagga

SEQ ID NO: 1701039 - DNA, 23 bp, Homo sapiens
ctcccttccatgccccaggatca

SEQ ID NO: 1701040 - DNA, 20 bp, Homo sapiens
ctcccttcccacctactgca

SEQ ID NO: 1701041 - DNA, 22 bp, Homo sapiens
ctcccttcccacctactgcact

SEQ ID NO: 1701042 - DNA, 18 bp, Homo sapiens
ctcccttccctccctgag

SEQ ID NO: 1701043 - DNA, 18 bp, Homo sapiens
ctcccttccgctgcgggc

SEQ ID NO: 1701044 - DNA, 15 bp, Homo sapiens
ctcccttcctgccac

SEQ ID NO: 1701045 - DNA, 17 bp, Homo sapiens
ctcccttcctgccactg

SEQ ID NO: 1701046 - DNA, 15 bp, Homo sapiens
ctcccttcctggcct

SEQ ID NO: 1701047 - DNA, 12 bp, Homo sapiens
ctcccttccttt

SEQ ID NO: 1701048 - DNA, 15 bp, Homo sapiens
ctcccttctcctttc

SEQ ID NO: 1701049 - DNA, 14 bp, Homo sapiens
ctcccttctctctc

SEQ ID NO: 1701050 - DNA, 23 bp, Homo sapiens
ctcccttgaggatggagagcagc

SEQ ID NO: 1701051 - DNA, 20 bp, Homo sapiens
ctcccttgagggtttgagag

SEQ ID NO: 1701052 - DNA, 22 bp, Homo sapiens
ctcccttgcctttcgaggcctg

SEQ ID NO: 1701053 - DNA, 20 bp, Homo sapiens
acttgttttggatggcttgt

SEQ ID NO: 1701054 - DNA, 13 bp, Homo sapiens
actttaaaaagga

SEQ ID NO: 1701055 - DNA, 14 bp, Homo sapiens
actttaaaaaggaa

SEQ ID NO: 1701056 - DNA, 20 bp, Homo sapiens
actttaaaaaggaaatttgt

SEQ ID NO: 1701057 - DNA, 19 bp, Homo sapiens
actttaaaaatttactaca

SEQ ID NO: 1701058 - DNA, 19 bp, Homo sapiens
actttaaagctcaggaggg

SEQ ID NO: 1701059 - DNA, 21 bp, Homo sapiens
actttaaatcttttcttcaac

SEQ ID NO: 1701060 - DNA, 13 bp, Homo sapiens
actttaaattgtg

SEQ ID NO: 1701061 - DNA, 20 bp, Homo sapiens
actttaacttagttttgcat

SEQ ID NO: 1701062 - DNA, 13 bp, Homo sapiens
actttaatacagc

SEQ ID NO: 1701063 - DNA, 20 bp, Homo sapiens
actttaattaccaacctgtt

SEQ ID NO: 1701064 - DNA, 15 bp, Homo sapiens
ctgaacccctggcca

SEQ ID NO: 1701065 - DNA, 17 bp, Homo sapiens
ctgaacccctggccagc

SEQ ID NO: 1701066 - DNA, 19 bp, Homo sapiens
ctgaaccgcacagctcagg

SEQ ID NO: 1701067 - DNA, 20 bp, Homo sapiens
ctgaaccgcacagctcagga

SEQ ID NO: 1701068 - DNA, 19 bp, Homo sapiens
ctgaacctggaaatgatgt

SEQ ID NO: 1701069 - DNA, 20 bp, Homo sapiens
ctgaacctggaaatgatgtt

SEQ ID NO: 1701070 - DNA, 18 bp, Homo sapiens
ctgaaccttaggctttgt

SEQ ID NO: 1701071 - DNA, 16 bp, Homo sapiens
ctgaaccttgagcaaa

SEQ ID NO: 1701072 - DNA, 14 bp, Homo sapiens
ctgaacgcagaaga

SEQ ID NO: 1701073 - DNA, 16 bp, Homo sapiens
ctgaacgttttcttct

SEQ ID NO: 1701074 - DNA, 13 bp, Homo sapiens
ctgaactatttat

SEQ ID NO: 1701075 - DNA, 17 bp, Homo sapiens
ctgaactattttaaata

SEQ ID NO: 1701076 - DNA, 15 bp, Homo sapiens
ctgaactcaaactga

SEQ ID NO: 1701077 - DNA, 14 bp, Homo sapiens
ctgaactcaagctg

SEQ ID NO: 1701078 - DNA, 18 bp, Homo sapiens
ctgaactcaagctgcgtt

SEQ ID NO: 1701079 - DNA, 13 bp, Homo sapiens
ctgaactccaccg

SEQ ID NO: 1701080 - DNA, 22 bp, Homo sapiens
ctgaactccaccgaccaactgc

SEQ ID NO: 1701081 - DNA, 23 bp, Homo sapiens
ctgaactccaccgaccaactgcc

SEQ ID NO: 1701082 - DNA, 21 bp, Homo sapiens
ctgaactccatacagcctcta

SEQ ID NO: 1701083 - DNA, 14 bp, Homo sapiens
ctgaactcccagaa

SEQ ID NO: 1701084 - DNA, 14 bp, Homo sapiens
ctgaactcttcaga

SEQ ID NO: 1701085 - DNA, 16 bp, Homo sapiens
ctgaactgagcctagc

SEQ ID NO: 1701086 - DNA, 13 bp, Homo sapiens
ctgaactgaggag

SEQ ID NO: 1701087 - DNA, 23 bp, Homo sapiens
ctgaactgaggagatgaccaggg

SEQ ID NO: 1701088 - DNA, 14 bp, Homo sapiens
ctgaactgaggcct

SEQ ID NO: 1701089 - DNA, 13 bp, Homo sapiens
ctgaagaacagta

SEQ ID NO: 1701090 - DNA, 17 bp, Homo sapiens
ctgaagaactctctgga

SEQ ID NO: 1701091 - DNA, 13 bp, Homo sapiens
ctgaagaatgaag

SEQ ID NO: 1701092 - DNA, 15 bp, Homo sapiens
ctgaagaatgaagac

SEQ ID NO: 1701093 - DNA, 13 bp, Homo sapiens
ctgaagaattgaa

SEQ ID NO: 1701094 - DNA, 16 bp, Homo sapiens
ctgaagaggcgggcca

SEQ ID NO: 1701095 - DNA, 20 bp, Homo sapiens
ctgaagaggcgggccagcca

SEQ ID NO: 1701096 - DNA, 20 bp, Homo sapiens
ctgaagagtgggtttcacaa

SEQ ID NO: 1701097 - DNA, 18 bp, Homo sapiens
ctgaagatctaaactttt

SEQ ID NO: 1701098 - DNA, 15 bp, Homo sapiens
ctgaagatgggagcc

SEQ ID NO: 1701099 - DNA, 17 bp, Homo sapiens
ctgaagatgggagcctt

SEQ ID NO: 1701100 - DNA, 17 bp, Homo sapiens
ctgaagattaggcacac

SEQ ID NO: 1701101 - DNA, 17 bp, Homo sapiens
ctgaagatttcagaggc

SEQ ID NO: 1701102 - DNA, 19 bp, Homo sapiens
ctgaagatttccatttgtc

SEQ ID NO: 1701103 - DNA, 20 bp, Homo sapiens
ctgaagatttccatttgtca

SEQ ID NO: 1701104 - DNA, 18 bp, Homo sapiens
ctgaagcagttcagaagg

SEQ ID NO: 1701105 - DNA, 17 bp, Homo sapiens
ctgaagccagctgccct

SEQ ID NO: 1701106 - DNA, 14 bp, Homo sapiens
ctgaagccattgga

SEQ ID NO: 1701107 - DNA, 23 bp, Homo sapiens
ctgaagccggacagctgcccaga

SEQ ID NO: 1701108 - DNA, 14 bp, Homo sapiens
ctgaagctgctgca

SEQ ID NO: 1701109 - DNA, 14 bp, Homo sapiens
ctgaagctgctgga

SEQ ID NO: 1701110 - DNA, 18 bp, Homo sapiens
ctgaagctggagcagcgg

SEQ ID NO: 1701111 - DNA, 11 bp, Homo sapiens
ctgaaggaaaa

SEQ ID NO: 1701112 - DNA, 18 bp, Homo sapiens
ctgaaggaatagccagag

SEQ ID NO: 1701113 - DNA, 21 bp, Homo sapiens
ctgaaggacacttcctgccta

SEQ ID NO: 1701114 - DNA, 12 bp, Homo sapiens
ctgaaggactgg

SEQ ID NO: 1701115 - DNA, 12 bp, Homo sapiens
ctgaaggagaag

SEQ ID NO: 1701116 - DNA, 17 bp, Homo sapiens
ctgaaggcaacctggaa

SEQ ID NO: 1701117 - DNA, 22 bp, Homo sapiens
ctgaaggcagtggcaggggagc

SEQ ID NO: 1701118 - DNA, 17 bp, Homo sapiens
ctgaagggaactagagg

SEQ ID NO: 1701119 - DNA, 21 bp, Homo sapiens
ctgaaggggttctcacagtgg

SEQ ID NO: 1701120 - DNA, 21 bp, Homo sapiens
ctgaagtcacatcacaggaca

SEQ ID NO: 1701121 - DNA, 22 bp, Homo sapiens
ctgaagtcacatcacaggacac

SEQ ID NO: 1701122 - DNA, 14 bp, Homo sapiens
ctgaagtcactgca

SEQ ID NO: 1701123 - DNA, 16 bp, Homo sapiens
ctgaagtcactgcaca

SEQ ID NO: 1701124 - DNA, 19 bp, Homo sapiens
ctgaagtgagcacagccta

SEQ ID NO: 1701125 - DNA, 14 bp, Homo sapiens
ctgaagttctgagc

SEQ ID NO: 1701126 - DNA, 23 bp, Homo sapiens
ctgaagtttttttgctgctgcct

SEQ ID NO: 1701127 - DNA, 14 bp, Homo sapiens
ctgaataaagcaat

SEQ ID NO: 1701128 - DNA, 15 bp, Homo sapiens
ctgaataaagcaatt

SEQ ID NO: 1701129 - DNA, 11 bp, Homo sapiens
ctgaataataa

SEQ ID NO: 1701130 - DNA, 14 bp, Homo sapiens
ctgaataatatcaa

SEQ ID NO: 1701131 - DNA, 16 bp, Homo sapiens
ctgaataatgctacca

SEQ ID NO: 1701132 - DNA, 19 bp, Homo sapiens
ctgaataatgctaccagga

SEQ ID NO: 1701133 - DNA, 23 bp, Homo sapiens
ctgaataatgctaccaggatgct

SEQ ID NO: 1701134 - DNA, 17 bp, Homo sapiens
ctgaatatacagcaggt

SEQ ID NO: 1701135 - DNA, 19 bp, Homo sapiens
ctgaatatcagtcactgtt

SEQ ID NO: 1701136 - DNA, 16 bp, Homo sapiens
ctgaatattctagaac

SEQ ID NO: 1701137 - DNA, 13 bp, Homo sapiens
ctgaatatttttt

SEQ ID NO: 1701138 - DNA, 14 bp, Homo sapiens
ctgaatattttttg

SEQ ID NO: 1701139 - DNA, 23 bp, Homo sapiens
ctgaatcccggcggaaagcctct

SEQ ID NO: 1701140 - DNA, 12 bp, Homo sapiens
ctgaatctcata

SEQ ID NO: 1701141 - DNA, 15 bp, Homo sapiens
ctgaatctgctacca

SEQ ID NO: 1701142 - DNA, 15 bp, Homo sapiens
ctgaatctgtgcctg

SEQ ID NO: 1701143 - DNA, 16 bp, Homo sapiens
ctgaatctgtgcctgc

SEQ ID NO: 1701144 - DNA, 23 bp, Homo sapiens
ctgaatctgtgcctgcactgaga

SEQ ID NO: 1701145 - DNA, 23 bp, Homo sapiens
ctgaatgcagggaatgcaatcct

SEQ ID NO: 1701146 - DNA, 23 bp, Homo sapiens
ctgaatgcctcgctcccttcaag

SEQ ID NO: 1701147 - DNA, 12 bp, Homo sapiens
ctgaatgctctg

SEQ ID NO: 1701148 - DNA, 20 bp, Homo sapiens
ctgaatgctgttaatatttc

SEQ ID NO: 1701149 - DNA, 22 bp, Homo sapiens
ctgaatgctgttaatatttcta

SEQ ID NO: 1701150 - DNA, 22 bp, Homo sapiens
ctgaatggaaggtttgtatatt

SEQ ID NO: 1701151 - DNA, 22 bp, Homo sapiens
ctgaatggttccatgcctgagg

SEQ ID NO: 1701152 - DNA, 19 bp, Homo sapiens
ctgaatggttttcaaaata

SEQ ID NO: 1701153 - DNA, 18 bp, Homo sapiens
ctgaatgtcaagaaaagg

SEQ ID NO: 1701154 - DNA, 22 bp, Homo sapiens
ctgaatgtgcctaatggagaag

SEQ ID NO: 1701155 - DNA, 23 bp, Homo sapiens
ctgaatgtgcctaatggagaaga

SEQ ID NO: 1701156 - DNA, 16 bp, Homo sapiens
ctgaattaaataaata

SEQ ID NO: 1701157 - DNA, 14 bp, Homo sapiens
ctgaattaattaat

SEQ ID NO: 1701158 - DNA, 16 bp, Homo sapiens
ctgaattaattaattt

SEQ ID NO: 1701159 - DNA, 18 bp, Homo sapiens
ctgaattatctatttcat

SEQ ID NO: 1701160 - DNA, 13 bp, Homo sapiens
ctgaattcactcc

SEQ ID NO: 1701161 - DNA, 15 bp, Homo sapiens
ctgaattcactccag

SEQ ID NO: 1701162 - DNA, 17 bp, Homo sapiens
ctgaattctatttgctg

SEQ ID NO: 1701163 - DNA, 18 bp, Homo sapiens
ctgaattggcttccagat

SEQ ID NO: 1701164 - DNA, 12 bp, Homo sapiens
ctgaatttaact

SEQ ID NO: 1701165 - DNA, 16 bp, Homo sapiens
ctgaatttatctttga

SEQ ID NO: 1701166 - DNA, 15 bp, Homo sapiens
ctgaatttcaggcat

SEQ ID NO: 1701167 - DNA, 17 bp, Homo sapiens
ctgaattttgagtctat

SEQ ID NO: 1701168 - DNA, 20 bp, Homo sapiens
ctgaattttgggacttctac

SEQ ID NO: 1701169 - DNA, 18 bp, Homo sapiens
ctgaatttttttgtaata

SEQ ID NO: 1701170 - DNA, 23 bp, Homo sapiens
ctgaatttttttgtaataagcaa

SEQ ID NO: 1701171 - DNA, 19 bp, Homo sapiens
ctgacaaaaatattttcct

SEQ ID NO: 1701172 - DNA, 21 bp, Homo sapiens
ctgacaaaatggggcagaaga

SEQ ID NO: 1701173 - DNA, 15 bp, Homo sapiens
ctgacaaaggtggta

SEQ ID NO: 1701174 - DNA, 16 bp, Homo sapiens
ctgacaaaggtggtaa

SEQ ID NO: 1701175 - DNA, 22 bp, Homo sapiens
ctgacaaaggtggtaaattcag

SEQ ID NO: 1701176 - DNA, 23 bp, Homo sapiens
ctgacaaaggtggtaaattcaga

SEQ ID NO: 1701177 - DNA, 11 bp, Homo sapiens
ctgacaaagtc

SEQ ID NO: 1701178 - DNA, 22 bp, Homo sapiens
ctgacaagggcccttctctact

SEQ ID NO: 1701179 - DNA, 19 bp, Homo sapiens
ctgacaagggctgacctgc

SEQ ID NO: 1701180 - DNA, 22 bp, Homo sapiens
ctgacaagggctgacctgcctc

SEQ ID NO: 1701181 - DNA, 17 bp, Homo sapiens
agacatggaggttctaa

SEQ ID NO: 1701182 - DNA, 22 bp, Homo sapiens
agacatgtaggtgtttgttcat

SEQ ID NO: 1701183 - DNA, 15 bp, Homo sapiens
agacattcagactaa

SEQ ID NO: 1701184 - DNA, 14 bp, Homo sapiens
agacatttcctttt

SEQ ID NO: 1701185 - DNA, 10 bp, Homo sapiens
agacatttct

SEQ ID NO: 1701186 - DNA, 20 bp, Homo sapiens
agacatttgctgaactcagc

SEQ ID NO: 1701187 - DNA, 11 bp, Homo sapiens
agacatttgta

SEQ ID NO: 1701188 - DNA, 21 bp, Homo sapiens
agacatttgtgtggaaatcat

SEQ ID NO: 1701189 - DNA, 12 bp, Homo sapiens
agacattttgtt

SEQ ID NO: 1701190 - DNA, 22 bp, Homo sapiens
agacattttttgctataatcat

SEQ ID NO: 1701191 - DNA, 20 bp, Homo sapiens
agaccaaaggaaggaacgct

SEQ ID NO: 1701192 - DNA, 15 bp, Homo sapiens
agaccaaatctcagt

SEQ ID NO: 1701193 - DNA, 16 bp, Homo sapiens
agaccaagcttgtcca

SEQ ID NO: 1701194 - DNA, 14 bp, Homo sapiens
agaccaaggcggga

SEQ ID NO: 1701195 - DNA, 16 bp, Homo sapiens
agaccaagtcctggct

SEQ ID NO: 1701196 - DNA, 21 bp, Homo sapiens
agaccaataaatttgtaactt

SEQ ID NO: 1701197 - DNA, 24 bp, Homo sapiens
agaccacactgcacacagtgactt

SEQ ID NO: 1701198 - DNA, 13 bp, Homo sapiens
agaccacatcttt

SEQ ID NO: 1701199 - DNA, 16 bp, Homo sapiens
agaccaccccgcctgc

SEQ ID NO: 1701200 - DNA, 16 bp, Homo sapiens
agaccacctgcttctg

SEQ ID NO: 1701201 - DNA, 21 bp, Homo sapiens
agaccacgcccgtcctgcctg

SEQ ID NO: 1701202 - DNA, 22 bp, Homo sapiens
agaccagaattcccttgaattg

SEQ ID NO: 1701203 - DNA, 16 bp, Homo sapiens
agaccagcactcagcc

SEQ ID NO: 1701204 - DNA, 20 bp, Homo sapiens
agaccagcagacagagccag

SEQ ID NO: 1701205 - DNA, 12 bp, Homo sapiens
agaccagcctgg

SEQ ID NO: 1701206 - DNA, 13 bp, Homo sapiens
agaccagcctggc

SEQ ID NO: 1701207 - DNA, 14 bp, Homo sapiens
agaccagcctggcc

SEQ ID NO: 1701208 - DNA, 12 bp, Homo sapiens
agaccagctcag

SEQ ID NO: 1701209 - DNA, 22 bp, Homo sapiens
agaccaggctgcagcctccact

SEQ ID NO: 1701210 - DNA, 15 bp, Homo sapiens
agaccaggctgtgtc

SEQ ID NO: 1701211 - DNA, 22 bp, Homo sapiens
agaccagttgggagcactggag

SEQ ID NO: 1701212 - DNA, 15 bp, Homo sapiens
agaccatagtgacca

SEQ ID NO: 1701213 - DNA, 15 bp, Homo sapiens
agaccatcctggccc

SEQ ID NO: 1701214 - DNA, 22 bp, Homo sapiens
agaccatgaagtaaattatgta

SEQ ID NO: 1701215 - DNA, 16 bp, Homo sapiens
agacccagatctcatg

SEQ ID NO: 1701216 - DNA, 20 bp, Homo sapiens
agacccagcaggaagccagg

SEQ ID NO: 1701217 - DNA, 19 bp, Homo sapiens
agacccagctgcagaccat

SEQ ID NO: 1701218 - DNA, 16 bp, Homo sapiens
agaccccacccaagct

SEQ ID NO: 1701219 - DNA, 20 bp, Homo sapiens
agaccccacccaagcttggc

SEQ ID NO: 1701220 - DNA, 13 bp, Homo sapiens
agaccccatctct

SEQ ID NO: 1701221 - DNA, 12 bp, Homo sapiens
agacccccactc

SEQ ID NO: 1701222 - DNA, 14 bp, Homo sapiens
agacccccaggcct

SEQ ID NO: 1701223 - DNA, 18 bp, Homo sapiens
agacccccatccagcctc

SEQ ID NO: 1701224 - DNA, 21 bp, Homo sapiens
agacccccatccagcctccag

SEQ ID NO: 1701225 - DNA, 11 bp, Homo sapiens
agaccccgccc

SEQ ID NO: 1701226 - DNA, 19 bp, Homo sapiens
agacccctctggccaggat

SEQ ID NO: 1701227 - DNA, 18 bp, Homo sapiens
agacccctgcctggactt

SEQ ID NO: 1701228 - DNA, 14 bp, Homo sapiens
agacccctggcttt

SEQ ID NO: 1701229 - DNA, 13 bp, Homo sapiens
agacccctgtctc

SEQ ID NO: 1701230 - DNA, 23 bp, Homo sapiens
agacccctgtctttgctgagagc

SEQ ID NO: 1701231 - DNA, 18 bp, Homo sapiens
agacccgtgacctgagat

SEQ ID NO: 1701232 - DNA, 16 bp, Homo sapiens
agaccctaccccacca

SEQ ID NO: 1701233 - DNA, 19 bp, Homo sapiens
agaccctactgaagtggct

SEQ ID NO: 1701234 - DNA, 11 bp, Homo sapiens
agaccctcact

SEQ ID NO: 1701235 - DNA, 21 bp, Homo sapiens
agaccctcactgctggggagt

SEQ ID NO: 1701236 - DNA, 14 bp, Homo sapiens
agaccctccccaca

SEQ ID NO: 1701237 - DNA, 14 bp, Homo sapiens
agaccctcttgccc

SEQ ID NO: 1701238 - DNA, 23 bp, Homo sapiens
agaccctctttcttgtttgtcag

SEQ ID NO: 1701239 - DNA, 11 bp, Homo sapiens
agaccctgaga

SEQ ID NO: 1701240 - DNA, 14 bp, Homo sapiens
agaccctgcctgag

SEQ ID NO: 1701241 - DNA, 18 bp, Homo sapiens
agaccctgcctgagccca

SEQ ID NO: 1701242 - DNA, 22 bp, Homo sapiens
agaccctgcctgagcccaggag

SEQ ID NO: 1701243 - DNA, 12 bp, Homo sapiens
agaccctggagg

SEQ ID NO: 1701244 - DNA, 17 bp, Homo sapiens
agaccctgggtgggctc

SEQ ID NO: 1701245 - DNA, 12 bp, Homo sapiens
agaccctgtgtc

SEQ ID NO: 1701246 - DNA, 24 bp, Homo sapiens
agaccctgtgtcctccaccatgca

SEQ ID NO: 1701247 - DNA, 14 bp, Homo sapiens
agaccctgtgttca

SEQ ID NO: 1701248 - DNA, 14 bp, Homo sapiens
agaccgccccaggg

SEQ ID NO: 1701249 - DNA, 15 bp, Homo sapiens
agaccgccccagggc

SEQ ID NO: 1701250 - DNA, 17 bp, Homo sapiens
agaccgccccagggcta

SEQ ID NO: 1701251 - DNA, 19 bp, Homo sapiens
agaccgcttcacccctgca

SEQ ID NO: 1701252 - DNA, 22 bp, Homo sapiens
agaccgtgtcccaaggagctga

SEQ ID NO: 1701253 - DNA, 15 bp, Homo sapiens
agacctactgttcta

SEQ ID NO: 1701254 - DNA, 19 bp, Homo sapiens
agacctactgttctaaagc

SEQ ID NO: 1701255 - DNA, 21 bp, Homo sapiens
agacctagtcccctttcctct

SEQ ID NO: 1701256 - DNA, 22 bp, Homo sapiens
agacctagtcccctttcctcta

SEQ ID NO: 1701257 - DNA, 13 bp, Homo sapiens
agacctcagcctg

SEQ ID NO: 1701258 - DNA, 15 bp, Homo sapiens
agacctcagcctgtg

SEQ ID NO: 1701259 - DNA, 16 bp, Homo sapiens
agacctcagcctgtgc

SEQ ID NO: 1701260 - DNA, 19 bp, Homo sapiens
agacctcagcctgtgctgc

SEQ ID NO: 1701261 - DNA, 20 bp, Homo sapiens
agacctcagcctgtgctgcc

SEQ ID NO: 1701262 - DNA, 13 bp, Homo sapiens
agacctcatcctg

SEQ ID NO: 1701263 - DNA, 17 bp, Homo sapiens
agacctcatctctacta

SEQ ID NO: 1701264 - DNA, 21 bp, Homo sapiens
agacctcatctgtggagctgc

SEQ ID NO: 1701265 - DNA, 13 bp, Homo sapiens
agacctcatgccc

SEQ ID NO: 1701266 - DNA, 15 bp, Homo sapiens
agacctcatgcccag

SEQ ID NO: 1701267 - DNA, 22 bp, Homo sapiens
agacctccactccacatctgca

SEQ ID NO: 1701268 - DNA, 20 bp, Homo sapiens
agacctccagtgagtacctg

SEQ ID NO: 1701269 - DNA, 19 bp, Homo sapiens
agacctctggttaatttat

SEQ ID NO: 1701270 - DNA, 18 bp, Homo sapiens
agacctcttccctctggg

SEQ ID NO: 1701271 - DNA, 19 bp, Homo sapiens
agacctcttccctctgggc

SEQ ID NO: 1701272 - DNA, 15 bp, Homo sapiens
agacctgatcctgga

SEQ ID NO: 1701273 - DNA, 15 bp, Homo sapiens
agacctgccctctct

SEQ ID NO: 1701274 - DNA, 10 bp, Homo sapiens
agacctgcct

SEQ ID NO: 1701275 - DNA, 14 bp, Homo sapiens
agacctggaaccag

SEQ ID NO: 1701276 - DNA, 16 bp, Homo sapiens
agacctggaaccagag

SEQ ID NO: 1701277 - DNA, 13 bp, Homo sapiens
agacctggagccc

SEQ ID NO: 1701278 - DNA, 14 bp, Homo sapiens
agacctggcagctc

SEQ ID NO: 1701279 - DNA, 14 bp, Homo sapiens
agacctgtcttcca

SEQ ID NO: 1701280 - DNA, 23 bp, Homo sapiens
agacctgtgctagttttacagat

SEQ ID NO: 1701281 - DNA, 17 bp, Homo sapiens
agacctgtgtgaactat

SEQ ID NO: 1701282 - DNA, 13 bp, Homo sapiens
agaccttccataa

SEQ ID NO: 1701283 - DNA, 23 bp, Homo sapiens
agaccttccataatgctactgtc

SEQ ID NO: 1701284 - DNA, 21 bp, Homo sapiens
agaccttgttacttctgaggt

SEQ ID NO: 1701285 - DNA, 22 bp, Homo sapiens
agaccttgttacttctgaggta

SEQ ID NO: 1701286 - DNA, 19 bp, Homo sapiens
agacctttattcacccctg

SEQ ID NO: 1701287 - DNA, 21 bp, Homo sapiens
agacctttattcacccctgcc

SEQ ID NO: 1701288 - DNA, 23 bp, Homo sapiens
agacctttattcacccctgcccc

SEQ ID NO: 1701289 - DNA, 22 bp, Homo sapiens
agaccttttggcccaatctctg

SEQ ID NO: 1701290 - DNA, 15 bp, Homo sapiens
agacgaggcaggggc

SEQ ID NO: 1701291 - DNA, 19 bp, Homo sapiens
agacgaggggcagggaagg

SEQ ID NO: 1701292 - DNA, 17 bp, Homo sapiens
agacgatttgtcagtta

SEQ ID NO: 1701293 - DNA, 14 bp, Homo sapiens
agacgcaggaatgg

SEQ ID NO: 1701294 - DNA, 22 bp, Homo sapiens
agacgcatagactgaggtataa

SEQ ID NO: 1701295 - DNA, 14 bp, Homo sapiens
agacgcccctccca

SEQ ID NO: 1701296 - DNA, 20 bp, Homo sapiens
agacgccttccaggtcagga

SEQ ID NO: 1701297 - DNA, 14 bp, Homo sapiens
agacggaaaacaat

SEQ ID NO: 1701298 - DNA, 22 bp, Homo sapiens
ctgacaataaagatatttccaa

SEQ ID NO: 1701299 - DNA, 16 bp, Homo sapiens
ctgacaatgaagggaa

SEQ ID NO: 1701300 - DNA, 15 bp, Homo sapiens
ctgacaatggcagct

SEQ ID NO: 1701301 - DNA, 16 bp, Homo sapiens
ctgacaatggcagcta

SEQ ID NO: 1701302 - DNA, 18 bp, Homo sapiens
ctgacacaaaaaaagttg

SEQ ID NO: 1701303 - DNA, 13 bp, Homo sapiens
ctgacacactaac

SEQ ID NO: 1701304 - DNA, 22 bp, Homo sapiens
ctgacacccagtgtccttccat

SEQ ID NO: 1701305 - DNA, 15 bp, Homo sapiens
ctgacaccccctccc

SEQ ID NO: 1701306 - DNA, 20 bp, Homo sapiens
ctgacaccctggtcctgact

SEQ ID NO: 1701307 - DNA, 18 bp, Homo sapiens
ctgacacctaccatgctg

SEQ ID NO: 1701308 - DNA, 19 bp, Homo sapiens
ctgacacctaccatgctgc

SEQ ID NO: 1701309 - DNA, 20 bp, Homo sapiens
ctgacacctaccatgctgct

SEQ ID NO: 1701310 - DNA, 21 bp, Homo sapiens
ctgacacctaccatgctgctt

SEQ ID NO: 1701311 - DNA, 18 bp, Homo sapiens
ctgacagatgtcagccga

SEQ ID NO: 1701312 - DNA, 12 bp, Homo sapiens
ctgacagcctcc

SEQ ID NO: 1701313 - DNA, 22 bp, Homo sapiens
ctgacagggacatgccctgtgt

SEQ ID NO: 1701314 - DNA, 12 bp, Homo sapiens
ctgacagggagc

SEQ ID NO: 1701315 - DNA, 13 bp, Homo sapiens
ctgacagggagca

SEQ ID NO: 1701316 - DNA, 14 bp, Homo sapiens
ctgacagtttttct

SEQ ID NO: 1701317 - DNA, 19 bp, Homo sapiens
ctgacatagagaaaaggct

SEQ ID NO: 1701318 - DNA, 12 bp, Homo sapiens
ctgacatccctt

SEQ ID NO: 1701319 - DNA, 16 bp, Homo sapiens
ctgacatctgtgtttc

SEQ ID NO: 1701320 - DNA, 17 bp, Homo sapiens
ctgacatctgtgtttca

SEQ ID NO: 1701321 - DNA, 21 bp, Homo sapiens
ctgacatctgtgtttcaagtg

SEQ ID NO: 1701322 - DNA, 15 bp, Homo sapiens
ctgacatgtaagaaa

SEQ ID NO: 1701323 - DNA, 20 bp, Homo sapiens
ctgacatgtaagaaaatgtt

SEQ ID NO: 1701324 - DNA, 14 bp, Homo sapiens
ctgacatgtggggc

SEQ ID NO: 1701325 - DNA, 19 bp, Homo sapiens
ctgacatgtggggccaggt

SEQ ID NO: 1701326 - DNA, 21 bp, Homo sapiens
ctgacatgtggggccaggtca

SEQ ID NO: 1701327 - DNA, 18 bp, Homo sapiens
ctgacatgtttgtgctct

SEQ ID NO: 1701328 - DNA, 20 bp, Homo sapiens
ctgacatgtttgtgctctgt

SEQ ID NO: 1701329 - DNA, 21 bp, Homo sapiens
ctgacattttctttcatgggc

SEQ ID NO: 1701330 - DNA, 15 bp, Homo sapiens
ctgaccaaacagcca

SEQ ID NO: 1701331 - DNA, 18 bp, Homo sapiens
ctgaccaaagactgcaga

SEQ ID NO: 1701332 - DNA, 20 bp, Homo sapiens
ctgaccaaagactgcagaac

SEQ ID NO: 1701333 - DNA, 17 bp, Homo sapiens
ctgaccaaatggccagt

SEQ ID NO: 1701334 - DNA, 14 bp, Homo sapiens
ctgaccaagagaga

SEQ ID NO: 1701335 - DNA, 16 bp, Homo sapiens
ctgaccaattgtgctg

SEQ ID NO: 1701336 - DNA, 16 bp, Homo sapiens
ctgaccaccctcccct

SEQ ID NO: 1701337 - DNA, 22 bp, Homo sapiens
ctgaccacggacgtttccatca

SEQ ID NO: 1701338 - DNA, 17 bp, Homo sapiens
ctgaccacttgaggcct

SEQ ID NO: 1701339 - DNA, 12 bp, Homo sapiens
ctgaccagagaa

SEQ ID NO: 1701340 - DNA, 13 bp, Homo sapiens
ctgaccagagaat

SEQ ID NO: 1701341 - DNA, 19 bp, Homo sapiens
ctgaccagagaatgcacct

SEQ ID NO: 1701342 - DNA, 12 bp, Homo sapiens
ctgaccagcggc

SEQ ID NO: 1701343 - DNA, 13 bp, Homo sapiens
ctgaccagcggct

SEQ ID NO: 1701344 - DNA, 16 bp, Homo sapiens
ctgaccagcggctgct

SEQ ID NO: 1701345 - DNA, 21 bp, Homo sapiens
ctgaccagcggctgctcaagc

SEQ ID NO: 1701346 - DNA, 22 bp, Homo sapiens
ctgaccagcggctgctcaagcc

SEQ ID NO: 1701347 - DNA, 21 bp, Homo sapiens
ctgaccataatcctagccccg

SEQ ID NO: 1701348 - DNA, 22 bp, Homo sapiens
ctgaccatattgtgcttcacag

SEQ ID NO: 1701349 - DNA, 22 bp, Homo sapiens
ctgaccatgctcatctgctggt

SEQ ID NO: 1701350 - DNA, 18 bp, Homo sapiens
ctgacccaactgatcctg

SEQ ID NO: 1701351 - DNA, 14 bp, Homo sapiens
ctgacccaactggg

SEQ ID NO: 1701352 - DNA, 17 bp, Homo sapiens
ctgacccaactgggggc

SEQ ID NO: 1701353 - DNA, 14 bp, Homo sapiens
ctgacccagcatct

SEQ ID NO: 1701354 - DNA, 16 bp, Homo sapiens
ctgacccagcatctcc

SEQ ID NO: 1701355 - DNA, 22 bp, Homo sapiens
ctgacccaggaccatcctggag

SEQ ID NO: 1701356 - DNA, 12 bp, Homo sapiens
ctgacccaggcc

SEQ ID NO: 1701357 - DNA, 14 bp, Homo sapiens
ctgacccaggccgc

SEQ ID NO: 1701358 - DNA, 16 bp, Homo sapiens
ctgacccaggccgcag

SEQ ID NO: 1701359 - DNA, 12 bp, Homo sapiens
ctgacccagtcc

SEQ ID NO: 1701360 - DNA, 14 bp, Homo sapiens
ctgacccagtccct

SEQ ID NO: 1701361 - DNA, 13 bp, Homo sapiens
ctgacccagtgcc

SEQ ID NO: 1701362 - DNA, 21 bp, Homo sapiens
ctgacccagtgcccccactga

SEQ ID NO: 1701363 - DNA, 20 bp, Homo sapiens
ctgaccccaaacaccttcca

SEQ ID NO: 1701364 - DNA, 21 bp, Homo sapiens
ctgaccccaaacaccttccag

SEQ ID NO: 1701365 - DNA, 22 bp, Homo sapiens
ctgaccccaaacaccttccagc

SEQ ID NO: 1701366 - DNA, 20 bp, Homo sapiens
ctgaccccagaaattctggc

SEQ ID NO: 1701367 - DNA, 21 bp, Homo sapiens
ctgaccccagtggtatcctgt

SEQ ID NO: 1701368 - DNA, 16 bp, Homo sapiens
ctgaccccattcctga

SEQ ID NO: 1701369 - DNA, 14 bp, Homo sapiens
ctgacccctctggt

SEQ ID NO: 1701370 - DNA, 16 bp, Homo sapiens
ctgacccctctggtgt

SEQ ID NO: 1701371 - DNA, 13 bp, Homo sapiens
ctgacccctgcct

SEQ ID NO: 1701372 - DNA, 22 bp, Homo sapiens
ctgacccctgcctgttggcagg

SEQ ID NO: 1701373 - DNA, 23 bp, Homo sapiens
ctgaccctgcttcaaatatttcc

SEQ ID NO: 1701374 - DNA, 18 bp, Homo sapiens
ctgacccttccagacata

SEQ ID NO: 1701375 - DNA, 18 bp, Homo sapiens
ctgacctaatatttggag

SEQ ID NO: 1701376 - DNA, 15 bp, Homo sapiens
ctgacctaccccagc

SEQ ID NO: 1701377 - DNA, 17 bp, Homo sapiens
ctgacctaccccagcca

SEQ ID NO: 1701378 - DNA, 19 bp, Homo sapiens
ctgacctaccccagccagg

SEQ ID NO: 1701379 - DNA, 20 bp, Homo sapiens
ctgacctcaagcaaccatga

SEQ ID NO: 1701380 - DNA, 18 bp, Homo sapiens
ctgacctccctctaattt

SEQ ID NO: 1701381 - DNA, 16 bp, Homo sapiens
ctgacctccgccatcc

SEQ ID NO: 1701382 - DNA, 18 bp, Homo sapiens
ctgacctgcctctcacac

SEQ ID NO: 1701383 - DNA, 23 bp, Homo sapiens
ctgacctggcatctaattctgat

SEQ ID NO: 1701384 - DNA, 12 bp, Homo sapiens
ctgacctggtgg

SEQ ID NO: 1701385 - DNA, 13 bp, Homo sapiens
ctgacctggtggg

SEQ ID NO: 1701386 - DNA, 18 bp, Homo sapiens
ctgacctgttgccagcag

SEQ ID NO: 1701387 - DNA, 20 bp, Homo sapiens
ctgaccttggagagacacag

SEQ ID NO: 1701388 - DNA, 12 bp, Homo sapiens
ctgacgagagat

SEQ ID NO: 1701389 - DNA, 22 bp, Homo sapiens
ctgacgcattctcgtatccaac

SEQ ID NO: 1701390 - DNA, 18 bp, Homo sapiens
ctgacgcttgtgacagtg

SEQ ID NO: 1701391 - DNA, 23 bp, Homo sapiens
ctgacgcttgtgacagtgcctct

SEQ ID NO: 1701392 - DNA, 14 bp, Homo sapiens
ctgacggcgccccc

SEQ ID NO: 1701393 - DNA, 22 bp, Homo sapiens
ctgacggcgcccccagtgtgca

SEQ ID NO: 1701394 - DNA, 19 bp, Homo sapiens
ctgacgtcagcgcaccaaa

SEQ ID NO: 1701395 - DNA, 20 bp, Homo sapiens
ctgacgtcagcgcaccaaaa

SEQ ID NO: 1701396 - DNA, 23 bp, Homo sapiens
ctgacgtctgaagcttgactccc

SEQ ID NO: 1701397 - DNA, 18 bp, Homo sapiens
ctgacgtgccttttgcac

SEQ ID NO: 1701398 - DNA, 13 bp, Homo sapiens
ctgacgtttctgg

SEQ ID NO: 1701399 - DNA, 23 bp, Homo sapiens
ctgactagaagggccagtcctgc

SEQ ID NO: 1701400 - DNA, 23 bp, Homo sapiens
ctgactattcttgatgtaaaatc

SEQ ID NO: 1701401 - DNA, 20 bp, Homo sapiens
ctgactcaattatttgcata

SEQ ID NO: 1701402 - DNA, 16 bp, Homo sapiens
ctgactcatcatttgt

SEQ ID NO: 1701403 - DNA, 12 bp, Homo sapiens
ctgactccagag

SEQ ID NO: 1701404 - DNA, 15 bp, Homo sapiens
ctgactccagagtct

SEQ ID NO: 1701405 - DNA, 15 bp, Homo sapiens
ctgactccctctcag

SEQ ID NO: 1701406 - DNA, 18 bp, Homo sapiens
ctgactctctgtgacctg

SEQ ID NO: 1701407 - DNA, 21 bp, Homo sapiens
ctgactgaaagtagggggctt

SEQ ID NO: 1701408 - DNA, 15 bp, Homo sapiens
ctgactgaaggaaaa

SEQ ID NO: 1701409 - DNA, 22 bp, Homo sapiens
ctgactgaaggaaaagcaagaa

SEQ ID NO: 1701410 - DNA, 18 bp, Homo sapiens
ctgactgaggcctgcttc

SEQ ID NO: 1701411 - DNA, 20 bp, Homo sapiens
ctgactgaggcctgcttccc

SEQ ID NO: 1701412 - DNA, 16 bp, Homo sapiens
ctgactgccaagccag

SEQ ID NO: 1701413 - DNA, 13 bp, Homo sapiens
ctgactgctcaga

SEQ ID NO: 1701414 - DNA, 16 bp, Homo sapiens
agacggagatgcatgg

SEQ ID NO: 1701415 - DNA, 17 bp, Homo sapiens
agacggagtgtgggagt

SEQ ID NO: 1701416 - DNA, 12 bp, Homo sapiens
agacggcggcca

SEQ ID NO: 1701417 - DNA, 19 bp, Homo sapiens
agacggcggccaggcacag

SEQ ID NO: 1701418 - DNA, 12 bp, Homo sapiens
agacgggcacag

SEQ ID NO: 1701419 - DNA, 14 bp, Homo sapiens
agacgggcacagac

SEQ ID NO: 1701420 - DNA, 19 bp, Homo sapiens
agacgggttcaccatgttg

SEQ ID NO: 1701421 - DNA, 19 bp, Homo sapiens
agacgggttgaaagacatc

SEQ ID NO: 1701422 - DNA, 22 bp, Homo sapiens
agacgggttgaaagacatcaat

SEQ ID NO: 1701423 - DNA, 16 bp, Homo sapiens
agacgtaaagaatttt

SEQ ID NO: 1701424 - DNA, 14 bp, Homo sapiens
agacgtggactcct

SEQ ID NO: 1701425 - DNA, 13 bp, Homo sapiens
agacgtttataaa

SEQ ID NO: 1701426 - DNA, 13 bp, Homo sapiens
agactaaattcaa

SEQ ID NO: 1701427 - DNA, 14 bp, Homo sapiens
agactaagccctgt

SEQ ID NO: 1701428 - DNA, 23 bp, Homo sapiens
agactacaggcacacaccaccac

SEQ ID NO: 1701429 - DNA, 15 bp, Homo sapiens
agactactgttcagc

SEQ ID NO: 1701430 - DNA, 17 bp, Homo sapiens
agactagaattctagtg

SEQ ID NO: 1701431 - DNA, 20 bp, Homo sapiens
agactagaattctagtgctg

SEQ ID NO: 1701432 - DNA, 16 bp, Homo sapiens
agactagatgtagtat

SEQ ID NO: 1701433 - DNA, 16 bp, Homo sapiens
agactagattgccttt

SEQ ID NO: 1701434 - DNA, 19 bp, Homo sapiens
agactatatatataaatgt

SEQ ID NO: 1701435 - DNA, 18 bp, Homo sapiens
agactatctaaatgttga

SEQ ID NO: 1701436 - DNA, 21 bp, Homo sapiens
agactatggagcctggcacag

SEQ ID NO: 1701437 - DNA, 14 bp, Homo sapiens
agactatggtgctg

SEQ ID NO: 1701438 - DNA, 14 bp, Homo sapiens
agactattcaaaca

SEQ ID NO: 1701439 - DNA, 16 bp, Homo sapiens
agactattcaaacagt

SEQ ID NO: 1701440 - DNA, 18 bp, Homo sapiens
agactattcaaacagtct

SEQ ID NO: 1701441 - DNA, 13 bp, Homo sapiens
agactatttgcta

SEQ ID NO: 1701442 - DNA, 14 bp, Homo sapiens
agactatttttaga

SEQ ID NO: 1701443 - DNA, 19 bp, Homo sapiens
agactcacctctgcctcaa

SEQ ID NO: 1701444 - DNA, 15 bp, Homo sapiens
agactcagactccat

SEQ ID NO: 1701445 - DNA, 20 bp, Homo sapiens
agactcagctgctatactta

SEQ ID NO: 1701446 - DNA, 21 bp, Homo sapiens
agactcagggccccagcacta

SEQ ID NO: 1701447 - DNA, 16 bp, Homo sapiens
agactcaggttccaga

SEQ ID NO: 1701448 - DNA, 20 bp, Homo sapiens
agactcaggttccagaacag

SEQ ID NO: 1701449 - DNA, 12 bp, Homo sapiens
agactcagtttg

SEQ ID NO: 1701450 - DNA, 17 bp, Homo sapiens
agactcagtttgtcaga

SEQ ID NO: 1701451 - DNA, 21 bp, Homo sapiens
agactcagtttgtcagacttt

SEQ ID NO: 1701452 - DNA, 17 bp, Homo sapiens
agactcatcttactgta

SEQ ID NO: 1701453 - DNA, 16 bp, Homo sapiens
agactccaaagaaatg

SEQ ID NO: 1701454 - DNA, 16 bp, Homo sapiens
agactccaaggagcta

SEQ ID NO: 1701455 - DNA, 19 bp, Homo sapiens
agactccagaatctgctgt

SEQ ID NO: 1701456 - DNA, 22 bp, Homo sapiens
agactccagaatctgctgttgc

SEQ ID NO: 1701457 - DNA, 18 bp, Homo sapiens
agactccatctcttctgc

SEQ ID NO: 1701458 - DNA, 23 bp, Homo sapiens
agactccatctctttaaaaacaa

SEQ ID NO: 1701459 - DNA, 15 bp, Homo sapiens
agactccggccttca

SEQ ID NO: 1701460 - DNA, 16 bp, Homo sapiens
agactccggccttcac

SEQ ID NO: 1701461 - DNA, 18 bp, Homo sapiens
agactccgtctcaaggaa

SEQ ID NO: 1701462 - DNA, 13 bp, Homo sapiens
agactcctcagga

SEQ ID NO: 1701463 - DNA, 16 bp, Homo sapiens
agactcctcaggagag

SEQ ID NO: 1701464 - DNA, 18 bp, Homo sapiens
agactcctcaggagagac

SEQ ID NO: 1701465 - DNA, 14 bp, Homo sapiens
agactcctgccctg

SEQ ID NO: 1701466 - DNA, 16 bp, Homo sapiens
agactcctgccctgtt

SEQ ID NO: 1701467 - DNA, 15 bp, Homo sapiens
agactccttgtggac

SEQ ID NO: 1701468 - DNA, 19 bp, Homo sapiens
agactctacccatattaca

SEQ ID NO: 1701469 - DNA, 18 bp, Homo sapiens
agactctagacaagatat

SEQ ID NO: 1701470 - DNA, 23 bp, Homo sapiens
agactctagacaagatattgtac

SEQ ID NO: 1701471 - DNA, 16 bp, Homo sapiens
agactctagagtccaa

SEQ ID NO: 1701472 - DNA, 15 bp, Homo sapiens
agactctagggtcca

SEQ ID NO: 1701473 - DNA, 20 bp, Homo sapiens
agactctgaaatctcagaat

SEQ ID NO: 1701474 - DNA, 12 bp, Homo sapiens
agactctggagg

SEQ ID NO: 1701475 - DNA, 13 bp, Homo sapiens
agactctggtgtt

SEQ ID NO: 1701476 - DNA, 18 bp, Homo sapiens
agactctgtctcaaaaaa

SEQ ID NO: 1701477 - DNA, 14 bp, Homo sapiens
agactgaacatgtt

SEQ ID NO: 1701478 - DNA, 24 bp, Homo sapiens
agactgaatagatatgaaagctga

SEQ ID NO: 1701479 - DNA, 12 bp, Homo sapiens
agactgaattta

SEQ ID NO: 1701480 - DNA, 13 bp, Homo sapiens
agactgagcagcc

SEQ ID NO: 1701481 - DNA, 15 bp, Homo sapiens
agactgagcagccgc

SEQ ID NO: 1701482 - DNA, 13 bp, Homo sapiens
agactgagctcaa

SEQ ID NO: 1701483 - DNA, 20 bp, Homo sapiens
agactgagctctccaggcca

SEQ ID NO: 1701484 - DNA, 22 bp, Homo sapiens
agactgagctctccaggccagg

SEQ ID NO: 1701485 - DNA, 21 bp, Homo sapiens
agactgattgattattcaaca

SEQ ID NO: 1701486 - DNA, 22 bp, Homo sapiens
agactgattggaattctttctg

SEQ ID NO: 1701487 - DNA, 22 bp, Homo sapiens
agactgcagaacccccaggtgg

SEQ ID NO: 1701488 - DNA, 12 bp, Homo sapiens
agactgcagctg

SEQ ID NO: 1701489 - DNA, 20 bp, Homo sapiens
agactgccccacggccctgt

SEQ ID NO: 1701490 - DNA, 15 bp, Homo sapiens
agactgctgggactg

SEQ ID NO: 1701491 - DNA, 16 bp, Homo sapiens
agactgcttcccatcc

SEQ ID NO: 1701492 - DNA, 22 bp, Homo sapiens
agactgcttcccatcctaccct

SEQ ID NO: 1701493 - DNA, 23 bp, Homo sapiens
agactgcttcccatcctaccctc

SEQ ID NO: 1701494 - DNA, 11 bp, Homo sapiens
agactggaaga

SEQ ID NO: 1701495 - DNA, 18 bp, Homo sapiens
agactggaagacacttca

SEQ ID NO: 1701496 - DNA, 19 bp, Homo sapiens
agactggaagacacttcag

SEQ ID NO: 1701497 - DNA, 21 bp, Homo sapiens
agactggcacagttttctgag

SEQ ID NO: 1701498 - DNA, 23 bp, Homo sapiens
agactggcacagttttctgagaa

SEQ ID NO: 1701499 - DNA, 14 bp, Homo sapiens
agactggctggctg

SEQ ID NO: 1701500 - DNA, 20 bp, Homo sapiens
agactgggaccttagaaatc

SEQ ID NO: 1701501 - DNA, 20 bp, Homo sapiens
agactgggagccacttctcc

SEQ ID NO: 1701502 - DNA, 21 bp, Homo sapiens
agactgggtgaggataacaca

SEQ ID NO: 1701503 - DNA, 23 bp, Homo sapiens
agactgtagatatgtattctttt

SEQ ID NO: 1701504 - DNA, 23 bp, Homo sapiens
agactgtagattgcttctgtagt

SEQ ID NO: 1701505 - DNA, 14 bp, Homo sapiens
agactgtgaacagc

SEQ ID NO: 1701506 - DNA, 19 bp, Homo sapiens
agactgtgaacagcttgct

SEQ ID NO: 1701507 - DNA, 15 bp, Homo sapiens
agactgtgaacttga

SEQ ID NO: 1701508 - DNA, 18 bp, Homo sapiens
agactgtgaacttgactg

SEQ ID NO: 1701509 - DNA, 13 bp, Homo sapiens
agactgtgcagaa

SEQ ID NO: 1701510 - DNA, 23 bp, Homo sapiens
agactgtggtaggggcagggagg

SEQ ID NO: 1701511 - DNA, 17 bp, Homo sapiens
agactgttaaatgaaac

SEQ ID NO: 1701512 - DNA, 14 bp, Homo sapiens
agactgttgagtta

SEQ ID NO: 1701513 - DNA, 15 bp, Homo sapiens
agactgttgctcaaa

SEQ ID NO: 1701514 - DNA, 14 bp, Homo sapiens
agactgttttactg

SEQ ID NO: 1701515 - DNA, 23 bp, Homo sapiens
agactgttttactgttttaattg

SEQ ID NO: 1701516 - DNA, 12 bp, Homo sapiens
agacttaaaaca

SEQ ID NO: 1701517 - DNA, 14 bp, Homo sapiens
agacttaaaacatg

SEQ ID NO: 1701518 - DNA, 21 bp, Homo sapiens
agacttaaaagagctcagaca

SEQ ID NO: 1701519 - DNA, 22 bp, Homo sapiens
agacttaaaagagctcagacat

SEQ ID NO: 1701520 - DNA, 13 bp, Homo sapiens
agacttaattctg

SEQ ID NO: 1701521 - DNA, 14 bp, Homo sapiens
agacttactctaag

SEQ ID NO: 1701522 - DNA, 19 bp, Homo sapiens
agacttagtatattttctt

SEQ ID NO: 1701523 - DNA, 14 bp, Homo sapiens
agacttatcaacat

SEQ ID NO: 1701524 - DNA, 15 bp, Homo sapiens
agacttcacactgca

SEQ ID NO: 1701525 - DNA, 21 bp, Homo sapiens
agacttcacactgcaagagcc

SEQ ID NO: 1701526 - DNA, 18 bp, Homo sapiens
agacttcacagcgtctgc

SEQ ID NO: 1701527 - DNA, 19 bp, Homo sapiens
agacttccaaacctgacag

SEQ ID NO: 1701528 - DNA, 17 bp, Homo sapiens
agacttccaaatcctgg

SEQ ID NO: 1701529 - DNA, 14 bp, Homo sapiens
agacttccaccctg

SEQ ID NO: 1701530 - DNA, 18 bp, Homo sapiens
agacttcccactgttctg

SEQ ID NO: 1701531 - DNA, 14 bp, Homo sapiens
ctgactgctcagaa

SEQ ID NO: 1701532 - DNA, 21 bp, Homo sapiens
ctgactggccaaacccttgct

SEQ ID NO: 1701533 - DNA, 17 bp, Homo sapiens
ctgactgtactcctccc

SEQ ID NO: 1701534 - DNA, 12 bp, Homo sapiens
ctgactgtggcc

SEQ ID NO: 1701535 - DNA, 17 bp, Homo sapiens
ctgactgtggccccctc

SEQ ID NO: 1701536 - DNA, 22 bp, Homo sapiens
ctgactgtgttgggcaagacct

SEQ ID NO: 1701537 - DNA, 14 bp, Homo sapiens
ctgactgttcttgg

SEQ ID NO: 1701538 - DNA, 11 bp, Homo sapiens
ctgactgttta

SEQ ID NO: 1701539 - DNA, 14 bp, Homo sapiens
ctgactgtttattt

SEQ ID NO: 1701540 - DNA, 15 bp, Homo sapiens
ctgactgtttattta

SEQ ID NO: 1701541 - DNA, 18 bp, Homo sapiens
ctgactgtttatttaagg

SEQ ID NO: 1701542 - DNA, 20 bp, Homo sapiens
ctgactgtttatttaaggat

SEQ ID NO: 1701543 - DNA, 22 bp, Homo sapiens
ctgacttaactttaacttttga

SEQ ID NO: 1701544 - DNA, 19 bp, Homo sapiens
ctgacttaagcaaaagaaa

SEQ ID NO: 1701545 - DNA, 20 bp, Homo sapiens
ctgacttcagtgaatatttt

SEQ ID NO: 1701546 - DNA, 23 bp, Homo sapiens
ctgacttcagtgggactcggtga

SEQ ID NO: 1701547 - DNA, 23 bp, Homo sapiens
ctgacttccctggaggagaagta

SEQ ID NO: 1701548 - DNA, 15 bp, Homo sapiens
ctgacttctaagtaa

SEQ ID NO: 1701549 - DNA, 11 bp, Homo sapiens
ctgacttctgc

SEQ ID NO: 1701550 - DNA, 12 bp, Homo sapiens
ctgacttctgcc

SEQ ID NO: 1701551 - DNA, 14 bp, Homo sapiens
ctgacttctggaga

SEQ ID NO: 1701552 - DNA, 15 bp, Homo sapiens
ctgacttctggagat

SEQ ID NO: 1701553 - DNA, 15 bp, Homo sapiens
ctgacttgctgtgtg

SEQ ID NO: 1701554 - DNA, 18 bp, Homo sapiens
ctgacttggatcccaaag

SEQ ID NO: 1701555 - DNA, 15 bp, Homo sapiens
ctgacttggcactta

SEQ ID NO: 1701556 - DNA, 16 bp, Homo sapiens
ctgacttggcacttaa

SEQ ID NO: 1701557 - DNA, 22 bp, Homo sapiens
ctgacttggcacttaagtgcac

SEQ ID NO: 1701558 - DNA, 22 bp, Homo sapiens
ctgacttggggagatggagttc

SEQ ID NO: 1701559 - DNA, 15 bp, Homo sapiens
ctgacttgtttgtct

SEQ ID NO: 1701560 - DNA, 14 bp, Homo sapiens
ctgactttacttgt

SEQ ID NO: 1701561 - DNA, 12 bp, Homo sapiens
ctgagaaaacaa

SEQ ID NO: 1701562 - DNA, 14 bp, Homo sapiens
ctgagaaaacaagc

SEQ ID NO: 1701563 - DNA, 23 bp, Homo sapiens
ctgagaaacccaccagcctaaga

SEQ ID NO: 1701564 - DNA, 19 bp, Homo sapiens
ctgagaaagactattcaaa

SEQ ID NO: 1701565 - DNA, 11 bp, Homo sapiens
ctgagaagaat

SEQ ID NO: 1701566 - DNA, 13 bp, Homo sapiens
ctgagaagcaaac

SEQ ID NO: 1701567 - DNA, 13 bp, Homo sapiens
ctgagaagctctg

SEQ ID NO: 1701568 - DNA, 18 bp, Homo sapiens
ctgagaaggcgaggagag

SEQ ID NO: 1701569 - DNA, 21 bp, Homo sapiens
ctgagaaggcgaggagagtgg

SEQ ID NO: 1701570 - DNA, 17 bp, Homo sapiens
ctgagaaggtccttaat

SEQ ID NO: 1701571 - DNA, 18 bp, Homo sapiens
ctgagaagtcaaacattt

SEQ ID NO: 1701572 - DNA, 18 bp, Homo sapiens
ctgagaatatatgctttt

SEQ ID NO: 1701573 - DNA, 16 bp, Homo sapiens
ctgagaatcagactga

SEQ ID NO: 1701574 - DNA, 18 bp, Homo sapiens
ctgagaatgagtgggaat

SEQ ID NO: 1701575 - DNA, 17 bp, Homo sapiens
ctgagacaaatggaggc

SEQ ID NO: 1701576 - DNA, 13 bp, Homo sapiens
ctgagacactgaa

SEQ ID NO: 1701577 - DNA, 16 bp, Homo sapiens
ctgagacagtgaattt

SEQ ID NO: 1701578 - DNA, 20 bp, Homo sapiens
ctgagaccctactgaagtgg

SEQ ID NO: 1701579 - DNA, 19 bp, Homo sapiens
ctgagacccttttctcagg

SEQ ID NO: 1701580 - DNA, 21 bp, Homo sapiens
ctgagacctctagagaaaaga

SEQ ID NO: 1701581 - DNA, 14 bp, Homo sapiens
ctgagacctgggat

SEQ ID NO: 1701582 - DNA, 21 bp, Homo sapiens
ctgagactccagaatctgctg

SEQ ID NO: 1701583 - DNA, 22 bp, Homo sapiens
ctgagactccagaatctgctgt

SEQ ID NO: 1701584 - DNA, 19 bp, Homo sapiens
ctgagactttcccctctcg

SEQ ID NO: 1701585 - DNA, 17 bp, Homo sapiens
ctgagagacccaaggag

SEQ ID NO: 1701586 - DNA, 15 bp, Homo sapiens
ctgagagacctgtgt

SEQ ID NO: 1701587 - DNA, 18 bp, Homo sapiens
ctgagagacctgtgtgaa

SEQ ID NO: 1701588 - DNA, 21 bp, Homo sapiens
ctgagagagaatagagctgcc

SEQ ID NO: 1701589 - DNA, 16 bp, Homo sapiens
ctgagagcaaagggaa

SEQ ID NO: 1701590 - DNA, 12 bp, Homo sapiens
ctgagagccaga

SEQ ID NO: 1701591 - DNA, 13 bp, Homo sapiens
ctgagagccccag

SEQ ID NO: 1701592 - DNA, 12 bp, Homo sapiens
ctgagagccctg

SEQ ID NO: 1701593 - DNA, 16 bp, Homo sapiens
ctgagagccctgctgt

SEQ ID NO: 1701594 - DNA, 19 bp, Homo sapiens
ctgagagccctgctgtggg

SEQ ID NO: 1701595 - DNA, 15 bp, Homo sapiens
ctgagaggaagcaag

SEQ ID NO: 1701596 - DNA, 12 bp, Homo sapiens
ctgagaggccac

SEQ ID NO: 1701597 - DNA, 17 bp, Homo sapiens
ctgagaggcgagctcct

SEQ ID NO: 1701598 - DNA, 14 bp, Homo sapiens
ctgagaggggaagc

SEQ ID NO: 1701599 - DNA, 19 bp, Homo sapiens
ctgagagtatttaggcaga

SEQ ID NO: 1701600 - DNA, 14 bp, Homo sapiens
ctgagagtcagctc

SEQ ID NO: 1701601 - DNA, 17 bp, Homo sapiens
ctgagagtctagattct

SEQ ID NO: 1701602 - DNA, 18 bp, Homo sapiens
ctgagataagaaaagcct

SEQ ID NO: 1701603 - DNA, 19 bp, Homo sapiens
ctgagataagaaaagcctg

SEQ ID NO: 1701604 - DNA, 21 bp, Homo sapiens
ctgagataagaaaagcctgaa

SEQ ID NO: 1701605 - DNA, 20 bp, Homo sapiens
ctgagatacttcccaaagcc

SEQ ID NO: 1701606 - DNA, 14 bp, Homo sapiens
ctgagatgagcccc

SEQ ID NO: 1701607 - DNA, 16 bp, Homo sapiens
ctgagatgagccccac

SEQ ID NO: 1701608 - DNA, 15 bp, Homo sapiens
ctgagatggaaaagt

SEQ ID NO: 1701609 - DNA, 16 bp, Homo sapiens
ctgagatgtgaacaca

SEQ ID NO: 1701610 - DNA, 20 bp, Homo sapiens
ctgagattctttaaggagat

SEQ ID NO: 1701611 - DNA, 23 bp, Homo sapiens
ctgagattgtgtttgttcataat

SEQ ID NO: 1701612 - DNA, 15 bp, Homo sapiens
ctgagatttcatctg

SEQ ID NO: 1701613 - DNA, 18 bp, Homo sapiens
ctgagatttcatctgctc

SEQ ID NO: 1701614 - DNA, 18 bp, Homo sapiens
ctgagcaagaccctgtct

SEQ ID NO: 1701615 - DNA, 16 bp, Homo sapiens
ctgagcaatgtctgtg

SEQ ID NO: 1701616 - DNA, 17 bp, Homo sapiens
ctgagcaatgtctgtgc

SEQ ID NO: 1701617 - DNA, 18 bp, Homo sapiens
ctgagcaatgtctgtgct

SEQ ID NO: 1701618 - DNA, 17 bp, Homo sapiens
ctgagcacactttagtg

SEQ ID NO: 1701619 - DNA, 14 bp, Homo sapiens
ctgagcaccctctg

SEQ ID NO: 1701620 - DNA, 18 bp, Homo sapiens
ctgagcacctcccagccc

SEQ ID NO: 1701621 - DNA, 16 bp, Homo sapiens
ctgagcactgtttata

SEQ ID NO: 1701622 - DNA, 13 bp, Homo sapiens
ctgagcagccgcc

SEQ ID NO: 1701623 - DNA, 19 bp, Homo sapiens
ctgagcagggtccacagct

SEQ ID NO: 1701624 - DNA, 13 bp, Homo sapiens
ctgagcatcctgg

SEQ ID NO: 1701625 - DNA, 21 bp, Homo sapiens
ctgagcatgatgggaataggg

SEQ ID NO: 1701626 - DNA, 22 bp, Homo sapiens
ctgagcatggggcgctcccact

SEQ ID NO: 1701627 - DNA, 15 bp, Homo sapiens
ctgagccactcgcag

SEQ ID NO: 1701628 - DNA, 17 bp, Homo sapiens
ctgagccactcgcagtc

SEQ ID NO: 1701629 - DNA, 20 bp, Homo sapiens
ctgagccagggaacagcccc

SEQ ID NO: 1701630 - DNA, 17 bp, Homo sapiens
ctgagcccagagaagct

SEQ ID NO: 1701631 - DNA, 13 bp, Homo sapiens
ctgagcccaggag

SEQ ID NO: 1701632 - DNA, 23 bp, Homo sapiens
ctgagcccaggagctgagtcacc

SEQ ID NO: 1701633 - DNA, 21 bp, Homo sapiens
ctgagcccccccaacactgtg

SEQ ID NO: 1701634 - DNA, 14 bp, Homo sapiens
ctgagcccccggct

SEQ ID NO: 1701635 - DNA, 16 bp, Homo sapiens
ctgagcccccggctag

SEQ ID NO: 1701636 - DNA, 16 bp, Homo sapiens
ctgagccccctgcacc

SEQ ID NO: 1701637 - DNA, 17 bp, Homo sapiens
ctgagcccctaccccac

SEQ ID NO: 1701638 - DNA, 16 bp, Homo sapiens
ctgagcccgggctgcc

SEQ ID NO: 1701639 - DNA, 19 bp, Homo sapiens
ctgagcccgggctgcctgg

SEQ ID NO: 1701640 - DNA, 20 bp, Homo sapiens
ctgagcccgggctgcctggg

SEQ ID NO: 1701641 - DNA, 18 bp, Homo sapiens
ctgagccctactccctgc

SEQ ID NO: 1701642 - DNA, 21 bp, Homo sapiens
ctgagccctactccctgcaga

SEQ ID NO: 1701643 - DNA, 22 bp, Homo sapiens
ctgagccctactccctgcagat

SEQ ID NO: 1701644 - DNA, 18 bp, Homo sapiens
ctgagccggccccaggct

SEQ ID NO: 1701645 - DNA, 18 bp, Homo sapiens
ctgagcctcaaccttctg

SEQ ID NO: 1701646 - DNA, 20 bp, Homo sapiens
ctgagcctcaaccttctggg

SEQ ID NO: 1701647 - DNA, 23 bp, Homo sapiens
ctgagcctcaaccttctggggga

SEQ ID NO: 1701648 - DNA, 14 bp, Homo sapiens
agacttccccatcc

SEQ ID NO: 1701649 - DNA, 17 bp, Homo sapiens
agacttccccatcccga

SEQ ID NO: 1701650 - DNA, 13 bp, Homo sapiens
agacttcctttat

SEQ ID NO: 1701651 - DNA, 20 bp, Homo sapiens
agacttctggaaggctggct

SEQ ID NO: 1701652 - DNA, 22 bp, Homo sapiens
agacttctggaaggctggctga

SEQ ID NO: 1701653 - DNA, 23 bp, Homo sapiens
agacttctggaaggctggctgag

SEQ ID NO: 1701654 - DNA, 15 bp, Homo sapiens
agacttgaagcacag

SEQ ID NO: 1701655 - DNA, 18 bp, Homo sapiens
agacttgacaacatccca

SEQ ID NO: 1701656 - DNA, 20 bp, Homo sapiens
agacttgacaacatcccaca

SEQ ID NO: 1701657 - DNA, 15 bp, Homo sapiens
agacttgagaacttg

SEQ ID NO: 1701658 - DNA, 15 bp, Homo sapiens
agacttgcttcctgc

SEQ ID NO: 1701659 - DNA, 20 bp, Homo sapiens
agacttgggatggggaggga

SEQ ID NO: 1701660 - DNA, 21 bp, Homo sapiens
agacttggttggtagggtggg

SEQ ID NO: 1701661 - DNA, 22 bp, Homo sapiens
agacttggttggtagggtggga

SEQ ID NO: 1701662 - DNA, 15 bp, Homo sapiens
agacttgttctagag

SEQ ID NO: 1701663 - DNA, 14 bp, Homo sapiens
agactttaaagaat

SEQ ID NO: 1701664 - DNA, 18 bp, Homo sapiens
agactttagcttttcctt

SEQ ID NO: 1701665 - DNA, 17 bp, Homo sapiens
agactttatgtagtttt

SEQ ID NO: 1701666 - DNA, 23 bp, Homo sapiens
agactttgcccagggtcctgtgc

SEQ ID NO: 1701667 - DNA, 16 bp, Homo sapiens
agacttttaatatcac

SEQ ID NO: 1701668 - DNA, 13 bp, Homo sapiens
agacttttgaaaa

SEQ ID NO: 1701669 - DNA, 21 bp, Homo sapiens
agagaaaaaaagtttgccaga

SEQ ID NO: 1701670 - DNA, 13 bp, Homo sapiens
agagaaaaaagaa

SEQ ID NO: 1701671 - DNA, 13 bp, Homo sapiens
agagaaaaagaaa

SEQ ID NO: 1701672 - DNA, 17 bp, Homo sapiens
agagaaaaagtgcccct

SEQ ID NO: 1701673 - DNA, 14 bp, Homo sapiens
agagaaaagctgga

SEQ ID NO: 1701674 - DNA, 20 bp, Homo sapiens
agagaaaatgcggttataaa

SEQ ID NO: 1701675 - DNA, 21 bp, Homo sapiens
agagaaaatgtaaaggaggga

SEQ ID NO: 1701676 - DNA, 13 bp, Homo sapiens
agagaaaattcct

SEQ ID NO: 1701677 - DNA, 19 bp, Homo sapiens
agagaaactacccaggtat

SEQ ID NO: 1701678 - DNA, 22 bp, Homo sapiens
agagaaactttgagtacagata

SEQ ID NO: 1701679 - DNA, 15 bp, Homo sapiens
agagaaagaaaatga

SEQ ID NO: 1701680 - DNA, 16 bp, Homo sapiens
agagaaagaaaatgaa

SEQ ID NO: 1701681 - DNA, 21 bp, Homo sapiens
agagaaaggggagcccactgt

SEQ ID NO: 1701682 - DNA, 23 bp, Homo sapiens
agagaaaggggagcccactgtcc

SEQ ID NO: 1701683 - DNA, 15 bp, Homo sapiens
agagaaatattttaa

SEQ ID NO: 1701684 - DNA, 12 bp, Homo sapiens
agagaaatcctt

SEQ ID NO: 1701685 - DNA, 13 bp, Homo sapiens
agagaaatccttc

SEQ ID NO: 1701686 - DNA, 13 bp, Homo sapiens
agagaacaggtgg

SEQ ID NO: 1701687 - DNA, 24 bp, Homo sapiens
agagaaccaaaccgcaaacgtgaa

SEQ ID NO: 1701688 - DNA, 22 bp, Homo sapiens
agagaacctcaggtacggagaa

SEQ ID NO: 1701689 - DNA, 15 bp, Homo sapiens
agagaagaaatagca

SEQ ID NO: 1701690 - DNA, 19 bp, Homo sapiens
agagaagaaatagcagagc

SEQ ID NO: 1701691 - DNA, 16 bp, Homo sapiens
agagaagagggcccag

SEQ ID NO: 1701692 - DNA, 17 bp, Homo sapiens
agagaagagggcccagc

SEQ ID NO: 1701693 - DNA, 20 bp, Homo sapiens
agagaagagggcccagccca

SEQ ID NO: 1701694 - DNA, 20 bp, Homo sapiens
agagaagataatgttcttta

SEQ ID NO: 1701695 - DNA, 15 bp, Homo sapiens
agagaagcaagtaaa

SEQ ID NO: 1701696 - DNA, 14 bp, Homo sapiens
agagaagcaggcag

SEQ ID NO: 1701697 - DNA, 13 bp, Homo sapiens
agagaagctgctg

SEQ ID NO: 1701698 - DNA, 13 bp, Homo sapiens
agagaaggaaaag

SEQ ID NO: 1701699 - DNA, 17 bp, Homo sapiens
agagaaggacggtgcca

SEQ ID NO: 1701700 - DNA, 18 bp, Homo sapiens
agagaaggagcagaaaga

SEQ ID NO: 1701701 - DNA, 12 bp, Homo sapiens
agagaaggcagg

SEQ ID NO: 1701702 - DNA, 23 bp, Homo sapiens
agagaaggcccataccttctggt

SEQ ID NO: 1701703 - DNA, 13 bp, Homo sapiens
agagaaggcctct

SEQ ID NO: 1701704 - DNA, 15 bp, Homo sapiens
agagaaggccttaca

SEQ ID NO: 1701705 - DNA, 23 bp, Homo sapiens
agagaagggggacgtttctggaa

SEQ ID NO: 1701706 - DNA, 12 bp, Homo sapiens
agagaagttgta

SEQ ID NO: 1701707 - DNA, 12 bp, Homo sapiens
agagaataaatt

SEQ ID NO: 1701708 - DNA, 22 bp, Homo sapiens
agagaatattagctttactgtt

SEQ ID NO: 1701709 - DNA, 15 bp, Homo sapiens
agagaatcatactta

SEQ ID NO: 1701710 - DNA, 16 bp, Homo sapiens
agagaatctgatcaat

SEQ ID NO: 1701711 - DNA, 22 bp, Homo sapiens
agagaatgaaattgctgaaaga

SEQ ID NO: 1701712 - DNA, 10 bp, Homo sapiens
agagaatgag

SEQ ID NO: 1701713 - DNA, 12 bp, Homo sapiens
agagaatgagag

SEQ ID NO: 1701714 - DNA, 20 bp, Homo sapiens
agagaatggctgggtcaggg

SEQ ID NO: 1701715 - DNA, 14 bp, Homo sapiens
agagaatgtatttg

SEQ ID NO: 1701716 - DNA, 17 bp, Homo sapiens
agagaatgtattttcat

SEQ ID NO: 1701717 - DNA, 21 bp, Homo sapiens
agagacaaacacctcccagga

SEQ ID NO: 1701718 - DNA, 19 bp, Homo sapiens
agagacacatacagagtgg

SEQ ID NO: 1701719 - DNA, 15 bp, Homo sapiens
agagacaccaaactg

SEQ ID NO: 1701720 - DNA, 19 bp, Homo sapiens
agagacaccaaactgccaa

SEQ ID NO: 1701721 - DNA, 23 bp, Homo sapiens
agagacaccccttcctgctgaca

SEQ ID NO: 1701722 - DNA, 13 bp, Homo sapiens
agagacacctgca

SEQ ID NO: 1701723 - DNA, 19 bp, Homo sapiens
agagacacctgcacctccc

SEQ ID NO: 1701724 - DNA, 17 bp, Homo sapiens
agagacagacttgagaa

SEQ ID NO: 1701725 - DNA, 14 bp, Homo sapiens
agagacagcccagg

SEQ ID NO: 1701726 - DNA, 18 bp, Homo sapiens
agagacagcccaggatac

SEQ ID NO: 1701727 - DNA, 21 bp, Homo sapiens
agagacaggaaaatcctctgg

SEQ ID NO: 1701728 - DNA, 19 bp, Homo sapiens
agagacagtgatgcctgcc

SEQ ID NO: 1701729 - DNA, 15 bp, Homo sapiens
agagacagttctctg

SEQ ID NO: 1701730 - DNA, 17 bp, Homo sapiens
agagacatacttgaagg

SEQ ID NO: 1701731 - DNA, 20 bp, Homo sapiens
agagaccagggctccagccc

SEQ ID NO: 1701732 - DNA, 16 bp, Homo sapiens
agagacccaacagcag

SEQ ID NO: 1701733 - DNA, 15 bp, Homo sapiens
agagacccagatctc

SEQ ID NO: 1701734 - DNA, 14 bp, Homo sapiens
agagacccagctgc

SEQ ID NO: 1701735 - DNA, 18 bp, Homo sapiens
agagacccagctgcagac

SEQ ID NO: 1701736 - DNA, 12 bp, Homo sapiens
agagacccccag

SEQ ID NO: 1701737 - DNA, 14 bp, Homo sapiens
agagacccccaggc

SEQ ID NO: 1701738 - DNA, 19 bp, Homo sapiens
agagaccccgcacccggct

SEQ ID NO: 1701739 - DNA, 15 bp, Homo sapiens
agagacccctcccct

SEQ ID NO: 1701740 - DNA, 23 bp, Homo sapiens
agagacccgggaaggaaggctct

SEQ ID NO: 1701741 - DNA, 22 bp, Homo sapiens
agagaccctcactgctggggag

SEQ ID NO: 1701742 - DNA, 23 bp, Homo sapiens
agagaccctcactgctggggagt

SEQ ID NO: 1701743 - DNA, 17 bp, Homo sapiens
agagacccttgtttgat

SEQ ID NO: 1701744 - DNA, 13 bp, Homo sapiens
agagacctgccct

SEQ ID NO: 1701745 - DNA, 17 bp, Homo sapiens
agagacctgtgtgaact

SEQ ID NO: 1701746 - DNA, 19 bp, Homo sapiens
agagacctgtgtgaactat

SEQ ID NO: 1701747 - DNA, 20 bp, Homo sapiens
agagacgccctatttctatg

SEQ ID NO: 1701748 - DNA, 21 bp, Homo sapiens
agagacgccctatttctatgt

SEQ ID NO: 1701749 - DNA, 18 bp, Homo sapiens
agagactgaaagcagcag

SEQ ID NO: 1701750 - DNA, 20 bp, Homo sapiens
agagactgaaagcagcagct

SEQ ID NO: 1701751 - DNA, 16 bp, Homo sapiens
agagactgagcagccg

SEQ ID NO: 1701752 - DNA, 17 bp, Homo sapiens
agagactgcgttctgca

SEQ ID NO: 1701753 - DNA, 19 bp, Homo sapiens
agagacttgtgctcaagga

SEQ ID NO: 1701754 - DNA, 12 bp, Homo sapiens
agagacttgttt

SEQ ID NO: 1701755 - DNA, 21 bp, Homo sapiens
agagagaaagaagtaggcatg

SEQ ID NO: 1701756 - DNA, 14 bp, Homo sapiens
agagagaagccagc

SEQ ID NO: 1701757 - DNA, 14 bp, Homo sapiens
agagagaataaatt

SEQ ID NO: 1701758 - DNA, 17 bp, Homo sapiens
agagagaataaattgga

SEQ ID NO: 1701759 - DNA, 17 bp, Homo sapiens
agagagaatagagctgc

SEQ ID NO: 1701760 - DNA, 19 bp, Homo sapiens
agagagaatagagctgcca

SEQ ID NO: 1701761 - DNA, 14 bp, Homo sapiens
agagagacaagaag

SEQ ID NO: 1701762 - DNA, 14 bp, Homo sapiens
agagagaccctcac

SEQ ID NO: 1701763 - DNA, 14 bp, Homo sapiens
agagagagagaaaa

SEQ ID NO: 1701764 - DNA, 14 bp, Homo sapiens
agagagagaggaca

SEQ ID NO: 1701765 - DNA, 13 bp, Homo sapiens
ctgaaatgtttgg

SEQ ID NO: 1701766 - DNA, 14 bp, Homo sapiens
ctgaaatgtttgga

SEQ ID NO: 1701767 - DNA, 12 bp, Homo sapiens
ctgaaattcaga

SEQ ID NO: 1701768 - DNA, 22 bp, Homo sapiens
ctgaaattcagagcaagttcct

SEQ ID NO: 1701769 - DNA, 13 bp, Homo sapiens
ctgaaattccaaa

SEQ ID NO: 1701770 - DNA, 19 bp, Homo sapiens
ctgaaattgcttatttttg

SEQ ID NO: 1701771 - DNA, 16 bp, Homo sapiens
ctgaacaaaagctcag

SEQ ID NO: 1701772 - DNA, 14 bp, Homo sapiens
ctgaacaagaattg

SEQ ID NO: 1701773 - DNA, 19 bp, Homo sapiens
ctgaacaataggctgttcc

SEQ ID NO: 1701774 - DNA, 16 bp, Homo sapiens
ctgaacaatctccaaa

SEQ ID NO: 1701775 - DNA, 22 bp, Homo sapiens
ctgaacacagtgtctgttcagc

SEQ ID NO: 1701776 - DNA, 14 bp, Homo sapiens
ctgaacacatgtgt

SEQ ID NO: 1701777 - DNA, 15 bp, Homo sapiens
ctgaacacatgtgta

SEQ ID NO: 1701778 - DNA, 16 bp, Homo sapiens
ctgaacacatgtgtat

SEQ ID NO: 1701779 - DNA, 22 bp, Homo sapiens
ctgaacacatttctttttaaaa

SEQ ID NO: 1701780 - DNA, 14 bp, Homo sapiens
ctgaacagaattaa

SEQ ID NO: 1701781 - DNA, 17 bp, Homo sapiens
ctgaacatccttccttc

SEQ ID NO: 1701782 - DNA, 13 bp, Homo sapiens
ctgaacatgttta

SEQ ID NO: 1701783 - DNA, 15 bp, Homo sapiens
ctgaacatgtttaca

SEQ ID NO: 1701784 - DNA, 19 bp, Homo sapiens
ctgaacattagttgcacta

SEQ ID NO: 1701785 - DNA, 12 bp, Homo sapiens
ctgaacattgga

SEQ ID NO: 1701786 - DNA, 14 bp, Homo sapiens
ctgaacattggaga

SEQ ID NO: 1701787 - DNA, 16 bp, Homo sapiens
ctgaaccaaagcctct

SEQ ID NO: 1701788 - DNA, 14 bp, Homo sapiens
ctgaaccactgctt

SEQ ID NO: 1701789 - DNA, 14 bp, Homo sapiens
ctgaaccagtccag

SEQ ID NO: 1701790 - DNA, 14 bp, Homo sapiens
ctgaaccccagagg

SEQ ID NO: 1701791 - DNA, 14 bp, Homo sapiens
ctgaaccccatggg

SEQ ID NO: 1701792 - DNA, 17 bp, Homo sapiens
ctgaaccccatgggctt

SEQ ID NO: 1701793 - DNA, 20 bp, Homo sapiens
ctgaaccccatgggcttgga

SEQ ID NO: 1701794 - DNA, 20 bp, Homo sapiens
agaattttcagaccccagcg

SEQ ID NO: 1701795 - DNA, 21 bp, Homo sapiens
agaattttcagaccccagcgg

SEQ ID NO: 1701796 - DNA, 16 bp, Homo sapiens
agaatttttccctcca

SEQ ID NO: 1701797 - DNA, 15 bp, Homo sapiens
agaatttttttgtct

SEQ ID NO: 1701798 - DNA, 16 bp, Homo sapiens
agaatttttttgtctt

SEQ ID NO: 1701799 - DNA, 23 bp, Homo sapiens
agacaaaaacaagtaaatatata

SEQ ID NO: 1701800 - DNA, 14 bp, Homo sapiens
agacaaaaagacaa

SEQ ID NO: 1701801 - DNA, 12 bp, Homo sapiens
agacaaaaagta

SEQ ID NO: 1701802 - DNA, 17 bp, Homo sapiens
agacaaaatttgagaat

SEQ ID NO: 1701803 - DNA, 13 bp, Homo sapiens
agacaaagccctg

SEQ ID NO: 1701804 - DNA, 15 bp, Homo sapiens
agacaaagccctgtc

SEQ ID NO: 1701805 - DNA, 18 bp, Homo sapiens
agacaaagccctgtcctt

SEQ ID NO: 1701806 - DNA, 16 bp, Homo sapiens
agacaaaggaggaatt

SEQ ID NO: 1701807 - DNA, 17 bp, Homo sapiens
agacaaaggaggaattt

SEQ ID NO: 1701808 - DNA, 20 bp, Homo sapiens
agacaaagtctaaggaagaa

SEQ ID NO: 1701809 - DNA, 16 bp, Homo sapiens
agacaaatatttggag

SEQ ID NO: 1701810 - DNA, 22 bp, Homo sapiens
agacaaatgggactgatgtcat

SEQ ID NO: 1701811 - DNA, 18 bp, Homo sapiens
agacaaattctgtttctt

SEQ ID NO: 1701812 - DNA, 19 bp, Homo sapiens
agacaaattctgtttcttg

SEQ ID NO: 1701813 - DNA, 21 bp, Homo sapiens
agacaaattctgtttcttgag

SEQ ID NO: 1701814 - DNA, 14 bp, Homo sapiens
agacaacagaagtc

SEQ ID NO: 1701815 - DNA, 14 bp, Homo sapiens
agacaacattatga

SEQ ID NO: 1701816 - DNA, 18 bp, Homo sapiens
agacaacattatgatcta

SEQ ID NO: 1701817 - DNA, 19 bp, Homo sapiens
agacaacattatgatctaa

SEQ ID NO: 1701818 - DNA, 21 bp, Homo sapiens
agacaacattatgatctaata

SEQ ID NO: 1701819 - DNA, 18 bp, Homo sapiens
agacaaccatagaactgt

SEQ ID NO: 1701820 - DNA, 14 bp, Homo sapiens
agacaacctttctg

SEQ ID NO: 1701821 - DNA, 14 bp, Homo sapiens
agacaagagctgct

SEQ ID NO: 1701822 - DNA, 15 bp, Homo sapiens
agacaagatattgta

SEQ ID NO: 1701823 - DNA, 21 bp, Homo sapiens
agacaagatattgtacataaa

SEQ ID NO: 1701824 - DNA, 22 bp, Homo sapiens
agacaagatattgtacataaaa

SEQ ID NO: 1701825 - DNA, 14 bp, Homo sapiens
agacaagcaacagg

SEQ ID NO: 1701826 - DNA, 20 bp, Homo sapiens
agacaagcactattttatat

SEQ ID NO: 1701827 - DNA, 19 bp, Homo sapiens
agacaagcagcccttgctt

SEQ ID NO: 1701828 - DNA, 13 bp, Homo sapiens
agacaagccctgg

SEQ ID NO: 1701829 - DNA, 16 bp, Homo sapiens
agacaagccctggcaa

SEQ ID NO: 1701830 - DNA, 17 bp, Homo sapiens
agacaagccctggcaac

SEQ ID NO: 1701831 - DNA, 13 bp, Homo sapiens
agacaaggtgcta

SEQ ID NO: 1701832 - DNA, 14 bp, Homo sapiens
agacaaggtgctaa

SEQ ID NO: 1701833 - DNA, 18 bp, Homo sapiens
agacaatatgtgagtgcc

SEQ ID NO: 1701834 - DNA, 14 bp, Homo sapiens
agacaatcactgcc

SEQ ID NO: 1701835 - DNA, 17 bp, Homo sapiens
agacaatttgatacata

SEQ ID NO: 1701836 - DNA, 18 bp, Homo sapiens
agacaatttgatacataa

SEQ ID NO: 1701837 - DNA, 23 bp, Homo sapiens
agacaatttgatacataataaaa

SEQ ID NO: 1701838 - DNA, 13 bp, Homo sapiens
agacaatttgcac

SEQ ID NO: 1701839 - DNA, 14 bp, Homo sapiens
agacacacacacgc

SEQ ID NO: 1701840 - DNA, 15 bp, Homo sapiens
agacacacacacgca

SEQ ID NO: 1701841 - DNA, 16 bp, Homo sapiens
agacacacacacgcac

SEQ ID NO: 1701842 - DNA, 16 bp, Homo sapiens
agacacagcctccccc

SEQ ID NO: 1701843 - DNA, 18 bp, Homo sapiens
agacacagcgtccctagc

SEQ ID NO: 1701844 - DNA, 13 bp, Homo sapiens
agacacaggccct

SEQ ID NO: 1701845 - DNA, 21 bp, Homo sapiens
agacacagtcatactgtcact

SEQ ID NO: 1701846 - DNA, 21 bp, Homo sapiens
agacacatacatgtcacattt

SEQ ID NO: 1701847 - DNA, 13 bp, Homo sapiens
agacacatgaagg

SEQ ID NO: 1701848 - DNA, 16 bp, Homo sapiens
agacacatgctatgtt

SEQ ID NO: 1701849 - DNA, 21 bp, Homo sapiens
agacacatgctatgttctgtc

SEQ ID NO: 1701850 - DNA, 16 bp, Homo sapiens
agacacatgggcttgt

SEQ ID NO: 1701851 - DNA, 13 bp, Homo sapiens
agacaccaaagtt

SEQ ID NO: 1701852 - DNA, 15 bp, Homo sapiens
agacaccaaagttct

SEQ ID NO: 1701853 - DNA, 19 bp, Homo sapiens
agacaccatcctgagccag

SEQ ID NO: 1701854 - DNA, 15 bp, Homo sapiens
agacacccaggactt

SEQ ID NO: 1701855 - DNA, 21 bp, Homo sapiens
agacaccctcaacctcttctg

SEQ ID NO: 1701856 - DNA, 14 bp, Homo sapiens
agacacctgcacct

SEQ ID NO: 1701857 - DNA, 16 bp, Homo sapiens
agacacctgcacctcc

SEQ ID NO: 1701858 - DNA, 20 bp, Homo sapiens
agacacctgcacctcccccc

SEQ ID NO: 1701859 - DNA, 19 bp, Homo sapiens
agacacctgttcacagaaa

SEQ ID NO: 1701860 - DNA, 23 bp, Homo sapiens
agacacgctcgcgggcagcgggc

SEQ ID NO: 1701861 - DNA, 21 bp, Homo sapiens
agacacggagcccagccctcc

SEQ ID NO: 1701862 - DNA, 22 bp, Homo sapiens
agacactaacgacttcagggca

SEQ ID NO: 1701863 - DNA, 14 bp, Homo sapiens
agacactctgctct

SEQ ID NO: 1701864 - DNA, 19 bp, Homo sapiens
agacactgaccatccactc

SEQ ID NO: 1701865 - DNA, 13 bp, Homo sapiens
agacactgcctgg

SEQ ID NO: 1701866 - DNA, 15 bp, Homo sapiens
agacactgcctgggc

SEQ ID NO: 1701867 - DNA, 20 bp, Homo sapiens
agacactggtttacacttta

SEQ ID NO: 1701868 - DNA, 15 bp, Homo sapiens
agacacttgccttct

SEQ ID NO: 1701869 - DNA, 11 bp, Homo sapiens
agacagaaaag

SEQ ID NO: 1701870 - DNA, 12 bp, Homo sapiens
agacagaatctc

SEQ ID NO: 1701871 - DNA, 19 bp, Homo sapiens
agacagaatggtggagtgt

SEQ ID NO: 1701872 - DNA, 14 bp, Homo sapiens
agacagacacacac

SEQ ID NO: 1701873 - DNA, 15 bp, Homo sapiens
agacagacacacaca

SEQ ID NO: 1701874 - DNA, 16 bp, Homo sapiens
agacagaccacttgcc

SEQ ID NO: 1701875 - DNA, 20 bp, Homo sapiens
agacagagccaggagaagct

SEQ ID NO: 1701876 - DNA, 15 bp, Homo sapiens
agacagatgccccag

SEQ ID NO: 1701877 - DNA, 19 bp, Homo sapiens
agacagatgccccagagct

SEQ ID NO: 1701878 - DNA, 12 bp, Homo sapiens
agacagcagctc

SEQ ID NO: 1701879 - DNA, 11 bp, Homo sapiens
agacagcctct

SEQ ID NO: 1701880 - DNA, 15 bp, Homo sapiens
agacagctccctctg

SEQ ID NO: 1701881 - DNA, 18 bp, Homo sapiens
agacagctccctctgcct

SEQ ID NO: 1701882 - DNA, 20 bp, Homo sapiens
agacagctccctctgcctga

SEQ ID NO: 1701883 - DNA, 14 bp, Homo sapiens
agacagcttttctc

SEQ ID NO: 1701884 - DNA, 20 bp, Homo sapiens
agacaggaaaatcctctggc

SEQ ID NO: 1701885 - DNA, 20 bp, Homo sapiens
agacaggacagaatgtgttc

SEQ ID NO: 1701886 - DNA, 18 bp, Homo sapiens
agacaggacctgactatt

SEQ ID NO: 1701887 - DNA, 14 bp, Homo sapiens
agacaggagaaatg

SEQ ID NO: 1701888 - DNA, 14 bp, Homo sapiens
agacaggagaatca

SEQ ID NO: 1701889 - DNA, 20 bp, Homo sapiens
agacaggccatgtgagccac

SEQ ID NO: 1701890 - DNA, 22 bp, Homo sapiens
agacaggccatgtgagccaccg

SEQ ID NO: 1701891 - DNA, 16 bp, Homo sapiens
agacaggcggggccca

SEQ ID NO: 1701892 - DNA, 15 bp, Homo sapiens
ctctgggcctgaggg

SEQ ID NO: 1701893 - DNA, 22 bp, Homo sapiens
ctctgggcctgagggtccacct

SEQ ID NO: 1701894 - DNA, 12 bp, Homo sapiens
ctctgggctcag

SEQ ID NO: 1701895 - DNA, 11 bp, Homo sapiens
ctctgggctgt

SEQ ID NO: 1701896 - DNA, 12 bp, Homo sapiens
ctctggggacag

SEQ ID NO: 1701897 - DNA, 19 bp, Homo sapiens
ctctggggatttctgggat

SEQ ID NO: 1701898 - DNA, 13 bp, Homo sapiens
ctctgggggtcct

SEQ ID NO: 1701899 - DNA, 16 bp, Homo sapiens
ctctgggggtcctctc

SEQ ID NO: 1701900 - DNA, 17 bp, Homo sapiens
ctctgggggtcctctct

SEQ ID NO: 1701901 - DNA, 19 bp, Homo sapiens
ctctgggggtcctctctga

SEQ ID NO: 1701902 - DNA, 21 bp, Homo sapiens
ctctgggtacctgcaagcaga

SEQ ID NO: 1701903 - DNA, 23 bp, Homo sapiens
ctctgggtacctgcaagcagaac

SEQ ID NO: 1701904 - DNA, 16 bp, Homo sapiens
ctctgggtccctcctc

SEQ ID NO: 1701905 - DNA, 19 bp, Homo sapiens
ctctgggtggaagtgccca

SEQ ID NO: 1701906 - DNA, 21 bp, Homo sapiens
ctctgggtggaagtgcccagc

SEQ ID NO: 1701907 - DNA, 22 bp, Homo sapiens
ctctgggtggaagtgcccagcc

SEQ ID NO: 1701908 - DNA, 23 bp, Homo sapiens
ctctggtacgaatctcatccctc

SEQ ID NO: 1701909 - DNA, 16 bp, Homo sapiens
ctctggtcgctcctgc

SEQ ID NO: 1701910 - DNA, 20 bp, Homo sapiens
ctctggtcgctcctgcccac

SEQ ID NO: 1701911 - DNA, 19 bp, Homo sapiens
ctctggtctactctagaag

SEQ ID NO: 1701912 - DNA, 16 bp, Homo sapiens
ctctggtgacaccagc

SEQ ID NO: 1701913 - DNA, 23 bp, Homo sapiens
ctctggtgagtcaccacttcagg

SEQ ID NO: 1701914 - DNA, 13 bp, Homo sapiens
ctctggtgcctcc

SEQ ID NO: 1701915 - DNA, 14 bp, Homo sapiens
ctctggtgcctcca

SEQ ID NO: 1701916 - DNA, 18 bp, Homo sapiens
ctctggtgtgtggtgagg

SEQ ID NO: 1701917 - DNA, 15 bp, Homo sapiens
ctctggttatttttc

SEQ ID NO: 1701918 - DNA, 20 bp, Homo sapiens
ctctggttatttttctcttg

SEQ ID NO: 1701919 - DNA, 22 bp, Homo sapiens
ctctggttatttttctcttgta

SEQ ID NO: 1701920 - DNA, 21 bp, Homo sapiens
ctctggttcctttcatctctc

SEQ ID NO: 1701921 - DNA, 20 bp, Homo sapiens
ctctggttttctggtggggc

SEQ ID NO: 1701922 - DNA, 19 bp, Homo sapiens
ctctgtaccgcccggcagc

SEQ ID NO: 1701923 - DNA, 12 bp, Homo sapiens
ctctgtactttt

SEQ ID NO: 1701924 - DNA, 22 bp, Homo sapiens
ctctgtagctccctcctcccat

SEQ ID NO: 1701925 - DNA, 18 bp, Homo sapiens
ctctgtaggcacagagct

SEQ ID NO: 1701926 - DNA, 21 bp, Homo sapiens
ctctgtaggcacagagctgca

SEQ ID NO: 1701927 - DNA, 13 bp, Homo sapiens
ctctgtaggcagc

SEQ ID NO: 1701928 - DNA, 19 bp, Homo sapiens
ctctgtaggcagcagagag

SEQ ID NO: 1701929 - DNA, 14 bp, Homo sapiens
ctctgtagtggccc

SEQ ID NO: 1701930 - DNA, 17 bp, Homo sapiens
ctctgtagtttatggca

SEQ ID NO: 1701931 - DNA, 14 bp, Homo sapiens
ctctgtcaggcctt

SEQ ID NO: 1701932 - DNA, 20 bp, Homo sapiens
ctctgtcatcactccctgga

SEQ ID NO: 1701933 - DNA, 21 bp, Homo sapiens
ctctgtcatcactccctggat

SEQ ID NO: 1701934 - DNA, 13 bp, Homo sapiens
ctctgtccaggcc

SEQ ID NO: 1701935 - DNA, 20 bp, Homo sapiens
ctctgtccagggccctgagc

SEQ ID NO: 1701936 - DNA, 14 bp, Homo sapiens
ctctgtccccttct

SEQ ID NO: 1701937 - DNA, 21 bp, Homo sapiens
ctctgtcctcttggccatcct

SEQ ID NO: 1701938 - DNA, 20 bp, Homo sapiens
ctctgtctacctggtctggt

SEQ ID NO: 1701939 - DNA, 22 bp, Homo sapiens
ctctgtctcctaagctggagtg

SEQ ID NO: 1701940 - DNA, 21 bp, Homo sapiens
ctctgtgaacgatttagaaag

SEQ ID NO: 1701941 - DNA, 13 bp, Homo sapiens
ctctgtgacccta

SEQ ID NO: 1701942 - DNA, 15 bp, Homo sapiens
ctctgtgacctgccc

SEQ ID NO: 1701943 - DNA, 11 bp, Homo sapiens
ctctgtgagaa

SEQ ID NO: 1701944 - DNA, 22 bp, Homo sapiens
ctctgtgagaaggtttattgtt

SEQ ID NO: 1701945 - DNA, 18 bp, Homo sapiens
ctctgtgcacagtggctt

SEQ ID NO: 1701946 - DNA, 13 bp, Homo sapiens
ctctgtgcaggtg

SEQ ID NO: 1701947 - DNA, 21 bp, Homo sapiens
ctctgtgcaggtgctgccttg

SEQ ID NO: 1701948 - DNA, 22 bp, Homo sapiens
ctctgtgcctccctccccagtg

SEQ ID NO: 1701949 - DNA, 16 bp, Homo sapiens
ctctgtgccttctttt

SEQ ID NO: 1701950 - DNA, 10 bp, Homo sapiens
ctctgtgctc

SEQ ID NO: 1701951 - DNA, 13 bp, Homo sapiens
ctctgtgctctga

SEQ ID NO: 1701952 - DNA, 11 bp, Homo sapiens
ctctgtgcttc

SEQ ID NO: 1701953 - DNA, 19 bp, Homo sapiens
ctctgtgcttcgactactg

SEQ ID NO: 1701954 - DNA, 20 bp, Homo sapiens
ctctgtgcttcgactactgc

SEQ ID NO: 1701955 - DNA, 11 bp, Homo sapiens
ctctgtggatg

SEQ ID NO: 1701956 - DNA, 22 bp, Homo sapiens
ctctgtggcctgtgtccagcag

SEQ ID NO: 1701957 - DNA, 23 bp, Homo sapiens
ctctgtggcctgtgtccagcagc

SEQ ID NO: 1701958 - DNA, 17 bp, Homo sapiens
ctctgtgggctggcagt

SEQ ID NO: 1701959 - DNA, 13 bp, Homo sapiens
ctctgtggggctg

SEQ ID NO: 1701960 - DNA, 17 bp, Homo sapiens
ctctgtgggtctctgga

SEQ ID NO: 1701961 - DNA, 20 bp, Homo sapiens
ctctgtgggtctctggaaga

SEQ ID NO: 1701962 - DNA, 13 bp, Homo sapiens
ctctgtgtaatct

SEQ ID NO: 1701963 - DNA, 18 bp, Homo sapiens
ctctgtgtatttgctttt

SEQ ID NO: 1701964 - DNA, 19 bp, Homo sapiens
ctctgtgtatttgcttttt

SEQ ID NO: 1701965 - DNA, 18 bp, Homo sapiens
ctctgtgtctaagattct

SEQ ID NO: 1701966 - DNA, 19 bp, Homo sapiens
ctctgttaacatctagcct

SEQ ID NO: 1701967 - DNA, 13 bp, Homo sapiens
ctctgttacaaaa

SEQ ID NO: 1701968 - DNA, 14 bp, Homo sapiens
ctctgttacaaaag

SEQ ID NO: 1701969 - DNA, 21 bp, Homo sapiens
ctctgttactccattactgtg

SEQ ID NO: 1701970 - DNA, 22 bp, Homo sapiens
ctctgttactccattactgtga

SEQ ID NO: 1701971 - DNA, 18 bp, Homo sapiens
ctctgttcaaagctgcct

SEQ ID NO: 1701972 - DNA, 22 bp, Homo sapiens
ctctgttccttcacatcctgtg

SEQ ID NO: 1701973 - DNA, 20 bp, Homo sapiens
ctctgttcctttctctgggc

SEQ ID NO: 1701974 - DNA, 22 bp, Homo sapiens
ctctgttcctttctctgggctt

SEQ ID NO: 1701975 - DNA, 22 bp, Homo sapiens
ctctgttctgctcccagatgcc

SEQ ID NO: 1701976 - DNA, 21 bp, Homo sapiens
ctctgttgccaggctggagtg

SEQ ID NO: 1701977 - DNA, 22 bp, Homo sapiens
ctctgttgcccaggctggagtg

SEQ ID NO: 1701978 - DNA, 15 bp, Homo sapiens
ctctgtttcttcctt

SEQ ID NO: 1701979 - DNA, 16 bp, Homo sapiens
ctctgtttgtgggact

SEQ ID NO: 1701980 - DNA, 18 bp, Homo sapiens
ctcttaaaaaataaaaac

SEQ ID NO: 1701981 - DNA, 20 bp, Homo sapiens
ctcttaaattatatatttat

SEQ ID NO: 1701982 - DNA, 12 bp, Homo sapiens
ctcttacctgtt

SEQ ID NO: 1701983 - DNA, 21 bp, Homo sapiens
ctcttacctgttatttatcaa

SEQ ID NO: 1701984 - DNA, 17 bp, Homo sapiens
ctcttaccttcccgcct

SEQ ID NO: 1701985 - DNA, 14 bp, Homo sapiens
ctcttgcgggcctg

SEQ ID NO: 1701986 - DNA, 17 bp, Homo sapiens
ctcttgctctcttgtga

SEQ ID NO: 1701987 - DNA, 14 bp, Homo sapiens
ctcttgcttgagga

SEQ ID NO: 1701988 - DNA, 13 bp, Homo sapiens
ctcttggagaagt

SEQ ID NO: 1701989 - DNA, 14 bp, Homo sapiens
ctcttggccatcct

SEQ ID NO: 1701990 - DNA, 21 bp, Homo sapiens
ctcttggccatccttctgtgt

SEQ ID NO: 1701991 - DNA, 22 bp, Homo sapiens
ctcttggctattgaccatgtgg

SEQ ID NO: 1701992 - DNA, 17 bp, Homo sapiens
ctcttggctgacccctc

SEQ ID NO: 1701993 - DNA, 19 bp, Homo sapiens
ctcttgggaagtgtgttta

SEQ ID NO: 1701994 - DNA, 19 bp, Homo sapiens
ctcttgggttcaagtgatt

SEQ ID NO: 1701995 - DNA, 15 bp, Homo sapiens
ctcttggtacctgtg

SEQ ID NO: 1701996 - DNA, 16 bp, Homo sapiens
ctcttggtccctggtc

SEQ ID NO: 1701997 - DNA, 23 bp, Homo sapiens
ctcttggtgggtgtggccagcac

SEQ ID NO: 1701998 - DNA, 21 bp, Homo sapiens
ctcttgtaagtcatctactta

SEQ ID NO: 1701999 - DNA, 20 bp, Homo sapiens
ctcttgtataagatcctaga

SEQ ID NO: 1702000 - DNA, 20 bp, Homo sapiens
ctcttgtcatttttaatatt

SEQ ID NO: 1702001 - DNA, 16 bp, Homo sapiens
ctcttgtccctgtcgc

SEQ ID NO: 1702002 - DNA, 14 bp, Homo sapiens
ctcttgtcctcttc

SEQ ID NO: 1702003 - DNA, 24 bp, Homo sapiens
ctcttgtcctcttctgctcttttc

SEQ ID NO: 1702004 - DNA, 15 bp, Homo sapiens
ctcttgtcctggccc

SEQ ID NO: 1702005 - DNA, 21 bp, Homo sapiens
ctcttgtcctggcccttcagt

SEQ ID NO: 1702006 - DNA, 22 bp, Homo sapiens
ctcttgtctggcaaaagaaaaa

SEQ ID NO: 1702007 - DNA, 21 bp, Homo sapiens
ctcttgtcttcctatttcaga

SEQ ID NO: 1702008 - DNA, 20 bp, Homo sapiens
ctcttgtgacgtgcactgtg

SEQ ID NO: 1702009 - DNA, 19 bp, Homo sapiens
ctcttgtgctcacgctccc

SEQ ID NO: 1702010 - DNA, 13 bp, Homo sapiens
agaatcattttta

SEQ ID NO: 1702011 - DNA, 15 bp, Homo sapiens
agaatccaatactgc

SEQ ID NO: 1702012 - DNA, 17 bp, Homo sapiens
agaatccacatttctaa

SEQ ID NO: 1702013 - DNA, 22 bp, Homo sapiens
agaatccacatttctaaaatct

SEQ ID NO: 1702014 - DNA, 20 bp, Homo sapiens
agaatccataaatgtgttcc

SEQ ID NO: 1702015 - DNA, 16 bp, Homo sapiens
agaatcccagcagcag

SEQ ID NO: 1702016 - DNA, 20 bp, Homo sapiens
agaatcccttaacagttgta

SEQ ID NO: 1702017 - DNA, 20 bp, Homo sapiens
agaatcctcagttggaatca

SEQ ID NO: 1702018 - DNA, 17 bp, Homo sapiens
agaatcctcccttccca

SEQ ID NO: 1702019 - DNA, 19 bp, Homo sapiens
agaatccttatctataaaa

SEQ ID NO: 1702020 - DNA, 14 bp, Homo sapiens
agaatcctttacat

SEQ ID NO: 1702021 - DNA, 14 bp, Homo sapiens
agaatctaaacctt

SEQ ID NO: 1702022 - DNA, 18 bp, Homo sapiens
agaatctagaaaatcaga

SEQ ID NO: 1702023 - DNA, 14 bp, Homo sapiens
agaatctagaaatg

SEQ ID NO: 1702024 - DNA, 13 bp, Homo sapiens
agaatctagaaga

SEQ ID NO: 1702025 - DNA, 18 bp, Homo sapiens
agaatctagaagatgtgt

SEQ ID NO: 1702026 - DNA, 21 bp, Homo sapiens
agaatctctatgtatattcta

SEQ ID NO: 1702027 - DNA, 16 bp, Homo sapiens
agaatctcttcatgct

SEQ ID NO: 1702028 - DNA, 22 bp, Homo sapiens
agaatctcttcatgcttgacat

SEQ ID NO: 1702029 - DNA, 18 bp, Homo sapiens
agaatctgctgttgccat

SEQ ID NO: 1702030 - DNA, 13 bp, Homo sapiens
agaatcttctggg

SEQ ID NO: 1702031 - DNA, 21 bp, Homo sapiens
agaatgaaaactgtaaatatt

SEQ ID NO: 1702032 - DNA, 19 bp, Homo sapiens
agaatgaaggtttttgtaa

SEQ ID NO: 1702033 - DNA, 20 bp, Homo sapiens
agaatgaaggtttttgtaaa

SEQ ID NO: 1702034 - DNA, 21 bp, Homo sapiens
agaatgaatttatctttacca

SEQ ID NO: 1702035 - DNA, 14 bp, Homo sapiens
agaatgagaatgga

SEQ ID NO: 1702036 - DNA, 17 bp, Homo sapiens
agaatgagagcgacaca

SEQ ID NO: 1702037 - DNA, 20 bp, Homo sapiens
agaatgagagcgacacagac

SEQ ID NO: 1702038 - DNA, 21 bp, Homo sapiens
agaatgagagcgacacagacg

SEQ ID NO: 1702039 - DNA, 14 bp, Homo sapiens
agaatgagagtgtg

SEQ ID NO: 1702040 - DNA, 12 bp, Homo sapiens
agaatgagcctc

SEQ ID NO: 1702041 - DNA, 14 bp, Homo sapiens
agaatgagtgggaa

SEQ ID NO: 1702042 - DNA, 14 bp, Homo sapiens
agaatgagtttctt

SEQ ID NO: 1702043 - DNA, 20 bp, Homo sapiens
agaatgatcaaggatctgga

SEQ ID NO: 1702044 - DNA, 21 bp, Homo sapiens
agaatgatggtttccaatttc

SEQ ID NO: 1702045 - DNA, 17 bp, Homo sapiens
agaatgatgttttaaaa

SEQ ID NO: 1702046 - DNA, 15 bp, Homo sapiens
agaatgattaatcaa

SEQ ID NO: 1702047 - DNA, 14 bp, Homo sapiens
agaatgatttcatg

SEQ ID NO: 1702048 - DNA, 17 bp, Homo sapiens
agaatgcacaagaatgg

SEQ ID NO: 1702049 - DNA, 19 bp, Homo sapiens
agaatgcacaagaatggat

SEQ ID NO: 1702050 - DNA, 20 bp, Homo sapiens
agaatgcagattcctgggcc

SEQ ID NO: 1702051 - DNA, 20 bp, Homo sapiens
agaatgcattccctgaatct

SEQ ID NO: 1702052 - DNA, 19 bp, Homo sapiens
agaatgccactttggctga

SEQ ID NO: 1702053 - DNA, 11 bp, Homo sapiens
agaatgctcct

SEQ ID NO: 1702054 - DNA, 13 bp, Homo sapiens
agaatgctggttt

SEQ ID NO: 1702055 - DNA, 14 bp, Homo sapiens
agaatggaagcctg

SEQ ID NO: 1702056 - DNA, 14 bp, Homo sapiens
agaatggagacaga

SEQ ID NO: 1702057 - DNA, 14 bp, Homo sapiens
agaatggaggaaga

SEQ ID NO: 1702058 - DNA, 16 bp, Homo sapiens
agaatggaggaagaac

SEQ ID NO: 1702059 - DNA, 20 bp, Homo sapiens
agaatggatcacaagatgga

SEQ ID NO: 1702060 - DNA, 18 bp, Homo sapiens
agaatggctgggtcaggg

SEQ ID NO: 1702061 - DNA, 14 bp, Homo sapiens
agaatggtgatttt

SEQ ID NO: 1702062 - DNA, 16 bp, Homo sapiens
agaatggtgattttaa

SEQ ID NO: 1702063 - DNA, 18 bp, Homo sapiens
agaatggtgattttaaat

SEQ ID NO: 1702064 - DNA, 20 bp, Homo sapiens
agaatggtgattttaaatgt

SEQ ID NO: 1702065 - DNA, 20 bp, Homo sapiens
agaatggtgtgaacccggga

SEQ ID NO: 1702066 - DNA, 17 bp, Homo sapiens
agaatgtaaaagaactt

SEQ ID NO: 1702067 - DNA, 21 bp, Homo sapiens
agaatgtaactccagatagag

SEQ ID NO: 1702068 - DNA, 21 bp, Homo sapiens
agaatgtaaggtatatcattc

SEQ ID NO: 1702069 - DNA, 23 bp, Homo sapiens
agaatgtaaggtatatcattcta

SEQ ID NO: 1702070 - DNA, 21 bp, Homo sapiens
agaatgtacgtccagcctgcc

SEQ ID NO: 1702071 - DNA, 17 bp, Homo sapiens
agaatgtattttcatag

SEQ ID NO: 1702072 - DNA, 23 bp, Homo sapiens
agaatgtattttcatagatgtgt

SEQ ID NO: 1702073 - DNA, 18 bp, Homo sapiens
agaatgtcagatttctgg

SEQ ID NO: 1702074 - DNA, 15 bp, Homo sapiens
agaatgtcagtatgt

SEQ ID NO: 1702075 - DNA, 16 bp, Homo sapiens
agaatgtcagtatgtg

SEQ ID NO: 1702076 - DNA, 19 bp, Homo sapiens
agaatgtgaaaaaggaata

SEQ ID NO: 1702077 - DNA, 20 bp, Homo sapiens
agaatgtgaaaaaggaataa

SEQ ID NO: 1702078 - DNA, 13 bp, Homo sapiens
agaatgtgttctt

SEQ ID NO: 1702079 - DNA, 20 bp, Homo sapiens
agaatgtgttcttttctcct

SEQ ID NO: 1702080 - DNA, 19 bp, Homo sapiens
agaatgtgtttcaaaacca

SEQ ID NO: 1702081 - DNA, 16 bp, Homo sapiens
agaatgttgtacttga

SEQ ID NO: 1702082 - DNA, 18 bp, Homo sapiens
agaatgttgtattcagtg

SEQ ID NO: 1702083 - DNA, 19 bp, Homo sapiens
agaatgttttactgtgaaa

SEQ ID NO: 1702084 - DNA, 21 bp, Homo sapiens
agaattaaacttttaattcat

SEQ ID NO: 1702085 - DNA, 17 bp, Homo sapiens
agaattagtatgtctgt

SEQ ID NO: 1702086 - DNA, 19 bp, Homo sapiens
agaattagtatgtctgttt

SEQ ID NO: 1702087 - DNA, 22 bp, Homo sapiens
agaattagtatgtctgtttttg

SEQ ID NO: 1702088 - DNA, 16 bp, Homo sapiens
agaattatatatttct

SEQ ID NO: 1702089 - DNA, 19 bp, Homo sapiens
agaattatgtaatatattg

SEQ ID NO: 1702090 - DNA, 11 bp, Homo sapiens
agaattattta

SEQ ID NO: 1702091 - DNA, 16 bp, Homo sapiens
agaattatttttgtgt

SEQ ID NO: 1702092 - DNA, 17 bp, Homo sapiens
agaattatttttgtgtt

SEQ ID NO: 1702093 - DNA, 21 bp, Homo sapiens
agaattcaaaagtgattatct

SEQ ID NO: 1702094 - DNA, 13 bp, Homo sapiens
agaattcagacat

SEQ ID NO: 1702095 - DNA, 12 bp, Homo sapiens
agaattccttcg

SEQ ID NO: 1702096 - DNA, 22 bp, Homo sapiens
agaattcggtgtgctgccaact

SEQ ID NO: 1702097 - DNA, 17 bp, Homo sapiens
agaattctcttatccaa

SEQ ID NO: 1702098 - DNA, 15 bp, Homo sapiens
agaattctgattgat

SEQ ID NO: 1702099 - DNA, 23 bp, Homo sapiens
agaattctgattgatttgattgg

SEQ ID NO: 1702100 - DNA, 13 bp, Homo sapiens
agaattctgctac

SEQ ID NO: 1702101 - DNA, 16 bp, Homo sapiens
agaattcttacatgtt

SEQ ID NO: 1702102 - DNA, 23 bp, Homo sapiens
agaattcttacatgttttctttg

SEQ ID NO: 1702103 - DNA, 17 bp, Homo sapiens
agaattgaaaagttttt

SEQ ID NO: 1702104 - DNA, 20 bp, Homo sapiens
agaattgactgaagcacagc

SEQ ID NO: 1702105 - DNA, 22 bp, Homo sapiens
agaattgatcattttcccccca

SEQ ID NO: 1702106 - DNA, 15 bp, Homo sapiens
agaattgtatcattt

SEQ ID NO: 1702107 - DNA, 20 bp, Homo sapiens
agaattgtatctcatactgt

SEQ ID NO: 1702108 - DNA, 22 bp, Homo sapiens
agaattgtatctcatactgtct

SEQ ID NO: 1702109 - DNA, 19 bp, Homo sapiens
agaagaaaattgctgtgcc

SEQ ID NO: 1702110 - DNA, 18 bp, Homo sapiens
agaagaaacgtctatgtg

SEQ ID NO: 1702111 - DNA, 15 bp, Homo sapiens
agaagaaagatgttt

SEQ ID NO: 1702112 - DNA, 19 bp, Homo sapiens
agaagaaatagcagagcct

SEQ ID NO: 1702113 - DNA, 20 bp, Homo sapiens
agaagaaatagcagagccta

SEQ ID NO: 1702114 - DNA, 22 bp, Homo sapiens
agaagaaattctgtcatagaaa

SEQ ID NO: 1702115 - DNA, 20 bp, Homo sapiens
agaagaaccaaatacctcaa

SEQ ID NO: 1702116 - DNA, 23 bp, Homo sapiens
agaagaaccaaatacctcaattt

SEQ ID NO: 1702117 - DNA, 18 bp, Homo sapiens
agaagaagagaagctgct

SEQ ID NO: 1702118 - DNA, 12 bp, Homo sapiens
agaagaaggaga

SEQ ID NO: 1702119 - DNA, 14 bp, Homo sapiens
agaagaaggagagc

SEQ ID NO: 1702120 - DNA, 14 bp, Homo sapiens
agaagaagtgtgtc

SEQ ID NO: 1702121 - DNA, 16 bp, Homo sapiens
agaagaagttcatgtc

SEQ ID NO: 1702122 - DNA, 18 bp, Homo sapiens
agaagaatattcaggact

SEQ ID NO: 1702123 - DNA, 17 bp, Homo sapiens
agaagaatccacaagga

SEQ ID NO: 1702124 - DNA, 18 bp, Homo sapiens
agaagaatccacaaggac

SEQ ID NO: 1702125 - DNA, 13 bp, Homo sapiens
agaagaatggctt

SEQ ID NO: 1702126 - DNA, 19 bp, Homo sapiens
agaagaatggctttcaata

SEQ ID NO: 1702127 - DNA, 21 bp, Homo sapiens
agaagaattttatttttctgt

SEQ ID NO: 1702128 - DNA, 15 bp, Homo sapiens
agaagacaaaaagac

SEQ ID NO: 1702129 - DNA, 22 bp, Homo sapiens
agaagacacaaggtgatttcag

SEQ ID NO: 1702130 - DNA, 15 bp, Homo sapiens
agaagacatgaacca

SEQ ID NO: 1702131 - DNA, 16 bp, Homo sapiens
agaagacatgaaccaa

SEQ ID NO: 1702132 - DNA, 19 bp, Homo sapiens
agaagacatggagactcct

SEQ ID NO: 1702133 - DNA, 20 bp, Homo sapiens
agaagacatggagactcctg

SEQ ID NO: 1702134 - DNA, 15 bp, Homo sapiens
agaagacattttgtt

SEQ ID NO: 1702135 - DNA, 17 bp, Homo sapiens
agaagacattttgttac

SEQ ID NO: 1702136 - DNA, 24 bp, Homo sapiens
agaagacttgatttttccgtccct

SEQ ID NO: 1702137 - DNA, 15 bp, Homo sapiens
agaagagaagctgct

SEQ ID NO: 1702138 - DNA, 13 bp, Homo sapiens
agaagagaagtga

SEQ ID NO: 1702139 - DNA, 20 bp, Homo sapiens
agaagagaattcagtatttt

SEQ ID NO: 1702140 - DNA, 22 bp, Homo sapiens
agaagagaattcagtatttttt

SEQ ID NO: 1702141 - DNA, 18 bp, Homo sapiens
agaagagactctttgcat

SEQ ID NO: 1702142 - DNA, 23 bp, Homo sapiens
agaagagagtggggcctgccctc

SEQ ID NO: 1702143 - DNA, 19 bp, Homo sapiens
agaagagatgagaaatgat

SEQ ID NO: 1702144 - DNA, 21 bp, Homo sapiens
agaagagccaagagtccagga

SEQ ID NO: 1702145 - DNA, 21 bp, Homo sapiens
agaagagccatcttggcaggg

SEQ ID NO: 1702146 - DNA, 22 bp, Homo sapiens
agaagagctgttcacagccaga

SEQ ID NO: 1702147 - DNA, 14 bp, Homo sapiens
agaagaggaagaaa

SEQ ID NO: 1702148 - DNA, 13 bp, Homo sapiens
agaagaggagcct

SEQ ID NO: 1702149 - DNA, 16 bp, Homo sapiens
agaagagggcccagcc

SEQ ID NO: 1702150 - DNA, 17 bp, Homo sapiens
agaagagggcccagccc

SEQ ID NO: 1702151 - DNA, 20 bp, Homo sapiens
agaagagggcccagcccaga

SEQ ID NO: 1702152 - DNA, 18 bp, Homo sapiens
agaagagggcctgtggga

SEQ ID NO: 1702153 - DNA, 24 bp, Homo sapiens
agaagagggcctgtgggagcctgc

SEQ ID NO: 1702154 - DNA, 17 bp, Homo sapiens
agaagagggtgtgtttg

SEQ ID NO: 1702155 - DNA, 14 bp, Homo sapiens
agaagagtattttt

SEQ ID NO: 1702156 - DNA, 15 bp, Homo sapiens
agaagataatgttct

SEQ ID NO: 1702157 - DNA, 13 bp, Homo sapiens
agaagatagcagg

SEQ ID NO: 1702158 - DNA, 20 bp, Homo sapiens
agaagatcaacgcctcactg

SEQ ID NO: 1702159 - DNA, 14 bp, Homo sapiens
agaagatgctccag

SEQ ID NO: 1702160 - DNA, 16 bp, Homo sapiens
agaagatggactctga

SEQ ID NO: 1702161 - DNA, 19 bp, Homo sapiens
agaagatggactctgaaaa

SEQ ID NO: 1702162 - DNA, 13 bp, Homo sapiens
agaagatgtgaaa

SEQ ID NO: 1702163 - DNA, 12 bp, Homo sapiens
agaagatgtgta

SEQ ID NO: 1702164 - DNA, 12 bp, Homo sapiens
agaagattctaa

SEQ ID NO: 1702165 - DNA, 23 bp, Homo sapiens
agaagattttataagaattttgc

SEQ ID NO: 1702166 - DNA, 22 bp, Homo sapiens
agaagcaagacacgtggcctcg

SEQ ID NO: 1702167 - DNA, 14 bp, Homo sapiens
agaagcaagggcaa

SEQ ID NO: 1702168 - DNA, 22 bp, Homo sapiens
agaagcaatctttgaaataaaa

SEQ ID NO: 1702169 - DNA, 16 bp, Homo sapiens
agaagcacagaatatt

SEQ ID NO: 1702170 - DNA, 19 bp, Homo sapiens
agaagcacagaatattttt

SEQ ID NO: 1702171 - DNA, 21 bp, Homo sapiens
agaagcacagctcctgccagg

SEQ ID NO: 1702172 - DNA, 14 bp, Homo sapiens
agaagcaggaaggg

SEQ ID NO: 1702173 - DNA, 13 bp, Homo sapiens
agaagcagtgagc

SEQ ID NO: 1702174 - DNA, 23 bp, Homo sapiens
agaagcagtgagccgcatcttct

SEQ ID NO: 1702175 - DNA, 15 bp, Homo sapiens
agaagcagtggcctt

SEQ ID NO: 1702176 - DNA, 16 bp, Homo sapiens
agaagcatgaaaaagc

SEQ ID NO: 1702177 - DNA, 17 bp, Homo sapiens
agaagcattgcctggac

SEQ ID NO: 1702178 - DNA, 19 bp, Homo sapiens
agaagcattgcctggactg

SEQ ID NO: 1702179 - DNA, 21 bp, Homo sapiens
agaagcattgcctggactgac

SEQ ID NO: 1702180 - DNA, 16 bp, Homo sapiens
agaagccaagggaaag

SEQ ID NO: 1702181 - DNA, 19 bp, Homo sapiens
agaagccaagggaaagggg

SEQ ID NO: 1702182 - DNA, 21 bp, Homo sapiens
agaagccaagggaaaggggtg

SEQ ID NO: 1702183 - DNA, 22 bp, Homo sapiens
agaagccaagggaaaggggtgc

SEQ ID NO: 1702184 - DNA, 15 bp, Homo sapiens
agaagccaagggaag

SEQ ID NO: 1702185 - DNA, 22 bp, Homo sapiens
agaagccaatctacaatctctt

SEQ ID NO: 1702186 - DNA, 11 bp, Homo sapiens
agaagccagcc

SEQ ID NO: 1702187 - DNA, 18 bp, Homo sapiens
agaagccagccacagacc

SEQ ID NO: 1702188 - DNA, 13 bp, Homo sapiens
agaagccaggaat

SEQ ID NO: 1702189 - DNA, 21 bp, Homo sapiens
agaagcccaatattataattt

SEQ ID NO: 1702190 - DNA, 20 bp, Homo sapiens
agaagcccgtgtgagaagtg

SEQ ID NO: 1702191 - DNA, 14 bp, Homo sapiens
agaagccgggaaca

SEQ ID NO: 1702192 - DNA, 18 bp, Homo sapiens
agaagccgggaacagaca

SEQ ID NO: 1702193 - DNA, 20 bp, Homo sapiens
agaagcctcgttttgatgcc

SEQ ID NO: 1702194 - DNA, 16 bp, Homo sapiens
agaagcctctggctag

SEQ ID NO: 1702195 - DNA, 14 bp, Homo sapiens
agaagcctgaggct

SEQ ID NO: 1702196 - DNA, 10 bp, Homo sapiens
agaagcctgc

SEQ ID NO: 1702197 - DNA, 11 bp, Homo sapiens
agaagcctgca

SEQ ID NO: 1702198 - DNA, 21 bp, Homo sapiens
agaagcctgcataatgtttct

SEQ ID NO: 1702199 - DNA, 20 bp, Homo sapiens
agaagcctgtaacactcctc

SEQ ID NO: 1702200 - DNA, 18 bp, Homo sapiens
agaagccttcagctccag

SEQ ID NO: 1702201 - DNA, 23 bp, Homo sapiens
agaagcgggacgagaccctacag

SEQ ID NO: 1702202 - DNA, 23 bp, Homo sapiens
agaagctatattagctgaaacaa

SEQ ID NO: 1702203 - DNA, 17 bp, Homo sapiens
agaagctcctctcccca

SEQ ID NO: 1702204 - DNA, 22 bp, Homo sapiens
agaagctcctctccccagccca

SEQ ID NO: 1702205 - DNA, 18 bp, Homo sapiens
agaagctcctgctacttc

SEQ ID NO: 1702206 - DNA, 22 bp, Homo sapiens
agaagctgaggctagttccaga

SEQ ID NO: 1702207 - DNA, 14 bp, Homo sapiens
agaagctgctgacc

SEQ ID NO: 1702208 - DNA, 23 bp, Homo sapiens
agaagcttgtggtgttcctgaag

SEQ ID NO: 1702209 - DNA, 19 bp, Homo sapiens
agaaggaaaatgatctgag

SEQ ID NO: 1702210 - DNA, 15 bp, Homo sapiens
agaaggaaagatggt

SEQ ID NO: 1702211 - DNA, 13 bp, Homo sapiens
ctcgaactcctgg

SEQ ID NO: 1702212 - DNA, 15 bp, Homo sapiens
ctcgaactcctggcc

SEQ ID NO: 1702213 - DNA, 16 bp, Homo sapiens
ctcatggaccagtggc

SEQ ID NO: 1702214 - DNA, 19 bp, Homo sapiens
ctcatggaccagtggctgg

SEQ ID NO: 1702215 - DNA, 16 bp, Homo sapiens
ctcatggcccccaggg

SEQ ID NO: 1702216 - DNA, 19 bp, Homo sapiens
ctcatggcccccaggggca

SEQ ID NO: 1702217 - DNA, 23 bp, Homo sapiens
ctcatggcccccaggggcaggac

SEQ ID NO: 1702218 - DNA, 17 bp, Homo sapiens
ctcatggcccctctgac

SEQ ID NO: 1702219 - DNA, 20 bp, Homo sapiens
ctcatggcgtaatgggcctg

SEQ ID NO: 1702220 - DNA, 22 bp, Homo sapiens
ctcatggcgtaatgggcctgcc

SEQ ID NO: 1702221 - DNA, 13 bp, Homo sapiens
ctcatgtaacatt

SEQ ID NO: 1702222 - DNA, 16 bp, Homo sapiens
ctcatgtaacattggt

SEQ ID NO: 1702223 - DNA, 18 bp, Homo sapiens
ctcatgtaacattggtga

SEQ ID NO: 1702224 - DNA, 17 bp, Homo sapiens
ctcatgtcctgtcctgg

SEQ ID NO: 1702225 - DNA, 21 bp, Homo sapiens
ctcatgtcctgtcctggtcct

SEQ ID NO: 1702226 - DNA, 23 bp, Homo sapiens
ctcatgtctggagtcccctcctc

SEQ ID NO: 1702227 - DNA, 20 bp, Homo sapiens
ctcatgtgcaataggtgaga

SEQ ID NO: 1702228 - DNA, 17 bp, Homo sapiens
ctcatgttgagccagtg

SEQ ID NO: 1702229 - DNA, 13 bp, Homo sapiens
ctcattaaaaaaa

SEQ ID NO: 1702230 - DNA, 18 bp, Homo sapiens
ctcattacagatttagtt

SEQ ID NO: 1702231 - DNA, 17 bp, Homo sapiens
ctcattacagttctttc

SEQ ID NO: 1702232 - DNA, 14 bp, Homo sapiens
ctcattagtggtac

SEQ ID NO: 1702233 - DNA, 20 bp, Homo sapiens
ctcattataaaatgggaaga

SEQ ID NO: 1702234 - DNA, 18 bp, Homo sapiens
ctcattatgccacttcct

SEQ ID NO: 1702235 - DNA, 13 bp, Homo sapiens
ctcattcagcatg

SEQ ID NO: 1702236 - DNA, 12 bp, Homo sapiens
ctcattccccag

SEQ ID NO: 1702237 - DNA, 13 bp, Homo sapiens
ctcattccccagg

SEQ ID NO: 1702238 - DNA, 16 bp, Homo sapiens
ctcattcctgcctgtc

SEQ ID NO: 1702239 - DNA, 18 bp, Homo sapiens
ctcattcctgcctgtctc

SEQ ID NO: 1702240 - DNA, 17 bp, Homo sapiens
ctcattctcttcttgct

SEQ ID NO: 1702241 - DNA, 18 bp, Homo sapiens
ctcattctcttcttgcta

SEQ ID NO: 1702242 - DNA, 11 bp, Homo sapiens
ctcattctgaa

SEQ ID NO: 1702243 - DNA, 15 bp, Homo sapiens
ctcattctgtgccat

SEQ ID NO: 1702244 - DNA, 22 bp, Homo sapiens
ctggcagtgctgagggaccgag

SEQ ID NO: 1702245 - DNA, 23 bp, Homo sapiens
ctggcatagccctcctgagcacc

SEQ ID NO: 1702246 - DNA, 23 bp, Homo sapiens
ctggcatcaagaggtgggagggc

SEQ ID NO: 1702247 - DNA, 16 bp, Homo sapiens
ctggcatcaagggaga

SEQ ID NO: 1702248 - DNA, 18 bp, Homo sapiens
ctggcatcaagggagaca

SEQ ID NO: 1702249 - DNA, 18 bp, Homo sapiens
ctggcatcttagacctcc

SEQ ID NO: 1702250 - DNA, 19 bp, Homo sapiens
ctggcatcttctggagaag

SEQ ID NO: 1702251 - DNA, 16 bp, Homo sapiens
ctggcattacagctgg

SEQ ID NO: 1702252 - DNA, 22 bp, Homo sapiens
ctggcattagaattatttaaac

SEQ ID NO: 1702253 - DNA, 21 bp, Homo sapiens
ctggcattatgtccactgtgt

SEQ ID NO: 1702254 - DNA, 20 bp, Homo sapiens
ctggcattggccagaccaca

SEQ ID NO: 1702255 - DNA, 17 bp, Homo sapiens
ctggccaaatagcaaag

SEQ ID NO: 1702256 - DNA, 23 bp, Homo sapiens
ctggccaaggggtgggcctgtga

SEQ ID NO: 1702257 - DNA, 16 bp, Homo sapiens
ctggccaaggtgtcca

SEQ ID NO: 1702258 - DNA, 17 bp, Homo sapiens
ctggccaaggtgtccag

SEQ ID NO: 1702259 - DNA, 19 bp, Homo sapiens
ctggccaccaggctggcgc

SEQ ID NO: 1702260 - DNA, 20 bp, Homo sapiens
ctggccaccaggctggcgca

SEQ ID NO: 1702261 - DNA, 10 bp, Homo sapiens
ctggccaccc

SEQ ID NO: 1702262 - DNA, 12 bp, Homo sapiens
ctggccaccctg

SEQ ID NO: 1702263 - DNA, 14 bp, Homo sapiens
ctggccaccctggc

SEQ ID NO: 1702264 - DNA, 15 bp, Homo sapiens
ctggccaccctggcc

SEQ ID NO: 1702265 - DNA, 16 bp, Homo sapiens
ctggccaccctggccc

SEQ ID NO: 1702266 - DNA, 18 bp, Homo sapiens
ctggccacctgaggtggg

SEQ ID NO: 1702267 - DNA, 22 bp, Homo sapiens
ctggccacctgaggtgggccca

SEQ ID NO: 1702268 - DNA, 14 bp, Homo sapiens
ctggccacgcagcc

SEQ ID NO: 1702269 - DNA, 21 bp, Homo sapiens
ctggccacgcagccaggacac

SEQ ID NO: 1702270 - DNA, 14 bp, Homo sapiens
ctggccactaaagc

SEQ ID NO: 1702271 - DNA, 15 bp, Homo sapiens
ctggccagacacagg

SEQ ID NO: 1702272 - DNA, 21 bp, Homo sapiens
ctggccagacacaggccctcc

SEQ ID NO: 1702273 - DNA, 19 bp, Homo sapiens
ctggccagagagggcccag

SEQ ID NO: 1702274 - DNA, 21 bp, Homo sapiens
ctggccagagagggcccagct

SEQ ID NO: 1702275 - DNA, 13 bp, Homo sapiens
ctggccagctctg

SEQ ID NO: 1702276 - DNA, 15 bp, Homo sapiens
ctggccaggagcagg

SEQ ID NO: 1702277 - DNA, 17 bp, Homo sapiens
ctggccaggagctcttc

SEQ ID NO: 1702278 - DNA, 23 bp, Homo sapiens
ctggccaggatggaggggtggtc

SEQ ID NO: 1702279 - DNA, 14 bp, Homo sapiens
ctggccaggcatgg

SEQ ID NO: 1702280 - DNA, 20 bp, Homo sapiens
ctggccagggccacgctcca

SEQ ID NO: 1702281 - DNA, 22 bp, Homo sapiens
ctggccagggccacgctccagc

SEQ ID NO: 1702282 - DNA, 15 bp, Homo sapiens
ctggccagtccaggc

SEQ ID NO: 1702283 - DNA, 19 bp, Homo sapiens
ctggccagtcctggtcctg

SEQ ID NO: 1702284 - DNA, 13 bp, Homo sapiens
ctggccagtcttc

SEQ ID NO: 1702285 - DNA, 14 bp, Homo sapiens
ctggccagtcttcc

SEQ ID NO: 1702286 - DNA, 20 bp, Homo sapiens
ctggccagtgtttaaaactt

SEQ ID NO: 1702287 - DNA, 12 bp, Homo sapiens
ctggccattctt

SEQ ID NO: 1702288 - DNA, 23 bp, Homo sapiens
ctggccatttccaagaggctgta

SEQ ID NO: 1702289 - DNA, 17 bp, Homo sapiens
ctggccatttttctggg

SEQ ID NO: 1702290 - DNA, 13 bp, Homo sapiens
ctggcccaccagg

SEQ ID NO: 1702291 - DNA, 14 bp, Homo sapiens
ctggcccacgccct

SEQ ID NO: 1702292 - DNA, 20 bp, Homo sapiens
ctggcccactgctggctgca

SEQ ID NO: 1702293 - DNA, 17 bp, Homo sapiens
ctggcccagccaaaccc

SEQ ID NO: 1702294 - DNA, 13 bp, Homo sapiens
ctggcccagccgg

SEQ ID NO: 1702295 - DNA, 15 bp, Homo sapiens
ctggcccagccggcc

SEQ ID NO: 1702296 - DNA, 16 bp, Homo sapiens
ctggcccagccggcct

SEQ ID NO: 1702297 - DNA, 20 bp, Homo sapiens
ctggcccagccggcctctct

SEQ ID NO: 1702298 - DNA, 12 bp, Homo sapiens
ctggcccagcgg

SEQ ID NO: 1702299 - DNA, 18 bp, Homo sapiens
ctggcccagcggcccctc

SEQ ID NO: 1702300 - DNA, 14 bp, Homo sapiens
ctggcccagggccc

SEQ ID NO: 1702301 - DNA, 15 bp, Homo sapiens
ctggcccagggccca

SEQ ID NO: 1702302 - DNA, 23 bp, Homo sapiens
ctggcccagggcccagagcccag

SEQ ID NO: 1702303 - DNA, 15 bp, Homo sapiens
ctggcccagggggcc

SEQ ID NO: 1702304 - DNA, 17 bp, Homo sapiens
ctggcccagggggcctg

SEQ ID NO: 1702305 - DNA, 13 bp, Homo sapiens
ctggcccagggtg

SEQ ID NO: 1702306 - DNA, 18 bp, Homo sapiens
ctggccccagccctgctg

SEQ ID NO: 1702307 - DNA, 23 bp, Homo sapiens
ctggccccagccctgctggggat

SEQ ID NO: 1702308 - DNA, 21 bp, Homo sapiens
ctggccccagtgcggttcctc

SEQ ID NO: 1702309 - DNA, 23 bp, Homo sapiens
ctggccccagtgcggttcctcat

SEQ ID NO: 1702310 - DNA, 17 bp, Homo sapiens
ctggccccgcctgcctg

SEQ ID NO: 1702311 - DNA, 18 bp, Homo sapiens
ctggccccgcctgcctgc

SEQ ID NO: 1702312 - DNA, 21 bp, Homo sapiens
ctggccccgcctgcctgccac

SEQ ID NO: 1702313 - DNA, 18 bp, Homo sapiens
ctggccccgcttggtggc

SEQ ID NO: 1702314 - DNA, 20 bp, Homo sapiens
ctggcccctccagaccctgc

SEQ ID NO: 1702315 - DNA, 23 bp, Homo sapiens
ctggcccctccagaccctgcctg

SEQ ID NO: 1702316 - DNA, 21 bp, Homo sapiens
ctggcccgcccctcgctgctg

SEQ ID NO: 1702317 - DNA, 23 bp, Homo sapiens
ctggcccgcccctcgctgctgct

SEQ ID NO: 1702318 - DNA, 23 bp, Homo sapiens
ctggccctatgcttccggcctcc

SEQ ID NO: 1702319 - DNA, 23 bp, Homo sapiens
ctggccctcactcaagaccaggc

SEQ ID NO: 1702320 - DNA, 17 bp, Homo sapiens
ctggccctgaggtgtgg

SEQ ID NO: 1702321 - DNA, 20 bp, Homo sapiens
ctggccctgaggtgtggggg

SEQ ID NO: 1702322 - DNA, 15 bp, Homo sapiens
ctggccctgcccagc

SEQ ID NO: 1702323 - DNA, 16 bp, Homo sapiens
ctggccctgcccagcc

SEQ ID NO: 1702324 - DNA, 18 bp, Homo sapiens
ctggccctgcccagccca

SEQ ID NO: 1702325 - DNA, 14 bp, Homo sapiens
ctggccctgccttc

SEQ ID NO: 1702326 - DNA, 13 bp, Homo sapiens
ctggccctgcttc

SEQ ID NO: 1702327 - DNA, 17 bp, Homo sapiens
ctggccctgcttcctgc

SEQ ID NO: 1702328 - DNA, 19 bp, Homo sapiens
ctggcccttacttgcttct

SEQ ID NO: 1702329 - DNA, 20 bp, Homo sapiens
ctggcccttcagtctgctcc

SEQ ID NO: 1702330 - DNA, 21 bp, Homo sapiens
ctggcccttgcttacctctca

SEQ ID NO: 1702331 - DNA, 12 bp, Homo sapiens
ctggccgccacc

SEQ ID NO: 1702332 - DNA, 15 bp, Homo sapiens
ctggccgccaccccc

SEQ ID NO: 1702333 - DNA, 14 bp, Homo sapiens
ctggccgccccctg

SEQ ID NO: 1702334 - DNA, 13 bp, Homo sapiens
ctggccgcctcca

SEQ ID NO: 1702335 - DNA, 14 bp, Homo sapiens
ctggccgcctccag

SEQ ID NO: 1702336 - DNA, 15 bp, Homo sapiens
ctggccggctccagt

SEQ ID NO: 1702337 - DNA, 13 bp, Homo sapiens
ctggccggtgctg

SEQ ID NO: 1702338 - DNA, 20 bp, Homo sapiens
ctggccggtgctgggttccc

SEQ ID NO: 1702339 - DNA, 22 bp, Homo sapiens
ctggccggtgctgggttcccac

SEQ ID NO: 1702340 - DNA, 23 bp, Homo sapiens
ctggcctaggagatatctgaggg

SEQ ID NO: 1702341 - DNA, 21 bp, Homo sapiens
ctggcctaggggccagggctt

SEQ ID NO: 1702342 - DNA, 22 bp, Homo sapiens
ctggcctatccgctgccagcct

SEQ ID NO: 1702343 - DNA, 15 bp, Homo sapiens
ctggcctcactggct

SEQ ID NO: 1702344 - DNA, 17 bp, Homo sapiens
ctggcctcactggctgg

SEQ ID NO: 1702345 - DNA, 21 bp, Homo sapiens
ctggcctcactggctggggca

SEQ ID NO: 1702346 - DNA, 18 bp, Homo sapiens
ctggcctcagttcccagc

SEQ ID NO: 1702347 - DNA, 22 bp, Homo sapiens
ctggcctcagttcccagctccc

SEQ ID NO: 1702348 - DNA, 16 bp, Homo sapiens
ctggcctccagctccc

SEQ ID NO: 1702349 - DNA, 15 bp, Homo sapiens
ctggcctcccacccg

SEQ ID NO: 1702350 - DNA, 23 bp, Homo sapiens
ctggcctcccacccgatgctgct

SEQ ID NO: 1702351 - DNA, 18 bp, Homo sapiens
ctggcctcccctgccacc

SEQ ID NO: 1702352 - DNA, 22 bp, Homo sapiens
ctggcctcccttctcctttcta

SEQ ID NO: 1702353 - DNA, 16 bp, Homo sapiens
ctggcctctctagcac

SEQ ID NO: 1702354 - DNA, 17 bp, Homo sapiens
ctggcctctctagcaca

SEQ ID NO: 1702355 - DNA, 15 bp, Homo sapiens
ctggcctctgctttc

SEQ ID NO: 1702356 - DNA, 23 bp, Homo sapiens
ctggcctctgggcagtgtggcct

SEQ ID NO: 1702357 - DNA, 13 bp, Homo sapiens
ctggcctctgtgc

SEQ ID NO: 1702358 - DNA, 14 bp, Homo sapiens
ctggcctctgtgcc

SEQ ID NO: 1702359 - DNA, 23 bp, Homo sapiens
ctggcctgagagtcagctctctg

SEQ ID NO: 1702360 - DNA, 15 bp, Homo sapiens
agcagaaaacccttg

SEQ ID NO: 1702361 - DNA, 22 bp, Homo sapiens
agcagaaaacccttgggccaga

SEQ ID NO: 1702362 - DNA, 20 bp, Homo sapiens
agcagaaagaagagaagtga

SEQ ID NO: 1702363 - DNA, 15 bp, Homo sapiens
agcagaaatctagaa

SEQ ID NO: 1702364 - DNA, 21 bp, Homo sapiens
agcagaaattctgtttttaaa

SEQ ID NO: 1702365 - DNA, 15 bp, Homo sapiens
agcagaacaaatgtg

SEQ ID NO: 1702366 - DNA, 16 bp, Homo sapiens
agcagaacaaatgtgt

SEQ ID NO: 1702367 - DNA, 14 bp, Homo sapiens
agcagaacaggtag

SEQ ID NO: 1702368 - DNA, 15 bp, Homo sapiens
agcagaacctgcaca

SEQ ID NO: 1702369 - DNA, 18 bp, Homo sapiens
agcagaacctgcacacag

SEQ ID NO: 1702370 - DNA, 23 bp, Homo sapiens
agcagaacctgcacacaggacag

SEQ ID NO: 1702371 - DNA, 14 bp, Homo sapiens
agcagaagctctcg

SEQ ID NO: 1702372 - DNA, 22 bp, Homo sapiens
agcagaagggggtggtgtctcc

SEQ ID NO: 1702373 - DNA, 16 bp, Homo sapiens
agcagaagtggagctg

SEQ ID NO: 1702374 - DNA, 14 bp, Homo sapiens
agcagaatactggt

SEQ ID NO: 1702375 - DNA, 17 bp, Homo sapiens
agcagaatactggtctc

SEQ ID NO: 1702376 - DNA, 18 bp, Homo sapiens
agcagaatactggtctca

SEQ ID NO: 1702377 - DNA, 23 bp, Homo sapiens
agcagaatcctcagttggaatca

SEQ ID NO: 1702378 - DNA, 18 bp, Homo sapiens
agcagaatggaggcaggg

SEQ ID NO: 1702379 - DNA, 21 bp, Homo sapiens
agcagaatgttgtacttgaaa

SEQ ID NO: 1702380 - DNA, 18 bp, Homo sapiens
agcagaattttaatgtga

SEQ ID NO: 1702381 - DNA, 20 bp, Homo sapiens
agcagaattttaatgtgaag

SEQ ID NO: 1702382 - DNA, 23 bp, Homo sapiens
agcagacagagccaggagaagct

SEQ ID NO: 1702383 - DNA, 21 bp, Homo sapiens
agcagacagtgttttctggga

SEQ ID NO: 1702384 - DNA, 15 bp, Homo sapiens
agcagactcagctgc

SEQ ID NO: 1702385 - DNA, 15 bp, Homo sapiens
agcagagacactaac

SEQ ID NO: 1702386 - DNA, 14 bp, Homo sapiens
agcagagagccaaa

SEQ ID NO: 1702387 - DNA, 22 bp, Homo sapiens
agcagagagccaaatctgacct

SEQ ID NO: 1702388 - DNA, 14 bp, Homo sapiens
agcagagcaggggc

SEQ ID NO: 1702389 - DNA, 15 bp, Homo sapiens
agcagagcaggggca

SEQ ID NO: 1702390 - DNA, 11 bp, Homo sapiens
agcagagccta

SEQ ID NO: 1702391 - DNA, 16 bp, Homo sapiens
agcagaggaccagggc

SEQ ID NO: 1702392 - DNA, 17 bp, Homo sapiens
agcagaggaccagggcc

SEQ ID NO: 1702393 - DNA, 18 bp, Homo sapiens
agcagaggaccagggcct

SEQ ID NO: 1702394 - DNA, 13 bp, Homo sapiens
agcagagggagga

SEQ ID NO: 1702395 - DNA, 17 bp, Homo sapiens
agcagagggaggaagat

SEQ ID NO: 1702396 - DNA, 19 bp, Homo sapiens
agcagagggcaggggtgct

SEQ ID NO: 1702397 - DNA, 19 bp, Homo sapiens
agcagagggggagtagcca

SEQ ID NO: 1702398 - DNA, 21 bp, Homo sapiens
agcagagtgagcaagggggcc

SEQ ID NO: 1702399 - DNA, 14 bp, Homo sapiens
agcagagtgaggat

SEQ ID NO: 1702400 - DNA, 19 bp, Homo sapiens
agcagagtgcacagctgtc

SEQ ID NO: 1702401 - DNA, 23 bp, Homo sapiens
agcagagtgcacagctgtccact

SEQ ID NO: 1702402 - DNA, 15 bp, Homo sapiens
agcagagtggactgc

SEQ ID NO: 1702403 - DNA, 19 bp, Homo sapiens
agcagagtggactgcattt

SEQ ID NO: 1702404 - DNA, 19 bp, Homo sapiens
agcagagttattgaatctt

SEQ ID NO: 1702405 - DNA, 13 bp, Homo sapiens
agcagagttttca

SEQ ID NO: 1702406 - DNA, 19 bp, Homo sapiens
agcagagttttcattaaat

SEQ ID NO: 1702407 - DNA, 19 bp, Homo sapiens
agcagatggtttccacatt

SEQ ID NO: 1702408 - DNA, 13 bp, Homo sapiens
agcagattttaat

SEQ ID NO: 1702409 - DNA, 20 bp, Homo sapiens
agcagcaaatgaaagaaccg

SEQ ID NO: 1702410 - DNA, 20 bp, Homo sapiens
agcagcaaattttcagcatt

SEQ ID NO: 1702411 - DNA, 20 bp, Homo sapiens
agcagcacacctcagcccca

SEQ ID NO: 1702412 - DNA, 13 bp, Homo sapiens
agcagcacctcct

SEQ ID NO: 1702413 - DNA, 14 bp, Homo sapiens
agcagcactgtgag

SEQ ID NO: 1702414 - DNA, 12 bp, Homo sapiens
agcagcagccag

SEQ ID NO: 1702415 - DNA, 17 bp, Homo sapiens
agcagcagccagcacca

SEQ ID NO: 1702416 - DNA, 21 bp, Homo sapiens
agcagcagcccaagcttccct

SEQ ID NO: 1702417 - DNA, 14 bp, Homo sapiens
agcagcaggtgctg

SEQ ID NO: 1702418 - DNA, 18 bp, Homo sapiens
agcagcaggtgtggccaa

SEQ ID NO: 1702419 - DNA, 15 bp, Homo sapiens
agcagcatagaacag

SEQ ID NO: 1702420 - DNA, 18 bp, Homo sapiens
agcagcattctggagggg

SEQ ID NO: 1702421 - DNA, 22 bp, Homo sapiens
agcagccaaggccgccagcgtg

SEQ ID NO: 1702422 - DNA, 13 bp, Homo sapiens
agcagccagagct

SEQ ID NO: 1702423 - DNA, 15 bp, Homo sapiens
agcagccagagctgt

SEQ ID NO: 1702424 - DNA, 22 bp, Homo sapiens
agcagccagagctgtgcctgct

SEQ ID NO: 1702425 - DNA, 11 bp, Homo sapiens
agcagccagcc

SEQ ID NO: 1702426 - DNA, 15 bp, Homo sapiens
agcagccagccgtga

SEQ ID NO: 1702427 - DNA, 13 bp, Homo sapiens
agcagccagctcc

SEQ ID NO: 1702428 - DNA, 14 bp, Homo sapiens
agcagccagctctc

SEQ ID NO: 1702429 - DNA, 15 bp, Homo sapiens
agcagccagggaccc

SEQ ID NO: 1702430 - DNA, 13 bp, Homo sapiens
agcagccagtctc

SEQ ID NO: 1702431 - DNA, 14 bp, Homo sapiens
agcagccagtctca

SEQ ID NO: 1702432 - DNA, 19 bp, Homo sapiens
agcagccagtctcagagac

SEQ ID NO: 1702433 - DNA, 18 bp, Homo sapiens
agcagcccaagcttccct

SEQ ID NO: 1702434 - DNA, 21 bp, Homo sapiens
agcagcccaagcttccctcca

SEQ ID NO: 1702435 - DNA, 20 bp, Homo sapiens
agcagcccaccctgctgctg

SEQ ID NO: 1702436 - DNA, 13 bp, Homo sapiens
agcagccctcctc

SEQ ID NO: 1702437 - DNA, 12 bp, Homo sapiens
agcagcccttgc

SEQ ID NO: 1702438 - DNA, 22 bp, Homo sapiens
agcagcctcaaaacgggtcagt

SEQ ID NO: 1702439 - DNA, 12 bp, Homo sapiens
agcagcctcaga

SEQ ID NO: 1702440 - DNA, 14 bp, Homo sapiens
agcagcctcagagt

SEQ ID NO: 1702441 - DNA, 16 bp, Homo sapiens
agcagcctcagagtgg

SEQ ID NO: 1702442 - DNA, 15 bp, Homo sapiens
agcagcctccactgt

SEQ ID NO: 1702443 - DNA, 24 bp, Homo sapiens
agcagcctccctgtcactcagctg

SEQ ID NO: 1702444 - DNA, 14 bp, Homo sapiens
agcagcctcgcaca

SEQ ID NO: 1702445 - DNA, 22 bp, Homo sapiens
agcagcctcgcacaggccctag

SEQ ID NO: 1702446 - DNA, 24 bp, Homo sapiens
agcagcctcgcacaggccctagct

SEQ ID NO: 1702447 - DNA, 13 bp, Homo sapiens
agcagcctgtggc

SEQ ID NO: 1702448 - DNA, 11 bp, Homo sapiens
agcagcctttc

SEQ ID NO: 1702449 - DNA, 16 bp, Homo sapiens
agcagcgcgcaggcct

SEQ ID NO: 1702450 - DNA, 14 bp, Homo sapiens
agcagctaggactg

SEQ ID NO: 1702451 - DNA, 18 bp, Homo sapiens
agcagctaggactgagga

SEQ ID NO: 1702452 - DNA, 23 bp, Homo sapiens
agcagctcacaccctaccttccc

SEQ ID NO: 1702453 - DNA, 21 bp, Homo sapiens
agcagctcaggcacacttctt

SEQ ID NO: 1702454 - DNA, 17 bp, Homo sapiens
agcagctgatgcctcct

SEQ ID NO: 1702455 - DNA, 17 bp, Homo sapiens
agcagctgcgggtctga

SEQ ID NO: 1702456 - DNA, 14 bp, Homo sapiens
agcagctgggaact

SEQ ID NO: 1702457 - DNA, 17 bp, Homo sapiens
agcagctggtcagtctt

SEQ ID NO: 1702458 - DNA, 13 bp, Homo sapiens
agcagctggtgcc

SEQ ID NO: 1702459 - DNA, 21 bp, Homo sapiens
agcagctggtgccccacctgc

SEQ ID NO: 1702460 - DNA, 15 bp, Homo sapiens
agcagctgtgctgca

SEQ ID NO: 1702461 - DNA, 14 bp, Homo sapiens
agcagcttattgtt

SEQ ID NO: 1702462 - DNA, 15 bp, Homo sapiens
agcagcttattgttt

SEQ ID NO: 1702463 - DNA, 15 bp, Homo sapiens
agcagcttcaccaga

SEQ ID NO: 1702464 - DNA, 14 bp, Homo sapiens
agcagcttccagat

SEQ ID NO: 1702465 - DNA, 14 bp, Homo sapiens
agcagcttccttct

SEQ ID NO: 1702466 - DNA, 17 bp, Homo sapiens
agcagcttccttctggg

SEQ ID NO: 1702467 - DNA, 19 bp, Homo sapiens
agcagcttccttctgggac

SEQ ID NO: 1702468 - DNA, 16 bp, Homo sapiens
agcagcttttggtctc

SEQ ID NO: 1702469 - DNA, 18 bp, Homo sapiens
agcaggaagccaggctga

SEQ ID NO: 1702470 - DNA, 22 bp, Homo sapiens
agcaggaaggacaggaagctgg

SEQ ID NO: 1702471 - DNA, 20 bp, Homo sapiens
agcaggaatatatgtgtgcc

SEQ ID NO: 1702472 - DNA, 21 bp, Homo sapiens
agcaggacttgctaaagcact

SEQ ID NO: 1702473 - DNA, 18 bp, Homo sapiens
agcaggagagactgagca

SEQ ID NO: 1702474 - DNA, 21 bp, Homo sapiens
agcaggagagactgagcagcc

SEQ ID NO: 1702475 - DNA, 14 bp, Homo sapiens
agcaggagcagctg

SEQ ID NO: 1702476 - DNA, 17 bp, Homo sapiens
agcaggagccccgccac

SEQ ID NO: 1702477 - DNA, 15 bp, Homo sapiens
ctggcctgagctggg

SEQ ID NO: 1702478 - DNA, 12 bp, Homo sapiens
ctggcctgctgg

SEQ ID NO: 1702479 - DNA, 15 bp, Homo sapiens
ctggcctgctgggct

SEQ ID NO: 1702480 - DNA, 23 bp, Homo sapiens
ctggcctggacagtatcccacat

SEQ ID NO: 1702481 - DNA, 14 bp, Homo sapiens
ctggcctggactgt

SEQ ID NO: 1702482 - DNA, 14 bp, Homo sapiens
ctggcctggatctc

SEQ ID NO: 1702483 - DNA, 22 bp, Homo sapiens
ctggcctggatctccccactct

SEQ ID NO: 1702484 - DNA, 12 bp, Homo sapiens
ctggcctggctc

SEQ ID NO: 1702485 - DNA, 13 bp, Homo sapiens
ctggcctggctcc

SEQ ID NO: 1702486 - DNA, 19 bp, Homo sapiens
ctggcctgggccacacctg

SEQ ID NO: 1702487 - DNA, 22 bp, Homo sapiens
ctggcctgggccacacctgagc

SEQ ID NO: 1702488 - DNA, 23 bp, Homo sapiens
ctggcctgggtctccctggtggg

SEQ ID NO: 1702489 - DNA, 19 bp, Homo sapiens
ctggcctggtccctggtcc

SEQ ID NO: 1702490 - DNA, 13 bp, Homo sapiens
ctggcctgtggca

SEQ ID NO: 1702491 - DNA, 18 bp, Homo sapiens
ctggcctgtggcacagcc

SEQ ID NO: 1702492 - DNA, 19 bp, Homo sapiens
ctggcctgtggcacagccc

SEQ ID NO: 1702493 - DNA, 21 bp, Homo sapiens
ctggcctgtggcacagccctg

SEQ ID NO: 1702494 - DNA, 23 bp, Homo sapiens
ctggcctgtggcacagccctgag

SEQ ID NO: 1702495 - DNA, 17 bp, Homo sapiens
ctggccttaaaaggggc

SEQ ID NO: 1702496 - DNA, 21 bp, Homo sapiens
ctggccttaaaaggggcccaa

SEQ ID NO: 1702497 - DNA, 19 bp, Homo sapiens
ctggccttaaagagggaca

SEQ ID NO: 1702498 - DNA, 21 bp, Homo sapiens
ctggccttaaagagggacagg

SEQ ID NO: 1702499 - DNA, 19 bp, Homo sapiens
ctggccttgaaaccacctt

SEQ ID NO: 1702500 - DNA, 13 bp, Homo sapiens
ctggccttgcccg

SEQ ID NO: 1702501 - DNA, 21 bp, Homo sapiens
ctggcctttttcatttatcta

SEQ ID NO: 1702502 - DNA, 13 bp, Homo sapiens
ctggcgcaggtgg

SEQ ID NO: 1702503 - DNA, 14 bp, Homo sapiens
ctggcgcaggtggg

SEQ ID NO: 1702504 - DNA, 14 bp, Homo sapiens
ctggcgccttctcg

SEQ ID NO: 1702505 - DNA, 21 bp, Homo sapiens
ctggcggaggtctctgggagc

SEQ ID NO: 1702506 - DNA, 18 bp, Homo sapiens
ctggcggctactcagcag

SEQ ID NO: 1702507 - DNA, 14 bp, Homo sapiens
ctggcggcttcctg

SEQ ID NO: 1702508 - DNA, 15 bp, Homo sapiens
ctggcggcttcctgt

SEQ ID NO: 1702509 - DNA, 20 bp, Homo sapiens
ctggcggcttcctgtccact

SEQ ID NO: 1702510 - DNA, 18 bp, Homo sapiens
ctggcgtgctcagaccca

SEQ ID NO: 1702511 - DNA, 16 bp, Homo sapiens
ctggctacatcccagc

SEQ ID NO: 1702512 - DNA, 19 bp, Homo sapiens
ctggctaccgaagtaaact

SEQ ID NO: 1702513 - DNA, 22 bp, Homo sapiens
ctggctagaggccagccccacc

SEQ ID NO: 1702514 - DNA, 16 bp, Homo sapiens
ctggctagagtcctca

SEQ ID NO: 1702515 - DNA, 22 bp, Homo sapiens
ctggctagagtcctcactccca

SEQ ID NO: 1702516 - DNA, 16 bp, Homo sapiens
ctggctatttttgtgt

SEQ ID NO: 1702517 - DNA, 14 bp, Homo sapiens
ctggctcactggca

SEQ ID NO: 1702518 - DNA, 16 bp, Homo sapiens
ctggctcactggcagg

SEQ ID NO: 1702519 - DNA, 17 bp, Homo sapiens
ctggctcactggcaggt

SEQ ID NO: 1702520 - DNA, 15 bp, Homo sapiens
ctggctccactcttg

SEQ ID NO: 1702521 - DNA, 15 bp, Homo sapiens
ctggctccaggcaga

SEQ ID NO: 1702522 - DNA, 14 bp, Homo sapiens
ctggctccccaaag

SEQ ID NO: 1702523 - DNA, 21 bp, Homo sapiens
ctggctccccacgagtcacct

SEQ ID NO: 1702524 - DNA, 17 bp, Homo sapiens
ctggctccctcctccag

SEQ ID NO: 1702525 - DNA, 22 bp, Homo sapiens
ctggctccctcctccaggcctg

SEQ ID NO: 1702526 - DNA, 23 bp, Homo sapiens
ctggctccctcctccaggcctgc

SEQ ID NO: 1702527 - DNA, 13 bp, Homo sapiens
ctggctccctgcc

SEQ ID NO: 1702528 - DNA, 16 bp, Homo sapiens
ctggctccctgcccct

SEQ ID NO: 1702529 - DNA, 17 bp, Homo sapiens
ctggctcggacccaccc

SEQ ID NO: 1702530 - DNA, 20 bp, Homo sapiens
ctggctcggacccaccccaa

SEQ ID NO: 1702531 - DNA, 17 bp, Homo sapiens
ctggctctaccctgtct

SEQ ID NO: 1702532 - DNA, 22 bp, Homo sapiens
ctggctctaccctgtctgtccc

SEQ ID NO: 1702533 - DNA, 12 bp, Homo sapiens
ctggctctcaga

SEQ ID NO: 1702534 - DNA, 14 bp, Homo sapiens
ctggctctcagagg

SEQ ID NO: 1702535 - DNA, 14 bp, Homo sapiens
ctggctctccaagt

SEQ ID NO: 1702536 - DNA, 20 bp, Homo sapiens
ctggctctccaagtgccaga

SEQ ID NO: 1702537 - DNA, 23 bp, Homo sapiens
ctggctctccaagtgccagaggt

SEQ ID NO: 1702538 - DNA, 16 bp, Homo sapiens
ctggctctgagaatca

SEQ ID NO: 1702539 - DNA, 12 bp, Homo sapiens
ctggctctgagc

SEQ ID NO: 1702540 - DNA, 13 bp, Homo sapiens
ctggctctgagcg

SEQ ID NO: 1702541 - DNA, 20 bp, Homo sapiens
ctggctctgagcgcctccat

SEQ ID NO: 1702542 - DNA, 24 bp, Homo sapiens
ctggctctgagcgcctccatccaa

SEQ ID NO: 1702543 - DNA, 12 bp, Homo sapiens
ctggctctgggc

SEQ ID NO: 1702544 - DNA, 14 bp, Homo sapiens
ctggctctgggccg

SEQ ID NO: 1702545 - DNA, 16 bp, Homo sapiens
ctggctgaaccctgtg

SEQ ID NO: 1702546 - DNA, 20 bp, Homo sapiens
ctggctgaaccctgtgctgg

SEQ ID NO: 1702547 - DNA, 21 bp, Homo sapiens
ctggctgaaccctgtgctggt

SEQ ID NO: 1702548 - DNA, 15 bp, Homo sapiens
ctggctgaagaatga

SEQ ID NO: 1702549 - DNA, 15 bp, Homo sapiens
ctggctgagcccctg

SEQ ID NO: 1702550 - DNA, 16 bp, Homo sapiens
ctggctgagcctggct

SEQ ID NO: 1702551 - DNA, 17 bp, Homo sapiens
ctggctgagcctggctg

SEQ ID NO: 1702552 - DNA, 18 bp, Homo sapiens
ctggctgagcctggctgg

SEQ ID NO: 1702553 - DNA, 21 bp, Homo sapiens
ctggctgaggatttcaagcct

SEQ ID NO: 1702554 - DNA, 22 bp, Homo sapiens
ctggctgaggatttcaagcctg

SEQ ID NO: 1702555 - DNA, 23 bp, Homo sapiens
ctggctgagtggaatgcagggaa

SEQ ID NO: 1702556 - DNA, 14 bp, Homo sapiens
ctggctgccaggcg

SEQ ID NO: 1702557 - DNA, 18 bp, Homo sapiens
ctggctgccaggcgttgg

SEQ ID NO: 1702558 - DNA, 22 bp, Homo sapiens
ctggctgccaggcgttggtgcc

SEQ ID NO: 1702559 - DNA, 18 bp, Homo sapiens
ctggctgcccagacccct

SEQ ID NO: 1702560 - DNA, 18 bp, Homo sapiens
ctggctgccccaacctgc

SEQ ID NO: 1702561 - DNA, 21 bp, Homo sapiens
ctggctgccccaacctgctga

SEQ ID NO: 1702562 - DNA, 13 bp, Homo sapiens
ctggctgccctgg

SEQ ID NO: 1702563 - DNA, 23 bp, Homo sapiens
ctggctgccctggccctgaggtg

SEQ ID NO: 1702564 - DNA, 16 bp, Homo sapiens
ctggctgctgccccca

SEQ ID NO: 1702565 - DNA, 17 bp, Homo sapiens
ctggctgctgcccccac

SEQ ID NO: 1702566 - DNA, 19 bp, Homo sapiens
ctggctgctgcccccaccc

SEQ ID NO: 1702567 - DNA, 18 bp, Homo sapiens
ctggctggagagctgcta

SEQ ID NO: 1702568 - DNA, 23 bp, Homo sapiens
ctggctggagtctcagagcacag

SEQ ID NO: 1702569 - DNA, 15 bp, Homo sapiens
ctggctggcacagaa

SEQ ID NO: 1702570 - DNA, 14 bp, Homo sapiens
ctggctggcaggtg

SEQ ID NO: 1702571 - DNA, 17 bp, Homo sapiens
ctggctggcccagagtt

SEQ ID NO: 1702572 - DNA, 17 bp, Homo sapiens
ctggctggcctgagcaa

SEQ ID NO: 1702573 - DNA, 15 bp, Homo sapiens
ctggctgggcatgga

SEQ ID NO: 1702574 - DNA, 16 bp, Homo sapiens
ctggctgggccttcac

SEQ ID NO: 1702575 - DNA, 21 bp, Homo sapiens
ctggctgggccttcaccaagc

SEQ ID NO: 1702576 - DNA, 23 bp, Homo sapiens
ctggctgggccttcaccaagcaa

SEQ ID NO: 1702577 - DNA, 16 bp, Homo sapiens
ctggctggggcagagg

SEQ ID NO: 1702578 - DNA, 19 bp, Homo sapiens
ctggctggtgggcccccaa

SEQ ID NO: 1702579 - DNA, 21 bp, Homo sapiens
ctggctggtgggcccccaatg

SEQ ID NO: 1702580 - DNA, 17 bp, Homo sapiens
ctggctgtaaggctcta

SEQ ID NO: 1702581 - DNA, 20 bp, Homo sapiens
ctggctgtaaggctctagat

SEQ ID NO: 1702582 - DNA, 18 bp, Homo sapiens
ctggctgtctagaatgtg

SEQ ID NO: 1702583 - DNA, 18 bp, Homo sapiens
ctggctgtgaatgccaaa

SEQ ID NO: 1702584 - DNA, 15 bp, Homo sapiens
ctggctgtgagcagc

SEQ ID NO: 1702585 - DNA, 17 bp, Homo sapiens
ctggctgtgagcagcct

SEQ ID NO: 1702586 - DNA, 12 bp, Homo sapiens
ctggctgtgccc

SEQ ID NO: 1702587 - DNA, 16 bp, Homo sapiens
ctggctgtgcccagca

SEQ ID NO: 1702588 - DNA, 17 bp, Homo sapiens
ctggctgtgcccagcag

SEQ ID NO: 1702589 - DNA, 19 bp, Homo sapiens
ctggctgtgcccagcaggc

SEQ ID NO: 1702590 - DNA, 22 bp, Homo sapiens
ctggctgtgcccagcaggccca

SEQ ID NO: 1702591 - DNA, 13 bp, Homo sapiens
ctggctgtgcccc

SEQ ID NO: 1702592 - DNA, 16 bp, Homo sapiens
ctggctgtgcccctga

SEQ ID NO: 1702593 - DNA, 23 bp, Homo sapiens
agcaggaggcccttgtcgtggga

SEQ ID NO: 1702594 - DNA, 15 bp, Homo sapiens
agcaggcaccgccac

SEQ ID NO: 1702595 - DNA, 18 bp, Homo sapiens
agcaggcagggctgggcc

SEQ ID NO: 1702596 - DNA, 16 bp, Homo sapiens
agcaggccagcccgga

SEQ ID NO: 1702597 - DNA, 19 bp, Homo sapiens
agcaggccagcccggacct

SEQ ID NO: 1702598 - DNA, 11 bp, Homo sapiens
agcaggcccag

SEQ ID NO: 1702599 - DNA, 15 bp, Homo sapiens
agcaggcccagcatg

SEQ ID NO: 1702600 - DNA, 18 bp, Homo sapiens
agcaggcccagcatgcag

SEQ ID NO: 1702601 - DNA, 22 bp, Homo sapiens
agcaggcgacaaaatctcctgg

SEQ ID NO: 1702602 - DNA, 16 bp, Homo sapiens
agcaggctactgtcag

SEQ ID NO: 1702603 - DNA, 19 bp, Homo sapiens
agcaggctcctggctgtgc

SEQ ID NO: 1702604 - DNA, 21 bp, Homo sapiens
agcaggctcctggctgtgccc

SEQ ID NO: 1702605 - DNA, 19 bp, Homo sapiens
agcagggaaagctccacgg

SEQ ID NO: 1702606 - DNA, 21 bp, Homo sapiens
agcagggaaagctccacggtg

SEQ ID NO: 1702607 - DNA, 24 bp, Homo sapiens
agcagggaagctcttttctcctgc

SEQ ID NO: 1702608 - DNA, 19 bp, Homo sapiens
agcagggattaacctctgc

SEQ ID NO: 1702609 - DNA, 22 bp, Homo sapiens
agcagggattaacctctgcact

SEQ ID NO: 1702610 - DNA, 15 bp, Homo sapiens
agcaggggggctgtg

SEQ ID NO: 1702611 - DNA, 23 bp, Homo sapiens
agcaggggggctgtgccaacctg

SEQ ID NO: 1702612 - DNA, 21 bp, Homo sapiens
agcaggggttggtcaaggcca

SEQ ID NO: 1702613 - DNA, 18 bp, Homo sapiens
agcagggtagtctggttt

SEQ ID NO: 1702614 - DNA, 15 bp, Homo sapiens
agcagggtccacagc

SEQ ID NO: 1702615 - DNA, 17 bp, Homo sapiens
agcagggtccacagctg

SEQ ID NO: 1702616 - DNA, 22 bp, Homo sapiens
agcagggtccacagctggaaag

SEQ ID NO: 1702617 - DNA, 20 bp, Homo sapiens
agcaggtgattggaccaggc

SEQ ID NO: 1702618 - DNA, 22 bp, Homo sapiens
agcaggtgattggaccaggcca

SEQ ID NO: 1702619 - DNA, 14 bp, Homo sapiens
agcaggtgctacaa

SEQ ID NO: 1702620 - DNA, 16 bp, Homo sapiens
agcaggtgtggtggct

SEQ ID NO: 1702621 - DNA, 20 bp, Homo sapiens
agcaggttccccaagggccc

SEQ ID NO: 1702622 - DNA, 21 bp, Homo sapiens
agcaggttccccaagggccct

SEQ ID NO: 1702623 - DNA, 21 bp, Homo sapiens
agcaggttcttgatgtcatgt

SEQ ID NO: 1702624 - DNA, 21 bp, Homo sapiens
agcaggttgaggggctcctgg

SEQ ID NO: 1702625 - DNA, 21 bp, Homo sapiens
agcaggtttgttttcagcact

SEQ ID NO: 1702626 - DNA, 21 bp, Homo sapiens
agcagtaaaagatgaagtttt

SEQ ID NO: 1702627 - DNA, 17 bp, Homo sapiens
agcagtaactgacaact

SEQ ID NO: 1702628 - DNA, 20 bp, Homo sapiens
agcagtatatgttaatttgt

SEQ ID NO: 1702629 - DNA, 21 bp, Homo sapiens
agcagtatcacaggccagatg

SEQ ID NO: 1702630 - DNA, 22 bp, Homo sapiens
agcagtcctcccaccttggcct

SEQ ID NO: 1702631 - DNA, 19 bp, Homo sapiens
agcagtcctgcctcagcct

SEQ ID NO: 1702632 - DNA, 21 bp, Homo sapiens
agcagtcgtgcctgtgtccat

SEQ ID NO: 1702633 - DNA, 22 bp, Homo sapiens
agcagtcgtggctttggcagtg

SEQ ID NO: 1702634 - DNA, 19 bp, Homo sapiens
agcagtctatcattgcagg

SEQ ID NO: 1702635 - DNA, 18 bp, Homo sapiens
agcagtctccttcagcac

SEQ ID NO: 1702636 - DNA, 19 bp, Homo sapiens
agcagtctgataaactgac

SEQ ID NO: 1702637 - DNA, 13 bp, Homo sapiens
agcagtctgcctg

SEQ ID NO: 1702638 - DNA, 15 bp, Homo sapiens
agcagtctgcctgga

SEQ ID NO: 1702639 - DNA, 14 bp, Homo sapiens
agcagtgagccgca

SEQ ID NO: 1702640 - DNA, 16 bp, Homo sapiens
agcagtgagtctcttc

SEQ ID NO: 1702641 - DNA, 19 bp, Homo sapiens
agcagtgatctcagggcag

SEQ ID NO: 1702642 - DNA, 19 bp, Homo sapiens
agcagtgcctcgaggcacc

SEQ ID NO: 1702643 - DNA, 12 bp, Homo sapiens
agcagtggacac

SEQ ID NO: 1702644 - DNA, 16 bp, Homo sapiens
agcagtggctggtcca

SEQ ID NO: 1702645 - DNA, 18 bp, Homo sapiens
agcagtggctggtccagg

SEQ ID NO: 1702646 - DNA, 19 bp, Homo sapiens
agcagtggctggtccaggg

SEQ ID NO: 1702647 - DNA, 22 bp, Homo sapiens
agcagtggctggtccagggcta

SEQ ID NO: 1702648 - DNA, 18 bp, Homo sapiens
agcagtgggcaggtggcc

SEQ ID NO: 1702649 - DNA, 19 bp, Homo sapiens
agcagtgtcccctgcccca

SEQ ID NO: 1702650 - DNA, 15 bp, Homo sapiens
agcagtgtcttccat

SEQ ID NO: 1702651 - DNA, 22 bp, Homo sapiens
agcagtgtcttccataatgtat

SEQ ID NO: 1702652 - DNA, 20 bp, Homo sapiens
agcagtgttacttgcaggta

SEQ ID NO: 1702653 - DNA, 21 bp, Homo sapiens
agcagttcttaacccagtgtc

SEQ ID NO: 1702654 - DNA, 15 bp, Homo sapiens
agcagttgacatcca

SEQ ID NO: 1702655 - DNA, 20 bp, Homo sapiens
agcagttgacatccaaatct

SEQ ID NO: 1702656 - DNA, 15 bp, Homo sapiens
agcagttgctcacat

SEQ ID NO: 1702657 - DNA, 16 bp, Homo sapiens
agcagttttcccctgg

SEQ ID NO: 1702658 - DNA, 19 bp, Homo sapiens
agcagttttcccctggcct

SEQ ID NO: 1702659 - DNA, 20 bp, Homo sapiens
agcagttttcccctggcctc

SEQ ID NO: 1702660 - DNA, 13 bp, Homo sapiens
agcataaaaacat

SEQ ID NO: 1702661 - DNA, 21 bp, Homo sapiens
agcataaaaacattttaaaaa

SEQ ID NO: 1702662 - DNA, 20 bp, Homo sapiens
agcataaaagatcaccttgt

SEQ ID NO: 1702663 - DNA, 13 bp, Homo sapiens
agcataaatgcaa

SEQ ID NO: 1702664 - DNA, 17 bp, Homo sapiens
agcataagtttctggga

SEQ ID NO: 1702665 - DNA, 22 bp, Homo sapiens
agcataatgctcccatctcctg

SEQ ID NO: 1702666 - DNA, 13 bp, Homo sapiens
agcatacatttat

SEQ ID NO: 1702667 - DNA, 21 bp, Homo sapiens
agcatactggcttcaccatca

SEQ ID NO: 1702668 - DNA, 17 bp, Homo sapiens
agcatactttgtaaata

SEQ ID NO: 1702669 - DNA, 22 bp, Homo sapiens
agcatagaacaggacctctgct

SEQ ID NO: 1702670 - DNA, 23 bp, Homo sapiens
agcatagccagcattcagcacac

SEQ ID NO: 1702671 - DNA, 16 bp, Homo sapiens
agcatatgacaaatgt

SEQ ID NO: 1702672 - DNA, 18 bp, Homo sapiens
agcatatgacaaatgttt

SEQ ID NO: 1702673 - DNA, 23 bp, Homo sapiens
agcatatgcagccaaccaagatg

SEQ ID NO: 1702674 - DNA, 20 bp, Homo sapiens
agcatatgggttagatgttg

SEQ ID NO: 1702675 - DNA, 20 bp, Homo sapiens
agcatatttgtatagttgct

SEQ ID NO: 1702676 - DNA, 21 bp, Homo sapiens
agcatatttgtatagttgctt

SEQ ID NO: 1702677 - DNA, 22 bp, Homo sapiens
agcatatttgtatagttgcttg

SEQ ID NO: 1702678 - DNA, 16 bp, Homo sapiens
agcatattttgctggt

SEQ ID NO: 1702679 - DNA, 14 bp, Homo sapiens
agcatcaatcttgt

SEQ ID NO: 1702680 - DNA, 13 bp, Homo sapiens
agcatcacctcag

SEQ ID NO: 1702681 - DNA, 15 bp, Homo sapiens
agcatcacctcaggc

SEQ ID NO: 1702682 - DNA, 20 bp, Homo sapiens
agcatcacctcaggccaggt

SEQ ID NO: 1702683 - DNA, 13 bp, Homo sapiens
agcatcacctgcc

SEQ ID NO: 1702684 - DNA, 15 bp, Homo sapiens
agcatcacctgcctg

SEQ ID NO: 1702685 - DNA, 19 bp, Homo sapiens
agcatcactagtgacaagt

SEQ ID NO: 1702686 - DNA, 23 bp, Homo sapiens
agcatcagagagtgtacatcatg

SEQ ID NO: 1702687 - DNA, 15 bp, Homo sapiens
agcatcagagggctg

SEQ ID NO: 1702688 - DNA, 12 bp, Homo sapiens
agcatccagcct

SEQ ID NO: 1702689 - DNA, 16 bp, Homo sapiens
agcatccagcctgtgt

SEQ ID NO: 1702690 - DNA, 17 bp, Homo sapiens
agcatccaggctggcca

SEQ ID NO: 1702691 - DNA, 16 bp, Homo sapiens
agcatcccccaaagtt

SEQ ID NO: 1702692 - DNA, 21 bp, Homo sapiens
agcatcccgcgcgcccttcct

SEQ ID NO: 1702693 - DNA, 13 bp, Homo sapiens
agcatccctggag

SEQ ID NO: 1702694 - DNA, 19 bp, Homo sapiens
agcatccctggagcaggag

SEQ ID NO: 1702695 - DNA, 20 bp, Homo sapiens
agcatccctggagcaggagc

SEQ ID NO: 1702696 - DNA, 14 bp, Homo sapiens
agcatcctggcagg

SEQ ID NO: 1702697 - DNA, 23 bp, Homo sapiens
agcatcggacaagacccccagca

SEQ ID NO: 1702698 - DNA, 20 bp, Homo sapiens
agcatcgggagcacccagag

SEQ ID NO: 1702699 - DNA, 21 bp, Homo sapiens
agcatcgggagcacccagagc

SEQ ID NO: 1702700 - DNA, 19 bp, Homo sapiens
agcatcgtgacccttcagg

SEQ ID NO: 1702701 - DNA, 22 bp, Homo sapiens
agcatcgtgacccttcagggcc

SEQ ID NO: 1702702 - DNA, 23 bp, Homo sapiens
agcatcgtgacccttcagggcca

SEQ ID NO: 1702703 - DNA, 21 bp, Homo sapiens
agcatctactctaaagaaaaa

SEQ ID NO: 1702704 - DNA, 15 bp, Homo sapiens
agcatctcaggaggg

SEQ ID NO: 1702705 - DNA, 14 bp, Homo sapiens
agcatctcccagca

SEQ ID NO: 1702706 - DNA, 17 bp, Homo sapiens
agcatctcccagcaaga

SEQ ID NO: 1702707 - DNA, 22 bp, Homo sapiens
agcatctccctcactgaaacca

SEQ ID NO: 1702708 - DNA, 17 bp, Homo sapiens
ctggctgtggaggcctg

SEQ ID NO: 1702709 - DNA, 20 bp, Homo sapiens
ctggctgtggaggcctgatg

SEQ ID NO: 1702710 - DNA, 23 bp, Homo sapiens
ctggctgtggaggcctgatgctg

SEQ ID NO: 1702711 - DNA, 16 bp, Homo sapiens
ctggctgttggcccct

SEQ ID NO: 1702712 - DNA, 22 bp, Homo sapiens
ctggctgttggcccctctgctg

SEQ ID NO: 1702713 - DNA, 19 bp, Homo sapiens
ctggcttacctatctgtgg

SEQ ID NO: 1702714 - DNA, 15 bp, Homo sapiens
ctggcttagtgccac

SEQ ID NO: 1702715 - DNA, 22 bp, Homo sapiens
ctggcttcccatagtggggcct

SEQ ID NO: 1702716 - DNA, 16 bp, Homo sapiens
ctggcttctctctttt

SEQ ID NO: 1702717 - DNA, 22 bp, Homo sapiens
ctggcttctctcttttcctcct

SEQ ID NO: 1702718 - DNA, 13 bp, Homo sapiens
ctggcttctgtgc

SEQ ID NO: 1702719 - DNA, 16 bp, Homo sapiens
ctggcttgaaggactg

SEQ ID NO: 1702720 - DNA, 17 bp, Homo sapiens
ctggcttgctccagggt

SEQ ID NO: 1702721 - DNA, 20 bp, Homo sapiens
ctggcttgcttgccgagcct

SEQ ID NO: 1702722 - DNA, 20 bp, Homo sapiens
ctggcttggggtcaagaaac

SEQ ID NO: 1702723 - DNA, 14 bp, Homo sapiens
ctggcttgtacatt

SEQ ID NO: 1702724 - DNA, 11 bp, Homo sapiens
ctggctttctc

SEQ ID NO: 1702725 - DNA, 13 bp, Homo sapiens
ctggctttctctc

SEQ ID NO: 1702726 - DNA, 14 bp, Homo sapiens
ctggctttctctct

SEQ ID NO: 1702727 - DNA, 19 bp, Homo sapiens
ctggctttctctctggctt

SEQ ID NO: 1702728 - DNA, 12 bp, Homo sapiens
ctggctttgcct

SEQ ID NO: 1702729 - DNA, 16 bp, Homo sapiens
ctggctttgcctcttc

SEQ ID NO: 1702730 - DNA, 17 bp, Homo sapiens
ctggctttgcctcttct

SEQ ID NO: 1702731 - DNA, 20 bp, Homo sapiens
ctggctttgcctcttctttg

SEQ ID NO: 1702732 - DNA, 15 bp, Homo sapiens
ctggcttttacttta

SEQ ID NO: 1702733 - DNA, 16 bp, Homo sapiens
ctggcttttcactgct

SEQ ID NO: 1702734 - DNA, 17 bp, Homo sapiens
ctggcttttcactgctg

SEQ ID NO: 1702735 - DNA, 20 bp, Homo sapiens
ctggcttttcactgctggct

SEQ ID NO: 1702736 - DNA, 15 bp, Homo sapiens
ctggcttttgagcac

SEQ ID NO: 1702737 - DNA, 21 bp, Homo sapiens
ctggctttttctgccactgag

SEQ ID NO: 1702738 - DNA, 17 bp, Homo sapiens
ctgggaaaggacccacc

SEQ ID NO: 1702739 - DNA, 22 bp, Homo sapiens
ctgggaacatgacccagcctga

SEQ ID NO: 1702740 - DNA, 16 bp, Homo sapiens
ctgggaaccactccca

SEQ ID NO: 1702741 - DNA, 18 bp, Homo sapiens
ctgggaaccactcccacc

SEQ ID NO: 1702742 - DNA, 19 bp, Homo sapiens
ctgggaaccccgcagcccg

SEQ ID NO: 1702743 - DNA, 17 bp, Homo sapiens
ctgggaagaagcaaggg

SEQ ID NO: 1702744 - DNA, 21 bp, Homo sapiens
ctgggaagaagcaagggcaag

SEQ ID NO: 1702745 - DNA, 22 bp, Homo sapiens
ctgggaagagaagagggcccag

SEQ ID NO: 1702746 - DNA, 22 bp, Homo sapiens
ctgggaagctgtactcagagca

SEQ ID NO: 1702747 - DNA, 14 bp, Homo sapiens
ctgggaaggaggga

SEQ ID NO: 1702748 - DNA, 21 bp, Homo sapiens
ctgggaaggagggagctgctc

SEQ ID NO: 1702749 - DNA, 16 bp, Homo sapiens
ctgggaagggagaggg

SEQ ID NO: 1702750 - DNA, 18 bp, Homo sapiens
ctgggaagggagagggcc

SEQ ID NO: 1702751 - DNA, 21 bp, Homo sapiens
ctgggaagggagagggcctct

SEQ ID NO: 1702752 - DNA, 18 bp, Homo sapiens
ctgggaataagtgccagg

SEQ ID NO: 1702753 - DNA, 14 bp, Homo sapiens
ctgggaatgggaga

SEQ ID NO: 1702754 - DNA, 18 bp, Homo sapiens
ctgggaatgggggagaga

SEQ ID NO: 1702755 - DNA, 13 bp, Homo sapiens
ctgggaatgtatt

SEQ ID NO: 1702756 - DNA, 18 bp, Homo sapiens
ctgggaatgtattattct

SEQ ID NO: 1702757 - DNA, 23 bp, Homo sapiens
ctgggaatgtattattctgcagc

SEQ ID NO: 1702758 - DNA, 18 bp, Homo sapiens
ctgggacagctggctggg

SEQ ID NO: 1702759 - DNA, 21 bp, Homo sapiens
ctgggacatcaggagactggg

SEQ ID NO: 1702760 - DNA, 13 bp, Homo sapiens
ctgggaccagagc

SEQ ID NO: 1702761 - DNA, 14 bp, Homo sapiens
ctgggaccagagcc

SEQ ID NO: 1702762 - DNA, 17 bp, Homo sapiens
ctgggaccagagccaga

SEQ ID NO: 1702763 - DNA, 19 bp, Homo sapiens
ctgggaccagagccagatg

SEQ ID NO: 1702764 - DNA, 20 bp, Homo sapiens
ctgggaccagagccagatgc

SEQ ID NO: 1702765 - DNA, 12 bp, Homo sapiens
ctgggacccagc

SEQ ID NO: 1702766 - DNA, 13 bp, Homo sapiens
ctgggacccagct

SEQ ID NO: 1702767 - DNA, 19 bp, Homo sapiens
ctgggacccagctactctg

SEQ ID NO: 1702768 - DNA, 22 bp, Homo sapiens
ctgggacccagctactctgtcc

SEQ ID NO: 1702769 - DNA, 14 bp, Homo sapiens
ctgggaccctttcc

SEQ ID NO: 1702770 - DNA, 15 bp, Homo sapiens
ctgggaccctttcct

SEQ ID NO: 1702771 - DNA, 20 bp, Homo sapiens
ctgggaccctttccttcctt

SEQ ID NO: 1702772 - DNA, 16 bp, Homo sapiens
ctgggacctgatttat

SEQ ID NO: 1702773 - DNA, 17 bp, Homo sapiens
ctgggacctgccaggca

SEQ ID NO: 1702774 - DNA, 19 bp, Homo sapiens
ctgggacgtggacatgcct

SEQ ID NO: 1702775 - DNA, 23 bp, Homo sapiens
ctgggactataggcatgcgccac

SEQ ID NO: 1702776 - DNA, 14 bp, Homo sapiens
ctgggactcagcct

SEQ ID NO: 1702777 - DNA, 15 bp, Homo sapiens
ctgggactcagcctt

SEQ ID NO: 1702778 - DNA, 16 bp, Homo sapiens
ctgggactcagccttc

SEQ ID NO: 1702779 - DNA, 17 bp, Homo sapiens
ctgggactcagccttca

SEQ ID NO: 1702780 - DNA, 18 bp, Homo sapiens
ctgggactcagccttcag

SEQ ID NO: 1702781 - DNA, 21 bp, Homo sapiens
ctgggactctcctcctcccct

SEQ ID NO: 1702782 - DNA, 15 bp, Homo sapiens
ctgggactgagccag

SEQ ID NO: 1702783 - DNA, 15 bp, Homo sapiens
ctgggactggacagc

SEQ ID NO: 1702784 - DNA, 13 bp, Homo sapiens
ctgggactggcca

SEQ ID NO: 1702785 - DNA, 19 bp, Homo sapiens
ctgggacttccatgcctta

SEQ ID NO: 1702786 - DNA, 17 bp, Homo sapiens
ctgggagaaaatcatca

SEQ ID NO: 1702787 - DNA, 17 bp, Homo sapiens
ctgggagaacctcaggc

SEQ ID NO: 1702788 - DNA, 13 bp, Homo sapiens
ctgggagacaaag

SEQ ID NO: 1702789 - DNA, 17 bp, Homo sapiens
ctgggagccacttctcc

SEQ ID NO: 1702790 - DNA, 15 bp, Homo sapiens
ctgggagccagtcct

SEQ ID NO: 1702791 - DNA, 15 bp, Homo sapiens
ctgggagcccagagg

SEQ ID NO: 1702792 - DNA, 20 bp, Homo sapiens
ctgggagctccactctgctt

SEQ ID NO: 1702793 - DNA, 23 bp, Homo sapiens
ctgggagctccactctgcttctc

SEQ ID NO: 1702794 - DNA, 15 bp, Homo sapiens
ctgggagcttccgct

SEQ ID NO: 1702795 - DNA, 15 bp, Homo sapiens
ctgggaggaagcagg

SEQ ID NO: 1702796 - DNA, 15 bp, Homo sapiens
ctgggaggagggaga

SEQ ID NO: 1702797 - DNA, 23 bp, Homo sapiens
ctgggaggcagaggttgcagtga

SEQ ID NO: 1702798 - DNA, 12 bp, Homo sapiens
ctgggagggagg

SEQ ID NO: 1702799 - DNA, 16 bp, Homo sapiens
ctgggagggttcccct

SEQ ID NO: 1702800 - DNA, 18 bp, Homo sapiens
ctgggagggttcccctgg

SEQ ID NO: 1702801 - DNA, 21 bp, Homo sapiens
ctgggagggttcccctggcct

SEQ ID NO: 1702802 - DNA, 13 bp, Homo sapiens
ctgggagtcccct

SEQ ID NO: 1702803 - DNA, 19 bp, Homo sapiens
ctgggagtgggtggaggca

SEQ ID NO: 1702804 - DNA, 21 bp, Homo sapiens
ctgggatatatggaggattct

SEQ ID NO: 1702805 - DNA, 19 bp, Homo sapiens
ctgggatatggctgcccag

SEQ ID NO: 1702806 - DNA, 21 bp, Homo sapiens
ctgggatatggctgcccagga

SEQ ID NO: 1702807 - DNA, 14 bp, Homo sapiens
ctgggatgacaggc

SEQ ID NO: 1702808 - DNA, 15 bp, Homo sapiens
ctgggatgggctccc

SEQ ID NO: 1702809 - DNA, 14 bp, Homo sapiens
ctgggatgtagaac

SEQ ID NO: 1702810 - DNA, 23 bp, Homo sapiens
ctgggattaagaaaccttgctct

SEQ ID NO: 1702811 - DNA, 20 bp, Homo sapiens
ctgggatttcttcgctgctc

SEQ ID NO: 1702812 - DNA, 23 bp, Homo sapiens
ctgggatttcttcgctgctctag

SEQ ID NO: 1702813 - DNA, 15 bp, Homo sapiens
ctgggcaacagagca

SEQ ID NO: 1702814 - DNA, 18 bp, Homo sapiens
ctgggcaacagagcaaga

SEQ ID NO: 1702815 - DNA, 21 bp, Homo sapiens
ctgggcaagagatgggacaag

SEQ ID NO: 1702816 - DNA, 17 bp, Homo sapiens
ctgggcaaggtgggtga

SEQ ID NO: 1702817 - DNA, 17 bp, Homo sapiens
ctgggcaatgaggcaga

SEQ ID NO: 1702818 - DNA, 15 bp, Homo sapiens
ctgggcacagtgggc

SEQ ID NO: 1702819 - DNA, 23 bp, Homo sapiens
ctgggcacagtgggcctgtgtgt

SEQ ID NO: 1702820 - DNA, 16 bp, Homo sapiens
ctgggcacctgcgcac

SEQ ID NO: 1702821 - DNA, 20 bp, Homo sapiens
ctgggcacctgcgcacaggt

SEQ ID NO: 1702822 - DNA, 22 bp, Homo sapiens
ctgggcacctgcgcacaggtgg

SEQ ID NO: 1702823 - DNA, 13 bp, Homo sapiens
ctgggcagaaggc

SEQ ID NO: 1702824 - DNA, 12 bp, Homo sapiens
agcatctgacca

SEQ ID NO: 1702825 - DNA, 15 bp, Homo sapiens
agcatctgaccatct

SEQ ID NO: 1702826 - DNA, 16 bp, Homo sapiens
agcatctgaccatctg

SEQ ID NO: 1702827 - DNA, 18 bp, Homo sapiens
agcatctgaccatctgtg

SEQ ID NO: 1702828 - DNA, 19 bp, Homo sapiens
agcatctgaccatctgtga

SEQ ID NO: 1702829 - DNA, 14 bp, Homo sapiens
agcatctggctgtc

SEQ ID NO: 1702830 - DNA, 22 bp, Homo sapiens
agcatctggctgtctagaatgt

SEQ ID NO: 1702831 - DNA, 12 bp, Homo sapiens
agcatcttctgg

SEQ ID NO: 1702832 - DNA, 14 bp, Homo sapiens
agcatgaaatgtga

SEQ ID NO: 1702833 - DNA, 22 bp, Homo sapiens
agcatgaaatgtgaatttttat

SEQ ID NO: 1702834 - DNA, 22 bp, Homo sapiens
agcatgaagaattttttctcat

SEQ ID NO: 1702835 - DNA, 21 bp, Homo sapiens
agcatgaataaaacactcatc

SEQ ID NO: 1702836 - DNA, 17 bp, Homo sapiens
agcatgacaacttttaa

SEQ ID NO: 1702837 - DNA, 19 bp, Homo sapiens
agcatgacaacttttaaag

SEQ ID NO: 1702838 - DNA, 20 bp, Homo sapiens
agcatgacaacttttaaaga

SEQ ID NO: 1702839 - DNA, 14 bp, Homo sapiens
agcatgacagaaaa

SEQ ID NO: 1702840 - DNA, 18 bp, Homo sapiens
agcatgacagaaaatatg

SEQ ID NO: 1702841 - DNA, 23 bp, Homo sapiens
agcatgacagaaaatatgtatta

SEQ ID NO: 1702842 - DNA, 15 bp, Homo sapiens
agcatgacagcctgc

SEQ ID NO: 1702843 - DNA, 23 bp, Homo sapiens
agcatgacctgtgaccagcactg

SEQ ID NO: 1702844 - DNA, 13 bp, Homo sapiens
agcatgatgggaa

SEQ ID NO: 1702845 - DNA, 19 bp, Homo sapiens
agcatgattctttaataga

SEQ ID NO: 1702846 - DNA, 18 bp, Homo sapiens
agcatgcacagctgcttg

SEQ ID NO: 1702847 - DNA, 15 bp, Homo sapiens
agcatgcgcgctgtg

SEQ ID NO: 1702848 - DNA, 14 bp, Homo sapiens
agcatgcttccttt

SEQ ID NO: 1702849 - DNA, 17 bp, Homo sapiens
agcatgcttcctttctc

SEQ ID NO: 1702850 - DNA, 20 bp, Homo sapiens
agcatgcttgggctgaccca

SEQ ID NO: 1702851 - DNA, 22 bp, Homo sapiens
agcatgcttgtgaaaatgtgtt

SEQ ID NO: 1702852 - DNA, 14 bp, Homo sapiens
agcatgctttgctg

SEQ ID NO: 1702853 - DNA, 16 bp, Homo sapiens
agcatgctttgctgct

SEQ ID NO: 1702854 - DNA, 19 bp, Homo sapiens
agcatggaaaaatggttga

SEQ ID NO: 1702855 - DNA, 14 bp, Homo sapiens
agcatggacattta

SEQ ID NO: 1702856 - DNA, 20 bp, Homo sapiens
agcatggacatttagaagaa

SEQ ID NO: 1702857 - DNA, 19 bp, Homo sapiens
agcatggaggaggagggag

SEQ ID NO: 1702858 - DNA, 21 bp, Homo sapiens
agcatggaggaggagggaggc

SEQ ID NO: 1702859 - DNA, 19 bp, Homo sapiens
agcatggcatagccccggc

SEQ ID NO: 1702860 - DNA, 18 bp, Homo sapiens
agcatggcatatttttca

SEQ ID NO: 1702861 - DNA, 21 bp, Homo sapiens
agcatggcatatttttcacat

SEQ ID NO: 1702862 - DNA, 16 bp, Homo sapiens
agcatggcctggactg

SEQ ID NO: 1702863 - DNA, 23 bp, Homo sapiens
agcatggggcgctcccactcaga

SEQ ID NO: 1702864 - DNA, 17 bp, Homo sapiens
agcatgggggctgccag

SEQ ID NO: 1702865 - DNA, 17 bp, Homo sapiens
agcatgggtgtgccctt

SEQ ID NO: 1702866 - DNA, 16 bp, Homo sapiens
agcatggtcacaagca

SEQ ID NO: 1702867 - DNA, 17 bp, Homo sapiens
agcatggtcacaagcac

SEQ ID NO: 1702868 - DNA, 21 bp, Homo sapiens
agcatgtaatgttaatgttat

SEQ ID NO: 1702869 - DNA, 15 bp, Homo sapiens
agcatgtaggagaat

SEQ ID NO: 1702870 - DNA, 19 bp, Homo sapiens
agcatgtctattcagcttc

SEQ ID NO: 1702871 - DNA, 17 bp, Homo sapiens
agcatgtctctctgcca

SEQ ID NO: 1702872 - DNA, 22 bp, Homo sapiens
agcatgtctctctgccaagatc

SEQ ID NO: 1702873 - DNA, 18 bp, Homo sapiens
agcatgtggcatgttcat

SEQ ID NO: 1702874 - DNA, 14 bp, Homo sapiens
agcatgttcctcct

SEQ ID NO: 1702875 - DNA, 14 bp, Homo sapiens
agcatgttttgcat

SEQ ID NO: 1702876 - DNA, 20 bp, Homo sapiens
agcattaagctgttcctgtt

SEQ ID NO: 1702877 - DNA, 13 bp, Homo sapiens
agcattacattat

SEQ ID NO: 1702878 - DNA, 22 bp, Homo sapiens
agcattacctaatttttttcct

SEQ ID NO: 1702879 - DNA, 15 bp, Homo sapiens
agcattattcttcag

SEQ ID NO: 1702880 - DNA, 14 bp, Homo sapiens
agcattcagcacac

SEQ ID NO: 1702881 - DNA, 16 bp, Homo sapiens
agcattcagcacacac

SEQ ID NO: 1702882 - DNA, 15 bp, Homo sapiens
agcattccagctctg

SEQ ID NO: 1702883 - DNA, 17 bp, Homo sapiens
agcattccagctctgcc

SEQ ID NO: 1702884 - DNA, 15 bp, Homo sapiens
agcattccagtaact

SEQ ID NO: 1702885 - DNA, 17 bp, Homo sapiens
agcattccagtaacttt

SEQ ID NO: 1702886 - DNA, 22 bp, Homo sapiens
agcattccctacagcctagggc

SEQ ID NO: 1702887 - DNA, 18 bp, Homo sapiens
agcattctcactcctacc

SEQ ID NO: 1702888 - DNA, 22 bp, Homo sapiens
agcattctcactcctacctggt

SEQ ID NO: 1702889 - DNA, 13 bp, Homo sapiens
agcattctcccca

SEQ ID NO: 1702890 - DNA, 20 bp, Homo sapiens
agcattcttgtcacaataaa

SEQ ID NO: 1702891 - DNA, 15 bp, Homo sapiens
agcattctttaacag

SEQ ID NO: 1702892 - DNA, 19 bp, Homo sapiens
agcattctttggagttaaa

SEQ ID NO: 1702893 - DNA, 18 bp, Homo sapiens
agcattgcctggactgac

SEQ ID NO: 1702894 - DNA, 19 bp, Homo sapiens
agcattgcctggactgacc

SEQ ID NO: 1702895 - DNA, 14 bp, Homo sapiens
agcattgctggttc

SEQ ID NO: 1702896 - DNA, 15 bp, Homo sapiens
agcattgctttctga

SEQ ID NO: 1702897 - DNA, 16 bp, Homo sapiens
agcattgctttctgaa

SEQ ID NO: 1702898 - DNA, 14 bp, Homo sapiens
agcattggcccctg

SEQ ID NO: 1702899 - DNA, 15 bp, Homo sapiens
agcattggcccctga

SEQ ID NO: 1702900 - DNA, 14 bp, Homo sapiens
agcattgtaaaata

SEQ ID NO: 1702901 - DNA, 18 bp, Homo sapiens
agcattgtaaatgtgctt

SEQ ID NO: 1702902 - DNA, 12 bp, Homo sapiens
agcatttactat

SEQ ID NO: 1702903 - DNA, 13 bp, Homo sapiens
agcatttaggaga

SEQ ID NO: 1702904 - DNA, 23 bp, Homo sapiens
agcatttaggagaatagcagaga

SEQ ID NO: 1702905 - DNA, 22 bp, Homo sapiens
agcatttagtgaagttgtgcaa

SEQ ID NO: 1702906 - DNA, 23 bp, Homo sapiens
agcatttcaaagccctgcctctg

SEQ ID NO: 1702907 - DNA, 24 bp, Homo sapiens
agcatttcaaagccctgcctctgt

SEQ ID NO: 1702908 - DNA, 17 bp, Homo sapiens
agcatttccaacaccac

SEQ ID NO: 1702909 - DNA, 22 bp, Homo sapiens
agcatttccaacaccacagaca

SEQ ID NO: 1702910 - DNA, 17 bp, Homo sapiens
agcatttgattaacatt

SEQ ID NO: 1702911 - DNA, 19 bp, Homo sapiens
agcatttgattaacatttg

SEQ ID NO: 1702912 - DNA, 16 bp, Homo sapiens
agcatttgctttcctc

SEQ ID NO: 1702913 - DNA, 19 bp, Homo sapiens
agcatttgctttcctctga

SEQ ID NO: 1702914 - DNA, 14 bp, Homo sapiens
agcatttggtttta

SEQ ID NO: 1702915 - DNA, 21 bp, Homo sapiens
agcatttggttttacacagga

SEQ ID NO: 1702916 - DNA, 20 bp, Homo sapiens
agcattttaaggttctcaga

SEQ ID NO: 1702917 - DNA, 15 bp, Homo sapiens
agcattttaattctc

SEQ ID NO: 1702918 - DNA, 17 bp, Homo sapiens
agcattttaattctctc

SEQ ID NO: 1702919 - DNA, 20 bp, Homo sapiens
agcattttgggatccttcag

SEQ ID NO: 1702920 - DNA, 16 bp, Homo sapiens
agcatttttataaact

SEQ ID NO: 1702921 - DNA, 17 bp, Homo sapiens
agcatttttatgcagac

SEQ ID NO: 1702922 - DNA, 16 bp, Homo sapiens
agccaaaacagatcca

SEQ ID NO: 1702923 - DNA, 17 bp, Homo sapiens
agccaaaatgtaggctt

SEQ ID NO: 1702924 - DNA, 18 bp, Homo sapiens
agccaaacccatgaggca

SEQ ID NO: 1702925 - DNA, 22 bp, Homo sapiens
agccaaacccctagagacagtg

SEQ ID NO: 1702926 - DNA, 16 bp, Homo sapiens
agccaaaccctgtctg

SEQ ID NO: 1702927 - DNA, 18 bp, Homo sapiens
agccaaactcaggcccag

SEQ ID NO: 1702928 - DNA, 14 bp, Homo sapiens
agccaaactgtaga

SEQ ID NO: 1702929 - DNA, 12 bp, Homo sapiens
agccaaagaaaa

SEQ ID NO: 1702930 - DNA, 17 bp, Homo sapiens
agccaaagaaacaagct

SEQ ID NO: 1702931 - DNA, 17 bp, Homo sapiens
agccaaaggcagctaag

SEQ ID NO: 1702932 - DNA, 18 bp, Homo sapiens
agccaaaggcagctaaga

SEQ ID NO: 1702933 - DNA, 18 bp, Homo sapiens
agccaaaggtcaaacagg

SEQ ID NO: 1702934 - DNA, 21 bp, Homo sapiens
agccaaagttttcaaactgct

SEQ ID NO: 1702935 - DNA, 12 bp, Homo sapiens
agccaaatctga

SEQ ID NO: 1702936 - DNA, 17 bp, Homo sapiens
agatcttgagagctgct

SEQ ID NO: 1702937 - DNA, 13 bp, Homo sapiens
agatcttgtctcc

SEQ ID NO: 1702938 - DNA, 16 bp, Homo sapiens
agatcttgtctccact

SEQ ID NO: 1702939 - DNA, 22 bp, Homo sapiens
agatcttgtctccactaaatga

SEQ ID NO: 1702940 - DNA, 16 bp, Homo sapiens
agatctttcagaaata

SEQ ID NO: 1702941 - DNA, 21 bp, Homo sapiens
agatctttcaggaaagacgga

SEQ ID NO: 1702942 - DNA, 13 bp, Homo sapiens
agatctttcccag

SEQ ID NO: 1702943 - DNA, 18 bp, Homo sapiens
agatctttctcttccctg

SEQ ID NO: 1702944 - DNA, 20 bp, Homo sapiens
agatctttctttccaaaaca

SEQ ID NO: 1702945 - DNA, 21 bp, Homo sapiens
agatctttctttccaaaacat

SEQ ID NO: 1702946 - DNA, 21 bp, Homo sapiens
agatgaaataaagacccaggg

SEQ ID NO: 1702947 - DNA, 15 bp, Homo sapiens
agatgaaatgccttt

SEQ ID NO: 1702948 - DNA, 19 bp, Homo sapiens
agatgaactgactgaagga

SEQ ID NO: 1702949 - DNA, 17 bp, Homo sapiens
agatgaagagtgagagg

SEQ ID NO: 1702950 - DNA, 18 bp, Homo sapiens
agatgaattgataaaaga

SEQ ID NO: 1702951 - DNA, 14 bp, Homo sapiens
agatgacacataaa

SEQ ID NO: 1702952 - DNA, 20 bp, Homo sapiens
agatgacacgcgctctccac

SEQ ID NO: 1702953 - DNA, 22 bp, Homo sapiens
agatgacacgcgctctccacca

SEQ ID NO: 1702954 - DNA, 18 bp, Homo sapiens
agatgacataaaatttac

SEQ ID NO: 1702955 - DNA, 21 bp, Homo sapiens
agatgacctacagtgctgtgt

SEQ ID NO: 1702956 - DNA, 14 bp, Homo sapiens
agatgactctctcc

SEQ ID NO: 1702957 - DNA, 15 bp, Homo sapiens
agatgagattggcat

SEQ ID NO: 1702958 - DNA, 19 bp, Homo sapiens
agatgagatttgccagcac

SEQ ID NO: 1702959 - DNA, 16 bp, Homo sapiens
agatgagggtgactgt

SEQ ID NO: 1702960 - DNA, 21 bp, Homo sapiens
agatgagtaaaggagtaagaa

SEQ ID NO: 1702961 - DNA, 20 bp, Homo sapiens
agatgataaaagagaagcca

SEQ ID NO: 1702962 - DNA, 24 bp, Homo sapiens
agatgatacttccaagtgataatt

SEQ ID NO: 1702963 - DNA, 16 bp, Homo sapiens
agatgatctactcaga

SEQ ID NO: 1702964 - DNA, 18 bp, Homo sapiens
agatgattaaataagatt

SEQ ID NO: 1702965 - DNA, 19 bp, Homo sapiens
agatgattaaataagattc

SEQ ID NO: 1702966 - DNA, 22 bp, Homo sapiens
agatgattaaataagattctaa

SEQ ID NO: 1702967 - DNA, 14 bp, Homo sapiens
agatgatttggtca

SEQ ID NO: 1702968 - DNA, 17 bp, Homo sapiens
agatgattttttgaaag

SEQ ID NO: 1702969 - DNA, 14 bp, Homo sapiens
agatgcaattgttt

SEQ ID NO: 1702970 - DNA, 19 bp, Homo sapiens
agatgcacgtggggcccac

SEQ ID NO: 1702971 - DNA, 22 bp, Homo sapiens
agatgcacgtggggcccactgc

SEQ ID NO: 1702972 - DNA, 17 bp, Homo sapiens
agatgcaggtgatgcca

SEQ ID NO: 1702973 - DNA, 14 bp, Homo sapiens
agatgcatttggaa

SEQ ID NO: 1702974 - DNA, 22 bp, Homo sapiens
agatgccacttctcactcacca

SEQ ID NO: 1702975 - DNA, 17 bp, Homo sapiens
agatgccagcttctctc

SEQ ID NO: 1702976 - DNA, 17 bp, Homo sapiens
agatgccatggcctgtg

SEQ ID NO: 1702977 - DNA, 13 bp, Homo sapiens
agatgccattttg

SEQ ID NO: 1702978 - DNA, 22 bp, Homo sapiens
agatgccattttgtacatgtat

SEQ ID NO: 1702979 - DNA, 19 bp, Homo sapiens
agatgccccctccaggaga

SEQ ID NO: 1702980 - DNA, 21 bp, Homo sapiens
agatgccccctccaggagaga

SEQ ID NO: 1702981 - DNA, 22 bp, Homo sapiens
agatgctccaagattctagatg

SEQ ID NO: 1702982 - DNA, 19 bp, Homo sapiens
agatgctccagcaacacag

SEQ ID NO: 1702983 - DNA, 16 bp, Homo sapiens
agatgctgaggcccct

SEQ ID NO: 1702984 - DNA, 21 bp, Homo sapiens
agatgctgaggcccctaggtg

SEQ ID NO: 1702985 - DNA, 20 bp, Homo sapiens
agatgctgatggagccttcc

SEQ ID NO: 1702986 - DNA, 17 bp, Homo sapiens
agatgctggcccagggc

SEQ ID NO: 1702987 - DNA, 17 bp, Homo sapiens
agatgctgtcggcacca

SEQ ID NO: 1702988 - DNA, 16 bp, Homo sapiens
agatgctgtgagtctt

SEQ ID NO: 1702989 - DNA, 19 bp, Homo sapiens
agatgctgtgtatatggta

SEQ ID NO: 1702990 - DNA, 14 bp, Homo sapiens
agatgcttggagca

SEQ ID NO: 1702991 - DNA, 18 bp, Homo sapiens
agatgcttggagcaatca

SEQ ID NO: 1702992 - DNA, 19 bp, Homo sapiens
agatgcttggagcaatcag

SEQ ID NO: 1702993 - DNA, 21 bp, Homo sapiens
agatggaaaaataacaactat

SEQ ID NO: 1702994 - DNA, 18 bp, Homo sapiens
agatggaagcttgttgaa

SEQ ID NO: 1702995 - DNA, 21 bp, Homo sapiens
agatggaaggccttttgcccg

SEQ ID NO: 1702996 - DNA, 23 bp, Homo sapiens
agatggaagttgcagtgagctga

SEQ ID NO: 1702997 - DNA, 23 bp, Homo sapiens
agatggacacgagccacaagctg

SEQ ID NO: 1702998 - DNA, 18 bp, Homo sapiens
agatggaccccagcattt

SEQ ID NO: 1702999 - DNA, 15 bp, Homo sapiens
agatggactctgaaa

SEQ ID NO: 1703000 - DNA, 19 bp, Homo sapiens
agatggagacaccctctgg

SEQ ID NO: 1703001 - DNA, 13 bp, Homo sapiens
agatggagaggct

SEQ ID NO: 1703002 - DNA, 17 bp, Homo sapiens
agatggagaggctgagg

SEQ ID NO: 1703003 - DNA, 17 bp, Homo sapiens
agatggagggcttggcc

SEQ ID NO: 1703004 - DNA, 21 bp, Homo sapiens
agatggaggtttccttttgga

SEQ ID NO: 1703005 - DNA, 13 bp, Homo sapiens
agatggagtccct

SEQ ID NO: 1703006 - DNA, 13 bp, Homo sapiens
agatggagtttct

SEQ ID NO: 1703007 - DNA, 20 bp, Homo sapiens
agatggataaactgagcctc

SEQ ID NO: 1703008 - DNA, 13 bp, Homo sapiens
agatggattctcc

SEQ ID NO: 1703009 - DNA, 15 bp, Homo sapiens
agatggatttgcctg

SEQ ID NO: 1703010 - DNA, 14 bp, Homo sapiens
agatggcactttga

SEQ ID NO: 1703011 - DNA, 16 bp, Homo sapiens
agatggctgctgcctg

SEQ ID NO: 1703012 - DNA, 21 bp, Homo sapiens
agatggctgtggcatttccaa

SEQ ID NO: 1703013 - DNA, 23 bp, Homo sapiens
agatggctgtggcatttccaaac

SEQ ID NO: 1703014 - DNA, 23 bp, Homo sapiens
agatgggaaggttagaaaggcag

SEQ ID NO: 1703015 - DNA, 13 bp, Homo sapiens
agatgggaatgag

SEQ ID NO: 1703016 - DNA, 20 bp, Homo sapiens
agatgggacaagcagtccct

SEQ ID NO: 1703017 - DNA, 15 bp, Homo sapiens
agatgggacagcaac

SEQ ID NO: 1703018 - DNA, 17 bp, Homo sapiens
agatgggacagcaacaa

SEQ ID NO: 1703019 - DNA, 20 bp, Homo sapiens
agatgggcatcttttgtatt

SEQ ID NO: 1703020 - DNA, 16 bp, Homo sapiens
agatgggcttgttttc

SEQ ID NO: 1703021 - DNA, 22 bp, Homo sapiens
agatgggggcagggctgtgctt

SEQ ID NO: 1703022 - DNA, 16 bp, Homo sapiens
agatgggtccctggcc

SEQ ID NO: 1703023 - DNA, 20 bp, Homo sapiens
agatgggtctgatattaatc

SEQ ID NO: 1703024 - DNA, 17 bp, Homo sapiens
agatgggtgatatataa

SEQ ID NO: 1703025 - DNA, 14 bp, Homo sapiens
agatggtcagtgtg

SEQ ID NO: 1703026 - DNA, 15 bp, Homo sapiens
agatggtcatccaga

SEQ ID NO: 1703027 - DNA, 19 bp, Homo sapiens
agatggtccatttgttcct

SEQ ID NO: 1703028 - DNA, 20 bp, Homo sapiens
agatggtccatttgttcctg

SEQ ID NO: 1703029 - DNA, 20 bp, Homo sapiens
agatggtgaagcattctccc

SEQ ID NO: 1703030 - DNA, 22 bp, Homo sapiens
agatggtgaagcattctcccca

SEQ ID NO: 1703031 - DNA, 22 bp, Homo sapiens
agatggtgaggctgtcagtgta

SEQ ID NO: 1703032 - DNA, 21 bp, Homo sapiens
agatggtttatgcatgtatat

SEQ ID NO: 1703033 - DNA, 11 bp, Homo sapiens
agatggtttcc

SEQ ID NO: 1703034 - DNA, 13 bp, Homo sapiens
agatgtactgcaa

SEQ ID NO: 1703035 - DNA, 19 bp, Homo sapiens
agatgtagataaactcaga

SEQ ID NO: 1703036 - DNA, 20 bp, Homo sapiens
agatgtaggggaagagatgt

SEQ ID NO: 1703037 - DNA, 12 bp, Homo sapiens
agatgtatcctt

SEQ ID NO: 1703038 - DNA, 13 bp, Homo sapiens
agatgtatttttg

SEQ ID NO: 1703039 - DNA, 15 bp, Homo sapiens
agatgtcagactggc

SEQ ID NO: 1703040 - DNA, 18 bp, Homo sapiens
agatgtcagccgagccgg

SEQ ID NO: 1703041 - DNA, 21 bp, Homo sapiens
agatgtccctttcttggccag

SEQ ID NO: 1703042 - DNA, 22 bp, Homo sapiens
agatgtccctttcttggccagt

SEQ ID NO: 1703043 - DNA, 20 bp, Homo sapiens
agatgtccgtctctcttgct

SEQ ID NO: 1703044 - DNA, 18 bp, Homo sapiens
agatgtctaatagttatt

SEQ ID NO: 1703045 - DNA, 15 bp, Homo sapiens
agatgtctttaggca

SEQ ID NO: 1703046 - DNA, 23 bp, Homo sapiens
agatgtctttaggcagcagcttt

SEQ ID NO: 1703047 - DNA, 15 bp, Homo sapiens
agatgtgaaaattac

SEQ ID NO: 1703048 - DNA, 14 bp, Homo sapiens
agatgtgaattatt

SEQ ID NO: 1703049 - DNA, 22 bp, Homo sapiens
agatgtgaattattgacactga

SEQ ID NO: 1703050 - DNA, 17 bp, Homo sapiens
agatgtgataaggatca

SEQ ID NO: 1703051 - DNA, 20 bp, Homo sapiens
ctgctgttgccatagcccca

SEQ ID NO: 1703052 - DNA, 21 bp, Homo sapiens
ctgctgttggtcctctctctg

SEQ ID NO: 1703053 - DNA, 22 bp, Homo sapiens
ctgctgttggtcctctctctgt

SEQ ID NO: 1703054 - DNA, 23 bp, Homo sapiens
ctgcttaatcttcaaagccttct

SEQ ID NO: 1703055 - DNA, 18 bp, Homo sapiens
ctgcttacccttcacctt

SEQ ID NO: 1703056 - DNA, 20 bp, Homo sapiens
ctgcttagctgccttgagct

SEQ ID NO: 1703057 - DNA, 14 bp, Homo sapiens
ctgcttcaaatatt

SEQ ID NO: 1703058 - DNA, 19 bp, Homo sapiens
ctgcttcaaatatttccct

SEQ ID NO: 1703059 - DNA, 13 bp, Homo sapiens
ctgcttcacttcc

SEQ ID NO: 1703060 - DNA, 19 bp, Homo sapiens
ctgcttcagtgtatggaaa

SEQ ID NO: 1703061 - DNA, 17 bp, Homo sapiens
ctgcttccaggctgggc

SEQ ID NO: 1703062 - DNA, 16 bp, Homo sapiens
ctgcttcccactgggg

SEQ ID NO: 1703063 - DNA, 12 bp, Homo sapiens
ctgcttcccaga

SEQ ID NO: 1703064 - DNA, 15 bp, Homo sapiens
ctgcttccctgttga

SEQ ID NO: 1703065 - DNA, 15 bp, Homo sapiens
ctgcttcccttactt

SEQ ID NO: 1703066 - DNA, 15 bp, Homo sapiens
ctgcttcctcctgga

SEQ ID NO: 1703067 - DNA, 18 bp, Homo sapiens
ctgcttcctcctggaaat

SEQ ID NO: 1703068 - DNA, 13 bp, Homo sapiens
ctgcttcctgtga

SEQ ID NO: 1703069 - DNA, 12 bp, Homo sapiens
ctgcttccttca

SEQ ID NO: 1703070 - DNA, 17 bp, Homo sapiens
ctgcttctccacctccc

SEQ ID NO: 1703071 - DNA, 19 bp, Homo sapiens
ctgcttctccacctccccc

SEQ ID NO: 1703072 - DNA, 20 bp, Homo sapiens
ctgcttctccacctccccca

SEQ ID NO: 1703073 - DNA, 15 bp, Homo sapiens
ctgcttctctgactt

SEQ ID NO: 1703074 - DNA, 18 bp, Homo sapiens
ctgcttctgctgccctga

SEQ ID NO: 1703075 - DNA, 16 bp, Homo sapiens
ctgcttcttcttccaa

SEQ ID NO: 1703076 - DNA, 18 bp, Homo sapiens
ctgcttgacagactcaag

SEQ ID NO: 1703077 - DNA, 17 bp, Homo sapiens
ctgcttgacctagctct

SEQ ID NO: 1703078 - DNA, 19 bp, Homo sapiens
ctgcttgagggagaatcct

SEQ ID NO: 1703079 - DNA, 20 bp, Homo sapiens
ctgcttgagttcccagatgg

SEQ ID NO: 1703080 - DNA, 17 bp, Homo sapiens
ctgcttgagttgcctga

SEQ ID NO: 1703081 - DNA, 13 bp, Homo sapiens
ctgcttgattttt

SEQ ID NO: 1703082 - DNA, 17 bp, Homo sapiens
ctgcttgcacacttccc

SEQ ID NO: 1703083 - DNA, 20 bp, Homo sapiens
ctgcttgccgactggctgtg

SEQ ID NO: 1703084 - DNA, 22 bp, Homo sapiens
ctgctttagtttcacattgcag

SEQ ID NO: 1703085 - DNA, 23 bp, Homo sapiens
ctgctttagtttcacattgcagt

SEQ ID NO: 1703086 - DNA, 15 bp, Homo sapiens
ctgctttcacttaag

SEQ ID NO: 1703087 - DNA, 21 bp, Homo sapiens
ctgctttcacttaagtgtctg

SEQ ID NO: 1703088 - DNA, 18 bp, Homo sapiens
ctgctttccagcctgggc

SEQ ID NO: 1703089 - DNA, 18 bp, Homo sapiens
ctgctttcccctgtgggg

SEQ ID NO: 1703090 - DNA, 18 bp, Homo sapiens
ctgctttcgtccatgttt

SEQ ID NO: 1703091 - DNA, 14 bp, Homo sapiens
ctgctttctccttt

SEQ ID NO: 1703092 - DNA, 22 bp, Homo sapiens
ctgctttgattggttgtgcctt

SEQ ID NO: 1703093 - DNA, 14 bp, Homo sapiens
ctgctttgcaaaga

SEQ ID NO: 1703094 - DNA, 22 bp, Homo sapiens
ctgctttgccaagttgctgtca

SEQ ID NO: 1703095 - DNA, 23 bp, Homo sapiens
ctgctttgccaagttgctgtcac

SEQ ID NO: 1703096 - DNA, 18 bp, Homo sapiens
ctgctttgcgctggtgga

SEQ ID NO: 1703097 - DNA, 16 bp, Homo sapiens
ctgctttgggctgccc

SEQ ID NO: 1703098 - DNA, 18 bp, Homo sapiens
ctgctttgggctgccctg

SEQ ID NO: 1703099 - DNA, 22 bp, Homo sapiens
ctgctttgggctgccctggtgc

SEQ ID NO: 1703100 - DNA, 23 bp, Homo sapiens
ctgcttttaactttataaatcca

SEQ ID NO: 1703101 - DNA, 17 bp, Homo sapiens
ctgcttttaccatgccc

SEQ ID NO: 1703102 - DNA, 12 bp, Homo sapiens
ctgcttttccac

SEQ ID NO: 1703103 - DNA, 19 bp, Homo sapiens
ctgcttttccacaaggaat

SEQ ID NO: 1703104 - DNA, 20 bp, Homo sapiens
ctgcttttccaggatcctgc

SEQ ID NO: 1703105 - DNA, 22 bp, Homo sapiens
ctgcttttccaggatcctgcag

SEQ ID NO: 1703106 - DNA, 16 bp, Homo sapiens
ctgcttttctgccctg

SEQ ID NO: 1703107 - DNA, 19 bp, Homo sapiens
ctgcttttctgccctggct

SEQ ID NO: 1703108 - DNA, 21 bp, Homo sapiens
ctgcttttcttaagtgcccac

SEQ ID NO: 1703109 - DNA, 18 bp, Homo sapiens
ctgctttttggaaagtca

SEQ ID NO: 1703110 - DNA, 20 bp, Homo sapiens
ctgctttttggaaagtcaga

SEQ ID NO: 1703111 - DNA, 17 bp, Homo sapiens
ctgctttttttcttaaa

SEQ ID NO: 1703112 - DNA, 17 bp, Homo sapiens
ctgcttttttttttcca

SEQ ID NO: 1703113 - DNA, 19 bp, Homo sapiens
ctgcttttttttttccagc

SEQ ID NO: 1703114 - DNA, 15 bp, Homo sapiens
ctggaaaaaaataca

SEQ ID NO: 1703115 - DNA, 17 bp, Homo sapiens
ctggaaaacagaacact

SEQ ID NO: 1703116 - DNA, 22 bp, Homo sapiens
ctggaaaagaagaaactttgcc

SEQ ID NO: 1703117 - DNA, 17 bp, Homo sapiens
ctggaaacagcatgaat

SEQ ID NO: 1703118 - DNA, 16 bp, Homo sapiens
ctggaaacccacctct

SEQ ID NO: 1703119 - DNA, 17 bp, Homo sapiens
ctggaaaggatctgtga

SEQ ID NO: 1703120 - DNA, 13 bp, Homo sapiens
ctggaaaggctca

SEQ ID NO: 1703121 - DNA, 15 bp, Homo sapiens
ctggaaaggctcagt

SEQ ID NO: 1703122 - DNA, 23 bp, Homo sapiens
ctggaaaggctcagtctcaggag

SEQ ID NO: 1703123 - DNA, 17 bp, Homo sapiens
ctggaaaggggagagcc

SEQ ID NO: 1703124 - DNA, 22 bp, Homo sapiens
ctggaaaggggagagcctgctg

SEQ ID NO: 1703125 - DNA, 23 bp, Homo sapiens
ctggaaagttgggcccctgagga

SEQ ID NO: 1703126 - DNA, 23 bp, Homo sapiens
ctggaaatatcagttactcagcc

SEQ ID NO: 1703127 - DNA, 14 bp, Homo sapiens
ctggaaatccagat

SEQ ID NO: 1703128 - DNA, 17 bp, Homo sapiens
ctggaaatgatgttggt

SEQ ID NO: 1703129 - DNA, 20 bp, Homo sapiens
ctggaaatgtagcacttacg

SEQ ID NO: 1703130 - DNA, 17 bp, Homo sapiens
ctggaacaaattatttt

SEQ ID NO: 1703131 - DNA, 19 bp, Homo sapiens
ctggaacaaattatttttg

SEQ ID NO: 1703132 - DNA, 18 bp, Homo sapiens
ctggaacaacttgtagca

SEQ ID NO: 1703133 - DNA, 23 bp, Homo sapiens
ctggaacatgggcattgggttct

SEQ ID NO: 1703134 - DNA, 17 bp, Homo sapiens
ctggaaccacctggacg

SEQ ID NO: 1703135 - DNA, 14 bp, Homo sapiens
ctggaaccagagcc

SEQ ID NO: 1703136 - DNA, 14 bp, Homo sapiens
ctggaaccagggag

SEQ ID NO: 1703137 - DNA, 19 bp, Homo sapiens
ctggaaccagggaggagag

SEQ ID NO: 1703138 - DNA, 13 bp, Homo sapiens
ctggaacccagac

SEQ ID NO: 1703139 - DNA, 18 bp, Homo sapiens
ctggaacccagactcaga

SEQ ID NO: 1703140 - DNA, 19 bp, Homo sapiens
ctggaacccagactcagac

SEQ ID NO: 1703141 - DNA, 17 bp, Homo sapiens
ctggaaccgggaagggt

SEQ ID NO: 1703142 - DNA, 18 bp, Homo sapiens
ctggaaccgggaagggtg

SEQ ID NO: 1703143 - DNA, 22 bp, Homo sapiens
ctggaaccgggaagggtggcct

SEQ ID NO: 1703144 - DNA, 23 bp, Homo sapiens
ctggaacctcagcctggccagac

SEQ ID NO: 1703145 - DNA, 16 bp, Homo sapiens
ctggaacggtgaaggt

SEQ ID NO: 1703146 - DNA, 12 bp, Homo sapiens
ctggaagaaaaa

SEQ ID NO: 1703147 - DNA, 14 bp, Homo sapiens
ctggaagaaagcaa

SEQ ID NO: 1703148 - DNA, 15 bp, Homo sapiens
ctggaagaacaggcc

SEQ ID NO: 1703149 - DNA, 13 bp, Homo sapiens
ctggaagactgtg

SEQ ID NO: 1703150 - DNA, 22 bp, Homo sapiens
ctggaagagcccagtctgttga

SEQ ID NO: 1703151 - DNA, 14 bp, Homo sapiens
ctggaagcagagca

SEQ ID NO: 1703152 - DNA, 14 bp, Homo sapiens
ctggaagcaggtgc

SEQ ID NO: 1703153 - DNA, 23 bp, Homo sapiens
ctggaagcatgtaggagaatcca

SEQ ID NO: 1703154 - DNA, 21 bp, Homo sapiens
ctggaagcccagcccctactg

SEQ ID NO: 1703155 - DNA, 20 bp, Homo sapiens
ctggaagcccctgggcccag

SEQ ID NO: 1703156 - DNA, 12 bp, Homo sapiens
ctggaagcctgc

SEQ ID NO: 1703157 - DNA, 18 bp, Homo sapiens
ctggaagctctccgagct

SEQ ID NO: 1703158 - DNA, 15 bp, Homo sapiens
ctggaagctggaaga

SEQ ID NO: 1703159 - DNA, 12 bp, Homo sapiens
ctggaagctgtg

SEQ ID NO: 1703160 - DNA, 16 bp, Homo sapiens
ctggaagctgtgtcct

SEQ ID NO: 1703161 - DNA, 22 bp, Homo sapiens
ctggaagctgtgtccttgcacc

SEQ ID NO: 1703162 - DNA, 12 bp, Homo sapiens
ctggaaggagca

SEQ ID NO: 1703163 - DNA, 18 bp, Homo sapiens
ctggaaggagcacatact

SEQ ID NO: 1703164 - DNA, 19 bp, Homo sapiens
ctggaaggcagggcagagg

SEQ ID NO: 1703165 - DNA, 13 bp, Homo sapiens
ctggaaggctggc

SEQ ID NO: 1703166 - DNA, 19 bp, Homo sapiens
ctggaaggctggctgagtg

SEQ ID NO: 1703167 - DNA, 15 bp, Homo sapiens
agatgtgatattcta

SEQ ID NO: 1703168 - DNA, 17 bp, Homo sapiens
agatgtgatattctaag

SEQ ID NO: 1703169 - DNA, 18 bp, Homo sapiens
agatgtgatattctaaga

SEQ ID NO: 1703170 - DNA, 19 bp, Homo sapiens
agatgtgatattctaagac

SEQ ID NO: 1703171 - DNA, 17 bp, Homo sapiens
agatgtgcaataatttg

SEQ ID NO: 1703172 - DNA, 19 bp, Homo sapiens
agatgtgcaataatttgta

SEQ ID NO: 1703173 - DNA, 22 bp, Homo sapiens
agatgtgcaataatttgtacaa

SEQ ID NO: 1703174 - DNA, 20 bp, Homo sapiens
agatgtgggccaccattgca

SEQ ID NO: 1703175 - DNA, 22 bp, Homo sapiens
agatgtggggctgagctgggga

SEQ ID NO: 1703176 - DNA, 16 bp, Homo sapiens
agatgtgtaaacaggt

SEQ ID NO: 1703177 - DNA, 20 bp, Homo sapiens
agatgtgtaaacaggtattt

SEQ ID NO: 1703178 - DNA, 22 bp, Homo sapiens
agatgtgtccatgtgaaattta

SEQ ID NO: 1703179 - DNA, 15 bp, Homo sapiens
agatgtgttcttatt

SEQ ID NO: 1703180 - DNA, 12 bp, Homo sapiens
agatgttaaaaa

SEQ ID NO: 1703181 - DNA, 23 bp, Homo sapiens
agatgttacaagtttatatatat

SEQ ID NO: 1703182 - DNA, 17 bp, Homo sapiens
agatgttagatcagggg

SEQ ID NO: 1703183 - DNA, 17 bp, Homo sapiens
agatgttattactgttt

SEQ ID NO: 1703184 - DNA, 14 bp, Homo sapiens
agatgttgccatgt

SEQ ID NO: 1703185 - DNA, 20 bp, Homo sapiens
agatgttgcttttgaaaagt

SEQ ID NO: 1703186 - DNA, 19 bp, Homo sapiens
agatgtttattcttctaga

SEQ ID NO: 1703187 - DNA, 14 bp, Homo sapiens
agatgtttcacacc

SEQ ID NO: 1703188 - DNA, 21 bp, Homo sapiens
agatgtttccagacttccttg

SEQ ID NO: 1703189 - DNA, 17 bp, Homo sapiens
agatgtttgtcagatat

SEQ ID NO: 1703190 - DNA, 24 bp, Homo sapiens
agatgtttgtcagatatgatatgt

SEQ ID NO: 1703191 - DNA, 11 bp, Homo sapiens
agatgttttag

SEQ ID NO: 1703192 - DNA, 23 bp, Homo sapiens
agatgttttagagttaacaatga

SEQ ID NO: 1703193 - DNA, 16 bp, Homo sapiens
agatgttttgtataaa

SEQ ID NO: 1703194 - DNA, 19 bp, Homo sapiens
agatgtttttaattctagt

SEQ ID NO: 1703195 - DNA, 12 bp, Homo sapiens
agattaaaggaa

SEQ ID NO: 1703196 - DNA, 15 bp, Homo sapiens
agattaagagcaaat

SEQ ID NO: 1703197 - DNA, 21 bp, Homo sapiens
agattaatctaccttgcagtg

SEQ ID NO: 1703198 - DNA, 14 bp, Homo sapiens
agattactgatgtg

SEQ ID NO: 1703199 - DNA, 23 bp, Homo sapiens
agattactgatgtgatattctgt

SEQ ID NO: 1703200 - DNA, 23 bp, Homo sapiens
agattacttaaataatttgggtg

SEQ ID NO: 1703201 - DNA, 15 bp, Homo sapiens
agattagaagctgaa

SEQ ID NO: 1703202 - DNA, 17 bp, Homo sapiens
agattaggcacacagat

SEQ ID NO: 1703203 - DNA, 20 bp, Homo sapiens
agattaggtagactttgctt

SEQ ID NO: 1703204 - DNA, 18 bp, Homo sapiens
agattaggtttgtcccag

SEQ ID NO: 1703205 - DNA, 15 bp, Homo sapiens
agattataatatgtg

SEQ ID NO: 1703206 - DNA, 14 bp, Homo sapiens
agattatagattct

SEQ ID NO: 1703207 - DNA, 18 bp, Homo sapiens
agattatagattctaaag

SEQ ID NO: 1703208 - DNA, 17 bp, Homo sapiens
agattatgatgcataca

SEQ ID NO: 1703209 - DNA, 20 bp, Homo sapiens
agattatgatgcatacagtt

SEQ ID NO: 1703210 - DNA, 17 bp, Homo sapiens
agattatgttcctgctg

SEQ ID NO: 1703211 - DNA, 19 bp, Homo sapiens
agattattgtgacttcact

SEQ ID NO: 1703212 - DNA, 21 bp, Homo sapiens
agattattgtgacttcactgt

SEQ ID NO: 1703213 - DNA, 23 bp, Homo sapiens
agattattgtgacttcactgtat

SEQ ID NO: 1703214 - DNA, 16 bp, Homo sapiens
agattatttcattcgt

SEQ ID NO: 1703215 - DNA, 21 bp, Homo sapiens
agattcaaagcccaactgtgg

SEQ ID NO: 1703216 - DNA, 14 bp, Homo sapiens
agattcaaaggttc

SEQ ID NO: 1703217 - DNA, 17 bp, Homo sapiens
agattcaagtagttttg

SEQ ID NO: 1703218 - DNA, 21 bp, Homo sapiens
agattcactgtcttttgattc

SEQ ID NO: 1703219 - DNA, 15 bp, Homo sapiens
agattcaggccagcc

SEQ ID NO: 1703220 - DNA, 18 bp, Homo sapiens
agattcaggccagcccag

SEQ ID NO: 1703221 - DNA, 23 bp, Homo sapiens
agattcaggccagcccagccagg

SEQ ID NO: 1703222 - DNA, 19 bp, Homo sapiens
agattcaggtatgttgcct

SEQ ID NO: 1703223 - DNA, 15 bp, Homo sapiens
agattcataaataca

SEQ ID NO: 1703224 - DNA, 16 bp, Homo sapiens
agattcatatttactt

SEQ ID NO: 1703225 - DNA, 19 bp, Homo sapiens
agattcatatttacttctt

SEQ ID NO: 1703226 - DNA, 17 bp, Homo sapiens
agattcatttttctttc

SEQ ID NO: 1703227 - DNA, 21 bp, Homo sapiens
agattccagagagtggctcct

SEQ ID NO: 1703228 - DNA, 20 bp, Homo sapiens
agattccattggtccaagat

SEQ ID NO: 1703229 - DNA, 21 bp, Homo sapiens
agattccattggtccaagatt

SEQ ID NO: 1703230 - DNA, 13 bp, Homo sapiens
agattcccagaga

SEQ ID NO: 1703231 - DNA, 13 bp, Homo sapiens
agattcccagagc

SEQ ID NO: 1703232 - DNA, 15 bp, Homo sapiens
agattcccctgtgtc

SEQ ID NO: 1703233 - DNA, 23 bp, Homo sapiens
agattccggatcctaagcatcta

SEQ ID NO: 1703234 - DNA, 13 bp, Homo sapiens
agattcctgggcc

SEQ ID NO: 1703235 - DNA, 15 bp, Homo sapiens
agattcctgggcctg

SEQ ID NO: 1703236 - DNA, 17 bp, Homo sapiens
agattcctgggcctgtc

SEQ ID NO: 1703237 - DNA, 11 bp, Homo sapiens
agattctaaag

SEQ ID NO: 1703238 - DNA, 13 bp, Homo sapiens
agattctaaagct

SEQ ID NO: 1703239 - DNA, 12 bp, Homo sapiens
agattctaaagg

SEQ ID NO: 1703240 - DNA, 19 bp, Homo sapiens
agattctactcttgtcatt

SEQ ID NO: 1703241 - DNA, 15 bp, Homo sapiens
agattctatagttct

SEQ ID NO: 1703242 - DNA, 20 bp, Homo sapiens
agattctctttaaaaaagac

SEQ ID NO: 1703243 - DNA, 21 bp, Homo sapiens
agattctgcctatgtaaaatg

SEQ ID NO: 1703244 - DNA, 19 bp, Homo sapiens
agattctggatctcctgct

SEQ ID NO: 1703245 - DNA, 20 bp, Homo sapiens
agattctggatctcctgctg

SEQ ID NO: 1703246 - DNA, 19 bp, Homo sapiens
agattctgtgtcagagccc

SEQ ID NO: 1703247 - DNA, 13 bp, Homo sapiens
agattcttaattc

SEQ ID NO: 1703248 - DNA, 13 bp, Homo sapiens
agattcttctgtg

SEQ ID NO: 1703249 - DNA, 19 bp, Homo sapiens
agattctttaaggagatag

SEQ ID NO: 1703250 - DNA, 14 bp, Homo sapiens
agattgaaaatctt

SEQ ID NO: 1703251 - DNA, 15 bp, Homo sapiens
agattgacgacaagt

SEQ ID NO: 1703252 - DNA, 13 bp, Homo sapiens
agattgagaaatg

SEQ ID NO: 1703253 - DNA, 16 bp, Homo sapiens
agattgagaaatgtgt

SEQ ID NO: 1703254 - DNA, 13 bp, Homo sapiens
agattgagaagcc

SEQ ID NO: 1703255 - DNA, 14 bp, Homo sapiens
agattgagaagcca

SEQ ID NO: 1703256 - DNA, 16 bp, Homo sapiens
agattgattgtattgt

SEQ ID NO: 1703257 - DNA, 12 bp, Homo sapiens
agattgcaaagc

SEQ ID NO: 1703258 - DNA, 22 bp, Homo sapiens
agattgctgtgtgttgcctggg

SEQ ID NO: 1703259 - DNA, 14 bp, Homo sapiens
agattgcttctgta

SEQ ID NO: 1703260 - DNA, 15 bp, Homo sapiens
agattggttttcctg

SEQ ID NO: 1703261 - DNA, 24 bp, Homo sapiens
agattgtggtgggccctgagtcct

SEQ ID NO: 1703262 - DNA, 20 bp, Homo sapiens
agattgtgtacatagagcaa

SEQ ID NO: 1703263 - DNA, 14 bp, Homo sapiens
agattgttaaaata

SEQ ID NO: 1703264 - DNA, 17 bp, Homo sapiens
agattgttggtgaattt

SEQ ID NO: 1703265 - DNA, 20 bp, Homo sapiens
agattgttggtgaattttca

SEQ ID NO: 1703266 - DNA, 19 bp, Homo sapiens
agatttaagccttacaaag

SEQ ID NO: 1703267 - DNA, 22 bp, Homo sapiens
agatttaagtgaatacattaac

SEQ ID NO: 1703268 - DNA, 16 bp, Homo sapiens
agatttatcaaatcag

SEQ ID NO: 1703269 - DNA, 13 bp, Homo sapiens
agatttattgtaa

SEQ ID NO: 1703270 - DNA, 23 bp, Homo sapiens
agatttcatctgctctccttcct

SEQ ID NO: 1703271 - DNA, 13 bp, Homo sapiens
agatttcctccat

SEQ ID NO: 1703272 - DNA, 17 bp, Homo sapiens
agatttcctccatggtg

SEQ ID NO: 1703273 - DNA, 17 bp, Homo sapiens
agatttctggcatatgt

SEQ ID NO: 1703274 - DNA, 13 bp, Homo sapiens
agatttctggttg

SEQ ID NO: 1703275 - DNA, 15 bp, Homo sapiens
agatttctggttgat

SEQ ID NO: 1703276 - DNA, 16 bp, Homo sapiens
agatttctggttgatt

SEQ ID NO: 1703277 - DNA, 11 bp, Homo sapiens
agatttctgtt

SEQ ID NO: 1703278 - DNA, 12 bp, Homo sapiens
agatttctgttc

SEQ ID NO: 1703279 - DNA, 14 bp, Homo sapiens
agatttctgttcag

SEQ ID NO: 1703280 - DNA, 20 bp, Homo sapiens
agatttcttctctttagtat

SEQ ID NO: 1703281 - DNA, 16 bp, Homo sapiens
agatttggagcactct

SEQ ID NO: 1703282 - DNA, 17 bp, Homo sapiens
agatttggcatctcctg

SEQ ID NO: 1703283 - DNA, 21 bp, Homo sapiens
agatttgtccttttatttctc

SEQ ID NO: 1703284 - DNA, 23 bp, Homo sapiens
ctggaagggaggaaggcctttct

SEQ ID NO: 1703285 - DNA, 16 bp, Homo sapiens
ctggaaggggcagcag

SEQ ID NO: 1703286 - DNA, 15 bp, Homo sapiens
ctggaaggtctgatc

SEQ ID NO: 1703287 - DNA, 18 bp, Homo sapiens
ctggaataaagttgcaga

SEQ ID NO: 1703288 - DNA, 23 bp, Homo sapiens
ctggaataaagttgcagatgatt

SEQ ID NO: 1703289 - DNA, 20 bp, Homo sapiens
ctggaatataaaacagtcat

SEQ ID NO: 1703290 - DNA, 18 bp, Homo sapiens
ctggaatctggagaccag

SEQ ID NO: 1703291 - DNA, 14 bp, Homo sapiens
ctggaatgcagtga

SEQ ID NO: 1703292 - DNA, 15 bp, Homo sapiens
ctggaatgtaatcaa

SEQ ID NO: 1703293 - DNA, 20 bp, Homo sapiens
ctggaatgtaatcaatgttt

SEQ ID NO: 1703294 - DNA, 21 bp, Homo sapiens
ctggaatgtaatcaatgtttc

SEQ ID NO: 1703295 - DNA, 16 bp, Homo sapiens
ctggaattcagcaccc

SEQ ID NO: 1703296 - DNA, 22 bp, Homo sapiens
ctggaattcagcaccctgggtg

SEQ ID NO: 1703297 - DNA, 23 bp, Homo sapiens
ctggaattcagcaccctgggtgc

SEQ ID NO: 1703298 - DNA, 19 bp, Homo sapiens
ctggaattccacagggacc

SEQ ID NO: 1703299 - DNA, 18 bp, Homo sapiens
ctggaattgccagctgac

SEQ ID NO: 1703300 - DNA, 14 bp, Homo sapiens
ctggaatttttccc

SEQ ID NO: 1703301 - DNA, 14 bp, Homo sapiens
ctggacacagctct

SEQ ID NO: 1703302 - DNA, 16 bp, Homo sapiens
ctggacaccctctgcc

SEQ ID NO: 1703303 - DNA, 16 bp, Homo sapiens
ctggacactcagacct

SEQ ID NO: 1703304 - DNA, 17 bp, Homo sapiens
ctggacactcagacctg

SEQ ID NO: 1703305 - DNA, 19 bp, Homo sapiens
ctggacactctatatgtag

SEQ ID NO: 1703306 - DNA, 13 bp, Homo sapiens
ctggacagcccca

SEQ ID NO: 1703307 - DNA, 17 bp, Homo sapiens
ctggacagctttgctcc

SEQ ID NO: 1703308 - DNA, 20 bp, Homo sapiens
ctggacaggctctgcttctc

SEQ ID NO: 1703309 - DNA, 18 bp, Homo sapiens
ctggacagtacctgattg

SEQ ID NO: 1703310 - DNA, 20 bp, Homo sapiens
ctggacagtacctgattgta

SEQ ID NO: 1703311 - DNA, 16 bp, Homo sapiens
ctggacagtatcccac

SEQ ID NO: 1703312 - DNA, 18 bp, Homo sapiens
ctggacagtatcccacat

SEQ ID NO: 1703313 - DNA, 15 bp, Homo sapiens
ctggacatgaaggaa

SEQ ID NO: 1703314 - DNA, 22 bp, Homo sapiens
ctggacatgagatggagaggct

SEQ ID NO: 1703315 - DNA, 17 bp, Homo sapiens
ctggacattctctttga

SEQ ID NO: 1703316 - DNA, 22 bp, Homo sapiens
ctggaccaccagccccagcaag

SEQ ID NO: 1703317 - DNA, 14 bp, Homo sapiens
ctggaccactgggc

SEQ ID NO: 1703318 - DNA, 17 bp, Homo sapiens
ctggacccttataaaat

SEQ ID NO: 1703319 - DNA, 18 bp, Homo sapiens
ctggacccttataaaatc

SEQ ID NO: 1703320 - DNA, 19 bp, Homo sapiens
ctggacctcatgttgttga

SEQ ID NO: 1703321 - DNA, 15 bp, Homo sapiens
ctggacctgtatatt

SEQ ID NO: 1703322 - DNA, 16 bp, Homo sapiens
ctggaccttttccctt

SEQ ID NO: 1703323 - DNA, 21 bp, Homo sapiens
ctggacgaagagcaggccagc

SEQ ID NO: 1703324 - DNA, 12 bp, Homo sapiens
ctggacgctgcc

SEQ ID NO: 1703325 - DNA, 17 bp, Homo sapiens
ctggacgctgccctgca

SEQ ID NO: 1703326 - DNA, 24 bp, Homo sapiens
ctggacgctgccctgcatgctgcc

SEQ ID NO: 1703327 - DNA, 20 bp, Homo sapiens
ctggacggcaggctcactgc

SEQ ID NO: 1703328 - DNA, 22 bp, Homo sapiens
ctggacggcaggctcactgcca

SEQ ID NO: 1703329 - DNA, 15 bp, Homo sapiens
ctggacggcattcct

SEQ ID NO: 1703330 - DNA, 19 bp, Homo sapiens
ctggacggcattcctgctt

SEQ ID NO: 1703331 - DNA, 16 bp, Homo sapiens
ctggacgtgaaatact

SEQ ID NO: 1703332 - DNA, 20 bp, Homo sapiens
ctggactaaaggcatccttg

SEQ ID NO: 1703333 - DNA, 16 bp, Homo sapiens
ctggactacacccaag

SEQ ID NO: 1703334 - DNA, 19 bp, Homo sapiens
ctggactattgtgccaact

SEQ ID NO: 1703335 - DNA, 12 bp, Homo sapiens
ctggactcagga

SEQ ID NO: 1703336 - DNA, 13 bp, Homo sapiens
ctggactcaggaa

SEQ ID NO: 1703337 - DNA, 13 bp, Homo sapiens
ctggactcaggat

SEQ ID NO: 1703338 - DNA, 19 bp, Homo sapiens
ctggactcaggatgcccag

SEQ ID NO: 1703339 - DNA, 22 bp, Homo sapiens
ctggactcaggatgcccagggc

SEQ ID NO: 1703340 - DNA, 13 bp, Homo sapiens
ctggactcccctc

SEQ ID NO: 1703341 - DNA, 20 bp, Homo sapiens
ctggactctaagctggagct

SEQ ID NO: 1703342 - DNA, 14 bp, Homo sapiens
ctggactctgcccc

SEQ ID NO: 1703343 - DNA, 15 bp, Homo sapiens
ctggactctgcccca

SEQ ID NO: 1703344 - DNA, 10 bp, Homo sapiens
ctggactgac

SEQ ID NO: 1703345 - DNA, 12 bp, Homo sapiens
ctggactgacca

SEQ ID NO: 1703346 - DNA, 17 bp, Homo sapiens
ctggactgactgcagcc

SEQ ID NO: 1703347 - DNA, 12 bp, Homo sapiens
ctggactgaggc

SEQ ID NO: 1703348 - DNA, 13 bp, Homo sapiens
ctggactgaggcc

SEQ ID NO: 1703349 - DNA, 13 bp, Homo sapiens
ctggactgcatgg

SEQ ID NO: 1703350 - DNA, 21 bp, Homo sapiens
ctggactgcatggggaggcag

SEQ ID NO: 1703351 - DNA, 13 bp, Homo sapiens
ctggactggccat

SEQ ID NO: 1703352 - DNA, 14 bp, Homo sapiens
ctggactgtggagg

SEQ ID NO: 1703353 - DNA, 16 bp, Homo sapiens
ctggacttacaaaatg

SEQ ID NO: 1703354 - DNA, 18 bp, Homo sapiens
ctggacttgagcttggca

SEQ ID NO: 1703355 - DNA, 13 bp, Homo sapiens
ctggagaaagagc

SEQ ID NO: 1703356 - DNA, 18 bp, Homo sapiens
ctggagaaagagctgcct

SEQ ID NO: 1703357 - DNA, 12 bp, Homo sapiens
ctggagaaagat

SEQ ID NO: 1703358 - DNA, 23 bp, Homo sapiens
ctggagaaagatgcagtcctcag

SEQ ID NO: 1703359 - DNA, 21 bp, Homo sapiens
ctggagaacagtggttgcctg

SEQ ID NO: 1703360 - DNA, 19 bp, Homo sapiens
ctggagaactatacctgct

SEQ ID NO: 1703361 - DNA, 21 bp, Homo sapiens
ctggagaccgcttcacccctg

SEQ ID NO: 1703362 - DNA, 14 bp, Homo sapiens
ctggagagccccat

SEQ ID NO: 1703363 - DNA, 23 bp, Homo sapiens
ctggagaggagggatgctgcctg

SEQ ID NO: 1703364 - DNA, 13 bp, Homo sapiens
ctggagatatgaa

SEQ ID NO: 1703365 - DNA, 14 bp, Homo sapiens
ctggagatcctcct

SEQ ID NO: 1703366 - DNA, 16 bp, Homo sapiens
ctggagatcctcctgc

SEQ ID NO: 1703367 - DNA, 17 bp, Homo sapiens
ctggagatcctcctgca

SEQ ID NO: 1703368 - DNA, 23 bp, Homo sapiens
ctggagatgcagctactggaatg

SEQ ID NO: 1703369 - DNA, 18 bp, Homo sapiens
ctggagcaacctactgtc

SEQ ID NO: 1703370 - DNA, 14 bp, Homo sapiens
ctggagcaccaggc

SEQ ID NO: 1703371 - DNA, 23 bp, Homo sapiens
ctggagcaccaggcacgaaccca

SEQ ID NO: 1703372 - DNA, 21 bp, Homo sapiens
ctggagcagcggattgctctg

SEQ ID NO: 1703373 - DNA, 22 bp, Homo sapiens
ctggagcagcggattgctctgg

SEQ ID NO: 1703374 - DNA, 21 bp, Homo sapiens
ctggagccagcagggctgtga

SEQ ID NO: 1703375 - DNA, 14 bp, Homo sapiens
ctggagccagggca

SEQ ID NO: 1703376 - DNA, 15 bp, Homo sapiens
ctggagccagggcag

SEQ ID NO: 1703377 - DNA, 20 bp, Homo sapiens
ctggagccagggcagaggaa

SEQ ID NO: 1703378 - DNA, 22 bp, Homo sapiens
ctggagccagggcagaggaatg

SEQ ID NO: 1703379 - DNA, 16 bp, Homo sapiens
ctggagcccagaggag

SEQ ID NO: 1703380 - DNA, 13 bp, Homo sapiens
ctggagcccagga

SEQ ID NO: 1703381 - DNA, 17 bp, Homo sapiens
ctggagcccctcctccc

SEQ ID NO: 1703382 - DNA, 18 bp, Homo sapiens
ctggagcccctcctcccc

SEQ ID NO: 1703383 - DNA, 16 bp, Homo sapiens
ctggagcccctgggtg

SEQ ID NO: 1703384 - DNA, 20 bp, Homo sapiens
ctggagcccgaggcaccagt

SEQ ID NO: 1703385 - DNA, 18 bp, Homo sapiens
ctggagcccgcactgtcc

SEQ ID NO: 1703386 - DNA, 20 bp, Homo sapiens
ctggagcccgcactgtccca

SEQ ID NO: 1703387 - DNA, 22 bp, Homo sapiens
ctggagccctaaccccttccag

SEQ ID NO: 1703388 - DNA, 23 bp, Homo sapiens
ctggagcctccactgcctctgga

SEQ ID NO: 1703389 - DNA, 20 bp, Homo sapiens
ctggagcgcttcagttcagc

SEQ ID NO: 1703390 - DNA, 13 bp, Homo sapiens
ctggagctcttgg

SEQ ID NO: 1703391 - DNA, 14 bp, Homo sapiens
ctggagctgggaga

SEQ ID NO: 1703392 - DNA, 16 bp, Homo sapiens
ctggagctgggagaca

SEQ ID NO: 1703393 - DNA, 21 bp, Homo sapiens
ctggagcttttaaaaatgttt

SEQ ID NO: 1703394 - DNA, 17 bp, Homo sapiens
ctggaggaaagggagga

SEQ ID NO: 1703395 - DNA, 18 bp, Homo sapiens
ctggaggaaagggaggag

SEQ ID NO: 1703396 - DNA, 22 bp, Homo sapiens
ctggaggagctggcctgtggca

SEQ ID NO: 1703397 - DNA, 22 bp, Homo sapiens
ctggaggatcccctccaagcct

SEQ ID NO: 1703398 - DNA, 16 bp, Homo sapiens
ctggaggcacgcacca

SEQ ID NO: 1703399 - DNA, 13 bp, Homo sapiens
ctggaggcagggc

SEQ ID NO: 1703400 - DNA, 15 bp, Homo sapiens
agatttgttttgcat

SEQ ID NO: 1703401 - DNA, 19 bp, Homo sapiens
agattttaaattcacaata

SEQ ID NO: 1703402 - DNA, 15 bp, Homo sapiens
agattttaaatttta

SEQ ID NO: 1703403 - DNA, 15 bp, Homo sapiens
agattttaatttatt

SEQ ID NO: 1703404 - DNA, 19 bp, Homo sapiens
agattttaatttatttgtt

SEQ ID NO: 1703405 - DNA, 21 bp, Homo sapiens
agattttaatttatttgtttc

SEQ ID NO: 1703406 - DNA, 21 bp, Homo sapiens
agattttaattttgaataaat

SEQ ID NO: 1703407 - DNA, 17 bp, Homo sapiens
agattttacaaaagatg

SEQ ID NO: 1703408 - DNA, 15 bp, Homo sapiens
agattttattttact

SEQ ID NO: 1703409 - DNA, 23 bp, Homo sapiens
agattttcctccatttttatttc

SEQ ID NO: 1703410 - DNA, 20 bp, Homo sapiens
agattttctattatggaaat

SEQ ID NO: 1703411 - DNA, 17 bp, Homo sapiens
agattttctggttctaa

SEQ ID NO: 1703412 - DNA, 19 bp, Homo sapiens
agattttctggttctaaca

SEQ ID NO: 1703413 - DNA, 23 bp, Homo sapiens
agattttgttttgttggacattt

SEQ ID NO: 1703414 - DNA, 13 bp, Homo sapiens
agatttttacaaa

SEQ ID NO: 1703415 - DNA, 15 bp, Homo sapiens
agatttttatttatg

SEQ ID NO: 1703416 - DNA, 13 bp, Homo sapiens
agatttttgcaat

SEQ ID NO: 1703417 - DNA, 14 bp, Homo sapiens
agatttttgcaata

SEQ ID NO: 1703418 - DNA, 15 bp, Homo sapiens
agatttttttcctga

SEQ ID NO: 1703419 - DNA, 23 bp, Homo sapiens
agcaaaaaaaaaaaaaagcatct

SEQ ID NO: 1703420 - DNA, 17 bp, Homo sapiens
agcaaaaatctgagaaa

SEQ ID NO: 1703421 - DNA, 13 bp, Homo sapiens
agcaaaacaaaac

SEQ ID NO: 1703422 - DNA, 16 bp, Homo sapiens
agcaaaagaccaaatc

SEQ ID NO: 1703423 - DNA, 16 bp, Homo sapiens
agcaaaaggctgagaa

SEQ ID NO: 1703424 - DNA, 15 bp, Homo sapiens
agcaaaatcaagaga

SEQ ID NO: 1703425 - DNA, 17 bp, Homo sapiens
agcaaaatgctcttgtc

SEQ ID NO: 1703426 - DNA, 23 bp, Homo sapiens
agcaaaattgatgtgtttattta

SEQ ID NO: 1703427 - DNA, 13 bp, Homo sapiens
agcaaacccagag

SEQ ID NO: 1703428 - DNA, 18 bp, Homo sapiens
agcaaacccagaggtgga

SEQ ID NO: 1703429 - DNA, 20 bp, Homo sapiens
agcaaacgtctattttgtat

SEQ ID NO: 1703430 - DNA, 18 bp, Homo sapiens
agcaaactatttgcgact

SEQ ID NO: 1703431 - DNA, 21 bp, Homo sapiens
agcaaagattaaatgtgtcat

SEQ ID NO: 1703432 - DNA, 14 bp, Homo sapiens
agcaaatatatgat

SEQ ID NO: 1703433 - DNA, 20 bp, Homo sapiens
agcaaatcatctgcattcct

SEQ ID NO: 1703434 - DNA, 15 bp, Homo sapiens
agcaaatgacagatt

SEQ ID NO: 1703435 - DNA, 20 bp, Homo sapiens
agcaacaaacctcactgaga

SEQ ID NO: 1703436 - DNA, 22 bp, Homo sapiens
agcaacaaagattgagaagcca

SEQ ID NO: 1703437 - DNA, 21 bp, Homo sapiens
agcaacaatttatgaattgaa

SEQ ID NO: 1703438 - DNA, 14 bp, Homo sapiens
agcaacagcttcag

SEQ ID NO: 1703439 - DNA, 19 bp, Homo sapiens
agcaacaggttttataatt

SEQ ID NO: 1703440 - DNA, 21 bp, Homo sapiens
agcaacatctagcaaatgtta

SEQ ID NO: 1703441 - DNA, 17 bp, Homo sapiens
agcaaccacaaatgcat

SEQ ID NO: 1703442 - DNA, 21 bp, Homo sapiens
agcaacccttcctgctgctgc

SEQ ID NO: 1703443 - DNA, 15 bp, Homo sapiens
agcaacctacccagc

SEQ ID NO: 1703444 - DNA, 24 bp, Homo sapiens
agcaacctactgtctaagcagttt

SEQ ID NO: 1703445 - DNA, 19 bp, Homo sapiens
agcaacctgtaactcacat

SEQ ID NO: 1703446 - DNA, 17 bp, Homo sapiens
agcaacgcttgtagaac

SEQ ID NO: 1703447 - DNA, 13 bp, Homo sapiens
agcaacggcacag

SEQ ID NO: 1703448 - DNA, 20 bp, Homo sapiens
agcaacgtagcttctaccat

SEQ ID NO: 1703449 - DNA, 17 bp, Homo sapiens
agcaactgcccttccag

SEQ ID NO: 1703450 - DNA, 17 bp, Homo sapiens
agcaacttattttgctt

SEQ ID NO: 1703451 - DNA, 18 bp, Homo sapiens
agcaacttcttctccatc

SEQ ID NO: 1703452 - DNA, 12 bp, Homo sapiens
agcaagaaacag

SEQ ID NO: 1703453 - DNA, 15 bp, Homo sapiens
agcaagaagattcta

SEQ ID NO: 1703454 - DNA, 18 bp, Homo sapiens
agcaagaagattctaaaa

SEQ ID NO: 1703455 - DNA, 19 bp, Homo sapiens
agcaagaagattctaaaac

SEQ ID NO: 1703456 - DNA, 16 bp, Homo sapiens
agcaagaaggaaagat

SEQ ID NO: 1703457 - DNA, 22 bp, Homo sapiens
agcaagaatgcagtacagaatt

SEQ ID NO: 1703458 - DNA, 22 bp, Homo sapiens
agcaagacacgtggcctcgtga

SEQ ID NO: 1703459 - DNA, 22 bp, Homo sapiens
agcaagacctcatctgtggagc

SEQ ID NO: 1703460 - DNA, 18 bp, Homo sapiens
agcaagactctttcaaaa

SEQ ID NO: 1703461 - DNA, 19 bp, Homo sapiens
agcaagactctttcaaaaa

SEQ ID NO: 1703462 - DNA, 20 bp, Homo sapiens
agcaagactttataattcct

SEQ ID NO: 1703463 - DNA, 21 bp, Homo sapiens
agcaagatgttttgtataaaa

SEQ ID NO: 1703464 - DNA, 22 bp, Homo sapiens
agcaagatgttttgtataaaat

SEQ ID NO: 1703465 - DNA, 19 bp, Homo sapiens
agcaagccagtgtccttcg

SEQ ID NO: 1703466 - DNA, 17 bp, Homo sapiens
agcaagccatcatcctc

SEQ ID NO: 1703467 - DNA, 19 bp, Homo sapiens
agcaagccctacagagctg

SEQ ID NO: 1703468 - DNA, 21 bp, Homo sapiens
agcaaggaaggtaaaaagtta

SEQ ID NO: 1703469 - DNA, 14 bp, Homo sapiens
agcaaggcacagcc

SEQ ID NO: 1703470 - DNA, 14 bp, Homo sapiens
agcaaggctgctgc

SEQ ID NO: 1703471 - DNA, 16 bp, Homo sapiens
agcaaggctgctgccg

SEQ ID NO: 1703472 - DNA, 14 bp, Homo sapiens
agcaaggctggggt

SEQ ID NO: 1703473 - DNA, 15 bp, Homo sapiens
agcaagggagaaaag

SEQ ID NO: 1703474 - DNA, 16 bp, Homo sapiens
agcaagggctccagca

SEQ ID NO: 1703475 - DNA, 18 bp, Homo sapiens
agcaagtaaaaaggctaa

SEQ ID NO: 1703476 - DNA, 19 bp, Homo sapiens
agcaagtaagaatggccaa

SEQ ID NO: 1703477 - DNA, 14 bp, Homo sapiens
agcaagtcacctta

SEQ ID NO: 1703478 - DNA, 16 bp, Homo sapiens
agcaagtcttaacaaa

SEQ ID NO: 1703479 - DNA, 12 bp, Homo sapiens
agcaagtgagca

SEQ ID NO: 1703480 - DNA, 22 bp, Homo sapiens
agcaagtgcccagtggagcctg

SEQ ID NO: 1703481 - DNA, 19 bp, Homo sapiens
agcaagtgtgcactccagc

SEQ ID NO: 1703482 - DNA, 20 bp, Homo sapiens
agcaagttcctgagtgcgtg

SEQ ID NO: 1703483 - DNA, 14 bp, Homo sapiens
agcaagttctagaa

SEQ ID NO: 1703484 - DNA, 20 bp, Homo sapiens
agcaagttctgagagccagg

SEQ ID NO: 1703485 - DNA, 13 bp, Homo sapiens
agcaataaatgaa

SEQ ID NO: 1703486 - DNA, 15 bp, Homo sapiens
agcaataaatgaatg

SEQ ID NO: 1703487 - DNA, 22 bp, Homo sapiens
agcaataacattcccactgcca

SEQ ID NO: 1703488 - DNA, 19 bp, Homo sapiens
agcaataatggtcccatcc

SEQ ID NO: 1703489 - DNA, 14 bp, Homo sapiens
agcaataattgttt

SEQ ID NO: 1703490 - DNA, 17 bp, Homo sapiens
agcaataattgtttcca

SEQ ID NO: 1703491 - DNA, 20 bp, Homo sapiens
agcaatacgtttgtgcagaa

SEQ ID NO: 1703492 - DNA, 18 bp, Homo sapiens
agcaatactgtttccatt

SEQ ID NO: 1703493 - DNA, 20 bp, Homo sapiens
agcaatactgtttccatttt

SEQ ID NO: 1703494 - DNA, 15 bp, Homo sapiens
agcaatctcttcatt

SEQ ID NO: 1703495 - DNA, 16 bp, Homo sapiens
agcaatctgaccctat

SEQ ID NO: 1703496 - DNA, 16 bp, Homo sapiens
agcaatctgcatttta

SEQ ID NO: 1703497 - DNA, 19 bp, Homo sapiens
agcaatctgcattttaaca

SEQ ID NO: 1703498 - DNA, 17 bp, Homo sapiens
agcaatctttgaaataa

SEQ ID NO: 1703499 - DNA, 19 bp, Homo sapiens
agcaatctttgaaataaaa

SEQ ID NO: 1703500 - DNA, 20 bp, Homo sapiens
agcaatgaactcaagaagga

SEQ ID NO: 1703501 - DNA, 18 bp, Homo sapiens
agcaatgatgacccacta

SEQ ID NO: 1703502 - DNA, 20 bp, Homo sapiens
agcaatgatgacccactaaa

SEQ ID NO: 1703503 - DNA, 23 bp, Homo sapiens
agcaatggtgtcagtatccaggc

SEQ ID NO: 1703504 - DNA, 13 bp, Homo sapiens
agcaatgtgagtc

SEQ ID NO: 1703505 - DNA, 16 bp, Homo sapiens
agcaatgtgagtccca

SEQ ID NO: 1703506 - DNA, 16 bp, Homo sapiens
agcaatgtgttttttc

SEQ ID NO: 1703507 - DNA, 18 bp, Homo sapiens
agcaatgttggtttttta

SEQ ID NO: 1703508 - DNA, 19 bp, Homo sapiens
agcaatgttggttttttat

SEQ ID NO: 1703509 - DNA, 19 bp, Homo sapiens
agcaattaggtagcacagc

SEQ ID NO: 1703510 - DNA, 23 bp, Homo sapiens
agcaattagtctgaaactggctt

SEQ ID NO: 1703511 - DNA, 14 bp, Homo sapiens
agcaattccaggct

SEQ ID NO: 1703512 - DNA, 18 bp, Homo sapiens
agcaattccaggctgagc

SEQ ID NO: 1703513 - DNA, 22 bp, Homo sapiens
agcaattctcctgcctcagcct

SEQ ID NO: 1703514 - DNA, 16 bp, Homo sapiens
agcaattctgactgtc

SEQ ID NO: 1703515 - DNA, 23 bp, Homo sapiens
agcaatttaatattttgcacagt

SEQ ID NO: 1703516 - DNA, 15 bp, Homo sapiens
ctggaggcagggcct

SEQ ID NO: 1703517 - DNA, 19 bp, Homo sapiens
ctggaggcagggccttgcc

SEQ ID NO: 1703518 - DNA, 13 bp, Homo sapiens
ctggaggcccagt

SEQ ID NO: 1703519 - DNA, 14 bp, Homo sapiens
ctggaggcccctgg

SEQ ID NO: 1703520 - DNA, 22 bp, Homo sapiens
ctggaggccgaggaccaccagc

SEQ ID NO: 1703521 - DNA, 23 bp, Homo sapiens
ctggaggccgaggaccaccagca

SEQ ID NO: 1703522 - DNA, 16 bp, Homo sapiens
ctggaggcctcaggtg

SEQ ID NO: 1703523 - DNA, 16 bp, Homo sapiens
ctggaggccttccagc

SEQ ID NO: 1703524 - DNA, 16 bp, Homo sapiens
ctggaggctgcagagc

SEQ ID NO: 1703525 - DNA, 23 bp, Homo sapiens
ctggaggctgcagagctgaccca

SEQ ID NO: 1703526 - DNA, 13 bp, Homo sapiens
ctggagggacttt

SEQ ID NO: 1703527 - DNA, 16 bp, Homo sapiens
ctggagggacttttaa

SEQ ID NO: 1703528 - DNA, 16 bp, Homo sapiens
ctggaggggagagctt

SEQ ID NO: 1703529 - DNA, 20 bp, Homo sapiens
ctggaggggcaccaggtgga

SEQ ID NO: 1703530 - DNA, 15 bp, Homo sapiens
ctggaggggcccacc

SEQ ID NO: 1703531 - DNA, 19 bp, Homo sapiens
ctggaggggcccacccaca

SEQ ID NO: 1703532 - DNA, 15 bp, Homo sapiens
ctggagggggagcac

SEQ ID NO: 1703533 - DNA, 16 bp, Homo sapiens
ctggaggttgaagcca

SEQ ID NO: 1703534 - DNA, 12 bp, Homo sapiens
ctggaggtttgt

SEQ ID NO: 1703535 - DNA, 20 bp, Homo sapiens
ctggagtcacatcagtgagg

SEQ ID NO: 1703536 - DNA, 21 bp, Homo sapiens
ctggagtcacatcagtgagga

SEQ ID NO: 1703537 - DNA, 22 bp, Homo sapiens
ctggagtcaggtgtcgaggcca

SEQ ID NO: 1703538 - DNA, 16 bp, Homo sapiens
ctggagtccagtctct

SEQ ID NO: 1703539 - DNA, 22 bp, Homo sapiens
ctggagtcccgtccctgcccag

SEQ ID NO: 1703540 - DNA, 13 bp, Homo sapiens
ctggagtgaggct

SEQ ID NO: 1703541 - DNA, 19 bp, Homo sapiens
ctggagtgaggcttccagg

SEQ ID NO: 1703542 - DNA, 21 bp, Homo sapiens
ctggagtgaggcttccaggct

SEQ ID NO: 1703543 - DNA, 17 bp, Homo sapiens
ctggagtgattctagag

SEQ ID NO: 1703544 - DNA, 14 bp, Homo sapiens
ctggagtgcagtgg

SEQ ID NO: 1703545 - DNA, 24 bp, Homo sapiens
ctggagtgcgctcttggtccctgg

SEQ ID NO: 1703546 - DNA, 19 bp, Homo sapiens
ctggagtggtgttcagcca

SEQ ID NO: 1703547 - DNA, 16 bp, Homo sapiens
ctggagttacattaat

SEQ ID NO: 1703548 - DNA, 22 bp, Homo sapiens
ctggagttacattaatgttaat

SEQ ID NO: 1703549 - DNA, 13 bp, Homo sapiens
ctggataaaatga

SEQ ID NO: 1703550 - DNA, 13 bp, Homo sapiens
ctggatatttcaa

SEQ ID NO: 1703551 - DNA, 14 bp, Homo sapiens
ctggatccatgggg

SEQ ID NO: 1703552 - DNA, 15 bp, Homo sapiens
ctggatcctgaaata

SEQ ID NO: 1703553 - DNA, 15 bp, Homo sapiens
ctggatctccccact

SEQ ID NO: 1703554 - DNA, 23 bp, Homo sapiens
ctggatctcctcaagtccccaag

SEQ ID NO: 1703555 - DNA, 13 bp, Homo sapiens
ctggatctcctgc

SEQ ID NO: 1703556 - DNA, 15 bp, Homo sapiens
ctggatctcctgctg

SEQ ID NO: 1703557 - DNA, 16 bp, Homo sapiens
ctggatctcctgctgc

SEQ ID NO: 1703558 - DNA, 21 bp, Homo sapiens
ctggatctgggaccctttcct

SEQ ID NO: 1703559 - DNA, 21 bp, Homo sapiens
ctggatcttctatcattccaa

SEQ ID NO: 1703560 - DNA, 14 bp, Homo sapiens
ctggatgaaggcaa

SEQ ID NO: 1703561 - DNA, 14 bp, Homo sapiens
ctggatgagaaaca

SEQ ID NO: 1703562 - DNA, 16 bp, Homo sapiens
ctggatgagaaacagc

SEQ ID NO: 1703563 - DNA, 20 bp, Homo sapiens
ctggatgagaaacagctcag

SEQ ID NO: 1703564 - DNA, 13 bp, Homo sapiens
ctggatgagactt

SEQ ID NO: 1703565 - DNA, 16 bp, Homo sapiens
ctggatgatggattcc

SEQ ID NO: 1703566 - DNA, 16 bp, Homo sapiens
ctggatgatttcatct

SEQ ID NO: 1703567 - DNA, 21 bp, Homo sapiens
ctggatgatttcatcttctgg

SEQ ID NO: 1703568 - DNA, 21 bp, Homo sapiens
ctggatgctgttgagggccaa

SEQ ID NO: 1703569 - DNA, 21 bp, Homo sapiens
ctggatggaaagacaaactgc

SEQ ID NO: 1703570 - DNA, 21 bp, Homo sapiens
ctggatggccgggctgctgct

SEQ ID NO: 1703571 - DNA, 15 bp, Homo sapiens
ctggatgggcattgg

SEQ ID NO: 1703572 - DNA, 17 bp, Homo sapiens
ctggatgggcattgggc

SEQ ID NO: 1703573 - DNA, 20 bp, Homo sapiens
ctggatgggcattgggctga

SEQ ID NO: 1703574 - DNA, 21 bp, Homo sapiens
ctggatgggcattgggctgac

SEQ ID NO: 1703575 - DNA, 21 bp, Homo sapiens
ctggatgggggtgcaggcagc

SEQ ID NO: 1703576 - DNA, 17 bp, Homo sapiens
ctggatgtgtggggcat

SEQ ID NO: 1703577 - DNA, 21 bp, Homo sapiens
ctggattaatgttttgtacaa

SEQ ID NO: 1703578 - DNA, 17 bp, Homo sapiens
ctggattcacgccctct

SEQ ID NO: 1703579 - DNA, 23 bp, Homo sapiens
ctggattcacgccctcttgtttc

SEQ ID NO: 1703580 - DNA, 16 bp, Homo sapiens
ctggattcattgtctc

SEQ ID NO: 1703581 - DNA, 16 bp, Homo sapiens
ctggattctaaacaac

SEQ ID NO: 1703582 - DNA, 16 bp, Homo sapiens
ctggattgtttttaaa

SEQ ID NO: 1703583 - DNA, 19 bp, Homo sapiens
ctggattttctttctatgt

SEQ ID NO: 1703584 - DNA, 15 bp, Homo sapiens
ctggcaaaccctccc

SEQ ID NO: 1703585 - DNA, 19 bp, Homo sapiens
ctggcaaaccctcccagaa

SEQ ID NO: 1703586 - DNA, 22 bp, Homo sapiens
ctggcaaaggacccttgagtaa

SEQ ID NO: 1703587 - DNA, 12 bp, Homo sapiens
ctggcaaaggcc

SEQ ID NO: 1703588 - DNA, 18 bp, Homo sapiens
ctggcaaagggagcagaa

SEQ ID NO: 1703589 - DNA, 17 bp, Homo sapiens
ctggcaacaacagcttc

SEQ ID NO: 1703590 - DNA, 15 bp, Homo sapiens
ctggcaacacagagg

SEQ ID NO: 1703591 - DNA, 15 bp, Homo sapiens
ctggcaaccagccag

SEQ ID NO: 1703592 - DNA, 19 bp, Homo sapiens
ctggcaaccagccagcgtc

SEQ ID NO: 1703593 - DNA, 13 bp, Homo sapiens
ctggcaagcaggg

SEQ ID NO: 1703594 - DNA, 16 bp, Homo sapiens
ctggcaagcagggaaa

SEQ ID NO: 1703595 - DNA, 17 bp, Homo sapiens
ctggcaagcagggaaag

SEQ ID NO: 1703596 - DNA, 19 bp, Homo sapiens
ctggcaaggactttgtaca

SEQ ID NO: 1703597 - DNA, 22 bp, Homo sapiens
ctggcaatgaaaaattctcagt

SEQ ID NO: 1703598 - DNA, 15 bp, Homo sapiens
ctggcacagaaacct

SEQ ID NO: 1703599 - DNA, 15 bp, Homo sapiens
ctggcacagggcagt

SEQ ID NO: 1703600 - DNA, 19 bp, Homo sapiens
ctggcacagttttctgaga

SEQ ID NO: 1703601 - DNA, 21 bp, Homo sapiens
ctggcacagttttctgagaaa

SEQ ID NO: 1703602 - DNA, 19 bp, Homo sapiens
ctggcacatcagaaaggaa

SEQ ID NO: 1703603 - DNA, 15 bp, Homo sapiens
ctggcaccatcagcc

SEQ ID NO: 1703604 - DNA, 21 bp, Homo sapiens
ctggcacctgtgttccagccc

SEQ ID NO: 1703605 - DNA, 16 bp, Homo sapiens
ctggcacgccctactc

SEQ ID NO: 1703606 - DNA, 18 bp, Homo sapiens
ctggcacgccctactcca

SEQ ID NO: 1703607 - DNA, 21 bp, Homo sapiens
ctggcacggtggctcaggcct

SEQ ID NO: 1703608 - DNA, 16 bp, Homo sapiens
ctggcactataatgta

SEQ ID NO: 1703609 - DNA, 13 bp, Homo sapiens
ctggcactgaacc

SEQ ID NO: 1703610 - DNA, 19 bp, Homo sapiens
ctggcactgaattaatcat

SEQ ID NO: 1703611 - DNA, 20 bp, Homo sapiens
ctggcacttttttaaatata

SEQ ID NO: 1703612 - DNA, 22 bp, Homo sapiens
ctggcacttttttaaatataaa

SEQ ID NO: 1703613 - DNA, 13 bp, Homo sapiens
ctggcagaagcat

SEQ ID NO: 1703614 - DNA, 23 bp, Homo sapiens
ctggcagaagcattgcctggact

SEQ ID NO: 1703615 - DNA, 17 bp, Homo sapiens
ctggcagccgtgccttc

SEQ ID NO: 1703616 - DNA, 20 bp, Homo sapiens
ctggcagccgtgccttcagc

SEQ ID NO: 1703617 - DNA, 20 bp, Homo sapiens
ctggcagctcctctccttgg

SEQ ID NO: 1703618 - DNA, 23 bp, Homo sapiens
ctggcagctcctctccttgggct

SEQ ID NO: 1703619 - DNA, 12 bp, Homo sapiens
ctggcagctctg

SEQ ID NO: 1703620 - DNA, 22 bp, Homo sapiens
ctggcaggattcttcccgctcc

SEQ ID NO: 1703621 - DNA, 17 bp, Homo sapiens
ctggcagggacctgaga

SEQ ID NO: 1703622 - DNA, 18 bp, Homo sapiens
ctggcagggacctgagag

SEQ ID NO: 1703623 - DNA, 16 bp, Homo sapiens
ctggcagggctttggg

SEQ ID NO: 1703624 - DNA, 21 bp, Homo sapiens
ctggcaggggagacaggagcc

SEQ ID NO: 1703625 - DNA, 22 bp, Homo sapiens
ctggcaggggagacaggagcct

SEQ ID NO: 1703626 - DNA, 15 bp, Homo sapiens
ctggcagggggcatg

SEQ ID NO: 1703627 - DNA, 18 bp, Homo sapiens
ctggcagggtgggatgga

SEQ ID NO: 1703628 - DNA, 18 bp, Homo sapiens
ctggcaggtaccgtgctc

SEQ ID NO: 1703629 - DNA, 20 bp, Homo sapiens
ctggcaggtgcagatgggct

SEQ ID NO: 1703630 - DNA, 21 bp, Homo sapiens
ctggcaggtgcagatgggctg

SEQ ID NO: 1703631 - DNA, 19 bp, Homo sapiens
ctggcaggtggccaggcag

SEQ ID NO: 1703632 - DNA, 24 bp, Homo sapiens
agcaatttaatattttgcacagtt

SEQ ID NO: 1703633 - DNA, 16 bp, Homo sapiens
agcaatttcccccctc

SEQ ID NO: 1703634 - DNA, 22 bp, Homo sapiens
agcaatttcgccgttgaagagg

SEQ ID NO: 1703635 - DNA, 13 bp, Homo sapiens
agcaatttctaat

SEQ ID NO: 1703636 - DNA, 16 bp, Homo sapiens
agcaattttctttgtt

SEQ ID NO: 1703637 - DNA, 19 bp, Homo sapiens
agcaattttctttgtttct

SEQ ID NO: 1703638 - DNA, 15 bp, Homo sapiens
agcacaaaattcaaa

SEQ ID NO: 1703639 - DNA, 20 bp, Homo sapiens
agcacaaaattcaaagcatg

SEQ ID NO: 1703640 - DNA, 21 bp, Homo sapiens
agcacaaacacacctctgcca

SEQ ID NO: 1703641 - DNA, 15 bp, Homo sapiens
agcacaacccaccac

SEQ ID NO: 1703642 - DNA, 15 bp, Homo sapiens
agcacaagggcacat

SEQ ID NO: 1703643 - DNA, 20 bp, Homo sapiens
agcacaagggcacattgccc

SEQ ID NO: 1703644 - DNA, 23 bp, Homo sapiens
agcacaatgtctcacatgggaca

SEQ ID NO: 1703645 - DNA, 19 bp, Homo sapiens
agcacacacaataaagaac

SEQ ID NO: 1703646 - DNA, 17 bp, Homo sapiens
agcacacacatctggcc

SEQ ID NO: 1703647 - DNA, 19 bp, Homo sapiens
agcacacacatctggccct

SEQ ID NO: 1703648 - DNA, 14 bp, Homo sapiens
agcacacaggtaca

SEQ ID NO: 1703649 - DNA, 15 bp, Homo sapiens
agcacaccagccgct

SEQ ID NO: 1703650 - DNA, 16 bp, Homo sapiens
agcacaccagccgctg

SEQ ID NO: 1703651 - DNA, 18 bp, Homo sapiens
agcacaccagccgctgca

SEQ ID NO: 1703652 - DNA, 15 bp, Homo sapiens
agcacacctcagccc

SEQ ID NO: 1703653 - DNA, 22 bp, Homo sapiens
agcacactgcacagggaaaatt

SEQ ID NO: 1703654 - DNA, 16 bp, Homo sapiens
agcacagagcgtcctt

SEQ ID NO: 1703655 - DNA, 13 bp, Homo sapiens
agcacagagggct

SEQ ID NO: 1703656 - DNA, 19 bp, Homo sapiens
agcacagcactttggtttt

SEQ ID NO: 1703657 - DNA, 22 bp, Homo sapiens
agcacagcactttggttttgct

SEQ ID NO: 1703658 - DNA, 15 bp, Homo sapiens
agcacagccctggga

SEQ ID NO: 1703659 - DNA, 16 bp, Homo sapiens
agcacagccctgggag

SEQ ID NO: 1703660 - DNA, 16 bp, Homo sapiens
agcacagctcctgcca

SEQ ID NO: 1703661 - DNA, 12 bp, Homo sapiens
agcacagctggg

SEQ ID NO: 1703662 - DNA, 18 bp, Homo sapiens
agcacagcttgacctgag

SEQ ID NO: 1703663 - DNA, 20 bp, Homo sapiens
agcacagcttgacctgaggc

SEQ ID NO: 1703664 - DNA, 14 bp, Homo sapiens
agcacagtgcctgc

SEQ ID NO: 1703665 - DNA, 20 bp, Homo sapiens
agcacatacggcagacctct

SEQ ID NO: 1703666 - DNA, 22 bp, Homo sapiens
agcacatactacctagaagtaa

SEQ ID NO: 1703667 - DNA, 23 bp, Homo sapiens
agcacatctgcattttcacccca

SEQ ID NO: 1703668 - DNA, 20 bp, Homo sapiens
agcacatgcgggctcgccca

SEQ ID NO: 1703669 - DNA, 19 bp, Homo sapiens
agcacattcgggaccaata

SEQ ID NO: 1703670 - DNA, 17 bp, Homo sapiens
agcacatttgtcagtat

SEQ ID NO: 1703671 - DNA, 13 bp, Homo sapiens
agcaccacactgg

SEQ ID NO: 1703672 - DNA, 12 bp, Homo sapiens
agcaccacccta

SEQ ID NO: 1703673 - DNA, 20 bp, Homo sapiens
agcaccacctacacaggagt

SEQ ID NO: 1703674 - DNA, 13 bp, Homo sapiens
agcacccacgtga

SEQ ID NO: 1703675 - DNA, 22 bp, Homo sapiens
agcacccagagcaccccctgct

SEQ ID NO: 1703676 - DNA, 19 bp, Homo sapiens
agcaccccatgccaaagct

SEQ ID NO: 1703677 - DNA, 14 bp, Homo sapiens
agcaccccctgctc

SEQ ID NO: 1703678 - DNA, 14 bp, Homo sapiens
agcaccctgggtgc

SEQ ID NO: 1703679 - DNA, 21 bp, Homo sapiens
agcacccttctcggagaccca

SEQ ID NO: 1703680 - DNA, 17 bp, Homo sapiens
agcaccgaggggccttt

SEQ ID NO: 1703681 - DNA, 18 bp, Homo sapiens
agcaccgaggggcctttg

SEQ ID NO: 1703682 - DNA, 14 bp, Homo sapiens
agcacctcacctga

SEQ ID NO: 1703683 - DNA, 16 bp, Homo sapiens
agcacctcagcctgca

SEQ ID NO: 1703684 - DNA, 14 bp, Homo sapiens
agcacctccagcct

SEQ ID NO: 1703685 - DNA, 17 bp, Homo sapiens
agcacctccaggcctgt

SEQ ID NO: 1703686 - DNA, 14 bp, Homo sapiens
agcacctcccagcc

SEQ ID NO: 1703687 - DNA, 18 bp, Homo sapiens
agcacctcccagcccctg

SEQ ID NO: 1703688 - DNA, 23 bp, Homo sapiens
agcacctgaaccccatgggcttg

SEQ ID NO: 1703689 - DNA, 16 bp, Homo sapiens
agcacctgccgacctc

SEQ ID NO: 1703690 - DNA, 21 bp, Homo sapiens
agcacctgccgacctcgtcct

SEQ ID NO: 1703691 - DNA, 22 bp, Homo sapiens
agcacctgccgacctcgtcctc

SEQ ID NO: 1703692 - DNA, 13 bp, Homo sapiens
agcacctgctccc

SEQ ID NO: 1703693 - DNA, 18 bp, Homo sapiens
agcaccttgtgcctgggg

SEQ ID NO: 1703694 - DNA, 19 bp, Homo sapiens
agcaccttgtgcctggggt

SEQ ID NO: 1703695 - DNA, 18 bp, Homo sapiens
agcacgaaatgttatttt

SEQ ID NO: 1703696 - DNA, 14 bp, Homo sapiens
agcacgcctgccat

SEQ ID NO: 1703697 - DNA, 15 bp, Homo sapiens
agcacgcctgccatc

SEQ ID NO: 1703698 - DNA, 21 bp, Homo sapiens
agcacgtaaatgcgtccctgt

SEQ ID NO: 1703699 - DNA, 16 bp, Homo sapiens
agcactaaagcagtgg

SEQ ID NO: 1703700 - DNA, 20 bp, Homo sapiens
agcactaaagcagtggacac

SEQ ID NO: 1703701 - DNA, 16 bp, Homo sapiens
agcactacaatcatgg

SEQ ID NO: 1703702 - DNA, 17 bp, Homo sapiens
agcactacaatcatggt

SEQ ID NO: 1703703 - DNA, 18 bp, Homo sapiens
agcactagtttgattatt

SEQ ID NO: 1703704 - DNA, 18 bp, Homo sapiens
agcactcacgccctaagc

SEQ ID NO: 1703705 - DNA, 13 bp, Homo sapiens
agcactcagcctc

SEQ ID NO: 1703706 - DNA, 22 bp, Homo sapiens
agcactccccagagctgtgcca

SEQ ID NO: 1703707 - DNA, 19 bp, Homo sapiens
agcactcgagaccatcctg

SEQ ID NO: 1703708 - DNA, 23 bp, Homo sapiens
agcactctctaaatcttccttgt

SEQ ID NO: 1703709 - DNA, 23 bp, Homo sapiens
agcactctgagtttaccatttgt

SEQ ID NO: 1703710 - DNA, 18 bp, Homo sapiens
agcactgaacctgggaaa

SEQ ID NO: 1703711 - DNA, 14 bp, Homo sapiens
agcactgacagatt

SEQ ID NO: 1703712 - DNA, 13 bp, Homo sapiens
agcactgacctgt

SEQ ID NO: 1703713 - DNA, 17 bp, Homo sapiens
agcactgagcaagttga

SEQ ID NO: 1703714 - DNA, 10 bp, Homo sapiens
agcactgagg

SEQ ID NO: 1703715 - DNA, 22 bp, Homo sapiens
agcactgagggtggcactcaac

SEQ ID NO: 1703716 - DNA, 17 bp, Homo sapiens
agcactggaggggccca

SEQ ID NO: 1703717 - DNA, 16 bp, Homo sapiens
agcactggagtgcagg

SEQ ID NO: 1703718 - DNA, 19 bp, Homo sapiens
agcactggagtgcagggag

SEQ ID NO: 1703719 - DNA, 20 bp, Homo sapiens
agcactggagtgcagggagg

SEQ ID NO: 1703720 - DNA, 22 bp, Homo sapiens
agcactggagtgcagggaggag

SEQ ID NO: 1703721 - DNA, 23 bp, Homo sapiens
agcactggagtgcagggaggaga

SEQ ID NO: 1703722 - DNA, 14 bp, Homo sapiens
agcactggccagag

SEQ ID NO: 1703723 - DNA, 17 bp, Homo sapiens
agcactggccagagagg

SEQ ID NO: 1703724 - DNA, 20 bp, Homo sapiens
agcactggccagagagggcc

SEQ ID NO: 1703725 - DNA, 23 bp, Homo sapiens
agcactggccagagagggcccag

SEQ ID NO: 1703726 - DNA, 20 bp, Homo sapiens
agcactggggtgggggtgga

SEQ ID NO: 1703727 - DNA, 19 bp, Homo sapiens
agcactgtcccttgcctca

SEQ ID NO: 1703728 - DNA, 22 bp, Homo sapiens
agcactgtcccttgcctcaatg

SEQ ID NO: 1703729 - DNA, 22 bp, Homo sapiens
agcactgtgaagacccagcagg

SEQ ID NO: 1703730 - DNA, 15 bp, Homo sapiens
agcactgttgagaag

SEQ ID NO: 1703731 - DNA, 14 bp, Homo sapiens
agcacttaaacaga

SEQ ID NO: 1703732 - DNA, 23 bp, Homo sapiens
agcacttaaacagaagcagaggc

SEQ ID NO: 1703733 - DNA, 17 bp, Homo sapiens
agcacttacgtaaaaca

SEQ ID NO: 1703734 - DNA, 14 bp, Homo sapiens
agcacttcccagga

SEQ ID NO: 1703735 - DNA, 14 bp, Homo sapiens
agcacttgcgtcct

SEQ ID NO: 1703736 - DNA, 16 bp, Homo sapiens
agcacttgcgtcctgc

SEQ ID NO: 1703737 - DNA, 17 bp, Homo sapiens
agcacttggagccaagg

SEQ ID NO: 1703738 - DNA, 23 bp, Homo sapiens
agcacttggagccaagggttcag

SEQ ID NO: 1703739 - DNA, 22 bp, Homo sapiens
agcacttgggggttcaggcccg

SEQ ID NO: 1703740 - DNA, 12 bp, Homo sapiens
agcacttgtata

SEQ ID NO: 1703741 - DNA, 23 bp, Homo sapiens
agcactttaatggcctggaggga

SEQ ID NO: 1703742 - DNA, 21 bp, Homo sapiens
agcactttgagaggctgaggt

SEQ ID NO: 1703743 - DNA, 12 bp, Homo sapiens
agcactttggga

SEQ ID NO: 1703744 - DNA, 17 bp, Homo sapiens
agcactttgggaggccg

SEQ ID NO: 1703745 - DNA, 20 bp, Homo sapiens
agcactttgggaggccgagg

SEQ ID NO: 1703746 - DNA, 22 bp, Homo sapiens
agcactttgggaggccgaggtg

SEQ ID NO: 1703747 - DNA, 22 bp, Homo sapiens
agcactttgggaggctgaggcg

SEQ ID NO: 1703748 - DNA, 19 bp, Homo sapiens
ctgcatggcatcagactag

SEQ ID NO: 1703749 - DNA, 20 bp, Homo sapiens
ctgcatggggaggcagcaga

SEQ ID NO: 1703750 - DNA, 21 bp, Homo sapiens
ctgcatggggaggcagcagag

SEQ ID NO: 1703751 - DNA, 12 bp, Homo sapiens
ctgcatgtgact

SEQ ID NO: 1703752 - DNA, 17 bp, Homo sapiens
ctgcatgtgacttctcc

SEQ ID NO: 1703753 - DNA, 20 bp, Homo sapiens
ctgcatgtgacttctcccct

SEQ ID NO: 1703754 - DNA, 19 bp, Homo sapiens
ctgcattaccagcttaaaa

SEQ ID NO: 1703755 - DNA, 12 bp, Homo sapiens
ctgcattagaaa

SEQ ID NO: 1703756 - DNA, 15 bp, Homo sapiens
ctgcattagaaatta

SEQ ID NO: 1703757 - DNA, 13 bp, Homo sapiens
ctgcattccgcag

SEQ ID NO: 1703758 - DNA, 20 bp, Homo sapiens
ctgcattcttaacaaactct

SEQ ID NO: 1703759 - DNA, 21 bp, Homo sapiens
ctgcattgctagataaaagct

SEQ ID NO: 1703760 - DNA, 16 bp, Homo sapiens
ctgcattggcctggcc

SEQ ID NO: 1703761 - DNA, 18 bp, Homo sapiens
ctgcattggcctggcctc

SEQ ID NO: 1703762 - DNA, 15 bp, Homo sapiens
ctgcattgttattgt

SEQ ID NO: 1703763 - DNA, 19 bp, Homo sapiens
ctgcattgttattgtggaa

SEQ ID NO: 1703764 - DNA, 22 bp, Homo sapiens
ctgcattgttattgtggaagat

SEQ ID NO: 1703765 - DNA, 20 bp, Homo sapiens
ctgcatttaaatttgatttc

SEQ ID NO: 1703766 - DNA, 23 bp, Homo sapiens
ctgcatttaaatttgatttccat

SEQ ID NO: 1703767 - DNA, 21 bp, Homo sapiens
ctgcatttcacatgccttgca

SEQ ID NO: 1703768 - DNA, 21 bp, Homo sapiens
ctgcattttaattttaaccaa

SEQ ID NO: 1703769 - DNA, 17 bp, Homo sapiens
ctgcattttcaccccac

SEQ ID NO: 1703770 - DNA, 15 bp, Homo sapiens
ctgcattttcctctt

SEQ ID NO: 1703771 - DNA, 23 bp, Homo sapiens
ctgcattttcctcttgtcctggc

SEQ ID NO: 1703772 - DNA, 20 bp, Homo sapiens
ctgccaacatgaggacagaa

SEQ ID NO: 1703773 - DNA, 22 bp, Homo sapiens
ctgccaacatgaggacagaagg

SEQ ID NO: 1703774 - DNA, 23 bp, Homo sapiens
ctgccaacatgaggacagaagga

SEQ ID NO: 1703775 - DNA, 15 bp, Homo sapiens
ctgccaaccatacct

SEQ ID NO: 1703776 - DNA, 16 bp, Homo sapiens
ctgccaacctaaaact

SEQ ID NO: 1703777 - DNA, 22 bp, Homo sapiens
ctgccaagccagattctcttga

SEQ ID NO: 1703778 - DNA, 23 bp, Homo sapiens
ctgccaagccagattctcttgaa

SEQ ID NO: 1703779 - DNA, 15 bp, Homo sapiens
ctgccaaggccagag

SEQ ID NO: 1703780 - DNA, 23 bp, Homo sapiens
ctgccaaggccagagtggcctgg

SEQ ID NO: 1703781 - DNA, 17 bp, Homo sapiens
ctgccaaggtggaggga

SEQ ID NO: 1703782 - DNA, 20 bp, Homo sapiens
ctgccaaggtggagggaagg

SEQ ID NO: 1703783 - DNA, 15 bp, Homo sapiens
ctgccaatccttaaa

SEQ ID NO: 1703784 - DNA, 19 bp, Homo sapiens
ctgccaattgctaccgaga

SEQ ID NO: 1703785 - DNA, 18 bp, Homo sapiens
ctgccacaccctccccat

SEQ ID NO: 1703786 - DNA, 18 bp, Homo sapiens
ctgccacactcagtcccc

SEQ ID NO: 1703787 - DNA, 14 bp, Homo sapiens
ctgccacactgatg

SEQ ID NO: 1703788 - DNA, 22 bp, Homo sapiens
ctgccacactgatggctcaaga

SEQ ID NO: 1703789 - DNA, 13 bp, Homo sapiens
ctgccacagagaa

SEQ ID NO: 1703790 - DNA, 16 bp, Homo sapiens
ctgccaccacgtctgc

SEQ ID NO: 1703791 - DNA, 20 bp, Homo sapiens
ctgccaccacgtctgccagg

SEQ ID NO: 1703792 - DNA, 16 bp, Homo sapiens
ctgccacccccttccc

SEQ ID NO: 1703793 - DNA, 23 bp, Homo sapiens
ctgccacccccttccctgggagg

SEQ ID NO: 1703794 - DNA, 17 bp, Homo sapiens
ctgccaccccttcctcc

SEQ ID NO: 1703795 - DNA, 19 bp, Homo sapiens
ctgccaccctacctgttca

SEQ ID NO: 1703796 - DNA, 23 bp, Homo sapiens
ctgccaccggaggtcactccacc

SEQ ID NO: 1703797 - DNA, 11 bp, Homo sapiens
ctgccacctcc

SEQ ID NO: 1703798 - DNA, 14 bp, Homo sapiens
ctgccacctcccct

SEQ ID NO: 1703799 - DNA, 22 bp, Homo sapiens
ctgccacctcccctatccaccc

SEQ ID NO: 1703800 - DNA, 15 bp, Homo sapiens
ctgccaccttcaagt

SEQ ID NO: 1703801 - DNA, 17 bp, Homo sapiens
ctgccactctctgggac

SEQ ID NO: 1703802 - DNA, 18 bp, Homo sapiens
ctgccactctctgggact

SEQ ID NO: 1703803 - DNA, 13 bp, Homo sapiens
ctgccactgagga

SEQ ID NO: 1703804 - DNA, 13 bp, Homo sapiens
ctgccactgccgc

SEQ ID NO: 1703805 - DNA, 16 bp, Homo sapiens
ctgccactgggcacct

SEQ ID NO: 1703806 - DNA, 18 bp, Homo sapiens
ctgccactgggcacctgc

SEQ ID NO: 1703807 - DNA, 12 bp, Homo sapiens
ctgccagcacag

SEQ ID NO: 1703808 - DNA, 15 bp, Homo sapiens
ctgccagcacagagc

SEQ ID NO: 1703809 - DNA, 12 bp, Homo sapiens
ctgccagcagca

SEQ ID NO: 1703810 - DNA, 17 bp, Homo sapiens
ctgccagcagcagcagg

SEQ ID NO: 1703811 - DNA, 13 bp, Homo sapiens
ctgccagcagggg

SEQ ID NO: 1703812 - DNA, 12 bp, Homo sapiens
ctgccagccaca

SEQ ID NO: 1703813 - DNA, 13 bp, Homo sapiens
ctgccagccagca

SEQ ID NO: 1703814 - DNA, 14 bp, Homo sapiens
ctgccagccagcag

SEQ ID NO: 1703815 - DNA, 20 bp, Homo sapiens
ctgccagccagcagccagct

SEQ ID NO: 1703816 - DNA, 16 bp, Homo sapiens
ctgccagcctggcttc

SEQ ID NO: 1703817 - DNA, 23 bp, Homo sapiens
ctgccagcctggcttctggagcc

SEQ ID NO: 1703818 - DNA, 15 bp, Homo sapiens
ctgccagccttgagc

SEQ ID NO: 1703819 - DNA, 17 bp, Homo sapiens
ctgccagccttgagccc

SEQ ID NO: 1703820 - DNA, 15 bp, Homo sapiens
ctgccagccttggag

SEQ ID NO: 1703821 - DNA, 15 bp, Homo sapiens
ctgccagcgcatgtg

SEQ ID NO: 1703822 - DNA, 20 bp, Homo sapiens
ctgccagcgcatgtgtcctt

SEQ ID NO: 1703823 - DNA, 16 bp, Homo sapiens
ctgccagcgtctgttg

SEQ ID NO: 1703824 - DNA, 13 bp, Homo sapiens
ctgccagctgcac

SEQ ID NO: 1703825 - DNA, 13 bp, Homo sapiens
ctgccagctgcct

SEQ ID NO: 1703826 - DNA, 19 bp, Homo sapiens
ctgccagctgccttcctca

SEQ ID NO: 1703827 - DNA, 16 bp, Homo sapiens
ctgccagctgggccca

SEQ ID NO: 1703828 - DNA, 18 bp, Homo sapiens
ctgccagctgggcccagc

SEQ ID NO: 1703829 - DNA, 19 bp, Homo sapiens
ctgccagctgggcccagca

SEQ ID NO: 1703830 - DNA, 20 bp, Homo sapiens
ctgccagctgggcccagcac

SEQ ID NO: 1703831 - DNA, 16 bp, Homo sapiens
ctgccaggcacctggc

SEQ ID NO: 1703832 - DNA, 19 bp, Homo sapiens
ctgccaggcacctggcctg

SEQ ID NO: 1703833 - DNA, 20 bp, Homo sapiens
ctgccaggcacctggcctgc

SEQ ID NO: 1703834 - DNA, 12 bp, Homo sapiens
ctgccaggcagg

SEQ ID NO: 1703835 - DNA, 13 bp, Homo sapiens
ctgccaggccagc

SEQ ID NO: 1703836 - DNA, 16 bp, Homo sapiens
ctgccaggccagcctc

SEQ ID NO: 1703837 - DNA, 18 bp, Homo sapiens
ctgccaggcccatctcag

SEQ ID NO: 1703838 - DNA, 19 bp, Homo sapiens
ctgccaggcgttggtgcca

SEQ ID NO: 1703839 - DNA, 20 bp, Homo sapiens
ctgccaggctgcctcctgcc

SEQ ID NO: 1703840 - DNA, 13 bp, Homo sapiens
ctgccaggctgtt

SEQ ID NO: 1703841 - DNA, 14 bp, Homo sapiens
ctgccaggctgttt

SEQ ID NO: 1703842 - DNA, 15 bp, Homo sapiens
ctgccaggctgtttc

SEQ ID NO: 1703843 - DNA, 13 bp, Homo sapiens
ctgccagggagct

SEQ ID NO: 1703844 - DNA, 15 bp, Homo sapiens
ctgccaggttcctgt

SEQ ID NO: 1703845 - DNA, 18 bp, Homo sapiens
ctgccagtgcagccactg

SEQ ID NO: 1703846 - DNA, 17 bp, Homo sapiens
ctgccagtgccttacct

SEQ ID NO: 1703847 - DNA, 20 bp, Homo sapiens
ctgccagtgccttacctcct

SEQ ID NO: 1703848 - DNA, 22 bp, Homo sapiens
ctgccagttctctgtggaagca

SEQ ID NO: 1703849 - DNA, 19 bp, Homo sapiens
ctgccataaatatttctca

SEQ ID NO: 1703850 - DNA, 15 bp, Homo sapiens
ctgccataattctaa

SEQ ID NO: 1703851 - DNA, 15 bp, Homo sapiens
ctgccatacataata

SEQ ID NO: 1703852 - DNA, 22 bp, Homo sapiens
ctgccatacataatatatgact

SEQ ID NO: 1703853 - DNA, 15 bp, Homo sapiens
ctgccatattgtgta

SEQ ID NO: 1703854 - DNA, 23 bp, Homo sapiens
ctgccatcatgtttacagaggac

SEQ ID NO: 1703855 - DNA, 19 bp, Homo sapiens
ctgccatcttagtttggat

SEQ ID NO: 1703856 - DNA, 17 bp, Homo sapiens
ctgccatcttcccagca

SEQ ID NO: 1703857 - DNA, 21 bp, Homo sapiens
ctgccatgcaccaggactggc

SEQ ID NO: 1703858 - DNA, 14 bp, Homo sapiens
ctgccatgccactg

SEQ ID NO: 1703859 - DNA, 19 bp, Homo sapiens
ctgccatgccactgccagg

SEQ ID NO: 1703860 - DNA, 17 bp, Homo sapiens
ctgccatgccaggaacc

SEQ ID NO: 1703861 - DNA, 22 bp, Homo sapiens
ctgccatgccaggaacctgtcc

SEQ ID NO: 1703862 - DNA, 22 bp, Homo sapiens
ctgccatggcgtgtccctctcg

SEQ ID NO: 1703863 - DNA, 19 bp, Homo sapiens
ctgccatgtagttggggca

SEQ ID NO: 1703864 - DNA, 19 bp, Homo sapiens
ctgaggttcctctgcctgc

SEQ ID NO: 1703865 - DNA, 21 bp, Homo sapiens
ctgaggttcctctgcctgccc

SEQ ID NO: 1703866 - DNA, 20 bp, Homo sapiens
ctgagtaaacataaaaactg

SEQ ID NO: 1703867 - DNA, 22 bp, Homo sapiens
ctgagtacatattgtggtgatg

SEQ ID NO: 1703868 - DNA, 17 bp, Homo sapiens
ctgagtagctctgcctt

SEQ ID NO: 1703869 - DNA, 19 bp, Homo sapiens
ctgagtagctggattacag

SEQ ID NO: 1703870 - DNA, 20 bp, Homo sapiens
ctgagtatgttaagctcttt

SEQ ID NO: 1703871 - DNA, 15 bp, Homo sapiens
ctgagtattttttat

SEQ ID NO: 1703872 - DNA, 17 bp, Homo sapiens
ctgagtattttttataa

SEQ ID NO: 1703873 - DNA, 14 bp, Homo sapiens
ctgagtcaaatcca

SEQ ID NO: 1703874 - DNA, 15 bp, Homo sapiens
ctgagtcacctcctc

SEQ ID NO: 1703875 - DNA, 15 bp, Homo sapiens
ctgagtcagtgctct

SEQ ID NO: 1703876 - DNA, 21 bp, Homo sapiens
ctgagtcatctgttagggcct

SEQ ID NO: 1703877 - DNA, 21 bp, Homo sapiens
ctgagtccaagagggtccttt

SEQ ID NO: 1703878 - DNA, 14 bp, Homo sapiens
ctgagtccagagct

SEQ ID NO: 1703879 - DNA, 15 bp, Homo sapiens
ctgagtccagagctt

SEQ ID NO: 1703880 - DNA, 14 bp, Homo sapiens
ctgagtcggcccca

SEQ ID NO: 1703881 - DNA, 19 bp, Homo sapiens
ctgagtcgtacagaaagct

SEQ ID NO: 1703882 - DNA, 20 bp, Homo sapiens
ctgagtcgtacagaaagctg

SEQ ID NO: 1703883 - DNA, 13 bp, Homo sapiens
ctgagtctatgtt

SEQ ID NO: 1703884 - DNA, 19 bp, Homo sapiens
ctgagtctatgttcaaaga

SEQ ID NO: 1703885 - DNA, 20 bp, Homo sapiens
ctgagtctatgttcaaagac

SEQ ID NO: 1703886 - DNA, 23 bp, Homo sapiens
ctgagtctatgttcaaagactgt

SEQ ID NO: 1703887 - DNA, 15 bp, Homo sapiens
ctgagtctccagggc

SEQ ID NO: 1703888 - DNA, 16 bp, Homo sapiens
ctgagtctcctgtgcc

SEQ ID NO: 1703889 - DNA, 14 bp, Homo sapiens
ctgagtctgggcag

SEQ ID NO: 1703890 - DNA, 22 bp, Homo sapiens
ctgagtctgggcagctgtccct

SEQ ID NO: 1703891 - DNA, 16 bp, Homo sapiens
ctgagtgagccacaga

SEQ ID NO: 1703892 - DNA, 22 bp, Homo sapiens
ctgagtgatactttaagttaaa

SEQ ID NO: 1703893 - DNA, 18 bp, Homo sapiens
ctgagtggaatgcaggga

SEQ ID NO: 1703894 - DNA, 18 bp, Homo sapiens
ctgagtggcaggggacag

SEQ ID NO: 1703895 - DNA, 13 bp, Homo sapiens
ctgagtgggaagc

SEQ ID NO: 1703896 - DNA, 21 bp, Homo sapiens
ctgagtgggaagcccatcctg

SEQ ID NO: 1703897 - DNA, 17 bp, Homo sapiens
ctgagtgggactttgca

SEQ ID NO: 1703898 - DNA, 18 bp, Homo sapiens
ctgagtgggctgggccct

SEQ ID NO: 1703899 - DNA, 13 bp, Homo sapiens
ctgagtgtcccaa

SEQ ID NO: 1703900 - DNA, 19 bp, Homo sapiens
ctgagttacttgtctgagg

SEQ ID NO: 1703901 - DNA, 19 bp, Homo sapiens
ctgagttaggctttctctt

SEQ ID NO: 1703902 - DNA, 15 bp, Homo sapiens
ctgagttatgatgta

SEQ ID NO: 1703903 - DNA, 23 bp, Homo sapiens
ctgagttctggttcatgcagaca

SEQ ID NO: 1703904 - DNA, 19 bp, Homo sapiens
ctgagttcttgtgtcctgg

SEQ ID NO: 1703905 - DNA, 21 bp, Homo sapiens
ctgagttcttgtgtcctggta

SEQ ID NO: 1703906 - DNA, 16 bp, Homo sapiens
ctgagttgcttttcag

SEQ ID NO: 1703907 - DNA, 15 bp, Homo sapiens
ctgagttggagctca

SEQ ID NO: 1703908 - DNA, 20 bp, Homo sapiens
ctgagttggagctcattctg

SEQ ID NO: 1703909 - DNA, 23 bp, Homo sapiens
ctgagttggcctggccatttcca

SEQ ID NO: 1703910 - DNA, 13 bp, Homo sapiens
ctgagttgttcta

SEQ ID NO: 1703911 - DNA, 16 bp, Homo sapiens
ctgagttgttctaaca

SEQ ID NO: 1703912 - DNA, 15 bp, Homo sapiens
ctgagtttaccattt

SEQ ID NO: 1703913 - DNA, 16 bp, Homo sapiens
ctgagtttccagcctg

SEQ ID NO: 1703914 - DNA, 11 bp, Homo sapiens
ctgagtttcct

SEQ ID NO: 1703915 - DNA, 17 bp, Homo sapiens
ctgagttttgtgtttgt

SEQ ID NO: 1703916 - DNA, 21 bp, Homo sapiens
ctgagttttgtgtttgttgta

SEQ ID NO: 1703917 - DNA, 22 bp, Homo sapiens
ctgagtttttaaaaatggacaa

SEQ ID NO: 1703918 - DNA, 12 bp, Homo sapiens
ctgataaacatt

SEQ ID NO: 1703919 - DNA, 17 bp, Homo sapiens
ctgataaacattaaaca

SEQ ID NO: 1703920 - DNA, 22 bp, Homo sapiens
ctgataaattaacctctcacag

SEQ ID NO: 1703921 - DNA, 19 bp, Homo sapiens
ctgataacttggggaggca

SEQ ID NO: 1703922 - DNA, 14 bp, Homo sapiens
ctgataagcttcaa

SEQ ID NO: 1703923 - DNA, 15 bp, Homo sapiens
ctgataccactgcac

SEQ ID NO: 1703924 - DNA, 21 bp, Homo sapiens
ctgatatatgtgtttttcaca

SEQ ID NO: 1703925 - DNA, 18 bp, Homo sapiens
ctgatatgatttaaaaca

SEQ ID NO: 1703926 - DNA, 22 bp, Homo sapiens
ctgatatgatttaaaacatgta

SEQ ID NO: 1703927 - DNA, 13 bp, Homo sapiens
ctgatatgggact

SEQ ID NO: 1703928 - DNA, 15 bp, Homo sapiens
ctgatatgggactga

SEQ ID NO: 1703929 - DNA, 16 bp, Homo sapiens
ctgatatgggactgag

SEQ ID NO: 1703930 - DNA, 15 bp, Homo sapiens
ctgatattaatcaaa

SEQ ID NO: 1703931 - DNA, 16 bp, Homo sapiens
ctgatattaatcaaaa

SEQ ID NO: 1703932 - DNA, 19 bp, Homo sapiens
ctgatattatggcaagtga

SEQ ID NO: 1703933 - DNA, 16 bp, Homo sapiens
ctgatattatttcttc

SEQ ID NO: 1703934 - DNA, 17 bp, Homo sapiens
ctgatattatttcttct

SEQ ID NO: 1703935 - DNA, 15 bp, Homo sapiens
ctgatatttatagaa

SEQ ID NO: 1703936 - DNA, 14 bp, Homo sapiens
ctgatcaaaaataa

SEQ ID NO: 1703937 - DNA, 15 bp, Homo sapiens
ctgatcaaaaataaa

SEQ ID NO: 1703938 - DNA, 20 bp, Homo sapiens
ctgatcaaaaataaactagt

SEQ ID NO: 1703939 - DNA, 22 bp, Homo sapiens
ctgatcaaaaataaactagttt

SEQ ID NO: 1703940 - DNA, 19 bp, Homo sapiens
ctgatcaggcttcctggtg

SEQ ID NO: 1703941 - DNA, 21 bp, Homo sapiens
ctgatccagagcacagatctg

SEQ ID NO: 1703942 - DNA, 20 bp, Homo sapiens
ctgatcccaccccctcctcc

SEQ ID NO: 1703943 - DNA, 16 bp, Homo sapiens
ctgatcccagacctgt

SEQ ID NO: 1703944 - DNA, 16 bp, Homo sapiens
ctgatcccatggccag

SEQ ID NO: 1703945 - DNA, 20 bp, Homo sapiens
ctgatcccggccggccctgg

SEQ ID NO: 1703946 - DNA, 22 bp, Homo sapiens
ctgatcccggccggccctggct

SEQ ID NO: 1703947 - DNA, 21 bp, Homo sapiens
ctgatccctgaacccctggcc

SEQ ID NO: 1703948 - DNA, 18 bp, Homo sapiens
ctgatccctgctctctga

SEQ ID NO: 1703949 - DNA, 19 bp, Homo sapiens
ctgatccgtccgaggctgc

SEQ ID NO: 1703950 - DNA, 20 bp, Homo sapiens
ctgatccgtccgaggctgct

SEQ ID NO: 1703951 - DNA, 13 bp, Homo sapiens
ctgatcctgctcc

SEQ ID NO: 1703952 - DNA, 16 bp, Homo sapiens
ctgatcctgctccagc

SEQ ID NO: 1703953 - DNA, 19 bp, Homo sapiens
ctgatcctgctccagcagc

SEQ ID NO: 1703954 - DNA, 13 bp, Homo sapiens
ctgatcctgctga

SEQ ID NO: 1703955 - DNA, 17 bp, Homo sapiens
ctgatcctggaggccca

SEQ ID NO: 1703956 - DNA, 21 bp, Homo sapiens
ctgatcgtgctaaattttcag

SEQ ID NO: 1703957 - DNA, 13 bp, Homo sapiens
ctgatctaacaaa

SEQ ID NO: 1703958 - DNA, 18 bp, Homo sapiens
ctgatctaacaaaataag

SEQ ID NO: 1703959 - DNA, 19 bp, Homo sapiens
ctgatctaacaaaataagg

SEQ ID NO: 1703960 - DNA, 13 bp, Homo sapiens
ctgatctcaggga

SEQ ID NO: 1703961 - DNA, 21 bp, Homo sapiens
ctgatctcagggaagcccagc

SEQ ID NO: 1703962 - DNA, 21 bp, Homo sapiens
ctgatctctactaccacaagg

SEQ ID NO: 1703963 - DNA, 18 bp, Homo sapiens
ctgatctctcagccccaa

SEQ ID NO: 1703964 - DNA, 12 bp, Homo sapiens
ctgatctgccca

SEQ ID NO: 1703965 - DNA, 16 bp, Homo sapiens
ctgatctgcccatcgt

SEQ ID NO: 1703966 - DNA, 14 bp, Homo sapiens
ctgatctgttatag

SEQ ID NO: 1703967 - DNA, 14 bp, Homo sapiens
ctgatcttgcctgt

SEQ ID NO: 1703968 - DNA, 16 bp, Homo sapiens
ctgatctttctagagc

SEQ ID NO: 1703969 - DNA, 18 bp, Homo sapiens
ctgatcttttaaaatcat

SEQ ID NO: 1703970 - DNA, 13 bp, Homo sapiens
ctgatgaaatctg

SEQ ID NO: 1703971 - DNA, 21 bp, Homo sapiens
ctgatgaactcttaatcaaat

SEQ ID NO: 1703972 - DNA, 17 bp, Homo sapiens
ctgatgaagaagggggt

SEQ ID NO: 1703973 - DNA, 12 bp, Homo sapiens
ctgatgacccag

SEQ ID NO: 1703974 - DNA, 14 bp, Homo sapiens
ctgatgacccaggc

SEQ ID NO: 1703975 - DNA, 19 bp, Homo sapiens
ctgatgacccaggctgcct

SEQ ID NO: 1703976 - DNA, 21 bp, Homo sapiens
ctgatgatcaaaacctgtgcc

SEQ ID NO: 1703977 - DNA, 17 bp, Homo sapiens
ctgatgatccagaacag

SEQ ID NO: 1703978 - DNA, 13 bp, Homo sapiens
ctgatgcagacac

SEQ ID NO: 1703979 - DNA, 15 bp, Homo sapiens
ctgatgcagcctgtg

SEQ ID NO: 1703980 - DNA, 18 bp, Homo sapiens
ctgatgcagcctgtggct

SEQ ID NO: 1703981 - DNA, 22 bp, Homo sapiens
ctgcaaggtggcctctgcctgg

SEQ ID NO: 1703982 - DNA, 16 bp, Homo sapiens
ctgcaatagagactgt

SEQ ID NO: 1703983 - DNA, 20 bp, Homo sapiens
ctgcaatagagactgtagat

SEQ ID NO: 1703984 - DNA, 23 bp, Homo sapiens
ctgcaatcctgtctttctgagca

SEQ ID NO: 1703985 - DNA, 14 bp, Homo sapiens
ctgcaatgagccat

SEQ ID NO: 1703986 - DNA, 18 bp, Homo sapiens
ctgcaattcaaaagttcc

SEQ ID NO: 1703987 - DNA, 16 bp, Homo sapiens
ctgcaattcccctctg

SEQ ID NO: 1703988 - DNA, 20 bp, Homo sapiens
ctgcaatttcatatgctgta

SEQ ID NO: 1703989 - DNA, 17 bp, Homo sapiens
ctgcacaaaagcagata

SEQ ID NO: 1703990 - DNA, 23 bp, Homo sapiens
ctgcacaaaagcagatacttgag

SEQ ID NO: 1703991 - DNA, 16 bp, Homo sapiens
ctgcacaaacatgaaa

SEQ ID NO: 1703992 - DNA, 18 bp, Homo sapiens
ctgcacaaacatgaaaat

SEQ ID NO: 1703993 - DNA, 18 bp, Homo sapiens
ctgcacaagccagggtgt

SEQ ID NO: 1703994 - DNA, 15 bp, Homo sapiens
ctgcacaataaaaat

SEQ ID NO: 1703995 - DNA, 22 bp, Homo sapiens
ctgcacaataaaaatgtttaac

SEQ ID NO: 1703996 - DNA, 15 bp, Homo sapiens
ctgcacacacctgcc

SEQ ID NO: 1703997 - DNA, 14 bp, Homo sapiens
ctgcacacaggaca

SEQ ID NO: 1703998 - DNA, 18 bp, Homo sapiens
ctgcacaccctccagaga

SEQ ID NO: 1703999 - DNA, 20 bp, Homo sapiens
ctgcacaccctccagagaca

SEQ ID NO: 1704000 - DNA, 18 bp, Homo sapiens
ctgcacagacaagcagcc

SEQ ID NO: 1704001 - DNA, 19 bp, Homo sapiens
ctgcacagacaagcagccc

SEQ ID NO: 1704002 - DNA, 16 bp, Homo sapiens
ctgcacagcatttgct

SEQ ID NO: 1704003 - DNA, 13 bp, Homo sapiens
ctgcacagcctct

SEQ ID NO: 1704004 - DNA, 19 bp, Homo sapiens
ctgcacaggagaattaccc

SEQ ID NO: 1704005 - DNA, 21 bp, Homo sapiens
ctgcacaggcacacagggccc

SEQ ID NO: 1704006 - DNA, 22 bp, Homo sapiens
ctgcacagtgcatctcagccca

SEQ ID NO: 1704007 - DNA, 23 bp, Homo sapiens
ctgcacatgaaagttttgcaaag

SEQ ID NO: 1704008 - DNA, 22 bp, Homo sapiens
ctgcacatgaatcccacccaca

SEQ ID NO: 1704009 - DNA, 14 bp, Homo sapiens
ctgcacatgtcttg

SEQ ID NO: 1704010 - DNA, 23 bp, Homo sapiens
ctgcacatgtcttgtacatgtgt

SEQ ID NO: 1704011 - DNA, 12 bp, Homo sapiens
ctgcacatgtgc

SEQ ID NO: 1704012 - DNA, 13 bp, Homo sapiens
ctgcacatgtgcc

SEQ ID NO: 1704013 - DNA, 20 bp, Homo sapiens
ctgcacatgtgccacacagt

SEQ ID NO: 1704014 - DNA, 16 bp, Homo sapiens
ctgcacattcctggcc

SEQ ID NO: 1704015 - DNA, 17 bp, Homo sapiens
ctgcacattcctggccc

SEQ ID NO: 1704016 - DNA, 21 bp, Homo sapiens
ctgcacattgcctgttctgct

SEQ ID NO: 1704017 - DNA, 13 bp, Homo sapiens
ctgcaccaaacct

SEQ ID NO: 1704018 - DNA, 19 bp, Homo sapiens
ctgcaccagcgcccccaga

SEQ ID NO: 1704019 - DNA, 15 bp, Homo sapiens
ctgcaccaggagaca

SEQ ID NO: 1704020 - DNA, 23 bp, Homo sapiens
ctgcaccatgctgctggggaaga

SEQ ID NO: 1704021 - DNA, 22 bp, Homo sapiens
ctgcacccacccctgcccaggc

SEQ ID NO: 1704022 - DNA, 18 bp, Homo sapiens
ctgcacccagaacagtgg

SEQ ID NO: 1704023 - DNA, 11 bp, Homo sapiens
ctgcacccagt

SEQ ID NO: 1704024 - DNA, 14 bp, Homo sapiens
ctgcacccagtgaa

SEQ ID NO: 1704025 - DNA, 12 bp, Homo sapiens
ctgcaccccagc

SEQ ID NO: 1704026 - DNA, 17 bp, Homo sapiens
ctgcaccccagcattcc

SEQ ID NO: 1704027 - DNA, 18 bp, Homo sapiens
ctgcaccccagcattcca

SEQ ID NO: 1704028 - DNA, 12 bp, Homo sapiens
ctgcaccctcca

SEQ ID NO: 1704029 - DNA, 14 bp, Homo sapiens
ctgcaccctccacc

SEQ ID NO: 1704030 - DNA, 16 bp, Homo sapiens
ctgcaccctccaccct

SEQ ID NO: 1704031 - DNA, 17 bp, Homo sapiens
ctgcaccctccaccctg

SEQ ID NO: 1704032 - DNA, 18 bp, Homo sapiens
ctgcaccctgcgcctcca

SEQ ID NO: 1704033 - DNA, 20 bp, Homo sapiens
ctgcaccctgcgcctccaga

SEQ ID NO: 1704034 - DNA, 22 bp, Homo sapiens
ctgcaccctggggcctggacct

SEQ ID NO: 1704035 - DNA, 16 bp, Homo sapiens
ctgcacccttccctct

SEQ ID NO: 1704036 - DNA, 11 bp, Homo sapiens
ctgcacctccc

SEQ ID NO: 1704037 - DNA, 18 bp, Homo sapiens
ctgcacctccccccactg

SEQ ID NO: 1704038 - DNA, 22 bp, Homo sapiens
ctgcacctccccccactgcagg

SEQ ID NO: 1704039 - DNA, 22 bp, Homo sapiens
ctgcacctctggctagagccga

SEQ ID NO: 1704040 - DNA, 24 bp, Homo sapiens
ctgcacctctggctagagccgagg

SEQ ID NO: 1704041 - DNA, 16 bp, Homo sapiens
ctgcacctgccagcct

SEQ ID NO: 1704042 - DNA, 17 bp, Homo sapiens
ctgcacctgccagcctg

SEQ ID NO: 1704043 - DNA, 19 bp, Homo sapiens
ctgcacctgccagcctggc

SEQ ID NO: 1704044 - DNA, 17 bp, Homo sapiens
ctgcacctgctgcgtcc

SEQ ID NO: 1704045 - DNA, 13 bp, Homo sapiens
ctgcacctggcct

SEQ ID NO: 1704046 - DNA, 19 bp, Homo sapiens
ctgcacctggcctgggcca

SEQ ID NO: 1704047 - DNA, 13 bp, Homo sapiens
ctgcacctgtgca

SEQ ID NO: 1704048 - DNA, 23 bp, Homo sapiens
ctgcactactcctctgcagtgcc

SEQ ID NO: 1704049 - DNA, 16 bp, Homo sapiens
ctgcactactgacatg

SEQ ID NO: 1704050 - DNA, 17 bp, Homo sapiens
ctgcactcaaccttaag

SEQ ID NO: 1704051 - DNA, 20 bp, Homo sapiens
ctgcactccaatctgggtga

SEQ ID NO: 1704052 - DNA, 11 bp, Homo sapiens
ctgcactccag

SEQ ID NO: 1704053 - DNA, 13 bp, Homo sapiens
ctgcactccagcc

SEQ ID NO: 1704054 - DNA, 14 bp, Homo sapiens
ctgcactccagcct

SEQ ID NO: 1704055 - DNA, 17 bp, Homo sapiens
ctgcactccagcctgag

SEQ ID NO: 1704056 - DNA, 23 bp, Homo sapiens
ctgcactccagcctgagtgacag

SEQ ID NO: 1704057 - DNA, 24 bp, Homo sapiens
ctgcactccagcctgagtgacaga

SEQ ID NO: 1704058 - DNA, 17 bp, Homo sapiens
ctgcactccagcctggg

SEQ ID NO: 1704059 - DNA, 18 bp, Homo sapiens
ctgcactccagcctgggc

SEQ ID NO: 1704060 - DNA, 19 bp, Homo sapiens
ctgcactccagcctgggcg

SEQ ID NO: 1704061 - DNA, 20 bp, Homo sapiens
ctgcactccagcctggggga

SEQ ID NO: 1704062 - DNA, 18 bp, Homo sapiens
ctgcactccatggccacc

SEQ ID NO: 1704063 - DNA, 16 bp, Homo sapiens
ctgcactcccacctga

SEQ ID NO: 1704064 - DNA, 18 bp, Homo sapiens
ctgcactccctcctggag

SEQ ID NO: 1704065 - DNA, 15 bp, Homo sapiens
ctgcactccctggcc

SEQ ID NO: 1704066 - DNA, 15 bp, Homo sapiens
ctgcactcctcaggg

SEQ ID NO: 1704067 - DNA, 15 bp, Homo sapiens
ctgcactgatgctgc

SEQ ID NO: 1704068 - DNA, 17 bp, Homo sapiens
ctgcactgatgctgccc

SEQ ID NO: 1704069 - DNA, 22 bp, Homo sapiens
ctgcactgctgtttggtttgga

SEQ ID NO: 1704070 - DNA, 18 bp, Homo sapiens
ctgcactgtaaaatgtgg

SEQ ID NO: 1704071 - DNA, 20 bp, Homo sapiens
ctgcactgtaaaatgtggga

SEQ ID NO: 1704072 - DNA, 13 bp, Homo sapiens
ctgcactttcccc

SEQ ID NO: 1704073 - DNA, 18 bp, Homo sapiens
ctgcactttcccccttcc

SEQ ID NO: 1704074 - DNA, 16 bp, Homo sapiens
ctgcagaaactactga

SEQ ID NO: 1704075 - DNA, 15 bp, Homo sapiens
ctgcagaacccacca

SEQ ID NO: 1704076 - DNA, 16 bp, Homo sapiens
ctgcagaacccccagg

SEQ ID NO: 1704077 - DNA, 18 bp, Homo sapiens
ctgcagaacccccaggtg

SEQ ID NO: 1704078 - DNA, 13 bp, Homo sapiens
ctgcagaaggaaa

SEQ ID NO: 1704079 - DNA, 15 bp, Homo sapiens
ctgcagaaggaaaga

SEQ ID NO: 1704080 - DNA, 14 bp, Homo sapiens
ctgcagacaggctc

SEQ ID NO: 1704081 - DNA, 11 bp, Homo sapiens
ctgcagactcc

SEQ ID NO: 1704082 - DNA, 21 bp, Homo sapiens
ctgcagagaaacttaagcaaa

SEQ ID NO: 1704083 - DNA, 23 bp, Homo sapiens
ctgcagagatttctcattgactt

SEQ ID NO: 1704084 - DNA, 13 bp, Homo sapiens
ctgcagagcacac

SEQ ID NO: 1704085 - DNA, 16 bp, Homo sapiens
ctgcagagcacacagg

SEQ ID NO: 1704086 - DNA, 16 bp, Homo sapiens
ctgcagagctgaccca

SEQ ID NO: 1704087 - DNA, 13 bp, Homo sapiens
ctgcagaggccag

SEQ ID NO: 1704088 - DNA, 17 bp, Homo sapiens
ctgcagaggccagaggc

SEQ ID NO: 1704089 - DNA, 23 bp, Homo sapiens
ctgcagaggggaaaccagtgtag

SEQ ID NO: 1704090 - DNA, 22 bp, Homo sapiens
ctgcagaggggctttctggaga

SEQ ID NO: 1704091 - DNA, 16 bp, Homo sapiens
ctgcagaggtctgtgc

SEQ ID NO: 1704092 - DNA, 18 bp, Homo sapiens
ctgcagaggtctgtgctg

SEQ ID NO: 1704093 - DNA, 17 bp, Homo sapiens
ctgcagagtctgcccca

SEQ ID NO: 1704094 - DNA, 18 bp, Homo sapiens
ctgcagatcttccgtggt

SEQ ID NO: 1704095 - DNA, 19 bp, Homo sapiens
ctgcagatgccaccctagc

SEQ ID NO: 1704096 - DNA, 23 bp, Homo sapiens
ctgcagattagttctttttgcca

SEQ ID NO: 1704097 - DNA, 18 bp, Homo sapiens
ctgcagcaaacactccac

SEQ ID NO: 1704098 - DNA, 21 bp, Homo sapiens
ctgcagcacatgcgggctcgc

SEQ ID NO: 1704099 - DNA, 22 bp, Homo sapiens
ctgcagcacatgcgggctcgcc

SEQ ID NO: 1704100 - DNA, 19 bp, Homo sapiens
ctgcagcaccgaggggcct

SEQ ID NO: 1704101 - DNA, 12 bp, Homo sapiens
ctgcagcacctc

SEQ ID NO: 1704102 - DNA, 21 bp, Homo sapiens
ctgcagcacctcacctgagac

SEQ ID NO: 1704103 - DNA, 15 bp, Homo sapiens
ctgcagcacctccag

SEQ ID NO: 1704104 - DNA, 18 bp, Homo sapiens
ctgcagcacctccaggcc

SEQ ID NO: 1704105 - DNA, 13 bp, Homo sapiens
ctgcagcagagtg

SEQ ID NO: 1704106 - DNA, 14 bp, Homo sapiens
ctgcagcagagtga

SEQ ID NO: 1704107 - DNA, 19 bp, Homo sapiens
ctgcagcagagtgagcaag

SEQ ID NO: 1704108 - DNA, 22 bp, Homo sapiens
ctgcagcagagtgagcaagggg

SEQ ID NO: 1704109 - DNA, 15 bp, Homo sapiens
ctgcagcaggtgctg

SEQ ID NO: 1704110 - DNA, 22 bp, Homo sapiens
ctgcagcaggtgctgggctgga

SEQ ID NO: 1704111 - DNA, 22 bp, Homo sapiens
ctgcagcatgttgctgaggagt

SEQ ID NO: 1704112 - DNA, 17 bp, Homo sapiens
ctgcagccagcccagcc

SEQ ID NO: 1704113 - DNA, 22 bp, Homo sapiens
ctgcagccagcccagcccagct

SEQ ID NO: 1704114 - DNA, 23 bp, Homo sapiens
ctgcagcccaaaacccagggcaa

SEQ ID NO: 1704115 - DNA, 12 bp, Homo sapiens
ctgcagccccct

SEQ ID NO: 1704116 - DNA, 24 bp, Homo sapiens
ctgcagcccggcgccaccatcctg

SEQ ID NO: 1704117 - DNA, 14 bp, Homo sapiens
ctgcagccctgcca

SEQ ID NO: 1704118 - DNA, 18 bp, Homo sapiens
ctgcagcctcccttccat

SEQ ID NO: 1704119 - DNA, 20 bp, Homo sapiens
ctgcagcctttgcctccccg

SEQ ID NO: 1704120 - DNA, 14 bp, Homo sapiens
ctgcagcggcagag

SEQ ID NO: 1704121 - DNA, 16 bp, Homo sapiens
ctgcagcggcagagca

SEQ ID NO: 1704122 - DNA, 17 bp, Homo sapiens
ctgcagctgatccatag

SEQ ID NO: 1704123 - DNA, 13 bp, Homo sapiens
ctgcagctgccgg

SEQ ID NO: 1704124 - DNA, 22 bp, Homo sapiens
ctgcagctgctgaagttctgag

SEQ ID NO: 1704125 - DNA, 16 bp, Homo sapiens
ctgcagctgggcccca

SEQ ID NO: 1704126 - DNA, 22 bp, Homo sapiens
ctgcagctgggccccatgctct

SEQ ID NO: 1704127 - DNA, 23 bp, Homo sapiens
ctgcagctgggccccatgctctg

SEQ ID NO: 1704128 - DNA, 14 bp, Homo sapiens
ctgcagctgtttca

SEQ ID NO: 1704129 - DNA, 22 bp, Homo sapiens
ctgcaggaacgagcactggcca

SEQ ID NO: 1704130 - DNA, 14 bp, Homo sapiens
ctgcaggaagaaac

SEQ ID NO: 1704131 - DNA, 15 bp, Homo sapiens
ctgcaggaagaaact

SEQ ID NO: 1704132 - DNA, 11 bp, Homo sapiens
ctgcaggactt

SEQ ID NO: 1704133 - DNA, 19 bp, Homo sapiens
ctgcaggacttctgcctga

SEQ ID NO: 1704134 - DNA, 19 bp, Homo sapiens
ctgcaggacttgagaagac

SEQ ID NO: 1704135 - DNA, 15 bp, Homo sapiens
ctgcaggacttgcca

SEQ ID NO: 1704136 - DNA, 19 bp, Homo sapiens
ctgcaggcaacactttagc

SEQ ID NO: 1704137 - DNA, 22 bp, Homo sapiens
ctgcaggcaggaacaaacaggg

SEQ ID NO: 1704138 - DNA, 15 bp, Homo sapiens
ctgcaggccactgtg

SEQ ID NO: 1704139 - DNA, 20 bp, Homo sapiens
ctgcaggccccgcttgtcca

SEQ ID NO: 1704140 - DNA, 22 bp, Homo sapiens
ctgcaggccccgcttgtccagc

SEQ ID NO: 1704141 - DNA, 14 bp, Homo sapiens
ctgcaggccctggc

SEQ ID NO: 1704142 - DNA, 15 bp, Homo sapiens
ctgcaggccctggcc

SEQ ID NO: 1704143 - DNA, 17 bp, Homo sapiens
ctgcaggccctggcctc

SEQ ID NO: 1704144 - DNA, 20 bp, Homo sapiens
ctgcaggcctgactactgcc

SEQ ID NO: 1704145 - DNA, 19 bp, Homo sapiens
ctgcaggctccatgcacct

SEQ ID NO: 1704146 - DNA, 20 bp, Homo sapiens
ctgcaggctccatgcacctc

SEQ ID NO: 1704147 - DNA, 12 bp, Homo sapiens
ctgcaggctgca

SEQ ID NO: 1704148 - DNA, 13 bp, Homo sapiens
ctgcaggctgcac

SEQ ID NO: 1704149 - DNA, 14 bp, Homo sapiens
ctgcagggcttctc

SEQ ID NO: 1704150 - DNA, 16 bp, Homo sapiens
ctgcagggcttctcct

SEQ ID NO: 1704151 - DNA, 19 bp, Homo sapiens
ctgcagggctttaaaattc

SEQ ID NO: 1704152 - DNA, 19 bp, Homo sapiens
ctgcaggggcctctgttcc

SEQ ID NO: 1704153 - DNA, 17 bp, Homo sapiens
ctgcagggggtgtgtct

SEQ ID NO: 1704154 - DNA, 20 bp, Homo sapiens
ctgcagggggtgtgtctgct

SEQ ID NO: 1704155 - DNA, 20 bp, Homo sapiens
ctgcagggtggtgctgggac

SEQ ID NO: 1704156 - DNA, 21 bp, Homo sapiens
ctgcagggtggtgctgggact

SEQ ID NO: 1704157 - DNA, 19 bp, Homo sapiens
ctgcaggtacttcctcctg

SEQ ID NO: 1704158 - DNA, 20 bp, Homo sapiens
ctgcaggtacttcctcctga

SEQ ID NO: 1704159 - DNA, 23 bp, Homo sapiens
ctgcaggtacttcctcctgatgg

SEQ ID NO: 1704160 - DNA, 17 bp, Homo sapiens
ctgcaggtgagcaggca

SEQ ID NO: 1704161 - DNA, 16 bp, Homo sapiens
ctgcagtagaaggtgc

SEQ ID NO: 1704162 - DNA, 17 bp, Homo sapiens
ctgcagtcaacagttca

SEQ ID NO: 1704163 - DNA, 23 bp, Homo sapiens
ctgcagtcaacagttcaaagaag

SEQ ID NO: 1704164 - DNA, 12 bp, Homo sapiens
ctgcagtcagat

SEQ ID NO: 1704165 - DNA, 13 bp, Homo sapiens
ctgcagtcagccc

SEQ ID NO: 1704166 - DNA, 16 bp, Homo sapiens
ctgcagtcatctcccc

SEQ ID NO: 1704167 - DNA, 21 bp, Homo sapiens
ctgcagtccgcagtctggcct

SEQ ID NO: 1704168 - DNA, 23 bp, Homo sapiens
ctgcagtcggcatgccaggaccc

SEQ ID NO: 1704169 - DNA, 17 bp, Homo sapiens
ctgcagtctcatttctc

SEQ ID NO: 1704170 - DNA, 18 bp, Homo sapiens
ctgcagtctcatttctca

SEQ ID NO: 1704171 - DNA, 14 bp, Homo sapiens
ctgcagtgattcag

SEQ ID NO: 1704172 - DNA, 20 bp, Homo sapiens
ctgcagtgattcagcaggcc

SEQ ID NO: 1704173 - DNA, 14 bp, Homo sapiens
ctgcagtgccagct

SEQ ID NO: 1704174 - DNA, 21 bp, Homo sapiens
ctgcagttcatccgcactgta

SEQ ID NO: 1704175 - DNA, 18 bp, Homo sapiens
ctgcagttggcagaaagg

SEQ ID NO: 1704176 - DNA, 16 bp, Homo sapiens
ctgcagtttcctggaa

SEQ ID NO: 1704177 - DNA, 16 bp, Homo sapiens
ctgcagtttggccctg

SEQ ID NO: 1704178 - DNA, 18 bp, Homo sapiens
ctgcagtttggccctgga

SEQ ID NO: 1704179 - DNA, 20 bp, Homo sapiens
ctgcagtttggccctggagc

SEQ ID NO: 1704180 - DNA, 15 bp, Homo sapiens
ctgcagttttgctat

SEQ ID NO: 1704181 - DNA, 16 bp, Homo sapiens
ctgcagttttgctatc

SEQ ID NO: 1704182 - DNA, 22 bp, Homo sapiens
ctgcagttttgctatctgggct

SEQ ID NO: 1704183 - DNA, 14 bp, Homo sapiens
ctgcagtttttcag

SEQ ID NO: 1704184 - DNA, 24 bp, Homo sapiens
ctgcagtttttcaggagcgcaaga

SEQ ID NO: 1704185 - DNA, 16 bp, Homo sapiens
ctgcagtttttcccaa

SEQ ID NO: 1704186 - DNA, 17 bp, Homo sapiens
ctgcagtttttcccaag

SEQ ID NO: 1704187 - DNA, 24 bp, Homo sapiens
ctgcatacgttttggtgttgcttt

SEQ ID NO: 1704188 - DNA, 20 bp, Homo sapiens
ctgcatactttgacaaggaa

SEQ ID NO: 1704189 - DNA, 22 bp, Homo sapiens
ctgcatactttgacaaggaaaa

SEQ ID NO: 1704190 - DNA, 14 bp, Homo sapiens
ctgcataggaattt

SEQ ID NO: 1704191 - DNA, 22 bp, Homo sapiens
ctgcataggagtttggaggaag

SEQ ID NO: 1704192 - DNA, 21 bp, Homo sapiens
ctgcatatagataattatcca

SEQ ID NO: 1704193 - DNA, 20 bp, Homo sapiens
ctgcatatcctggtgtctag

SEQ ID NO: 1704194 - DNA, 13 bp, Homo sapiens
ctgcatcatctgt

SEQ ID NO: 1704195 - DNA, 22 bp, Homo sapiens
ctgcatcccgatacctcagccc

SEQ ID NO: 1704196 - DNA, 21 bp, Homo sapiens
ctgcatcccttcgcctgcagc

SEQ ID NO: 1704197 - DNA, 18 bp, Homo sapiens
ctgcatccttcctgggga

SEQ ID NO: 1704198 - DNA, 19 bp, Homo sapiens
ctgcatccttcctggggac

SEQ ID NO: 1704199 - DNA, 16 bp, Homo sapiens
ctgcatctcaaaaaaa

SEQ ID NO: 1704200 - DNA, 18 bp, Homo sapiens
ctgcatctggggcccata

SEQ ID NO: 1704201 - DNA, 16 bp, Homo sapiens
ctgcatgaatatcata

SEQ ID NO: 1704202 - DNA, 15 bp, Homo sapiens
ctgcatgagctggca

SEQ ID NO: 1704203 - DNA, 15 bp, Homo sapiens
ctgcatgatgtttgc

SEQ ID NO: 1704204 - DNA, 16 bp, Homo sapiens
ctgcatgatgtttgcc

SEQ ID NO: 1704205 - DNA, 13 bp, Homo sapiens
ctgcatgcgacag

SEQ ID NO: 1704206 - DNA, 14 bp, Homo sapiens
ctgcatgctctgga

SEQ ID NO: 1704207 - DNA, 15 bp, Homo sapiens
ctgcatgctctggaa

SEQ ID NO: 1704208 - DNA, 12 bp, Homo sapiens
ctgcatggacct

SEQ ID NO: 1704209 - DNA, 13 bp, Homo sapiens
ctgcatggaccta

SEQ ID NO: 1704210 - DNA, 16 bp, Homo sapiens
ctgcatggacctaaca

SEQ ID NO: 1704211 - DNA, 17 bp, Homo sapiens
ctgcatggacctaacat

SEQ ID NO: 1704212 - DNA, 17 bp, Homo sapiens
ctgcatggattcagcat

SEQ ID NO: 1704213 - DNA, 15 bp, Homo sapiens
ctgatgcccctgaca

SEQ ID NO: 1704214 - DNA, 23 bp, Homo sapiens
ctgatgcccgttgtctaggagac

SEQ ID NO: 1704215 - DNA, 18 bp, Homo sapiens
ctgatgcctgaatgtatc

SEQ ID NO: 1704216 - DNA, 14 bp, Homo sapiens
ctgatgctccctcc

SEQ ID NO: 1704217 - DNA, 17 bp, Homo sapiens
ctgatgctccctcccct

SEQ ID NO: 1704218 - DNA, 19 bp, Homo sapiens
ctgatgctccctcccctgc

SEQ ID NO: 1704219 - DNA, 24 bp, Homo sapiens
ctgatgctccctcccctgccctgg

SEQ ID NO: 1704220 - DNA, 11 bp, Homo sapiens
ctgatgctgcc

SEQ ID NO: 1704221 - DNA, 14 bp, Homo sapiens
ctgatgctgcccct

SEQ ID NO: 1704222 - DNA, 21 bp, Homo sapiens
ctgatggaaaataccagtgtt

SEQ ID NO: 1704223 - DNA, 21 bp, Homo sapiens
ctgatggaagatggtccgtgc

SEQ ID NO: 1704224 - DNA, 17 bp, Homo sapiens
ctgatggagccccacct

SEQ ID NO: 1704225 - DNA, 15 bp, Homo sapiens
ctgatggaggaaaaa

SEQ ID NO: 1704226 - DNA, 15 bp, Homo sapiens
ctgatggagtgtgca

SEQ ID NO: 1704227 - DNA, 19 bp, Homo sapiens
ctgatggagtgtgcagaca

SEQ ID NO: 1704228 - DNA, 15 bp, Homo sapiens
ctgatggattccaaa

SEQ ID NO: 1704229 - DNA, 12 bp, Homo sapiens
ctgatggcagct

SEQ ID NO: 1704230 - DNA, 11 bp, Homo sapiens
ctgatggccaa

SEQ ID NO: 1704231 - DNA, 15 bp, Homo sapiens
ctgatggccaagagc

SEQ ID NO: 1704232 - DNA, 16 bp, Homo sapiens
ctgatggccaagagca

SEQ ID NO: 1704233 - DNA, 20 bp, Homo sapiens
ctgatggcccctccagcaca

SEQ ID NO: 1704234 - DNA, 19 bp, Homo sapiens
ctgatggccttaatttcct

SEQ ID NO: 1704235 - DNA, 13 bp, Homo sapiens
ctgatggctcaag

SEQ ID NO: 1704236 - DNA, 23 bp, Homo sapiens
ctgatggctgctagattttaatt

SEQ ID NO: 1704237 - DNA, 17 bp, Homo sapiens
ctgatggggtcgctctt

SEQ ID NO: 1704238 - DNA, 18 bp, Homo sapiens
ctgatggtcttaaatgct

SEQ ID NO: 1704239 - DNA, 18 bp, Homo sapiens
ctgatggtgctgctcagg

SEQ ID NO: 1704240 - DNA, 15 bp, Homo sapiens
ctgatgtaggagctg

SEQ ID NO: 1704241 - DNA, 17 bp, Homo sapiens
ctgatgtaggagctgga

SEQ ID NO: 1704242 - DNA, 19 bp, Homo sapiens
ctgatgtcaatttctgtgt

SEQ ID NO: 1704243 - DNA, 12 bp, Homo sapiens
ctgatgtcatct

SEQ ID NO: 1704244 - DNA, 16 bp, Homo sapiens
ctgatgtcatcttgag

SEQ ID NO: 1704245 - DNA, 18 bp, Homo sapiens
ctgatgtcatcttgagct

SEQ ID NO: 1704246 - DNA, 20 bp, Homo sapiens
ctgatgtccatttgtcccaa

SEQ ID NO: 1704247 - DNA, 22 bp, Homo sapiens
ctgatgtccatttgtcccaata

SEQ ID NO: 1704248 - DNA, 22 bp, Homo sapiens
ctgatgtcttaacgaataaagg

SEQ ID NO: 1704249 - DNA, 23 bp, Homo sapiens
ctgatgtgacttttatatgcttt

SEQ ID NO: 1704250 - DNA, 13 bp, Homo sapiens
ctgatgtggactg

SEQ ID NO: 1704251 - DNA, 17 bp, Homo sapiens
ctgatgtggactgtctt

SEQ ID NO: 1704252 - DNA, 14 bp, Homo sapiens
ctgatgtttctgtg

SEQ ID NO: 1704253 - DNA, 16 bp, Homo sapiens
ctgatgtttctgtgaa

SEQ ID NO: 1704254 - DNA, 13 bp, Homo sapiens
ctgatgtttgtgc

SEQ ID NO: 1704255 - DNA, 19 bp, Homo sapiens
ctgattaaatatttgaaga

SEQ ID NO: 1704256 - DNA, 21 bp, Homo sapiens
ctgattaaatttaatatactg

SEQ ID NO: 1704257 - DNA, 23 bp, Homo sapiens
ctgattactgtcaataaacagct

SEQ ID NO: 1704258 - DNA, 20 bp, Homo sapiens
ctgattagagtgcaaaagtg

SEQ ID NO: 1704259 - DNA, 14 bp, Homo sapiens
ctgattattgaatg

SEQ ID NO: 1704260 - DNA, 15 bp, Homo sapiens
ctgattattgaatgt

SEQ ID NO: 1704261 - DNA, 18 bp, Homo sapiens
ctgattattgaatgttat

SEQ ID NO: 1704262 - DNA, 20 bp, Homo sapiens
ctgattattgagttccagtt

SEQ ID NO: 1704263 - DNA, 12 bp, Homo sapiens
ctgattatttat

SEQ ID NO: 1704264 - DNA, 19 bp, Homo sapiens
ctgattcaagaacaagcaa

SEQ ID NO: 1704265 - DNA, 16 bp, Homo sapiens
ctgattcacctcttcc

SEQ ID NO: 1704266 - DNA, 20 bp, Homo sapiens
ctgattcactgcatggctcc

SEQ ID NO: 1704267 - DNA, 17 bp, Homo sapiens
ctgattcagcagtgcct

SEQ ID NO: 1704268 - DNA, 22 bp, Homo sapiens
ctgattcataataaatatctgt

SEQ ID NO: 1704269 - DNA, 21 bp, Homo sapiens
ctgattcatagtaaaatacct

SEQ ID NO: 1704270 - DNA, 22 bp, Homo sapiens
ctgattcatcctgggatgtaaa

SEQ ID NO: 1704271 - DNA, 15 bp, Homo sapiens
ctgattcccctccac

SEQ ID NO: 1704272 - DNA, 13 bp, Homo sapiens
ctgattctgggat

SEQ ID NO: 1704273 - DNA, 21 bp, Homo sapiens
ctgattcttgattcctggctc

SEQ ID NO: 1704274 - DNA, 20 bp, Homo sapiens
ctgattcttgtaaatctttt

SEQ ID NO: 1704275 - DNA, 21 bp, Homo sapiens
ctgattcttgtaaatcttttt

SEQ ID NO: 1704276 - DNA, 17 bp, Homo sapiens
ctgattgatcacacagt

SEQ ID NO: 1704277 - DNA, 19 bp, Homo sapiens
ctgattgatcacacagtgt

SEQ ID NO: 1704278 - DNA, 12 bp, Homo sapiens
ctgattggctgc

SEQ ID NO: 1704279 - DNA, 19 bp, Homo sapiens
ctgattgtgccagtgcact

SEQ ID NO: 1704280 - DNA, 16 bp, Homo sapiens
ctgatttaggagaagc

SEQ ID NO: 1704281 - DNA, 22 bp, Homo sapiens
ctgatttaggagaagccaggaa

SEQ ID NO: 1704282 - DNA, 17 bp, Homo sapiens
ctgatttattgaaattt

SEQ ID NO: 1704283 - DNA, 16 bp, Homo sapiens
ctgatttcagtttttc

SEQ ID NO: 1704284 - DNA, 22 bp, Homo sapiens
ctgatttcagtttttcatttgt

SEQ ID NO: 1704285 - DNA, 24 bp, Homo sapiens
ctgatttcagtttttcatttgttt

SEQ ID NO: 1704286 - DNA, 13 bp, Homo sapiens
ctgatttccaggc

SEQ ID NO: 1704287 - DNA, 21 bp, Homo sapiens
ctgattttaggagctaaggct

SEQ ID NO: 1704288 - DNA, 22 bp, Homo sapiens
ctgattttaggagctaaggctc

SEQ ID NO: 1704289 - DNA, 23 bp, Homo sapiens
ctgattttaggagctaaggctct

SEQ ID NO: 1704290 - DNA, 14 bp, Homo sapiens
ctgattttctcact

SEQ ID NO: 1704291 - DNA, 21 bp, Homo sapiens
ctgatttttctcttttttaaa

SEQ ID NO: 1704292 - DNA, 20 bp, Homo sapiens
ctgattttttttccttttaa

SEQ ID NO: 1704293 - DNA, 20 bp, Homo sapiens
ctgcaaaaaaagcctccaag

SEQ ID NO: 1704294 - DNA, 21 bp, Homo sapiens
ctgcaaaaatggatattatta

SEQ ID NO: 1704295 - DNA, 11 bp, Homo sapiens
ctgcaaaattt

SEQ ID NO: 1704296 - DNA, 12 bp, Homo sapiens
ctgcaaagcttt

SEQ ID NO: 1704297 - DNA, 16 bp, Homo sapiens
ctgcaaagctttggct

SEQ ID NO: 1704298 - DNA, 21 bp, Homo sapiens
ctgcaaaggagaagcacagct

SEQ ID NO: 1704299 - DNA, 17 bp, Homo sapiens
ctgcaaataaggacagc

SEQ ID NO: 1704300 - DNA, 19 bp, Homo sapiens
ctgcaaatactgtatattc

SEQ ID NO: 1704301 - DNA, 14 bp, Homo sapiens
ctgcaaatagtttc

SEQ ID NO: 1704302 - DNA, 20 bp, Homo sapiens
ctgcaaatagtttcaaatga

SEQ ID NO: 1704303 - DNA, 21 bp, Homo sapiens
ctgcaacaacgcctggtgccc

SEQ ID NO: 1704304 - DNA, 14 bp, Homo sapiens
ctgcaacctccacc

SEQ ID NO: 1704305 - DNA, 15 bp, Homo sapiens
ctgcaacctgttgat

SEQ ID NO: 1704306 - DNA, 13 bp, Homo sapiens
ctgcaactagcca

SEQ ID NO: 1704307 - DNA, 21 bp, Homo sapiens
ctgcaactagccaaggctagt

SEQ ID NO: 1704308 - DNA, 15 bp, Homo sapiens
ctgcaactcaaggac

SEQ ID NO: 1704309 - DNA, 18 bp, Homo sapiens
ctgcaacttccgcctcct

SEQ ID NO: 1704310 - DNA, 17 bp, Homo sapiens
ctgcaacttccgctgag

SEQ ID NO: 1704311 - DNA, 19 bp, Homo sapiens
ctgcaacttccgctgaggg

SEQ ID NO: 1704312 - DNA, 23 bp, Homo sapiens
ctgcaacttccgctgaggggtct

SEQ ID NO: 1704313 - DNA, 14 bp, Homo sapiens
ctgcaacttctgcc

SEQ ID NO: 1704314 - DNA, 22 bp, Homo sapiens
ctgcaagaccacggagggagcg

SEQ ID NO: 1704315 - DNA, 15 bp, Homo sapiens
ctgcaagagaatctg

SEQ ID NO: 1704316 - DNA, 21 bp, Homo sapiens
ctgcaagagccaagttccaaa

SEQ ID NO: 1704317 - DNA, 23 bp, Homo sapiens
ctgcaagagccttggtgtccacc

SEQ ID NO: 1704318 - DNA, 14 bp, Homo sapiens
ctgcaagcagaact

SEQ ID NO: 1704319 - DNA, 15 bp, Homo sapiens
ctgcaagccccaggg

SEQ ID NO: 1704320 - DNA, 16 bp, Homo sapiens
ctgcaagccccagggc

SEQ ID NO: 1704321 - DNA, 17 bp, Homo sapiens
ctgcaagccccagggcc

SEQ ID NO: 1704322 - DNA, 19 bp, Homo sapiens
ctgcaagccccagggcctg

SEQ ID NO: 1704323 - DNA, 20 bp, Homo sapiens
ctgcaagctctgcctcccgg

SEQ ID NO: 1704324 - DNA, 16 bp, Homo sapiens
ctgcaaggtactctgg

SEQ ID NO: 1704325 - DNA, 18 bp, Homo sapiens
ctgcaaggtactctggtg

SEQ ID NO: 1704326 - DNA, 17 bp, Homo sapiens
ctgcaaggtctttggtt

SEQ ID NO: 1704327 - DNA, 12 bp, Homo sapiens
ctgcaaggtggc

SEQ ID NO: 1704328 - DNA, 13 bp, Homo sapiens
ctgcaaggtggcc

SEQ ID NO: 1704329 - DNA, 15 bp, Homo sapiens
agagcccttcactgc

SEQ ID NO: 1704330 - DNA, 17 bp, Homo sapiens
agagcccttcactgcca

SEQ ID NO: 1704331 - DNA, 24 bp, Homo sapiens
agagccgggaggaaaaggcccctg

SEQ ID NO: 1704332 - DNA, 19 bp, Homo sapiens
agagccggtggtgcccgtg

SEQ ID NO: 1704333 - DNA, 15 bp, Homo sapiens
agagcctagccacct

SEQ ID NO: 1704334 - DNA, 18 bp, Homo sapiens
agagcctagccacctccc

SEQ ID NO: 1704335 - DNA, 20 bp, Homo sapiens
agagcctgctcccccacccc

SEQ ID NO: 1704336 - DNA, 13 bp, Homo sapiens
agagcctgctggc

SEQ ID NO: 1704337 - DNA, 24 bp, Homo sapiens
agagcctgctggcacccaccgtgg

SEQ ID NO: 1704338 - DNA, 16 bp, Homo sapiens
agagcctgtcaccaga

SEQ ID NO: 1704339 - DNA, 19 bp, Homo sapiens
agagcctgtcaccagagct

SEQ ID NO: 1704340 - DNA, 17 bp, Homo sapiens
agagccttaacttctta

SEQ ID NO: 1704341 - DNA, 20 bp, Homo sapiens
agagccttcaagtgccaaac

SEQ ID NO: 1704342 - DNA, 23 bp, Homo sapiens
agagccttcagaatgctcctgag

SEQ ID NO: 1704343 - DNA, 15 bp, Homo sapiens
agagccttctcagaa

SEQ ID NO: 1704344 - DNA, 16 bp, Homo sapiens
agagccttctcagaag

SEQ ID NO: 1704345 - DNA, 19 bp, Homo sapiens
agagccttggtgtccacct

SEQ ID NO: 1704346 - DNA, 22 bp, Homo sapiens
agagccttggtgtccacctggc

SEQ ID NO: 1704347 - DNA, 13 bp, Homo sapiens
agagcgacacaga

SEQ ID NO: 1704348 - DNA, 14 bp, Homo sapiens
agagcgacacagac

SEQ ID NO: 1704349 - DNA, 12 bp, Homo sapiens
agagcgaggctg

SEQ ID NO: 1704350 - DNA, 12 bp, Homo sapiens
agagcgccagct

SEQ ID NO: 1704351 - DNA, 12 bp, Homo sapiens
agagcggctgga

SEQ ID NO: 1704352 - DNA, 15 bp, Homo sapiens
agagcggctggagaa

SEQ ID NO: 1704353 - DNA, 16 bp, Homo sapiens
agagcggctggagaaa

SEQ ID NO: 1704354 - DNA, 19 bp, Homo sapiens
agagcggctggagaaagat

SEQ ID NO: 1704355 - DNA, 18 bp, Homo sapiens
agagcggggtcccctctg

SEQ ID NO: 1704356 - DNA, 18 bp, Homo sapiens
agagcgtgcacttgtgat

SEQ ID NO: 1704357 - DNA, 19 bp, Homo sapiens
agagctaaactccttcctg

SEQ ID NO: 1704358 - DNA, 20 bp, Homo sapiens
agagctaataaatctcttct

SEQ ID NO: 1704359 - DNA, 17 bp, Homo sapiens
agagctagaaaaataaa

SEQ ID NO: 1704360 - DNA, 21 bp, Homo sapiens
agagctagaaaaataaaatgt

SEQ ID NO: 1704361 - DNA, 21 bp, Homo sapiens
agagctagcgctgccgcaccc

SEQ ID NO: 1704362 - DNA, 23 bp, Homo sapiens
agagctagctgccactttcacgt

SEQ ID NO: 1704363 - DNA, 18 bp, Homo sapiens
agagctatggcccagaaa

SEQ ID NO: 1704364 - DNA, 15 bp, Homo sapiens
agagctcatcccccc

SEQ ID NO: 1704365 - DNA, 18 bp, Homo sapiens
agagctcccctccacagc

SEQ ID NO: 1704366 - DNA, 22 bp, Homo sapiens
agagctctcccctcctgctggg

SEQ ID NO: 1704367 - DNA, 23 bp, Homo sapiens
agagctctcccctcctgctgggc

SEQ ID NO: 1704368 - DNA, 14 bp, Homo sapiens
agagctctctctac

SEQ ID NO: 1704369 - DNA, 17 bp, Homo sapiens
agagctcttcaagctgt

SEQ ID NO: 1704370 - DNA, 19 bp, Homo sapiens
agagctcttcaagctgtcc

SEQ ID NO: 1704371 - DNA, 22 bp, Homo sapiens
agagctcttcggtttctgagca

SEQ ID NO: 1704372 - DNA, 12 bp, Homo sapiens
agagctgagcca

SEQ ID NO: 1704373 - DNA, 14 bp, Homo sapiens
agagctgagccagt

SEQ ID NO: 1704374 - DNA, 19 bp, Homo sapiens
agagctgagggccctgtgg

SEQ ID NO: 1704375 - DNA, 13 bp, Homo sapiens
agagctgatccag

SEQ ID NO: 1704376 - DNA, 23 bp, Homo sapiens
agagctgcataatgtccctctct

SEQ ID NO: 1704377 - DNA, 11 bp, Homo sapiens
agagctgcctg

SEQ ID NO: 1704378 - DNA, 12 bp, Homo sapiens
agagctgctgag

SEQ ID NO: 1704379 - DNA, 22 bp, Homo sapiens
agagctgctgtccttttaggaa

SEQ ID NO: 1704380 - DNA, 22 bp, Homo sapiens
agagctggaaggcagggcagag

SEQ ID NO: 1704381 - DNA, 13 bp, Homo sapiens
agagctggctctg

SEQ ID NO: 1704382 - DNA, 11 bp, Homo sapiens
agagctgtgcc

SEQ ID NO: 1704383 - DNA, 13 bp, Homo sapiens
agagctgtgccag

SEQ ID NO: 1704384 - DNA, 21 bp, Homo sapiens
agagctgtgcctgctcagcag

SEQ ID NO: 1704385 - DNA, 22 bp, Homo sapiens
agagctgtgcctgctcagcagc

SEQ ID NO: 1704386 - DNA, 14 bp, Homo sapiens
agagctgtggagga

SEQ ID NO: 1704387 - DNA, 13 bp, Homo sapiens
agagctgttcatg

SEQ ID NO: 1704388 - DNA, 19 bp, Homo sapiens
agagctgtttatggcctca

SEQ ID NO: 1704389 - DNA, 20 bp, Homo sapiens
agagctgtttatggcctcag

SEQ ID NO: 1704390 - DNA, 13 bp, Homo sapiens
agagcttagaaac

SEQ ID NO: 1704391 - DNA, 18 bp, Homo sapiens
agagcttagaaactggaa

SEQ ID NO: 1704392 - DNA, 12 bp, Homo sapiens
agagcttctctg

SEQ ID NO: 1704393 - DNA, 18 bp, Homo sapiens
agagcttctctgggctga

SEQ ID NO: 1704394 - DNA, 18 bp, Homo sapiens
agagcttgaagcctccac

SEQ ID NO: 1704395 - DNA, 23 bp, Homo sapiens
agagctttctgtccttttggcac

SEQ ID NO: 1704396 - DNA, 14 bp, Homo sapiens
agagctttctttca

SEQ ID NO: 1704397 - DNA, 16 bp, Homo sapiens
agagctttctttcaca

SEQ ID NO: 1704398 - DNA, 15 bp, Homo sapiens
agagctttgtgcttg

SEQ ID NO: 1704399 - DNA, 17 bp, Homo sapiens
agagctttttaatagca

SEQ ID NO: 1704400 - DNA, 16 bp, Homo sapiens
agaggaaaaatgggag

SEQ ID NO: 1704401 - DNA, 20 bp, Homo sapiens
agaggaaaaatgggagccag

SEQ ID NO: 1704402 - DNA, 22 bp, Homo sapiens
agaggaaaaatgggagccagga

SEQ ID NO: 1704403 - DNA, 19 bp, Homo sapiens
agaggaaataacagagaga

SEQ ID NO: 1704404 - DNA, 21 bp, Homo sapiens
agaggaacagcactggggagt

SEQ ID NO: 1704405 - DNA, 13 bp, Homo sapiens
agaggaagagaga

SEQ ID NO: 1704406 - DNA, 15 bp, Homo sapiens
agaggaaggaaaagg

SEQ ID NO: 1704407 - DNA, 21 bp, Homo sapiens
agaggaataaggcccagagcg

SEQ ID NO: 1704408 - DNA, 24 bp, Homo sapiens
agaggaatcagacttcacactgca

SEQ ID NO: 1704409 - DNA, 17 bp, Homo sapiens
agaggaatctgtttctc

SEQ ID NO: 1704410 - DNA, 18 bp, Homo sapiens
agaggacagtctggagaa

SEQ ID NO: 1704411 - DNA, 19 bp, Homo sapiens
agaggacagtctggagaag

SEQ ID NO: 1704412 - DNA, 20 bp, Homo sapiens
agaggaccacagtgggtggc

SEQ ID NO: 1704413 - DNA, 14 bp, Homo sapiens
agaggaccagggcc

SEQ ID NO: 1704414 - DNA, 18 bp, Homo sapiens
agaggactcccaaccctg

SEQ ID NO: 1704415 - DNA, 20 bp, Homo sapiens
agaggactgagactggcact

SEQ ID NO: 1704416 - DNA, 22 bp, Homo sapiens
agaggactgtagggagggcggc

SEQ ID NO: 1704417 - DNA, 15 bp, Homo sapiens
agaggagaccctgga

SEQ ID NO: 1704418 - DNA, 14 bp, Homo sapiens
agaggagacttttt

SEQ ID NO: 1704419 - DNA, 16 bp, Homo sapiens
agaggagcacctgaac

SEQ ID NO: 1704420 - DNA, 14 bp, Homo sapiens
agaggagcctcaga

SEQ ID NO: 1704421 - DNA, 21 bp, Homo sapiens
agaggagcctcagaagaaaac

SEQ ID NO: 1704422 - DNA, 23 bp, Homo sapiens
agaggagcctttttaaaacacat

SEQ ID NO: 1704423 - DNA, 14 bp, Homo sapiens
agaggagctctccc

SEQ ID NO: 1704424 - DNA, 20 bp, Homo sapiens
agaggagctgggagccgggc

SEQ ID NO: 1704425 - DNA, 16 bp, Homo sapiens
agaggaggtttgcctg

SEQ ID NO: 1704426 - DNA, 20 bp, Homo sapiens
agaggaggtttgcctgtgat

SEQ ID NO: 1704427 - DNA, 11 bp, Homo sapiens
agaggcaccag

SEQ ID NO: 1704428 - DNA, 13 bp, Homo sapiens
agaggcagaagaa

SEQ ID NO: 1704429 - DNA, 20 bp, Homo sapiens
agaggcagagttctgtgaag

SEQ ID NO: 1704430 - DNA, 20 bp, Homo sapiens
agaggcagcatgcttgggct

SEQ ID NO: 1704431 - DNA, 22 bp, Homo sapiens
agaggcagcatgcttgggctga

SEQ ID NO: 1704432 - DNA, 13 bp, Homo sapiens
agaggcagggagg

SEQ ID NO: 1704433 - DNA, 18 bp, Homo sapiens
agaggcagtgatgacttg

SEQ ID NO: 1704434 - DNA, 18 bp, Homo sapiens
agaggccaaaggctggtg

SEQ ID NO: 1704435 - DNA, 23 bp, Homo sapiens
agaggccaagtctaatgaagaga

SEQ ID NO: 1704436 - DNA, 13 bp, Homo sapiens
agaggccaatgcc

SEQ ID NO: 1704437 - DNA, 18 bp, Homo sapiens
agaggccacattactaga

SEQ ID NO: 1704438 - DNA, 23 bp, Homo sapiens
agaggccaggcaggagcccttct

SEQ ID NO: 1704439 - DNA, 18 bp, Homo sapiens
agaggcccaggcaccacc

SEQ ID NO: 1704440 - DNA, 14 bp, Homo sapiens
agaggccccagcct

SEQ ID NO: 1704441 - DNA, 23 bp, Homo sapiens
agaggccccagcctccctgaagc

SEQ ID NO: 1704442 - DNA, 22 bp, Homo sapiens
agaggcccccagcccagggctc

SEQ ID NO: 1704443 - DNA, 22 bp, Homo sapiens
agaggccgaaggtgcctcagac

SEQ ID NO: 1704444 - DNA, 23 bp, Homo sapiens
agaggccgaaggtgcctcagact

SEQ ID NO: 1704445 - DNA, 14 bp, Homo sapiens
ctgagcctctgctc

SEQ ID NO: 1704446 - DNA, 15 bp, Homo sapiens
ctgagcctctgctcc

SEQ ID NO: 1704447 - DNA, 16 bp, Homo sapiens
ctgagcctctgctccc

SEQ ID NO: 1704448 - DNA, 18 bp, Homo sapiens
ctgagcctctgctcccca

SEQ ID NO: 1704449 - DNA, 17 bp, Homo sapiens
ctgagcctgaggccttc

SEQ ID NO: 1704450 - DNA, 20 bp, Homo sapiens
ctgagcctgaggccttccag

SEQ ID NO: 1704451 - DNA, 15 bp, Homo sapiens
ctgagcctgcaggga

SEQ ID NO: 1704452 - DNA, 14 bp, Homo sapiens
ctgagcctggccct

SEQ ID NO: 1704453 - DNA, 14 bp, Homo sapiens
ctgagcctggctgg

SEQ ID NO: 1704454 - DNA, 20 bp, Homo sapiens
ctgagcgagtgctctcactg

SEQ ID NO: 1704455 - DNA, 17 bp, Homo sapiens
ctgagcggcgcagagcc

SEQ ID NO: 1704456 - DNA, 17 bp, Homo sapiens
ctgagctccacctctgg

SEQ ID NO: 1704457 - DNA, 20 bp, Homo sapiens
ctgagctccacctctggtgg

SEQ ID NO: 1704458 - DNA, 16 bp, Homo sapiens
ctgagctcccacctcc

SEQ ID NO: 1704459 - DNA, 20 bp, Homo sapiens
ctgagctcggtggacccagg

SEQ ID NO: 1704460 - DNA, 13 bp, Homo sapiens
ctgagctggggaa

SEQ ID NO: 1704461 - DNA, 14 bp, Homo sapiens
ctgagctggggaag

SEQ ID NO: 1704462 - DNA, 12 bp, Homo sapiens
ctgagctggggc

SEQ ID NO: 1704463 - DNA, 16 bp, Homo sapiens
ctgagctggggccaca

SEQ ID NO: 1704464 - DNA, 24 bp, Homo sapiens
ctgagctgtcgctgcctccatggc

SEQ ID NO: 1704465 - DNA, 22 bp, Homo sapiens
ctgagcttagccttgtgccctg

SEQ ID NO: 1704466 - DNA, 24 bp, Homo sapiens
ctgagcttagccttgtgccctgcc

SEQ ID NO: 1704467 - DNA, 14 bp, Homo sapiens
ctgagcttttcatg

SEQ ID NO: 1704468 - DNA, 20 bp, Homo sapiens
ctgagcttttcatggaagtg

SEQ ID NO: 1704469 - DNA, 23 bp, Homo sapiens
ctgaggaagagggactgttcttt

SEQ ID NO: 1704470 - DNA, 16 bp, Homo sapiens
ctgaggaattttcttt

SEQ ID NO: 1704471 - DNA, 21 bp, Homo sapiens
ctgaggacaccagtgaaagaa

SEQ ID NO: 1704472 - DNA, 22 bp, Homo sapiens
ctgaggacaccagtgaaagaag

SEQ ID NO: 1704473 - DNA, 23 bp, Homo sapiens
ctgaggacaccagtgaaagaagc

SEQ ID NO: 1704474 - DNA, 15 bp, Homo sapiens
ctgaggacaggcccc

SEQ ID NO: 1704475 - DNA, 14 bp, Homo sapiens
ctgaggacctctca

SEQ ID NO: 1704476 - DNA, 15 bp, Homo sapiens
ctgaggacctctcag

SEQ ID NO: 1704477 - DNA, 17 bp, Homo sapiens
ctgaggacgagaccccc

SEQ ID NO: 1704478 - DNA, 22 bp, Homo sapiens
ctgaggacgagacccccatcca

SEQ ID NO: 1704479 - DNA, 15 bp, Homo sapiens
ctgaggactggagac

SEQ ID NO: 1704480 - DNA, 13 bp, Homo sapiens
ctgaggagacaga

SEQ ID NO: 1704481 - DNA, 15 bp, Homo sapiens
ctgaggagacagaaa

SEQ ID NO: 1704482 - DNA, 19 bp, Homo sapiens
ctgaggagacagaaagcct

SEQ ID NO: 1704483 - DNA, 14 bp, Homo sapiens
ctgaggagccctga

SEQ ID NO: 1704484 - DNA, 16 bp, Homo sapiens
ctgaggagccctgagg

SEQ ID NO: 1704485 - DNA, 21 bp, Homo sapiens
ctgaggagccctgaggacctc

SEQ ID NO: 1704486 - DNA, 13 bp, Homo sapiens
ctgaggagctttg

SEQ ID NO: 1704487 - DNA, 11 bp, Homo sapiens
ctgaggaggag

SEQ ID NO: 1704488 - DNA, 15 bp, Homo sapiens
ctgaggagtgaggaa

SEQ ID NO: 1704489 - DNA, 21 bp, Homo sapiens
ctgaggatacagctcttctca

SEQ ID NO: 1704490 - DNA, 16 bp, Homo sapiens
ctgaggatgagctgga

SEQ ID NO: 1704491 - DNA, 17 bp, Homo sapiens
ctgaggatgagctggaa

SEQ ID NO: 1704492 - DNA, 18 bp, Homo sapiens
ctgaggatgagctggaag

SEQ ID NO: 1704493 - DNA, 14 bp, Homo sapiens
ctgaggatggcctg

SEQ ID NO: 1704494 - DNA, 19 bp, Homo sapiens
ctgaggatgggtcagagct

SEQ ID NO: 1704495 - DNA, 20 bp, Homo sapiens
ctgaggatgggtcagagcta

SEQ ID NO: 1704496 - DNA, 22 bp, Homo sapiens
ctgaggatgtagagagaacagg

SEQ ID NO: 1704497 - DNA, 16 bp, Homo sapiens
ctgaggcaagagaatt

SEQ ID NO: 1704498 - DNA, 15 bp, Homo sapiens
ctgaggcagaagaat

SEQ ID NO: 1704499 - DNA, 17 bp, Homo sapiens
ctgaggcagacagcagc

SEQ ID NO: 1704500 - DNA, 17 bp, Homo sapiens
ctgaggccacccactga

SEQ ID NO: 1704501 - DNA, 15 bp, Homo sapiens
ctgaggccagggctg

SEQ ID NO: 1704502 - DNA, 20 bp, Homo sapiens
ctgaggcccagcccctccag

SEQ ID NO: 1704503 - DNA, 14 bp, Homo sapiens
ctgaggcccagtgc

SEQ ID NO: 1704504 - DNA, 17 bp, Homo sapiens
ctgaggcccagtgcata

SEQ ID NO: 1704505 - DNA, 15 bp, Homo sapiens
ctgaggcccctaggt

SEQ ID NO: 1704506 - DNA, 16 bp, Homo sapiens
ctgaggcccctaggtg

SEQ ID NO: 1704507 - DNA, 19 bp, Homo sapiens
ctgaggccccttaactcat

SEQ ID NO: 1704508 - DNA, 19 bp, Homo sapiens
ctgaggcctaaaagtaaac

SEQ ID NO: 1704509 - DNA, 15 bp, Homo sapiens
ctgaggcctagactc

SEQ ID NO: 1704510 - DNA, 17 bp, Homo sapiens
ctgaggcctcatccctc

SEQ ID NO: 1704511 - DNA, 12 bp, Homo sapiens
ctgaggcctgga

SEQ ID NO: 1704512 - DNA, 20 bp, Homo sapiens
ctgaggcctggactttcctg

SEQ ID NO: 1704513 - DNA, 14 bp, Homo sapiens
ctgaggcctgggcc

SEQ ID NO: 1704514 - DNA, 22 bp, Homo sapiens
ctgaggcctgggccgctgccac

SEQ ID NO: 1704515 - DNA, 14 bp, Homo sapiens
ctgaggccttccag

SEQ ID NO: 1704516 - DNA, 17 bp, Homo sapiens
ctgaggccttgtgtgtc

SEQ ID NO: 1704517 - DNA, 16 bp, Homo sapiens
ctgaggctctttctgg

SEQ ID NO: 1704518 - DNA, 18 bp, Homo sapiens
ctgaggctctttctgggc

SEQ ID NO: 1704519 - DNA, 20 bp, Homo sapiens
ctgaggctgggggagagccg

SEQ ID NO: 1704520 - DNA, 19 bp, Homo sapiens
ctgaggcttaggcctctct

SEQ ID NO: 1704521 - DNA, 16 bp, Homo sapiens
ctgagggaccaactgg

SEQ ID NO: 1704522 - DNA, 20 bp, Homo sapiens
ctgagggaccaactgggccc

SEQ ID NO: 1704523 - DNA, 15 bp, Homo sapiens
ctgagggaccagcca

SEQ ID NO: 1704524 - DNA, 18 bp, Homo sapiens
ctgagggaccagccaaga

SEQ ID NO: 1704525 - DNA, 13 bp, Homo sapiens
ctgagggaccctt

SEQ ID NO: 1704526 - DNA, 19 bp, Homo sapiens
ctgagggaccgagcccagc

SEQ ID NO: 1704527 - DNA, 18 bp, Homo sapiens
ctgagggcagtgcccttt

SEQ ID NO: 1704528 - DNA, 14 bp, Homo sapiens
ctgagggccacact

SEQ ID NO: 1704529 - DNA, 14 bp, Homo sapiens
ctgagggccaggga

SEQ ID NO: 1704530 - DNA, 19 bp, Homo sapiens
ctgagggcccctctgccca

SEQ ID NO: 1704531 - DNA, 21 bp, Homo sapiens
ctgagggcccctctgcccagc

SEQ ID NO: 1704532 - DNA, 17 bp, Homo sapiens
ctgagggccctgtggag

SEQ ID NO: 1704533 - DNA, 15 bp, Homo sapiens
ctgagggcctgctgg

SEQ ID NO: 1704534 - DNA, 16 bp, Homo sapiens
ctgagggctctgtttg

SEQ ID NO: 1704535 - DNA, 18 bp, Homo sapiens
ctgaggggaggcacctcc

SEQ ID NO: 1704536 - DNA, 19 bp, Homo sapiens
ctgaggggcaacgaagaaa

SEQ ID NO: 1704537 - DNA, 21 bp, Homo sapiens
ctgaggggcaacgaagaaaaa

SEQ ID NO: 1704538 - DNA, 22 bp, Homo sapiens
ctgaggggcaacgaagaaaaaa

SEQ ID NO: 1704539 - DNA, 17 bp, Homo sapiens
ctgaggggcatctgccc

SEQ ID NO: 1704540 - DNA, 20 bp, Homo sapiens
ctgagggggtgggggtgccg

SEQ ID NO: 1704541 - DNA, 23 bp, Homo sapiens
ctgagggggtgggggtgccgctg

SEQ ID NO: 1704542 - DNA, 20 bp, Homo sapiens
ctgaggggtgggggtgccgc

SEQ ID NO: 1704543 - DNA, 13 bp, Homo sapiens
ctgagggtccacc

SEQ ID NO: 1704544 - DNA, 17 bp, Homo sapiens
ctgagggtccacctgga

SEQ ID NO: 1704545 - DNA, 21 bp, Homo sapiens
ctgagggtccacctggagagt

SEQ ID NO: 1704546 - DNA, 18 bp, Homo sapiens
ctgaggtataaagacaag

SEQ ID NO: 1704547 - DNA, 16 bp, Homo sapiens
ctgaggtcactgctag

SEQ ID NO: 1704548 - DNA, 19 bp, Homo sapiens
ctgaggtgaaagggagcta

SEQ ID NO: 1704549 - DNA, 17 bp, Homo sapiens
ctgaggtgcctgtccca

SEQ ID NO: 1704550 - DNA, 22 bp, Homo sapiens
ctgaggtgcctgtcccaccccc

SEQ ID NO: 1704551 - DNA, 22 bp, Homo sapiens
ctgaggtgggcccaggaccagc

SEQ ID NO: 1704552 - DNA, 15 bp, Homo sapiens
ctgaggtgggctggg

SEQ ID NO: 1704553 - DNA, 13 bp, Homo sapiens
ctgaggtgtgggg

SEQ ID NO: 1704554 - DNA, 16 bp, Homo sapiens
ctgaggtgtgggggct

SEQ ID NO: 1704555 - DNA, 17 bp, Homo sapiens
ctgaggtgtgggggctg

SEQ ID NO: 1704556 - DNA, 19 bp, Homo sapiens
ctgaggtgtgggggctgca

SEQ ID NO: 1704557 - DNA, 20 bp, Homo sapiens
ctgaggtgtgggggctgcag

SEQ ID NO: 1704558 - DNA, 21 bp, Homo sapiens
ctgaggtgtgggggctgcagc

SEQ ID NO: 1704559 - DNA, 22 bp, Homo sapiens
ctgaggttcccgacaccagaag

SEQ ID NO: 1704560 - DNA, 18 bp, Homo sapiens
ctgaggttcctctgcctg

SEQ ID NO: 1704561 - DNA, 14 bp, Homo sapiens
agagagatgttttg

SEQ ID NO: 1704562 - DNA, 15 bp, Homo sapiens
agagagcaaggaagc

SEQ ID NO: 1704563 - DNA, 15 bp, Homo sapiens
agagagccaaatctg

SEQ ID NO: 1704564 - DNA, 12 bp, Homo sapiens
agagagccaaga

SEQ ID NO: 1704565 - DNA, 19 bp, Homo sapiens
agagagcctgtcaccagag

SEQ ID NO: 1704566 - DNA, 23 bp, Homo sapiens
agagagccttggttcatcagtgt

SEQ ID NO: 1704567 - DNA, 13 bp, Homo sapiens
agagaggagcacc

SEQ ID NO: 1704568 - DNA, 15 bp, Homo sapiens
agagaggcagcaagt

SEQ ID NO: 1704569 - DNA, 14 bp, Homo sapiens
agagaggccttttg

SEQ ID NO: 1704570 - DNA, 13 bp, Homo sapiens
agagagggactca

SEQ ID NO: 1704571 - DNA, 17 bp, Homo sapiens
agagagggaggtatgga

SEQ ID NO: 1704572 - DNA, 15 bp, Homo sapiens
agagagggcccagct

SEQ ID NO: 1704573 - DNA, 20 bp, Homo sapiens
agagaggggctgctctccag

SEQ ID NO: 1704574 - DNA, 21 bp, Homo sapiens
agagaggtggggatcctgcct

SEQ ID NO: 1704575 - DNA, 14 bp, Homo sapiens
agagagtggctcct

SEQ ID NO: 1704576 - DNA, 19 bp, Homo sapiens
agagagtggggcctgccct

SEQ ID NO: 1704577 - DNA, 13 bp, Homo sapiens
agagagtttcaaa

SEQ ID NO: 1704578 - DNA, 15 bp, Homo sapiens
agagagtttcaaaag

SEQ ID NO: 1704579 - DNA, 15 bp, Homo sapiens
agagataaaacagaa

SEQ ID NO: 1704580 - DNA, 16 bp, Homo sapiens
agagatatagatatta

SEQ ID NO: 1704581 - DNA, 17 bp, Homo sapiens
agagatatggcagcgaa

SEQ ID NO: 1704582 - DNA, 20 bp, Homo sapiens
agagatatgtagaaggcaca

SEQ ID NO: 1704583 - DNA, 14 bp, Homo sapiens
agagatcaaagatg

SEQ ID NO: 1704584 - DNA, 15 bp, Homo sapiens
agagatcaaagatga

SEQ ID NO: 1704585 - DNA, 18 bp, Homo sapiens
agagatccaaaagaagcc

SEQ ID NO: 1704586 - DNA, 19 bp, Homo sapiens
agagatccctgcagaaccc

SEQ ID NO: 1704587 - DNA, 17 bp, Homo sapiens
agagatgactgagtcct

SEQ ID NO: 1704588 - DNA, 18 bp, Homo sapiens
agagatgactgagtcctc

SEQ ID NO: 1704589 - DNA, 14 bp, Homo sapiens
agagatgcctccac

SEQ ID NO: 1704590 - DNA, 21 bp, Homo sapiens
agagatgctgtaacttaaaat

SEQ ID NO: 1704591 - DNA, 22 bp, Homo sapiens
agagatgcttggagcaatcaga

SEQ ID NO: 1704592 - DNA, 13 bp, Homo sapiens
agagatttctcat

SEQ ID NO: 1704593 - DNA, 14 bp, Homo sapiens
agagattttctctt

SEQ ID NO: 1704594 - DNA, 17 bp, Homo sapiens
agagattttttttccct

SEQ ID NO: 1704595 - DNA, 18 bp, Homo sapiens
agagcaaaagcctcagaa

SEQ ID NO: 1704596 - DNA, 16 bp, Homo sapiens
agagcaaaagggagga

SEQ ID NO: 1704597 - DNA, 18 bp, Homo sapiens
agagcaaaataattttaa

SEQ ID NO: 1704598 - DNA, 14 bp, Homo sapiens
agagcaaaattgat

SEQ ID NO: 1704599 - DNA, 20 bp, Homo sapiens
agagcaaaattgatgtgttt

SEQ ID NO: 1704600 - DNA, 20 bp, Homo sapiens
agagcaaatgcaaaaataac

SEQ ID NO: 1704601 - DNA, 13 bp, Homo sapiens
agagcaacccctg

SEQ ID NO: 1704602 - DNA, 18 bp, Homo sapiens
agagcaacctctgtatta

SEQ ID NO: 1704603 - DNA, 23 bp, Homo sapiens
agagcaatgttggttttttataa

SEQ ID NO: 1704604 - DNA, 17 bp, Homo sapiens
agagcaattccaggctg

SEQ ID NO: 1704605 - DNA, 18 bp, Homo sapiens
agagcaattccaggctga

SEQ ID NO: 1704606 - DNA, 17 bp, Homo sapiens
agagcaccctcgagaag

SEQ ID NO: 1704607 - DNA, 20 bp, Homo sapiens
agagcagaacagatctttta

SEQ ID NO: 1704608 - DNA, 13 bp, Homo sapiens
agagcagcaggtg

SEQ ID NO: 1704609 - DNA, 21 bp, Homo sapiens
agagcagccagcacccacctg

SEQ ID NO: 1704610 - DNA, 21 bp, Homo sapiens
agagcagcctgatggccaagg

SEQ ID NO: 1704611 - DNA, 19 bp, Homo sapiens
agagcagctccttcctagc

SEQ ID NO: 1704612 - DNA, 17 bp, Homo sapiens
agagcaggactccaggc

SEQ ID NO: 1704613 - DNA, 16 bp, Homo sapiens
agagcaggagcccctg

SEQ ID NO: 1704614 - DNA, 22 bp, Homo sapiens
agagcaggagcccctggggctg

SEQ ID NO: 1704615 - DNA, 20 bp, Homo sapiens
agagcaggaggcccctggcc

SEQ ID NO: 1704616 - DNA, 19 bp, Homo sapiens
agagcaggcacatggagga

SEQ ID NO: 1704617 - DNA, 23 bp, Homo sapiens
agagcaggccagcccggacctct

SEQ ID NO: 1704618 - DNA, 22 bp, Homo sapiens
agagcagggattaacctctgca

SEQ ID NO: 1704619 - DNA, 23 bp, Homo sapiens
agagcaggtgactgtgctgtgca

SEQ ID NO: 1704620 - DNA, 13 bp, Homo sapiens
agagcagtgggca

SEQ ID NO: 1704621 - DNA, 21 bp, Homo sapiens
agagcatatttgccaataaag

SEQ ID NO: 1704622 - DNA, 20 bp, Homo sapiens
agagcatcgtgacccttcag

SEQ ID NO: 1704623 - DNA, 22 bp, Homo sapiens
agagcatcgtgacccttcaggg

SEQ ID NO: 1704624 - DNA, 16 bp, Homo sapiens
agagcattagctggcg

SEQ ID NO: 1704625 - DNA, 14 bp, Homo sapiens
agagccaacctgga

SEQ ID NO: 1704626 - DNA, 16 bp, Homo sapiens
agagccaacctggact

SEQ ID NO: 1704627 - DNA, 17 bp, Homo sapiens
agagccaacctggactt

SEQ ID NO: 1704628 - DNA, 18 bp, Homo sapiens
agagccaacctggacttc

SEQ ID NO: 1704629 - DNA, 20 bp, Homo sapiens
agagccaacctggacttcct

SEQ ID NO: 1704630 - DNA, 19 bp, Homo sapiens
agagccaagacggaggagg

SEQ ID NO: 1704631 - DNA, 14 bp, Homo sapiens
agagccaagcactg

SEQ ID NO: 1704632 - DNA, 13 bp, Homo sapiens
agagccacctgca

SEQ ID NO: 1704633 - DNA, 16 bp, Homo sapiens
agagccacctgcaaga

SEQ ID NO: 1704634 - DNA, 17 bp, Homo sapiens
agagccacctgcaagat

SEQ ID NO: 1704635 - DNA, 13 bp, Homo sapiens
agagccacctgga

SEQ ID NO: 1704636 - DNA, 16 bp, Homo sapiens
agagccactctatgag

SEQ ID NO: 1704637 - DNA, 20 bp, Homo sapiens
agagccactttcaagctgca

SEQ ID NO: 1704638 - DNA, 14 bp, Homo sapiens
agagccagatgcag

SEQ ID NO: 1704639 - DNA, 18 bp, Homo sapiens
agagccagatgcaggaca

SEQ ID NO: 1704640 - DNA, 13 bp, Homo sapiens
agagccagcaact

SEQ ID NO: 1704641 - DNA, 16 bp, Homo sapiens
agagccagccctccct

SEQ ID NO: 1704642 - DNA, 11 bp, Homo sapiens
agagccagccg

SEQ ID NO: 1704643 - DNA, 13 bp, Homo sapiens
agagccagcctgg

SEQ ID NO: 1704644 - DNA, 23 bp, Homo sapiens
agagccagcctggctctgccccc

SEQ ID NO: 1704645 - DNA, 21 bp, Homo sapiens
agagccagcggctccaactcc

SEQ ID NO: 1704646 - DNA, 13 bp, Homo sapiens
agagccagcttgg

SEQ ID NO: 1704647 - DNA, 13 bp, Homo sapiens
agagccaggagaa

SEQ ID NO: 1704648 - DNA, 15 bp, Homo sapiens
agagccaggagaagc

SEQ ID NO: 1704649 - DNA, 18 bp, Homo sapiens
agagccaggagaagctca

SEQ ID NO: 1704650 - DNA, 15 bp, Homo sapiens
agagccaggatgccc

SEQ ID NO: 1704651 - DNA, 21 bp, Homo sapiens
agagccaggatgcccagatga

SEQ ID NO: 1704652 - DNA, 19 bp, Homo sapiens
agagccatataagtttgaa

SEQ ID NO: 1704653 - DNA, 22 bp, Homo sapiens
agagccatataagtttgaagga

SEQ ID NO: 1704654 - DNA, 13 bp, Homo sapiens
agagccatgggcc

SEQ ID NO: 1704655 - DNA, 15 bp, Homo sapiens
agagccatgggcctg

SEQ ID NO: 1704656 - DNA, 16 bp, Homo sapiens
agagccatgggcctgg

SEQ ID NO: 1704657 - DNA, 17 bp, Homo sapiens
agagccatgggcctggg

SEQ ID NO: 1704658 - DNA, 22 bp, Homo sapiens
agagcccacatggccgggccct

SEQ ID NO: 1704659 - DNA, 10 bp, Homo sapiens
agagcccagc

SEQ ID NO: 1704660 - DNA, 14 bp, Homo sapiens
agagcccagcccag

SEQ ID NO: 1704661 - DNA, 11 bp, Homo sapiens
agagcccagct

SEQ ID NO: 1704662 - DNA, 12 bp, Homo sapiens
agagcccagctc

SEQ ID NO: 1704663 - DNA, 15 bp, Homo sapiens
agagcccagctccaa

SEQ ID NO: 1704664 - DNA, 13 bp, Homo sapiens
agagcccagctct

SEQ ID NO: 1704665 - DNA, 15 bp, Homo sapiens
agagcccagctcttg

SEQ ID NO: 1704666 - DNA, 19 bp, Homo sapiens
agagcccagctcttgctct

SEQ ID NO: 1704667 - DNA, 20 bp, Homo sapiens
agagcccagctcttgctctc

SEQ ID NO: 1704668 - DNA, 15 bp, Homo sapiens
agagcccatgctcaa

SEQ ID NO: 1704669 - DNA, 14 bp, Homo sapiens
agagccccacacgg

SEQ ID NO: 1704670 - DNA, 13 bp, Homo sapiens
agagccccagctg

SEQ ID NO: 1704671 - DNA, 14 bp, Homo sapiens
agagccccagctga

SEQ ID NO: 1704672 - DNA, 16 bp, Homo sapiens
agagccccagctgaca

SEQ ID NO: 1704673 - DNA, 15 bp, Homo sapiens
agagcccctcctcca

SEQ ID NO: 1704674 - DNA, 20 bp, Homo sapiens
agagcccctcctccagcccc

SEQ ID NO: 1704675 - DNA, 23 bp, Homo sapiens
agagcccctcctccagcccctgt

SEQ ID NO: 1704676 - DNA, 14 bp, Homo sapiens
agagcccctgcccc

SEQ ID NO: 1704677 - DNA, 17 bp, Homo sapiens
agagccctccaggcctg

SEQ ID NO: 1704678 - DNA, 22 bp, Homo sapiens
agagccctgtggccgccacctg

SEQ ID NO: 1704679 - DNA, 18 bp, Homo sapiens
gacaaatagaaaatggtc

SEQ ID NO: 1704680 - DNA, 16 bp, Homo sapiens
gacaaatcacatattt

SEQ ID NO: 1704681 - DNA, 16 bp, Homo sapiens
gacaaatgggactgat

SEQ ID NO: 1704682 - DNA, 22 bp, Homo sapiens
gacaaatgggactgatgtcatc

SEQ ID NO: 1704683 - DNA, 19 bp, Homo sapiens
gacaaattacaaaaggctc

SEQ ID NO: 1704684 - DNA, 13 bp, Homo sapiens
gacaacaaaagaa

SEQ ID NO: 1704685 - DNA, 17 bp, Homo sapiens
gacaacagaaaaacaat

SEQ ID NO: 1704686 - DNA, 18 bp, Homo sapiens
gacaacagaaaaacaatc

SEQ ID NO: 1704687 - DNA, 23 bp, Homo sapiens
gacaacagaaaaacaatcttatt

SEQ ID NO: 1704688 - DNA, 14 bp, Homo sapiens
gacaacagaagtca

SEQ ID NO: 1704689 - DNA, 17 bp, Homo sapiens
gacaacagaagtcatga

SEQ ID NO: 1704690 - DNA, 22 bp, Homo sapiens
gacaacagaagtcatgaagccc

SEQ ID NO: 1704691 - DNA, 23 bp, Homo sapiens
gacaacaggttttcaccatagcc

SEQ ID NO: 1704692 - DNA, 12 bp, Homo sapiens
gacaacattaaa

SEQ ID NO: 1704693 - DNA, 18 bp, Homo sapiens
gacaacattatgatctaa

SEQ ID NO: 1704694 - DNA, 22 bp, Homo sapiens
gacaacattatgatctaataaa

SEQ ID NO: 1704695 - DNA, 14 bp, Homo sapiens
gacaacctttctgt

SEQ ID NO: 1704696 - DNA, 16 bp, Homo sapiens
gacaactagatttgtc

SEQ ID NO: 1704697 - DNA, 18 bp, Homo sapiens
gacaactagatttgtcct

SEQ ID NO: 1704698 - DNA, 13 bp, Homo sapiens
gacaactgtgact

SEQ ID NO: 1704699 - DNA, 16 bp, Homo sapiens
gacaacttatttaaaa

SEQ ID NO: 1704700 - DNA, 19 bp, Homo sapiens
gacaagaaaggcagacaca

SEQ ID NO: 1704701 - DNA, 14 bp, Homo sapiens
gacaagagatctac

SEQ ID NO: 1704702 - DNA, 16 bp, Homo sapiens
gacaagagatctacac

SEQ ID NO: 1704703 - DNA, 18 bp, Homo sapiens
gacaagagatctacacat

SEQ ID NO: 1704704 - DNA, 20 bp, Homo sapiens
gacaagagatctacacatgt

SEQ ID NO: 1704705 - DNA, 20 bp, Homo sapiens
gacaagagatgggaatgagg

SEQ ID NO: 1704706 - DNA, 17 bp, Homo sapiens
gacaagagctgctgtcc

SEQ ID NO: 1704707 - DNA, 22 bp, Homo sapiens
gacaagagttggggacagaact

SEQ ID NO: 1704708 - DNA, 15 bp, Homo sapiens
gacaagatgggacag

SEQ ID NO: 1704709 - DNA, 23 bp, Homo sapiens
gacaagatggtccatttgttcct

SEQ ID NO: 1704710 - DNA, 23 bp, Homo sapiens
gacaagccaacttgtaaatacac

SEQ ID NO: 1704711 - DNA, 14 bp, Homo sapiens
gacaagccctggca

SEQ ID NO: 1704712 - DNA, 15 bp, Homo sapiens
gacaagccctggcaa

SEQ ID NO: 1704713 - DNA, 20 bp, Homo sapiens
gacaagctgacttggcactt

SEQ ID NO: 1704714 - DNA, 22 bp, Homo sapiens
gacaagctgacttggcacttaa

SEQ ID NO: 1704715 - DNA, 11 bp, Homo sapiens
gacaaggaaaa

SEQ ID NO: 1704716 - DNA, 12 bp, Homo sapiens
gacaaggaaaat

SEQ ID NO: 1704717 - DNA, 16 bp, Homo sapiens
gacaagggaggcagtg

SEQ ID NO: 1704718 - DNA, 19 bp, Homo sapiens
gacaagggaggcagtggct

SEQ ID NO: 1704719 - DNA, 15 bp, Homo sapiens
gacaagggattctgg

SEQ ID NO: 1704720 - DNA, 17 bp, Homo sapiens
gacaagggattctggga

SEQ ID NO: 1704721 - DNA, 15 bp, Homo sapiens
gacaagggctgacct

SEQ ID NO: 1704722 - DNA, 20 bp, Homo sapiens
gacaagtgctgaacagtgga

SEQ ID NO: 1704723 - DNA, 14 bp, Homo sapiens
gacaagtgctgttg

SEQ ID NO: 1704724 - DNA, 21 bp, Homo sapiens
gacaataattacattggcaca

SEQ ID NO: 1704725 - DNA, 18 bp, Homo sapiens
gacaatacagtaagcata

SEQ ID NO: 1704726 - DNA, 15 bp, Homo sapiens
gacaatactggggtt

SEQ ID NO: 1704727 - DNA, 19 bp, Homo sapiens
gacaatatgtgagtgcctt

SEQ ID NO: 1704728 - DNA, 17 bp, Homo sapiens
gacaatcaactctaata

SEQ ID NO: 1704729 - DNA, 13 bp, Homo sapiens
gacaatcactgcc

SEQ ID NO: 1704730 - DNA, 14 bp, Homo sapiens
gacaatcactgcca

SEQ ID NO: 1704731 - DNA, 18 bp, Homo sapiens
gacaatcagtcccctccc

SEQ ID NO: 1704732 - DNA, 13 bp, Homo sapiens
gacaatggcagct

SEQ ID NO: 1704733 - DNA, 14 bp, Homo sapiens
gacaatggcagcta

SEQ ID NO: 1704734 - DNA, 14 bp, Homo sapiens
gacaatgttgagaa

SEQ ID NO: 1704735 - DNA, 15 bp, Homo sapiens
gacaatttctggcag

SEQ ID NO: 1704736 - DNA, 18 bp, Homo sapiens
gacaattttgtcttaagt

SEQ ID NO: 1704737 - DNA, 18 bp, Homo sapiens
gacacaaagcttctaaag

SEQ ID NO: 1704738 - DNA, 13 bp, Homo sapiens
gacacaacacaga

SEQ ID NO: 1704739 - DNA, 17 bp, Homo sapiens
gacacaacccaatagga

SEQ ID NO: 1704740 - DNA, 22 bp, Homo sapiens
gacacaagtggaccttaggcct

SEQ ID NO: 1704741 - DNA, 20 bp, Homo sapiens
gacacaatctcggctcactg

SEQ ID NO: 1704742 - DNA, 14 bp, Homo sapiens
gacacaatttcatt

SEQ ID NO: 1704743 - DNA, 19 bp, Homo sapiens
gacacacacacgcacgcac

SEQ ID NO: 1704744 - DNA, 21 bp, Homo sapiens
gacacacacacgcacgcacac

SEQ ID NO: 1704745 - DNA, 14 bp, Homo sapiens
gacacacagcactc

SEQ ID NO: 1704746 - DNA, 15 bp, Homo sapiens
gacacaccaggcgct

SEQ ID NO: 1704747 - DNA, 22 bp, Homo sapiens
gacacagacattttgtgtgaga

SEQ ID NO: 1704748 - DNA, 23 bp, Homo sapiens
gacacagattatgttcctgctgt

SEQ ID NO: 1704749 - DNA, 13 bp, Homo sapiens
gacacagcacaag

SEQ ID NO: 1704750 - DNA, 21 bp, Homo sapiens
gacacagcagcttcaccagag

SEQ ID NO: 1704751 - DNA, 11 bp, Homo sapiens
aggtctgtgct

SEQ ID NO: 1704752 - DNA, 18 bp, Homo sapiens
aggtcttatctgttcagt

SEQ ID NO: 1704753 - DNA, 18 bp, Homo sapiens
aggtcttgcagtggcttt

SEQ ID NO: 1704754 - DNA, 18 bp, Homo sapiens
aggtctttgcacatgtga

SEQ ID NO: 1704755 - DNA, 18 bp, Homo sapiens
aggtctttggttcagcta

SEQ ID NO: 1704756 - DNA, 22 bp, Homo sapiens
aggtgaaggctctcacccccat

SEQ ID NO: 1704757 - DNA, 17 bp, Homo sapiens
aggtgaatactcttgaa

SEQ ID NO: 1704758 - DNA, 18 bp, Homo sapiens
aggtgacaaaccatttcc

SEQ ID NO: 1704759 - DNA, 21 bp, Homo sapiens
aggtgactgtgctgtgcagct

SEQ ID NO: 1704760 - DNA, 13 bp, Homo sapiens
aggtgagaaaaaa

SEQ ID NO: 1704761 - DNA, 15 bp, Homo sapiens
aggtgagcaggcagg

SEQ ID NO: 1704762 - DNA, 22 bp, Homo sapiens
aggtgaggcccaagagccctgt

SEQ ID NO: 1704763 - DNA, 21 bp, Homo sapiens
aggtgagtttgagctgccttc

SEQ ID NO: 1704764 - DNA, 15 bp, Homo sapiens
aggtgataaaatcat

SEQ ID NO: 1704765 - DNA, 18 bp, Homo sapiens
aggtgatagcattgcttt

SEQ ID NO: 1704766 - DNA, 20 bp, Homo sapiens
aggtgatggaggtatttgaa

SEQ ID NO: 1704767 - DNA, 17 bp, Homo sapiens
aggtgatgggggcatgg

SEQ ID NO: 1704768 - DNA, 21 bp, Homo sapiens
aggtgatgtttccagctgcca

SEQ ID NO: 1704769 - DNA, 16 bp, Homo sapiens
aggtgatttcagactg

SEQ ID NO: 1704770 - DNA, 15 bp, Homo sapiens
aggtgcaatttcaag

SEQ ID NO: 1704771 - DNA, 16 bp, Homo sapiens
aggtgcaatttcaagg

SEQ ID NO: 1704772 - DNA, 21 bp, Homo sapiens
aggtgcagaggtaccctgggt

SEQ ID NO: 1704773 - DNA, 18 bp, Homo sapiens
aggtgcagagtgcccaga

SEQ ID NO: 1704774 - DNA, 16 bp, Homo sapiens
aggtgcagtggctcac

SEQ ID NO: 1704775 - DNA, 14 bp, Homo sapiens
aggtgccaccaccc

SEQ ID NO: 1704776 - DNA, 22 bp, Homo sapiens
aggtgccaccaccctgcccccc

SEQ ID NO: 1704777 - DNA, 20 bp, Homo sapiens
aggtgccactccctgagctt

SEQ ID NO: 1704778 - DNA, 20 bp, Homo sapiens
aggtgccatgcctgctccct

SEQ ID NO: 1704779 - DNA, 14 bp, Homo sapiens
aggtgcccagggcc

SEQ ID NO: 1704780 - DNA, 18 bp, Homo sapiens
aggtgcctcacgcctgta

SEQ ID NO: 1704781 - DNA, 19 bp, Homo sapiens
aggtgcctcagactccgcc

SEQ ID NO: 1704782 - DNA, 11 bp, Homo sapiens
aggtgcctcat

SEQ ID NO: 1704783 - DNA, 21 bp, Homo sapiens
aggtgcctcatagcatagcca

SEQ ID NO: 1704784 - DNA, 17 bp, Homo sapiens
aggtgcctgaactagtt

SEQ ID NO: 1704785 - DNA, 17 bp, Homo sapiens
aggtgcctgtcccaccc

SEQ ID NO: 1704786 - DNA, 19 bp, Homo sapiens
aggtgcctgtgaggcaggg

SEQ ID NO: 1704787 - DNA, 22 bp, Homo sapiens
aggtgccttcttattctcactc

SEQ ID NO: 1704788 - DNA, 20 bp, Homo sapiens
aggtgcgtgttcagcagaac

SEQ ID NO: 1704789 - DNA, 16 bp, Homo sapiens
aggtgctaacatagat

SEQ ID NO: 1704790 - DNA, 16 bp, Homo sapiens
aggtgctacaaaaaca

SEQ ID NO: 1704791 - DNA, 20 bp, Homo sapiens
aggtgctacaaaaacacagc

SEQ ID NO: 1704792 - DNA, 22 bp, Homo sapiens
aggtgctacaaaaacacagcaa

SEQ ID NO: 1704793 - DNA, 21 bp, Homo sapiens
aggtgctatctgttcagtgat

SEQ ID NO: 1704794 - DNA, 13 bp, Homo sapiens
aggtgctgagctt

SEQ ID NO: 1704795 - DNA, 23 bp, Homo sapiens
aggtgctgagcttagccttgtgc

SEQ ID NO: 1704796 - DNA, 18 bp, Homo sapiens
aggtgctgatgtcaaagt

SEQ ID NO: 1704797 - DNA, 20 bp, Homo sapiens
aggtgctgatgtcaaagtgt

SEQ ID NO: 1704798 - DNA, 18 bp, Homo sapiens
aggtgctgcggcgcgggc

SEQ ID NO: 1704799 - DNA, 21 bp, Homo sapiens
aggtgctggaaagggagggag

SEQ ID NO: 1704800 - DNA, 22 bp, Homo sapiens
aggtgctggaaagggagggagg

SEQ ID NO: 1704801 - DNA, 23 bp, Homo sapiens
aggtgcttattctcaaagcagga

SEQ ID NO: 1704802 - DNA, 17 bp, Homo sapiens
aggtgcttgaggccccg

SEQ ID NO: 1704803 - DNA, 23 bp, Homo sapiens
aggtgctttgctagatgctgtga

SEQ ID NO: 1704804 - DNA, 14 bp, Homo sapiens
aggtgcttttgatg

SEQ ID NO: 1704805 - DNA, 18 bp, Homo sapiens
aggtggaagaagggagaa

SEQ ID NO: 1704806 - DNA, 19 bp, Homo sapiens
aggtggaagaagggagaag

SEQ ID NO: 1704807 - DNA, 14 bp, Homo sapiens
aggtggaaggcagg

SEQ ID NO: 1704808 - DNA, 21 bp, Homo sapiens
aggtggacacaacagcagtct

SEQ ID NO: 1704809 - DNA, 15 bp, Homo sapiens
aggtggacctggcag

SEQ ID NO: 1704810 - DNA, 13 bp, Homo sapiens
aggtggactgact

SEQ ID NO: 1704811 - DNA, 22 bp, Homo sapiens
aggtggagaactgggatttgaa

SEQ ID NO: 1704812 - DNA, 21 bp, Homo sapiens
aggtggagccaagtggtccag

SEQ ID NO: 1704813 - DNA, 22 bp, Homo sapiens
aggtggagccaagtggtccagc

SEQ ID NO: 1704814 - DNA, 20 bp, Homo sapiens
aggtggagcttgcagtgagc

SEQ ID NO: 1704815 - DNA, 13 bp, Homo sapiens
aggtggagggcac

SEQ ID NO: 1704816 - DNA, 19 bp, Homo sapiens
aggtggagggcacagccct

SEQ ID NO: 1704817 - DNA, 17 bp, Homo sapiens
aggtggatcacctgagg

SEQ ID NO: 1704818 - DNA, 16 bp, Homo sapiens
aggtggatggccccag

SEQ ID NO: 1704819 - DNA, 23 bp, Homo sapiens
aggtggatgttatgaacagctgt

SEQ ID NO: 1704820 - DNA, 17 bp, Homo sapiens
aggtggccacagcagga

SEQ ID NO: 1704821 - DNA, 17 bp, Homo sapiens
aggtggccactccagac

SEQ ID NO: 1704822 - DNA, 17 bp, Homo sapiens
aggtggcctctgcctgg

SEQ ID NO: 1704823 - DNA, 21 bp, Homo sapiens
aggtggctgacccagtccctg

SEQ ID NO: 1704824 - DNA, 23 bp, Homo sapiens
aggtggctgacccagtccctggg

SEQ ID NO: 1704825 - DNA, 23 bp, Homo sapiens
aggtggctgtagatggtgacctg

SEQ ID NO: 1704826 - DNA, 19 bp, Homo sapiens
aggtgggcaaagggaagta

SEQ ID NO: 1704827 - DNA, 19 bp, Homo sapiens
aggtgggcagctgggcccc

SEQ ID NO: 1704828 - DNA, 13 bp, Homo sapiens
aggtgggcccagg

SEQ ID NO: 1704829 - DNA, 23 bp, Homo sapiens
aggtgggcccaggaccagctggg

SEQ ID NO: 1704830 - DNA, 15 bp, Homo sapiens
aggtgggccttgcta

SEQ ID NO: 1704831 - DNA, 19 bp, Homo sapiens
aggtgggctgagccctggc

SEQ ID NO: 1704832 - DNA, 14 bp, Homo sapiens
aggtgggctgctga

SEQ ID NO: 1704833 - DNA, 14 bp, Homo sapiens
aggtgggctgggcc

SEQ ID NO: 1704834 - DNA, 16 bp, Homo sapiens
aggtgggctgtattca

SEQ ID NO: 1704835 - DNA, 17 bp, Homo sapiens
aggtggggatcctgcct

SEQ ID NO: 1704836 - DNA, 16 bp, Homo sapiens
aggtgggggaaaatga

SEQ ID NO: 1704837 - DNA, 15 bp, Homo sapiens
aggtgggggttgctg

SEQ ID NO: 1704838 - DNA, 13 bp, Homo sapiens
aggtgggtccagg

SEQ ID NO: 1704839 - DNA, 18 bp, Homo sapiens
aggtgggtccaggaaggc

SEQ ID NO: 1704840 - DNA, 21 bp, Homo sapiens
aggtgggtccaggaaggcagc

SEQ ID NO: 1704841 - DNA, 23 bp, Homo sapiens
aggtgggtccaggaaggcagctg

SEQ ID NO: 1704842 - DNA, 18 bp, Homo sapiens
aggtggtaaattcagaca

SEQ ID NO: 1704843 - DNA, 21 bp, Homo sapiens
aggtggtaaattcagacaaca

SEQ ID NO: 1704844 - DNA, 22 bp, Homo sapiens
aggtggtcctcctatctccctg

SEQ ID NO: 1704845 - DNA, 21 bp, Homo sapiens
aggtggtggtagagaagcaag

SEQ ID NO: 1704846 - DNA, 16 bp, Homo sapiens
aggtgtcaacttttga

SEQ ID NO: 1704847 - DNA, 21 bp, Homo sapiens
aggtgtcaacttttgaccaaa

SEQ ID NO: 1704848 - DNA, 16 bp, Homo sapiens
aggtgtccagggtcct

SEQ ID NO: 1704849 - DNA, 12 bp, Homo sapiens
aggtgtccccaa

SEQ ID NO: 1704850 - DNA, 15 bp, Homo sapiens
aggtgtctgccttca

SEQ ID NO: 1704851 - DNA, 22 bp, Homo sapiens
aggtgtctgccttcacaaatgt

SEQ ID NO: 1704852 - DNA, 17 bp, Homo sapiens
aggtgtctggggtgagg

SEQ ID NO: 1704853 - DNA, 13 bp, Homo sapiens
aggtgtgaggagg

SEQ ID NO: 1704854 - DNA, 17 bp, Homo sapiens
aggtgtgaggaggaggc

SEQ ID NO: 1704855 - DNA, 12 bp, Homo sapiens
aggtgtgcaaag

SEQ ID NO: 1704856 - DNA, 13 bp, Homo sapiens
aggtgtgcaaaga

SEQ ID NO: 1704857 - DNA, 20 bp, Homo sapiens
aggtgtgcctgtgctcctgc

SEQ ID NO: 1704858 - DNA, 21 bp, Homo sapiens
aggtgtgcctgtgctcctgcc

SEQ ID NO: 1704859 - DNA, 23 bp, Homo sapiens
aggtgtgcctgtgctcctgccca

SEQ ID NO: 1704860 - DNA, 17 bp, Homo sapiens
aggtgtgggagggaaga

SEQ ID NO: 1704861 - DNA, 15 bp, Homo sapiens
aggtgtgggatctgg

SEQ ID NO: 1704862 - DNA, 18 bp, Homo sapiens
aggtgtgggggctgcagc

SEQ ID NO: 1704863 - DNA, 19 bp, Homo sapiens
aggtgtgggtgtctgtttg

SEQ ID NO: 1704864 - DNA, 12 bp, Homo sapiens
aggtgtggtggc

SEQ ID NO: 1704865 - DNA, 16 bp, Homo sapiens
aggtgtggtggctcat

SEQ ID NO: 1704866 - DNA, 22 bp, Homo sapiens
gacacagcagcttcaccagagc

SEQ ID NO: 1704867 - DNA, 23 bp, Homo sapiens
gacacagcagcttcaccagagca

SEQ ID NO: 1704868 - DNA, 14 bp, Homo sapiens
gacacagcagtgag

SEQ ID NO: 1704869 - DNA, 14 bp, Homo sapiens
gacacagcctcccc

SEQ ID NO: 1704870 - DNA, 13 bp, Homo sapiens
gacacagcgtccc

SEQ ID NO: 1704871 - DNA, 21 bp, Homo sapiens
gacacagcgtccctagcagtg

SEQ ID NO: 1704872 - DNA, 22 bp, Homo sapiens
gacacagcgtccctagcagtga

SEQ ID NO: 1704873 - DNA, 11 bp, Homo sapiens
gacacagctct

SEQ ID NO: 1704874 - DNA, 14 bp, Homo sapiens
gacacagctcttca

SEQ ID NO: 1704875 - DNA, 15 bp, Homo sapiens
gacacagctcttcat

SEQ ID NO: 1704876 - DNA, 16 bp, Homo sapiens
gacacagctcttcatt

SEQ ID NO: 1704877 - DNA, 13 bp, Homo sapiens
gacacagttcctg

SEQ ID NO: 1704878 - DNA, 16 bp, Homo sapiens
gacacagttcctggga

SEQ ID NO: 1704879 - DNA, 15 bp, Homo sapiens
gacacataaatctgt

SEQ ID NO: 1704880 - DNA, 19 bp, Homo sapiens
gacacatacagagtgggcc

SEQ ID NO: 1704881 - DNA, 15 bp, Homo sapiens
gacacatatacatat

SEQ ID NO: 1704882 - DNA, 18 bp, Homo sapiens
gacacatatgaacacaga

SEQ ID NO: 1704883 - DNA, 21 bp, Homo sapiens
gacacatcccggcctcttcca

SEQ ID NO: 1704884 - DNA, 13 bp, Homo sapiens
gacacatcgtttt

SEQ ID NO: 1704885 - DNA, 14 bp, Homo sapiens
gacacatgctatgt

SEQ ID NO: 1704886 - DNA, 16 bp, Homo sapiens
gacacatgctatgttc

SEQ ID NO: 1704887 - DNA, 19 bp, Homo sapiens
gacacatgctatgttctgt

SEQ ID NO: 1704888 - DNA, 17 bp, Homo sapiens
gacacatgggcttgtga

SEQ ID NO: 1704889 - DNA, 15 bp, Homo sapiens
gacacattacaaagc

SEQ ID NO: 1704890 - DNA, 15 bp, Homo sapiens
gacacattgccttct

SEQ ID NO: 1704891 - DNA, 14 bp, Homo sapiens
gacaccaaagttct

SEQ ID NO: 1704892 - DNA, 13 bp, Homo sapiens
gacaccaataaat

SEQ ID NO: 1704893 - DNA, 22 bp, Homo sapiens
gacaccagaagctgttgggaga

SEQ ID NO: 1704894 - DNA, 19 bp, Homo sapiens
gacaccaggagtccctggt

SEQ ID NO: 1704895 - DNA, 20 bp, Homo sapiens
gacaccaggagtccctggta

SEQ ID NO: 1704896 - DNA, 16 bp, Homo sapiens
gacaccagtgaaagaa

SEQ ID NO: 1704897 - DNA, 15 bp, Homo sapiens
gacaccatcctgagc

SEQ ID NO: 1704898 - DNA, 16 bp, Homo sapiens
gacaccatcctgagcc

SEQ ID NO: 1704899 - DNA, 14 bp, Homo sapiens
gacacccaaagggt

SEQ ID NO: 1704900 - DNA, 13 bp, Homo sapiens
gacacccatgcca

SEQ ID NO: 1704901 - DNA, 19 bp, Homo sapiens
gacacccatgccagagagg

SEQ ID NO: 1704902 - DNA, 18 bp, Homo sapiens
gacacccctcgcccccat

SEQ ID NO: 1704903 - DNA, 10 bp, Homo sapiens
gacacccggc

SEQ ID NO: 1704904 - DNA, 13 bp, Homo sapiens
gacaccctcaacc

SEQ ID NO: 1704905 - DNA, 14 bp, Homo sapiens
gacaccctctgccg

SEQ ID NO: 1704906 - DNA, 13 bp, Homo sapiens
gacaccctctggg

SEQ ID NO: 1704907 - DNA, 14 bp, Homo sapiens
gacaccctggcctg

SEQ ID NO: 1704908 - DNA, 23 bp, Homo sapiens
gacaccctggcctgaactgagga

SEQ ID NO: 1704909 - DNA, 18 bp, Homo sapiens
gacaccgtccctcagtga

SEQ ID NO: 1704910 - DNA, 13 bp, Homo sapiens
gacacctaccatg

SEQ ID NO: 1704911 - DNA, 15 bp, Homo sapiens
gacacctcccccttt

SEQ ID NO: 1704912 - DNA, 15 bp, Homo sapiens
gacacctgcacctcc

SEQ ID NO: 1704913 - DNA, 20 bp, Homo sapiens
gacacctgcacctcccccca

SEQ ID NO: 1704914 - DNA, 19 bp, Homo sapiens
gacacctggccgcctccag

SEQ ID NO: 1704915 - DNA, 17 bp, Homo sapiens
gacacctgggccgggct

SEQ ID NO: 1704916 - DNA, 20 bp, Homo sapiens
gacacctggtgcgggcctgg

SEQ ID NO: 1704917 - DNA, 10 bp, Homo sapiens
gacacctgtc

SEQ ID NO: 1704918 - DNA, 20 bp, Homo sapiens
gacacctgtcttgaataaga

SEQ ID NO: 1704919 - DNA, 22 bp, Homo sapiens
gacacctgtcttgaataagagt

SEQ ID NO: 1704920 - DNA, 14 bp, Homo sapiens
gacacgagccacaa

SEQ ID NO: 1704921 - DNA, 19 bp, Homo sapiens
gacacgctcgcgggcagcg

SEQ ID NO: 1704922 - DNA, 15 bp, Homo sapiens
gacacggagcccagc

SEQ ID NO: 1704923 - DNA, 15 bp, Homo sapiens
gacacggcttcactg

SEQ ID NO: 1704924 - DNA, 18 bp, Homo sapiens
gacacggcttcactgacc

SEQ ID NO: 1704925 - DNA, 13 bp, Homo sapiens
gacacgtggcctc

SEQ ID NO: 1704926 - DNA, 23 bp, Homo sapiens
gacacgtggcctcgtgaggggca

SEQ ID NO: 1704927 - DNA, 15 bp, Homo sapiens
gacactaacgacttc

SEQ ID NO: 1704928 - DNA, 16 bp, Homo sapiens
gacactagaagatttt

SEQ ID NO: 1704929 - DNA, 12 bp, Homo sapiens
gacactatatct

SEQ ID NO: 1704930 - DNA, 13 bp, Homo sapiens
gacactgcctggg

SEQ ID NO: 1704931 - DNA, 14 bp, Homo sapiens
gacactgcctgggc

SEQ ID NO: 1704932 - DNA, 14 bp, Homo sapiens
gacactgctctaac

SEQ ID NO: 1704933 - DNA, 14 bp, Homo sapiens
gacactgctgcacc

SEQ ID NO: 1704934 - DNA, 13 bp, Homo sapiens
gacactggaccag

SEQ ID NO: 1704935 - DNA, 14 bp, Homo sapiens
gacactgggcagca

SEQ ID NO: 1704936 - DNA, 16 bp, Homo sapiens
gacactgtgcccagcc

SEQ ID NO: 1704937 - DNA, 22 bp, Homo sapiens
gacactgtggagactttctgtt

SEQ ID NO: 1704938 - DNA, 18 bp, Homo sapiens
gacacttccctctgtttc

SEQ ID NO: 1704939 - DNA, 12 bp, Homo sapiens
gacacttcctgc

SEQ ID NO: 1704940 - DNA, 14 bp, Homo sapiens
gacacttcctgcct

SEQ ID NO: 1704941 - DNA, 15 bp, Homo sapiens
gacacttgccttctt

SEQ ID NO: 1704942 - DNA, 21 bp, Homo sapiens
gacactttgaaatgtgtttct

SEQ ID NO: 1704943 - DNA, 13 bp, Homo sapiens
gacagaaagcctc

SEQ ID NO: 1704944 - DNA, 22 bp, Homo sapiens
gacagaaagcctccgctgggct

SEQ ID NO: 1704945 - DNA, 15 bp, Homo sapiens
gacagaatgtgttct

SEQ ID NO: 1704946 - DNA, 13 bp, Homo sapiens
gacagacacacac

SEQ ID NO: 1704947 - DNA, 15 bp, Homo sapiens
gacagacaggctctt

SEQ ID NO: 1704948 - DNA, 18 bp, Homo sapiens
gacagacatctctgcacc

SEQ ID NO: 1704949 - DNA, 16 bp, Homo sapiens
gacagaccacttgcca

SEQ ID NO: 1704950 - DNA, 19 bp, Homo sapiens
gacagaccacttgccacgc

SEQ ID NO: 1704951 - DNA, 14 bp, Homo sapiens
gacagaccctctgc

SEQ ID NO: 1704952 - DNA, 15 bp, Homo sapiens
gacagactatttgct

SEQ ID NO: 1704953 - DNA, 15 bp, Homo sapiens
gacagacttgagaac

SEQ ID NO: 1704954 - DNA, 18 bp, Homo sapiens
gacagagacacctgcacc

SEQ ID NO: 1704955 - DNA, 22 bp, Homo sapiens
gacagagacacctgcacctccc

SEQ ID NO: 1704956 - DNA, 15 bp, Homo sapiens
gacagagaggactgt

SEQ ID NO: 1704957 - DNA, 21 bp, Homo sapiens
gacagagccaagcactgctca

SEQ ID NO: 1704958 - DNA, 18 bp, Homo sapiens
gacagagccccacgctgt

SEQ ID NO: 1704959 - DNA, 18 bp, Homo sapiens
gacagaggaccattacaa

SEQ ID NO: 1704960 - DNA, 12 bp, Homo sapiens
gacagaggaggg

SEQ ID NO: 1704961 - DNA, 19 bp, Homo sapiens
gacagaggccccagcctcc

SEQ ID NO: 1704962 - DNA, 16 bp, Homo sapiens
gacagaggccggggtc

SEQ ID NO: 1704963 - DNA, 21 bp, Homo sapiens
gacagagggcacatgaacagc

SEQ ID NO: 1704964 - DNA, 21 bp, Homo sapiens
gacagaggttgtagtgagcca

SEQ ID NO: 1704965 - DNA, 16 bp, Homo sapiens
gacagagtatgaacac

SEQ ID NO: 1704966 - DNA, 12 bp, Homo sapiens
gacagagtgaga

SEQ ID NO: 1704967 - DNA, 22 bp, Homo sapiens
gacagagtgagaccctgtctca

SEQ ID NO: 1704968 - DNA, 21 bp, Homo sapiens
gacagagttcactataaatgg

SEQ ID NO: 1704969 - DNA, 21 bp, Homo sapiens
gacagataaatccttaacatt

SEQ ID NO: 1704970 - DNA, 13 bp, Homo sapiens
gacagataactct

SEQ ID NO: 1704971 - DNA, 16 bp, Homo sapiens
gacagatatttcaaac

SEQ ID NO: 1704972 - DNA, 19 bp, Homo sapiens
gacagatgaatgccgtgga

SEQ ID NO: 1704973 - DNA, 19 bp, Homo sapiens
gacagatgccccagagctg

SEQ ID NO: 1704974 - DNA, 23 bp, Homo sapiens
gacagcaaaatgttgaagaaaaa

SEQ ID NO: 1704975 - DNA, 20 bp, Homo sapiens
gacagcaacaaaatcatggc

SEQ ID NO: 1704976 - DNA, 17 bp, Homo sapiens
gacagcaagtgagcaga

SEQ ID NO: 1704977 - DNA, 15 bp, Homo sapiens
gacagcagcctccct

SEQ ID NO: 1704978 - DNA, 13 bp, Homo sapiens
gacagcagcctgt

SEQ ID NO: 1704979 - DNA, 20 bp, Homo sapiens
gacagcagctcaggcacact

SEQ ID NO: 1704980 - DNA, 22 bp, Homo sapiens
gacagcagctggtgccccacct

SEQ ID NO: 1704981 - DNA, 20 bp, Homo sapiens
gacagcagtatcacaggcca

SEQ ID NO: 1704982 - DNA, 22 bp, Homo sapiens
gacagcagtatcacaggccaga

SEQ ID NO: 1704983 - DNA, 14 bp, Homo sapiens
gacagcattttaag

SEQ ID NO: 1704984 - DNA, 17 bp, Homo sapiens
aggtgttaacattccaa

SEQ ID NO: 1704985 - DNA, 20 bp, Homo sapiens
aggtgttacagaggaccctt

SEQ ID NO: 1704986 - DNA, 22 bp, Homo sapiens
aggtgttcaagaccagcctgac

SEQ ID NO: 1704987 - DNA, 12 bp, Homo sapiens
aggtgttgccaa

SEQ ID NO: 1704988 - DNA, 17 bp, Homo sapiens
aggtgttggctgcacgt

SEQ ID NO: 1704989 - DNA, 22 bp, Homo sapiens
aggtgtttccatttctcaatca

SEQ ID NO: 1704990 - DNA, 22 bp, Homo sapiens
aggttaaaaaaaggcattgttt

SEQ ID NO: 1704991 - DNA, 16 bp, Homo sapiens
aggttaaggtgggtcc

SEQ ID NO: 1704992 - DNA, 22 bp, Homo sapiens
aggttaattccaattatatgag

SEQ ID NO: 1704993 - DNA, 15 bp, Homo sapiens
aggttacaagcctgc

SEQ ID NO: 1704994 - DNA, 16 bp, Homo sapiens
aggttagaaaggcagc

SEQ ID NO: 1704995 - DNA, 14 bp, Homo sapiens
aggttataattttt

SEQ ID NO: 1704996 - DNA, 14 bp, Homo sapiens
aggttataggtcac

SEQ ID NO: 1704997 - DNA, 21 bp, Homo sapiens
aggttatcaaaactgttgtca

SEQ ID NO: 1704998 - DNA, 15 bp, Homo sapiens
aggttatcagtgctt

SEQ ID NO: 1704999 - DNA, 15 bp, Homo sapiens
aggttatctgcctgg

SEQ ID NO: 1705000 - DNA, 22 bp, Homo sapiens
aggttatctgcctggcctggct

SEQ ID NO: 1705001 - DNA, 16 bp, Homo sapiens
aggttattgcaataaa

SEQ ID NO: 1705002 - DNA, 21 bp, Homo sapiens
aggttattgcaataaagtata

SEQ ID NO: 1705003 - DNA, 19 bp, Homo sapiens
aggttatttaaaataaatt

SEQ ID NO: 1705004 - DNA, 13 bp, Homo sapiens
aggttattttgct

SEQ ID NO: 1705005 - DNA, 14 bp, Homo sapiens
aggttattttgctt

SEQ ID NO: 1705006 - DNA, 19 bp, Homo sapiens
aggttcaagcaatcctccc

SEQ ID NO: 1705007 - DNA, 15 bp, Homo sapiens
aggttcagccaaggt

SEQ ID NO: 1705008 - DNA, 15 bp, Homo sapiens
aggttcatgcccaag

SEQ ID NO: 1705009 - DNA, 15 bp, Homo sapiens
aggttccagtgagcc

SEQ ID NO: 1705010 - DNA, 19 bp, Homo sapiens
aggttccccaagggccctg

SEQ ID NO: 1705011 - DNA, 20 bp, Homo sapiens
aggttccccaagggccctgg

SEQ ID NO: 1705012 - DNA, 23 bp, Homo sapiens
aggttccccaagggccctggcac

SEQ ID NO: 1705013 - DNA, 14 bp, Homo sapiens
aggttcccctgtca

SEQ ID NO: 1705014 - DNA, 15 bp, Homo sapiens
aggttcccgacacca

SEQ ID NO: 1705015 - DNA, 16 bp, Homo sapiens
aggttccgatgttatt

SEQ ID NO: 1705016 - DNA, 20 bp, Homo sapiens
aggttcctctgcctgccccg

SEQ ID NO: 1705017 - DNA, 20 bp, Homo sapiens
aggttcctgtactactgcct

SEQ ID NO: 1705018 - DNA, 16 bp, Homo sapiens
aggttcctttttcaaa

SEQ ID NO: 1705019 - DNA, 21 bp, Homo sapiens
aggttcgagacccaaaccccc

SEQ ID NO: 1705020 - DNA, 11 bp, Homo sapiens
aggttctaaaa

SEQ ID NO: 1705021 - DNA, 14 bp, Homo sapiens
aggttctaaagttc

SEQ ID NO: 1705022 - DNA, 15 bp, Homo sapiens
aggttctaaagttct

SEQ ID NO: 1705023 - DNA, 18 bp, Homo sapiens
aggttctaaagttctaag

SEQ ID NO: 1705024 - DNA, 12 bp, Homo sapiens
aggttctaaggc

SEQ ID NO: 1705025 - DNA, 21 bp, Homo sapiens
aggttctccaacatcacagcc

SEQ ID NO: 1705026 - DNA, 22 bp, Homo sapiens
aggttctccaacatcacagccc

SEQ ID NO: 1705027 - DNA, 14 bp, Homo sapiens
aggttctgcctgct

SEQ ID NO: 1705028 - DNA, 16 bp, Homo sapiens
aggttctggttccatt

SEQ ID NO: 1705029 - DNA, 17 bp, Homo sapiens
aggttcttagtgtcact

SEQ ID NO: 1705030 - DNA, 19 bp, Homo sapiens
aggttcttcatccctttcc

SEQ ID NO: 1705031 - DNA, 16 bp, Homo sapiens
aggttcttgatgtcat

SEQ ID NO: 1705032 - DNA, 13 bp, Homo sapiens
aggttgcacacag

SEQ ID NO: 1705033 - DNA, 19 bp, Homo sapiens
aggttgcacacagtacaca

SEQ ID NO: 1705034 - DNA, 12 bp, Homo sapiens
aggttgcaggga

SEQ ID NO: 1705035 - DNA, 19 bp, Homo sapiens
aggttgcagtgagccaaga

SEQ ID NO: 1705036 - DNA, 12 bp, Homo sapiens
aggttgcagtgc

SEQ ID NO: 1705037 - DNA, 17 bp, Homo sapiens
aggttgccaaattgctg

SEQ ID NO: 1705038 - DNA, 17 bp, Homo sapiens
aggttgcctgaaaaatg

SEQ ID NO: 1705039 - DNA, 16 bp, Homo sapiens
aggttggacagccccc

SEQ ID NO: 1705040 - DNA, 18 bp, Homo sapiens
aggttggacagccccctt

SEQ ID NO: 1705041 - DNA, 20 bp, Homo sapiens
aggttggtgactgaaacatt

SEQ ID NO: 1705042 - DNA, 18 bp, Homo sapiens
aggttgtagtgagccaag

SEQ ID NO: 1705043 - DNA, 15 bp, Homo sapiens
aggttgtatgtaaat

SEQ ID NO: 1705044 - DNA, 16 bp, Homo sapiens
aggttgtatgtaaatc

SEQ ID NO: 1705045 - DNA, 17 bp, Homo sapiens
aggttgtatgtaaatct

SEQ ID NO: 1705046 - DNA, 18 bp, Homo sapiens
aggttgtatgtaaatctg

SEQ ID NO: 1705047 - DNA, 19 bp, Homo sapiens
aggttgtatgtaaatctgc

SEQ ID NO: 1705048 - DNA, 20 bp, Homo sapiens
aggttgtctgaagtcactgc

SEQ ID NO: 1705049 - DNA, 23 bp, Homo sapiens
aggttgtgcagggtgtgtactgc

SEQ ID NO: 1705050 - DNA, 16 bp, Homo sapiens
aggtttacactgcgga

SEQ ID NO: 1705051 - DNA, 17 bp, Homo sapiens
aggtttactgtgaagag

SEQ ID NO: 1705052 - DNA, 19 bp, Homo sapiens
aggtttactgtgaagagaa

SEQ ID NO: 1705053 - DNA, 12 bp, Homo sapiens
aggtttattgtt

SEQ ID NO: 1705054 - DNA, 13 bp, Homo sapiens
aggtttcaaagat

SEQ ID NO: 1705055 - DNA, 19 bp, Homo sapiens
aggtttccttttggaacat

SEQ ID NO: 1705056 - DNA, 12 bp, Homo sapiens
aggtttctattg

SEQ ID NO: 1705057 - DNA, 13 bp, Homo sapiens
aggtttctctctt

SEQ ID NO: 1705058 - DNA, 17 bp, Homo sapiens
aggtttctctcttccct

SEQ ID NO: 1705059 - DNA, 21 bp, Homo sapiens
aggtttggatgggagtgagac

SEQ ID NO: 1705060 - DNA, 20 bp, Homo sapiens
aggtttggctagttctctta

SEQ ID NO: 1705061 - DNA, 22 bp, Homo sapiens
aggtttggggagggggaagaga

SEQ ID NO: 1705062 - DNA, 13 bp, Homo sapiens
aggtttgtatatt

SEQ ID NO: 1705063 - DNA, 18 bp, Homo sapiens
aggttttaaatctgcttt

SEQ ID NO: 1705064 - DNA, 21 bp, Homo sapiens
aggttttaagctaaaatgtta

SEQ ID NO: 1705065 - DNA, 22 bp, Homo sapiens
aggttttcctcttctattttgt

SEQ ID NO: 1705066 - DNA, 22 bp, Homo sapiens
aggttttctctaacttctcaag

SEQ ID NO: 1705067 - DNA, 16 bp, Homo sapiens
aggttttgtaaaactg

SEQ ID NO: 1705068 - DNA, 13 bp, Homo sapiens
aggtttttgtaaa

SEQ ID NO: 1705069 - DNA, 21 bp, Homo sapiens
aggtttttttgtatagtaaag

SEQ ID NO: 1705070 - DNA, 13 bp, Homo sapiens
agtaaaaactaga

SEQ ID NO: 1705071 - DNA, 14 bp, Homo sapiens
agtaaaaaggctaa

SEQ ID NO: 1705072 - DNA, 20 bp, Homo sapiens
agtaaaaattaaaaaatgaa

SEQ ID NO: 1705073 - DNA, 17 bp, Homo sapiens
agtaaaacataatgtat

SEQ ID NO: 1705074 - DNA, 23 bp, Homo sapiens
agtaaaagaagaaatagttctgt

SEQ ID NO: 1705075 - DNA, 13 bp, Homo sapiens
agtaaaagacatt

SEQ ID NO: 1705076 - DNA, 19 bp, Homo sapiens
agtaaaagtatagatacaa

SEQ ID NO: 1705077 - DNA, 17 bp, Homo sapiens
agtaaaatactcttttt

SEQ ID NO: 1705078 - DNA, 14 bp, Homo sapiens
agtaaaattcagtt

SEQ ID NO: 1705079 - DNA, 14 bp, Homo sapiens
agtaaacaggaaac

SEQ ID NO: 1705080 - DNA, 16 bp, Homo sapiens
agtaaacataaaaact

SEQ ID NO: 1705081 - DNA, 20 bp, Homo sapiens
agtaaacataaaaactgatt

SEQ ID NO: 1705082 - DNA, 20 bp, Homo sapiens
agtaaacattaagtaaatgc

SEQ ID NO: 1705083 - DNA, 17 bp, Homo sapiens
agtaaaccactgaaaaa

SEQ ID NO: 1705084 - DNA, 17 bp, Homo sapiens
agtaaagcttttctttt

SEQ ID NO: 1705085 - DNA, 16 bp, Homo sapiens
agtaaaggcattgtcc

SEQ ID NO: 1705086 - DNA, 14 bp, Homo sapiens
agtaaataatgaaa

SEQ ID NO: 1705087 - DNA, 23 bp, Homo sapiens
agtaaatagtttgaattcagtaa

SEQ ID NO: 1705088 - DNA, 15 bp, Homo sapiens
agtaaatcagaaagt

SEQ ID NO: 1705089 - DNA, 13 bp, Homo sapiens
agtaaattatgat

SEQ ID NO: 1705090 - DNA, 20 bp, Homo sapiens
agtaacaatacaaatggatt

SEQ ID NO: 1705091 - DNA, 21 bp, Homo sapiens
agtaacacagtattatgcctg

SEQ ID NO: 1705092 - DNA, 22 bp, Homo sapiens
agtaacatcaaagattaggtga

SEQ ID NO: 1705093 - DNA, 23 bp, Homo sapiens
agtaaccatcactggttgcactt

SEQ ID NO: 1705094 - DNA, 17 bp, Homo sapiens
agtaacccctcctggct

SEQ ID NO: 1705095 - DNA, 16 bp, Homo sapiens
agtaacctagtgaatt

SEQ ID NO: 1705096 - DNA, 16 bp, Homo sapiens
agtaacgcgtcttcct

SEQ ID NO: 1705097 - DNA, 18 bp, Homo sapiens
agtaacgcgtcttcctga

SEQ ID NO: 1705098 - DNA, 19 bp, Homo sapiens
agtaacgcgtcttcctgag

SEQ ID NO: 1705099 - DNA, 13 bp, Homo sapiens
agtaactactttt

SEQ ID NO: 1705100 - DNA, 20 bp, Homo sapiens
agtaactactttttatactc

SEQ ID NO: 1705101 - DNA, 15 bp, Homo sapiens
gacagcattttaagg

SEQ ID NO: 1705102 - DNA, 13 bp, Homo sapiens
gacagccagagcc

SEQ ID NO: 1705103 - DNA, 16 bp, Homo sapiens
gacagccagagcctgt

SEQ ID NO: 1705104 - DNA, 13 bp, Homo sapiens
gacagcccagagc

SEQ ID NO: 1705105 - DNA, 21 bp, Homo sapiens
gacagcccaggatactggcac

SEQ ID NO: 1705106 - DNA, 14 bp, Homo sapiens
gacagccccaccct

SEQ ID NO: 1705107 - DNA, 16 bp, Homo sapiens
gacagcctcccacccc

SEQ ID NO: 1705108 - DNA, 18 bp, Homo sapiens
gacagcctgcagcaggaa

SEQ ID NO: 1705109 - DNA, 11 bp, Homo sapiens
gacagcctggc

SEQ ID NO: 1705110 - DNA, 12 bp, Homo sapiens
gacagcctggca

SEQ ID NO: 1705111 - DNA, 20 bp, Homo sapiens
gacagcctgtggcggtgcct

SEQ ID NO: 1705112 - DNA, 22 bp, Homo sapiens
gacagcctgtggcggtgcctgg

SEQ ID NO: 1705113 - DNA, 13 bp, Homo sapiens
gacagcgggaaaa

SEQ ID NO: 1705114 - DNA, 15 bp, Homo sapiens
gacagcgggaaaaat

SEQ ID NO: 1705115 - DNA, 21 bp, Homo sapiens
gacagcgtccggggtggtgga

SEQ ID NO: 1705116 - DNA, 15 bp, Homo sapiens
gacagctccgggatc

SEQ ID NO: 1705117 - DNA, 13 bp, Homo sapiens
gacagctgcccag

SEQ ID NO: 1705118 - DNA, 18 bp, Homo sapiens
gacagctgcccagacaca

SEQ ID NO: 1705119 - DNA, 18 bp, Homo sapiens
gacagctgctgggaccca

SEQ ID NO: 1705120 - DNA, 21 bp, Homo sapiens
gacagctgctgggacccacct

SEQ ID NO: 1705121 - DNA, 22 bp, Homo sapiens
gacagcttcctcacacccctgt

SEQ ID NO: 1705122 - DNA, 22 bp, Homo sapiens
gacagcttgagccgggcccctg

SEQ ID NO: 1705123 - DNA, 19 bp, Homo sapiens
gacaggaaaatcctctggc

SEQ ID NO: 1705124 - DNA, 15 bp, Homo sapiens
gacaggacagaatgt

SEQ ID NO: 1705125 - DNA, 22 bp, Homo sapiens
gacaggacagtgcttcagcctg

SEQ ID NO: 1705126 - DNA, 17 bp, Homo sapiens
gacaggaccctcaggaa

SEQ ID NO: 1705127 - DNA, 15 bp, Homo sapiens
gacaggacctgacta

SEQ ID NO: 1705128 - DNA, 12 bp, Homo sapiens
gacaggagaaat

SEQ ID NO: 1705129 - DNA, 14 bp, Homo sapiens
gacaggagaagaga

SEQ ID NO: 1705130 - DNA, 14 bp, Homo sapiens
gacaggagcctagc

SEQ ID NO: 1705131 - DNA, 17 bp, Homo sapiens
gacaggaggcggcccgg

SEQ ID NO: 1705132 - DNA, 21 bp, Homo sapiens
gacaggaggcggcccggccag

SEQ ID NO: 1705133 - DNA, 22 bp, Homo sapiens
gacaggatctataggcagcttc

SEQ ID NO: 1705134 - DNA, 20 bp, Homo sapiens
gacaggatggggttctggaa

SEQ ID NO: 1705135 - DNA, 13 bp, Homo sapiens
gacaggcactcca

SEQ ID NO: 1705136 - DNA, 21 bp, Homo sapiens
gacaggcagcctcctttgtgt

SEQ ID NO: 1705137 - DNA, 18 bp, Homo sapiens
gacaggcccaagagatga

SEQ ID NO: 1705138 - DNA, 21 bp, Homo sapiens
gacaggcccaagagatgaaga

SEQ ID NO: 1705139 - DNA, 13 bp, Homo sapiens
gacaggctcttag

SEQ ID NO: 1705140 - DNA, 17 bp, Homo sapiens
gacaggctcttagcagc

SEQ ID NO: 1705141 - DNA, 19 bp, Homo sapiens
gacaggctgaagagaggga

SEQ ID NO: 1705142 - DNA, 19 bp, Homo sapiens
gacagggacccacttcaca

SEQ ID NO: 1705143 - DNA, 14 bp, Homo sapiens
gacagggcatggcc

SEQ ID NO: 1705144 - DNA, 20 bp, Homo sapiens
gacagggcatggccaggtgg

SEQ ID NO: 1705145 - DNA, 22 bp, Homo sapiens
gacagggcatggccaggtggcc

SEQ ID NO: 1705146 - DNA, 15 bp, Homo sapiens
gacagggcctggagc

SEQ ID NO: 1705147 - DNA, 16 bp, Homo sapiens
gacagggcctggagcc

SEQ ID NO: 1705148 - DNA, 15 bp, Homo sapiens
gacagtaaaatacta

SEQ ID NO: 1705149 - DNA, 16 bp, Homo sapiens
gacagtatatttgaaa

SEQ ID NO: 1705150 - DNA, 19 bp, Homo sapiens
gacagtatatttgaaactg

SEQ ID NO: 1705151 - DNA, 18 bp, Homo sapiens
gacagtatcccacatcca

SEQ ID NO: 1705152 - DNA, 21 bp, Homo sapiens
gacagtatcccacatccaact

SEQ ID NO: 1705153 - DNA, 19 bp, Homo sapiens
gacagtatcgtttgtttat

SEQ ID NO: 1705154 - DNA, 13 bp, Homo sapiens
gacagtcctggga

SEQ ID NO: 1705155 - DNA, 15 bp, Homo sapiens
gacagtcctgggaga

SEQ ID NO: 1705156 - DNA, 15 bp, Homo sapiens
gacagtcctttccca

SEQ ID NO: 1705157 - DNA, 23 bp, Homo sapiens
gacagtcctttcccaccattcct

SEQ ID NO: 1705158 - DNA, 15 bp, Homo sapiens
gacagtctggagaag

SEQ ID NO: 1705159 - DNA, 15 bp, Homo sapiens
gacagtctgttatgc

SEQ ID NO: 1705160 - DNA, 21 bp, Homo sapiens
gacagtgccatccccaccttc

SEQ ID NO: 1705161 - DNA, 10 bp, Homo sapiens
gacagtgccc

SEQ ID NO: 1705162 - DNA, 16 bp, Homo sapiens
gacagtgcccatgcaa

SEQ ID NO: 1705163 - DNA, 18 bp, Homo sapiens
gacagtgccccgggaacc

SEQ ID NO: 1705164 - DNA, 14 bp, Homo sapiens
gacagtgccctgag

SEQ ID NO: 1705165 - DNA, 13 bp, Homo sapiens
gacagtgcctctt

SEQ ID NO: 1705166 - DNA, 21 bp, Homo sapiens
gacagtgcctgggaatgtatt

SEQ ID NO: 1705167 - DNA, 15 bp, Homo sapiens
gacagtggatatgac

SEQ ID NO: 1705168 - DNA, 20 bp, Homo sapiens
gacagtggatatgacccaca

SEQ ID NO: 1705169 - DNA, 23 bp, Homo sapiens
gacagtggatatgacccacactg

SEQ ID NO: 1705170 - DNA, 17 bp, Homo sapiens
gacagtggctgacaagg

SEQ ID NO: 1705171 - DNA, 23 bp, Homo sapiens
gacagtgggcaggaggccccagg

SEQ ID NO: 1705172 - DNA, 15 bp, Homo sapiens
gacagtgtgggcgct

SEQ ID NO: 1705173 - DNA, 13 bp, Homo sapiens
gacagttggcaga

SEQ ID NO: 1705174 - DNA, 21 bp, Homo sapiens
gacagtttaccagttgccttt

SEQ ID NO: 1705175 - DNA, 14 bp, Homo sapiens
gacagtttccaaat

SEQ ID NO: 1705176 - DNA, 22 bp, Homo sapiens
gacatacagctgcctacctaat

SEQ ID NO: 1705177 - DNA, 12 bp, Homo sapiens
gacatacgaaac

SEQ ID NO: 1705178 - DNA, 17 bp, Homo sapiens
gacatacgaaacacaaa

SEQ ID NO: 1705179 - DNA, 17 bp, Homo sapiens
gacatacttgaagggcc

SEQ ID NO: 1705180 - DNA, 19 bp, Homo sapiens
gacatacttgaagggccag

SEQ ID NO: 1705181 - DNA, 23 bp, Homo sapiens
gacataggccatgaaaaaaatga

SEQ ID NO: 1705182 - DNA, 16 bp, Homo sapiens
gacatcaaagcctggc

SEQ ID NO: 1705183 - DNA, 14 bp, Homo sapiens
gacatcaatgaaac

SEQ ID NO: 1705184 - DNA, 15 bp, Homo sapiens
gacatcacagggtgg

SEQ ID NO: 1705185 - DNA, 19 bp, Homo sapiens
gacatcacagggtgggcct

SEQ ID NO: 1705186 - DNA, 16 bp, Homo sapiens
gacatcacttgtacaa

SEQ ID NO: 1705187 - DNA, 22 bp, Homo sapiens
gacatcacttgtacaaaataaa

SEQ ID NO: 1705188 - DNA, 14 bp, Homo sapiens
gacatcagcctgct

SEQ ID NO: 1705189 - DNA, 16 bp, Homo sapiens
gacatcaggagactgg

SEQ ID NO: 1705190 - DNA, 20 bp, Homo sapiens
gacatcatcattcttgtggg

SEQ ID NO: 1705191 - DNA, 13 bp, Homo sapiens
gacatccagcaga

SEQ ID NO: 1705192 - DNA, 17 bp, Homo sapiens
gacatcccttcctggaa

SEQ ID NO: 1705193 - DNA, 22 bp, Homo sapiens
gacatcccttcctggaaacagc

SEQ ID NO: 1705194 - DNA, 22 bp, Homo sapiens
gacatccgtcattgctgctgct

SEQ ID NO: 1705195 - DNA, 22 bp, Homo sapiens
gacatcctagaggtagagaaac

SEQ ID NO: 1705196 - DNA, 15 bp, Homo sapiens
gacatcctcctccca

SEQ ID NO: 1705197 - DNA, 22 bp, Homo sapiens
gacatcgtaggcagccacggcc

SEQ ID NO: 1705198 - DNA, 13 bp, Homo sapiens
gacatctctgcac

SEQ ID NO: 1705199 - DNA, 14 bp, Homo sapiens
gacatctggaatct

SEQ ID NO: 1705200 - DNA, 20 bp, Homo sapiens
gacatctggaatctggagac

SEQ ID NO: 1705201 - DNA, 22 bp, Homo sapiens
gacatctggaatctggagacca

SEQ ID NO: 1705202 - DNA, 12 bp, Homo sapiens
gacatcttaaat

SEQ ID NO: 1705203 - DNA, 13 bp, Homo sapiens
gacatgaaggaaa

SEQ ID NO: 1705204 - DNA, 21 bp, Homo sapiens
gacatgatggagcgcacctgc

SEQ ID NO: 1705205 - DNA, 15 bp, Homo sapiens
gacatgcaataaaat

SEQ ID NO: 1705206 - DNA, 17 bp, Homo sapiens
gacatgcaataaaattt

SEQ ID NO: 1705207 - DNA, 20 bp, Homo sapiens
gacatgcaataaaatttaaa

SEQ ID NO: 1705208 - DNA, 13 bp, Homo sapiens
gacatgcactgac

SEQ ID NO: 1705209 - DNA, 16 bp, Homo sapiens
gacatgcttttctgcc

SEQ ID NO: 1705210 - DNA, 21 bp, Homo sapiens
gacatgcttttctgccactcc

SEQ ID NO: 1705211 - DNA, 22 bp, Homo sapiens
gacatgcttttctgccactcca

SEQ ID NO: 1705212 - DNA, 15 bp, Homo sapiens
gacatggaaatgaag

SEQ ID NO: 1705213 - DNA, 21 bp, Homo sapiens
gacatggacccactacccttc

SEQ ID NO: 1705214 - DNA, 17 bp, Homo sapiens
gacatggagactcctgc

SEQ ID NO: 1705215 - DNA, 20 bp, Homo sapiens
gacatggagactcctgccct

SEQ ID NO: 1705216 - DNA, 20 bp, Homo sapiens
gacatggaggttctaaggcc

SEQ ID NO: 1705217 - DNA, 21 bp, Homo sapiens
gacatggaggttctaaggcct

SEQ ID NO: 1705218 - DNA, 13 bp, Homo sapiens
agtaactgtgact

SEQ ID NO: 1705219 - DNA, 14 bp, Homo sapiens
agtaacttggcttt

SEQ ID NO: 1705220 - DNA, 15 bp, Homo sapiens
agtaacttggctttc

SEQ ID NO: 1705221 - DNA, 18 bp, Homo sapiens
agtaacttggctttcatt

SEQ ID NO: 1705222 - DNA, 14 bp, Homo sapiens
agtaactttatgtg

SEQ ID NO: 1705223 - DNA, 16 bp, Homo sapiens
agtaactttatgtgta

SEQ ID NO: 1705224 - DNA, 17 bp, Homo sapiens
agtaactttatgtgtaa

SEQ ID NO: 1705225 - DNA, 22 bp, Homo sapiens
agtaacttttttgtgtatgtac

SEQ ID NO: 1705226 - DNA, 12 bp, Homo sapiens
agtaagaagagg

SEQ ID NO: 1705227 - DNA, 21 bp, Homo sapiens
agtaagaagaggagcctcaga

SEQ ID NO: 1705228 - DNA, 19 bp, Homo sapiens
agtaagagctaagttctaa

SEQ ID NO: 1705229 - DNA, 14 bp, Homo sapiens
agtaagaggtgtta

SEQ ID NO: 1705230 - DNA, 20 bp, Homo sapiens
agtaagctgctctattgtag

SEQ ID NO: 1705231 - DNA, 17 bp, Homo sapiens
agtaagtaccactcagg

SEQ ID NO: 1705232 - DNA, 23 bp, Homo sapiens
agtaagtgtgtcttcctagaatt

SEQ ID NO: 1705233 - DNA, 17 bp, Homo sapiens
agtaataaactgtgttt

SEQ ID NO: 1705234 - DNA, 20 bp, Homo sapiens
agtaatacattccattgttt

SEQ ID NO: 1705235 - DNA, 20 bp, Homo sapiens
agtaatataatacacaaaat

SEQ ID NO: 1705236 - DNA, 16 bp, Homo sapiens
agtaatatatttaaag

SEQ ID NO: 1705237 - DNA, 17 bp, Homo sapiens
agtaatatatttaaagg

SEQ ID NO: 1705238 - DNA, 21 bp, Homo sapiens
agtaatatatttaaagggaaa

SEQ ID NO: 1705239 - DNA, 18 bp, Homo sapiens
agtaatatttatatattt

SEQ ID NO: 1705240 - DNA, 19 bp, Homo sapiens
agtaatattttactttgag

SEQ ID NO: 1705241 - DNA, 15 bp, Homo sapiens
agtaatcaatacaga

SEQ ID NO: 1705242 - DNA, 15 bp, Homo sapiens
agtaatcatactcaa

SEQ ID NO: 1705243 - DNA, 22 bp, Homo sapiens
agtaatcatctaagtcagtacc

SEQ ID NO: 1705244 - DNA, 17 bp, Homo sapiens
agtaatcccagaacaat

SEQ ID NO: 1705245 - DNA, 15 bp, Homo sapiens
agtaatcccatttcc

SEQ ID NO: 1705246 - DNA, 16 bp, Homo sapiens
agtaatcccatttccc

SEQ ID NO: 1705247 - DNA, 16 bp, Homo sapiens
agtaatgacttagaaa

SEQ ID NO: 1705248 - DNA, 13 bp, Homo sapiens
agtaatgatttct

SEQ ID NO: 1705249 - DNA, 15 bp, Homo sapiens
agtaatgatttcttg

SEQ ID NO: 1705250 - DNA, 20 bp, Homo sapiens
agtaatgcagtttttaaaaa

SEQ ID NO: 1705251 - DNA, 22 bp, Homo sapiens
agtaatggtgtagaacactaat

SEQ ID NO: 1705252 - DNA, 12 bp, Homo sapiens
agtaatgtatta

SEQ ID NO: 1705253 - DNA, 20 bp, Homo sapiens
agtaattatcgggaacagtg

SEQ ID NO: 1705254 - DNA, 19 bp, Homo sapiens
agtaattcaagaaaacaac

SEQ ID NO: 1705255 - DNA, 19 bp, Homo sapiens
agtaatttattgtctgtct

SEQ ID NO: 1705256 - DNA, 22 bp, Homo sapiens
agtaatttcatttaaatatctg

SEQ ID NO: 1705257 - DNA, 21 bp, Homo sapiens
agtaatttctttttttccttt

SEQ ID NO: 1705258 - DNA, 18 bp, Homo sapiens
agtacaaatgaagaaagt

SEQ ID NO: 1705259 - DNA, 18 bp, Homo sapiens
agtacaataatgtactca

SEQ ID NO: 1705260 - DNA, 18 bp, Homo sapiens
agtacaatgaactgcttt

SEQ ID NO: 1705261 - DNA, 16 bp, Homo sapiens
agtacaattcattgtt

SEQ ID NO: 1705262 - DNA, 18 bp, Homo sapiens
agtacacaccagaagatg

SEQ ID NO: 1705263 - DNA, 15 bp, Homo sapiens
agtacagaattggat

SEQ ID NO: 1705264 - DNA, 12 bp, Homo sapiens
agtacagaattt

SEQ ID NO: 1705265 - DNA, 15 bp, Homo sapiens
agtacagatactgtg

SEQ ID NO: 1705266 - DNA, 17 bp, Homo sapiens
agtacagatactgtgag

SEQ ID NO: 1705267 - DNA, 21 bp, Homo sapiens
agtacagtattcttttaaaat

SEQ ID NO: 1705268 - DNA, 18 bp, Homo sapiens
agtacattctaaagagag

SEQ ID NO: 1705269 - DNA, 20 bp, Homo sapiens
agtacattgtaaaataaagt

SEQ ID NO: 1705270 - DNA, 16 bp, Homo sapiens
agtacatttaaatttt

SEQ ID NO: 1705271 - DNA, 19 bp, Homo sapiens
agtacatttaaattttttg

SEQ ID NO: 1705272 - DNA, 12 bp, Homo sapiens
agtacatttaat

SEQ ID NO: 1705273 - DNA, 19 bp, Homo sapiens
agtacatttggagacacaa

SEQ ID NO: 1705274 - DNA, 13 bp, Homo sapiens
agtacattttttg

SEQ ID NO: 1705275 - DNA, 16 bp, Homo sapiens
agtaccaatgctgttg

SEQ ID NO: 1705276 - DNA, 15 bp, Homo sapiens
agtaccactcaggcc

SEQ ID NO: 1705277 - DNA, 21 bp, Homo sapiens
agtaccagtgagtggccccac

SEQ ID NO: 1705278 - DNA, 22 bp, Homo sapiens
agtacccaccaccttcttctcc

SEQ ID NO: 1705279 - DNA, 13 bp, Homo sapiens
agtacctccaagc

SEQ ID NO: 1705280 - DNA, 17 bp, Homo sapiens
agtacctcgtttctaca

SEQ ID NO: 1705281 - DNA, 15 bp, Homo sapiens
agtacctgaaaagta

SEQ ID NO: 1705282 - DNA, 17 bp, Homo sapiens
agtacctgattgtattt

SEQ ID NO: 1705283 - DNA, 17 bp, Homo sapiens
agtacctgcaaaaatga

SEQ ID NO: 1705284 - DNA, 13 bp, Homo sapiens
agtacctgctgcc

SEQ ID NO: 1705285 - DNA, 17 bp, Homo sapiens
agtacctgctgccccag

SEQ ID NO: 1705286 - DNA, 18 bp, Homo sapiens
agtacctgtagtgagaaa

SEQ ID NO: 1705287 - DNA, 14 bp, Homo sapiens
agtacctttgtcac

SEQ ID NO: 1705288 - DNA, 21 bp, Homo sapiens
agtacgagccccacagagcag

SEQ ID NO: 1705289 - DNA, 20 bp, Homo sapiens
agtacgatcaagttgttgac

SEQ ID NO: 1705290 - DNA, 18 bp, Homo sapiens
agtacgtcccgctgctgt

SEQ ID NO: 1705291 - DNA, 18 bp, Homo sapiens
agtacgtgctaacaggct

SEQ ID NO: 1705292 - DNA, 13 bp, Homo sapiens
agtactcaatgtt

SEQ ID NO: 1705293 - DNA, 22 bp, Homo sapiens
agtactcaatgtttctggacat

SEQ ID NO: 1705294 - DNA, 17 bp, Homo sapiens
agtactcactttttcca

SEQ ID NO: 1705295 - DNA, 19 bp, Homo sapiens
agtactcctgcaaaatttt

SEQ ID NO: 1705296 - DNA, 20 bp, Homo sapiens
agtactcctgcaaaatttta

SEQ ID NO: 1705297 - DNA, 13 bp, Homo sapiens
agtactctctgct

SEQ ID NO: 1705298 - DNA, 16 bp, Homo sapiens
agtactctctgctcta

SEQ ID NO: 1705299 - DNA, 15 bp, Homo sapiens
agtactctttaacat

SEQ ID NO: 1705300 - DNA, 19 bp, Homo sapiens
agtactgcattttttactt

SEQ ID NO: 1705301 - DNA, 23 bp, Homo sapiens
agtacttagctagttttattctt

SEQ ID NO: 1705302 - DNA, 23 bp, Homo sapiens
agtacttggtttttttttttctt

SEQ ID NO: 1705303 - DNA, 24 bp, Homo sapiens
agtacttgtgaaacacagctgttc

SEQ ID NO: 1705304 - DNA, 21 bp, Homo sapiens
agtactttaaaaaggaaattt

SEQ ID NO: 1705305 - DNA, 19 bp, Homo sapiens
agtactttagactaattgt

SEQ ID NO: 1705306 - DNA, 17 bp, Homo sapiens
agtagaagcatgtttgt

SEQ ID NO: 1705307 - DNA, 17 bp, Homo sapiens
agtagaagtcttagatg

SEQ ID NO: 1705308 - DNA, 20 bp, Homo sapiens
agtagaagtcttagatgtat

SEQ ID NO: 1705309 - DNA, 13 bp, Homo sapiens
agtagaatgtagt

SEQ ID NO: 1705310 - DNA, 21 bp, Homo sapiens
agtagaccttgttacttctga

SEQ ID NO: 1705311 - DNA, 23 bp, Homo sapiens
agtagaccttgttacttctgagg

SEQ ID NO: 1705312 - DNA, 15 bp, Homo sapiens
agtagactactgttc

SEQ ID NO: 1705313 - DNA, 22 bp, Homo sapiens
agtagagagggaacatcctaag

SEQ ID NO: 1705314 - DNA, 12 bp, Homo sapiens
agtagagccagc

SEQ ID NO: 1705315 - DNA, 13 bp, Homo sapiens
agtagagccagct

SEQ ID NO: 1705316 - DNA, 15 bp, Homo sapiens
agtagagccagcttg

SEQ ID NO: 1705317 - DNA, 17 bp, Homo sapiens
agtagaggtataattgt

SEQ ID NO: 1705318 - DNA, 14 bp, Homo sapiens
agtagagtcatctc

SEQ ID NO: 1705319 - DNA, 16 bp, Homo sapiens
agtagagtcatctcca

SEQ ID NO: 1705320 - DNA, 23 bp, Homo sapiens
agtagagtcatctccatcagctg

SEQ ID NO: 1705321 - DNA, 16 bp, Homo sapiens
agtagatcacctcctc

SEQ ID NO: 1705322 - DNA, 23 bp, Homo sapiens
agtagatccatttccattgctta

SEQ ID NO: 1705323 - DNA, 18 bp, Homo sapiens
agtagatttctggcatat

SEQ ID NO: 1705324 - DNA, 15 bp, Homo sapiens
agtagattttccaaa

SEQ ID NO: 1705325 - DNA, 16 bp, Homo sapiens
agtagcaactgctggt

SEQ ID NO: 1705326 - DNA, 14 bp, Homo sapiens
agtagcatgagaga

SEQ ID NO: 1705327 - DNA, 18 bp, Homo sapiens
agtagcctcttgtgtaac

SEQ ID NO: 1705328 - DNA, 15 bp, Homo sapiens
agtagctagtagcaa

SEQ ID NO: 1705329 - DNA, 11 bp, Homo sapiens
agtagctgcta

SEQ ID NO: 1705330 - DNA, 15 bp, Homo sapiens
agtagctttccacat

SEQ ID NO: 1705331 - DNA, 20 bp, Homo sapiens
agtagctttccacatttgtc

SEQ ID NO: 1705332 - DNA, 23 bp, Homo sapiens
agtaggaaagtcacccaaacact

SEQ ID NO: 1705333 - DNA, 22 bp, Homo sapiens
agtaggagacacgacagcacac

SEQ ID NO: 1705334 - DNA, 19 bp, Homo sapiens
gacatggctccggcctctg

SEQ ID NO: 1705335 - DNA, 22 bp, Homo sapiens
gacatgggtattttataatgtt

SEQ ID NO: 1705336 - DNA, 13 bp, Homo sapiens
gacatgggtgggg

SEQ ID NO: 1705337 - DNA, 21 bp, Homo sapiens
gacatggtgcctgagaggcag

SEQ ID NO: 1705338 - DNA, 14 bp, Homo sapiens
gacatgtaagaaaa

SEQ ID NO: 1705339 - DNA, 18 bp, Homo sapiens
gacatgtgaggaggaaaa

SEQ ID NO: 1705340 - DNA, 14 bp, Homo sapiens
gacatgtgggtgga

SEQ ID NO: 1705341 - DNA, 21 bp, Homo sapiens
gacatgtgggtggagaaggga

SEQ ID NO: 1705342 - DNA, 14 bp, Homo sapiens
gacatgtggtggga

SEQ ID NO: 1705343 - DNA, 22 bp, Homo sapiens
gacatgtggtgggacagggacc

SEQ ID NO: 1705344 - DNA, 14 bp, Homo sapiens
gacatgtttcaaga

SEQ ID NO: 1705345 - DNA, 16 bp, Homo sapiens
gacattaaaagattat

SEQ ID NO: 1705346 - DNA, 19 bp, Homo sapiens
gacattcagactaaaaata

SEQ ID NO: 1705347 - DNA, 20 bp, Homo sapiens
gacattcagactaaaaatac

SEQ ID NO: 1705348 - DNA, 14 bp, Homo sapiens
gacattccaacaat

SEQ ID NO: 1705349 - DNA, 20 bp, Homo sapiens
gacattccttgtcaccagca

SEQ ID NO: 1705350 - DNA, 18 bp, Homo sapiens
gacattctctttgataac

SEQ ID NO: 1705351 - DNA, 22 bp, Homo sapiens
gacattctctttgataacaaaa

SEQ ID NO: 1705352 - DNA, 23 bp, Homo sapiens
gacattctctttgataacaaaaa

SEQ ID NO: 1705353 - DNA, 23 bp, Homo sapiens
gacattcttagctgtaacttaac

SEQ ID NO: 1705354 - DNA, 16 bp, Homo sapiens
gacattgaaactacac

SEQ ID NO: 1705355 - DNA, 20 bp, Homo sapiens
gacattgtatgcagggagca

SEQ ID NO: 1705356 - DNA, 21 bp, Homo sapiens
gacattgtctcctatatattt

SEQ ID NO: 1705357 - DNA, 18 bp, Homo sapiens
gacattgttaaaataaag

SEQ ID NO: 1705358 - DNA, 13 bp, Homo sapiens
gacatttaaatgt

SEQ ID NO: 1705359 - DNA, 15 bp, Homo sapiens
gacatttaaatgtaa

SEQ ID NO: 1705360 - DNA, 11 bp, Homo sapiens
gacatttccca

SEQ ID NO: 1705361 - DNA, 17 bp, Homo sapiens
gacatttctaattcctg

SEQ ID NO: 1705362 - DNA, 14 bp, Homo sapiens
gacatttcttcccc

SEQ ID NO: 1705363 - DNA, 14 bp, Homo sapiens
gacatttggtggta

SEQ ID NO: 1705364 - DNA, 13 bp, Homo sapiens
gacatttgtatat

SEQ ID NO: 1705365 - DNA, 15 bp, Homo sapiens
gacattttcttcaga

SEQ ID NO: 1705366 - DNA, 14 bp, Homo sapiens
gacattttcttttt

SEQ ID NO: 1705367 - DNA, 17 bp, Homo sapiens
gaccaaagactgcagaa

SEQ ID NO: 1705368 - DNA, 20 bp, Homo sapiens
gaccaaagactgcagaaccc

SEQ ID NO: 1705369 - DNA, 20 bp, Homo sapiens
gaccaaagcaaagaaaataa

SEQ ID NO: 1705370 - DNA, 20 bp, Homo sapiens
gaccaaagggaagtgaggcc

SEQ ID NO: 1705371 - DNA, 17 bp, Homo sapiens
gaccaaagtttgcaact

SEQ ID NO: 1705372 - DNA, 18 bp, Homo sapiens
gaccaaatctcagttgtt

SEQ ID NO: 1705373 - DNA, 23 bp, Homo sapiens
gaccaaattccttggcatgcctt

SEQ ID NO: 1705374 - DNA, 17 bp, Homo sapiens
gaccaaattgctttaca

SEQ ID NO: 1705375 - DNA, 22 bp, Homo sapiens
gaccaacatggagaaaccctgt

SEQ ID NO: 1705376 - DNA, 18 bp, Homo sapiens
gaccaactggcttctgtg

SEQ ID NO: 1705377 - DNA, 19 bp, Homo sapiens
gaccaactggcttctgtgc

SEQ ID NO: 1705378 - DNA, 22 bp, Homo sapiens
gaccaactggcttctgtgcact

SEQ ID NO: 1705379 - DNA, 19 bp, Homo sapiens
gaccaactgggcccaagac

SEQ ID NO: 1705380 - DNA, 15 bp, Homo sapiens
gaccaagaactgcat

SEQ ID NO: 1705381 - DNA, 21 bp, Homo sapiens
gaccaagttataaatcaatgt

SEQ ID NO: 1705382 - DNA, 16 bp, Homo sapiens
gaccaatacatttgta

SEQ ID NO: 1705383 - DNA, 18 bp, Homo sapiens
gaccaatacatttgtatt

SEQ ID NO: 1705384 - DNA, 19 bp, Homo sapiens
gaccaatacatttgtattt

SEQ ID NO: 1705385 - DNA, 19 bp, Homo sapiens
gaccacaccaaccaggcct

SEQ ID NO: 1705386 - DNA, 15 bp, Homo sapiens
gaccacaccagcctc

SEQ ID NO: 1705387 - DNA, 20 bp, Homo sapiens
gaccacaccagcctcctggg

SEQ ID NO: 1705388 - DNA, 22 bp, Homo sapiens
gaccacactgcacacagtgact

SEQ ID NO: 1705389 - DNA, 20 bp, Homo sapiens
gaccacagcccgctctctgg

SEQ ID NO: 1705390 - DNA, 15 bp, Homo sapiens
gaccacagctgctgg

SEQ ID NO: 1705391 - DNA, 17 bp, Homo sapiens
gaccacataagaaggca

SEQ ID NO: 1705392 - DNA, 14 bp, Homo sapiens
gaccaccagcaggc

SEQ ID NO: 1705393 - DNA, 13 bp, Homo sapiens
gaccaccagcccc

SEQ ID NO: 1705394 - DNA, 14 bp, Homo sapiens
gaccaccagcccca

SEQ ID NO: 1705395 - DNA, 16 bp, Homo sapiens
gaccaccagccccagc

SEQ ID NO: 1705396 - DNA, 16 bp, Homo sapiens
gaccaccctcccctct

SEQ ID NO: 1705397 - DNA, 16 bp, Homo sapiens
gaccacctgcttctga

SEQ ID NO: 1705398 - DNA, 17 bp, Homo sapiens
gaccacctgcttctgaa

SEQ ID NO: 1705399 - DNA, 16 bp, Homo sapiens
gaccacctttcacaaa

SEQ ID NO: 1705400 - DNA, 14 bp, Homo sapiens
gaccacgctttcta

SEQ ID NO: 1705401 - DNA, 23 bp, Homo sapiens
gaccactcctgtccctgtagctc

SEQ ID NO: 1705402 - DNA, 17 bp, Homo sapiens
gaccactgaattcactc

SEQ ID NO: 1705403 - DNA, 20 bp, Homo sapiens
gaccactgaattcactccag

SEQ ID NO: 1705404 - DNA, 15 bp, Homo sapiens
gaccacttccagggg

SEQ ID NO: 1705405 - DNA, 15 bp, Homo sapiens
gaccacttgaggcct

SEQ ID NO: 1705406 - DNA, 16 bp, Homo sapiens
gaccagaagccaaaga

SEQ ID NO: 1705407 - DNA, 22 bp, Homo sapiens
gaccagaatgaaaactgtaaat

SEQ ID NO: 1705408 - DNA, 12 bp, Homo sapiens
gaccagaattcc

SEQ ID NO: 1705409 - DNA, 14 bp, Homo sapiens
gaccagagccagat

SEQ ID NO: 1705410 - DNA, 15 bp, Homo sapiens
gaccagagctgtctg

SEQ ID NO: 1705411 - DNA, 17 bp, Homo sapiens
gaccagaggaagcccct

SEQ ID NO: 1705412 - DNA, 18 bp, Homo sapiens
gaccagaggagccttttt

SEQ ID NO: 1705413 - DNA, 16 bp, Homo sapiens
gaccagatctttctct

SEQ ID NO: 1705414 - DNA, 17 bp, Homo sapiens
gaccagatctttctctt

SEQ ID NO: 1705415 - DNA, 13 bp, Homo sapiens
gaccagcactcag

SEQ ID NO: 1705416 - DNA, 18 bp, Homo sapiens
gaccagcagacagagcca

SEQ ID NO: 1705417 - DNA, 20 bp, Homo sapiens
gaccagcagacagagccagg

SEQ ID NO: 1705418 - DNA, 16 bp, Homo sapiens
gaccagcagatcccag

SEQ ID NO: 1705419 - DNA, 17 bp, Homo sapiens
gaccagcagatcccagc

SEQ ID NO: 1705420 - DNA, 18 bp, Homo sapiens
gaccagcagatcccagct

SEQ ID NO: 1705421 - DNA, 12 bp, Homo sapiens
gaccagccagca

SEQ ID NO: 1705422 - DNA, 18 bp, Homo sapiens
gaccagccagcagcagcc

SEQ ID NO: 1705423 - DNA, 11 bp, Homo sapiens
gaccagcctgg

SEQ ID NO: 1705424 - DNA, 12 bp, Homo sapiens
gaccagcctggg

SEQ ID NO: 1705425 - DNA, 17 bp, Homo sapiens
gaccagcctgggcagca

SEQ ID NO: 1705426 - DNA, 14 bp, Homo sapiens
gaccagcggctgct

SEQ ID NO: 1705427 - DNA, 16 bp, Homo sapiens
gaccagcggctgctca

SEQ ID NO: 1705428 - DNA, 14 bp, Homo sapiens
gaccagctcaggac

SEQ ID NO: 1705429 - DNA, 22 bp, Homo sapiens
gaccagctcaggacagatgcca

SEQ ID NO: 1705430 - DNA, 14 bp, Homo sapiens
gaccagctctcttc

SEQ ID NO: 1705431 - DNA, 13 bp, Homo sapiens
gaccagctgctcc

SEQ ID NO: 1705432 - DNA, 23 bp, Homo sapiens
gaccagctgctccgaggacccag

SEQ ID NO: 1705433 - DNA, 18 bp, Homo sapiens
gaccaggctgcagcctcc

SEQ ID NO: 1705434 - DNA, 12 bp, Homo sapiens
gaccaggctgga

SEQ ID NO: 1705435 - DNA, 14 bp, Homo sapiens
gaccaggctgggca

SEQ ID NO: 1705436 - DNA, 13 bp, Homo sapiens
gaccagggatgct

SEQ ID NO: 1705437 - DNA, 21 bp, Homo sapiens
gaccagggccaccgcagggga

SEQ ID NO: 1705438 - DNA, 11 bp, Homo sapiens
gaccagggcct

SEQ ID NO: 1705439 - DNA, 19 bp, Homo sapiens
gaccagggccttttctggc

SEQ ID NO: 1705440 - DNA, 21 bp, Homo sapiens
gaccagggctccagcccctct

SEQ ID NO: 1705441 - DNA, 13 bp, Homo sapiens
gaccaggggagag

SEQ ID NO: 1705442 - DNA, 16 bp, Homo sapiens
gaccaggtcctgctcc

SEQ ID NO: 1705443 - DNA, 14 bp, Homo sapiens
gaccagtcccacac

SEQ ID NO: 1705444 - DNA, 21 bp, Homo sapiens
gaccagtggctggtctcaccc

SEQ ID NO: 1705445 - DNA, 15 bp, Homo sapiens
gaccagttgggagca

SEQ ID NO: 1705446 - DNA, 20 bp, Homo sapiens
gaccagttgggagcactgga

SEQ ID NO: 1705447 - DNA, 15 bp, Homo sapiens
gaccataatgttaca

SEQ ID NO: 1705448 - DNA, 18 bp, Homo sapiens
gaccatattacctggatt

SEQ ID NO: 1705449 - DNA, 18 bp, Homo sapiens
gaccatcaagaacctaca

SEQ ID NO: 1705450 - DNA, 23 bp, Homo sapiens
gaccatcatttcacctgctgctt

SEQ ID NO: 1705451 - DNA, 15 bp, Homo sapiens
agtaggagcactggg

SEQ ID NO: 1705452 - DNA, 18 bp, Homo sapiens
agtaggcatatatcacta

SEQ ID NO: 1705453 - DNA, 13 bp, Homo sapiens
agtaggcatgtta

SEQ ID NO: 1705454 - DNA, 18 bp, Homo sapiens
agtaggggaagacatgca

SEQ ID NO: 1705455 - DNA, 13 bp, Homo sapiens
agtaggtccaagg

SEQ ID NO: 1705456 - DNA, 21 bp, Homo sapiens
agtaggtcccggccagctctg

SEQ ID NO: 1705457 - DNA, 16 bp, Homo sapiens
agtaggtggcttgagc

SEQ ID NO: 1705458 - DNA, 18 bp, Homo sapiens
agtagtaaatcagaaagt

SEQ ID NO: 1705459 - DNA, 16 bp, Homo sapiens
agtagtaatagagcaa

SEQ ID NO: 1705460 - DNA, 20 bp, Homo sapiens
agtagtcagaagcaggttct

SEQ ID NO: 1705461 - DNA, 12 bp, Homo sapiens
agtagtcctgtg

SEQ ID NO: 1705462 - DNA, 15 bp, Homo sapiens
agtagttggtttgta

SEQ ID NO: 1705463 - DNA, 22 bp, Homo sapiens
agtagttggtttgtatgagatg

SEQ ID NO: 1705464 - DNA, 14 bp, Homo sapiens
agtagtttgcattt

SEQ ID NO: 1705465 - DNA, 20 bp, Homo sapiens
agtagtttgcatttcagaaa

SEQ ID NO: 1705466 - DNA, 14 bp, Homo sapiens
agtagttttcaaaa

SEQ ID NO: 1705467 - DNA, 13 bp, Homo sapiens
agtagtttttcag

SEQ ID NO: 1705468 - DNA, 21 bp, Homo sapiens
agtataaccatatgatactat

SEQ ID NO: 1705469 - DNA, 19 bp, Homo sapiens
agtataagactactgaatc

SEQ ID NO: 1705470 - DNA, 12 bp, Homo sapiens
agtatacattgt

SEQ ID NO: 1705471 - DNA, 21 bp, Homo sapiens
agtatacgtataaatatcagt

SEQ ID NO: 1705472 - DNA, 18 bp, Homo sapiens
agtatagaagtctggaaa

SEQ ID NO: 1705473 - DNA, 22 bp, Homo sapiens
agtatatctggacaagccaact

SEQ ID NO: 1705474 - DNA, 12 bp, Homo sapiens
agtatatgtgag

SEQ ID NO: 1705475 - DNA, 21 bp, Homo sapiens
agtatatgtgcagtcttgctt

SEQ ID NO: 1705476 - DNA, 21 bp, Homo sapiens
agtatattgataaccttgaaa

SEQ ID NO: 1705477 - DNA, 11 bp, Homo sapiens
agtatatttat

SEQ ID NO: 1705478 - DNA, 15 bp, Homo sapiens
agtatatttatactc

SEQ ID NO: 1705479 - DNA, 14 bp, Homo sapiens
agtatatttatagt

SEQ ID NO: 1705480 - DNA, 18 bp, Homo sapiens
agtatattttcttttcct

SEQ ID NO: 1705481 - DNA, 13 bp, Homo sapiens
agtatcagcacta

SEQ ID NO: 1705482 - DNA, 12 bp, Homo sapiens
agtatcccacat

SEQ ID NO: 1705483 - DNA, 15 bp, Homo sapiens
agtatccttccttca

SEQ ID NO: 1705484 - DNA, 17 bp, Homo sapiens
agtatctaacaaaacca

SEQ ID NO: 1705485 - DNA, 19 bp, Homo sapiens
agtatctatatatgtgtat

SEQ ID NO: 1705486 - DNA, 23 bp, Homo sapiens
agtatctatatatgtgtatgtac

SEQ ID NO: 1705487 - DNA, 12 bp, Homo sapiens
agtatctgtata

SEQ ID NO: 1705488 - DNA, 17 bp, Homo sapiens
agtatcttgtgcttctt

SEQ ID NO: 1705489 - DNA, 14 bp, Homo sapiens
agtatgaaattata

SEQ ID NO: 1705490 - DNA, 13 bp, Homo sapiens
agtatgaatatta

SEQ ID NO: 1705491 - DNA, 18 bp, Homo sapiens
agtatgagtcttctgtaa

SEQ ID NO: 1705492 - DNA, 15 bp, Homo sapiens
agtatgatgaaaata

SEQ ID NO: 1705493 - DNA, 21 bp, Homo sapiens
agtatgatgaaaataattttc

SEQ ID NO: 1705494 - DNA, 19 bp, Homo sapiens
agtatgcagttgataagag

SEQ ID NO: 1705495 - DNA, 17 bp, Homo sapiens
agtatgccttaagcaga

SEQ ID NO: 1705496 - DNA, 13 bp, Homo sapiens
agtatgtattatt

SEQ ID NO: 1705497 - DNA, 13 bp, Homo sapiens
agtatgtctgttt

SEQ ID NO: 1705498 - DNA, 15 bp, Homo sapiens
agtatgtggaagtgt

SEQ ID NO: 1705499 - DNA, 19 bp, Homo sapiens
agtatgtggaagtgtgggt

SEQ ID NO: 1705500 - DNA, 16 bp, Homo sapiens
agtatgttaagctctt

SEQ ID NO: 1705501 - DNA, 19 bp, Homo sapiens
agtatgttaagctctttat

SEQ ID NO: 1705502 - DNA, 21 bp, Homo sapiens
agtatgttccaaaccctcctg

SEQ ID NO: 1705503 - DNA, 22 bp, Homo sapiens
agtatgttccaaaccctcctgg

SEQ ID NO: 1705504 - DNA, 15 bp, Homo sapiens
agtattaaaatctac

SEQ ID NO: 1705505 - DNA, 21 bp, Homo sapiens
agtattaatatctgaggatga

SEQ ID NO: 1705506 - DNA, 19 bp, Homo sapiens
agtattatagacaaaagaa

SEQ ID NO: 1705507 - DNA, 15 bp, Homo sapiens
agtattatcattgct

SEQ ID NO: 1705508 - DNA, 23 bp, Homo sapiens
agtattatgccccagttcagaaa

SEQ ID NO: 1705509 - DNA, 19 bp, Homo sapiens
agtattcaacaatttcaat

SEQ ID NO: 1705510 - DNA, 14 bp, Homo sapiens
agtattcattctgc

SEQ ID NO: 1705511 - DNA, 20 bp, Homo sapiens
agtattcctaacctgtcaga

SEQ ID NO: 1705512 - DNA, 11 bp, Homo sapiens
agtattctcat

SEQ ID NO: 1705513 - DNA, 15 bp, Homo sapiens
agtattcttttcaat

SEQ ID NO: 1705514 - DNA, 18 bp, Homo sapiens
agtattggggtctgaccc

SEQ ID NO: 1705515 - DNA, 12 bp, Homo sapiens
agtattgtttaa

SEQ ID NO: 1705516 - DNA, 16 bp, Homo sapiens
agtattgtttaaaatg

SEQ ID NO: 1705517 - DNA, 22 bp, Homo sapiens
agtattgtttaaaatgtaattt

SEQ ID NO: 1705518 - DNA, 14 bp, Homo sapiens
agtatttaagccta

SEQ ID NO: 1705519 - DNA, 18 bp, Homo sapiens
agtatttaagcctaaaga

SEQ ID NO: 1705520 - DNA, 21 bp, Homo sapiens
agtatttaagcctaaagattt

SEQ ID NO: 1705521 - DNA, 13 bp, Homo sapiens
agtatttactttt

SEQ ID NO: 1705522 - DNA, 15 bp, Homo sapiens
agtatttagaagcca

SEQ ID NO: 1705523 - DNA, 19 bp, Homo sapiens
agtatttagaagccaacta

SEQ ID NO: 1705524 - DNA, 16 bp, Homo sapiens
agtatttataatagca

SEQ ID NO: 1705525 - DNA, 14 bp, Homo sapiens
agtatttatatatt

SEQ ID NO: 1705526 - DNA, 16 bp, Homo sapiens
agtatttatatattta

SEQ ID NO: 1705527 - DNA, 20 bp, Homo sapiens
agtatttatatatttataac

SEQ ID NO: 1705528 - DNA, 20 bp, Homo sapiens
agtatttatttatgtacttt

SEQ ID NO: 1705529 - DNA, 20 bp, Homo sapiens
agtatttcagtgttttcatt

SEQ ID NO: 1705530 - DNA, 22 bp, Homo sapiens
agtatttcagtgttttcatttt

SEQ ID NO: 1705531 - DNA, 22 bp, Homo sapiens
agtatttccatagtcaatgatg

SEQ ID NO: 1705532 - DNA, 19 bp, Homo sapiens
agtatttcccttccaaaga

SEQ ID NO: 1705533 - DNA, 19 bp, Homo sapiens
agtatttctaaagtaattg

SEQ ID NO: 1705534 - DNA, 17 bp, Homo sapiens
agtatttgaacacagtt

SEQ ID NO: 1705535 - DNA, 23 bp, Homo sapiens
agtatttgatcagtaagtcacag

SEQ ID NO: 1705536 - DNA, 19 bp, Homo sapiens
agtatttggtccaaaaaaa

SEQ ID NO: 1705537 - DNA, 22 bp, Homo sapiens
agtatttggtccaaaaaaagga

SEQ ID NO: 1705538 - DNA, 16 bp, Homo sapiens
agtattttatctggaa

SEQ ID NO: 1705539 - DNA, 17 bp, Homo sapiens
agtattttgctggaata

SEQ ID NO: 1705540 - DNA, 19 bp, Homo sapiens
agtatttttgattaacaat

SEQ ID NO: 1705541 - DNA, 22 bp, Homo sapiens
agtatttttgattaacaatgta

SEQ ID NO: 1705542 - DNA, 12 bp, Homo sapiens
agtatttttgcc

SEQ ID NO: 1705543 - DNA, 13 bp, Homo sapiens
agtattttttgta

SEQ ID NO: 1705544 - DNA, 20 bp, Homo sapiens
agtattttttgtataattgg

SEQ ID NO: 1705545 - DNA, 13 bp, Homo sapiens
agtcaaaaaatta

SEQ ID NO: 1705546 - DNA, 15 bp, Homo sapiens
agtcaaaaattaaac

SEQ ID NO: 1705547 - DNA, 17 bp, Homo sapiens
agtcaaaaggtgcctgt

SEQ ID NO: 1705548 - DNA, 21 bp, Homo sapiens
agtcaaagtgttgctgtggct

SEQ ID NO: 1705549 - DNA, 20 bp, Homo sapiens
agtcaaagttgaaaattcat

SEQ ID NO: 1705550 - DNA, 15 bp, Homo sapiens
agtcaaatccagtgg

SEQ ID NO: 1705551 - DNA, 19 bp, Homo sapiens
agtcaaatccagtggtggg

SEQ ID NO: 1705552 - DNA, 17 bp, Homo sapiens
agtcaaatctgggctca

SEQ ID NO: 1705553 - DNA, 16 bp, Homo sapiens
agtcaacagattcaga

SEQ ID NO: 1705554 - DNA, 13 bp, Homo sapiens
agtcaacagtaaa

SEQ ID NO: 1705555 - DNA, 14 bp, Homo sapiens
agtcaacagtaaac

SEQ ID NO: 1705556 - DNA, 15 bp, Homo sapiens
agtcaacagtaaacc

SEQ ID NO: 1705557 - DNA, 20 bp, Homo sapiens
agtcaacagtaaaccactga

SEQ ID NO: 1705558 - DNA, 19 bp, Homo sapiens
agtcaacagttcaaagaag

SEQ ID NO: 1705559 - DNA, 21 bp, Homo sapiens
agtcaactacacaaagcaggc

SEQ ID NO: 1705560 - DNA, 13 bp, Homo sapiens
agtcaactgctgt

SEQ ID NO: 1705561 - DNA, 19 bp, Homo sapiens
agtcaagcacatgtaataa

SEQ ID NO: 1705562 - DNA, 14 bp, Homo sapiens
agtcaataagaaaa

SEQ ID NO: 1705563 - DNA, 12 bp, Homo sapiens
agtcaatacata

SEQ ID NO: 1705564 - DNA, 14 bp, Homo sapiens
agtcaataggccta

SEQ ID NO: 1705565 - DNA, 18 bp, Homo sapiens
agtcaatcccctcattca

SEQ ID NO: 1705566 - DNA, 17 bp, Homo sapiens
agtcacacagtgttgga

SEQ ID NO: 1705567 - DNA, 19 bp, Homo sapiens
agtcacactgctagcaaat

SEQ ID NO: 1705568 - DNA, 23 bp, Homo sapiens
gaccatccactctaccctcccac

SEQ ID NO: 1705569 - DNA, 20 bp, Homo sapiens
gaccatcctggccaacatga

SEQ ID NO: 1705570 - DNA, 18 bp, Homo sapiens
gaccatcgtccttcctct

SEQ ID NO: 1705571 - DNA, 12 bp, Homo sapiens
gaccatctgtga

SEQ ID NO: 1705572 - DNA, 16 bp, Homo sapiens
gaccatctgtgactat

SEQ ID NO: 1705573 - DNA, 21 bp, Homo sapiens
gaccatgaagtaaattatgta

SEQ ID NO: 1705574 - DNA, 18 bp, Homo sapiens
gaccatgcgtcaggggcc

SEQ ID NO: 1705575 - DNA, 23 bp, Homo sapiens
gaccatggccgaagccccttgga

SEQ ID NO: 1705576 - DNA, 13 bp, Homo sapiens
gaccatgttcatt

SEQ ID NO: 1705577 - DNA, 23 bp, Homo sapiens
gaccatgttcattataatctcaa

SEQ ID NO: 1705578 - DNA, 17 bp, Homo sapiens
gaccattctcaccctgt

SEQ ID NO: 1705579 - DNA, 18 bp, Homo sapiens
gaccattctcaccctgtg

SEQ ID NO: 1705580 - DNA, 14 bp, Homo sapiens
gaccattgacctca

SEQ ID NO: 1705581 - DNA, 15 bp, Homo sapiens
gaccatttcaggggt

SEQ ID NO: 1705582 - DNA, 20 bp, Homo sapiens
gaccattttttaatttactt

SEQ ID NO: 1705583 - DNA, 17 bp, Homo sapiens
gacccaacagcagtgat

SEQ ID NO: 1705584 - DNA, 19 bp, Homo sapiens
gacccaactgatcctgctc

SEQ ID NO: 1705585 - DNA, 19 bp, Homo sapiens
gacccaactgggggcaaag

SEQ ID NO: 1705586 - DNA, 22 bp, Homo sapiens
gacccaagtggggcctccttgt

SEQ ID NO: 1705587 - DNA, 14 bp, Homo sapiens
gacccacactgcca

SEQ ID NO: 1705588 - DNA, 23 bp, Homo sapiens
gacccacagactggttttgcaac

SEQ ID NO: 1705589 - DNA, 14 bp, Homo sapiens
gacccaccagtgcc

SEQ ID NO: 1705590 - DNA, 20 bp, Homo sapiens
gacccacccatcttcctgct

SEQ ID NO: 1705591 - DNA, 12 bp, Homo sapiens
gacccaccccaa

SEQ ID NO: 1705592 - DNA, 17 bp, Homo sapiens
gacccacccctgtgctc

SEQ ID NO: 1705593 - DNA, 15 bp, Homo sapiens
gacccacctccccct

SEQ ID NO: 1705594 - DNA, 13 bp, Homo sapiens
gacccactaaaga

SEQ ID NO: 1705595 - DNA, 15 bp, Homo sapiens
gacccactaaagagt

SEQ ID NO: 1705596 - DNA, 15 bp, Homo sapiens
gacccactacccttc

SEQ ID NO: 1705597 - DNA, 18 bp, Homo sapiens
agtcactggcagcctgca

SEQ ID NO: 1705598 - DNA, 23 bp, Homo sapiens
agtcactggtctgtttgcatttg

SEQ ID NO: 1705599 - DNA, 14 bp, Homo sapiens
agtcacttaactat

SEQ ID NO: 1705600 - DNA, 23 bp, Homo sapiens
agtcacttaactataaggtgcct

SEQ ID NO: 1705601 - DNA, 15 bp, Homo sapiens
agtcacttaatcttt

SEQ ID NO: 1705602 - DNA, 13 bp, Homo sapiens
agtcacttctcca

SEQ ID NO: 1705603 - DNA, 20 bp, Homo sapiens
agtcagaggagaagagacat

SEQ ID NO: 1705604 - DNA, 17 bp, Homo sapiens
agtcagatcctgttact

SEQ ID NO: 1705605 - DNA, 14 bp, Homo sapiens
agtcagatgaggca

SEQ ID NO: 1705606 - DNA, 14 bp, Homo sapiens
agtcagatgcccag

SEQ ID NO: 1705607 - DNA, 23 bp, Homo sapiens
agtcagatggaaaattcattttt

SEQ ID NO: 1705608 - DNA, 17 bp, Homo sapiens
agtcagccacactgggc

SEQ ID NO: 1705609 - DNA, 18 bp, Homo sapiens
agtcagccacactgggcc

SEQ ID NO: 1705610 - DNA, 21 bp, Homo sapiens
agtcagccccgacttcctgac

SEQ ID NO: 1705611 - DNA, 13 bp, Homo sapiens
agtcagctctctg

SEQ ID NO: 1705612 - DNA, 14 bp, Homo sapiens
agtcagctctctgc

SEQ ID NO: 1705613 - DNA, 17 bp, Homo sapiens
agtcagctctctgccct

SEQ ID NO: 1705614 - DNA, 22 bp, Homo sapiens
agtcagggacagcagcctccct

SEQ ID NO: 1705615 - DNA, 17 bp, Homo sapiens
agtcagggtgaattgtg

SEQ ID NO: 1705616 - DNA, 14 bp, Homo sapiens
agtcaggtccaatt

SEQ ID NO: 1705617 - DNA, 22 bp, Homo sapiens
agtcagtaggtccaagggccat

SEQ ID NO: 1705618 - DNA, 23 bp, Homo sapiens
agtcagtgcaaatgtcagataca

SEQ ID NO: 1705619 - DNA, 20 bp, Homo sapiens
agtcagtgcccaactgttat

SEQ ID NO: 1705620 - DNA, 22 bp, Homo sapiens
agtcagtgctctcagctggcag

SEQ ID NO: 1705621 - DNA, 15 bp, Homo sapiens
agtcagttcccggag

SEQ ID NO: 1705622 - DNA, 21 bp, Homo sapiens
agtcagttgctcaaaaagaaa

SEQ ID NO: 1705623 - DNA, 19 bp, Homo sapiens
agtcatctacttaataaat

SEQ ID NO: 1705624 - DNA, 17 bp, Homo sapiens
agtcatctcaaactctt

SEQ ID NO: 1705625 - DNA, 18 bp, Homo sapiens
agtcatctccatcagctg

SEQ ID NO: 1705626 - DNA, 11 bp, Homo sapiens
agtcatctccc

SEQ ID NO: 1705627 - DNA, 15 bp, Homo sapiens
agtcatctcccctcc

SEQ ID NO: 1705628 - DNA, 19 bp, Homo sapiens
agtcatctcccctcctggc

SEQ ID NO: 1705629 - DNA, 14 bp, Homo sapiens
agtcatctgtttaa

SEQ ID NO: 1705630 - DNA, 19 bp, Homo sapiens
agtcatgatctccctgccg

SEQ ID NO: 1705631 - DNA, 23 bp, Homo sapiens
agtcatgatctccctgccgcctc

SEQ ID NO: 1705632 - DNA, 22 bp, Homo sapiens
agtcatggagaatctgctgcat

SEQ ID NO: 1705633 - DNA, 23 bp, Homo sapiens
agtcattcagcagcaaattttca

SEQ ID NO: 1705634 - DNA, 12 bp, Homo sapiens
agtcattcttac

SEQ ID NO: 1705635 - DNA, 20 bp, Homo sapiens
agtcattgtaatgttgtgaa

SEQ ID NO: 1705636 - DNA, 13 bp, Homo sapiens
agtcatttaataa

SEQ ID NO: 1705637 - DNA, 12 bp, Homo sapiens
agtcatttttgt

SEQ ID NO: 1705638 - DNA, 13 bp, Homo sapiens
agtcatttttgta

SEQ ID NO: 1705639 - DNA, 13 bp, Homo sapiens
agtccaaaatact

SEQ ID NO: 1705640 - DNA, 20 bp, Homo sapiens
agtccaaatgtgatcaactg

SEQ ID NO: 1705641 - DNA, 11 bp, Homo sapiens
agtccaagcat

SEQ ID NO: 1705642 - DNA, 13 bp, Homo sapiens
agtccacaggggc

SEQ ID NO: 1705643 - DNA, 17 bp, Homo sapiens
agtccacaggggccacc

SEQ ID NO: 1705644 - DNA, 15 bp, Homo sapiens
agtccacctgaggaa

SEQ ID NO: 1705645 - DNA, 21 bp, Homo sapiens
agtccactgttgagccccagt

SEQ ID NO: 1705646 - DNA, 14 bp, Homo sapiens
agtccactttgttt

SEQ ID NO: 1705647 - DNA, 13 bp, Homo sapiens
agtccagagcttg

SEQ ID NO: 1705648 - DNA, 14 bp, Homo sapiens
agtccagccagctc

SEQ ID NO: 1705649 - DNA, 15 bp, Homo sapiens
agtccagccagctcc

SEQ ID NO: 1705650 - DNA, 17 bp, Homo sapiens
agtccaggactgggtct

SEQ ID NO: 1705651 - DNA, 23 bp, Homo sapiens
agtccaggactgggtctgacctg

SEQ ID NO: 1705652 - DNA, 17 bp, Homo sapiens
agtccaggctgccgtgg

SEQ ID NO: 1705653 - DNA, 18 bp, Homo sapiens
agtccaggctgccgtggg

SEQ ID NO: 1705654 - DNA, 15 bp, Homo sapiens
agtccatgctccagg

SEQ ID NO: 1705655 - DNA, 19 bp, Homo sapiens
agtccatgttattctctca

SEQ ID NO: 1705656 - DNA, 15 bp, Homo sapiens
agtccattctcccag

SEQ ID NO: 1705657 - DNA, 16 bp, Homo sapiens
agtccattctcccagg

SEQ ID NO: 1705658 - DNA, 18 bp, Homo sapiens
agtccatttcccacatct

SEQ ID NO: 1705659 - DNA, 17 bp, Homo sapiens
agtcccaaggaaagccc

SEQ ID NO: 1705660 - DNA, 13 bp, Homo sapiens
agtcccagagccc

SEQ ID NO: 1705661 - DNA, 22 bp, Homo sapiens
agtcccagctactcagaagcct

SEQ ID NO: 1705662 - DNA, 18 bp, Homo sapiens
agtcccagctactcagga

SEQ ID NO: 1705663 - DNA, 13 bp, Homo sapiens
agtcccaggggca

SEQ ID NO: 1705664 - DNA, 18 bp, Homo sapiens
agtcccaggggcagccac

SEQ ID NO: 1705665 - DNA, 20 bp, Homo sapiens
agtcccaggggcagccacac

SEQ ID NO: 1705666 - DNA, 21 bp, Homo sapiens
agtcccaggggcagccacacc

SEQ ID NO: 1705667 - DNA, 13 bp, Homo sapiens
agtcccattcata

SEQ ID NO: 1705668 - DNA, 15 bp, Homo sapiens
agtccccacccctgc

SEQ ID NO: 1705669 - DNA, 16 bp, Homo sapiens
agtccccacccctgcc

SEQ ID NO: 1705670 - DNA, 17 bp, Homo sapiens
agtccccacccctgccc

SEQ ID NO: 1705671 - DNA, 20 bp, Homo sapiens
agtccccacccctgccccca

SEQ ID NO: 1705672 - DNA, 14 bp, Homo sapiens
agtccccagccctt

SEQ ID NO: 1705673 - DNA, 18 bp, Homo sapiens
agtccccagcccttctgc

SEQ ID NO: 1705674 - DNA, 22 bp, Homo sapiens
agtccccgaggagctgggcccc

SEQ ID NO: 1705675 - DNA, 15 bp, Homo sapiens
agtccccgtgccccg

SEQ ID NO: 1705676 - DNA, 17 bp, Homo sapiens
agtcccctactccctct

SEQ ID NO: 1705677 - DNA, 17 bp, Homo sapiens
agtcccctccaggaaga

SEQ ID NO: 1705678 - DNA, 13 bp, Homo sapiens
agtcccctcccat

SEQ ID NO: 1705679 - DNA, 18 bp, Homo sapiens
agtcccctcccatctggg

SEQ ID NO: 1705680 - DNA, 21 bp, Homo sapiens
agtcccctcccatctgggagt

SEQ ID NO: 1705681 - DNA, 18 bp, Homo sapiens
agtcccctccccggccct

SEQ ID NO: 1705682 - DNA, 12 bp, Homo sapiens
agtcccctgttg

SEQ ID NO: 1705683 - DNA, 22 bp, Homo sapiens
agtccctcgccgtccctcccag

SEQ ID NO: 1705684 - DNA, 19 bp, Homo sapiens
agtccctgactctctgtga

SEQ ID NO: 1705685 - DNA, 13 bp, Homo sapiens
agtccctggagct

SEQ ID NO: 1705686 - DNA, 22 bp, Homo sapiens
agtccctggagctgtccttcat

SEQ ID NO: 1705687 - DNA, 14 bp, Homo sapiens
gaccctgggcaagt

SEQ ID NO: 1705688 - DNA, 20 bp, Homo sapiens
gaccctgtcttctgggcaca

SEQ ID NO: 1705689 - DNA, 15 bp, Homo sapiens
gacccttataaaatc

SEQ ID NO: 1705690 - DNA, 14 bp, Homo sapiens
gacccttcagggcc

SEQ ID NO: 1705691 - DNA, 17 bp, Homo sapiens
gacccttcagggccaga

SEQ ID NO: 1705692 - DNA, 22 bp, Homo sapiens
gacccttcccaatcagcactga

SEQ ID NO: 1705693 - DNA, 14 bp, Homo sapiens
gaccctttccttcc

SEQ ID NO: 1705694 - DNA, 15 bp, Homo sapiens
gacccttttctcagg

SEQ ID NO: 1705695 - DNA, 14 bp, Homo sapiens
gaccgagccctgga

SEQ ID NO: 1705696 - DNA, 15 bp, Homo sapiens
gaccgagccctggag

SEQ ID NO: 1705697 - DNA, 16 bp, Homo sapiens
gaccgagccctggaga

SEQ ID NO: 1705698 - DNA, 12 bp, Homo sapiens
gaccgccccctc

SEQ ID NO: 1705699 - DNA, 15 bp, Homo sapiens
gaccgccccctcctc

SEQ ID NO: 1705700 - DNA, 14 bp, Homo sapiens
gaccgcttcacccc

SEQ ID NO: 1705701 - DNA, 16 bp, Homo sapiens
gaccgcttcacccctg

SEQ ID NO: 1705702 - DNA, 18 bp, Homo sapiens
gaccgcttcacccctgca

SEQ ID NO: 1705703 - DNA, 17 bp, Homo sapiens
gaccgggtgggcctggc

SEQ ID NO: 1705704 - DNA, 18 bp, Homo sapiens
gaccgggtgggcctggcc

SEQ ID NO: 1705705 - DNA, 19 bp, Homo sapiens
gaccgggtgggcctggcct

SEQ ID NO: 1705706 - DNA, 20 bp, Homo sapiens
gaccgggtgggcctggcctg

SEQ ID NO: 1705707 - DNA, 15 bp, Homo sapiens
gaccggtacagaaag

SEQ ID NO: 1705708 - DNA, 13 bp, Homo sapiens
gaccgtccagggg

SEQ ID NO: 1705709 - DNA, 15 bp, Homo sapiens
gaccgtggacaggcc

SEQ ID NO: 1705710 - DNA, 17 bp, Homo sapiens
gaccgtggacaggccca

SEQ ID NO: 1705711 - DNA, 18 bp, Homo sapiens
gaccgtggacaggcccag

SEQ ID NO: 1705712 - DNA, 20 bp, Homo sapiens
gaacaattgaagtaaacttt

SEQ ID NO: 1705713 - DNA, 15 bp, Homo sapiens
gaacacaatgtgtat

SEQ ID NO: 1705714 - DNA, 18 bp, Homo sapiens
gaacacacagactttctg

SEQ ID NO: 1705715 - DNA, 16 bp, Homo sapiens
gaacacagcatgtgcc

SEQ ID NO: 1705716 - DNA, 17 bp, Homo sapiens
gaacacagcatgtgcca

SEQ ID NO: 1705717 - DNA, 17 bp, Homo sapiens
gaacacaggcaaaatcc

SEQ ID NO: 1705718 - DNA, 15 bp, Homo sapiens
gaacacagtgtctgt

SEQ ID NO: 1705719 - DNA, 16 bp, Homo sapiens
gaacacagtgtctgtt

SEQ ID NO: 1705720 - DNA, 16 bp, Homo sapiens
gaacacatgtgtatga

SEQ ID NO: 1705721 - DNA, 23 bp, Homo sapiens
gaacacccttagaaaatgtgtcc

SEQ ID NO: 1705722 - DNA, 19 bp, Homo sapiens
gaacactaactcaccagcc

SEQ ID NO: 1705723 - DNA, 13 bp, Homo sapiens
gaacactagccag

SEQ ID NO: 1705724 - DNA, 22 bp, Homo sapiens
gaacactatggttaaccctctc

SEQ ID NO: 1705725 - DNA, 16 bp, Homo sapiens
gaacactgggggaggg

SEQ ID NO: 1705726 - DNA, 17 bp, Homo sapiens
gaacactgggggagggg

SEQ ID NO: 1705727 - DNA, 20 bp, Homo sapiens
gaacactgggggaggggaca

SEQ ID NO: 1705728 - DNA, 19 bp, Homo sapiens
gaacagaaggatgaatgag

SEQ ID NO: 1705729 - DNA, 18 bp, Homo sapiens
gaacagacaacagaagtc

SEQ ID NO: 1705730 - DNA, 15 bp, Homo sapiens
gaacagacaggagaa

SEQ ID NO: 1705731 - DNA, 18 bp, Homo sapiens
gaacagacaggagaaatg

SEQ ID NO: 1705732 - DNA, 15 bp, Homo sapiens
gaacagcctgcctgt

SEQ ID NO: 1705733 - DNA, 19 bp, Homo sapiens
gaacagcgggagacctgtg

SEQ ID NO: 1705734 - DNA, 21 bp, Homo sapiens
gaacagctatgggagccccag

SEQ ID NO: 1705735 - DNA, 22 bp, Homo sapiens
gaacagctatgggagccccagg

SEQ ID NO: 1705736 - DNA, 15 bp, Homo sapiens
gaacagctgtaatct

SEQ ID NO: 1705737 - DNA, 12 bp, Homo sapiens
gaacagctgtgt

SEQ ID NO: 1705738 - DNA, 13 bp, Homo sapiens
gaacagctgtgtc

SEQ ID NO: 1705739 - DNA, 14 bp, Homo sapiens
gaacagctgtgtct

SEQ ID NO: 1705740 - DNA, 19 bp, Homo sapiens
gaacagctgtgtctgccaa

SEQ ID NO: 1705741 - DNA, 17 bp, Homo sapiens
gaacagcttgccaggga

SEQ ID NO: 1705742 - DNA, 19 bp, Homo sapiens
gaacaggcttggagggaag

SEQ ID NO: 1705743 - DNA, 14 bp, Homo sapiens
gaacaggtggatgt

SEQ ID NO: 1705744 - DNA, 19 bp, Homo sapiens
gaacaggttcttaaaaagg

SEQ ID NO: 1705745 - DNA, 20 bp, Homo sapiens
gaacagtggttgcctggggg

SEQ ID NO: 1705746 - DNA, 23 bp, Homo sapiens
gaacagtgtggtttgggaaagat

SEQ ID NO: 1705747 - DNA, 14 bp, Homo sapiens
gaacagtgtttccc

SEQ ID NO: 1705748 - DNA, 16 bp, Homo sapiens
gaacagtgtttcccat

SEQ ID NO: 1705749 - DNA, 22 bp, Homo sapiens
gaacataaagcaaatagacaca

SEQ ID NO: 1705750 - DNA, 15 bp, Homo sapiens
gaacatatgttgcaa

SEQ ID NO: 1705751 - DNA, 18 bp, Homo sapiens
gaacatattgttgaaagg

SEQ ID NO: 1705752 - DNA, 17 bp, Homo sapiens
gaacatccaaccttccc

SEQ ID NO: 1705753 - DNA, 17 bp, Homo sapiens
gaacatctcttgaaacc

SEQ ID NO: 1705754 - DNA, 18 bp, Homo sapiens
gaacatgacccagcctga

SEQ ID NO: 1705755 - DNA, 16 bp, Homo sapiens
gaacatgcacatttat

SEQ ID NO: 1705756 - DNA, 18 bp, Homo sapiens
gaacatgcacatttatat

SEQ ID NO: 1705757 - DNA, 13 bp, Homo sapiens
gaacatgccccct

SEQ ID NO: 1705758 - DNA, 16 bp, Homo sapiens
gaacatgctggaaata

SEQ ID NO: 1705759 - DNA, 17 bp, Homo sapiens
gaacatgctggaaataa

SEQ ID NO: 1705760 - DNA, 17 bp, Homo sapiens
gaacatggacttgtata

SEQ ID NO: 1705761 - DNA, 22 bp, Homo sapiens
gaacatggacttgtatatttgt

SEQ ID NO: 1705762 - DNA, 23 bp, Homo sapiens
gaacatggctagcctttcttgta

SEQ ID NO: 1705763 - DNA, 18 bp, Homo sapiens
gaacatggctggcctggt

SEQ ID NO: 1705764 - DNA, 19 bp, Homo sapiens
gaacatggctggcctggta

SEQ ID NO: 1705765 - DNA, 18 bp, Homo sapiens
gaacatgtgccttttctg

SEQ ID NO: 1705766 - DNA, 19 bp, Homo sapiens
gaacatgtgccttttctga

SEQ ID NO: 1705767 - DNA, 20 bp, Homo sapiens
gaacatgtgccttttctgaa

SEQ ID NO: 1705768 - DNA, 14 bp, Homo sapiens
gaacatgttctcca

SEQ ID NO: 1705769 - DNA, 23 bp, Homo sapiens
gaacatgtttacaggtttgaatt

SEQ ID NO: 1705770 - DNA, 21 bp, Homo sapiens
gaacattaaaatatagagaca

SEQ ID NO: 1705771 - DNA, 13 bp, Homo sapiens
gaacattcccagc

SEQ ID NO: 1705772 - DNA, 21 bp, Homo sapiens
gaacattctaccaaatttttg

SEQ ID NO: 1705773 - DNA, 10 bp, Homo sapiens
gaacattgta

SEQ ID NO: 1705774 - DNA, 15 bp, Homo sapiens
gaacattgtactgtt

SEQ ID NO: 1705775 - DNA, 17 bp, Homo sapiens
gaacatttgatattttt

SEQ ID NO: 1705776 - DNA, 22 bp, Homo sapiens
gaacatttgatatttttccatt

SEQ ID NO: 1705777 - DNA, 23 bp, Homo sapiens
gaaccaaaacttccaaggccctg

SEQ ID NO: 1705778 - DNA, 16 bp, Homo sapiens
gaaccaaatacctcaa

SEQ ID NO: 1705779 - DNA, 19 bp, Homo sapiens
gaaccaaatacctcaattt

SEQ ID NO: 1705780 - DNA, 22 bp, Homo sapiens
gaaccaaatacctcaatttttg

SEQ ID NO: 1705781 - DNA, 16 bp, Homo sapiens
gaaccaaatctggaag

SEQ ID NO: 1705782 - DNA, 17 bp, Homo sapiens
gaaccaaatctggaagc

SEQ ID NO: 1705783 - DNA, 24 bp, Homo sapiens
gaaccaacaacctcaactgcctac

SEQ ID NO: 1705784 - DNA, 15 bp, Homo sapiens
gaaccaagcttcaga

SEQ ID NO: 1705785 - DNA, 16 bp, Homo sapiens
gaaccaagcttcagag

SEQ ID NO: 1705786 - DNA, 22 bp, Homo sapiens
agggacagaggccccagcctcc

SEQ ID NO: 1705787 - DNA, 17 bp, Homo sapiens
agggacagcaagtgagc

SEQ ID NO: 1705788 - DNA, 23 bp, Homo sapiens
agggacagcagcctccctgtcac

SEQ ID NO: 1705789 - DNA, 21 bp, Homo sapiens
agggacagcccactgagaagt

SEQ ID NO: 1705790 - DNA, 15 bp, Homo sapiens
agggacagctgctgg

SEQ ID NO: 1705791 - DNA, 14 bp, Homo sapiens
agggacaggagaag

SEQ ID NO: 1705792 - DNA, 17 bp, Homo sapiens
agggacaggagaagaga

SEQ ID NO: 1705793 - DNA, 16 bp, Homo sapiens
agggacaggctgaaga

SEQ ID NO: 1705794 - DNA, 18 bp, Homo sapiens
agggacatgccctgtgtg

SEQ ID NO: 1705795 - DNA, 19 bp, Homo sapiens
agggacatgccctgtgtgg

SEQ ID NO: 1705796 - DNA, 20 bp, Homo sapiens
agggacatgccctgtgtggc

SEQ ID NO: 1705797 - DNA, 19 bp, Homo sapiens
agggaccaactgggcccaa

SEQ ID NO: 1705798 - DNA, 12 bp, Homo sapiens
agggaccaaggc

SEQ ID NO: 1705799 - DNA, 21 bp, Homo sapiens
agggaccaaggcaaggcaggt

SEQ ID NO: 1705800 - DNA, 23 bp, Homo sapiens
agggaccaaggcaaggcaggtgc

SEQ ID NO: 1705801 - DNA, 15 bp, Homo sapiens
agggaccagccaaga

SEQ ID NO: 1705802 - DNA, 20 bp, Homo sapiens
agggaccagccaagagggct

SEQ ID NO: 1705803 - DNA, 18 bp, Homo sapiens
agggaccagggccaccgc

SEQ ID NO: 1705804 - DNA, 15 bp, Homo sapiens
agggacccaggtgtg

SEQ ID NO: 1705805 - DNA, 18 bp, Homo sapiens
agggacccaggtgtgcct

SEQ ID NO: 1705806 - DNA, 20 bp, Homo sapiens
agggacccaggtgtgcctgt

SEQ ID NO: 1705807 - DNA, 15 bp, Homo sapiens
agggacccccagaac

SEQ ID NO: 1705808 - DNA, 19 bp, Homo sapiens
agggacccggggtctcctg

SEQ ID NO: 1705809 - DNA, 21 bp, Homo sapiens
agggacccggggtctcctgga

SEQ ID NO: 1705810 - DNA, 22 bp, Homo sapiens
agggacccggggtctcctggac

SEQ ID NO: 1705811 - DNA, 18 bp, Homo sapiens
agggaccggtgctgcagg

SEQ ID NO: 1705812 - DNA, 20 bp, Homo sapiens
agggaccggtgctgcaggag

SEQ ID NO: 1705813 - DNA, 13 bp, Homo sapiens
agggacctgagag

SEQ ID NO: 1705814 - DNA, 21 bp, Homo sapiens
agggacctgagagcatctcag

SEQ ID NO: 1705815 - DNA, 21 bp, Homo sapiens
agggacgctttgggagaatgt

SEQ ID NO: 1705816 - DNA, 14 bp, Homo sapiens
agggacgctttgtc

SEQ ID NO: 1705817 - DNA, 19 bp, Homo sapiens
agggacggccaagaatgta

SEQ ID NO: 1705818 - DNA, 19 bp, Homo sapiens
agggactagggcagtttgg

SEQ ID NO: 1705819 - DNA, 19 bp, Homo sapiens
agggactagtgagtcagca

SEQ ID NO: 1705820 - DNA, 22 bp, Homo sapiens
agggactatctttgctgcagag

SEQ ID NO: 1705821 - DNA, 17 bp, Homo sapiens
agggactgccaggctgt

SEQ ID NO: 1705822 - DNA, 17 bp, Homo sapiens
agggacttaaaaaactt

SEQ ID NO: 1705823 - DNA, 16 bp, Homo sapiens
agggacttgtttagag

SEQ ID NO: 1705824 - DNA, 22 bp, Homo sapiens
agggacttgtttagagagcctg

SEQ ID NO: 1705825 - DNA, 15 bp, Homo sapiens
agggagaaaagagaa

SEQ ID NO: 1705826 - DNA, 16 bp, Homo sapiens
agggagaagaaaggtg

SEQ ID NO: 1705827 - DNA, 14 bp, Homo sapiens
agggagaagagaaa

SEQ ID NO: 1705828 - DNA, 17 bp, Homo sapiens
agggagaaggaagggca

SEQ ID NO: 1705829 - DNA, 18 bp, Homo sapiens
agggagaaggaagggcag

SEQ ID NO: 1705830 - DNA, 19 bp, Homo sapiens
agggagaaggaagggcaga

SEQ ID NO: 1705831 - DNA, 20 bp, Homo sapiens
agggagacaccagtggtgcg

SEQ ID NO: 1705832 - DNA, 18 bp, Homo sapiens
gaagaaactttctggtgc

SEQ ID NO: 1705833 - DNA, 22 bp, Homo sapiens
gaagaaagatttgttactgtat

SEQ ID NO: 1705834 - DNA, 22 bp, Homo sapiens
gaagaaatcacagaatcatatg

SEQ ID NO: 1705835 - DNA, 23 bp, Homo sapiens
gaagaaatctttctccctcaact

SEQ ID NO: 1705836 - DNA, 22 bp, Homo sapiens
gaagaaattcaggtacagaaaa

SEQ ID NO: 1705837 - DNA, 18 bp, Homo sapiens
gaagaacaacaaagacat

SEQ ID NO: 1705838 - DNA, 18 bp, Homo sapiens
gaagaacaccctctaaat

SEQ ID NO: 1705839 - DNA, 19 bp, Homo sapiens
gaagaacaggcctctccat

SEQ ID NO: 1705840 - DNA, 20 bp, Homo sapiens
gaagaacatccaaggagaaa

SEQ ID NO: 1705841 - DNA, 16 bp, Homo sapiens
gaagaaccaaatacct

SEQ ID NO: 1705842 - DNA, 18 bp, Homo sapiens
gaagaaccaaatacctca

SEQ ID NO: 1705843 - DNA, 23 bp, Homo sapiens
gaagaacggggctcttctcattt

SEQ ID NO: 1705844 - DNA, 14 bp, Homo sapiens
gaagaactgcaggc

SEQ ID NO: 1705845 - DNA, 15 bp, Homo sapiens
gaagaactgcaggcc

SEQ ID NO: 1705846 - DNA, 13 bp, Homo sapiens
gaagaagaaatct

SEQ ID NO: 1705847 - DNA, 19 bp, Homo sapiens
gaagaagagaagctgctga

SEQ ID NO: 1705848 - DNA, 13 bp, Homo sapiens
gaagaagatgctc

SEQ ID NO: 1705849 - DNA, 12 bp, Homo sapiens
gaagaaggcagt

SEQ ID NO: 1705850 - DNA, 13 bp, Homo sapiens
gaagaaggcagtg

SEQ ID NO: 1705851 - DNA, 14 bp, Homo sapiens
gaagaagggagaag

SEQ ID NO: 1705852 - DNA, 17 bp, Homo sapiens
gaagaagggagaagaaa

SEQ ID NO: 1705853 - DNA, 21 bp, Homo sapiens
gaagaagtcactgaacaaaac

SEQ ID NO: 1705854 - DNA, 17 bp, Homo sapiens
gaagaatccacaaggac

SEQ ID NO: 1705855 - DNA, 12 bp, Homo sapiens
gaagaatgaaag

SEQ ID NO: 1705856 - DNA, 23 bp, Homo sapiens
gaagaatgcacaagaatggatca

SEQ ID NO: 1705857 - DNA, 12 bp, Homo sapiens
gaagaatggctt

SEQ ID NO: 1705858 - DNA, 15 bp, Homo sapiens
gaagaatggctttca

SEQ ID NO: 1705859 - DNA, 18 bp, Homo sapiens
gaagaatggctttcaata

SEQ ID NO: 1705860 - DNA, 14 bp, Homo sapiens
gaagaatgtttctg

SEQ ID NO: 1705861 - DNA, 16 bp, Homo sapiens
gaagaattaagataca

SEQ ID NO: 1705862 - DNA, 18 bp, Homo sapiens
gaagaattgaacccagga

SEQ ID NO: 1705863 - DNA, 20 bp, Homo sapiens
gaagaattgaacccaggagg

SEQ ID NO: 1705864 - DNA, 15 bp, Homo sapiens
gaagaatttattaca

SEQ ID NO: 1705865 - DNA, 15 bp, Homo sapiens
gaagaattttcagac

SEQ ID NO: 1705866 - DNA, 15 bp, Homo sapiens
gaagacaaaaagaca

SEQ ID NO: 1705867 - DNA, 20 bp, Homo sapiens
gaagacaaaaagacaaacat

SEQ ID NO: 1705868 - DNA, 19 bp, Homo sapiens
gaagacaaagtctaaggaa

SEQ ID NO: 1705869 - DNA, 16 bp, Homo sapiens
gaagacaacagaaaga

SEQ ID NO: 1705870 - DNA, 17 bp, Homo sapiens
gaagacaacagaaagag

SEQ ID NO: 1705871 - DNA, 20 bp, Homo sapiens
gaagacaatttgatacataa

SEQ ID NO: 1705872 - DNA, 21 bp, Homo sapiens
gaagacacagactgcgatttg

SEQ ID NO: 1705873 - DNA, 14 bp, Homo sapiens
gaagacacagcctc

SEQ ID NO: 1705874 - DNA, 14 bp, Homo sapiens
gaagacacttcaga

SEQ ID NO: 1705875 - DNA, 15 bp, Homo sapiens
gaagacaggacagtg

SEQ ID NO: 1705876 - DNA, 21 bp, Homo sapiens
gaagacatggagactcctgcc

SEQ ID NO: 1705877 - DNA, 12 bp, Homo sapiens
gaagacattttg

SEQ ID NO: 1705878 - DNA, 18 bp, Homo sapiens
gaagaccaaaggaaggaa

SEQ ID NO: 1705879 - DNA, 19 bp, Homo sapiens
gaagaccaaagtttgcaac

SEQ ID NO: 1705880 - DNA, 16 bp, Homo sapiens
gaagaccccacccaag

SEQ ID NO: 1705881 - DNA, 19 bp, Homo sapiens
gaagacccctgactcatca

SEQ ID NO: 1705882 - DNA, 16 bp, Homo sapiens
gaagacggaaaacaat

SEQ ID NO: 1705883 - DNA, 16 bp, Homo sapiens
gaagactagaggccag

SEQ ID NO: 1705884 - DNA, 18 bp, Homo sapiens
gaagactagaggccaggg

SEQ ID NO: 1705885 - DNA, 20 bp, Homo sapiens
gaagactccctgatcccaga

SEQ ID NO: 1705886 - DNA, 13 bp, Homo sapiens
gaagactgtgcag

SEQ ID NO: 1705887 - DNA, 11 bp, Homo sapiens
gaagactgtgg

SEQ ID NO: 1705888 - DNA, 18 bp, Homo sapiens
gaagacttaaaagagctc

SEQ ID NO: 1705889 - DNA, 21 bp, Homo sapiens
gaagagaagaaatagcagagc

SEQ ID NO: 1705890 - DNA, 14 bp, Homo sapiens
gaagagaagctgct

SEQ ID NO: 1705891 - DNA, 24 bp, Homo sapiens
gaagagaagtgaccgagagaacct

SEQ ID NO: 1705892 - DNA, 16 bp, Homo sapiens
gaagagactgggaaga

SEQ ID NO: 1705893 - DNA, 15 bp, Homo sapiens
gaagagagagaccct

SEQ ID NO: 1705894 - DNA, 22 bp, Homo sapiens
gaagagagggacaggcactcca

SEQ ID NO: 1705895 - DNA, 21 bp, Homo sapiens
gaagagagtggggcctgccct

SEQ ID NO: 1705896 - DNA, 12 bp, Homo sapiens
gaagagcagcct

SEQ ID NO: 1705897 - DNA, 22 bp, Homo sapiens
gaagagcagcctgatggccaag

SEQ ID NO: 1705898 - DNA, 23 bp, Homo sapiens
gaagagcaggactccaggcccaa

SEQ ID NO: 1705899 - DNA, 23 bp, Homo sapiens
gaagagcaggcacatggaggagc

SEQ ID NO: 1705900 - DNA, 21 bp, Homo sapiens
agggatggagaaagaagtgga

SEQ ID NO: 1705901 - DNA, 14 bp, Homo sapiens
agggatgggcagcc

SEQ ID NO: 1705902 - DNA, 17 bp, Homo sapiens
agggatgggcagcccaa

SEQ ID NO: 1705903 - DNA, 13 bp, Homo sapiens
agggatggtgccc

SEQ ID NO: 1705904 - DNA, 15 bp, Homo sapiens
agggatgtgggtaag

SEQ ID NO: 1705905 - DNA, 20 bp, Homo sapiens
agggatgtgggtaagaggag

SEQ ID NO: 1705906 - DNA, 21 bp, Homo sapiens
agggatgtgggtaagaggagc

SEQ ID NO: 1705907 - DNA, 17 bp, Homo sapiens
agggattaacctctgca

SEQ ID NO: 1705908 - DNA, 20 bp, Homo sapiens
agggattagggagagaagat

SEQ ID NO: 1705909 - DNA, 16 bp, Homo sapiens
agggattcaggctgct

SEQ ID NO: 1705910 - DNA, 13 bp, Homo sapiens
agggattctggga

SEQ ID NO: 1705911 - DNA, 22 bp, Homo sapiens
agggattctgggcttggggtgt

SEQ ID NO: 1705912 - DNA, 16 bp, Homo sapiens
agggattgctgccact

SEQ ID NO: 1705913 - DNA, 22 bp, Homo sapiens
agggatttggggctcagagtgg

SEQ ID NO: 1705914 - DNA, 17 bp, Homo sapiens
agggcaaattattttaa

SEQ ID NO: 1705915 - DNA, 22 bp, Homo sapiens
agggcaacaatacatgctgcta

SEQ ID NO: 1705916 - DNA, 15 bp, Homo sapiens
agggcaatctttgcc

SEQ ID NO: 1705917 - DNA, 18 bp, Homo sapiens
agggcacagccctccgac

SEQ ID NO: 1705918 - DNA, 19 bp, Homo sapiens
agggcacagccctccgacc

SEQ ID NO: 1705919 - DNA, 23 bp, Homo sapiens
agggcacattgcccatggctggg

SEQ ID NO: 1705920 - DNA, 14 bp, Homo sapiens
agggcaccagaggc

SEQ ID NO: 1705921 - DNA, 21 bp, Homo sapiens
agggcaccctagttctacctc

SEQ ID NO: 1705922 - DNA, 17 bp, Homo sapiens
agggcactcccaaccct

SEQ ID NO: 1705923 - DNA, 16 bp, Homo sapiens
agggcactggtggccc

SEQ ID NO: 1705924 - DNA, 19 bp, Homo sapiens
agggcagagaatggctggg

SEQ ID NO: 1705925 - DNA, 23 bp, Homo sapiens
agggcagaggaatgtagggcctg

SEQ ID NO: 1705926 - DNA, 22 bp, Homo sapiens
agggcagaggctggaggcaggg

SEQ ID NO: 1705927 - DNA, 15 bp, Homo sapiens
agggcagcaagggac

SEQ ID NO: 1705928 - DNA, 15 bp, Homo sapiens
agggcagcagaaggg

SEQ ID NO: 1705929 - DNA, 19 bp, Homo sapiens
agggcagccctccacttct

SEQ ID NO: 1705930 - DNA, 13 bp, Homo sapiens
agggcagctgcta

SEQ ID NO: 1705931 - DNA, 18 bp, Homo sapiens
agggcaggaaggagagcc

SEQ ID NO: 1705932 - DNA, 14 bp, Homo sapiens
agggcaggcttggg

SEQ ID NO: 1705933 - DNA, 15 bp, Homo sapiens
agggcaggcttgggg

SEQ ID NO: 1705934 - DNA, 17 bp, Homo sapiens
agggcaggcttggggaa

SEQ ID NO: 1705935 - DNA, 17 bp, Homo sapiens
agggcagggcatctcct

SEQ ID NO: 1705936 - DNA, 14 bp, Homo sapiens
agggcagggcccac

SEQ ID NO: 1705937 - DNA, 17 bp, Homo sapiens
agggcagggcccacgtg

SEQ ID NO: 1705938 - DNA, 19 bp, Homo sapiens
agggcagggcccacgtgta

SEQ ID NO: 1705939 - DNA, 15 bp, Homo sapiens
agggcagtgcccatg

SEQ ID NO: 1705940 - DNA, 15 bp, Homo sapiens
agggcagtgcccttt

SEQ ID NO: 1705941 - DNA, 14 bp, Homo sapiens
agggcatcaggcac

SEQ ID NO: 1705942 - DNA, 15 bp, Homo sapiens
agggcatcaggcact

SEQ ID NO: 1705943 - DNA, 16 bp, Homo sapiens
agggcatcaggcactg

SEQ ID NO: 1705944 - DNA, 22 bp, Homo sapiens
agggcatcaggcactggtggca

SEQ ID NO: 1705945 - DNA, 17 bp, Homo sapiens
agggcatcatgcatctt

SEQ ID NO: 1705946 - DNA, 12 bp, Homo sapiens
agggcatctcct

SEQ ID NO: 1705947 - DNA, 14 bp, Homo sapiens
agggcatctcctgt

SEQ ID NO: 1705948 - DNA, 23 bp, Homo sapiens
agggcatctcctgtgcatgggtg

SEQ ID NO: 1705949 - DNA, 20 bp, Homo sapiens
agggcatgcacgggcatgca

SEQ ID NO: 1705950 - DNA, 17 bp, Homo sapiens
gaagcaatctttgaaat

SEQ ID NO: 1705951 - DNA, 17 bp, Homo sapiens
gaagcacagctcctgcc

SEQ ID NO: 1705952 - DNA, 21 bp, Homo sapiens
gaagcactacaccttgccttg

SEQ ID NO: 1705953 - DNA, 22 bp, Homo sapiens
gaagcacttaagtcttccttaa

SEQ ID NO: 1705954 - DNA, 23 bp, Homo sapiens
gaagcactttgggattctttcca

SEQ ID NO: 1705955 - DNA, 12 bp, Homo sapiens
gaagcagccagc

SEQ ID NO: 1705956 - DNA, 14 bp, Homo sapiens
gaagcagccagctc

SEQ ID NO: 1705957 - DNA, 22 bp, Homo sapiens
gaagcagcctctccccaggtcc

SEQ ID NO: 1705958 - DNA, 23 bp, Homo sapiens
gaagcagctaaaccaaggactga

SEQ ID NO: 1705959 - DNA, 12 bp, Homo sapiens
gaagcaggaggc

SEQ ID NO: 1705960 - DNA, 10 bp, Homo sapiens
gaagcaggca

SEQ ID NO: 1705961 - DNA, 19 bp, Homo sapiens
gaagcaggttgaggggctc

SEQ ID NO: 1705962 - DNA, 18 bp, Homo sapiens
gaagcagtgcctcgaggc

SEQ ID NO: 1705963 - DNA, 19 bp, Homo sapiens
gaagcagtgcctcgaggca

SEQ ID NO: 1705964 - DNA, 19 bp, Homo sapiens
gaagcagtgccttccataa

SEQ ID NO: 1705965 - DNA, 14 bp, Homo sapiens
gaagcagtggcctt

SEQ ID NO: 1705966 - DNA, 22 bp, Homo sapiens
gaagcagttgtaccaagtgaaa

SEQ ID NO: 1705967 - DNA, 17 bp, Homo sapiens
gaagcattctccccagt

SEQ ID NO: 1705968 - DNA, 22 bp, Homo sapiens
gaagcatttcaaagccctgcct

SEQ ID NO: 1705969 - DNA, 17 bp, Homo sapiens
gaagccaagggaaaggg

SEQ ID NO: 1705970 - DNA, 13 bp, Homo sapiens
gaagccacagaaa

SEQ ID NO: 1705971 - DNA, 18 bp, Homo sapiens
gaagccacaggcctgaga

SEQ ID NO: 1705972 - DNA, 14 bp, Homo sapiens
gaagccaccttccc

SEQ ID NO: 1705973 - DNA, 15 bp, Homo sapiens
gaagccactgaagct

SEQ ID NO: 1705974 - DNA, 18 bp, Homo sapiens
gaagccactgaagctggg

SEQ ID NO: 1705975 - DNA, 16 bp, Homo sapiens
gaagccagccacagac

SEQ ID NO: 1705976 - DNA, 18 bp, Homo sapiens
gaagccagccacagaccc

SEQ ID NO: 1705977 - DNA, 19 bp, Homo sapiens
gaagccaggaatttcccag

SEQ ID NO: 1705978 - DNA, 21 bp, Homo sapiens
gaagccaggaatttcccagga

SEQ ID NO: 1705979 - DNA, 23 bp, Homo sapiens
gaagccaggaatttcccaggacc

SEQ ID NO: 1705980 - DNA, 14 bp, Homo sapiens
gaagccaggtacag

SEQ ID NO: 1705981 - DNA, 22 bp, Homo sapiens
gaagccaggtacaggagaggca

SEQ ID NO: 1705982 - DNA, 24 bp, Homo sapiens
gaagccaggtacaggagaggcagc

SEQ ID NO: 1705983 - DNA, 22 bp, Homo sapiens
gaagccatccctttttttacat

SEQ ID NO: 1705984 - DNA, 18 bp, Homo sapiens
gaagcccaattgctggag

SEQ ID NO: 1705985 - DNA, 13 bp, Homo sapiens
gaagcccaggctc

SEQ ID NO: 1705986 - DNA, 16 bp, Homo sapiens
gaagcccatcctgacc

SEQ ID NO: 1705987 - DNA, 17 bp, Homo sapiens
gaagcccatcctgacca

SEQ ID NO: 1705988 - DNA, 14 bp, Homo sapiens
gaagcccccagcta

SEQ ID NO: 1705989 - DNA, 14 bp, Homo sapiens
gaagcccctgggcc

SEQ ID NO: 1705990 - DNA, 15 bp, Homo sapiens
gaagccccttggaga

SEQ ID NO: 1705991 - DNA, 20 bp, Homo sapiens
gaagccctagtagctggcgc

SEQ ID NO: 1705992 - DNA, 21 bp, Homo sapiens
gaagccctagtagctggcgcc

SEQ ID NO: 1705993 - DNA, 23 bp, Homo sapiens
gaagccctcaaagaagtcggaat

SEQ ID NO: 1705994 - DNA, 15 bp, Homo sapiens
gaagccctcccaggt

SEQ ID NO: 1705995 - DNA, 11 bp, Homo sapiens
gaagccctcct

SEQ ID NO: 1705996 - DNA, 12 bp, Homo sapiens
gaagccctcctt

SEQ ID NO: 1705997 - DNA, 11 bp, Homo sapiens
gaagccctgga

SEQ ID NO: 1705998 - DNA, 21 bp, Homo sapiens
gaagccctggatttcagaaag

SEQ ID NO: 1705999 - DNA, 15 bp, Homo sapiens
gaagccgactctggc

SEQ ID NO: 1706000 - DNA, 18 bp, Homo sapiens
gaagccggacagctgccc

SEQ ID NO: 1706001 - DNA, 20 bp, Homo sapiens
gaagccggacagctgcccag

SEQ ID NO: 1706002 - DNA, 21 bp, Homo sapiens
gaagccggacagctgcccaga

SEQ ID NO: 1706003 - DNA, 22 bp, Homo sapiens
gaagccgtcctggcgcctggca

SEQ ID NO: 1706004 - DNA, 20 bp, Homo sapiens
gaagccgtctgactccagag

SEQ ID NO: 1706005 - DNA, 22 bp, Homo sapiens
gaagcctccaagcctgcctccc

SEQ ID NO: 1706006 - DNA, 21 bp, Homo sapiens
gaagcctccacaccagctgct

SEQ ID NO: 1706007 - DNA, 19 bp, Homo sapiens
gaagcctccttagaaaaaa

SEQ ID NO: 1706008 - DNA, 15 bp, Homo sapiens
gaagcctctgcctcc

SEQ ID NO: 1706009 - DNA, 18 bp, Homo sapiens
gaagcctgaactgaggcc

SEQ ID NO: 1706010 - DNA, 15 bp, Homo sapiens
gaagcctgtgccagc

SEQ ID NO: 1706011 - DNA, 15 bp, Homo sapiens
gaagccttcagctcc

SEQ ID NO: 1706012 - DNA, 16 bp, Homo sapiens
gaagccttcagctcca

SEQ ID NO: 1706013 - DNA, 22 bp, Homo sapiens
gaagcggtggataactagccag

SEQ ID NO: 1706014 - DNA, 13 bp, Homo sapiens
gaaggtaaaaagt

SEQ ID NO: 1706015 - DNA, 18 bp, Homo sapiens
gaaggtagcccagcactg

SEQ ID NO: 1706016 - DNA, 19 bp, Homo sapiens
gaaggtagcccagcactgt

SEQ ID NO: 1706017 - DNA, 21 bp, Homo sapiens
gaaggtagcccagcactgtga

SEQ ID NO: 1706018 - DNA, 15 bp, Homo sapiens
gaaggtcccctggca

SEQ ID NO: 1706019 - DNA, 16 bp, Homo sapiens
gaaggtcccctggcag

SEQ ID NO: 1706020 - DNA, 13 bp, Homo sapiens
gaaggtctccaag

SEQ ID NO: 1706021 - DNA, 22 bp, Homo sapiens
gaaggtctccaagacaataatt

SEQ ID NO: 1706022 - DNA, 18 bp, Homo sapiens
gaaggtctccaagggagg

SEQ ID NO: 1706023 - DNA, 21 bp, Homo sapiens
gaaggtctccaagggagggtg

SEQ ID NO: 1706024 - DNA, 14 bp, Homo sapiens
gaaggtgacagcag

SEQ ID NO: 1706025 - DNA, 14 bp, Homo sapiens
gaaggtgcctcaga

SEQ ID NO: 1706026 - DNA, 22 bp, Homo sapiens
gaaggtgcctcagactccgccc

SEQ ID NO: 1706027 - DNA, 18 bp, Homo sapiens
gaaggtgctgacggccag

SEQ ID NO: 1706028 - DNA, 19 bp, Homo sapiens
gaaggtgctgacggccagg

SEQ ID NO: 1706029 - DNA, 13 bp, Homo sapiens
gaaggtggggccc

SEQ ID NO: 1706030 - DNA, 17 bp, Homo sapiens
gaaggtggggccctgcc

SEQ ID NO: 1706031 - DNA, 21 bp, Homo sapiens
gaaggtggggccctgccccta

SEQ ID NO: 1706032 - DNA, 20 bp, Homo sapiens
gaaggttaggatttaacagt

SEQ ID NO: 1706033 - DNA, 13 bp, Homo sapiens
gaaggttcttctt

SEQ ID NO: 1706034 - DNA, 22 bp, Homo sapiens
gaaggtttgtgttttctctgga

SEQ ID NO: 1706035 - DNA, 19 bp, Homo sapiens
gaaggtttttgtaaagatt

SEQ ID NO: 1706036 - DNA, 17 bp, Homo sapiens
gaagtaaaacatttaaa

SEQ ID NO: 1706037 - DNA, 17 bp, Homo sapiens
gaagtaaactgatgtac

SEQ ID NO: 1706038 - DNA, 22 bp, Homo sapiens
gaagtaaattaaacatttttca

SEQ ID NO: 1706039 - DNA, 13 bp, Homo sapiens
gaagtaaattatg

SEQ ID NO: 1706040 - DNA, 17 bp, Homo sapiens
gaagtaacccctcctgg

SEQ ID NO: 1706041 - DNA, 18 bp, Homo sapiens
gaagtaacttatttgact

SEQ ID NO: 1706042 - DNA, 13 bp, Homo sapiens
gaagtaagaagag

SEQ ID NO: 1706043 - DNA, 15 bp, Homo sapiens
gaagtaagaagagga

SEQ ID NO: 1706044 - DNA, 17 bp, Homo sapiens
gaagtaagaagaggagc

SEQ ID NO: 1706045 - DNA, 16 bp, Homo sapiens
gaagtacacctgtgtg

SEQ ID NO: 1706046 - DNA, 17 bp, Homo sapiens
gaagtacacctgtgtgg

SEQ ID NO: 1706047 - DNA, 13 bp, Homo sapiens
gaagtaccagact

SEQ ID NO: 1706048 - DNA, 13 bp, Homo sapiens
gaagtagcctctt

SEQ ID NO: 1706049 - DNA, 15 bp, Homo sapiens
gaagtagctagtagc

SEQ ID NO: 1706050 - DNA, 17 bp, Homo sapiens
gaagtaggaggaaacag

SEQ ID NO: 1706051 - DNA, 15 bp, Homo sapiens
gaagtagtccagcct

SEQ ID NO: 1706052 - DNA, 14 bp, Homo sapiens
gaagtattcctgtt

SEQ ID NO: 1706053 - DNA, 22 bp, Homo sapiens
gaagtattcttttcaattatat

SEQ ID NO: 1706054 - DNA, 20 bp, Homo sapiens
gaagtcaaagacaaagtgtg

SEQ ID NO: 1706055 - DNA, 21 bp, Homo sapiens
gaagtcactcacactggccac

SEQ ID NO: 1706056 - DNA, 16 bp, Homo sapiens
gaagtcactgaacaaa

SEQ ID NO: 1706057 - DNA, 20 bp, Homo sapiens
gaagtcagccacactgggcc

SEQ ID NO: 1706058 - DNA, 22 bp, Homo sapiens
gaagtcagccacactgggcctg

SEQ ID NO: 1706059 - DNA, 13 bp, Homo sapiens
gaagtcagtacga

SEQ ID NO: 1706060 - DNA, 19 bp, Homo sapiens
gaagtcagtacgatcaagt

SEQ ID NO: 1706061 - DNA, 19 bp, Homo sapiens
gaagtccaggactgggtct

SEQ ID NO: 1706062 - DNA, 18 bp, Homo sapiens
gaagtcccttgccatcct

SEQ ID NO: 1706063 - DNA, 16 bp, Homo sapiens
gaagtctaggagctgg

SEQ ID NO: 1706064 - DNA, 20 bp, Homo sapiens
gaagtctaggagctgggagg

SEQ ID NO: 1706065 - DNA, 22 bp, Homo sapiens
gaagtctaggagctgggaggaa

SEQ ID NO: 1706066 - DNA, 18 bp, Homo sapiens
gaagtctccctgcacagc

SEQ ID NO: 1706067 - DNA, 21 bp, Homo sapiens
gaagtctccctgcacagcctc

SEQ ID NO: 1706068 - DNA, 14 bp, Homo sapiens
gaagtctgcgccct

SEQ ID NO: 1706069 - DNA, 18 bp, Homo sapiens
gaagtctggctttgctct

SEQ ID NO: 1706070 - DNA, 12 bp, Homo sapiens
agggctggacct

SEQ ID NO: 1706071 - DNA, 13 bp, Homo sapiens
agggctggaccta

SEQ ID NO: 1706072 - DNA, 14 bp, Homo sapiens
agggctggactgag

SEQ ID NO: 1706073 - DNA, 16 bp, Homo sapiens
agggctggactgaggc

SEQ ID NO: 1706074 - DNA, 18 bp, Homo sapiens
agggctggaggcccaggc

SEQ ID NO: 1706075 - DNA, 13 bp, Homo sapiens
agggctggctcct

SEQ ID NO: 1706076 - DNA, 12 bp, Homo sapiens
agggctgggagg

SEQ ID NO: 1706077 - DNA, 14 bp, Homo sapiens
agggctgggaggaa

SEQ ID NO: 1706078 - DNA, 11 bp, Homo sapiens
agggctgggga

SEQ ID NO: 1706079 - DNA, 16 bp, Homo sapiens
agggctggtctctgct

SEQ ID NO: 1706080 - DNA, 23 bp, Homo sapiens
agggctgtgcttgaaggccctgc

SEQ ID NO: 1706081 - DNA, 18 bp, Homo sapiens
agggcttacctgtacact

SEQ ID NO: 1706082 - DNA, 20 bp, Homo sapiens
agggcttcctctagaagcca

SEQ ID NO: 1706083 - DNA, 21 bp, Homo sapiens
agggcttcctctagaagccaa

SEQ ID NO: 1706084 - DNA, 22 bp, Homo sapiens
agggcttctgcaccctccaccc

SEQ ID NO: 1706085 - DNA, 21 bp, Homo sapiens
agggcttggcccagcgccaag

SEQ ID NO: 1706086 - DNA, 14 bp, Homo sapiens
agggctttaaaatt

SEQ ID NO: 1706087 - DNA, 19 bp, Homo sapiens
agggctttaaaattctctt

SEQ ID NO: 1706088 - DNA, 20 bp, Homo sapiens
agggctttaaaattctcttc

SEQ ID NO: 1706089 - DNA, 23 bp, Homo sapiens
agggctttaaaattctcttccaa

SEQ ID NO: 1706090 - DNA, 17 bp, Homo sapiens
agggctttgagggtgga

SEQ ID NO: 1706091 - DNA, 18 bp, Homo sapiens
aggggaaaaatgggaaat

SEQ ID NO: 1706092 - DNA, 20 bp, Homo sapiens
aggggaaaatgtgaagctga

SEQ ID NO: 1706093 - DNA, 14 bp, Homo sapiens
aggggaaaggcctg

SEQ ID NO: 1706094 - DNA, 13 bp, Homo sapiens
aggggaagaatga

SEQ ID NO: 1706095 - DNA, 15 bp, Homo sapiens
aggggaagaatgaaa

SEQ ID NO: 1706096 - DNA, 16 bp, Homo sapiens
aggggaagagatgttt

SEQ ID NO: 1706097 - DNA, 14 bp, Homo sapiens
aggggaagaggcct

SEQ ID NO: 1706098 - DNA, 12 bp, Homo sapiens
aggggaaggaag

SEQ ID NO: 1706099 - DNA, 23 bp, Homo sapiens
aggggaagggccagtctgggctg

SEQ ID NO: 1706100 - DNA, 20 bp, Homo sapiens
aggggaagggctttgagggt

SEQ ID NO: 1706101 - DNA, 14 bp, Homo sapiens
aggggaaggggctg

SEQ ID NO: 1706102 - DNA, 17 bp, Homo sapiens
aggggaataatagaaga

SEQ ID NO: 1706103 - DNA, 22 bp, Homo sapiens
aggggacaagggatttgaggtg

SEQ ID NO: 1706104 - DNA, 24 bp, Homo sapiens
aggggaccaattctggacagacag

SEQ ID NO: 1706105 - DNA, 20 bp, Homo sapiens
aggggaccccgagaaccctg

SEQ ID NO: 1706106 - DNA, 23 bp, Homo sapiens
aggggaccccgagaaccctgagc

SEQ ID NO: 1706107 - DNA, 14 bp, Homo sapiens
aggggactcagccc

SEQ ID NO: 1706108 - DNA, 17 bp, Homo sapiens
aggggactcagccctga

SEQ ID NO: 1706109 - DNA, 12 bp, Homo sapiens
aggggagagaga

SEQ ID NO: 1706110 - DNA, 16 bp, Homo sapiens
aggggagagcctgctg

SEQ ID NO: 1706111 - DNA, 17 bp, Homo sapiens
aggggagccagctgctt

SEQ ID NO: 1706112 - DNA, 17 bp, Homo sapiens
aggggagcccactgtcc

SEQ ID NO: 1706113 - DNA, 24 bp, Homo sapiens
aggggagcccactgtcctgggcct

SEQ ID NO: 1706114 - DNA, 12 bp, Homo sapiens
aggggaggaaaa

SEQ ID NO: 1706115 - DNA, 13 bp, Homo sapiens
aggggaggaaaaa

SEQ ID NO: 1706116 - DNA, 15 bp, Homo sapiens
aggggaggaaaaaag

SEQ ID NO: 1706117 - DNA, 17 bp, Homo sapiens
aggggaggcacctccag

SEQ ID NO: 1706118 - DNA, 20 bp, Homo sapiens
aggggaggctgctttctgcc

SEQ ID NO: 1706119 - DNA, 16 bp, Homo sapiens
aggggaggggcctagg

SEQ ID NO: 1706120 - DNA, 12 bp, Homo sapiens
aggggagtagag

SEQ ID NO: 1706121 - DNA, 16 bp, Homo sapiens
aggggagttgtgtctg

SEQ ID NO: 1706122 - DNA, 14 bp, Homo sapiens
aggggatatttaag

SEQ ID NO: 1706123 - DNA, 20 bp, Homo sapiens
aggggatatttactgctctt

SEQ ID NO: 1706124 - DNA, 14 bp, Homo sapiens
aggggatccagcca

SEQ ID NO: 1706125 - DNA, 15 bp, Homo sapiens
aggggatccagccac

SEQ ID NO: 1706126 - DNA, 18 bp, Homo sapiens
aggggcaacgaagaaaaa

SEQ ID NO: 1706127 - DNA, 16 bp, Homo sapiens
aggggcacaccactgc

SEQ ID NO: 1706128 - DNA, 19 bp, Homo sapiens
aggggcacaccactgccct

SEQ ID NO: 1706129 - DNA, 14 bp, Homo sapiens
gaataacatgtaat

SEQ ID NO: 1706130 - DNA, 17 bp, Homo sapiens
gaataactacctcctca

SEQ ID NO: 1706131 - DNA, 16 bp, Homo sapiens
gaataagaatggagca

SEQ ID NO: 1706132 - DNA, 23 bp, Homo sapiens
gaataagacaagagatctacaca

SEQ ID NO: 1706133 - DNA, 19 bp, Homo sapiens
gaataagagtgattagagc

SEQ ID NO: 1706134 - DNA, 23 bp, Homo sapiens
gaataagctctagttcttaacaa

SEQ ID NO: 1706135 - DNA, 13 bp, Homo sapiens
gaataaggaggag

SEQ ID NO: 1706136 - DNA, 15 bp, Homo sapiens
gaataaggaggagga

SEQ ID NO: 1706137 - DNA, 19 bp, Homo sapiens
gaataataaaagtatatat

SEQ ID NO: 1706138 - DNA, 21 bp, Homo sapiens
gaataatcacgctttcctgaa

SEQ ID NO: 1706139 - DNA, 13 bp, Homo sapiens
gaataatgaaaat

SEQ ID NO: 1706140 - DNA, 15 bp, Homo sapiens
gaataatgaaaataa

SEQ ID NO: 1706141 - DNA, 14 bp, Homo sapiens
gaataatgaatgga

SEQ ID NO: 1706142 - DNA, 14 bp, Homo sapiens
gaataatttcttac

SEQ ID NO: 1706143 - DNA, 13 bp, Homo sapiens
gaatacatcagaa

SEQ ID NO: 1706144 - DNA, 16 bp, Homo sapiens
gaatacatcagaaaat

SEQ ID NO: 1706145 - DNA, 18 bp, Homo sapiens
gaatacatcagaaaataa

SEQ ID NO: 1706146 - DNA, 14 bp, Homo sapiens
gaatactcttgaaa

SEQ ID NO: 1706147 - DNA, 16 bp, Homo sapiens
gaatactgggttctta

SEQ ID NO: 1706148 - DNA, 15 bp, Homo sapiens
gaatagagctgccac

SEQ ID NO: 1706149 - DNA, 19 bp, Homo sapiens
gaatagagctgccactggg

SEQ ID NO: 1706150 - DNA, 18 bp, Homo sapiens
gaatagccagagaggagc

SEQ ID NO: 1706151 - DNA, 22 bp, Homo sapiens
gaatagggggatataatacata

SEQ ID NO: 1706152 - DNA, 18 bp, Homo sapiens
gaatagtgcttgctggcc

SEQ ID NO: 1706153 - DNA, 16 bp, Homo sapiens
gaatagttgagcccca

SEQ ID NO: 1706154 - DNA, 15 bp, Homo sapiens
gaatataaaacagtc

SEQ ID NO: 1706155 - DNA, 13 bp, Homo sapiens
gaatatagttatt

SEQ ID NO: 1706156 - DNA, 15 bp, Homo sapiens
gaatatatagaattc

SEQ ID NO: 1706157 - DNA, 20 bp, Homo sapiens
gaatatatctctatttgaga

SEQ ID NO: 1706158 - DNA, 12 bp, Homo sapiens
gaatatattata

SEQ ID NO: 1706159 - DNA, 21 bp, Homo sapiens
gaatatcagaagtatatctgt

SEQ ID NO: 1706160 - DNA, 17 bp, Homo sapiens
gaatatctgtaatggta

SEQ ID NO: 1706161 - DNA, 23 bp, Homo sapiens
gaatatgacaatctaccaactgt

SEQ ID NO: 1706162 - DNA, 20 bp, Homo sapiens
gaatatgacctaaatccatt

SEQ ID NO: 1706163 - DNA, 15 bp, Homo sapiens
gaatatgacggaaga

SEQ ID NO: 1706164 - DNA, 17 bp, Homo sapiens
gaatatggtggaaaata

SEQ ID NO: 1706165 - DNA, 22 bp, Homo sapiens
gaatatgttagaatcaaatact

SEQ ID NO: 1706166 - DNA, 14 bp, Homo sapiens
gaatatgtttcaaa

SEQ ID NO: 1706167 - DNA, 20 bp, Homo sapiens
gaatatgtttcaaactttgg

SEQ ID NO: 1706168 - DNA, 14 bp, Homo sapiens
gaatattaaaaaac

SEQ ID NO: 1706169 - DNA, 18 bp, Homo sapiens
gaatattaattagtttat

SEQ ID NO: 1706170 - DNA, 18 bp, Homo sapiens
gaatattcccaagcccat

SEQ ID NO: 1706171 - DNA, 17 bp, Homo sapiens
gaatattgatgttaaca

SEQ ID NO: 1706172 - DNA, 17 bp, Homo sapiens
gaatattgtgattctgt

SEQ ID NO: 1706173 - DNA, 18 bp, Homo sapiens
gaatattgtgattctgtt

SEQ ID NO: 1706174 - DNA, 12 bp, Homo sapiens
gaatatttacta

SEQ ID NO: 1706175 - DNA, 13 bp, Homo sapiens
gaatatttataac

SEQ ID NO: 1706176 - DNA, 15 bp, Homo sapiens
gaatatttataacag

SEQ ID NO: 1706177 - DNA, 13 bp, Homo sapiens
gaatatttattac

SEQ ID NO: 1706178 - DNA, 17 bp, Homo sapiens
gaatatttattacctct

SEQ ID NO: 1706179 - DNA, 21 bp, Homo sapiens
gaatatttattacctctgata

SEQ ID NO: 1706180 - DNA, 16 bp, Homo sapiens
gaatatttcaagctct

SEQ ID NO: 1706181 - DNA, 23 bp, Homo sapiens
gaatatttcaagctctgcaacag

SEQ ID NO: 1706182 - DNA, 14 bp, Homo sapiens
gaatattttcaaaa

SEQ ID NO: 1706183 - DNA, 19 bp, Homo sapiens
gaatatttttatatttcct

SEQ ID NO: 1706184 - DNA, 20 bp, Homo sapiens
gaatcaagatgtcagactgg

SEQ ID NO: 1706185 - DNA, 20 bp, Homo sapiens
gaatcacagtactttccagc

SEQ ID NO: 1706186 - DNA, 17 bp, Homo sapiens
gaatcacctgaacccca

SEQ ID NO: 1706187 - DNA, 19 bp, Homo sapiens
gaatcactgtgctcagcca

SEQ ID NO: 1706188 - DNA, 13 bp, Homo sapiens
gaatcagaactca

SEQ ID NO: 1706189 - DNA, 18 bp, Homo sapiens
agggggctttctggggcc

SEQ ID NO: 1706190 - DNA, 12 bp, Homo sapiens
aggggggctgtg

SEQ ID NO: 1706191 - DNA, 13 bp, Homo sapiens
aggggggctgtgc

SEQ ID NO: 1706192 - DNA, 20 bp, Homo sapiens
aggggggttgcagtggagag

SEQ ID NO: 1706193 - DNA, 16 bp, Homo sapiens
agggggtcccagtggg

SEQ ID NO: 1706194 - DNA, 13 bp, Homo sapiens
agggggtgactgg

SEQ ID NO: 1706195 - DNA, 23 bp, Homo sapiens
agggggtgattagagggaggaga

SEQ ID NO: 1706196 - DNA, 17 bp, Homo sapiens
agggggtgggggtgccg

SEQ ID NO: 1706197 - DNA, 12 bp, Homo sapiens
agggggttacaa

SEQ ID NO: 1706198 - DNA, 20 bp, Homo sapiens
agggggttacaaactgcaat

SEQ ID NO: 1706199 - DNA, 21 bp, Homo sapiens
agggggttcttattttgcatt

SEQ ID NO: 1706200 - DNA, 23 bp, Homo sapiens
aggggtacattctagctgagaag

SEQ ID NO: 1706201 - DNA, 21 bp, Homo sapiens
aggggtatcatgtatggtgat

SEQ ID NO: 1706202 - DNA, 16 bp, Homo sapiens
aggggtcaggctccat

SEQ ID NO: 1706203 - DNA, 15 bp, Homo sapiens
aggggtcccagccac

SEQ ID NO: 1706204 - DNA, 19 bp, Homo sapiens
aggggtcctcgggatgccg

SEQ ID NO: 1706205 - DNA, 18 bp, Homo sapiens
aggggtcctgcaggtcct

SEQ ID NO: 1706206 - DNA, 20 bp, Homo sapiens
aggggtcctgcaggtcctgg

SEQ ID NO: 1706207 - DNA, 16 bp, Homo sapiens
aggggtctccctggct

SEQ ID NO: 1706208 - DNA, 14 bp, Homo sapiens
aggggtgactgaac

SEQ ID NO: 1706209 - DNA, 22 bp, Homo sapiens
aggggtgcacccactcaccagg

SEQ ID NO: 1706210 - DNA, 13 bp, Homo sapiens
aggggtgccccct

SEQ ID NO: 1706211 - DNA, 21 bp, Homo sapiens
aggggtgccccctcctctccc

SEQ ID NO: 1706212 - DNA, 21 bp, Homo sapiens
aggggtgcgctcacctgcagc

SEQ ID NO: 1706213 - DNA, 23 bp, Homo sapiens
aggggtggaatgccgctgtctct

SEQ ID NO: 1706214 - DNA, 14 bp, Homo sapiens
aggggtggagaagt

SEQ ID NO: 1706215 - DNA, 17 bp, Homo sapiens
aggggtggagactgctt

SEQ ID NO: 1706216 - DNA, 17 bp, Homo sapiens
aggggtggccgggcaca

SEQ ID NO: 1706217 - DNA, 21 bp, Homo sapiens
aggggtggctgcctcatttag

SEQ ID NO: 1706218 - DNA, 13 bp, Homo sapiens
aggggtgggctgg

SEQ ID NO: 1706219 - DNA, 12 bp, Homo sapiens
aggggtggggag

SEQ ID NO: 1706220 - DNA, 14 bp, Homo sapiens
aggggtggggagct

SEQ ID NO: 1706221 - DNA, 21 bp, Homo sapiens
aggggtgggtcagaacatgtt

SEQ ID NO: 1706222 - DNA, 24 bp, Homo sapiens
aggggtggtggggggcagggccac

SEQ ID NO: 1706223 - DNA, 22 bp, Homo sapiens
aggggtgtcttgggcagagctg

SEQ ID NO: 1706224 - DNA, 15 bp, Homo sapiens
aggggtgtgggaaga

SEQ ID NO: 1706225 - DNA, 20 bp, Homo sapiens
aggggttcctcaaatttttt

SEQ ID NO: 1706226 - DNA, 20 bp, Homo sapiens
aggggttcttgagccagcca

SEQ ID NO: 1706227 - DNA, 15 bp, Homo sapiens
aggggttgagggaag

SEQ ID NO: 1706228 - DNA, 19 bp, Homo sapiens
aggggttggtcaaggccac

SEQ ID NO: 1706229 - DNA, 11 bp, Homo sapiens
agggtaaatca

SEQ ID NO: 1706230 - DNA, 15 bp, Homo sapiens
agggtaaggtgcctt

SEQ ID NO: 1706231 - DNA, 14 bp, Homo sapiens
agggtacagtttgg

SEQ ID NO: 1706232 - DNA, 19 bp, Homo sapiens
agggtactaaggaatcttt

SEQ ID NO: 1706233 - DNA, 22 bp, Homo sapiens
agggtagaatgattaatcaaag

SEQ ID NO: 1706234 - DNA, 22 bp, Homo sapiens
agggtagaattgtttggcaatg

SEQ ID NO: 1706235 - DNA, 13 bp, Homo sapiens
agggtaggaaagg

SEQ ID NO: 1706236 - DNA, 21 bp, Homo sapiens
agggtaggaggtttggatggg

SEQ ID NO: 1706237 - DNA, 21 bp, Homo sapiens
agggtatggactatctgtctg

SEQ ID NO: 1706238 - DNA, 14 bp, Homo sapiens
agggtatttgaccc

SEQ ID NO: 1706239 - DNA, 18 bp, Homo sapiens
agggtccaaccagacctg

SEQ ID NO: 1706240 - DNA, 14 bp, Homo sapiens
agggtccacctgga

SEQ ID NO: 1706241 - DNA, 15 bp, Homo sapiens
agggtccacctggag

SEQ ID NO: 1706242 - DNA, 13 bp, Homo sapiens
agggtccagaccc

SEQ ID NO: 1706243 - DNA, 16 bp, Homo sapiens
agggtccctcgcgccc

SEQ ID NO: 1706244 - DNA, 14 bp, Homo sapiens
gaatgaaatgtatg

SEQ ID NO: 1706245 - DNA, 11 bp, Homo sapiens
gaatgaagacc

SEQ ID NO: 1706246 - DNA, 16 bp, Homo sapiens
gaatgaagcagtattt

SEQ ID NO: 1706247 - DNA, 21 bp, Homo sapiens
gaatgaaggtttttgtaaaga

SEQ ID NO: 1706248 - DNA, 16 bp, Homo sapiens
gaatgaattaaataaa

SEQ ID NO: 1706249 - DNA, 15 bp, Homo sapiens
gaatgaatttatctt

SEQ ID NO: 1706250 - DNA, 16 bp, Homo sapiens
gaatgaatttatcttt

SEQ ID NO: 1706251 - DNA, 20 bp, Homo sapiens
gaatgaatttatctttacca

SEQ ID NO: 1706252 - DNA, 22 bp, Homo sapiens
gaatgactaagaggaaagtaca

SEQ ID NO: 1706253 - DNA, 14 bp, Homo sapiens
gaatgagagtgtga

SEQ ID NO: 1706254 - DNA, 11 bp, Homo sapiens
gaatgagcctc

SEQ ID NO: 1706255 - DNA, 13 bp, Homo sapiens
gaatgagcctcgg

SEQ ID NO: 1706256 - DNA, 16 bp, Homo sapiens
gaatgaggaaaattct

SEQ ID NO: 1706257 - DNA, 22 bp, Homo sapiens
gaatgaggtcccaggcagagaa

SEQ ID NO: 1706258 - DNA, 21 bp, Homo sapiens
gaatgagtctgttgtgtgtca

SEQ ID NO: 1706259 - DNA, 14 bp, Homo sapiens
gaatgagtttctta

SEQ ID NO: 1706260 - DNA, 16 bp, Homo sapiens
gaatgagtttcttaga

SEQ ID NO: 1706261 - DNA, 18 bp, Homo sapiens
gaatgagtttcttagact

SEQ ID NO: 1706262 - DNA, 14 bp, Homo sapiens
gaatgattaatcaa

SEQ ID NO: 1706263 - DNA, 14 bp, Homo sapiens
gaatgatttcatgc

SEQ ID NO: 1706264 - DNA, 19 bp, Homo sapiens
gaatgcaaccaagtcacac

SEQ ID NO: 1706265 - DNA, 12 bp, Homo sapiens
gaatgcaagagt

SEQ ID NO: 1706266 - DNA, 14 bp, Homo sapiens
gaatgcaatccttc

SEQ ID NO: 1706267 - DNA, 18 bp, Homo sapiens
gaatgcaccatggagacg

SEQ ID NO: 1706268 - DNA, 19 bp, Homo sapiens
gaatgcagaggtctccaaa

SEQ ID NO: 1706269 - DNA, 22 bp, Homo sapiens
gaatgcagattcctgggcctgt

SEQ ID NO: 1706270 - DNA, 16 bp, Homo sapiens
gaatgcagcaggaagg

SEQ ID NO: 1706271 - DNA, 21 bp, Homo sapiens
gaatgcagggaagagggcagt

SEQ ID NO: 1706272 - DNA, 14 bp, Homo sapiens
gaatgcagtacaga

SEQ ID NO: 1706273 - DNA, 19 bp, Homo sapiens
gaatgcattccctgaatct

SEQ ID NO: 1706274 - DNA, 22 bp, Homo sapiens
gaatgccatttagaatctagaa

SEQ ID NO: 1706275 - DNA, 17 bp, Homo sapiens
gaatgcccacaggcaaa

SEQ ID NO: 1706276 - DNA, 18 bp, Homo sapiens
gaatgccgctgtctctga

SEQ ID NO: 1706277 - DNA, 16 bp, Homo sapiens
gaatgcctcgctccct

SEQ ID NO: 1706278 - DNA, 17 bp, Homo sapiens
gaatgcctcgctccctt

SEQ ID NO: 1706279 - DNA, 20 bp, Homo sapiens
gaatgcctcgctcccttcaa

SEQ ID NO: 1706280 - DNA, 12 bp, Homo sapiens
gaatgcctgtgc

SEQ ID NO: 1706281 - DNA, 14 bp, Homo sapiens
gaatgcctgtgcca

SEQ ID NO: 1706282 - DNA, 21 bp, Homo sapiens
gaatgcggccgcattccctga

SEQ ID NO: 1706283 - DNA, 21 bp, Homo sapiens
gaatgctgcaggacttgagaa

SEQ ID NO: 1706284 - DNA, 11 bp, Homo sapiens
gaatgctgcca

SEQ ID NO: 1706285 - DNA, 15 bp, Homo sapiens
gaatgctgccagtgt

SEQ ID NO: 1706286 - DNA, 21 bp, Homo sapiens
gaatgctgcccgctctgcaga

SEQ ID NO: 1706287 - DNA, 14 bp, Homo sapiens
gaatgctgggactc

SEQ ID NO: 1706288 - DNA, 19 bp, Homo sapiens
gaatgctgggactcagcct

SEQ ID NO: 1706289 - DNA, 21 bp, Homo sapiens
gaatgcttttagtgtgtgcat

SEQ ID NO: 1706290 - DNA, 21 bp, Homo sapiens
gaatggaatcgatttcctccc

SEQ ID NO: 1706291 - DNA, 13 bp, Homo sapiens
gaatggagacaga

SEQ ID NO: 1706292 - DNA, 21 bp, Homo sapiens
gaatggagcagtacatgggaa

SEQ ID NO: 1706293 - DNA, 14 bp, Homo sapiens
gaatggagcctgct

SEQ ID NO: 1706294 - DNA, 17 bp, Homo sapiens
gaatggaggaagaacaa

SEQ ID NO: 1706295 - DNA, 15 bp, Homo sapiens
gaatggagtcttttc

SEQ ID NO: 1706296 - DNA, 21 bp, Homo sapiens
gaatggatcaatacacacaca

SEQ ID NO: 1706297 - DNA, 17 bp, Homo sapiens
gaatggatcacaagatg

SEQ ID NO: 1706298 - DNA, 14 bp, Homo sapiens
gaatggatgaggtg

SEQ ID NO: 1706299 - DNA, 20 bp, Homo sapiens
gaatggatggggagaatggt

SEQ ID NO: 1706300 - DNA, 21 bp, Homo sapiens
gaatggatttttctttaactg

SEQ ID NO: 1706301 - DNA, 24 bp, Homo sapiens
gaatggccctagaactgtgcctag

SEQ ID NO: 1706302 - DNA, 15 bp, Homo sapiens
gaatggctgggtcag

SEQ ID NO: 1706303 - DNA, 17 bp, Homo sapiens
gaatggctgggtcaggg

SEQ ID NO: 1706304 - DNA, 22 bp, Homo sapiens
gaatggggaactctccctctgg

SEQ ID NO: 1706305 - DNA, 13 bp, Homo sapiens
gaatgggggagag

SEQ ID NO: 1706306 - DNA, 20 bp, Homo sapiens
gaatggtacatgtcttccat

SEQ ID NO: 1706307 - DNA, 15 bp, Homo sapiens
gaatggtctttgctc

SEQ ID NO: 1706308 - DNA, 21 bp, Homo sapiens
agggtttcgactggtccagct

SEQ ID NO: 1706309 - DNA, 15 bp, Homo sapiens
agggtttgcactcca

SEQ ID NO: 1706310 - DNA, 14 bp, Homo sapiens
agggttttccaatg

SEQ ID NO: 1706311 - DNA, 18 bp, Homo sapiens
agggttttccaccctgga

SEQ ID NO: 1706312 - DNA, 19 bp, Homo sapiens
agggttttccaccctggaa

SEQ ID NO: 1706313 - DNA, 16 bp, Homo sapiens
agggttttcttttctt

SEQ ID NO: 1706314 - DNA, 17 bp, Homo sapiens
agggttttgcaataact

SEQ ID NO: 1706315 - DNA, 12 bp, Homo sapiens
agggttttgccc

SEQ ID NO: 1706316 - DNA, 13 bp, Homo sapiens
agggttttgcccc

SEQ ID NO: 1706317 - DNA, 14 bp, Homo sapiens
agggtttttagaga

SEQ ID NO: 1706318 - DNA, 14 bp, Homo sapiens
aggtaaataaaaag

SEQ ID NO: 1706319 - DNA, 22 bp, Homo sapiens
aggtaaatctagagtttataca

SEQ ID NO: 1706320 - DNA, 15 bp, Homo sapiens
aggtaagaagtttta

SEQ ID NO: 1706321 - DNA, 22 bp, Homo sapiens
aggtaagaagttttaaaaagcc

SEQ ID NO: 1706322 - DNA, 18 bp, Homo sapiens
aggtaatgaagctatttg

SEQ ID NO: 1706323 - DNA, 16 bp, Homo sapiens
aggtaatgtgaataaa

SEQ ID NO: 1706324 - DNA, 16 bp, Homo sapiens
aggtacaactgtattt

SEQ ID NO: 1706325 - DNA, 22 bp, Homo sapiens
aggtacagcaacaggaatctca

SEQ ID NO: 1706326 - DNA, 14 bp, Homo sapiens
aggtacaggagagg

SEQ ID NO: 1706327 - DNA, 20 bp, Homo sapiens
aggtaccaaacaaggaagcc

SEQ ID NO: 1706328 - DNA, 21 bp, Homo sapiens
aggtaccaaacaaggaagcca

SEQ ID NO: 1706329 - DNA, 21 bp, Homo sapiens
aggtaccactgatttggagat

SEQ ID NO: 1706330 - DNA, 14 bp, Homo sapiens
aggtaccctgggtg

SEQ ID NO: 1706331 - DNA, 20 bp, Homo sapiens
aggtaccctgggtgtccccg

SEQ ID NO: 1706332 - DNA, 16 bp, Homo sapiens
aggtaccgatttctgc

SEQ ID NO: 1706333 - DNA, 13 bp, Homo sapiens
aggtactctcctg

SEQ ID NO: 1706334 - DNA, 23 bp, Homo sapiens
aggtactgtctgcttctctctct

SEQ ID NO: 1706335 - DNA, 13 bp, Homo sapiens
aggtacttcctcc

SEQ ID NO: 1706336 - DNA, 19 bp, Homo sapiens
aggtacttcctcctgatgg

SEQ ID NO: 1706337 - DNA, 19 bp, Homo sapiens
aggtagaaatatctgaaaa

SEQ ID NO: 1706338 - DNA, 22 bp, Homo sapiens
aggtagaattatctaatttata

SEQ ID NO: 1706339 - DNA, 21 bp, Homo sapiens
aggtagatcgcttgagcccag

SEQ ID NO: 1706340 - DNA, 19 bp, Homo sapiens
aggtagcccagcactgtga

SEQ ID NO: 1706341 - DNA, 20 bp, Homo sapiens
aggtaggcccttgtcctgcc

SEQ ID NO: 1706342 - DNA, 20 bp, Homo sapiens
aggtagtattacaccaccgg

SEQ ID NO: 1706343 - DNA, 11 bp, Homo sapiens
aggtataattt

SEQ ID NO: 1706344 - DNA, 15 bp, Homo sapiens
aggtataattttatg

SEQ ID NO: 1706345 - DNA, 16 bp, Homo sapiens
aggtatatagaacaca

SEQ ID NO: 1706346 - DNA, 18 bp, Homo sapiens
aggtatatcattctaaag

SEQ ID NO: 1706347 - DNA, 22 bp, Homo sapiens
aggtatatcattctaaagatag

SEQ ID NO: 1706348 - DNA, 14 bp, Homo sapiens
aggtatgttgcctt

SEQ ID NO: 1706349 - DNA, 20 bp, Homo sapiens
aggtattaaaactaaatttc

SEQ ID NO: 1706350 - DNA, 13 bp, Homo sapiens
aggtattaagatt

SEQ ID NO: 1706351 - DNA, 22 bp, Homo sapiens
aggtattacaagtaatgtaaag

SEQ ID NO: 1706352 - DNA, 20 bp, Homo sapiens
aggtatttaaagtattttct

SEQ ID NO: 1706353 - DNA, 15 bp, Homo sapiens
aggtcaaacaggctg

SEQ ID NO: 1706354 - DNA, 17 bp, Homo sapiens
aggtcaaacaggctgta

SEQ ID NO: 1706355 - DNA, 19 bp, Homo sapiens
aggtcaacagagaaggcag

SEQ ID NO: 1706356 - DNA, 20 bp, Homo sapiens
aggtcaagggcttactattt

SEQ ID NO: 1706357 - DNA, 17 bp, Homo sapiens
aggtcaagtaagaagac

SEQ ID NO: 1706358 - DNA, 22 bp, Homo sapiens
aggtcaagtaagaagacatgaa

SEQ ID NO: 1706359 - DNA, 20 bp, Homo sapiens
gaattatgtaatatattgta

SEQ ID NO: 1706360 - DNA, 20 bp, Homo sapiens
gaattattctgattcttttt

SEQ ID NO: 1706361 - DNA, 19 bp, Homo sapiens
gaattatttttttaaagtg

SEQ ID NO: 1706362 - DNA, 18 bp, Homo sapiens
gaattcaaactggggcct

SEQ ID NO: 1706363 - DNA, 22 bp, Homo sapiens
gaattcaaactggggcctccag

SEQ ID NO: 1706364 - DNA, 17 bp, Homo sapiens
gaattcaagaaaggaaa

SEQ ID NO: 1706365 - DNA, 18 bp, Homo sapiens
gaattcactccagtcaac

SEQ ID NO: 1706366 - DNA, 23 bp, Homo sapiens
gaattcagaagacccctgactca

SEQ ID NO: 1706367 - DNA, 12 bp, Homo sapiens
gaattcataaaa

SEQ ID NO: 1706368 - DNA, 18 bp, Homo sapiens
gaattcataaaaataacc

SEQ ID NO: 1706369 - DNA, 17 bp, Homo sapiens
gaattccacagggacca

SEQ ID NO: 1706370 - DNA, 17 bp, Homo sapiens
gaattccataatacata

SEQ ID NO: 1706371 - DNA, 14 bp, Homo sapiens
gaattccatcttgt

SEQ ID NO: 1706372 - DNA, 14 bp, Homo sapiens
gaattccctccccc

SEQ ID NO: 1706373 - DNA, 15 bp, Homo sapiens
gaattccctccccct

SEQ ID NO: 1706374 - DNA, 18 bp, Homo sapiens
gaattcctaacttttcaa

SEQ ID NO: 1706375 - DNA, 18 bp, Homo sapiens
gaattcctcctctattta

SEQ ID NO: 1706376 - DNA, 14 bp, Homo sapiens
gaattcctctttaa

SEQ ID NO: 1706377 - DNA, 16 bp, Homo sapiens
gaattcctcttttgct

SEQ ID NO: 1706378 - DNA, 21 bp, Homo sapiens
gaattcctcttttgcttaaat

SEQ ID NO: 1706379 - DNA, 22 bp, Homo sapiens
gaattccttcgaaaggccttca

SEQ ID NO: 1706380 - DNA, 22 bp, Homo sapiens
gaattctaacattaaatcacag

SEQ ID NO: 1706381 - DNA, 16 bp, Homo sapiens
gaattctagtgctgct

SEQ ID NO: 1706382 - DNA, 16 bp, Homo sapiens
gaattctatttgaagc

SEQ ID NO: 1706383 - DNA, 14 bp, Homo sapiens
gaattctgaagttt

SEQ ID NO: 1706384 - DNA, 19 bp, Homo sapiens
gaattctgctacctcactg

SEQ ID NO: 1706385 - DNA, 14 bp, Homo sapiens
gaattcttctgcaa

SEQ ID NO: 1706386 - DNA, 18 bp, Homo sapiens
gaattcttctgcaacatt

SEQ ID NO: 1706387 - DNA, 17 bp, Homo sapiens
gaattcttgataaatga

SEQ ID NO: 1706388 - DNA, 14 bp, Homo sapiens
gaattgaaaagttt

SEQ ID NO: 1706389 - DNA, 21 bp, Homo sapiens
gaattgaaataaggagggaca

SEQ ID NO: 1706390 - DNA, 16 bp, Homo sapiens
gaattgaacccaggag

SEQ ID NO: 1706391 - DNA, 14 bp, Homo sapiens
gaattgagctgcag

SEQ ID NO: 1706392 - DNA, 21 bp, Homo sapiens
gaattgatcattttcccccca

SEQ ID NO: 1706393 - DNA, 14 bp, Homo sapiens
gaattgctttatgg

SEQ ID NO: 1706394 - DNA, 13 bp, Homo sapiens
gaattgtctttta

SEQ ID NO: 1706395 - DNA, 18 bp, Homo sapiens
gaattgtgaccaagttat

SEQ ID NO: 1706396 - DNA, 20 bp, Homo sapiens
gaattgttagcaaatgacag

SEQ ID NO: 1706397 - DNA, 22 bp, Homo sapiens
gaattgttgagatactttacta

SEQ ID NO: 1706398 - DNA, 15 bp, Homo sapiens
gaatttaaaactgtt

SEQ ID NO: 1706399 - DNA, 22 bp, Homo sapiens
gaatttaactactaagaataaa

SEQ ID NO: 1706400 - DNA, 16 bp, Homo sapiens
gaatttacttccttgc

SEQ ID NO: 1706401 - DNA, 23 bp, Homo sapiens
gaatttaggggaaaaaaaagtta

SEQ ID NO: 1706402 - DNA, 18 bp, Homo sapiens
gaatttagtattatcaaa

SEQ ID NO: 1706403 - DNA, 16 bp, Homo sapiens
gaatttatctttacca

SEQ ID NO: 1706404 - DNA, 17 bp, Homo sapiens
gaatttatctttaccaa

SEQ ID NO: 1706405 - DNA, 15 bp, Homo sapiens
gaatttatctttgat

SEQ ID NO: 1706406 - DNA, 16 bp, Homo sapiens
gaatttatctttgata

SEQ ID NO: 1706407 - DNA, 18 bp, Homo sapiens
gaatttattagtttaaaa

SEQ ID NO: 1706408 - DNA, 13 bp, Homo sapiens
gaatttattcaat

SEQ ID NO: 1706409 - DNA, 21 bp, Homo sapiens
gaatttcacctgtaaacctga

SEQ ID NO: 1706410 - DNA, 18 bp, Homo sapiens
gaatttcaggcattttgt

SEQ ID NO: 1706411 - DNA, 15 bp, Homo sapiens
gaatttcccaggacc

SEQ ID NO: 1706412 - DNA, 16 bp, Homo sapiens
gaatttcccaggaccc

SEQ ID NO: 1706413 - DNA, 22 bp, Homo sapiens
gaatttctggaagattcttact

SEQ ID NO: 1706414 - DNA, 16 bp, Homo sapiens
gaatttcttaacttct

SEQ ID NO: 1706415 - DNA, 20 bp, Homo sapiens
gaatttctttgtcattcaag

SEQ ID NO: 1706416 - DNA, 19 bp, Homo sapiens
gaatttgaagctgcagtga

SEQ ID NO: 1706417 - DNA, 22 bp, Homo sapiens
gaatttgacctaggcaagtttg

SEQ ID NO: 1706418 - DNA, 23 bp, Homo sapiens
gaatttgatcgttccagttccca

SEQ ID NO: 1706419 - DNA, 12 bp, Homo sapiens
gaatttgctaaa

SEQ ID NO: 1706420 - DNA, 19 bp, Homo sapiens
gaatttggcctgcactaat

SEQ ID NO: 1706421 - DNA, 16 bp, Homo sapiens
gaatttgtattaaaaa

SEQ ID NO: 1706422 - DNA, 22 bp, Homo sapiens
gaatttgttcttaaaaaaataa

SEQ ID NO: 1706423 - DNA, 13 bp, Homo sapiens
gaattttaaagta

SEQ ID NO: 1706424 - DNA, 15 bp, Homo sapiens
gaattttaaagtatg

SEQ ID NO: 1706425 - DNA, 11 bp, Homo sapiens
gaaagaagcaa

SEQ ID NO: 1706426 - DNA, 13 bp, Homo sapiens
gaaagaattattt

SEQ ID NO: 1706427 - DNA, 13 bp, Homo sapiens
gaaagacaaactg

SEQ ID NO: 1706428 - DNA, 18 bp, Homo sapiens
gaaagacactgcctgggc

SEQ ID NO: 1706429 - DNA, 20 bp, Homo sapiens
gaaagacactgcctgggctg

SEQ ID NO: 1706430 - DNA, 21 bp, Homo sapiens
gaaagacggattgcattagaa

SEQ ID NO: 1706431 - DNA, 14 bp, Homo sapiens
gaaagactgagctc

SEQ ID NO: 1706432 - DNA, 17 bp, Homo sapiens
gaaagactgtacaaagt

SEQ ID NO: 1706433 - DNA, 11 bp, Homo sapiens
gaaagagacca

SEQ ID NO: 1706434 - DNA, 17 bp, Homo sapiens
gaaagagagaagccagc

SEQ ID NO: 1706435 - DNA, 20 bp, Homo sapiens
gaaagagagaagccagccac

SEQ ID NO: 1706436 - DNA, 13 bp, Homo sapiens
gaaagagatttaa

SEQ ID NO: 1706437 - DNA, 14 bp, Homo sapiens
gaaagagctgcctg

SEQ ID NO: 1706438 - DNA, 19 bp, Homo sapiens
gaaagagctgcctggatga

SEQ ID NO: 1706439 - DNA, 13 bp, Homo sapiens
gaaagaggaagca

SEQ ID NO: 1706440 - DNA, 21 bp, Homo sapiens
gaaagaggcaccaggaagccg

SEQ ID NO: 1706441 - DNA, 14 bp, Homo sapiens
gaaagaggccagac

SEQ ID NO: 1706442 - DNA, 20 bp, Homo sapiens
gaaagaggctgaggcctgga

SEQ ID NO: 1706443 - DNA, 20 bp, Homo sapiens
gaaagaggtaaaattctcta

SEQ ID NO: 1706444 - DNA, 15 bp, Homo sapiens
gaaagatacagacat

SEQ ID NO: 1706445 - DNA, 16 bp, Homo sapiens
gaaagatggataaact

SEQ ID NO: 1706446 - DNA, 22 bp, Homo sapiens
gaaagatggataaactgagcct

SEQ ID NO: 1706447 - DNA, 17 bp, Homo sapiens
gaaagatttgttactgt

SEQ ID NO: 1706448 - DNA, 21 bp, Homo sapiens
gaaagatttgttactgtattt

SEQ ID NO: 1706449 - DNA, 19 bp, Homo sapiens
gaaagattttattgtataa

SEQ ID NO: 1706450 - DNA, 13 bp, Homo sapiens
gaaagcaaaatac

SEQ ID NO: 1706451 - DNA, 15 bp, Homo sapiens
gaaagcaaaatacat

SEQ ID NO: 1706452 - DNA, 14 bp, Homo sapiens
gaaagcaaagggct

SEQ ID NO: 1706453 - DNA, 22 bp, Homo sapiens
gaaagcaacaaagattgagaag

SEQ ID NO: 1706454 - DNA, 16 bp, Homo sapiens
gaaagcacatgaataa

SEQ ID NO: 1706455 - DNA, 21 bp, Homo sapiens
gaaagcactacaatcatggtc

SEQ ID NO: 1706456 - DNA, 21 bp, Homo sapiens
gaaagcacttaaacagaagca

SEQ ID NO: 1706457 - DNA, 15 bp, Homo sapiens
gaaagcagaatcaac

SEQ ID NO: 1706458 - DNA, 14 bp, Homo sapiens
gaaagcagcagcta

SEQ ID NO: 1706459 - DNA, 14 bp, Homo sapiens
gaaagcagctgaac

SEQ ID NO: 1706460 - DNA, 12 bp, Homo sapiens
gaaagcaggagc

SEQ ID NO: 1706461 - DNA, 16 bp, Homo sapiens
gaaagcaggagcagct

SEQ ID NO: 1706462 - DNA, 15 bp, Homo sapiens
gaaagcatatgcagc

SEQ ID NO: 1706463 - DNA, 23 bp, Homo sapiens
gaaagcatatgggttagatgttg

SEQ ID NO: 1706464 - DNA, 17 bp, Homo sapiens
gaaagcatcacctcagg

SEQ ID NO: 1706465 - DNA, 19 bp, Homo sapiens
gaaagcatcacctcaggcc

SEQ ID NO: 1706466 - DNA, 21 bp, Homo sapiens
gaaagcatgtggcatgttcat

SEQ ID NO: 1706467 - DNA, 19 bp, Homo sapiens
gaaagcccaaggtgctgat

SEQ ID NO: 1706468 - DNA, 14 bp, Homo sapiens
gaaagccccagcac

SEQ ID NO: 1706469 - DNA, 18 bp, Homo sapiens
gaaagcctccgctgggct

SEQ ID NO: 1706470 - DNA, 19 bp, Homo sapiens
gaaagcctccgctgggctt

SEQ ID NO: 1706471 - DNA, 15 bp, Homo sapiens
gaaagcctctgctgc

SEQ ID NO: 1706472 - DNA, 16 bp, Homo sapiens
gaaagcctctgctgcc

SEQ ID NO: 1706473 - DNA, 14 bp, Homo sapiens
gaaagcctctggcc

SEQ ID NO: 1706474 - DNA, 15 bp, Homo sapiens
gaaagccttaaaaat

SEQ ID NO: 1706475 - DNA, 16 bp, Homo sapiens
gaaagccttagggaag

SEQ ID NO: 1706476 - DNA, 22 bp, Homo sapiens
gaaagcctttcattttgcttta

SEQ ID NO: 1706477 - DNA, 16 bp, Homo sapiens
gaaagcggcgccacag

SEQ ID NO: 1706478 - DNA, 13 bp, Homo sapiens
gaaagctagagat

SEQ ID NO: 1706479 - DNA, 16 bp, Homo sapiens
gaaagctagagatatg

SEQ ID NO: 1706480 - DNA, 14 bp, Homo sapiens
gaaagctatatcta

SEQ ID NO: 1706481 - DNA, 12 bp, Homo sapiens
gaaagctctaga

SEQ ID NO: 1706482 - DNA, 22 bp, Homo sapiens
gaaagctgattactgtcaataa

SEQ ID NO: 1706483 - DNA, 21 bp, Homo sapiens
gaaagctgctgtgatcccagt

SEQ ID NO: 1706484 - DNA, 13 bp, Homo sapiens
gaaagctggactg

SEQ ID NO: 1706485 - DNA, 15 bp, Homo sapiens
gaaagctggactgac

SEQ ID NO: 1706486 - DNA, 22 bp, Homo sapiens
gaaagctttattttgagatgta

SEQ ID NO: 1706487 - DNA, 21 bp, Homo sapiens
gaaaggaaaaaagaaaaaagc

SEQ ID NO: 1706488 - DNA, 23 bp, Homo sapiens
gaaaggaagcattgtaaaataat

SEQ ID NO: 1706489 - DNA, 15 bp, Homo sapiens
gaaaggacagagcca

SEQ ID NO: 1706490 - DNA, 16 bp, Homo sapiens
gaaaggacagagccag

SEQ ID NO: 1706491 - DNA, 17 bp, Homo sapiens
gaaaggacagagccagc

SEQ ID NO: 1706492 - DNA, 13 bp, Homo sapiens
gaaaggacccacc

SEQ ID NO: 1706493 - DNA, 20 bp, Homo sapiens
gaaaggatatttaagaaaat

SEQ ID NO: 1706494 - DNA, 21 bp, Homo sapiens
gaaaggatctgtgattggctg

SEQ ID NO: 1706495 - DNA, 20 bp, Homo sapiens
gaaaggatgtaaacagtgcc

SEQ ID NO: 1706496 - DNA, 14 bp, Homo sapiens
gaaaggattttacc

SEQ ID NO: 1706497 - DNA, 19 bp, Homo sapiens
gaaaggattttaccaaagc

SEQ ID NO: 1706498 - DNA, 14 bp, Homo sapiens
gaaaggcagacaca

SEQ ID NO: 1706499 - DNA, 17 bp, Homo sapiens
gaaaggcattctctgaa

SEQ ID NO: 1706500 - DNA, 16 bp, Homo sapiens
gaaaggcctgtgggga

SEQ ID NO: 1706501 - DNA, 18 bp, Homo sapiens
gaaaggcctgtggggagc

SEQ ID NO: 1706502 - DNA, 20 bp, Homo sapiens
gaaaggcctgtggggagccg

SEQ ID NO: 1706503 - DNA, 22 bp, Homo sapiens
gaaaggcctgtggggagccgag

SEQ ID NO: 1706504 - DNA, 16 bp, Homo sapiens
gaaaggccttcagaca

SEQ ID NO: 1706505 - DNA, 21 bp, Homo sapiens
gaaaggccttcagacacatgc

SEQ ID NO: 1706506 - DNA, 19 bp, Homo sapiens
gaaaggctcagtctcagga

SEQ ID NO: 1706507 - DNA, 21 bp, Homo sapiens
gaaaggctcagtctcaggagc

SEQ ID NO: 1706508 - DNA, 17 bp, Homo sapiens
gaaaggctcatttaaaa

SEQ ID NO: 1706509 - DNA, 14 bp, Homo sapiens
aggcctttaaccat

SEQ ID NO: 1706510 - DNA, 11 bp, Homo sapiens
aggcctttctt

SEQ ID NO: 1706511 - DNA, 15 bp, Homo sapiens
aggcctttcttctgt

SEQ ID NO: 1706512 - DNA, 19 bp, Homo sapiens
aggcctttcttctgtgtta

SEQ ID NO: 1706513 - DNA, 14 bp, Homo sapiens
aggcgagccaggca

SEQ ID NO: 1706514 - DNA, 15 bp, Homo sapiens
aggcgagccaggcaa

SEQ ID NO: 1706515 - DNA, 14 bp, Homo sapiens
aggcgccggcgggc

SEQ ID NO: 1706516 - DNA, 23 bp, Homo sapiens
aggcgcctataatcccagctact

SEQ ID NO: 1706517 - DNA, 24 bp, Homo sapiens
aggcgcctataatcccagctactg

SEQ ID NO: 1706518 - DNA, 17 bp, Homo sapiens
aggcgcgtttgtgcata

SEQ ID NO: 1706519 - DNA, 14 bp, Homo sapiens
aggcgctaatttat

SEQ ID NO: 1706520 - DNA, 13 bp, Homo sapiens
aggcggcagctgg

SEQ ID NO: 1706521 - DNA, 14 bp, Homo sapiens
aggcggcagctggg

SEQ ID NO: 1706522 - DNA, 20 bp, Homo sapiens
aggcggcccggccagcgggc

SEQ ID NO: 1706523 - DNA, 21 bp, Homo sapiens
aggcggcctttgttgctcagc

SEQ ID NO: 1706524 - DNA, 21 bp, Homo sapiens
aggcgggatttatgtgcactg

SEQ ID NO: 1706525 - DNA, 13 bp, Homo sapiens
aggcgggccagcc

SEQ ID NO: 1706526 - DNA, 17 bp, Homo sapiens
aggcgggccagccaggc

SEQ ID NO: 1706527 - DNA, 14 bp, Homo sapiens
aggcgggcttggaa

SEQ ID NO: 1706528 - DNA, 19 bp, Homo sapiens
aggcggggtattcccactc

SEQ ID NO: 1706529 - DNA, 17 bp, Homo sapiens
aggcggtcatgtgtgca

SEQ ID NO: 1706530 - DNA, 21 bp, Homo sapiens
aggcggtcatgtgtgcatgtg

SEQ ID NO: 1706531 - DNA, 16 bp, Homo sapiens
aggcgtgcccccctcc

SEQ ID NO: 1706532 - DNA, 16 bp, Homo sapiens
aggcgttagtgggcag

SEQ ID NO: 1706533 - DNA, 18 bp, Homo sapiens
aggcgttagtgggcaggt

SEQ ID NO: 1706534 - DNA, 19 bp, Homo sapiens
aggcgttcttcgaggtgga

SEQ ID NO: 1706535 - DNA, 18 bp, Homo sapiens
aggctaaaaggtcttgca

SEQ ID NO: 1706536 - DNA, 19 bp, Homo sapiens
aggctaaattactcaggaa

SEQ ID NO: 1706537 - DNA, 14 bp, Homo sapiens
aggctaagaccctg

SEQ ID NO: 1706538 - DNA, 20 bp, Homo sapiens
aggctaagaccctgtgtcct

SEQ ID NO: 1706539 - DNA, 22 bp, Homo sapiens
aggctaagatgagatttgccag

SEQ ID NO: 1706540 - DNA, 23 bp, Homo sapiens
aggctaagatgagatttgccagc

SEQ ID NO: 1706541 - DNA, 21 bp, Homo sapiens
aggctaattcagtgtcacatg

SEQ ID NO: 1706542 - DNA, 21 bp, Homo sapiens
aggctacctcacctgggcagg

SEQ ID NO: 1706543 - DNA, 18 bp, Homo sapiens
aggctagcttctgctttt

SEQ ID NO: 1706544 - DNA, 13 bp, Homo sapiens
gaaagttggaaag

SEQ ID NO: 1706545 - DNA, 22 bp, Homo sapiens
gaaagttgtaaaatagaaaaag

SEQ ID NO: 1706546 - DNA, 18 bp, Homo sapiens
gaaagtttttttttatta

SEQ ID NO: 1706547 - DNA, 21 bp, Homo sapiens
gaaataaaaaaaaaaggatga

SEQ ID NO: 1706548 - DNA, 14 bp, Homo sapiens
gaaataaagtcaga

SEQ ID NO: 1706549 - DNA, 19 bp, Homo sapiens
gaaataaagtcagatggaa

SEQ ID NO: 1706550 - DNA, 17 bp, Homo sapiens
gaaataaagtttgctta

SEQ ID NO: 1706551 - DNA, 19 bp, Homo sapiens
gaaataaataaaaatgcat

SEQ ID NO: 1706552 - DNA, 21 bp, Homo sapiens
gaaataaatgtatcatagaaa

SEQ ID NO: 1706553 - DNA, 12 bp, Homo sapiens
gaaataaatgtt

SEQ ID NO: 1706554 - DNA, 14 bp, Homo sapiens
gaaataacagagag

SEQ ID NO: 1706555 - DNA, 14 bp, Homo sapiens
gaaataactgcctt

SEQ ID NO: 1706556 - DNA, 16 bp, Homo sapiens
gaaataagaaaaatca

SEQ ID NO: 1706557 - DNA, 15 bp, Homo sapiens
gaaataataaaaaat

SEQ ID NO: 1706558 - DNA, 14 bp, Homo sapiens
gaaataataaatct

SEQ ID NO: 1706559 - DNA, 16 bp, Homo sapiens
gaaataatagggaaaa

SEQ ID NO: 1706560 - DNA, 16 bp, Homo sapiens
gaaataatatatttct

SEQ ID NO: 1706561 - DNA, 18 bp, Homo sapiens
gaaataatatatttcttc

SEQ ID NO: 1706562 - DNA, 19 bp, Homo sapiens
gaaataatatatttcttct

SEQ ID NO: 1706563 - DNA, 13 bp, Homo sapiens
gaaataatatgca

SEQ ID NO: 1706564 - DNA, 14 bp, Homo sapiens
gaaataattacaga

SEQ ID NO: 1706565 - DNA, 19 bp, Homo sapiens
gaaataattacagaatata

SEQ ID NO: 1706566 - DNA, 16 bp, Homo sapiens
gaaataatttgaatgt

SEQ ID NO: 1706567 - DNA, 21 bp, Homo sapiens
gaaatacaattctacattgtc

SEQ ID NO: 1706568 - DNA, 14 bp, Homo sapiens
gaaatacataaaaa

SEQ ID NO: 1706569 - DNA, 22 bp, Homo sapiens
gaaataccacaagcctgagaac

SEQ ID NO: 1706570 - DNA, 19 bp, Homo sapiens
gaaatactactcctgtaat

SEQ ID NO: 1706571 - DNA, 20 bp, Homo sapiens
gaaatactagatttgggaga

SEQ ID NO: 1706572 - DNA, 15 bp, Homo sapiens
gaaatactgctctga

SEQ ID NO: 1706573 - DNA, 22 bp, Homo sapiens
gaaatactgctctgaatatttt

SEQ ID NO: 1706574 - DNA, 19 bp, Homo sapiens
gaaatacttaacacgtgaa

SEQ ID NO: 1706575 - DNA, 15 bp, Homo sapiens
gaaatacttgtgatt

SEQ ID NO: 1706576 - DNA, 16 bp, Homo sapiens
gaaatagaattataac

SEQ ID NO: 1706577 - DNA, 15 bp, Homo sapiens
gaaataggaaacaag

SEQ ID NO: 1706578 - DNA, 18 bp, Homo sapiens
gaaataggaaacaagtga

SEQ ID NO: 1706579 - DNA, 18 bp, Homo sapiens
gaaatagttcaaagccaa

SEQ ID NO: 1706580 - DNA, 15 bp, Homo sapiens
gaaatatagtgcaat

SEQ ID NO: 1706581 - DNA, 21 bp, Homo sapiens
gaaatatcagttactcagccc

SEQ ID NO: 1706582 - DNA, 19 bp, Homo sapiens
gaaatatcgctgatgcaga

SEQ ID NO: 1706583 - DNA, 23 bp, Homo sapiens
gaaatatcgctgatgcagacaca

SEQ ID NO: 1706584 - DNA, 14 bp, Homo sapiens
gaaatatctgtatt

SEQ ID NO: 1706585 - DNA, 15 bp, Homo sapiens
gaaatatctttctct

SEQ ID NO: 1706586 - DNA, 13 bp, Homo sapiens
gaaatatgcatct

SEQ ID NO: 1706587 - DNA, 15 bp, Homo sapiens
gaaatattcagaaat

SEQ ID NO: 1706588 - DNA, 20 bp, Homo sapiens
gaaatattttaaaatcagct

SEQ ID NO: 1706589 - DNA, 17 bp, Homo sapiens
gaaatcaaatatgcaaa

SEQ ID NO: 1706590 - DNA, 18 bp, Homo sapiens
gaaatcaaatatgcaaag

SEQ ID NO: 1706591 - DNA, 21 bp, Homo sapiens
gaaatcaaatatgcaaagcac

SEQ ID NO: 1706592 - DNA, 23 bp, Homo sapiens
gaaatcaaatatgcaaagcactg

SEQ ID NO: 1706593 - DNA, 15 bp, Homo sapiens
gaaatcaaatgtatg

SEQ ID NO: 1706594 - DNA, 16 bp, Homo sapiens
gaaatcaatgcaagag

SEQ ID NO: 1706595 - DNA, 15 bp, Homo sapiens
gaaatcacaggggcg

SEQ ID NO: 1706596 - DNA, 17 bp, Homo sapiens
gaaatcacaggggcggg

SEQ ID NO: 1706597 - DNA, 18 bp, Homo sapiens
gaaatcagtaatatttat

SEQ ID NO: 1706598 - DNA, 17 bp, Homo sapiens
gaaatcagtttctcaaa

SEQ ID NO: 1706599 - DNA, 16 bp, Homo sapiens
gaaatcattgtagaaa

SEQ ID NO: 1706600 - DNA, 11 bp, Homo sapiens
gaaatccagat

SEQ ID NO: 1706601 - DNA, 19 bp, Homo sapiens
gaaatccatatatatgaaa

SEQ ID NO: 1706602 - DNA, 14 bp, Homo sapiens
gaaatctggcccag

SEQ ID NO: 1706603 - DNA, 17 bp, Homo sapiens
gaaatctgtaaagccag

SEQ ID NO: 1706604 - DNA, 18 bp, Homo sapiens
gaaatctgtaaagccagt

SEQ ID NO: 1706605 - DNA, 15 bp, Homo sapiens
gaaatgaaagggaaa

SEQ ID NO: 1706606 - DNA, 19 bp, Homo sapiens
gaaatgacggtgttaattt

SEQ ID NO: 1706607 - DNA, 21 bp, Homo sapiens
gaaatgatgttggtccaaagt

SEQ ID NO: 1706608 - DNA, 23 bp, Homo sapiens
gaaatgattcaaattgctgcttg

SEQ ID NO: 1706609 - DNA, 14 bp, Homo sapiens
gaaatgcaaaaatc

SEQ ID NO: 1706610 - DNA, 18 bp, Homo sapiens
gaaatgctcttttgcaca

SEQ ID NO: 1706611 - DNA, 17 bp, Homo sapiens
gaaatgctgcattttaa

SEQ ID NO: 1706612 - DNA, 13 bp, Homo sapiens
gaaatgctgcctg

SEQ ID NO: 1706613 - DNA, 15 bp, Homo sapiens
gaaatgctgcctgcc

SEQ ID NO: 1706614 - DNA, 13 bp, Homo sapiens
gaaatggctgggg

SEQ ID NO: 1706615 - DNA, 16 bp, Homo sapiens
gaaatggcttttctta

SEQ ID NO: 1706616 - DNA, 19 bp, Homo sapiens
gaaatgggaaaaaacttaa

SEQ ID NO: 1706617 - DNA, 22 bp, Homo sapiens
gaaatgtaagggaaactgccag

SEQ ID NO: 1706618 - DNA, 22 bp, Homo sapiens
gaaatgtacactaccaaacact

SEQ ID NO: 1706619 - DNA, 22 bp, Homo sapiens
gaaatgtagaattgaaaatgca

SEQ ID NO: 1706620 - DNA, 13 bp, Homo sapiens
gaaatgtcataaa

SEQ ID NO: 1706621 - DNA, 14 bp, Homo sapiens
gaaatgtcataaat

SEQ ID NO: 1706622 - DNA, 20 bp, Homo sapiens
gaaatgtgaatttttattgt

SEQ ID NO: 1706623 - DNA, 13 bp, Homo sapiens
gaaatgtgtttct

SEQ ID NO: 1706624 - DNA, 15 bp, Homo sapiens
gaaaatatttaatat

SEQ ID NO: 1706625 - DNA, 19 bp, Homo sapiens
gaaaatatttcctgacttg

SEQ ID NO: 1706626 - DNA, 22 bp, Homo sapiens
gaaaatatttcctgacttgagt

SEQ ID NO: 1706627 - DNA, 15 bp, Homo sapiens
gaaaatcaaatacat

SEQ ID NO: 1706628 - DNA, 16 bp, Homo sapiens
gaaaatcaccattccg

SEQ ID NO: 1706629 - DNA, 18 bp, Homo sapiens
gaaaatcactttgtctaa

SEQ ID NO: 1706630 - DNA, 14 bp, Homo sapiens
gaaaatccttttaa

SEQ ID NO: 1706631 - DNA, 22 bp, Homo sapiens
gaaaatccttttaaccatttta

SEQ ID NO: 1706632 - DNA, 19 bp, Homo sapiens
gaaaatctatatttgtctt

SEQ ID NO: 1706633 - DNA, 19 bp, Homo sapiens
gaaaatctttataaatgta

SEQ ID NO: 1706634 - DNA, 13 bp, Homo sapiens
gaaaatgaaagct

SEQ ID NO: 1706635 - DNA, 23 bp, Homo sapiens
gaaaatgaattttgtatgctgaa

SEQ ID NO: 1706636 - DNA, 16 bp, Homo sapiens
gaaaatgacttatttc

SEQ ID NO: 1706637 - DNA, 18 bp, Homo sapiens
gaaaatgacttatttctg

SEQ ID NO: 1706638 - DNA, 16 bp, Homo sapiens
gaaaatgagcatcaga

SEQ ID NO: 1706639 - DNA, 23 bp, Homo sapiens
gaaaatgagtttttatggggctg

SEQ ID NO: 1706640 - DNA, 14 bp, Homo sapiens
gaaaatgatctgag

SEQ ID NO: 1706641 - DNA, 21 bp, Homo sapiens
gaaaatgattcctggacatca

SEQ ID NO: 1706642 - DNA, 22 bp, Homo sapiens
gaaaatgcctcaattcacatag

SEQ ID NO: 1706643 - DNA, 19 bp, Homo sapiens
gaaaatgcttaaaaaataa

SEQ ID NO: 1706644 - DNA, 20 bp, Homo sapiens
gaaaatgtaaaggagggaga

SEQ ID NO: 1706645 - DNA, 22 bp, Homo sapiens
gaaaatgtcagaaaccagttat

SEQ ID NO: 1706646 - DNA, 14 bp, Homo sapiens
gaaaatgtccagga

SEQ ID NO: 1706647 - DNA, 22 bp, Homo sapiens
gaaaatgttttacattccattt

SEQ ID NO: 1706648 - DNA, 21 bp, Homo sapiens
gaaaattcatagtaagattga

SEQ ID NO: 1706649 - DNA, 14 bp, Homo sapiens
gaaaattcattttt

SEQ ID NO: 1706650 - DNA, 14 bp, Homo sapiens
gaaaattccagaaa

SEQ ID NO: 1706651 - DNA, 21 bp, Homo sapiens
gaaaattctaacccaagacat

SEQ ID NO: 1706652 - DNA, 24 bp, Homo sapiens
gaaaattgaggtttggaagagtga

SEQ ID NO: 1706653 - DNA, 20 bp, Homo sapiens
gaaaattgcctttctgtgtt

SEQ ID NO: 1706654 - DNA, 21 bp, Homo sapiens
gaaaattgcctttctgtgttt

SEQ ID NO: 1706655 - DNA, 14 bp, Homo sapiens
gaaaattgtttagt

SEQ ID NO: 1706656 - DNA, 13 bp, Homo sapiens
gaaaattttgtaa

SEQ ID NO: 1706657 - DNA, 19 bp, Homo sapiens
gaaaattttgtattaattt

SEQ ID NO: 1706658 - DNA, 15 bp, Homo sapiens
gaaaatttttacatt

SEQ ID NO: 1706659 - DNA, 23 bp, Homo sapiens
gaaacaaaaacactaaaaataaa

SEQ ID NO: 1706660 - DNA, 23 bp, Homo sapiens
gaaacaaacaaaagctgaacaca

SEQ ID NO: 1706661 - DNA, 15 bp, Homo sapiens
gaaacaaagaagtgt

SEQ ID NO: 1706662 - DNA, 17 bp, Homo sapiens
gaaacaaagtactcttt

SEQ ID NO: 1706663 - DNA, 14 bp, Homo sapiens
gaaacaaataatca

SEQ ID NO: 1706664 - DNA, 22 bp, Homo sapiens
gaaacaagctgtgcaggcatgg

SEQ ID NO: 1706665 - DNA, 15 bp, Homo sapiens
gaaacaagtattttg

SEQ ID NO: 1706666 - DNA, 17 bp, Homo sapiens
gaaacaagtgaaagcat

SEQ ID NO: 1706667 - DNA, 22 bp, Homo sapiens
gaaacaagttattctcttcact

SEQ ID NO: 1706668 - DNA, 22 bp, Homo sapiens
gaaacaatgttgtccaacaata

SEQ ID NO: 1706669 - DNA, 14 bp, Homo sapiens
gaaacacacgtgct

SEQ ID NO: 1706670 - DNA, 23 bp, Homo sapiens
gaaacacacgtgctgtgggcctc

SEQ ID NO: 1706671 - DNA, 12 bp, Homo sapiens
gaaacacagctg

SEQ ID NO: 1706672 - DNA, 13 bp, Homo sapiens
gaaacacagctgt

SEQ ID NO: 1706673 - DNA, 16 bp, Homo sapiens
gaaacacccctctgtc

SEQ ID NO: 1706674 - DNA, 17 bp, Homo sapiens
gaaacacccctctgtct

SEQ ID NO: 1706675 - DNA, 23 bp, Homo sapiens
gaaacactaagctctctgggcct

SEQ ID NO: 1706676 - DNA, 13 bp, Homo sapiens
gaaacactcttat

SEQ ID NO: 1706677 - DNA, 14 bp, Homo sapiens
gaaacactgccttt

SEQ ID NO: 1706678 - DNA, 17 bp, Homo sapiens
gaaacactgccttttta

SEQ ID NO: 1706679 - DNA, 14 bp, Homo sapiens
gaaacagaaacaaa

SEQ ID NO: 1706680 - DNA, 17 bp, Homo sapiens
gaaacagagtggcctcc

SEQ ID NO: 1706681 - DNA, 19 bp, Homo sapiens
gaaacagattcaggccagc

SEQ ID NO: 1706682 - DNA, 23 bp, Homo sapiens
gaaacagattcaggccagcccag

SEQ ID NO: 1706683 - DNA, 16 bp, Homo sapiens
gaaacagctcagccag

SEQ ID NO: 1706684 - DNA, 17 bp, Homo sapiens
gaaacagctcagccagt

SEQ ID NO: 1706685 - DNA, 15 bp, Homo sapiens
gaaacagctttcaag

SEQ ID NO: 1706686 - DNA, 21 bp, Homo sapiens
gaaacagctttcaagtgcctt

SEQ ID NO: 1706687 - DNA, 21 bp, Homo sapiens
gaaacagttctcactgggaag

SEQ ID NO: 1706688 - DNA, 21 bp, Homo sapiens
gaaacagttgctgtgaacttt

SEQ ID NO: 1706689 - DNA, 18 bp, Homo sapiens
gaaacagtttcttgcttg

SEQ ID NO: 1706690 - DNA, 20 bp, Homo sapiens
gaaacatcagttactctgaa

SEQ ID NO: 1706691 - DNA, 16 bp, Homo sapiens
gaaacatgacactgac

SEQ ID NO: 1706692 - DNA, 17 bp, Homo sapiens
gaaacatgacactgacc

SEQ ID NO: 1706693 - DNA, 19 bp, Homo sapiens
gaaacatttacaataaata

SEQ ID NO: 1706694 - DNA, 12 bp, Homo sapiens
gaaacatttcct

SEQ ID NO: 1706695 - DNA, 17 bp, Homo sapiens
gaaacatttcctttgaa

SEQ ID NO: 1706696 - DNA, 20 bp, Homo sapiens
gaaacattttatcattaaaa

SEQ ID NO: 1706697 - DNA, 20 bp, Homo sapiens
gaaacattttttcttctgaa

SEQ ID NO: 1706698 - DNA, 13 bp, Homo sapiens
gaaaccacagtca

SEQ ID NO: 1706699 - DNA, 14 bp, Homo sapiens
gaaaccacagtcag

SEQ ID NO: 1706700 - DNA, 22 bp, Homo sapiens
gaaaccagcttttactgttttt

SEQ ID NO: 1706701 - DNA, 19 bp, Homo sapiens
gaaaccagtgtagccttgc

SEQ ID NO: 1706702 - DNA, 20 bp, Homo sapiens
gaaaccattttcccatcatc

SEQ ID NO: 1706703 - DNA, 21 bp, Homo sapiens
gaaacccaccagcctaagaag

SEQ ID NO: 1706704 - DNA, 17 bp, Homo sapiens
gaaaccccatctctact

SEQ ID NO: 1706705 - DNA, 24 bp, Homo sapiens
gaaacccttcagtgctacattttg

SEQ ID NO: 1706706 - DNA, 16 bp, Homo sapiens
gaaacccttgctgctt

SEQ ID NO: 1706707 - DNA, 13 bp, Homo sapiens
gaaaccgggagaa

SEQ ID NO: 1706708 - DNA, 21 bp, Homo sapiens
gaaacctacacactgtcatgc

SEQ ID NO: 1706709 - DNA, 15 bp, Homo sapiens
gaaacctacttttta

SEQ ID NO: 1706710 - DNA, 16 bp, Homo sapiens
gaaacctgggattcag

SEQ ID NO: 1706711 - DNA, 19 bp, Homo sapiens
gaaaccttattgtacctct

SEQ ID NO: 1706712 - DNA, 13 bp, Homo sapiens
gaaaccttggaga

SEQ ID NO: 1706713 - DNA, 15 bp, Homo sapiens
gaaaccttggagagg

SEQ ID NO: 1706714 - DNA, 21 bp, Homo sapiens
gaaacctttagggcagcttgc

SEQ ID NO: 1706715 - DNA, 16 bp, Homo sapiens
gaaacgagatttgcca

SEQ ID NO: 1706716 - DNA, 20 bp, Homo sapiens
gaaacgctacctctctgtcc

SEQ ID NO: 1706717 - DNA, 16 bp, Homo sapiens
gaaacgggctccttcc

SEQ ID NO: 1706718 - DNA, 18 bp, Homo sapiens
gaaacgggctccttcccc

SEQ ID NO: 1706719 - DNA, 20 bp, Homo sapiens
gaaacgggctccttcccctg

SEQ ID NO: 1706720 - DNA, 17 bp, Homo sapiens
gaaactcaccatgtaaa

SEQ ID NO: 1706721 - DNA, 13 bp, Homo sapiens
gaaactccatctc

SEQ ID NO: 1706722 - DNA, 22 bp, Homo sapiens
gaaactccatctcaaaacaaaa

SEQ ID NO: 1706723 - DNA, 23 bp, Homo sapiens
gaaactccatctcaaaacaaaac

SEQ ID NO: 1706724 - DNA, 18 bp, Homo sapiens
gaaactcccatgtatgga

SEQ ID NO: 1706725 - DNA, 19 bp, Homo sapiens
gaaactcctgtttctcctt

SEQ ID NO: 1706726 - DNA, 20 bp, Homo sapiens
gaaactccttttgctgtctt

SEQ ID NO: 1706727 - DNA, 21 bp, Homo sapiens
gaaactccttttgctgtcttt

SEQ ID NO: 1706728 - DNA, 14 bp, Homo sapiens
gaaactgctgcaga

SEQ ID NO: 1706729 - DNA, 13 bp, Homo sapiens
gaaactggccagg

SEQ ID NO: 1706730 - DNA, 16 bp, Homo sapiens
gaaactggccaggggt

SEQ ID NO: 1706731 - DNA, 16 bp, Homo sapiens
gaaactgggtttctca

SEQ ID NO: 1706732 - DNA, 18 bp, Homo sapiens
gaaacttgtttcactgaa

SEQ ID NO: 1706733 - DNA, 21 bp, Homo sapiens
gaaactttgggaaaacatgtt

SEQ ID NO: 1706734 - DNA, 20 bp, Homo sapiens
gaaacttttgttagggctgc

SEQ ID NO: 1706735 - DNA, 15 bp, Homo sapiens
gaaagaaagaaggaa

SEQ ID NO: 1706736 - DNA, 20 bp, Homo sapiens
gaaagaacatggacttgtat

SEQ ID NO: 1706737 - DNA, 23 bp, Homo sapiens
gaaagaacatggacttgtatatt

SEQ ID NO: 1706738 - DNA, 21 bp, Homo sapiens
gaaagaactttaaagctcagg

SEQ ID NO: 1706739 - DNA, 16 bp, Homo sapiens
ctttgccaaaatacca

SEQ ID NO: 1706740 - DNA, 11 bp, Homo sapiens
ctttgccacaa

SEQ ID NO: 1706741 - DNA, 12 bp, Homo sapiens
ctttgccagagc

SEQ ID NO: 1706742 - DNA, 14 bp, Homo sapiens
ctttgcccacaatg

SEQ ID NO: 1706743 - DNA, 12 bp, Homo sapiens
ctttgcccaccc

SEQ ID NO: 1706744 - DNA, 12 bp, Homo sapiens
aggcaagagaat

SEQ ID NO: 1706745 - DNA, 17 bp, Homo sapiens
aggcaagagggggtgga

SEQ ID NO: 1706746 - DNA, 18 bp, Homo sapiens
aggcaagcccctcagccc

SEQ ID NO: 1706747 - DNA, 20 bp, Homo sapiens
aggcaagcccctcagccctt

SEQ ID NO: 1706748 - DNA, 14 bp, Homo sapiens
aggcaagcctggcc

SEQ ID NO: 1706749 - DNA, 16 bp, Homo sapiens
aggcaagctgaaattt

SEQ ID NO: 1706750 - DNA, 21 bp, Homo sapiens
aggcaagctgaaattttagaa

SEQ ID NO: 1706751 - DNA, 15 bp, Homo sapiens
aggcaaggcaggtgc

SEQ ID NO: 1706752 - DNA, 15 bp, Homo sapiens
aggcaagtttgttca

SEQ ID NO: 1706753 - DNA, 18 bp, Homo sapiens
aggcaatggtttgtgtca

SEQ ID NO: 1706754 - DNA, 19 bp, Homo sapiens
aggcaatgtcaggaacaga

SEQ ID NO: 1706755 - DNA, 20 bp, Homo sapiens
aggcacaaaattttgtttaa

SEQ ID NO: 1706756 - DNA, 19 bp, Homo sapiens
aggcacaaatcttgggtct

SEQ ID NO: 1706757 - DNA, 19 bp, Homo sapiens
aggcacacagagattctgg

SEQ ID NO: 1706758 - DNA, 12 bp, Homo sapiens
aggcacacagat

SEQ ID NO: 1706759 - DNA, 15 bp, Homo sapiens
aggcacacagctact

SEQ ID NO: 1706760 - DNA, 15 bp, Homo sapiens
aggcacacagggccc

SEQ ID NO: 1706761 - DNA, 16 bp, Homo sapiens
aggcacacttcttctt

SEQ ID NO: 1706762 - DNA, 14 bp, Homo sapiens
aggcacagctgagt

SEQ ID NO: 1706763 - DNA, 16 bp, Homo sapiens
aggcacagggcccgca

SEQ ID NO: 1706764 - DNA, 14 bp, Homo sapiens
aggcacagtgggag

SEQ ID NO: 1706765 - DNA, 20 bp, Homo sapiens
aggcacagtgggagctgagc

SEQ ID NO: 1706766 - DNA, 22 bp, Homo sapiens
aggcacagtgggagctgagctg

SEQ ID NO: 1706767 - DNA, 17 bp, Homo sapiens
aggcacatggaggagct

SEQ ID NO: 1706768 - DNA, 14 bp, Homo sapiens
aggcaccaccagga

SEQ ID NO: 1706769 - DNA, 17 bp, Homo sapiens
aggcaccaccaggagca

SEQ ID NO: 1706770 - DNA, 20 bp, Homo sapiens
aggcaccaccaggagcagca

SEQ ID NO: 1706771 - DNA, 22 bp, Homo sapiens
aggcaccaccaggagcagcagc

SEQ ID NO: 1706772 - DNA, 13 bp, Homo sapiens
aggcaccagctct

SEQ ID NO: 1706773 - DNA, 11 bp, Homo sapiens
aggcaccagga

SEQ ID NO: 1706774 - DNA, 12 bp, Homo sapiens
aggcaccaggaa

SEQ ID NO: 1706775 - DNA, 14 bp, Homo sapiens
aggcaccaggaagc

SEQ ID NO: 1706776 - DNA, 15 bp, Homo sapiens
aggcaccaggaagcc

SEQ ID NO: 1706777 - DNA, 16 bp, Homo sapiens
aggcaccaggaagccg

SEQ ID NO: 1706778 - DNA, 20 bp, Homo sapiens
aggcaccagtgtcctcccct

SEQ ID NO: 1706779 - DNA, 15 bp, Homo sapiens
aggcaccgagaatgt

SEQ ID NO: 1706780 - DNA, 16 bp, Homo sapiens
aggcaccgagaatgtt

SEQ ID NO: 1706781 - DNA, 18 bp, Homo sapiens
aggcaccgagaatgttgt

SEQ ID NO: 1706782 - DNA, 22 bp, Homo sapiens
aggcaccgccacgtcccagcat

SEQ ID NO: 1706783 - DNA, 16 bp, Homo sapiens
aggcaccggcgctgca

SEQ ID NO: 1706784 - DNA, 23 bp, Homo sapiens
aggcacctacactcacctgcact

SEQ ID NO: 1706785 - DNA, 17 bp, Homo sapiens
aggcacctccaggcagg

SEQ ID NO: 1706786 - DNA, 20 bp, Homo sapiens
aggcacctccccgctctccc

SEQ ID NO: 1706787 - DNA, 13 bp, Homo sapiens
aggcacctcttcc

SEQ ID NO: 1706788 - DNA, 14 bp, Homo sapiens
aggcacctcttcct

SEQ ID NO: 1706789 - DNA, 13 bp, Homo sapiens
aggcacctggcct

SEQ ID NO: 1706790 - DNA, 15 bp, Homo sapiens
aggcacctggcctgc

SEQ ID NO: 1706791 - DNA, 18 bp, Homo sapiens
aggcacctggcctgctgg

SEQ ID NO: 1706792 - DNA, 19 bp, Homo sapiens
aggcacgaacccacctgct

SEQ ID NO: 1706793 - DNA, 20 bp, Homo sapiens
aggcacgaacccacctgctg

SEQ ID NO: 1706794 - DNA, 20 bp, Homo sapiens
aggcactctgttatttagac

SEQ ID NO: 1706795 - DNA, 18 bp, Homo sapiens
aggcactgcccttttcag

SEQ ID NO: 1706796 - DNA, 16 bp, Homo sapiens
aggcactggtggcatc

SEQ ID NO: 1706797 - DNA, 17 bp, Homo sapiens
aggcactgtagttctaa

SEQ ID NO: 1706798 - DNA, 19 bp, Homo sapiens
aggcactgtagttctaaga

SEQ ID NO: 1706799 - DNA, 17 bp, Homo sapiens
aggcactgttcatctca

SEQ ID NO: 1706800 - DNA, 21 bp, Homo sapiens
aggcagaaagatacagacatt

SEQ ID NO: 1706801 - DNA, 24 bp, Homo sapiens
aggcagaaagatacagacattcaa

SEQ ID NO: 1706802 - DNA, 22 bp, Homo sapiens
aggcagaagaattgaacccagg

SEQ ID NO: 1706803 - DNA, 21 bp, Homo sapiens
aggcagacacaccgcggccag

SEQ ID NO: 1706804 - DNA, 14 bp, Homo sapiens
aggcagacagcagc

SEQ ID NO: 1706805 - DNA, 15 bp, Homo sapiens
aggcagacagcagct

SEQ ID NO: 1706806 - DNA, 22 bp, Homo sapiens
aggcagacttccctgaatgtat

SEQ ID NO: 1706807 - DNA, 14 bp, Homo sapiens
aggcagagaaatct

SEQ ID NO: 1706808 - DNA, 14 bp, Homo sapiens
aggcagagaatcat

SEQ ID NO: 1706809 - DNA, 13 bp, Homo sapiens
aggcagagctgag

SEQ ID NO: 1706810 - DNA, 15 bp, Homo sapiens
aggcagagctgaggg

SEQ ID NO: 1706811 - DNA, 20 bp, Homo sapiens
aggcagagctgagggccctg

SEQ ID NO: 1706812 - DNA, 17 bp, Homo sapiens
aggcagaggcctgggct

SEQ ID NO: 1706813 - DNA, 18 bp, Homo sapiens
aggcagaggcctgggctg

SEQ ID NO: 1706814 - DNA, 13 bp, Homo sapiens
aggcagaggctgc

SEQ ID NO: 1706815 - DNA, 22 bp, Homo sapiens
aggcagaggttgcagtgagctg

SEQ ID NO: 1706816 - DNA, 19 bp, Homo sapiens
aggcagagttctgtgaaga

SEQ ID NO: 1706817 - DNA, 18 bp, Homo sapiens
aggcagataagttggagc

SEQ ID NO: 1706818 - DNA, 16 bp, Homo sapiens
aggcagatagcactgg

SEQ ID NO: 1706819 - DNA, 15 bp, Homo sapiens
aggcagatccaggac

SEQ ID NO: 1706820 - DNA, 15 bp, Homo sapiens
aggcagatctgtgcc

SEQ ID NO: 1706821 - DNA, 21 bp, Homo sapiens
aggcagatctgtgccccatgc

SEQ ID NO: 1706822 - DNA, 22 bp, Homo sapiens
aggcagatctgtgccccatgcc

SEQ ID NO: 1706823 - DNA, 23 bp, Homo sapiens
aggcagatctgtgccccatgcct

SEQ ID NO: 1706824 - DNA, 17 bp, Homo sapiens
aggcagattgaaaagga

SEQ ID NO: 1706825 - DNA, 20 bp, Homo sapiens
aggcagcaaggtggccacag

SEQ ID NO: 1706826 - DNA, 16 bp, Homo sapiens
aggcagcaccacactg

SEQ ID NO: 1706827 - DNA, 19 bp, Homo sapiens
aggcagcaccacactgggt

SEQ ID NO: 1706828 - DNA, 23 bp, Homo sapiens
aggcagcaccacactgggtgcgt

SEQ ID NO: 1706829 - DNA, 22 bp, Homo sapiens
aggcagcagagagagaggacag

SEQ ID NO: 1706830 - DNA, 23 bp, Homo sapiens
aggcagcagagagagaggacaga

SEQ ID NO: 1706831 - DNA, 19 bp, Homo sapiens
aggcagcatgcttgggctg

SEQ ID NO: 1706832 - DNA, 14 bp, Homo sapiens
aggcagccagggct

SEQ ID NO: 1706833 - DNA, 22 bp, Homo sapiens
aggcagcccagctcctgaataa

SEQ ID NO: 1706834 - DNA, 15 bp, Homo sapiens
aggcagccctcacct

SEQ ID NO: 1706835 - DNA, 22 bp, Homo sapiens
aggcagccctcacctctgagga

SEQ ID NO: 1706836 - DNA, 23 bp, Homo sapiens
aggcagccctcacctctgaggac

SEQ ID NO: 1706837 - DNA, 17 bp, Homo sapiens
aggcagccgaggcctgg

SEQ ID NO: 1706838 - DNA, 12 bp, Homo sapiens
aggcagcctcca

SEQ ID NO: 1706839 - DNA, 14 bp, Homo sapiens
aggcagcctccaga

SEQ ID NO: 1706840 - DNA, 17 bp, Homo sapiens
aggcagcctccagagcc

SEQ ID NO: 1706841 - DNA, 17 bp, Homo sapiens
aggcagcctcctttgtg

SEQ ID NO: 1706842 - DNA, 19 bp, Homo sapiens
aggcagcctcctttgtgtg

SEQ ID NO: 1706843 - DNA, 14 bp, Homo sapiens
aggcagcctctctg

SEQ ID NO: 1706844 - DNA, 15 bp, Homo sapiens
aggcagcgaccccag

SEQ ID NO: 1706845 - DNA, 14 bp, Homo sapiens
aggcagcgggatct

SEQ ID NO: 1706846 - DNA, 13 bp, Homo sapiens
aggcagctccctc

SEQ ID NO: 1706847 - DNA, 16 bp, Homo sapiens
aggcagctccctcctg

SEQ ID NO: 1706848 - DNA, 12 bp, Homo sapiens
aggcagctgcct

SEQ ID NO: 1706849 - DNA, 16 bp, Homo sapiens
aggcagctgcctctgc

SEQ ID NO: 1706850 - DNA, 23 bp, Homo sapiens
aggcagctgcctctgctccctct

SEQ ID NO: 1706851 - DNA, 13 bp, Homo sapiens
aggcagctgctct

SEQ ID NO: 1706852 - DNA, 23 bp, Homo sapiens
aggcagctgctcttagtgcccgc

SEQ ID NO: 1706853 - DNA, 18 bp, Homo sapiens
aggcagctggatgagact

SEQ ID NO: 1706854 - DNA, 20 bp, Homo sapiens
ctttgtggattctgaggccc

SEQ ID NO: 1706855 - DNA, 13 bp, Homo sapiens
ctttgtggcagtg

SEQ ID NO: 1706856 - DNA, 14 bp, Homo sapiens
ctttgtggcagtgg

SEQ ID NO: 1706857 - DNA, 15 bp, Homo sapiens
ctttgtggcagtggc

SEQ ID NO: 1706858 - DNA, 17 bp, Homo sapiens
ctttgtgtagctttgct

SEQ ID NO: 1706859 - DNA, 16 bp, Homo sapiens
ctttgtgtggctgccc

SEQ ID NO: 1706860 - DNA, 16 bp, Homo sapiens
ctttgtgttcatttca

SEQ ID NO: 1706861 - DNA, 15 bp, Homo sapiens
ctttgttacaggcac

SEQ ID NO: 1706862 - DNA, 15 bp, Homo sapiens
cttatgttccagatg

SEQ ID NO: 1706863 - DNA, 14 bp, Homo sapiens
cttatgttgaatat

SEQ ID NO: 1706864 - DNA, 15 bp, Homo sapiens
cttattactattatt

SEQ ID NO: 1706865 - DNA, 19 bp, Homo sapiens
cttattagaagccaagtaa

SEQ ID NO: 1706866 - DNA, 14 bp, Homo sapiens
cttattatttttga

SEQ ID NO: 1706867 - DNA, 16 bp, Homo sapiens
cttattatttttgaga

SEQ ID NO: 1706868 - DNA, 15 bp, Homo sapiens
cttattccaagtgca

SEQ ID NO: 1706869 - DNA, 17 bp, Homo sapiens
cttattccgagcattcc

SEQ ID NO: 1706870 - DNA, 19 bp, Homo sapiens
cttattcctaatggctatt

SEQ ID NO: 1706871 - DNA, 15 bp, Homo sapiens
cttattctcaaagca

SEQ ID NO: 1706872 - DNA, 19 bp, Homo sapiens
cttattcttgtggttaaaa

SEQ ID NO: 1706873 - DNA, 22 bp, Homo sapiens
cttattgacaaccgagaaggtt

SEQ ID NO: 1706874 - DNA, 16 bp, Homo sapiens
cttattgaccattttt

SEQ ID NO: 1706875 - DNA, 17 bp, Homo sapiens
cttattgcgctgctacc

SEQ ID NO: 1706876 - DNA, 18 bp, Homo sapiens
cttattgcttcatctgta

SEQ ID NO: 1706877 - DNA, 19 bp, Homo sapiens
cttattgcttcatctgtaa

SEQ ID NO: 1706878 - DNA, 18 bp, Homo sapiens
cttattggaactctgctt

SEQ ID NO: 1706879 - DNA, 18 bp, Homo sapiens
cttattggcagctctact

SEQ ID NO: 1706880 - DNA, 16 bp, Homo sapiens
cttattggccactggg

SEQ ID NO: 1706881 - DNA, 18 bp, Homo sapiens
cttattgtaacaggcttt

SEQ ID NO: 1706882 - DNA, 15 bp, Homo sapiens
cttattgtacctctc

SEQ ID NO: 1706883 - DNA, 18 bp, Homo sapiens
cttattgtacctctctta

SEQ ID NO: 1706884 - DNA, 19 bp, Homo sapiens
cttattgtgtgcgctgcct

SEQ ID NO: 1706885 - DNA, 20 bp, Homo sapiens
cttattgtgtgcgctgcctg

SEQ ID NO: 1706886 - DNA, 18 bp, Homo sapiens
cttattgtttaatctttt

SEQ ID NO: 1706887 - DNA, 17 bp, Homo sapiens
cttatttaatgaaagac

SEQ ID NO: 1706888 - DNA, 13 bp, Homo sapiens
cttatttattatt

SEQ ID NO: 1706889 - DNA, 14 bp, Homo sapiens
cttatttcatttct

SEQ ID NO: 1706890 - DNA, 19 bp, Homo sapiens
cttatttctagaagcacat

SEQ ID NO: 1706891 - DNA, 11 bp, Homo sapiens
cttatttctgc

SEQ ID NO: 1706892 - DNA, 17 bp, Homo sapiens
cttatttctgctctgga

SEQ ID NO: 1706893 - DNA, 13 bp, Homo sapiens
cttatttgtctgt

SEQ ID NO: 1706894 - DNA, 13 bp, Homo sapiens
cttattttacatt

SEQ ID NO: 1706895 - DNA, 16 bp, Homo sapiens
cttattttaggaaatt

SEQ ID NO: 1706896 - DNA, 14 bp, Homo sapiens
cttattttagtata

SEQ ID NO: 1706897 - DNA, 17 bp, Homo sapiens
cttattttctcaatctc

SEQ ID NO: 1706898 - DNA, 19 bp, Homo sapiens
cttattttctgaattcata

SEQ ID NO: 1706899 - DNA, 22 bp, Homo sapiens
cttattttctgaattcataaaa

SEQ ID NO: 1706900 - DNA, 15 bp, Homo sapiens
cttattttgtattac

SEQ ID NO: 1706901 - DNA, 23 bp, Homo sapiens
cttatttttataacatctttatt

SEQ ID NO: 1706902 - DNA, 14 bp, Homo sapiens
cttattttttccca

SEQ ID NO: 1706903 - DNA, 19 bp, Homo sapiens
cttattttttcccaaagcc

SEQ ID NO: 1706904 - DNA, 21 bp, Homo sapiens
cttatttttttaagaaaaaag

SEQ ID NO: 1706905 - DNA, 19 bp, Homo sapiens
cttcaaaaagcagagtgga

SEQ ID NO: 1706906 - DNA, 17 bp, Homo sapiens
cttcaaactttcacttt

SEQ ID NO: 1706907 - DNA, 18 bp, Homo sapiens
cttcaaagcttgaagatc

SEQ ID NO: 1706908 - DNA, 17 bp, Homo sapiens
cttcaaagtttatatgc

SEQ ID NO: 1706909 - DNA, 13 bp, Homo sapiens
cttcaaatgttta

SEQ ID NO: 1706910 - DNA, 18 bp, Homo sapiens
cttcaaattaaaacagct

SEQ ID NO: 1706911 - DNA, 23 bp, Homo sapiens
cttcaacagaccccctctagaaa

SEQ ID NO: 1706912 - DNA, 20 bp, Homo sapiens
cttcaaccattccccatggg

SEQ ID NO: 1706913 - DNA, 14 bp, Homo sapiens
cttcaacccagtgg

SEQ ID NO: 1706914 - DNA, 16 bp, Homo sapiens
cttcaacccccagcta

SEQ ID NO: 1706915 - DNA, 14 bp, Homo sapiens
cttcaaccctcagc

SEQ ID NO: 1706916 - DNA, 19 bp, Homo sapiens
cttcaaccctcagccttga

SEQ ID NO: 1706917 - DNA, 13 bp, Homo sapiens
cttcaactcctgg

SEQ ID NO: 1706918 - DNA, 16 bp, Homo sapiens
cttcaactcctgggct

SEQ ID NO: 1706919 - DNA, 17 bp, Homo sapiens
cttcaactcctgggctc

SEQ ID NO: 1706920 - DNA, 22 bp, Homo sapiens
cttcaagctgttatttcttccc

SEQ ID NO: 1706921 - DNA, 23 bp, Homo sapiens
cttcaagctgttatttcttccct

SEQ ID NO: 1706922 - DNA, 20 bp, Homo sapiens
cttcaaggactgtttcagtg

SEQ ID NO: 1706923 - DNA, 18 bp, Homo sapiens
cttcaagggaagaaacac

SEQ ID NO: 1706924 - DNA, 15 bp, Homo sapiens
cttcaagggtaatct

SEQ ID NO: 1706925 - DNA, 19 bp, Homo sapiens
cttcaagtgccaaacagag

SEQ ID NO: 1706926 - DNA, 16 bp, Homo sapiens
cttcaagttagctcag

SEQ ID NO: 1706927 - DNA, 17 bp, Homo sapiens
cttcaagttagctcagg

SEQ ID NO: 1706928 - DNA, 18 bp, Homo sapiens
cttcaatataagaagcaa

SEQ ID NO: 1706929 - DNA, 21 bp, Homo sapiens
cttcaatcggcttgtgggtga

SEQ ID NO: 1706930 - DNA, 12 bp, Homo sapiens
agctgacctctg

SEQ ID NO: 1706931 - DNA, 15 bp, Homo sapiens
agctgacctctgttg

SEQ ID NO: 1706932 - DNA, 21 bp, Homo sapiens
agctgacctctgttgtcctcc

SEQ ID NO: 1706933 - DNA, 13 bp, Homo sapiens
agctgactcacac

SEQ ID NO: 1706934 - DNA, 13 bp, Homo sapiens
agctgactgtggc

SEQ ID NO: 1706935 - DNA, 18 bp, Homo sapiens
agctgactgtggccccct

SEQ ID NO: 1706936 - DNA, 16 bp, Homo sapiens
agctgacttggcactt

SEQ ID NO: 1706937 - DNA, 18 bp, Homo sapiens
agctgacttggcacttaa

SEQ ID NO: 1706938 - DNA, 16 bp, Homo sapiens
agctgagagccctgct

SEQ ID NO: 1706939 - DNA, 14 bp, Homo sapiens
agctgagatgtgga

SEQ ID NO: 1706940 - DNA, 21 bp, Homo sapiens
agctgagcctgcagggaagcc

SEQ ID NO: 1706941 - DNA, 11 bp, Homo sapiens
agctgagctgg

SEQ ID NO: 1706942 - DNA, 13 bp, Homo sapiens
agctgagcttgag

SEQ ID NO: 1706943 - DNA, 15 bp, Homo sapiens
agctgagcttgagct

SEQ ID NO: 1706944 - DNA, 17 bp, Homo sapiens
agctgagcttgagctcc

SEQ ID NO: 1706945 - DNA, 13 bp, Homo sapiens
agctgagcttttg

SEQ ID NO: 1706946 - DNA, 13 bp, Homo sapiens
agctgagggccct

SEQ ID NO: 1706947 - DNA, 15 bp, Homo sapiens
agctgagggccctgt

SEQ ID NO: 1706948 - DNA, 17 bp, Homo sapiens
agctgagggccctgtgg

SEQ ID NO: 1706949 - DNA, 13 bp, Homo sapiens
agctgagtcacct

SEQ ID NO: 1706950 - DNA, 14 bp, Homo sapiens
agctgagtcacctc

SEQ ID NO: 1706951 - DNA, 23 bp, Homo sapiens
agctgagttacttgtctgaggcc

SEQ ID NO: 1706952 - DNA, 16 bp, Homo sapiens
agctgagttatgatgt

SEQ ID NO: 1706953 - DNA, 20 bp, Homo sapiens
agctgatactttgacagtgt

SEQ ID NO: 1706954 - DNA, 20 bp, Homo sapiens
agctgatattatggcaagtg

SEQ ID NO: 1706955 - DNA, 17 bp, Homo sapiens
agctgatattatttctt

SEQ ID NO: 1706956 - DNA, 23 bp, Homo sapiens
agctgatattatttcttctctta

SEQ ID NO: 1706957 - DNA, 13 bp, Homo sapiens
agctgatccagag

SEQ ID NO: 1706958 - DNA, 15 bp, Homo sapiens
agctgatccagagca

SEQ ID NO: 1706959 - DNA, 15 bp, Homo sapiens
agctgatccatagga

SEQ ID NO: 1706960 - DNA, 16 bp, Homo sapiens
agctgatccataggac

SEQ ID NO: 1706961 - DNA, 22 bp, Homo sapiens
agctgatgaaactcctgatttt

SEQ ID NO: 1706962 - DNA, 15 bp, Homo sapiens
agctgatgatgtctc

SEQ ID NO: 1706963 - DNA, 23 bp, Homo sapiens
agctgatgatgtctcttgtagaa

SEQ ID NO: 1706964 - DNA, 15 bp, Homo sapiens
agctgatgcctcctt

SEQ ID NO: 1706965 - DNA, 22 bp, Homo sapiens
agctgatgcctgaatgtatcct

SEQ ID NO: 1706966 - DNA, 15 bp, Homo sapiens
agctgatggcagctg

SEQ ID NO: 1706967 - DNA, 17 bp, Homo sapiens
agctgatgttggaagag

SEQ ID NO: 1706968 - DNA, 19 bp, Homo sapiens
agctgattactgtcaataa

SEQ ID NO: 1706969 - DNA, 20 bp, Homo sapiens
agctgattactgtcaataaa

SEQ ID NO: 1706970 - DNA, 19 bp, Homo sapiens
agctgattgcagaaaggag

SEQ ID NO: 1706971 - DNA, 14 bp, Homo sapiens
agctgatttccagg

SEQ ID NO: 1706972 - DNA, 18 bp, Homo sapiens
agctgatttccaggcccc

SEQ ID NO: 1706973 - DNA, 23 bp, Homo sapiens
agctgatttccaggcccctgagg

SEQ ID NO: 1706974 - DNA, 14 bp, Homo sapiens
agctgatttgtata

SEQ ID NO: 1706975 - DNA, 16 bp, Homo sapiens
agctgcaaaaataatc

SEQ ID NO: 1706976 - DNA, 18 bp, Homo sapiens
agctgcaaaaataatcat

SEQ ID NO: 1706977 - DNA, 22 bp, Homo sapiens
agcttcccacacctgcctgcgt

SEQ ID NO: 1706978 - DNA, 13 bp, Homo sapiens
agcttcctcacac

SEQ ID NO: 1706979 - DNA, 14 bp, Homo sapiens
agcttcctcacacc

SEQ ID NO: 1706980 - DNA, 22 bp, Homo sapiens
agcttcctcacacccctgtccc

SEQ ID NO: 1706981 - DNA, 23 bp, Homo sapiens
agcttcctcacacccctgtccca

SEQ ID NO: 1706982 - DNA, 13 bp, Homo sapiens
agcttccttctgg

SEQ ID NO: 1706983 - DNA, 19 bp, Homo sapiens
agcttccttctgtgaaagt

SEQ ID NO: 1706984 - DNA, 14 bp, Homo sapiens
agcttctaaagcag

SEQ ID NO: 1706985 - DNA, 18 bp, Homo sapiens
agcttctaccatgaacag

SEQ ID NO: 1706986 - DNA, 17 bp, Homo sapiens
agcttctatcccaggag

SEQ ID NO: 1706987 - DNA, 12 bp, Homo sapiens
agcttctccaag

SEQ ID NO: 1706988 - DNA, 15 bp, Homo sapiens
agcttctctgggctg

SEQ ID NO: 1706989 - DNA, 17 bp, Homo sapiens
agcttctgccacataaa

SEQ ID NO: 1706990 - DNA, 19 bp, Homo sapiens
agcttctgcttttctgccc

SEQ ID NO: 1706991 - DNA, 20 bp, Homo sapiens
agcttctgcttttctgccct

SEQ ID NO: 1706992 - DNA, 21 bp, Homo sapiens
agcttctgcttttctgccctg

SEQ ID NO: 1706993 - DNA, 12 bp, Homo sapiens
agcttctggagc

SEQ ID NO: 1706994 - DNA, 21 bp, Homo sapiens
agcttctgtgtgtgagctacc

SEQ ID NO: 1706995 - DNA, 15 bp, Homo sapiens
agcttcttcagagtg

SEQ ID NO: 1706996 - DNA, 17 bp, Homo sapiens
agcttcttgtttccttg

SEQ ID NO: 1706997 - DNA, 18 bp, Homo sapiens
agcttcttgtttccttgt

SEQ ID NO: 1706998 - DNA, 13 bp, Homo sapiens
agcttgactccca

SEQ ID NO: 1706999 - DNA, 21 bp, Homo sapiens
agcttgagccgggcccctggg

SEQ ID NO: 1707000 - DNA, 23 bp, Homo sapiens
agcttgagccgggcccctgggct

SEQ ID NO: 1707001 - DNA, 17 bp, Homo sapiens
agcttgagcctccccca

SEQ ID NO: 1707002 - DNA, 22 bp, Homo sapiens
agcttgagctcccctggagcca

SEQ ID NO: 1707003 - DNA, 19 bp, Homo sapiens
agcttgaggccaagatggc

SEQ ID NO: 1707004 - DNA, 22 bp, Homo sapiens
agcttgagtctcaagggtggca

SEQ ID NO: 1707005 - DNA, 18 bp, Homo sapiens
agcttgatttttctagca

SEQ ID NO: 1707006 - DNA, 15 bp, Homo sapiens
agcttgcaagaagca

SEQ ID NO: 1707007 - DNA, 15 bp, Homo sapiens
agcttgccagggatg

SEQ ID NO: 1707008 - DNA, 18 bp, Homo sapiens
agcttgctgtcacttctt

SEQ ID NO: 1707009 - DNA, 23 bp, Homo sapiens
agcttgctgtcacttcttcacct

SEQ ID NO: 1707010 - DNA, 14 bp, Homo sapiens
agcttggcagccga

SEQ ID NO: 1707011 - DNA, 15 bp, Homo sapiens
agcttggcagccgag

SEQ ID NO: 1707012 - DNA, 20 bp, Homo sapiens
agcttggcagccgagctcgt

SEQ ID NO: 1707013 - DNA, 17 bp, Homo sapiens
agcttggccctttcctt

SEQ ID NO: 1707014 - DNA, 16 bp, Homo sapiens
agcttggctgtaggac

SEQ ID NO: 1707015 - DNA, 22 bp, Homo sapiens
agcttgggaagtcgaggctgca

SEQ ID NO: 1707016 - DNA, 12 bp, Homo sapiens
agcttgggaatg

SEQ ID NO: 1707017 - DNA, 14 bp, Homo sapiens
agcttgggaatgga

SEQ ID NO: 1707018 - DNA, 12 bp, Homo sapiens
agcttgggccca

SEQ ID NO: 1707019 - DNA, 17 bp, Homo sapiens
agcttgggcccagctgg

SEQ ID NO: 1707020 - DNA, 20 bp, Homo sapiens
agcttgggcccagctgggct

SEQ ID NO: 1707021 - DNA, 21 bp, Homo sapiens
agcttggggccaccaaagctg

SEQ ID NO: 1707022 - DNA, 21 bp, Homo sapiens
agcttgggggatgactagagg

SEQ ID NO: 1707023 - DNA, 19 bp, Homo sapiens
agcttgggtccaccatgca

SEQ ID NO: 1707024 - DNA, 15 bp, Homo sapiens
agcttggtattgcag

SEQ ID NO: 1707025 - DNA, 17 bp, Homo sapiens
agcttggtattgcagag

SEQ ID NO: 1707026 - DNA, 15 bp, Homo sapiens
agcttggttccagga

SEQ ID NO: 1707027 - DNA, 18 bp, Homo sapiens
agcttgtgctcctcttga

SEQ ID NO: 1707028 - DNA, 18 bp, Homo sapiens
agcttgtggcccctttta

SEQ ID NO: 1707029 - DNA, 18 bp, Homo sapiens
agcttgtggtgttcctga

SEQ ID NO: 1707030 - DNA, 21 bp, Homo sapiens
agcttgtggtgttcctgaagc

SEQ ID NO: 1707031 - DNA, 16 bp, Homo sapiens
agcttgttatttataa

SEQ ID NO: 1707032 - DNA, 20 bp, Homo sapiens
agcttgttgaaaacccagac

SEQ ID NO: 1707033 - DNA, 23 bp, Homo sapiens
agcttgttgaaaacccagactgt

SEQ ID NO: 1707034 - DNA, 12 bp, Homo sapiens
agcttgtttcta

SEQ ID NO: 1707035 - DNA, 22 bp, Homo sapiens
agcttgttttgtttcatcctgt

SEQ ID NO: 1707036 - DNA, 17 bp, Homo sapiens
agctttaaaaaaataat

SEQ ID NO: 1707037 - DNA, 17 bp, Homo sapiens
agctttaaattatgtga

SEQ ID NO: 1707038 - DNA, 21 bp, Homo sapiens
agctttaatcaatcatgccct

SEQ ID NO: 1707039 - DNA, 17 bp, Homo sapiens
agctttacaacttccat

SEQ ID NO: 1707040 - DNA, 16 bp, Homo sapiens
agctttactactgtgg

SEQ ID NO: 1707041 - DNA, 23 bp, Homo sapiens
agctttatcaaagggtgaaaatt

SEQ ID NO: 1707042 - DNA, 23 bp, Homo sapiens
agctttatgttcatttgtttgtt

SEQ ID NO: 1707043 - DNA, 16 bp, Homo sapiens
agctttcaaagcattt

SEQ ID NO: 1707044 - DNA, 19 bp, Homo sapiens
agctttcagagccagtgaa

SEQ ID NO: 1707045 - DNA, 16 bp, Homo sapiens
agctttccatgttgct

SEQ ID NO: 1707046 - DNA, 21 bp, Homo sapiens
agctttcccctctgaataaat

SEQ ID NO: 1707047 - DNA, 12 bp, Homo sapiens
agctttccctgc

SEQ ID NO: 1707048 - DNA, 15 bp, Homo sapiens
agctttcctgcccca

SEQ ID NO: 1707049 - DNA, 20 bp, Homo sapiens
agctttcctgccccaggcct

SEQ ID NO: 1707050 - DNA, 22 bp, Homo sapiens
agctttcctgccccaggcctga

SEQ ID NO: 1707051 - DNA, 23 bp, Homo sapiens
agctttcctgccccaggcctgaa

SEQ ID NO: 1707052 - DNA, 12 bp, Homo sapiens
agctttcctggt

SEQ ID NO: 1707053 - DNA, 22 bp, Homo sapiens
agctttcctttttcccaataaa

SEQ ID NO: 1707054 - DNA, 19 bp, Homo sapiens
agctttctcgcgccctccc

SEQ ID NO: 1707055 - DNA, 19 bp, Homo sapiens
cttcccattctgccccaga

SEQ ID NO: 1707056 - DNA, 22 bp, Homo sapiens
cttcccatttctctacactaag

SEQ ID NO: 1707057 - DNA, 17 bp, Homo sapiens
cttcccatttcttccca

SEQ ID NO: 1707058 - DNA, 19 bp, Homo sapiens
cttccccaacttccctagt

SEQ ID NO: 1707059 - DNA, 20 bp, Homo sapiens
cttccccaacttccctagtc

SEQ ID NO: 1707060 - DNA, 20 bp, Homo sapiens
cttccccacttctgtgccac

SEQ ID NO: 1707061 - DNA, 13 bp, Homo sapiens
cttccccagcctc

SEQ ID NO: 1707062 - DNA, 10 bp, Homo sapiens
cttccccagg

SEQ ID NO: 1707063 - DNA, 12 bp, Homo sapiens
cttccccaggcc

SEQ ID NO: 1707064 - DNA, 17 bp, Homo sapiens
cttccccaggcccacca

SEQ ID NO: 1707065 - DNA, 13 bp, Homo sapiens
cttccccatcccg

SEQ ID NO: 1707066 - DNA, 18 bp, Homo sapiens
cttcccccacccctccac

SEQ ID NO: 1707067 - DNA, 13 bp, Homo sapiens
cttcccccagccc

SEQ ID NO: 1707068 - DNA, 17 bp, Homo sapiens
cttcccccatgtgcctg

SEQ ID NO: 1707069 - DNA, 19 bp, Homo sapiens
cttccccctccccctcctg

SEQ ID NO: 1707070 - DNA, 20 bp, Homo sapiens
cttccccctccccctcctgc

SEQ ID NO: 1707071 - DNA, 21 bp, Homo sapiens
cttcccctcccccactcctct

SEQ ID NO: 1707072 - DNA, 16 bp, Homo sapiens
cttcccctccctggct

SEQ ID NO: 1707073 - DNA, 17 bp, Homo sapiens
cttcccctgcacctggc

SEQ ID NO: 1707074 - DNA, 20 bp, Homo sapiens
cttcccctgcacctggcctg

SEQ ID NO: 1707075 - DNA, 16 bp, Homo sapiens
cttccccttgcccagg

SEQ ID NO: 1707076 - DNA, 19 bp, Homo sapiens
cttcccctttactcagccc

SEQ ID NO: 1707077 - DNA, 23 bp, Homo sapiens
cttcccctttactcagcccagct

SEQ ID NO: 1707078 - DNA, 17 bp, Homo sapiens
cttccccttttgcctgg

SEQ ID NO: 1707079 - DNA, 20 bp, Homo sapiens
cttccccttttgcctggctg

SEQ ID NO: 1707080 - DNA, 18 bp, Homo sapiens
cttcccgctcagccctcc

SEQ ID NO: 1707081 - DNA, 17 bp, Homo sapiens
cttcccgggccagggct

SEQ ID NO: 1707082 - DNA, 19 bp, Homo sapiens
cttcccgggccagggctgc

SEQ ID NO: 1707083 - DNA, 21 bp, Homo sapiens
cttcccgtcccatatcctgcc

SEQ ID NO: 1707084 - DNA, 22 bp, Homo sapiens
cttcccgtcccatatcctgcct

SEQ ID NO: 1707085 - DNA, 13 bp, Homo sapiens
cttccctacctca

SEQ ID NO: 1707086 - DNA, 16 bp, Homo sapiens
cttccctacctcaggc

SEQ ID NO: 1707087 - DNA, 21 bp, Homo sapiens
cttccctagctttagaccctg

SEQ ID NO: 1707088 - DNA, 15 bp, Homo sapiens
cttccctccctatct

SEQ ID NO: 1707089 - DNA, 10 bp, Homo sapiens
cttccctcct

SEQ ID NO: 1707090 - DNA, 13 bp, Homo sapiens
cttccctcctttg

SEQ ID NO: 1707091 - DNA, 14 bp, Homo sapiens
aggaaaaataatca

SEQ ID NO: 1707092 - DNA, 12 bp, Homo sapiens
aggaaaaattca

SEQ ID NO: 1707093 - DNA, 18 bp, Homo sapiens
aggaaaacaaatcactgt

SEQ ID NO: 1707094 - DNA, 12 bp, Homo sapiens
aggaaaacattg

SEQ ID NO: 1707095 - DNA, 13 bp, Homo sapiens
aggaaaagaaaag

SEQ ID NO: 1707096 - DNA, 15 bp, Homo sapiens
aggaaaaggaaaaaa

SEQ ID NO: 1707097 - DNA, 17 bp, Homo sapiens
aggaaaaggttgttgtt

SEQ ID NO: 1707098 - DNA, 22 bp, Homo sapiens
aggaaaagttaaactaaaaaaa

SEQ ID NO: 1707099 - DNA, 11 bp, Homo sapiens
aggaaaatatt

SEQ ID NO: 1707100 - DNA, 13 bp, Homo sapiens
aggaaaatttcac

SEQ ID NO: 1707101 - DNA, 19 bp, Homo sapiens
aggaaacaaccatgtcatt

SEQ ID NO: 1707102 - DNA, 13 bp, Homo sapiens
aggaaacatttta

SEQ ID NO: 1707103 - DNA, 13 bp, Homo sapiens
aggaaaccaacac

SEQ ID NO: 1707104 - DNA, 16 bp, Homo sapiens
aggaaaccgcctagtt

SEQ ID NO: 1707105 - DNA, 21 bp, Homo sapiens
aggaaaccgcctagtttactg

SEQ ID NO: 1707106 - DNA, 16 bp, Homo sapiens
aggaaacgctacctct

SEQ ID NO: 1707107 - DNA, 22 bp, Homo sapiens
aggaaactccacatctgcctta

SEQ ID NO: 1707108 - DNA, 15 bp, Homo sapiens
aggaaactgaagcat

SEQ ID NO: 1707109 - DNA, 21 bp, Homo sapiens
aggaaagaagggggccctgct

SEQ ID NO: 1707110 - DNA, 22 bp, Homo sapiens
aggaaagcaataaatgaatggg

SEQ ID NO: 1707111 - DNA, 23 bp, Homo sapiens
aggaaaggattttaccaaagcat

SEQ ID NO: 1707112 - DNA, 16 bp, Homo sapiens
aggaaaggcttggctg

SEQ ID NO: 1707113 - DNA, 16 bp, Homo sapiens
aggaaagggcctggcc

SEQ ID NO: 1707114 - DNA, 19 bp, Homo sapiens
aggaaaggggcgagcaccc

SEQ ID NO: 1707115 - DNA, 14 bp, Homo sapiens
aggaaagtacattt

SEQ ID NO: 1707116 - DNA, 20 bp, Homo sapiens
aggaaatatatatgtgtgtg

SEQ ID NO: 1707117 - DNA, 15 bp, Homo sapiens
aggaaatctcctctt

SEQ ID NO: 1707118 - DNA, 19 bp, Homo sapiens
aggaaatctcctcttttgt

SEQ ID NO: 1707119 - DNA, 23 bp, Homo sapiens
aggaaatgctattgttgtgggct

SEQ ID NO: 1707120 - DNA, 18 bp, Homo sapiens
aggaaatggagaagctct

SEQ ID NO: 1707121 - DNA, 16 bp, Homo sapiens
aggaaattctccactg

SEQ ID NO: 1707122 - DNA, 14 bp, Homo sapiens
aggaaatttgcagc

SEQ ID NO: 1707123 - DNA, 16 bp, Homo sapiens
aggaacaacagcatct

SEQ ID NO: 1707124 - DNA, 17 bp, Homo sapiens
aggaacacgattttcaa

SEQ ID NO: 1707125 - DNA, 12 bp, Homo sapiens
aggaacactgac

SEQ ID NO: 1707126 - DNA, 13 bp, Homo sapiens
aggaacactgaca

SEQ ID NO: 1707127 - DNA, 12 bp, Homo sapiens
aggaacactggc

SEQ ID NO: 1707128 - DNA, 16 bp, Homo sapiens
aggaacatatgaaaat

SEQ ID NO: 1707129 - DNA, 20 bp, Homo sapiens
aggaaccacaatgtttcttc

SEQ ID NO: 1707130 - DNA, 21 bp, Homo sapiens
aggaacccttgcatccattgt

SEQ ID NO: 1707131 - DNA, 20 bp, Homo sapiens
aggaaccgtggtatgtctgc

SEQ ID NO: 1707132 - DNA, 19 bp, Homo sapiens
aggaaccttccttcctgct

SEQ ID NO: 1707133 - DNA, 18 bp, Homo sapiens
aggaacgagcactggcca

SEQ ID NO: 1707134 - DNA, 21 bp, Homo sapiens
aggaacgctaacaatttctca

SEQ ID NO: 1707135 - DNA, 15 bp, Homo sapiens
aggaacgtttctgaa

SEQ ID NO: 1707136 - DNA, 12 bp, Homo sapiens
aggaactcacat

SEQ ID NO: 1707137 - DNA, 16 bp, Homo sapiens
aggaactgctgggctt

SEQ ID NO: 1707138 - DNA, 13 bp, Homo sapiens
aggaactgggctg

SEQ ID NO: 1707139 - DNA, 18 bp, Homo sapiens
aggaactgggctgggcct

SEQ ID NO: 1707140 - DNA, 18 bp, Homo sapiens
aggaactgtagatgatgt

SEQ ID NO: 1707141 - DNA, 17 bp, Homo sapiens
aggaactgtctcaaaag

SEQ ID NO: 1707142 - DNA, 15 bp, Homo sapiens
aggaacttttgttag

SEQ ID NO: 1707143 - DNA, 13 bp, Homo sapiens
aggaagaaacttt

SEQ ID NO: 1707144 - DNA, 20 bp, Homo sapiens
aggaagaacaacaaagacat

SEQ ID NO: 1707145 - DNA, 21 bp, Homo sapiens
aggaagaacaccctctaaatg

SEQ ID NO: 1707146 - DNA, 18 bp, Homo sapiens
aggaagaacggggctctt

SEQ ID NO: 1707147 - DNA, 22 bp, Homo sapiens
aggaagaacggggctcttctca

SEQ ID NO: 1707148 - DNA, 20 bp, Homo sapiens
aggaagaagaaatctttctc

SEQ ID NO: 1707149 - DNA, 14 bp, Homo sapiens
aggaagagaaacca

SEQ ID NO: 1707150 - DNA, 13 bp, Homo sapiens
aggaagagagaga

SEQ ID NO: 1707151 - DNA, 20 bp, Homo sapiens
aggaagagcaggcacatgga

SEQ ID NO: 1707152 - DNA, 12 bp, Homo sapiens
aggaagagccac

SEQ ID NO: 1707153 - DNA, 14 bp, Homo sapiens
aggaagagccacct

SEQ ID NO: 1707154 - DNA, 16 bp, Homo sapiens
aggaagagctaataaa

SEQ ID NO: 1707155 - DNA, 21 bp, Homo sapiens
aggaagaggcccactagaggg

SEQ ID NO: 1707156 - DNA, 23 bp, Homo sapiens
aggaagaggcccactagagggcc

SEQ ID NO: 1707157 - DNA, 20 bp, Homo sapiens
aggaagatcctgaagcagtt

SEQ ID NO: 1707158 - DNA, 12 bp, Homo sapiens
aggaagcaacag

SEQ ID NO: 1707159 - DNA, 14 bp, Homo sapiens
aggaagcaacagct

SEQ ID NO: 1707160 - DNA, 17 bp, Homo sapiens
aggaagcagcctcagag

SEQ ID NO: 1707161 - DNA, 17 bp, Homo sapiens
aggaagcattgtaaaat

SEQ ID NO: 1707162 - DNA, 12 bp, Homo sapiens
aggaagccaaag

SEQ ID NO: 1707163 - DNA, 18 bp, Homo sapiens
aggaagccaggctgagtg

SEQ ID NO: 1707164 - DNA, 17 bp, Homo sapiens
aggaagcccacatattc

SEQ ID NO: 1707165 - DNA, 21 bp, Homo sapiens
aggaagcccaggctcggagga

SEQ ID NO: 1707166 - DNA, 22 bp, Homo sapiens
aggaagcccaggctcggaggac

SEQ ID NO: 1707167 - DNA, 14 bp, Homo sapiens
aggaagccgtcctg

SEQ ID NO: 1707168 - DNA, 19 bp, Homo sapiens
aggaagcctgcagtcctgg

SEQ ID NO: 1707169 - DNA, 15 bp, Homo sapiens
aggaagcgtggggta

SEQ ID NO: 1707170 - DNA, 23 bp, Homo sapiens
aggaagcttggcttcctcttctt

SEQ ID NO: 1707171 - DNA, 15 bp, Homo sapiens
aggaaggaacaaaga

SEQ ID NO: 1707172 - DNA, 21 bp, Homo sapiens
aggaaggagactcacctctgc

SEQ ID NO: 1707173 - DNA, 23 bp, Homo sapiens
aggaaggagactcacctctgcct

SEQ ID NO: 1707174 - DNA, 17 bp, Homo sapiens
cttcctggaaacagcat

SEQ ID NO: 1707175 - DNA, 12 bp, Homo sapiens
cttcctggacct

SEQ ID NO: 1707176 - DNA, 15 bp, Homo sapiens
cttcctggacctgag

SEQ ID NO: 1707177 - DNA, 16 bp, Homo sapiens
cttcctggacctgagt

SEQ ID NO: 1707178 - DNA, 16 bp, Homo sapiens
cttcctggagcccaga

SEQ ID NO: 1707179 - DNA, 21 bp, Homo sapiens
cttcctggattttctttctat

SEQ ID NO: 1707180 - DNA, 23 bp, Homo sapiens
cttcctggattttctttctatgt

SEQ ID NO: 1707181 - DNA, 11 bp, Homo sapiens
cttcctggcct

SEQ ID NO: 1707182 - DNA, 12 bp, Homo sapiens
cttcctggcctc

SEQ ID NO: 1707183 - DNA, 14 bp, Homo sapiens
cttcctggcctcac

SEQ ID NO: 1707184 - DNA, 19 bp, Homo sapiens
cttcctggcctcactggct

SEQ ID NO: 1707185 - DNA, 13 bp, Homo sapiens
cttcctggcctcc

SEQ ID NO: 1707186 - DNA, 18 bp, Homo sapiens
cttcctggggatgtcata

SEQ ID NO: 1707187 - DNA, 20 bp, Homo sapiens
cttcctggggcatctggcga

SEQ ID NO: 1707188 - DNA, 21 bp, Homo sapiens
cttcctggggccccgctggga

SEQ ID NO: 1707189 - DNA, 10 bp, Homo sapiens
cttcctgggt

SEQ ID NO: 1707190 - DNA, 18 bp, Homo sapiens
cttcctgggtcctgcctg

SEQ ID NO: 1707191 - DNA, 16 bp, Homo sapiens
cttcctgtccagctcc

SEQ ID NO: 1707192 - DNA, 23 bp, Homo sapiens
cttcctgtctttgttgtctccct

SEQ ID NO: 1707193 - DNA, 18 bp, Homo sapiens
cttcctgtgatccaccca

SEQ ID NO: 1707194 - DNA, 15 bp, Homo sapiens
cttcctgtgtgtcca

SEQ ID NO: 1707195 - DNA, 23 bp, Homo sapiens
cttcctgtttttcacattttcct

SEQ ID NO: 1707196 - DNA, 13 bp, Homo sapiens
cttccttcagggt

SEQ ID NO: 1707197 - DNA, 12 bp, Homo sapiens
cttccttcagtt

SEQ ID NO: 1707198 - DNA, 13 bp, Homo sapiens
cttccttcccacc

SEQ ID NO: 1707199 - DNA, 13 bp, Homo sapiens
cttccttccctgg

SEQ ID NO: 1707200 - DNA, 16 bp, Homo sapiens
cttccttccctgggct

SEQ ID NO: 1707201 - DNA, 14 bp, Homo sapiens
cttccttctgggac

SEQ ID NO: 1707202 - DNA, 21 bp, Homo sapiens
cttccttgaagaactgcaggc

SEQ ID NO: 1707203 - DNA, 19 bp, Homo sapiens
cttccttggcatcacaggg

SEQ ID NO: 1707204 - DNA, 14 bp, Homo sapiens
cttccttgtgagga

SEQ ID NO: 1707205 - DNA, 15 bp, Homo sapiens
cttcctttcaggcca

SEQ ID NO: 1707206 - DNA, 15 bp, Homo sapiens
cttcctttctcctgc

SEQ ID NO: 1707207 - DNA, 12 bp, Homo sapiens
cttctgaagatt

SEQ ID NO: 1707208 - DNA, 18 bp, Homo sapiens
cttctgaataaagcaatt

SEQ ID NO: 1707209 - DNA, 13 bp, Homo sapiens
cttctgacaaagg

SEQ ID NO: 1707210 - DNA, 22 bp, Homo sapiens
cttctgacaaaggtggtaaatt

SEQ ID NO: 1707211 - DNA, 20 bp, Homo sapiens
cttctgacgtgccttttgca

SEQ ID NO: 1707212 - DNA, 13 bp, Homo sapiens
cttctgactgctg

SEQ ID NO: 1707213 - DNA, 11 bp, Homo sapiens
cttctgactgt

SEQ ID NO: 1707214 - DNA, 21 bp, Homo sapiens
cttctgactgtttatttaagg

SEQ ID NO: 1707215 - DNA, 14 bp, Homo sapiens
cttctgactttact

SEQ ID NO: 1707216 - DNA, 23 bp, Homo sapiens
cttctgagcactgtttatacact

SEQ ID NO: 1707217 - DNA, 20 bp, Homo sapiens
cttctgagctatttcatcta

SEQ ID NO: 1707218 - DNA, 21 bp, Homo sapiens
cttctgagctccacctctggt

SEQ ID NO: 1707219 - DNA, 23 bp, Homo sapiens
cttctgaggaccgctgataagca

SEQ ID NO: 1707220 - DNA, 16 bp, Homo sapiens
cttctgagtattctca

SEQ ID NO: 1707221 - DNA, 15 bp, Homo sapiens
cttctgattcccctc

SEQ ID NO: 1707222 - DNA, 18 bp, Homo sapiens
cttctgattcccctccac

SEQ ID NO: 1707223 - DNA, 14 bp, Homo sapiens
cttctgatttttct

SEQ ID NO: 1707224 - DNA, 16 bp, Homo sapiens
cttctgatttttctct

SEQ ID NO: 1707225 - DNA, 19 bp, Homo sapiens
cttctgatttttctctttt

SEQ ID NO: 1707226 - DNA, 20 bp, Homo sapiens
cttctgatttttctcttttt

SEQ ID NO: 1707227 - DNA, 12 bp, Homo sapiens
cttctgcaccct

SEQ ID NO: 1707228 - DNA, 21 bp, Homo sapiens
cttctgcaccctccaccctgt

SEQ ID NO: 1707229 - DNA, 21 bp, Homo sapiens
cttctgccctaacctgacaga

SEQ ID NO: 1707230 - DNA, 19 bp, Homo sapiens
cttctgcctaacttgtaaa

SEQ ID NO: 1707231 - DNA, 16 bp, Homo sapiens
cttctgcctggagact

SEQ ID NO: 1707232 - DNA, 18 bp, Homo sapiens
cttctgccttagtctcag

SEQ ID NO: 1707233 - DNA, 14 bp, Homo sapiens
cttctgccttctca

SEQ ID NO: 1707234 - DNA, 15 bp, Homo sapiens
cttctgctccaccct

SEQ ID NO: 1707235 - DNA, 19 bp, Homo sapiens
cttctgctccacccttggc

SEQ ID NO: 1707236 - DNA, 23 bp, Homo sapiens
cttctgctccacccttggcctgt

SEQ ID NO: 1707237 - DNA, 12 bp, Homo sapiens
cttctgctgaaa

SEQ ID NO: 1707238 - DNA, 14 bp, Homo sapiens
cttctgctgccctg

SEQ ID NO: 1707239 - DNA, 15 bp, Homo sapiens
cttctgctgccctga

SEQ ID NO: 1707240 - DNA, 15 bp, Homo sapiens
cttctgctggataaa

SEQ ID NO: 1707241 - DNA, 17 bp, Homo sapiens
cttctgcttttctgccc

SEQ ID NO: 1707242 - DNA, 15 bp, Homo sapiens
cttctggaaggctgg

SEQ ID NO: 1707243 - DNA, 17 bp, Homo sapiens
cttctggaaggctggct

SEQ ID NO: 1707244 - DNA, 18 bp, Homo sapiens
cttctggaaggctggctg

SEQ ID NO: 1707245 - DNA, 16 bp, Homo sapiens
cttctggaatttgttc

SEQ ID NO: 1707246 - DNA, 19 bp, Homo sapiens
cttctggagatggaagctt

SEQ ID NO: 1707247 - DNA, 17 bp, Homo sapiens
cttctggagatggatcc

SEQ ID NO: 1707248 - DNA, 23 bp, Homo sapiens
cttctggagatggatccttccat

SEQ ID NO: 1707249 - DNA, 17 bp, Homo sapiens
cttctggagctgggaga

SEQ ID NO: 1707250 - DNA, 21 bp, Homo sapiens
cttctggcataactaaaatta

SEQ ID NO: 1707251 - DNA, 17 bp, Homo sapiens
cttctggccggtgctgg

SEQ ID NO: 1707252 - DNA, 19 bp, Homo sapiens
cttctggccggtgctgggt

SEQ ID NO: 1707253 - DNA, 23 bp, Homo sapiens
cttctggccggtgctgggttccc

SEQ ID NO: 1707254 - DNA, 19 bp, Homo sapiens
cttctggcctctgctgaat

SEQ ID NO: 1707255 - DNA, 12 bp, Homo sapiens
cttctggctcaa

SEQ ID NO: 1707256 - DNA, 23 bp, Homo sapiens
cttctgggaaaaacaacatcatt

SEQ ID NO: 1707257 - DNA, 22 bp, Homo sapiens
cttctgggcttcatctggcaac

SEQ ID NO: 1707258 - DNA, 17 bp, Homo sapiens
cttctgggcttcattct

SEQ ID NO: 1707259 - DNA, 15 bp, Homo sapiens
cttctggggcaggct

SEQ ID NO: 1707260 - DNA, 15 bp, Homo sapiens
cttctggtactttct

SEQ ID NO: 1707261 - DNA, 15 bp, Homo sapiens
cttctggtgctactc

SEQ ID NO: 1707262 - DNA, 18 bp, Homo sapiens
cttctgtagtactcctta

SEQ ID NO: 1707263 - DNA, 21 bp, Homo sapiens
cttctgtgagacccccacacc

SEQ ID NO: 1707264 - DNA, 22 bp, Homo sapiens
cttctgtgagacccccacacct

SEQ ID NO: 1707265 - DNA, 15 bp, Homo sapiens
cttctgtgatgagct

SEQ ID NO: 1707266 - DNA, 17 bp, Homo sapiens
cttctgtgatgagctga

SEQ ID NO: 1707267 - DNA, 19 bp, Homo sapiens
cttctgtgatgagctgatc

SEQ ID NO: 1707268 - DNA, 18 bp, Homo sapiens
cttctgtgcactagcctg

SEQ ID NO: 1707269 - DNA, 15 bp, Homo sapiens
cttctgtggctcaca

SEQ ID NO: 1707270 - DNA, 22 bp, Homo sapiens
cttctgtggctcacagaaccct

SEQ ID NO: 1707271 - DNA, 13 bp, Homo sapiens
cttctgtgtatct

SEQ ID NO: 1707272 - DNA, 14 bp, Homo sapiens
cttctgtgttcatt

SEQ ID NO: 1707273 - DNA, 15 bp, Homo sapiens
cttctgtgtttctgg

SEQ ID NO: 1707274 - DNA, 17 bp, Homo sapiens
cttctgtgtttctggag

SEQ ID NO: 1707275 - DNA, 14 bp, Homo sapiens
cttctgttctgcag

SEQ ID NO: 1707276 - DNA, 16 bp, Homo sapiens
cttctgttttcttctt

SEQ ID NO: 1707277 - DNA, 15 bp, Homo sapiens
cttcttaaaaggagc

SEQ ID NO: 1707278 - DNA, 22 bp, Homo sapiens
cttcttaaaatcaaatgtaaat

SEQ ID NO: 1707279 - DNA, 17 bp, Homo sapiens
cttcttaaaggcctgga

SEQ ID NO: 1707280 - DNA, 13 bp, Homo sapiens
cttcttacatgca

SEQ ID NO: 1707281 - DNA, 13 bp, Homo sapiens
cttcttatacatt

SEQ ID NO: 1707282 - DNA, 22 bp, Homo sapiens
cttcttattctcactccaccac

SEQ ID NO: 1707283 - DNA, 18 bp, Homo sapiens
cttcttcacccagctaat

SEQ ID NO: 1707284 - DNA, 14 bp, Homo sapiens
cttcttcagagtga

SEQ ID NO: 1707285 - DNA, 17 bp, Homo sapiens
cttcttccacttctcca

SEQ ID NO: 1707286 - DNA, 20 bp, Homo sapiens
cttcttccccaggtccttcc

SEQ ID NO: 1707287 - DNA, 12 bp, Homo sapiens
cttcttccctta

SEQ ID NO: 1707288 - DNA, 16 bp, Homo sapiens
cttcttctaagaagac

SEQ ID NO: 1707289 - DNA, 18 bp, Homo sapiens
cttcttctaagaagacat

SEQ ID NO: 1707290 - DNA, 20 bp, Homo sapiens
cttcttctaagaagacattt

SEQ ID NO: 1707291 - DNA, 22 bp, Homo sapiens
cttcttctaagaagacattttg

SEQ ID NO: 1707292 - DNA, 15 bp, Homo sapiens
cttcttctcaaagca

SEQ ID NO: 1707293 - DNA, 12 bp, Homo sapiens
cttcttgaaggt

SEQ ID NO: 1707294 - DNA, 13 bp, Homo sapiens
cttcttgaatata

SEQ ID NO: 1707295 - DNA, 18 bp, Homo sapiens
cttgaaaataaaaagaga

SEQ ID NO: 1707296 - DNA, 19 bp, Homo sapiens
cttgaaaataaaaagagaa

SEQ ID NO: 1707297 - DNA, 22 bp, Homo sapiens
cttgaaacagattcaggccagc

SEQ ID NO: 1707298 - DNA, 23 bp, Homo sapiens
cttgaaacagattcaggccagcc

SEQ ID NO: 1707299 - DNA, 21 bp, Homo sapiens
cttgaaacctgttaaaacaac

SEQ ID NO: 1707300 - DNA, 16 bp, Homo sapiens
cttgaaactttgggaa

SEQ ID NO: 1707301 - DNA, 19 bp, Homo sapiens
cttgaaatatataatattc

SEQ ID NO: 1707302 - DNA, 15 bp, Homo sapiens
cttgaaatattcaga

SEQ ID NO: 1707303 - DNA, 17 bp, Homo sapiens
cttgaaatcctggaaaa

SEQ ID NO: 1707304 - DNA, 14 bp, Homo sapiens
cttgaaatgaaagg

SEQ ID NO: 1707305 - DNA, 15 bp, Homo sapiens
cttgaaatgaaaggg

SEQ ID NO: 1707306 - DNA, 17 bp, Homo sapiens
cttgaaatgaaagggaa

SEQ ID NO: 1707307 - DNA, 19 bp, Homo sapiens
cttgaaatgaaagggaaac

SEQ ID NO: 1707308 - DNA, 16 bp, Homo sapiens
cttgaaatgtagaatt

SEQ ID NO: 1707309 - DNA, 14 bp, Homo sapiens
cttgaaattttaac

SEQ ID NO: 1707310 - DNA, 15 bp, Homo sapiens
cttgaaattttaacc

SEQ ID NO: 1707311 - DNA, 13 bp, Homo sapiens
cttgaacactggg

SEQ ID NO: 1707312 - DNA, 16 bp, Homo sapiens
cttgaacactggggga

SEQ ID NO: 1707313 - DNA, 15 bp, Homo sapiens
cttgaacccaggaga

SEQ ID NO: 1707314 - DNA, 14 bp, Homo sapiens
cttgaaccccctcc

SEQ ID NO: 1707315 - DNA, 15 bp, Homo sapiens
cttgaacgagcagcc

SEQ ID NO: 1707316 - DNA, 19 bp, Homo sapiens
cttgaacgagcagcccagg

SEQ ID NO: 1707317 - DNA, 20 bp, Homo sapiens
cttgaacgagcagcccaggg

SEQ ID NO: 1707318 - DNA, 13 bp, Homo sapiens
cttgaactgggcg

SEQ ID NO: 1707319 - DNA, 22 bp, Homo sapiens
cttgaagaaacagagtggcctc

SEQ ID NO: 1707320 - DNA, 17 bp, Homo sapiens
cttgaagaactgcaggc

SEQ ID NO: 1707321 - DNA, 15 bp, Homo sapiens
cttgaagactccctg

SEQ ID NO: 1707322 - DNA, 20 bp, Homo sapiens
cttgaagatcgttagtatct

SEQ ID NO: 1707323 - DNA, 19 bp, Homo sapiens
cttgaagcatttcaaagcc

SEQ ID NO: 1707324 - DNA, 15 bp, Homo sapiens
cttgaagccaaagaa

SEQ ID NO: 1707325 - DNA, 16 bp, Homo sapiens
cttgaagccaaagaaa

SEQ ID NO: 1707326 - DNA, 17 bp, Homo sapiens
cttgaagccactgaagc

SEQ ID NO: 1707327 - DNA, 18 bp, Homo sapiens
cttgaagccactgaagct

SEQ ID NO: 1707328 - DNA, 18 bp, Homo sapiens
cttgaagcctccacacca

SEQ ID NO: 1707329 - DNA, 22 bp, Homo sapiens
cttgaagcctccacaccagctg

SEQ ID NO: 1707330 - DNA, 13 bp, Homo sapiens
cttgaaggactgc

SEQ ID NO: 1707331 - DNA, 17 bp, Homo sapiens
cttgaaggactgcagac

SEQ ID NO: 1707332 - DNA, 17 bp, Homo sapiens
cttgaaggccctgctga

SEQ ID NO: 1707333 - DNA, 21 bp, Homo sapiens
cttgaaggccctgctgagtca

SEQ ID NO: 1707334 - DNA, 18 bp, Homo sapiens
cttgaagggccagagcca

SEQ ID NO: 1707335 - DNA, 19 bp, Homo sapiens
cttgaagggccagagccag

SEQ ID NO: 1707336 - DNA, 17 bp, Homo sapiens
cttgaagtcacccggcc

SEQ ID NO: 1707337 - DNA, 21 bp, Homo sapiens
cttgaagtcagccacactggg

SEQ ID NO: 1707338 - DNA, 22 bp, Homo sapiens
cttgaagtcagccacactgggc

SEQ ID NO: 1707339 - DNA, 23 bp, Homo sapiens
cttgaagtcagccacactgggcc

SEQ ID NO: 1707340 - DNA, 23 bp, Homo sapiens
cttgaagtccaggactgggtctg

SEQ ID NO: 1707341 - DNA, 16 bp, Homo sapiens
cttgaagtctgtacag

SEQ ID NO: 1707342 - DNA, 20 bp, Homo sapiens
cttgaagttgggtgtttcca

SEQ ID NO: 1707343 - DNA, 16 bp, Homo sapiens
cttgaatataaaaaat

SEQ ID NO: 1707344 - DNA, 24 bp, Homo sapiens
cttgaatatctgccccagtagtca

SEQ ID NO: 1707345 - DNA, 14 bp, Homo sapiens
cttgaatccttcca

SEQ ID NO: 1707346 - DNA, 23 bp, Homo sapiens
cttgaatccttccattccacaca

SEQ ID NO: 1707347 - DNA, 15 bp, Homo sapiens
cttgaatgctgccag

SEQ ID NO: 1707348 - DNA, 18 bp, Homo sapiens
cttgaatggagctggtga

SEQ ID NO: 1707349 - DNA, 18 bp, Homo sapiens
cttgaattagtatttcag

SEQ ID NO: 1707350 - DNA, 20 bp, Homo sapiens
cttgaatttctaaaaaacag

SEQ ID NO: 1707351 - DNA, 18 bp, Homo sapiens
cttgaatttctggaagat

SEQ ID NO: 1707352 - DNA, 19 bp, Homo sapiens
cttgacaaaacctaacttg

SEQ ID NO: 1707353 - DNA, 20 bp, Homo sapiens
cttgacaaaacctaacttgc

SEQ ID NO: 1707354 - DNA, 14 bp, Homo sapiens
cttgacaacatctg

SEQ ID NO: 1707355 - DNA, 21 bp, Homo sapiens
cttgacacctgtcttgaataa

SEQ ID NO: 1707356 - DNA, 15 bp, Homo sapiens
cttgacagagcagct

SEQ ID NO: 1707357 - DNA, 22 bp, Homo sapiens
cttgacagtatatttgaaactg

SEQ ID NO: 1707358 - DNA, 22 bp, Homo sapiens
cttgacatacctaccagtatta

SEQ ID NO: 1707359 - DNA, 23 bp, Homo sapiens
cttgacattccttgtcaccagca

SEQ ID NO: 1707360 - DNA, 20 bp, Homo sapiens
cttgacatttatcacctctg

SEQ ID NO: 1707361 - DNA, 20 bp, Homo sapiens
cttgaccaacagaaaccttt

SEQ ID NO: 1707362 - DNA, 21 bp, Homo sapiens
cttgaccaacagaaacctttt

SEQ ID NO: 1707363 - DNA, 11 bp, Homo sapiens
cttgaccagca

SEQ ID NO: 1707364 - DNA, 19 bp, Homo sapiens
cttgaccagcagatcccag

SEQ ID NO: 1707365 - DNA, 23 bp, Homo sapiens
cttgaccagcagatcccagctca

SEQ ID NO: 1707366 - DNA, 23 bp, Homo sapiens
cttgaccctgaaaggaacactgg

SEQ ID NO: 1707367 - DNA, 20 bp, Homo sapiens
cttgactaaaaaaaaaagaa

SEQ ID NO: 1707368 - DNA, 21 bp, Homo sapiens
cttgactcccaagtttccata

SEQ ID NO: 1707369 - DNA, 19 bp, Homo sapiens
cttgactgccccttctatg

SEQ ID NO: 1707370 - DNA, 19 bp, Homo sapiens
cttgactgggtgagaccca

SEQ ID NO: 1707371 - DNA, 13 bp, Homo sapiens
cttgactttctga

SEQ ID NO: 1707372 - DNA, 13 bp, Homo sapiens
cttgagaaccttt

SEQ ID NO: 1707373 - DNA, 18 bp, Homo sapiens
cttgagaaccttttcaaa

SEQ ID NO: 1707374 - DNA, 12 bp, Homo sapiens
cttgagaagaca

SEQ ID NO: 1707375 - DNA, 13 bp, Homo sapiens
cttgagaagacat

SEQ ID NO: 1707376 - DNA, 17 bp, Homo sapiens
cttgagacacggagccc

SEQ ID NO: 1707377 - DNA, 20 bp, Homo sapiens
cttgagacccccaagcttcc

SEQ ID NO: 1707378 - DNA, 22 bp, Homo sapiens
cttgagacccccaagcttccac

SEQ ID NO: 1707379 - DNA, 16 bp, Homo sapiens
cttgagacctcagcca

SEQ ID NO: 1707380 - DNA, 19 bp, Homo sapiens
cttgagacctggaaccaga

SEQ ID NO: 1707381 - DNA, 17 bp, Homo sapiens
cttgagagctgctgagg

SEQ ID NO: 1707382 - DNA, 21 bp, Homo sapiens
cttgagcagtggctggtccag

SEQ ID NO: 1707383 - DNA, 23 bp, Homo sapiens
cttgagcatcaatcttgttactg

SEQ ID NO: 1707384 - DNA, 18 bp, Homo sapiens
cttgagccaggaggcctg

SEQ ID NO: 1707385 - DNA, 15 bp, Homo sapiens
aggacccgccagccc

SEQ ID NO: 1707386 - DNA, 16 bp, Homo sapiens
aggacccgccagcccc

SEQ ID NO: 1707387 - DNA, 20 bp, Homo sapiens
aggacccgccagccccgctc

SEQ ID NO: 1707388 - DNA, 20 bp, Homo sapiens
aggacccggaggggcctggc

SEQ ID NO: 1707389 - DNA, 22 bp, Homo sapiens
aggacccggaggggcctggcag

SEQ ID NO: 1707390 - DNA, 17 bp, Homo sapiens
aggacccgggaccacag

SEQ ID NO: 1707391 - DNA, 22 bp, Homo sapiens
aggacccgggaccacagctgct

SEQ ID NO: 1707392 - DNA, 22 bp, Homo sapiens
aggacccggggcccgcctcaca

SEQ ID NO: 1707393 - DNA, 21 bp, Homo sapiens
aggaccctcaggaattcagtg

SEQ ID NO: 1707394 - DNA, 13 bp, Homo sapiens
aggaccctgacct

SEQ ID NO: 1707395 - DNA, 20 bp, Homo sapiens
aggaccgccatggtgctggg

SEQ ID NO: 1707396 - DNA, 19 bp, Homo sapiens
aggaccgtggccctgccct

SEQ ID NO: 1707397 - DNA, 19 bp, Homo sapiens
aggacctagggatgttctg

SEQ ID NO: 1707398 - DNA, 22 bp, Homo sapiens
aggacctagggatgttctggcc

SEQ ID NO: 1707399 - DNA, 21 bp, Homo sapiens
aggacctcggatgaccatact

SEQ ID NO: 1707400 - DNA, 13 bp, Homo sapiens
aggacctctcagc

SEQ ID NO: 1707401 - DNA, 13 bp, Homo sapiens
aggacctctgctt

SEQ ID NO: 1707402 - DNA, 20 bp, Homo sapiens
aggacctgaaattccaaagt

SEQ ID NO: 1707403 - DNA, 18 bp, Homo sapiens
aggacctgcatccttcct

SEQ ID NO: 1707404 - DNA, 21 bp, Homo sapiens
aggacctgcatccttcctggg

SEQ ID NO: 1707405 - DNA, 17 bp, Homo sapiens
aggaccttaagacagag

SEQ ID NO: 1707406 - DNA, 21 bp, Homo sapiens
aggacctttccaccacagcca

SEQ ID NO: 1707407 - DNA, 22 bp, Homo sapiens
aggacctttccaccacagccag

SEQ ID NO: 1707408 - DNA, 18 bp, Homo sapiens
aggacgagacccccatcc

SEQ ID NO: 1707409 - DNA, 21 bp, Homo sapiens
aggacgagacccccatccagc

SEQ ID NO: 1707410 - DNA, 22 bp, Homo sapiens
aggacgagacccccatccagcc

SEQ ID NO: 1707411 - DNA, 22 bp, Homo sapiens
aggacgcgaggggaaaggcctg

SEQ ID NO: 1707412 - DNA, 14 bp, Homo sapiens
aggacgctggctac

SEQ ID NO: 1707413 - DNA, 17 bp, Homo sapiens
aggacggtgccaagggc

SEQ ID NO: 1707414 - DNA, 21 bp, Homo sapiens
aggacggtgccaagggcccca

SEQ ID NO: 1707415 - DNA, 22 bp, Homo sapiens
aggacgtggatgaccctcccct

SEQ ID NO: 1707416 - DNA, 20 bp, Homo sapiens
aggactaacataaaatctgt

SEQ ID NO: 1707417 - DNA, 19 bp, Homo sapiens
aggactaccgcaggcccgg

SEQ ID NO: 1707418 - DNA, 21 bp, Homo sapiens
aggactagaagattagaaact

SEQ ID NO: 1707419 - DNA, 20 bp, Homo sapiens
aggactatatttgggcctgc

SEQ ID NO: 1707420 - DNA, 17 bp, Homo sapiens
aggactcaccactgccc

SEQ ID NO: 1707421 - DNA, 15 bp, Homo sapiens
aggactccaggccca

SEQ ID NO: 1707422 - DNA, 23 bp, Homo sapiens
aggactccaggcccaaggctccc

SEQ ID NO: 1707423 - DNA, 12 bp, Homo sapiens
aggactccctcc

SEQ ID NO: 1707424 - DNA, 17 bp, Homo sapiens
aggactccctcctcacc

SEQ ID NO: 1707425 - DNA, 16 bp, Homo sapiens
aggactctcctcttcg

SEQ ID NO: 1707426 - DNA, 17 bp, Homo sapiens
aggactgaattgtcccc

SEQ ID NO: 1707427 - DNA, 19 bp, Homo sapiens
aggactgaattgtccccag

SEQ ID NO: 1707428 - DNA, 20 bp, Homo sapiens
aggactgaattgtccccagt

SEQ ID NO: 1707429 - DNA, 19 bp, Homo sapiens
aggactgagcaccctctgg

SEQ ID NO: 1707430 - DNA, 12 bp, Homo sapiens
aggactgagggc

SEQ ID NO: 1707431 - DNA, 23 bp, Homo sapiens
aggactgagtcccctccaggaag

SEQ ID NO: 1707432 - DNA, 18 bp, Homo sapiens
aggactgatttcagagtg

SEQ ID NO: 1707433 - DNA, 19 bp, Homo sapiens
aggactgggtctgacctgg

SEQ ID NO: 1707434 - DNA, 14 bp, Homo sapiens
aggactgtaaacat

SEQ ID NO: 1707435 - DNA, 23 bp, Homo sapiens
aggactgtggcgactctgcagag

SEQ ID NO: 1707436 - DNA, 23 bp, Homo sapiens
aggactgtgtttccaaaggttcc

SEQ ID NO: 1707437 - DNA, 16 bp, Homo sapiens
aggactgtttcagtgt

SEQ ID NO: 1707438 - DNA, 21 bp, Homo sapiens
aggacttaaaattagtctttt

SEQ ID NO: 1707439 - DNA, 21 bp, Homo sapiens
aggacttaacggctccaggat

SEQ ID NO: 1707440 - DNA, 20 bp, Homo sapiens
aggacttcctgtccagctcc

SEQ ID NO: 1707441 - DNA, 13 bp, Homo sapiens
aggacttgaaaga

SEQ ID NO: 1707442 - DNA, 16 bp, Homo sapiens
aggacttgaaagaaat

SEQ ID NO: 1707443 - DNA, 17 bp, Homo sapiens
aggacttgatgtacata

SEQ ID NO: 1707444 - DNA, 23 bp, Homo sapiens
aggacttgccacccccagttcct

SEQ ID NO: 1707445 - DNA, 21 bp, Homo sapiens
aggacttgtctccatgtgtat

SEQ ID NO: 1707446 - DNA, 18 bp, Homo sapiens
aggactttgaggcaagtg

SEQ ID NO: 1707447 - DNA, 23 bp, Homo sapiens
aggactttgaggcaagtgtgggc

SEQ ID NO: 1707448 - DNA, 13 bp, Homo sapiens
aggagaaaaacaa

SEQ ID NO: 1707449 - DNA, 16 bp, Homo sapiens
aggagaaacagagaca

SEQ ID NO: 1707450 - DNA, 15 bp, Homo sapiens
aggagaaatgcaata

SEQ ID NO: 1707451 - DNA, 18 bp, Homo sapiens
aggagaaatgcaataact

SEQ ID NO: 1707452 - DNA, 20 bp, Homo sapiens
aggagaaatgcaataactct

SEQ ID NO: 1707453 - DNA, 13 bp, Homo sapiens
aggagaagccagg

SEQ ID NO: 1707454 - DNA, 15 bp, Homo sapiens
aggagaagccaggaa

SEQ ID NO: 1707455 - DNA, 12 bp, Homo sapiens
aggagaagctca

SEQ ID NO: 1707456 - DNA, 13 bp, Homo sapiens
aggagaagctcag

SEQ ID NO: 1707457 - DNA, 15 bp, Homo sapiens
aggagaagctcagct

SEQ ID NO: 1707458 - DNA, 18 bp, Homo sapiens
aggagaagctgatccagt

SEQ ID NO: 1707459 - DNA, 14 bp, Homo sapiens
aggagaagctgcat

SEQ ID NO: 1707460 - DNA, 16 bp, Homo sapiens
aggagaagtattcctg

SEQ ID NO: 1707461 - DNA, 21 bp, Homo sapiens
aggagaatagcagagagccaa

SEQ ID NO: 1707462 - DNA, 20 bp, Homo sapiens
aggagaatcacctgaacccc

SEQ ID NO: 1707463 - DNA, 18 bp, Homo sapiens
aggagaatccaagcgagg

SEQ ID NO: 1707464 - DNA, 20 bp, Homo sapiens
aggagaatcgcttgaaccca

SEQ ID NO: 1707465 - DNA, 20 bp, Homo sapiens
aggagaatcgcttgaacctg

SEQ ID NO: 1707466 - DNA, 16 bp, Homo sapiens
aggagaatgaaatgta

SEQ ID NO: 1707467 - DNA, 20 bp, Homo sapiens
aggagacacgtgtggcgggc

SEQ ID NO: 1707468 - DNA, 12 bp, Homo sapiens
aggagacagaaa

SEQ ID NO: 1707469 - DNA, 13 bp, Homo sapiens
aggagacagaaag

SEQ ID NO: 1707470 - DNA, 15 bp, Homo sapiens
aggagacattgctct

SEQ ID NO: 1707471 - DNA, 19 bp, Homo sapiens
aggagacattgctctatgt

SEQ ID NO: 1707472 - DNA, 23 bp, Homo sapiens
aggagacattgctctatgtctgc

SEQ ID NO: 1707473 - DNA, 17 bp, Homo sapiens
aggagaccaaggcggga

SEQ ID NO: 1707474 - DNA, 14 bp, Homo sapiens
aggagaccctggaa

SEQ ID NO: 1707475 - DNA, 15 bp, Homo sapiens
aggagaccctggaat

SEQ ID NO: 1707476 - DNA, 11 bp, Homo sapiens
aggagactcac

SEQ ID NO: 1707477 - DNA, 21 bp, Homo sapiens
aggagactcacctctgcctca

SEQ ID NO: 1707478 - DNA, 19 bp, Homo sapiens
aggagactccaaggagcta

SEQ ID NO: 1707479 - DNA, 12 bp, Homo sapiens
aggagactgcgt

SEQ ID NO: 1707480 - DNA, 16 bp, Homo sapiens
aggagagacccctccc

SEQ ID NO: 1707481 - DNA, 19 bp, Homo sapiens
aggagagactgaaagcagc

SEQ ID NO: 1707482 - DNA, 18 bp, Homo sapiens
aggagagactgagcagcc

SEQ ID NO: 1707483 - DNA, 22 bp, Homo sapiens
aggagagactgagcagccgcca

SEQ ID NO: 1707484 - DNA, 12 bp, Homo sapiens
aggagagagacc

SEQ ID NO: 1707485 - DNA, 13 bp, Homo sapiens
aggagagagccag

SEQ ID NO: 1707486 - DNA, 14 bp, Homo sapiens
aggagagagccagg

SEQ ID NO: 1707487 - DNA, 15 bp, Homo sapiens
aggagagagccagga

SEQ ID NO: 1707488 - DNA, 16 bp, Homo sapiens
aggagagccagccctc

SEQ ID NO: 1707489 - DNA, 18 bp, Homo sapiens
aggagagcctgctgcatg

SEQ ID NO: 1707490 - DNA, 20 bp, Homo sapiens
aggagaggcgggagaactga

SEQ ID NO: 1707491 - DNA, 19 bp, Homo sapiens
aggagaggggcagaacagc

SEQ ID NO: 1707492 - DNA, 17 bp, Homo sapiens
aggagagtagaacagat

SEQ ID NO: 1707493 - DNA, 17 bp, Homo sapiens
aggagagtcacagaaca

SEQ ID NO: 1707494 - DNA, 20 bp, Homo sapiens
aggagagtggttgttgccaa

SEQ ID NO: 1707495 - DNA, 22 bp, Homo sapiens
aggagatagacgggttgaaaga

SEQ ID NO: 1707496 - DNA, 23 bp, Homo sapiens
aggagatatctgagggaggaggc

SEQ ID NO: 1707497 - DNA, 14 bp, Homo sapiens
aggagatcagcagc

SEQ ID NO: 1707498 - DNA, 15 bp, Homo sapiens
aggagatcagcagcg

SEQ ID NO: 1707499 - DNA, 20 bp, Homo sapiens
aggagatcgagaccatcctg

SEQ ID NO: 1707500 - DNA, 23 bp, Homo sapiens
aggagatcgagaccatcctggct

SEQ ID NO: 1707501 - DNA, 13 bp, Homo sapiens
cttgagccagtaa

SEQ ID NO: 1707502 - DNA, 14 bp, Homo sapiens
cttgagccatccaa

SEQ ID NO: 1707503 - DNA, 12 bp, Homo sapiens
cttgagcccagg

SEQ ID NO: 1707504 - DNA, 13 bp, Homo sapiens
cttgagcccagga

SEQ ID NO: 1707505 - DNA, 17 bp, Homo sapiens
cttgagccgggcccctg

SEQ ID NO: 1707506 - DNA, 19 bp, Homo sapiens
cttgagccgggcccctggg

SEQ ID NO: 1707507 - DNA, 13 bp, Homo sapiens
cttgagcctcccc

SEQ ID NO: 1707508 - DNA, 23 bp, Homo sapiens
cttgagctagagataaaacagaa

SEQ ID NO: 1707509 - DNA, 13 bp, Homo sapiens
cttgagcttggga

SEQ ID NO: 1707510 - DNA, 14 bp, Homo sapiens
cttgaggaaaatat

SEQ ID NO: 1707511 - DNA, 18 bp, Homo sapiens
cttgaggaagcccaggct

SEQ ID NO: 1707512 - DNA, 23 bp, Homo sapiens
cttgaggatggagagcagccagc

SEQ ID NO: 1707513 - DNA, 17 bp, Homo sapiens
cttgaggattgtggaaa

SEQ ID NO: 1707514 - DNA, 13 bp, Homo sapiens
cttgaggccaaga

SEQ ID NO: 1707515 - DNA, 21 bp, Homo sapiens
cttgaggccccgatggactcc

SEQ ID NO: 1707516 - DNA, 22 bp, Homo sapiens
cttgaggccccgatggactcct

SEQ ID NO: 1707517 - DNA, 15 bp, Homo sapiens
cttgaggcctgatct

SEQ ID NO: 1707518 - DNA, 20 bp, Homo sapiens
cttgagggagaatcctccct

SEQ ID NO: 1707519 - DNA, 21 bp, Homo sapiens
cttgagtctcaagggtggcag

SEQ ID NO: 1707520 - DNA, 19 bp, Homo sapiens
cttgagtgttcctttttaa

SEQ ID NO: 1707521 - DNA, 18 bp, Homo sapiens
cttgagttggagtactat

SEQ ID NO: 1707522 - DNA, 16 bp, Homo sapiens
cttgagtttgtcgctc

SEQ ID NO: 1707523 - DNA, 21 bp, Homo sapiens
cttgagtttgtcgctcatgtg

SEQ ID NO: 1707524 - DNA, 18 bp, Homo sapiens
cttgataatattagtgat

SEQ ID NO: 1707525 - DNA, 21 bp, Homo sapiens
cttgataatattagtgattct

SEQ ID NO: 1707526 - DNA, 22 bp, Homo sapiens
cttgataatattagtgattctg

SEQ ID NO: 1707527 - DNA, 16 bp, Homo sapiens
cttgatacccccctct

SEQ ID NO: 1707528 - DNA, 21 bp, Homo sapiens
cttgatacccccctctgtctt

SEQ ID NO: 1707529 - DNA, 23 bp, Homo sapiens
cttgatatttgtatttattcttt

SEQ ID NO: 1707530 - DNA, 23 bp, Homo sapiens
cttgatcaacatcttttcttgcc

SEQ ID NO: 1707531 - DNA, 23 bp, Homo sapiens
cttgatcagccccaccctggcct

SEQ ID NO: 1707532 - DNA, 20 bp, Homo sapiens
cttgatcagtagtttgcatt

SEQ ID NO: 1707533 - DNA, 22 bp, Homo sapiens
cttgatcagtagtttgcatttc

SEQ ID NO: 1707534 - DNA, 14 bp, Homo sapiens
cttgatctctcttg

SEQ ID NO: 1707535 - DNA, 15 bp, Homo sapiens
cttgatctctcttgt

SEQ ID NO: 1707536 - DNA, 20 bp, Homo sapiens
cttgatctctcttgtcctct

SEQ ID NO: 1707537 - DNA, 15 bp, Homo sapiens
cttgatctgtatata

SEQ ID NO: 1707538 - DNA, 22 bp, Homo sapiens
cttgatctgtatatacaataac

SEQ ID NO: 1707539 - DNA, 15 bp, Homo sapiens
cttgatgccagaggg

SEQ ID NO: 1707540 - DNA, 18 bp, Homo sapiens
cttgatgccagagggcca

SEQ ID NO: 1707541 - DNA, 22 bp, Homo sapiens
cttgatgccagagggccagcag

SEQ ID NO: 1707542 - DNA, 23 bp, Homo sapiens
cttgatggggaatccgtgtgtgt

SEQ ID NO: 1707543 - DNA, 14 bp, Homo sapiens
cttgatgtaaaatc

SEQ ID NO: 1707544 - DNA, 22 bp, Homo sapiens
cttgatgtacagattttatttg

SEQ ID NO: 1707545 - DNA, 19 bp, Homo sapiens
cttgatgttccacctgcca

SEQ ID NO: 1707546 - DNA, 20 bp, Homo sapiens
cttgatgttccacctgccac

SEQ ID NO: 1707547 - DNA, 23 bp, Homo sapiens
cttgatgttgcttagtcacttat

SEQ ID NO: 1707548 - DNA, 17 bp, Homo sapiens
cttgatgtttcctggaa

SEQ ID NO: 1707549 - DNA, 21 bp, Homo sapiens
cttgatgtttcctggaagcag

SEQ ID NO: 1707550 - DNA, 13 bp, Homo sapiens
cttgattaaatca

SEQ ID NO: 1707551 - DNA, 14 bp, Homo sapiens
cttgattaaatcaa

SEQ ID NO: 1707552 - DNA, 15 bp, Homo sapiens
cttgattcagtcaca

SEQ ID NO: 1707553 - DNA, 18 bp, Homo sapiens
cttgatttaaacacacag

SEQ ID NO: 1707554 - DNA, 19 bp, Homo sapiens
cttgatttcaaagttttgt

SEQ ID NO: 1707555 - DNA, 14 bp, Homo sapiens
cttgattttcaagc

SEQ ID NO: 1707556 - DNA, 13 bp, Homo sapiens
cttgattttccat

SEQ ID NO: 1707557 - DNA, 22 bp, Homo sapiens
cttgattttccatctaaaaata

SEQ ID NO: 1707558 - DNA, 23 bp, Homo sapiens
cttgcaacttctttctgttgaga

SEQ ID NO: 1707559 - DNA, 16 bp, Homo sapiens
cttgcaagcatgcttg

SEQ ID NO: 1707560 - DNA, 17 bp, Homo sapiens
cttgcaagcatgcttgt

SEQ ID NO: 1707561 - DNA, 22 bp, Homo sapiens
cttgcacactcccctgcactgg

SEQ ID NO: 1707562 - DNA, 14 bp, Homo sapiens
cttgcacagccaac

SEQ ID NO: 1707563 - DNA, 18 bp, Homo sapiens
cttgcacagccaacgaga

SEQ ID NO: 1707564 - DNA, 22 bp, Homo sapiens
cttgcacagccaacgagacaca

SEQ ID NO: 1707565 - DNA, 12 bp, Homo sapiens
cttgcacatttg

SEQ ID NO: 1707566 - DNA, 22 bp, Homo sapiens
cttgcaccccaaagctttcctg

SEQ ID NO: 1707567 - DNA, 18 bp, Homo sapiens
cttgcacccgcctctccc

SEQ ID NO: 1707568 - DNA, 13 bp, Homo sapiens
cttgcacctgcat

SEQ ID NO: 1707569 - DNA, 17 bp, Homo sapiens
cttgcacggtgacccct

SEQ ID NO: 1707570 - DNA, 17 bp, Homo sapiens
cttgcactcttctacca

SEQ ID NO: 1707571 - DNA, 23 bp, Homo sapiens
cttgcactgaagccggacagctg

SEQ ID NO: 1707572 - DNA, 19 bp, Homo sapiens
cttgcagatatctgcatgt

SEQ ID NO: 1707573 - DNA, 16 bp, Homo sapiens
cttgcagcatttacta

SEQ ID NO: 1707574 - DNA, 23 bp, Homo sapiens
cttgcagcatttactatgcacaa

SEQ ID NO: 1707575 - DNA, 21 bp, Homo sapiens
cttgcaggggtcccccctcaa

SEQ ID NO: 1707576 - DNA, 23 bp, Homo sapiens
cttgcaggggtcccccctcaaga

SEQ ID NO: 1707577 - DNA, 21 bp, Homo sapiens
cttgcataataagctaaagag

SEQ ID NO: 1707578 - DNA, 19 bp, Homo sapiens
cttgcatccaactccagga

SEQ ID NO: 1707579 - DNA, 16 bp, Homo sapiens
cttgcatccattgttg

SEQ ID NO: 1707580 - DNA, 18 bp, Homo sapiens
cttgcatctaaccaaaaa

SEQ ID NO: 1707581 - DNA, 22 bp, Homo sapiens
cttgccaatgaggtctgaaatg

SEQ ID NO: 1707582 - DNA, 23 bp, Homo sapiens
cttgccaatgaggtctgaaatgg

SEQ ID NO: 1707583 - DNA, 16 bp, Homo sapiens
cttgccacccccagtt

SEQ ID NO: 1707584 - DNA, 15 bp, Homo sapiens
cttgccactgcactc

SEQ ID NO: 1707585 - DNA, 11 bp, Homo sapiens
cttgccagaga

SEQ ID NO: 1707586 - DNA, 12 bp, Homo sapiens
cttgccagagat

SEQ ID NO: 1707587 - DNA, 23 bp, Homo sapiens
cttgccagggatgggcagcccaa

SEQ ID NO: 1707588 - DNA, 14 bp, Homo sapiens
cttgccatgcagga

SEQ ID NO: 1707589 - DNA, 16 bp, Homo sapiens
cttgccatgcaggaag

SEQ ID NO: 1707590 - DNA, 17 bp, Homo sapiens
cttgccattccaaaata

SEQ ID NO: 1707591 - DNA, 16 bp, Homo sapiens
cttgccatttgtagct

SEQ ID NO: 1707592 - DNA, 14 bp, Homo sapiens
cttgcccagcagct

SEQ ID NO: 1707593 - DNA, 16 bp, Homo sapiens
cttgcccagcagctca

SEQ ID NO: 1707594 - DNA, 13 bp, Homo sapiens
cttgcccagggct

SEQ ID NO: 1707595 - DNA, 16 bp, Homo sapiens
cttgcccagggctcag

SEQ ID NO: 1707596 - DNA, 23 bp, Homo sapiens
cttgcccagggctcagcctggtg

SEQ ID NO: 1707597 - DNA, 14 bp, Homo sapiens
cttgcccatcctga

SEQ ID NO: 1707598 - DNA, 22 bp, Homo sapiens
cttgccccacctcccccttccc

SEQ ID NO: 1707599 - DNA, 17 bp, Homo sapiens
cttgccccactctgcct

SEQ ID NO: 1707600 - DNA, 14 bp, Homo sapiens
cttgcccccatccc

SEQ ID NO: 1707601 - DNA, 18 bp, Homo sapiens
cttgcccccatccctcgg

SEQ ID NO: 1707602 - DNA, 18 bp, Homo sapiens
cttgccccggccccggcc

SEQ ID NO: 1707603 - DNA, 12 bp, Homo sapiens
cttgcccggctg

SEQ ID NO: 1707604 - DNA, 22 bp, Homo sapiens
cttgcccgtcgtgtgctgaaga

SEQ ID NO: 1707605 - DNA, 16 bp, Homo sapiens
cttgccctccgcctgg

SEQ ID NO: 1707606 - DNA, 19 bp, Homo sapiens
cttgccctccgcctgggat

SEQ ID NO: 1707607 - DNA, 15 bp, Homo sapiens
cttgcccttccctgt

SEQ ID NO: 1707608 - DNA, 19 bp, Homo sapiens
cttgcccttccctgtccct

SEQ ID NO: 1707609 - DNA, 12 bp, Homo sapiens
cttgcccttgga

SEQ ID NO: 1707610 - DNA, 13 bp, Homo sapiens
cttgcccttggag

SEQ ID NO: 1707611 - DNA, 22 bp, Homo sapiens
cttgccctttccccccatgttg

SEQ ID NO: 1707612 - DNA, 21 bp, Homo sapiens
cttgcctaaatttaatgctgc

SEQ ID NO: 1707613 - DNA, 21 bp, Homo sapiens
cttgcctaactaactggcagg

SEQ ID NO: 1707614 - DNA, 15 bp, Homo sapiens
cttgcctcaatgcca

SEQ ID NO: 1707615 - DNA, 17 bp, Homo sapiens
cttgcctcatttcccta

SEQ ID NO: 1707616 - DNA, 18 bp, Homo sapiens
cttgcctccaggtgcaga

SEQ ID NO: 1707617 - DNA, 16 bp, Homo sapiens
aggagatgaccaggga

SEQ ID NO: 1707618 - DNA, 19 bp, Homo sapiens
aggagatgaccagggatgc

SEQ ID NO: 1707619 - DNA, 20 bp, Homo sapiens
aggagatggaagttgcagtg

SEQ ID NO: 1707620 - DNA, 15 bp, Homo sapiens
aggagatttcttagt

SEQ ID NO: 1707621 - DNA, 22 bp, Homo sapiens
aggagcacaggcagctggatga

SEQ ID NO: 1707622 - DNA, 19 bp, Homo sapiens
aggagcactggggtggggg

SEQ ID NO: 1707623 - DNA, 14 bp, Homo sapiens
aggagcagagggca

SEQ ID NO: 1707624 - DNA, 16 bp, Homo sapiens
aggagcagagggcagg

SEQ ID NO: 1707625 - DNA, 15 bp, Homo sapiens
aggagcagcagccag

SEQ ID NO: 1707626 - DNA, 16 bp, Homo sapiens
aggagcagcagccagc

SEQ ID NO: 1707627 - DNA, 11 bp, Homo sapiens
aggagcagctt

SEQ ID NO: 1707628 - DNA, 19 bp, Homo sapiens
aggagcaggagcctgagcc

SEQ ID NO: 1707629 - DNA, 18 bp, Homo sapiens
aggagcatatgtcctaga

SEQ ID NO: 1707630 - DNA, 21 bp, Homo sapiens
aggagcatgcgcagaggccag

SEQ ID NO: 1707631 - DNA, 15 bp, Homo sapiens
aggagccaccagttc

SEQ ID NO: 1707632 - DNA, 20 bp, Homo sapiens
aggagcccagccagaaagca

SEQ ID NO: 1707633 - DNA, 14 bp, Homo sapiens
aggagccccagctt

SEQ ID NO: 1707634 - DNA, 14 bp, Homo sapiens
aggagccccgccac

SEQ ID NO: 1707635 - DNA, 18 bp, Homo sapiens
aggagccctgaggacctc

SEQ ID NO: 1707636 - DNA, 23 bp, Homo sapiens
aggagcccttctatacccaccca

SEQ ID NO: 1707637 - DNA, 18 bp, Homo sapiens
aggagccgggcctcccac

SEQ ID NO: 1707638 - DNA, 19 bp, Homo sapiens
aggagcctagcggagccca

SEQ ID NO: 1707639 - DNA, 10 bp, Homo sapiens
aggagcctca

SEQ ID NO: 1707640 - DNA, 12 bp, Homo sapiens
aggagcctcaga

SEQ ID NO: 1707641 - DNA, 21 bp, Homo sapiens
aggagcctcagaagaaaacaa

SEQ ID NO: 1707642 - DNA, 22 bp, Homo sapiens
aggagcctgtgcgtcccagctg

SEQ ID NO: 1707643 - DNA, 22 bp, Homo sapiens
aggagccttcctttctcctgcc

SEQ ID NO: 1707644 - DNA, 14 bp, Homo sapiens
aggagccttgctgg

SEQ ID NO: 1707645 - DNA, 22 bp, Homo sapiens
aggagccttgctgggccaggga

SEQ ID NO: 1707646 - DNA, 19 bp, Homo sapiens
aggagcctttttaaaacac

SEQ ID NO: 1707647 - DNA, 13 bp, Homo sapiens
aggagcgtggact

SEQ ID NO: 1707648 - DNA, 14 bp, Homo sapiens
aggagcgtggactc

SEQ ID NO: 1707649 - DNA, 19 bp, Homo sapiens
aggagcgtggactctgcta

SEQ ID NO: 1707650 - DNA, 18 bp, Homo sapiens
aggagctagcccagtccc

SEQ ID NO: 1707651 - DNA, 20 bp, Homo sapiens
aggagctcaccctgcccgct

SEQ ID NO: 1707652 - DNA, 20 bp, Homo sapiens
aggagctcgcggggcagcaa

SEQ ID NO: 1707653 - DNA, 17 bp, Homo sapiens
aggagctctcaatttta

SEQ ID NO: 1707654 - DNA, 12 bp, Homo sapiens
aggagctctgcg

SEQ ID NO: 1707655 - DNA, 24 bp, Homo sapiens
aggagctctgcgccaggcagagct

SEQ ID NO: 1707656 - DNA, 19 bp, Homo sapiens
aggagctcttcaggcctcc

SEQ ID NO: 1707657 - DNA, 21 bp, Homo sapiens
aggagctcttcaggcctccct

SEQ ID NO: 1707658 - DNA, 22 bp, Homo sapiens
aggagctgactcacacctgaac

SEQ ID NO: 1707659 - DNA, 15 bp, Homo sapiens
aggagctgatacttt

SEQ ID NO: 1707660 - DNA, 14 bp, Homo sapiens
aggagctgcccaga

SEQ ID NO: 1707661 - DNA, 15 bp, Homo sapiens
aggagctggcctgtg

SEQ ID NO: 1707662 - DNA, 19 bp, Homo sapiens
aggagctggctggcaggtg

SEQ ID NO: 1707663 - DNA, 20 bp, Homo sapiens
aggagctggggatccctccc

SEQ ID NO: 1707664 - DNA, 15 bp, Homo sapiens
aggagcttacccaag

SEQ ID NO: 1707665 - DNA, 15 bp, Homo sapiens
aggagcttctcccag

SEQ ID NO: 1707666 - DNA, 16 bp, Homo sapiens
aggagcttgcaagaag

SEQ ID NO: 1707667 - DNA, 19 bp, Homo sapiens
aggagctttctcaatgtct

SEQ ID NO: 1707668 - DNA, 24 bp, Homo sapiens
aggagctttttagtttttcagctt

SEQ ID NO: 1707669 - DNA, 23 bp, Homo sapiens
aggaggaattagttgggatgcca

SEQ ID NO: 1707670 - DNA, 11 bp, Homo sapiens
aggaggagcct

SEQ ID NO: 1707671 - DNA, 14 bp, Homo sapiens
aggaggaggacaca

SEQ ID NO: 1707672 - DNA, 13 bp, Homo sapiens
aggaggaggagcc

SEQ ID NO: 1707673 - DNA, 15 bp, Homo sapiens
aggaggagggagaag

SEQ ID NO: 1707674 - DNA, 18 bp, Homo sapiens
aggaggagggagaagaga

SEQ ID NO: 1707675 - DNA, 15 bp, Homo sapiens
aggaggagggaggcc

SEQ ID NO: 1707676 - DNA, 16 bp, Homo sapiens
aggaggagggaggccg

SEQ ID NO: 1707677 - DNA, 20 bp, Homo sapiens
aggaggattgcttgagccca

SEQ ID NO: 1707678 - DNA, 20 bp, Homo sapiens
aggaggcaggcatggccctg

SEQ ID NO: 1707679 - DNA, 19 bp, Homo sapiens
aggaggcatctggaaaggg

SEQ ID NO: 1707680 - DNA, 18 bp, Homo sapiens
aggaggccaaccagcccg

SEQ ID NO: 1707681 - DNA, 16 bp, Homo sapiens
aggaggccacctctcc

SEQ ID NO: 1707682 - DNA, 18 bp, Homo sapiens
aggaggccacctctccaa

SEQ ID NO: 1707683 - DNA, 14 bp, Homo sapiens
aggaggccccaggc

SEQ ID NO: 1707684 - DNA, 17 bp, Homo sapiens
aggaggcccctggccca

SEQ ID NO: 1707685 - DNA, 19 bp, Homo sapiens
aggaggccctggtgtcagg

SEQ ID NO: 1707686 - DNA, 23 bp, Homo sapiens
aggaggccctggtgtcaggcagg

SEQ ID NO: 1707687 - DNA, 15 bp, Homo sapiens
aggaggcggcccggc

SEQ ID NO: 1707688 - DNA, 21 bp, Homo sapiens
aggaggcgtctcgggagagga

SEQ ID NO: 1707689 - DNA, 14 bp, Homo sapiens
aggaggctgagaca

SEQ ID NO: 1707690 - DNA, 15 bp, Homo sapiens
aggaggctgagacag

SEQ ID NO: 1707691 - DNA, 16 bp, Homo sapiens
aggaggctgaggcagg

SEQ ID NO: 1707692 - DNA, 19 bp, Homo sapiens
aggaggctgaggcaggagg

SEQ ID NO: 1707693 - DNA, 13 bp, Homo sapiens
aggaggctgaggt

SEQ ID NO: 1707694 - DNA, 13 bp, Homo sapiens
aggaggctgcatg

SEQ ID NO: 1707695 - DNA, 15 bp, Homo sapiens
aggaggctgcatgct

SEQ ID NO: 1707696 - DNA, 18 bp, Homo sapiens
aggaggctgcatgctctg

SEQ ID NO: 1707697 - DNA, 21 bp, Homo sapiens
aggaggctggaggaagggggg

SEQ ID NO: 1707698 - DNA, 13 bp, Homo sapiens
aggaggctggcca

SEQ ID NO: 1707699 - DNA, 14 bp, Homo sapiens
aggaggctggccaa

SEQ ID NO: 1707700 - DNA, 17 bp, Homo sapiens
aggagggaatgattggt

SEQ ID NO: 1707701 - DNA, 14 bp, Homo sapiens
aggagggagaagag

SEQ ID NO: 1707702 - DNA, 16 bp, Homo sapiens
aggagggagaagagaa

SEQ ID NO: 1707703 - DNA, 23 bp, Homo sapiens
aggagggagacactggcccctca

SEQ ID NO: 1707704 - DNA, 13 bp, Homo sapiens
aggagggagactg

SEQ ID NO: 1707705 - DNA, 14 bp, Homo sapiens
aggagggaggccag

SEQ ID NO: 1707706 - DNA, 13 bp, Homo sapiens
aggagggatgctg

SEQ ID NO: 1707707 - DNA, 14 bp, Homo sapiens
aggagggatgctgc

SEQ ID NO: 1707708 - DNA, 21 bp, Homo sapiens
aggagggatgctgctccgccc

SEQ ID NO: 1707709 - DNA, 16 bp, Homo sapiens
aggagggatgtgggta

SEQ ID NO: 1707710 - DNA, 14 bp, Homo sapiens
aggagggcagagcc

SEQ ID NO: 1707711 - DNA, 18 bp, Homo sapiens
aggagggcagagccatgg

SEQ ID NO: 1707712 - DNA, 14 bp, Homo sapiens
aggagggcagcaga

SEQ ID NO: 1707713 - DNA, 12 bp, Homo sapiens
aggaggggaaga

SEQ ID NO: 1707714 - DNA, 20 bp, Homo sapiens
aggaggggaaggggctgagg

SEQ ID NO: 1707715 - DNA, 21 bp, Homo sapiens
aggaggggaaggggctgagga

SEQ ID NO: 1707716 - DNA, 23 bp, Homo sapiens
aggaggggcagcgcatgtgtgca

SEQ ID NO: 1707717 - DNA, 16 bp, Homo sapiens
aggaggggctgtaaaa

SEQ ID NO: 1707718 - DNA, 18 bp, Homo sapiens
aggagggtgacgcccagc

SEQ ID NO: 1707719 - DNA, 19 bp, Homo sapiens
aggagggtgacgcccagct

SEQ ID NO: 1707720 - DNA, 15 bp, Homo sapiens
aggagggtggaggaa

SEQ ID NO: 1707721 - DNA, 22 bp, Homo sapiens
aggagggtggaggaaggtgctg

SEQ ID NO: 1707722 - DNA, 13 bp, Homo sapiens
aggaggtggagaa

SEQ ID NO: 1707723 - DNA, 18 bp, Homo sapiens
aggaggtggcagccctgt

SEQ ID NO: 1707724 - DNA, 23 bp, Homo sapiens
aggaggtggcagccctgtaggga

SEQ ID NO: 1707725 - DNA, 23 bp, Homo sapiens
aggaggttgtggatgctccaggg

SEQ ID NO: 1707726 - DNA, 14 bp, Homo sapiens
aggagtaaaattca

SEQ ID NO: 1707727 - DNA, 21 bp, Homo sapiens
aggagtaaaattcagtttttt

SEQ ID NO: 1707728 - DNA, 15 bp, Homo sapiens
aggagtaagacaagt

SEQ ID NO: 1707729 - DNA, 18 bp, Homo sapiens
aggagtaagacaagtggg

SEQ ID NO: 1707730 - DNA, 13 bp, Homo sapiens
aggagtatttttg

SEQ ID NO: 1707731 - DNA, 16 bp, Homo sapiens
aggagtcccaaggaaa

SEQ ID NO: 1707732 - DNA, 17 bp, Homo sapiens
aggagtcccaaggaaag

SEQ ID NO: 1707733 - DNA, 13 bp, Homo sapiens
aggagtctgccac

SEQ ID NO: 1707734 - DNA, 19 bp, Homo sapiens
cttgcctccaggtgcagag

SEQ ID NO: 1707735 - DNA, 14 bp, Homo sapiens
cttgcctccccatt

SEQ ID NO: 1707736 - DNA, 20 bp, Homo sapiens
cttgcctccccatttcccat

SEQ ID NO: 1707737 - DNA, 15 bp, Homo sapiens
cttgcctctgcacac

SEQ ID NO: 1707738 - DNA, 24 bp, Homo sapiens
cttgcctctgcacaccctccagag

SEQ ID NO: 1707739 - DNA, 19 bp, Homo sapiens
cttgcctctgtgctgtgtg

SEQ ID NO: 1707740 - DNA, 12 bp, Homo sapiens
cttgcctcttcc

SEQ ID NO: 1707741 - DNA, 18 bp, Homo sapiens
cttgcctgaacatccttc

SEQ ID NO: 1707742 - DNA, 14 bp, Homo sapiens
cttgcctgcagggc

SEQ ID NO: 1707743 - DNA, 16 bp, Homo sapiens
cttgcctgcagggcca

SEQ ID NO: 1707744 - DNA, 13 bp, Homo sapiens
cttgcctggggtc

SEQ ID NO: 1707745 - DNA, 17 bp, Homo sapiens
cttgcctgtctggctca

SEQ ID NO: 1707746 - DNA, 20 bp, Homo sapiens
cttgcctgtttcccaggccc

SEQ ID NO: 1707747 - DNA, 19 bp, Homo sapiens
cttgccttaaccagtctct

SEQ ID NO: 1707748 - DNA, 20 bp, Homo sapiens
cttgccttaataaatatgta

SEQ ID NO: 1707749 - DNA, 17 bp, Homo sapiens
cttgcctttcgaggcct

SEQ ID NO: 1707750 - DNA, 14 bp, Homo sapiens
cttgcctttgaaga

SEQ ID NO: 1707751 - DNA, 16 bp, Homo sapiens
cttgcgtcctgcagag

SEQ ID NO: 1707752 - DNA, 13 bp, Homo sapiens
cttgctaaagcac

SEQ ID NO: 1707753 - DNA, 17 bp, Homo sapiens
cttgctaaagcactttg

SEQ ID NO: 1707754 - DNA, 21 bp, Homo sapiens
cttgctaaagcactttgcact

SEQ ID NO: 1707755 - DNA, 17 bp, Homo sapiens
cttgctacctgtgagca

SEQ ID NO: 1707756 - DNA, 22 bp, Homo sapiens
cttgctatttgagcatgcacag

SEQ ID NO: 1707757 - DNA, 17 bp, Homo sapiens
cttgctccagattctga

SEQ ID NO: 1707758 - DNA, 21 bp, Homo sapiens
cttgctccagattctgatgca

SEQ ID NO: 1707759 - DNA, 12 bp, Homo sapiens
cttgctccaggg

SEQ ID NO: 1707760 - DNA, 14 bp, Homo sapiens
cttgctccagggtc

SEQ ID NO: 1707761 - DNA, 17 bp, Homo sapiens
cttgctccagggtcttg

SEQ ID NO: 1707762 - DNA, 23 bp, Homo sapiens
cttgctccttttgctctttttgt

SEQ ID NO: 1707763 - DNA, 19 bp, Homo sapiens
cttgctctcctcatctcca

SEQ ID NO: 1707764 - DNA, 23 bp, Homo sapiens
cttgctctgcttgacaacatctg

SEQ ID NO: 1707765 - DNA, 22 bp, Homo sapiens
cttgctctgttacccaggctgg

SEQ ID NO: 1707766 - DNA, 16 bp, Homo sapiens
cttgctcttctttctg

SEQ ID NO: 1707767 - DNA, 18 bp, Homo sapiens
cttgctgaatttcaggca

SEQ ID NO: 1707768 - DNA, 21 bp, Homo sapiens
cttgctgatggctgctagatt

SEQ ID NO: 1707769 - DNA, 22 bp, Homo sapiens
cttgctgctccggtttgggctg

SEQ ID NO: 1707770 - DNA, 13 bp, Homo sapiens
cttgctgctctgc

SEQ ID NO: 1707771 - DNA, 15 bp, Homo sapiens
cttgctgctctgcgt

SEQ ID NO: 1707772 - DNA, 11 bp, Homo sapiens
cttgctgctgc

SEQ ID NO: 1707773 - DNA, 16 bp, Homo sapiens
cttgctgctgccttca

SEQ ID NO: 1707774 - DNA, 13 bp, Homo sapiens
cttgctgcttcta

SEQ ID NO: 1707775 - DNA, 16 bp, Homo sapiens
cttgctggattaatgt

SEQ ID NO: 1707776 - DNA, 12 bp, Homo sapiens
cttgctggcccc

SEQ ID NO: 1707777 - DNA, 16 bp, Homo sapiens
cttgctggccccagcc

SEQ ID NO: 1707778 - DNA, 15 bp, Homo sapiens
cttgctggctctgag

SEQ ID NO: 1707779 - DNA, 19 bp, Homo sapiens
cttgctggctctgagaatc

SEQ ID NO: 1707780 - DNA, 14 bp, Homo sapiens
cttgctgggccagg

SEQ ID NO: 1707781 - DNA, 16 bp, Homo sapiens
cttgctggtctagtca

SEQ ID NO: 1707782 - DNA, 19 bp, Homo sapiens
cttgctgtgtgaccctggg

SEQ ID NO: 1707783 - DNA, 22 bp, Homo sapiens
cttgctgtgtgaccctgggcaa

SEQ ID NO: 1707784 - DNA, 13 bp, Homo sapiens
cttgcttaaattt

SEQ ID NO: 1707785 - DNA, 22 bp, Homo sapiens
cttgcttagtatggttctcaga

SEQ ID NO: 1707786 - DNA, 12 bp, Homo sapiens
cttgcttcagtg

SEQ ID NO: 1707787 - DNA, 13 bp, Homo sapiens
cttgcttcattgt

SEQ ID NO: 1707788 - DNA, 17 bp, Homo sapiens
cttgcttccctaatcta

SEQ ID NO: 1707789 - DNA, 18 bp, Homo sapiens
cttgcttctgtatttcct

SEQ ID NO: 1707790 - DNA, 19 bp, Homo sapiens
cttgcttctgtatttcctt

SEQ ID NO: 1707791 - DNA, 14 bp, Homo sapiens
cttgcttcttactg

SEQ ID NO: 1707792 - DNA, 19 bp, Homo sapiens
cttgcttcttactgataat

SEQ ID NO: 1707793 - DNA, 14 bp, Homo sapiens
cttgcttctttcta

SEQ ID NO: 1707794 - DNA, 18 bp, Homo sapiens
cttgcttctttctagaaa

SEQ ID NO: 1707795 - DNA, 12 bp, Homo sapiens
cttgcttgcctg

SEQ ID NO: 1707796 - DNA, 13 bp, Homo sapiens
cttgcttgctttt

SEQ ID NO: 1707797 - DNA, 16 bp, Homo sapiens
cttgcttggaagccag

SEQ ID NO: 1707798 - DNA, 14 bp, Homo sapiens
cttgctttcctgca

SEQ ID NO: 1707799 - DNA, 13 bp, Homo sapiens
cttgctttgggct

SEQ ID NO: 1707800 - DNA, 21 bp, Homo sapiens
cttgctttgggctttgcaggc

SEQ ID NO: 1707801 - DNA, 22 bp, Homo sapiens
cttgctttggggggtgtgctga

SEQ ID NO: 1707802 - DNA, 17 bp, Homo sapiens
cttgcttttctgtattt

SEQ ID NO: 1707803 - DNA, 14 bp, Homo sapiens
cttggaaaaacagc

SEQ ID NO: 1707804 - DNA, 22 bp, Homo sapiens
cttggaaaaatccagaaagaaa

SEQ ID NO: 1707805 - DNA, 21 bp, Homo sapiens
cttggaaagaaacaaccgttg

SEQ ID NO: 1707806 - DNA, 19 bp, Homo sapiens
cttggaaatgtctgctggt

SEQ ID NO: 1707807 - DNA, 24 bp, Homo sapiens
cttggaaatgtctgctggtatttc

SEQ ID NO: 1707808 - DNA, 15 bp, Homo sapiens
cttggaacaccctgg

SEQ ID NO: 1707809 - DNA, 11 bp, Homo sapiens
cttggaactgc

SEQ ID NO: 1707810 - DNA, 17 bp, Homo sapiens
cttggaactgtcccagc

SEQ ID NO: 1707811 - DNA, 15 bp, Homo sapiens
cttggaagccaggta

SEQ ID NO: 1707812 - DNA, 15 bp, Homo sapiens
cttggaagctgtttg

SEQ ID NO: 1707813 - DNA, 16 bp, Homo sapiens
cttggaagctgtttgg

SEQ ID NO: 1707814 - DNA, 19 bp, Homo sapiens
cttggaagctgtttggaaa

SEQ ID NO: 1707815 - DNA, 22 bp, Homo sapiens
cttggaagggcgttctaggtag

SEQ ID NO: 1707816 - DNA, 14 bp, Homo sapiens
cttggacacttggt

SEQ ID NO: 1707817 - DNA, 14 bp, Homo sapiens
cttggaccactcct

SEQ ID NO: 1707818 - DNA, 18 bp, Homo sapiens
cttggaccactcctgtcc

SEQ ID NO: 1707819 - DNA, 13 bp, Homo sapiens
cttggactacaca

SEQ ID NO: 1707820 - DNA, 16 bp, Homo sapiens
cttggactcattttaa

SEQ ID NO: 1707821 - DNA, 23 bp, Homo sapiens
cttggagaatgtgagaagccagc

SEQ ID NO: 1707822 - DNA, 14 bp, Homo sapiens
cttggagactcctg

SEQ ID NO: 1707823 - DNA, 20 bp, Homo sapiens
cttggagactcctggtctgt

SEQ ID NO: 1707824 - DNA, 13 bp, Homo sapiens
cttggagagagag

SEQ ID NO: 1707825 - DNA, 17 bp, Homo sapiens
cttggagagagaggctg

SEQ ID NO: 1707826 - DNA, 21 bp, Homo sapiens
cttggagagagaggctgcctc

SEQ ID NO: 1707827 - DNA, 23 bp, Homo sapiens
cttggagagagaggctgcctcag

SEQ ID NO: 1707828 - DNA, 14 bp, Homo sapiens
cttggagagctcag

SEQ ID NO: 1707829 - DNA, 23 bp, Homo sapiens
cttggagagctcaggatggctca

SEQ ID NO: 1707830 - DNA, 21 bp, Homo sapiens
cttggagccccagtgccaagc

SEQ ID NO: 1707831 - DNA, 14 bp, Homo sapiens
cttggagctgtcct

SEQ ID NO: 1707832 - DNA, 17 bp, Homo sapiens
cttggagctttggaata

SEQ ID NO: 1707833 - DNA, 18 bp, Homo sapiens
cttggagctttggaatat

SEQ ID NO: 1707834 - DNA, 17 bp, Homo sapiens
cttggagctttttcaaa

SEQ ID NO: 1707835 - DNA, 16 bp, Homo sapiens
cttggaggagagagac

SEQ ID NO: 1707836 - DNA, 19 bp, Homo sapiens
cttggaggagagagacccc

SEQ ID NO: 1707837 - DNA, 19 bp, Homo sapiens
cttggaggatcgtggccaa

SEQ ID NO: 1707838 - DNA, 17 bp, Homo sapiens
cttggaggccaccggga

SEQ ID NO: 1707839 - DNA, 14 bp, Homo sapiens
cttggagggaccaa

SEQ ID NO: 1707840 - DNA, 14 bp, Homo sapiens
cttggagtcccagg

SEQ ID NO: 1707841 - DNA, 14 bp, Homo sapiens
cttggattctctaa

SEQ ID NO: 1707842 - DNA, 23 bp, Homo sapiens
cttggatttgaacttgctctttt

SEQ ID NO: 1707843 - DNA, 18 bp, Homo sapiens
cttggcaaattttaaaac

SEQ ID NO: 1707844 - DNA, 19 bp, Homo sapiens
cttggcaccagacacccag

SEQ ID NO: 1707845 - DNA, 12 bp, Homo sapiens
cttggcacttaa

SEQ ID NO: 1707846 - DNA, 17 bp, Homo sapiens
cttggcacttaagtgca

SEQ ID NO: 1707847 - DNA, 20 bp, Homo sapiens
cttggcatcacagggcagag

SEQ ID NO: 1707848 - DNA, 23 bp, Homo sapiens
cttggcatcgaccacaccagcct

SEQ ID NO: 1707849 - DNA, 20 bp, Homo sapiens
cttggcatgccttccagcac

SEQ ID NO: 1707850 - DNA, 13 bp, Homo sapiens
cttggccacagac

SEQ ID NO: 1707851 - DNA, 17 bp, Homo sapiens
aggagtctgccacttgt

SEQ ID NO: 1707852 - DNA, 19 bp, Homo sapiens
aggagtctgccacttgtca

SEQ ID NO: 1707853 - DNA, 22 bp, Homo sapiens
aggagtcttcagacccagagaa

SEQ ID NO: 1707854 - DNA, 22 bp, Homo sapiens
aggagtgaaacctttagggcag

SEQ ID NO: 1707855 - DNA, 12 bp, Homo sapiens
aggagtgaggaa

SEQ ID NO: 1707856 - DNA, 16 bp, Homo sapiens
aggagtgccaggacca

SEQ ID NO: 1707857 - DNA, 17 bp, Homo sapiens
aggagtgccaggaccag

SEQ ID NO: 1707858 - DNA, 21 bp, Homo sapiens
aggagtgccaggaccagcctg

SEQ ID NO: 1707859 - DNA, 23 bp, Homo sapiens
aggagtgggttttattgtccttc

SEQ ID NO: 1707860 - DNA, 15 bp, Homo sapiens
aggagtgtcctgccc

SEQ ID NO: 1707861 - DNA, 16 bp, Homo sapiens
aggagtgtcctggctg

SEQ ID NO: 1707862 - DNA, 17 bp, Homo sapiens
aggagttagaggccagc

SEQ ID NO: 1707863 - DNA, 19 bp, Homo sapiens
aggagttcaagaccagcct

SEQ ID NO: 1707864 - DNA, 22 bp, Homo sapiens
aggagttcaagactagcctggc

SEQ ID NO: 1707865 - DNA, 13 bp, Homo sapiens
aggagttcataga

SEQ ID NO: 1707866 - DNA, 12 bp, Homo sapiens
aggagttgcctg

SEQ ID NO: 1707867 - DNA, 13 bp, Homo sapiens
aggagttgcctga

SEQ ID NO: 1707868 - DNA, 14 bp, Homo sapiens
aggagttgctgttt

SEQ ID NO: 1707869 - DNA, 17 bp, Homo sapiens
aggagtttgaggctgca

SEQ ID NO: 1707870 - DNA, 19 bp, Homo sapiens
aggagtttgaggctgcagc

SEQ ID NO: 1707871 - DNA, 22 bp, Homo sapiens
aggataagaaagcctaaaattg

SEQ ID NO: 1707872 - DNA, 13 bp, Homo sapiens
aggatacagctct

SEQ ID NO: 1707873 - DNA, 16 bp, Homo sapiens
aggatacagctcttct

SEQ ID NO: 1707874 - DNA, 14 bp, Homo sapiens
aggatacatttaat

SEQ ID NO: 1707875 - DNA, 22 bp, Homo sapiens
aggatacatttaataaaactgc

SEQ ID NO: 1707876 - DNA, 13 bp, Homo sapiens
aggatactctgtc

SEQ ID NO: 1707877 - DNA, 23 bp, Homo sapiens
aggatagaagtatacctgatttt

SEQ ID NO: 1707878 - DNA, 18 bp, Homo sapiens
aggatagatgctggccca

SEQ ID NO: 1707879 - DNA, 20 bp, Homo sapiens
aggatagatgctggcccagg

SEQ ID NO: 1707880 - DNA, 21 bp, Homo sapiens
aggatagatgctggcccaggg

SEQ ID NO: 1707881 - DNA, 17 bp, Homo sapiens
aggatagctaactgtaa

SEQ ID NO: 1707882 - DNA, 20 bp, Homo sapiens
aggatagctaactgtaaatc

SEQ ID NO: 1707883 - DNA, 20 bp, Homo sapiens
aggatagtagttaaataact

SEQ ID NO: 1707884 - DNA, 18 bp, Homo sapiens
aggatatattttcacttt

SEQ ID NO: 1707885 - DNA, 18 bp, Homo sapiens
aggatattgctaattgtg

SEQ ID NO: 1707886 - DNA, 20 bp, Homo sapiens
aggatattgctaattgtgta

SEQ ID NO: 1707887 - DNA, 17 bp, Homo sapiens
aggatattggttcttcc

SEQ ID NO: 1707888 - DNA, 16 bp, Homo sapiens
aggatatttaagaaaa

SEQ ID NO: 1707889 - DNA, 18 bp, Homo sapiens
aggatatttaagaaaata

SEQ ID NO: 1707890 - DNA, 19 bp, Homo sapiens
aggatatttaagaaaatac

SEQ ID NO: 1707891 - DNA, 15 bp, Homo sapiens
aggatcaagaaagtg

SEQ ID NO: 1707892 - DNA, 20 bp, Homo sapiens
aggatcactctctgctggca

SEQ ID NO: 1707893 - DNA, 22 bp, Homo sapiens
aggatcactctctgctggcagg

SEQ ID NO: 1707894 - DNA, 16 bp, Homo sapiens
aggatcccctccaagc

SEQ ID NO: 1707895 - DNA, 16 bp, Homo sapiens
aggatccgctgccacc

SEQ ID NO: 1707896 - DNA, 16 bp, Homo sapiens
aggatccggaaagaag

SEQ ID NO: 1707897 - DNA, 12 bp, Homo sapiens
aggatcgaggca

SEQ ID NO: 1707898 - DNA, 14 bp, Homo sapiens
aggatcgaggcatg

SEQ ID NO: 1707899 - DNA, 20 bp, Homo sapiens
aggatcgtagtgtgtttaaa

SEQ ID NO: 1707900 - DNA, 14 bp, Homo sapiens
aggatcgtggccaa

SEQ ID NO: 1707901 - DNA, 15 bp, Homo sapiens
aggatctaagggaag

SEQ ID NO: 1707902 - DNA, 16 bp, Homo sapiens
aggatctaagggaaga

SEQ ID NO: 1707903 - DNA, 19 bp, Homo sapiens
aggatctataggcagcttc

SEQ ID NO: 1707904 - DNA, 17 bp, Homo sapiens
aggatctcaagccagcc

SEQ ID NO: 1707905 - DNA, 13 bp, Homo sapiens
aggatctgctgag

SEQ ID NO: 1707906 - DNA, 18 bp, Homo sapiens
aggatctgctgaggccca

SEQ ID NO: 1707907 - DNA, 19 bp, Homo sapiens
aggatctgctgaggcccag

SEQ ID NO: 1707908 - DNA, 22 bp, Homo sapiens
aggatctgctgaggcccagtgc

SEQ ID NO: 1707909 - DNA, 17 bp, Homo sapiens
aggatctgtgattggct

SEQ ID NO: 1707910 - DNA, 19 bp, Homo sapiens
aggatctgtgattggctgg

SEQ ID NO: 1707911 - DNA, 20 bp, Homo sapiens
aggatgaatgaggtcccagg

SEQ ID NO: 1707912 - DNA, 18 bp, Homo sapiens
aggatgaattctttcaat

SEQ ID NO: 1707913 - DNA, 19 bp, Homo sapiens
aggatgaattttctgcagc

SEQ ID NO: 1707914 - DNA, 22 bp, Homo sapiens
aggatgaattttctgcagctgt

SEQ ID NO: 1707915 - DNA, 13 bp, Homo sapiens
aggatgagctgga

SEQ ID NO: 1707916 - DNA, 13 bp, Homo sapiens
aggatgaggacag

SEQ ID NO: 1707917 - DNA, 21 bp, Homo sapiens
aggatgcacatttctggattg

SEQ ID NO: 1707918 - DNA, 22 bp, Homo sapiens
aggatgcccagggccactctgc

SEQ ID NO: 1707919 - DNA, 17 bp, Homo sapiens
aggatgccttttctgtg

SEQ ID NO: 1707920 - DNA, 19 bp, Homo sapiens
aggatgctctttcccagga

SEQ ID NO: 1707921 - DNA, 16 bp, Homo sapiens
aggatgctgcagcaga

SEQ ID NO: 1707922 - DNA, 17 bp, Homo sapiens
aggatgctgcagcagag

SEQ ID NO: 1707923 - DNA, 21 bp, Homo sapiens
aggatgcttgattccagtggt

SEQ ID NO: 1707924 - DNA, 13 bp, Homo sapiens
aggatggagagag

SEQ ID NO: 1707925 - DNA, 14 bp, Homo sapiens
aggatggagagagg

SEQ ID NO: 1707926 - DNA, 15 bp, Homo sapiens
aggatggagagaggg

SEQ ID NO: 1707927 - DNA, 15 bp, Homo sapiens
aggatggatggcacc

SEQ ID NO: 1707928 - DNA, 21 bp, Homo sapiens
aggatggatggcaccctggaa

SEQ ID NO: 1707929 - DNA, 22 bp, Homo sapiens
aggatggatggcaccctggaac

SEQ ID NO: 1707930 - DNA, 20 bp, Homo sapiens
aggatgggatgggttccaga

SEQ ID NO: 1707931 - DNA, 15 bp, Homo sapiens
aggatgggggagagg

SEQ ID NO: 1707932 - DNA, 19 bp, Homo sapiens
aggatggggttctggaaat

SEQ ID NO: 1707933 - DNA, 16 bp, Homo sapiens
aggatgggtcagagct

SEQ ID NO: 1707934 - DNA, 16 bp, Homo sapiens
aggatggtgggcagga

SEQ ID NO: 1707935 - DNA, 19 bp, Homo sapiens
aggatggtggttattttaa

SEQ ID NO: 1707936 - DNA, 18 bp, Homo sapiens
aggatgtaaacagtgcct

SEQ ID NO: 1707937 - DNA, 11 bp, Homo sapiens
aggatgtaaag

SEQ ID NO: 1707938 - DNA, 13 bp, Homo sapiens
aggatgtctgggc

SEQ ID NO: 1707939 - DNA, 16 bp, Homo sapiens
aggatgtgtgcatgtg

SEQ ID NO: 1707940 - DNA, 15 bp, Homo sapiens
aggatgttagaaagt

SEQ ID NO: 1707941 - DNA, 17 bp, Homo sapiens
aggattaatctctaaaa

SEQ ID NO: 1707942 - DNA, 18 bp, Homo sapiens
aggattaatctctaaaat

SEQ ID NO: 1707943 - DNA, 13 bp, Homo sapiens
aggattattgata

SEQ ID NO: 1707944 - DNA, 15 bp, Homo sapiens
aggattcctctttgt

SEQ ID NO: 1707945 - DNA, 21 bp, Homo sapiens
aggattgaaaatgtccaggaa

SEQ ID NO: 1707946 - DNA, 21 bp, Homo sapiens
aggattggcaactcttcagac

SEQ ID NO: 1707947 - DNA, 12 bp, Homo sapiens
aggattgtggaa

SEQ ID NO: 1707948 - DNA, 12 bp, Homo sapiens
aggatttaacag

SEQ ID NO: 1707949 - DNA, 13 bp, Homo sapiens
aggatttaaggag

SEQ ID NO: 1707950 - DNA, 12 bp, Homo sapiens
aggatttctggg

SEQ ID NO: 1707951 - DNA, 19 bp, Homo sapiens
aggattttaacaaaagcaa

SEQ ID NO: 1707952 - DNA, 23 bp, Homo sapiens
aggattttaacaaaagcaagact

SEQ ID NO: 1707953 - DNA, 20 bp, Homo sapiens
aggattttaatttcaggaaa

SEQ ID NO: 1707954 - DNA, 16 bp, Homo sapiens
aggattttaccaaagc

SEQ ID NO: 1707955 - DNA, 13 bp, Homo sapiens
aggattttatacc

SEQ ID NO: 1707956 - DNA, 15 bp, Homo sapiens
aggattttgaaccca

SEQ ID NO: 1707957 - DNA, 15 bp, Homo sapiens
aggatttttatcttt

SEQ ID NO: 1707958 - DNA, 19 bp, Homo sapiens
aggcaaaaactgtactgtg

SEQ ID NO: 1707959 - DNA, 20 bp, Homo sapiens
aggcaaacgaataaagatag

SEQ ID NO: 1707960 - DNA, 14 bp, Homo sapiens
aggcaaagctggct

SEQ ID NO: 1707961 - DNA, 19 bp, Homo sapiens
aggcaaatataagctggga

SEQ ID NO: 1707962 - DNA, 22 bp, Homo sapiens
aggcaacactggaacatggcta

SEQ ID NO: 1707963 - DNA, 15 bp, Homo sapiens
aggcaacgcagacca

SEQ ID NO: 1707964 - DNA, 15 bp, Homo sapiens
aggcaactgaggcag

SEQ ID NO: 1707965 - DNA, 19 bp, Homo sapiens
aggcaactgaggcagacag

SEQ ID NO: 1707966 - DNA, 13 bp, Homo sapiens
aggcaagaaaagg

SEQ ID NO: 1707967 - DNA, 15 bp, Homo sapiens
aggcaagaaaaggac

SEQ ID NO: 1707968 - DNA, 15 bp, Homo sapiens
cttggccatgcagaa

SEQ ID NO: 1707969 - DNA, 18 bp, Homo sapiens
cttggccatgcagaaagc

SEQ ID NO: 1707970 - DNA, 12 bp, Homo sapiens
cttggcccagag

SEQ ID NO: 1707971 - DNA, 13 bp, Homo sapiens
cttggcccaggag

SEQ ID NO: 1707972 - DNA, 16 bp, Homo sapiens
cttggcccaggagctc

SEQ ID NO: 1707973 - DNA, 17 bp, Homo sapiens
cttggcccaggagctct

SEQ ID NO: 1707974 - DNA, 20 bp, Homo sapiens
cttggcccaggagctctgcg

SEQ ID NO: 1707975 - DNA, 15 bp, Homo sapiens
cttggcccctgtgtg

SEQ ID NO: 1707976 - DNA, 21 bp, Homo sapiens
cttggccgcacctaaagcagc

SEQ ID NO: 1707977 - DNA, 19 bp, Homo sapiens
cttggcctaaacctcagtt

SEQ ID NO: 1707978 - DNA, 11 bp, Homo sapiens
cttggcctcag

SEQ ID NO: 1707979 - DNA, 16 bp, Homo sapiens
cttggcctgctgtgat

SEQ ID NO: 1707980 - DNA, 16 bp, Homo sapiens
cttggccttgcagctg

SEQ ID NO: 1707981 - DNA, 17 bp, Homo sapiens
cttggccttgcagctgg

SEQ ID NO: 1707982 - DNA, 22 bp, Homo sapiens
cttggccttgcagctggcccac

SEQ ID NO: 1707983 - DNA, 15 bp, Homo sapiens
cttggcggcagcagc

SEQ ID NO: 1707984 - DNA, 13 bp, Homo sapiens
cttggctattgac

SEQ ID NO: 1707985 - DNA, 23 bp, Homo sapiens
cttggctcacaaggcccaggaga

SEQ ID NO: 1707986 - DNA, 24 bp, Homo sapiens
cttggctcactgcaacttctgcct

SEQ ID NO: 1707987 - DNA, 18 bp, Homo sapiens
cttggctcgaatctctgt

SEQ ID NO: 1707988 - DNA, 19 bp, Homo sapiens
cttggctcgaatctctgtg

SEQ ID NO: 1707989 - DNA, 20 bp, Homo sapiens
cttggctcgaatctctgtgc

SEQ ID NO: 1707990 - DNA, 21 bp, Homo sapiens
cttggctcgaatctctgtgcc

SEQ ID NO: 1707991 - DNA, 23 bp, Homo sapiens
cttggctcgatgctgtgggggac

SEQ ID NO: 1707992 - DNA, 13 bp, Homo sapiens
cttggctgacccc

SEQ ID NO: 1707993 - DNA, 16 bp, Homo sapiens
cttggctgacccctct

SEQ ID NO: 1707994 - DNA, 15 bp, Homo sapiens
cttggctgcaggcaa

SEQ ID NO: 1707995 - DNA, 14 bp, Homo sapiens
cttggctgccctgt

SEQ ID NO: 1707996 - DNA, 16 bp, Homo sapiens
cttggctgcttcctgt

SEQ ID NO: 1707997 - DNA, 17 bp, Homo sapiens
cttggctgcttcctgtg

SEQ ID NO: 1707998 - DNA, 12 bp, Homo sapiens
cttggctgtctg

SEQ ID NO: 1707999 - DNA, 12 bp, Homo sapiens
cttggctgtgag

SEQ ID NO: 1708000 - DNA, 18 bp, Homo sapiens
cttggctttatgcaaata

SEQ ID NO: 1708001 - DNA, 23 bp, Homo sapiens
cttggctttcagagccagcctgg

SEQ ID NO: 1708002 - DNA, 22 bp, Homo sapiens
cttggctttcattattagtact

SEQ ID NO: 1708003 - DNA, 16 bp, Homo sapiens
cttgggaactccactc

SEQ ID NO: 1708004 - DNA, 18 bp, Homo sapiens
cttgggaagtcgaggctg

SEQ ID NO: 1708005 - DNA, 17 bp, Homo sapiens
cttgggactgggtttgg

SEQ ID NO: 1708006 - DNA, 17 bp, Homo sapiens
cttgggatagtgttctg

SEQ ID NO: 1708007 - DNA, 19 bp, Homo sapiens
cttgggatagtgttctgct

SEQ ID NO: 1708008 - DNA, 14 bp, Homo sapiens
cttgggcaaggaca

SEQ ID NO: 1708009 - DNA, 23 bp, Homo sapiens
cttgggcatccacccagtgctgc

SEQ ID NO: 1708010 - DNA, 20 bp, Homo sapiens
cttgggcccagctgggctct

SEQ ID NO: 1708011 - DNA, 13 bp, Homo sapiens
cttgggccctgca

SEQ ID NO: 1708012 - DNA, 19 bp, Homo sapiens
cttgggccctgcacagata

SEQ ID NO: 1708013 - DNA, 22 bp, Homo sapiens
cttgggccctgcattggcctgg

SEQ ID NO: 1708014 - DNA, 18 bp, Homo sapiens
cttgggcctcaggctctg

SEQ ID NO: 1708015 - DNA, 19 bp, Homo sapiens
cttgggcctcaggctctgc

SEQ ID NO: 1708016 - DNA, 20 bp, Homo sapiens
cttgggcctcaggctctgca

SEQ ID NO: 1708017 - DNA, 12 bp, Homo sapiens
cttgggcggctg

SEQ ID NO: 1708018 - DNA, 14 bp, Homo sapiens
cttgggcggctgag

SEQ ID NO: 1708019 - DNA, 15 bp, Homo sapiens
cttgggcggctgaga

SEQ ID NO: 1708020 - DNA, 17 bp, Homo sapiens
cttgggctactggcagc

SEQ ID NO: 1708021 - DNA, 15 bp, Homo sapiens
cttgggctcctggct

SEQ ID NO: 1708022 - DNA, 16 bp, Homo sapiens
cttgggctcctggctg

SEQ ID NO: 1708023 - DNA, 22 bp, Homo sapiens
cttgggctcctggctgccaggc

SEQ ID NO: 1708024 - DNA, 16 bp, Homo sapiens
cttgggctgacccagc

SEQ ID NO: 1708025 - DNA, 17 bp, Homo sapiens
cttgggctgacccagca

SEQ ID NO: 1708026 - DNA, 21 bp, Homo sapiens
cttggggaaaatggccatgca

SEQ ID NO: 1708027 - DNA, 23 bp, Homo sapiens
cttggggaaaatggccatgcagg

SEQ ID NO: 1708028 - DNA, 16 bp, Homo sapiens
cttggggaatttcctc

SEQ ID NO: 1708029 - DNA, 17 bp, Homo sapiens
cttggggaatttcctct

SEQ ID NO: 1708030 - DNA, 18 bp, Homo sapiens
cttggggaatttcctcta

SEQ ID NO: 1708031 - DNA, 13 bp, Homo sapiens
cttggggaggcaa

SEQ ID NO: 1708032 - DNA, 19 bp, Homo sapiens
cttggggagttaagacctg

SEQ ID NO: 1708033 - DNA, 23 bp, Homo sapiens
cttggggagttaagacctggcag

SEQ ID NO: 1708034 - DNA, 19 bp, Homo sapiens
cttggggccaccaaagctg

SEQ ID NO: 1708035 - DNA, 17 bp, Homo sapiens
cttggggcccagtgcat

SEQ ID NO: 1708036 - DNA, 13 bp, Homo sapiens
cttggggcctggc

SEQ ID NO: 1708037 - DNA, 14 bp, Homo sapiens
cttggggcctggct

SEQ ID NO: 1708038 - DNA, 19 bp, Homo sapiens
cttggggcctggcttgctc

SEQ ID NO: 1708039 - DNA, 14 bp, Homo sapiens
cttggggctcagcc

SEQ ID NO: 1708040 - DNA, 23 bp, Homo sapiens
cttggggctcagccacagcctga

SEQ ID NO: 1708041 - DNA, 15 bp, Homo sapiens
cttggggctgatgaa

SEQ ID NO: 1708042 - DNA, 15 bp, Homo sapiens
cttgggggaaaatac

SEQ ID NO: 1708043 - DNA, 18 bp, Homo sapiens
cttgggggggtggccgct

SEQ ID NO: 1708044 - DNA, 13 bp, Homo sapiens
cttgggggtcagg

SEQ ID NO: 1708045 - DNA, 18 bp, Homo sapiens
cttgggggttcaggcccg

SEQ ID NO: 1708046 - DNA, 15 bp, Homo sapiens
cttggggtcaagaaa

SEQ ID NO: 1708047 - DNA, 16 bp, Homo sapiens
cttggggtgtggggtg

SEQ ID NO: 1708048 - DNA, 19 bp, Homo sapiens
cttggggtgtggggtgggg

SEQ ID NO: 1708049 - DNA, 14 bp, Homo sapiens
cttgggtccaccat

SEQ ID NO: 1708050 - DNA, 20 bp, Homo sapiens
cttgggtccaccatgcagaa

SEQ ID NO: 1708051 - DNA, 23 bp, Homo sapiens
cttgggtcccccacgtgacagtg

SEQ ID NO: 1708052 - DNA, 19 bp, Homo sapiens
cttgggtgtattctctgta

SEQ ID NO: 1708053 - DNA, 15 bp, Homo sapiens
cttggtagcagcctg

SEQ ID NO: 1708054 - DNA, 14 bp, Homo sapiens
cttggtagttctgt

SEQ ID NO: 1708055 - DNA, 14 bp, Homo sapiens
cttggtcacataca

SEQ ID NO: 1708056 - DNA, 13 bp, Homo sapiens
cttggtcagagcc

SEQ ID NO: 1708057 - DNA, 19 bp, Homo sapiens
cttggtctggctttaagaa

SEQ ID NO: 1708058 - DNA, 14 bp, Homo sapiens
cttggtcttccatg

SEQ ID NO: 1708059 - DNA, 15 bp, Homo sapiens
cttggtgctgtgtgc

SEQ ID NO: 1708060 - DNA, 19 bp, Homo sapiens
cttggtggagcagccagag

SEQ ID NO: 1708061 - DNA, 20 bp, Homo sapiens
cttggtggagcagccagagc

SEQ ID NO: 1708062 - DNA, 21 bp, Homo sapiens
cttggtggggctcgtggcctt

SEQ ID NO: 1708063 - DNA, 12 bp, Homo sapiens
cttggtgtaatt

SEQ ID NO: 1708064 - DNA, 15 bp, Homo sapiens
cttggtgtccacctg

SEQ ID NO: 1708065 - DNA, 17 bp, Homo sapiens
cttggtgtccacctggc

SEQ ID NO: 1708066 - DNA, 21 bp, Homo sapiens
cttggttagacgccttccagg

SEQ ID NO: 1708067 - DNA, 22 bp, Homo sapiens
cttggttcaataaagcactgag

SEQ ID NO: 1708068 - DNA, 21 bp, Homo sapiens
cttggttggctggcagctgag

SEQ ID NO: 1708069 - DNA, 15 bp, Homo sapiens
cttggtttggggaga

SEQ ID NO: 1708070 - DNA, 22 bp, Homo sapiens
cttggtttgttatatcagggaa

SEQ ID NO: 1708071 - DNA, 20 bp, Homo sapiens
cttggtttttactgctctga

SEQ ID NO: 1708072 - DNA, 22 bp, Homo sapiens
cttgtaaaaagggggctgcatt

SEQ ID NO: 1708073 - DNA, 14 bp, Homo sapiens
cttgtaaataaagt

SEQ ID NO: 1708074 - DNA, 19 bp, Homo sapiens
cttgtaaataaagtctatt

SEQ ID NO: 1708075 - DNA, 21 bp, Homo sapiens
cttgtaactccaccaacccat

SEQ ID NO: 1708076 - DNA, 14 bp, Homo sapiens
cttgtaagaccctt

SEQ ID NO: 1708077 - DNA, 22 bp, Homo sapiens
cttgtaatttaaacaggcccag

SEQ ID NO: 1708078 - DNA, 23 bp, Homo sapiens
cttgtaatttaaacatttgttcc

SEQ ID NO: 1708079 - DNA, 19 bp, Homo sapiens
cttgtacatgtgtagcctg

SEQ ID NO: 1708080 - DNA, 22 bp, Homo sapiens
cttgtacatgtgtagcctgtgc

SEQ ID NO: 1708081 - DNA, 19 bp, Homo sapiens
cttgtacatttttaaattc

SEQ ID NO: 1708082 - DNA, 17 bp, Homo sapiens
cttgtaccatagaaaaa

SEQ ID NO: 1708083 - DNA, 23 bp, Homo sapiens
cttgtaccgatgcagctctcttt

SEQ ID NO: 1708084 - DNA, 19 bp, Homo sapiens
ctgtggcacttgcctgggt

SEQ ID NO: 1708085 - DNA, 21 bp, Homo sapiens
ctgtggcagaaaagaggagac

SEQ ID NO: 1708086 - DNA, 23 bp, Homo sapiens
ctgtggcagagttacagttctgt

SEQ ID NO: 1708087 - DNA, 20 bp, Homo sapiens
ctgtggcagccgtcccaggc

SEQ ID NO: 1708088 - DNA, 22 bp, Homo sapiens
ctgtggcagccgtcccaggcca

SEQ ID NO: 1708089 - DNA, 14 bp, Homo sapiens
ctgtggcagctgcc

SEQ ID NO: 1708090 - DNA, 23 bp, Homo sapiens
ctgtggcagctgcccctggcacc

SEQ ID NO: 1708091 - DNA, 14 bp, Homo sapiens
ctgtggcataaatt

SEQ ID NO: 1708092 - DNA, 18 bp, Homo sapiens
ctgtggcatgggtgaaga

SEQ ID NO: 1708093 - DNA, 14 bp, Homo sapiens
ctgtggcatttcca

SEQ ID NO: 1708094 - DNA, 17 bp, Homo sapiens
ctgtggccacagccccc

SEQ ID NO: 1708095 - DNA, 15 bp, Homo sapiens
ctgtggccagagctg

SEQ ID NO: 1708096 - DNA, 16 bp, Homo sapiens
ctgtggccccaccctg

SEQ ID NO: 1708097 - DNA, 17 bp, Homo sapiens
ctgtggccccaccctgg

SEQ ID NO: 1708098 - DNA, 18 bp, Homo sapiens
ctgtggccccaccctggg

SEQ ID NO: 1708099 - DNA, 21 bp, Homo sapiens
ctgtggccccaccctgggccc

SEQ ID NO: 1708100 - DNA, 15 bp, Homo sapiens
ctgtggccccctccg

SEQ ID NO: 1708101 - DNA, 15 bp, Homo sapiens
ctgtggccgcacgcc

SEQ ID NO: 1708102 - DNA, 18 bp, Homo sapiens
ctgtggccgcacgcctct

SEQ ID NO: 1708103 - DNA, 16 bp, Homo sapiens
ctgtggccgccacctg

SEQ ID NO: 1708104 - DNA, 15 bp, Homo sapiens
ctgtggccgtctcct

SEQ ID NO: 1708105 - DNA, 17 bp, Homo sapiens
ctgtggccgtctcctcc

SEQ ID NO: 1708106 - DNA, 18 bp, Homo sapiens
ctgtggccgtctcctccc

SEQ ID NO: 1708107 - DNA, 20 bp, Homo sapiens
ctgtggccgtctcctccctc

SEQ ID NO: 1708108 - DNA, 21 bp, Homo sapiens
ctgtggccgttatctggaagt

SEQ ID NO: 1708109 - DNA, 19 bp, Homo sapiens
ctgtggcctccctgctcta

SEQ ID NO: 1708110 - DNA, 15 bp, Homo sapiens
ctgtggcctgtgtcc

SEQ ID NO: 1708111 - DNA, 16 bp, Homo sapiens
ctgtggcctgtgtcca

SEQ ID NO: 1708112 - DNA, 17 bp, Homo sapiens
ctgtggcctgtgtccca

SEQ ID NO: 1708113 - DNA, 22 bp, Homo sapiens
ctgtggcctgtgtcccatgacc

SEQ ID NO: 1708114 - DNA, 23 bp, Homo sapiens
ctgtggcgactctgcagagtcac

SEQ ID NO: 1708115 - DNA, 14 bp, Homo sapiens
ctgtggcggtgcct

SEQ ID NO: 1708116 - DNA, 18 bp, Homo sapiens
ctgtggcggtgcctgggt

SEQ ID NO: 1708117 - DNA, 19 bp, Homo sapiens
ctgtggctccctcctcctg

SEQ ID NO: 1708118 - DNA, 23 bp, Homo sapiens
ctgtggctccctcctcctgtcct

SEQ ID NO: 1708119 - DNA, 18 bp, Homo sapiens
ctgtggctggaggagctg

SEQ ID NO: 1708120 - DNA, 23 bp, Homo sapiens
ctgtggctggaggagctggcctg

SEQ ID NO: 1708121 - DNA, 20 bp, Homo sapiens
ctgtggcttggagtggccaa

SEQ ID NO: 1708122 - DNA, 18 bp, Homo sapiens
ctgtggctttttgttcag

SEQ ID NO: 1708123 - DNA, 15 bp, Homo sapiens
ctgtgggatgtgcca

SEQ ID NO: 1708124 - DNA, 15 bp, Homo sapiens
ctgtgggccagattg

SEQ ID NO: 1708125 - DNA, 18 bp, Homo sapiens
ctgtgggcgagcatgggg

SEQ ID NO: 1708126 - DNA, 21 bp, Homo sapiens
ctgtgggcgagcatgggggct

SEQ ID NO: 1708127 - DNA, 23 bp, Homo sapiens
ctgtgggctacatgctggggtca

SEQ ID NO: 1708128 - DNA, 21 bp, Homo sapiens
ctgtgggcttatgtctctgcc

SEQ ID NO: 1708129 - DNA, 16 bp, Homo sapiens
ctgtggggatctcagg

SEQ ID NO: 1708130 - DNA, 20 bp, Homo sapiens
ctgtggggcagctgagcagc

SEQ ID NO: 1708131 - DNA, 22 bp, Homo sapiens
ctgtgggggtcatcagggaggg

SEQ ID NO: 1708132 - DNA, 24 bp, Homo sapiens
ctgtgggggtgagggtcccatgtg

SEQ ID NO: 1708133 - DNA, 19 bp, Homo sapiens
ctgtgggggtgtgccccct

SEQ ID NO: 1708134 - DNA, 16 bp, Homo sapiens
ctgtgggtctctgaag

SEQ ID NO: 1708135 - DNA, 20 bp, Homo sapiens
ctgtgggtctctgaagggac

SEQ ID NO: 1708136 - DNA, 15 bp, Homo sapiens
ctgtgggtctctgga

SEQ ID NO: 1708137 - DNA, 22 bp, Homo sapiens
ctgtgggtctgggagtcacaca

SEQ ID NO: 1708138 - DNA, 11 bp, Homo sapiens
ctgtgggtgtg

SEQ ID NO: 1708139 - DNA, 18 bp, Homo sapiens
ctgtggtaggggcaggga

SEQ ID NO: 1708140 - DNA, 21 bp, Homo sapiens
ctgtggtagttggaaacaaat

SEQ ID NO: 1708141 - DNA, 21 bp, Homo sapiens
ctgtggtgatacctataaaga

SEQ ID NO: 1708142 - DNA, 14 bp, Homo sapiens
ctgtggtgatctgt

SEQ ID NO: 1708143 - DNA, 17 bp, Homo sapiens
ctgtggtggctccccct

SEQ ID NO: 1708144 - DNA, 19 bp, Homo sapiens
ctgtggtggctccccctct

SEQ ID NO: 1708145 - DNA, 18 bp, Homo sapiens
ctgtggtggggagaggca

SEQ ID NO: 1708146 - DNA, 15 bp, Homo sapiens
ctgtggttcctctgc

SEQ ID NO: 1708147 - DNA, 16 bp, Homo sapiens
ctgtggtttcagatgt

SEQ ID NO: 1708148 - DNA, 23 bp, Homo sapiens
ctgtggtttcagatgtgcaataa

SEQ ID NO: 1708149 - DNA, 15 bp, Homo sapiens
ctgtggtttcatgtt

SEQ ID NO: 1708150 - DNA, 16 bp, Homo sapiens
ctgtggtttcatgtta

SEQ ID NO: 1708151 - DNA, 17 bp, Homo sapiens
ctgtggtttcatgttag

SEQ ID NO: 1708152 - DNA, 23 bp, Homo sapiens
ctgttcaatgtttttaaaaatct

SEQ ID NO: 1708153 - DNA, 20 bp, Homo sapiens
ctgttcacagaaaaagcatg

SEQ ID NO: 1708154 - DNA, 12 bp, Homo sapiens
ctgttcacagcc

SEQ ID NO: 1708155 - DNA, 19 bp, Homo sapiens
ctgttcacagccagactgg

SEQ ID NO: 1708156 - DNA, 17 bp, Homo sapiens
ctgttcacagtctctgg

SEQ ID NO: 1708157 - DNA, 14 bp, Homo sapiens
ctgttcacccacag

SEQ ID NO: 1708158 - DNA, 15 bp, Homo sapiens
ctgttcactctactt

SEQ ID NO: 1708159 - DNA, 16 bp, Homo sapiens
ctgttcacttttcctc

SEQ ID NO: 1708160 - DNA, 15 bp, Homo sapiens
ctgttcagatgtgca

SEQ ID NO: 1708161 - DNA, 17 bp, Homo sapiens
ctgttcagatgtgcatt

SEQ ID NO: 1708162 - DNA, 14 bp, Homo sapiens
ctgttcagattaaa

SEQ ID NO: 1708163 - DNA, 13 bp, Homo sapiens
ctgttcagcaaac

SEQ ID NO: 1708164 - DNA, 15 bp, Homo sapiens
ctgttcagcaaacta

SEQ ID NO: 1708165 - DNA, 14 bp, Homo sapiens
ctgttcagcgtttt

SEQ ID NO: 1708166 - DNA, 17 bp, Homo sapiens
ctgttcagcttttattc

SEQ ID NO: 1708167 - DNA, 20 bp, Homo sapiens
ctgttcagcttttattcctg

SEQ ID NO: 1708168 - DNA, 12 bp, Homo sapiens
ctgttcagtgag

SEQ ID NO: 1708169 - DNA, 14 bp, Homo sapiens
ctgttcagtgagat

SEQ ID NO: 1708170 - DNA, 20 bp, Homo sapiens
ctgttcagtgtcccgggccc

SEQ ID NO: 1708171 - DNA, 13 bp, Homo sapiens
ctgttcatttcca

SEQ ID NO: 1708172 - DNA, 14 bp, Homo sapiens
ctgttcatttccac

SEQ ID NO: 1708173 - DNA, 21 bp, Homo sapiens
ctgttccaacctcctgctctg

SEQ ID NO: 1708174 - DNA, 13 bp, Homo sapiens
ctgttccagactc

SEQ ID NO: 1708175 - DNA, 14 bp, Homo sapiens
ctgttccagactca

SEQ ID NO: 1708176 - DNA, 22 bp, Homo sapiens
ctgttccagactcaggttccag

SEQ ID NO: 1708177 - DNA, 15 bp, Homo sapiens
ctgttccatgcaact

SEQ ID NO: 1708178 - DNA, 16 bp, Homo sapiens
ctgttccatgcaactg

SEQ ID NO: 1708179 - DNA, 15 bp, Homo sapiens
ctgttcccaactcag

SEQ ID NO: 1708180 - DNA, 13 bp, Homo sapiens
ctgttccccagag

SEQ ID NO: 1708181 - DNA, 15 bp, Homo sapiens
ctgttcccccaccct

SEQ ID NO: 1708182 - DNA, 15 bp, Homo sapiens
ctgttccctagagag

SEQ ID NO: 1708183 - DNA, 17 bp, Homo sapiens
ctgttccctagagagaa

SEQ ID NO: 1708184 - DNA, 19 bp, Homo sapiens
ctgttccctagagagaata

SEQ ID NO: 1708185 - DNA, 22 bp, Homo sapiens
ctgttccctagagagaataaat

SEQ ID NO: 1708186 - DNA, 16 bp, Homo sapiens
ctgttccctctggctt

SEQ ID NO: 1708187 - DNA, 12 bp, Homo sapiens
ctgttccctgga

SEQ ID NO: 1708188 - DNA, 20 bp, Homo sapiens
ctgttctacatagatgctta

SEQ ID NO: 1708189 - DNA, 14 bp, Homo sapiens
ctgttctccctggg

SEQ ID NO: 1708190 - DNA, 16 bp, Homo sapiens
ctgttctcctgtccct

SEQ ID NO: 1708191 - DNA, 21 bp, Homo sapiens
ctgttctcctgtccctccatc

SEQ ID NO: 1708192 - DNA, 19 bp, Homo sapiens
ctgttctgaaaggagacat

SEQ ID NO: 1708193 - DNA, 14 bp, Homo sapiens
ctgttctgcactga

SEQ ID NO: 1708194 - DNA, 16 bp, Homo sapiens
ctgttctgcactgaaa

SEQ ID NO: 1708195 - DNA, 14 bp, Homo sapiens
ctgttctgcagaca

SEQ ID NO: 1708196 - DNA, 20 bp, Homo sapiens
ctgttctgcgctgtgtacaa

SEQ ID NO: 1708197 - DNA, 13 bp, Homo sapiens
ctgttctggagga

SEQ ID NO: 1708198 - DNA, 14 bp, Homo sapiens
ctgttctggaggaa

SEQ ID NO: 1708199 - DNA, 14 bp, Homo sapiens
ctgttctgtttcaa

SEQ ID NO: 1708200 - DNA, 15 bp, Homo sapiens
ctgttctgtttcaag

SEQ ID NO: 1708201 - DNA, 21 bp, Homo sapiens
ctgttctgtttcaaggcactc

SEQ ID NO: 1708202 - DNA, 14 bp, Homo sapiens
ctgttcttacaaat

SEQ ID NO: 1708203 - DNA, 16 bp, Homo sapiens
ctgttcttagagtgta

SEQ ID NO: 1708204 - DNA, 14 bp, Homo sapiens
agcctttttgaaag

SEQ ID NO: 1708205 - DNA, 21 bp, Homo sapiens
agcctttttgtataaaataga

SEQ ID NO: 1708206 - DNA, 13 bp, Homo sapiens
agcgaacttcaca

SEQ ID NO: 1708207 - DNA, 14 bp, Homo sapiens
agcgaagcagagag

SEQ ID NO: 1708208 - DNA, 15 bp, Homo sapiens
agcgaagcagagagg

SEQ ID NO: 1708209 - DNA, 15 bp, Homo sapiens
agcgaaggaacctct

SEQ ID NO: 1708210 - DNA, 20 bp, Homo sapiens
agcgaagggggtcaaaggaa

SEQ ID NO: 1708211 - DNA, 18 bp, Homo sapiens
agcgacagcattttaagg

SEQ ID NO: 1708212 - DNA, 17 bp, Homo sapiens
agcgacccattcagaga

SEQ ID NO: 1708213 - DNA, 15 bp, Homo sapiens
agcgaccgccccctc

SEQ ID NO: 1708214 - DNA, 16 bp, Homo sapiens
agcgaccgccccctcc

SEQ ID NO: 1708215 - DNA, 16 bp, Homo sapiens
agcgactccgttggcc

SEQ ID NO: 1708216 - DNA, 20 bp, Homo sapiens
agcgactccgttggccactc

SEQ ID NO: 1708217 - DNA, 16 bp, Homo sapiens
agcgagaggcagcaag

SEQ ID NO: 1708218 - DNA, 22 bp, Homo sapiens
agcgagcccctcggctctggag

SEQ ID NO: 1708219 - DNA, 19 bp, Homo sapiens
agcgaggaaaggattttac

SEQ ID NO: 1708220 - DNA, 23 bp, Homo sapiens
agcgaggtcaacagagaaggcag

SEQ ID NO: 1708221 - DNA, 14 bp, Homo sapiens
agcgagttgtggaa

SEQ ID NO: 1708222 - DNA, 18 bp, Homo sapiens
agcgatctctcctggcct

SEQ ID NO: 1708223 - DNA, 19 bp, Homo sapiens
agcgatgaatttggagact

SEQ ID NO: 1708224 - DNA, 16 bp, Homo sapiens
agcgatgtgcaggaag

SEQ ID NO: 1708225 - DNA, 23 bp, Homo sapiens
agcgattctcccgcctcagcctc

SEQ ID NO: 1708226 - DNA, 24 bp, Homo sapiens
agcgattctcctgcctcagcctcc

SEQ ID NO: 1708227 - DNA, 15 bp, Homo sapiens
agcgattctcctgtc

SEQ ID NO: 1708228 - DNA, 15 bp, Homo sapiens
agcgatttgaaacac

SEQ ID NO: 1708229 - DNA, 14 bp, Homo sapiens
agcgcaaggcactt

SEQ ID NO: 1708230 - DNA, 22 bp, Homo sapiens
agcgcatgtgtgcatgtgctgt

SEQ ID NO: 1708231 - DNA, 17 bp, Homo sapiens
agcgccaaatgttcatc

SEQ ID NO: 1708232 - DNA, 18 bp, Homo sapiens
agcgcccacccaggtccc

SEQ ID NO: 1708233 - DNA, 16 bp, Homo sapiens
agcgccccgcccccac

SEQ ID NO: 1708234 - DNA, 17 bp, Homo sapiens
agcgccccgcccccacc

SEQ ID NO: 1708235 - DNA, 14 bp, Homo sapiens
agcgcgcaggcctg

SEQ ID NO: 1708236 - DNA, 12 bp, Homo sapiens
agcgcggccagc

SEQ ID NO: 1708237 - DNA, 15 bp, Homo sapiens
agcgcggccagcgtc

SEQ ID NO: 1708238 - DNA, 21 bp, Homo sapiens
agcgcggttttttccacgcag

SEQ ID NO: 1708239 - DNA, 17 bp, Homo sapiens
agcgctcctgccgcaga

SEQ ID NO: 1708240 - DNA, 21 bp, Homo sapiens
agcgctcctgccgcagagctg

SEQ ID NO: 1708241 - DNA, 22 bp, Homo sapiens
agcgctcctgccgcagagctgg

SEQ ID NO: 1708242 - DNA, 13 bp, Homo sapiens
agcgctctcctgg

SEQ ID NO: 1708243 - DNA, 15 bp, Homo sapiens
agcgctctcctggac

SEQ ID NO: 1708244 - DNA, 19 bp, Homo sapiens
agcgctggctccctgggca

SEQ ID NO: 1708245 - DNA, 19 bp, Homo sapiens
agcgcttaaaaaaacaaat

SEQ ID NO: 1708246 - DNA, 18 bp, Homo sapiens
agcggagagagccaagac

SEQ ID NO: 1708247 - DNA, 20 bp, Homo sapiens
agcggaggagaccagctcag

SEQ ID NO: 1708248 - DNA, 17 bp, Homo sapiens
agcggattgctctggag

SEQ ID NO: 1708249 - DNA, 13 bp, Homo sapiens
agcggcagagcaa

SEQ ID NO: 1708250 - DNA, 18 bp, Homo sapiens
agcggcccctcccacaca

SEQ ID NO: 1708251 - DNA, 17 bp, Homo sapiens
agcggccctaagggagt

SEQ ID NO: 1708252 - DNA, 13 bp, Homo sapiens
agcggcgcagagc

SEQ ID NO: 1708253 - DNA, 21 bp, Homo sapiens
agcggctgagtcatgatctcc

SEQ ID NO: 1708254 - DNA, 11 bp, Homo sapiens
agcgggagccc

SEQ ID NO: 1708255 - DNA, 10 bp, Homo sapiens
agcgggcaca

SEQ ID NO: 1708256 - DNA, 11 bp, Homo sapiens
agcgggcacag

SEQ ID NO: 1708257 - DNA, 14 bp, Homo sapiens
agcgggcagatggg

SEQ ID NO: 1708258 - DNA, 23 bp, Homo sapiens
agcgggcaggttctgcctgcttt

SEQ ID NO: 1708259 - DNA, 22 bp, Homo sapiens
agcgggcggaggggatccagcc

SEQ ID NO: 1708260 - DNA, 16 bp, Homo sapiens
agcgggggccttgaag

SEQ ID NO: 1708261 - DNA, 13 bp, Homo sapiens
agcggggggaggg

SEQ ID NO: 1708262 - DNA, 14 bp, Homo sapiens
agcggggggagggt

SEQ ID NO: 1708263 - DNA, 17 bp, Homo sapiens
agcggggtcccctctgt

SEQ ID NO: 1708264 - DNA, 18 bp, Homo sapiens
agcggtccaacgccgcct

SEQ ID NO: 1708265 - DNA, 19 bp, Homo sapiens
agcggtccaacgccgcctt

SEQ ID NO: 1708266 - DNA, 21 bp, Homo sapiens
agcggtggataactagccaga

SEQ ID NO: 1708267 - DNA, 23 bp, Homo sapiens
agcggtggataactagccagaca

SEQ ID NO: 1708268 - DNA, 12 bp, Homo sapiens
ctgtttctaaga

SEQ ID NO: 1708269 - DNA, 14 bp, Homo sapiens
ctgtttctaagaaa

SEQ ID NO: 1708270 - DNA, 15 bp, Homo sapiens
ctgtttctaagaaaa

SEQ ID NO: 1708271 - DNA, 21 bp, Homo sapiens
ctgtttctctgccgctacctc

SEQ ID NO: 1708272 - DNA, 14 bp, Homo sapiens
ctgtttctctgctg

SEQ ID NO: 1708273 - DNA, 16 bp, Homo sapiens
ctgtttctcttgagct

SEQ ID NO: 1708274 - DNA, 20 bp, Homo sapiens
ctgtttctcttgagctggcc

SEQ ID NO: 1708275 - DNA, 16 bp, Homo sapiens
ctgtttctctttcctt

SEQ ID NO: 1708276 - DNA, 17 bp, Homo sapiens
ctgtttctgatttgctg

SEQ ID NO: 1708277 - DNA, 15 bp, Homo sapiens
ctgtttcttcttgtg

SEQ ID NO: 1708278 - DNA, 23 bp, Homo sapiens
ctgtttgaggatatattttcact

SEQ ID NO: 1708279 - DNA, 20 bp, Homo sapiens
ctgtttgatgctatttatgc

SEQ ID NO: 1708280 - DNA, 17 bp, Homo sapiens
ctgtttgatgtatgtgt

SEQ ID NO: 1708281 - DNA, 18 bp, Homo sapiens
ctgtttgatgtatgtgtg

SEQ ID NO: 1708282 - DNA, 22 bp, Homo sapiens
ctgtttgatgtatgtgtgaaac

SEQ ID NO: 1708283 - DNA, 22 bp, Homo sapiens
ctgtttgcatttgatacatttt

SEQ ID NO: 1708284 - DNA, 15 bp, Homo sapiens
ctgtttgccttggct

SEQ ID NO: 1708285 - DNA, 23 bp, Homo sapiens
ctgtttgctcaaaattgcttcta

SEQ ID NO: 1708286 - DNA, 16 bp, Homo sapiens
ctgtttggacccatgg

SEQ ID NO: 1708287 - DNA, 12 bp, Homo sapiens
ctgtttggactg

SEQ ID NO: 1708288 - DNA, 12 bp, Homo sapiens
ctgtttggcact

SEQ ID NO: 1708289 - DNA, 21 bp, Homo sapiens
ctgtttgggttgttggtctgt

SEQ ID NO: 1708290 - DNA, 14 bp, Homo sapiens
ctgtttgttaaaac

SEQ ID NO: 1708291 - DNA, 12 bp, Homo sapiens
ctgtttgttatg

SEQ ID NO: 1708292 - DNA, 20 bp, Homo sapiens
ctgtttgtttcaagaacctg

SEQ ID NO: 1708293 - DNA, 12 bp, Homo sapiens
ctgttttaaatt

SEQ ID NO: 1708294 - DNA, 14 bp, Homo sapiens
ctgttttactgttt

SEQ ID NO: 1708295 - DNA, 15 bp, Homo sapiens
ctgttttactgtttt

SEQ ID NO: 1708296 - DNA, 18 bp, Homo sapiens
ctgttttaggttaaaaaa

SEQ ID NO: 1708297 - DNA, 13 bp, Homo sapiens
ctgttttatgtca

SEQ ID NO: 1708298 - DNA, 15 bp, Homo sapiens
ctgttttcaagtgta

SEQ ID NO: 1708299 - DNA, 13 bp, Homo sapiens
ctgttttccccca

SEQ ID NO: 1708300 - DNA, 21 bp, Homo sapiens
ctgttttctctcggctcccca

SEQ ID NO: 1708301 - DNA, 13 bp, Homo sapiens
ctgttttctgagc

SEQ ID NO: 1708302 - DNA, 15 bp, Homo sapiens
ctgttttctgagccc

SEQ ID NO: 1708303 - DNA, 12 bp, Homo sapiens
ctgttttctgga

SEQ ID NO: 1708304 - DNA, 13 bp, Homo sapiens
ctgttttctggaa

SEQ ID NO: 1708305 - DNA, 16 bp, Homo sapiens
ctgttttctgtttctt

SEQ ID NO: 1708306 - DNA, 18 bp, Homo sapiens
ctgttttcttctcagtct

SEQ ID NO: 1708307 - DNA, 18 bp, Homo sapiens
ctgttttgaatctcataa

SEQ ID NO: 1708308 - DNA, 17 bp, Homo sapiens
ctgttttgagttcctat

SEQ ID NO: 1708309 - DNA, 14 bp, Homo sapiens
ctgttttgggcctc

SEQ ID NO: 1708310 - DNA, 22 bp, Homo sapiens
ctgttttgggcctccatgcccc

SEQ ID NO: 1708311 - DNA, 22 bp, Homo sapiens
ctgttttggggctttcccagga

SEQ ID NO: 1708312 - DNA, 16 bp, Homo sapiens
ctgttttgtgtctggt

SEQ ID NO: 1708313 - DNA, 18 bp, Homo sapiens
ctgttttgtgtctggtgc

SEQ ID NO: 1708314 - DNA, 17 bp, Homo sapiens
ctgttttgtttggcaag

SEQ ID NO: 1708315 - DNA, 21 bp, Homo sapiens
ctgttttgtttggcaaggaaa

SEQ ID NO: 1708316 - DNA, 22 bp, Homo sapiens
ctgttttgtttggcaaggaaag

SEQ ID NO: 1708317 - DNA, 17 bp, Homo sapiens
ctgtttttaagctgttt

SEQ ID NO: 1708318 - DNA, 18 bp, Homo sapiens
ctgtttttaagctgtttc

SEQ ID NO: 1708319 - DNA, 23 bp, Homo sapiens
ctgtttttagagcttccaaatgt

SEQ ID NO: 1708320 - DNA, 18 bp, Homo sapiens
ctgtttttattagccaat

SEQ ID NO: 1708321 - DNA, 12 bp, Homo sapiens
ctgtttttcaca

SEQ ID NO: 1708322 - DNA, 15 bp, Homo sapiens
ctgtttttcacattt

SEQ ID NO: 1708323 - DNA, 23 bp, Homo sapiens
agctaccgtggatctccttccct

SEQ ID NO: 1708324 - DNA, 16 bp, Homo sapiens
agctacctcaaacttc

SEQ ID NO: 1708325 - DNA, 14 bp, Homo sapiens
agctactcagaagc

SEQ ID NO: 1708326 - DNA, 21 bp, Homo sapiens
agctactcagaagcctgaggc

SEQ ID NO: 1708327 - DNA, 13 bp, Homo sapiens
agctactcaggag

SEQ ID NO: 1708328 - DNA, 21 bp, Homo sapiens
agctactcagtggggctggca

SEQ ID NO: 1708329 - DNA, 22 bp, Homo sapiens
agctactcagtggggctggcat

SEQ ID NO: 1708330 - DNA, 19 bp, Homo sapiens
agctactggaatggtgttt

SEQ ID NO: 1708331 - DNA, 13 bp, Homo sapiens
agctactggggag

SEQ ID NO: 1708332 - DNA, 18 bp, Homo sapiens
agctactggggaggctga

SEQ ID NO: 1708333 - DNA, 16 bp, Homo sapiens
agctactgtatgcaaa

SEQ ID NO: 1708334 - DNA, 18 bp, Homo sapiens
agctagaaaaataaaatg

SEQ ID NO: 1708335 - DNA, 16 bp, Homo sapiens
agctagaatatcctat

SEQ ID NO: 1708336 - DNA, 17 bp, Homo sapiens
agctagacacatgaagg

SEQ ID NO: 1708337 - DNA, 15 bp, Homo sapiens
agctagactggagtg

SEQ ID NO: 1708338 - DNA, 15 bp, Homo sapiens
agctagaggccacct

SEQ ID NO: 1708339 - DNA, 17 bp, Homo sapiens
agctagatactggaaac

SEQ ID NO: 1708340 - DNA, 14 bp, Homo sapiens
agctagcgctgccg

SEQ ID NO: 1708341 - DNA, 12 bp, Homo sapiens
agctagctgcca

SEQ ID NO: 1708342 - DNA, 15 bp, Homo sapiens
agctagcttttagga

SEQ ID NO: 1708343 - DNA, 16 bp, Homo sapiens
agctagcttttaggaa

SEQ ID NO: 1708344 - DNA, 20 bp, Homo sapiens
agctagcttttaggaaaatc

SEQ ID NO: 1708345 - DNA, 13 bp, Homo sapiens
agctaggaatgaa

SEQ ID NO: 1708346 - DNA, 17 bp, Homo sapiens
agctaggactgaggagt

SEQ ID NO: 1708347 - DNA, 15 bp, Homo sapiens
agctaggccccagag

SEQ ID NO: 1708348 - DNA, 19 bp, Homo sapiens
agctaggccccagaggccc

SEQ ID NO: 1708349 - DNA, 20 bp, Homo sapiens
agctaggccccagaggccct

SEQ ID NO: 1708350 - DNA, 22 bp, Homo sapiens
agctaggccccagaggccctgg

SEQ ID NO: 1708351 - DNA, 23 bp, Homo sapiens
agctaggcttcccaggctgggct

SEQ ID NO: 1708352 - DNA, 16 bp, Homo sapiens
agctagtagcaatgtg

SEQ ID NO: 1708353 - DNA, 16 bp, Homo sapiens
agctagtatcttcaaa

SEQ ID NO: 1708354 - DNA, 12 bp, Homo sapiens
agctagtgcctt

SEQ ID NO: 1708355 - DNA, 21 bp, Homo sapiens
agctagtgcctttagagggta

SEQ ID NO: 1708356 - DNA, 17 bp, Homo sapiens
agctataaagtatatat

SEQ ID NO: 1708357 - DNA, 16 bp, Homo sapiens
agctataatgtttccc

SEQ ID NO: 1708358 - DNA, 15 bp, Homo sapiens
agctataattctgtt

SEQ ID NO: 1708359 - DNA, 18 bp, Homo sapiens
agctatacctcacaataa

SEQ ID NO: 1708360 - DNA, 17 bp, Homo sapiens
agctatataagacaaga

SEQ ID NO: 1708361 - DNA, 17 bp, Homo sapiens
agctatatatttaggaa

SEQ ID NO: 1708362 - DNA, 13 bp, Homo sapiens
agctatatttgat

SEQ ID NO: 1708363 - DNA, 16 bp, Homo sapiens
agctatatttgattat

SEQ ID NO: 1708364 - DNA, 15 bp, Homo sapiens
agctatcagtgcttt

SEQ ID NO: 1708365 - DNA, 16 bp, Homo sapiens
agctatcagtgctttg

SEQ ID NO: 1708366 - DNA, 20 bp, Homo sapiens
agctatcattgcttcctcct

SEQ ID NO: 1708367 - DNA, 18 bp, Homo sapiens
agctatctaggtggagtt

SEQ ID NO: 1708368 - DNA, 20 bp, Homo sapiens
agctatgagagatgtgtcca

SEQ ID NO: 1708369 - DNA, 19 bp, Homo sapiens
agctatgattatgccactg

SEQ ID NO: 1708370 - DNA, 18 bp, Homo sapiens
agctatgggagccccagg

SEQ ID NO: 1708371 - DNA, 15 bp, Homo sapiens
agctattaagaaaat

SEQ ID NO: 1708372 - DNA, 16 bp, Homo sapiens
agctatttatgggccc

SEQ ID NO: 1708373 - DNA, 13 bp, Homo sapiens
agctatttcatct

SEQ ID NO: 1708374 - DNA, 22 bp, Homo sapiens
agctcaaataggtcatcatgaa

SEQ ID NO: 1708375 - DNA, 21 bp, Homo sapiens
agctcaactcacagcttctcc

SEQ ID NO: 1708376 - DNA, 23 bp, Homo sapiens
agctcaagaattgttagcaaatg

SEQ ID NO: 1708377 - DNA, 16 bp, Homo sapiens
agctcaagggctggca

SEQ ID NO: 1708378 - DNA, 17 bp, Homo sapiens
agctcaagggctggcac

SEQ ID NO: 1708379 - DNA, 18 bp, Homo sapiens
agctcaagggctggcact

SEQ ID NO: 1708380 - DNA, 20 bp, Homo sapiens
agctcaagggctggcacttt

SEQ ID NO: 1708381 - DNA, 22 bp, Homo sapiens
agctcacaccctaccttcccca

SEQ ID NO: 1708382 - DNA, 21 bp, Homo sapiens
agctcacactccagtggcaga

SEQ ID NO: 1708383 - DNA, 14 bp, Homo sapiens
cttaactatttcac

SEQ ID NO: 1708384 - DNA, 16 bp, Homo sapiens
cttaactatttcacat

SEQ ID NO: 1708385 - DNA, 22 bp, Homo sapiens
cttaacttaaattttaatttat

SEQ ID NO: 1708386 - DNA, 18 bp, Homo sapiens
cttaacttcttgcttctt

SEQ ID NO: 1708387 - DNA, 12 bp, Homo sapiens
cttaacttgttt

SEQ ID NO: 1708388 - DNA, 20 bp, Homo sapiens
cttaactttcccatggtcaa

SEQ ID NO: 1708389 - DNA, 12 bp, Homo sapiens
cttaagaaataa

SEQ ID NO: 1708390 - DNA, 15 bp, Homo sapiens
cttaagaaataaatc

SEQ ID NO: 1708391 - DNA, 13 bp, Homo sapiens
cttaagaactgtg

SEQ ID NO: 1708392 - DNA, 20 bp, Homo sapiens
cttaagacaaatgggactga

SEQ ID NO: 1708393 - DNA, 19 bp, Homo sapiens
cttaagacagagtatcctg

SEQ ID NO: 1708394 - DNA, 22 bp, Homo sapiens
cttaagacctactgttctaaag

SEQ ID NO: 1708395 - DNA, 14 bp, Homo sapiens
cttaagatattgaa

SEQ ID NO: 1708396 - DNA, 16 bp, Homo sapiens
cttaagatctgactgc

SEQ ID NO: 1708397 - DNA, 19 bp, Homo sapiens
cttaagatggaaatacagt

SEQ ID NO: 1708398 - DNA, 17 bp, Homo sapiens
cttaagattctttgtga

SEQ ID NO: 1708399 - DNA, 17 bp, Homo sapiens
cttaagcaaaagaaaaa

SEQ ID NO: 1708400 - DNA, 22 bp, Homo sapiens
cttaagcaaaggggacagctgt

SEQ ID NO: 1708401 - DNA, 21 bp, Homo sapiens
cttaagcagaacaaatgtgtt

SEQ ID NO: 1708402 - DNA, 15 bp, Homo sapiens
cttaagcagcaacag

SEQ ID NO: 1708403 - DNA, 18 bp, Homo sapiens
cttaagcagcatggaaaa

SEQ ID NO: 1708404 - DNA, 20 bp, Homo sapiens
cttaagcagcatggaaaaat

SEQ ID NO: 1708405 - DNA, 22 bp, Homo sapiens
cttaagcagcatggaaaaatgg

SEQ ID NO: 1708406 - DNA, 18 bp, Homo sapiens
cttaagcatctggctcta

SEQ ID NO: 1708407 - DNA, 21 bp, Homo sapiens
cttaagccaaactcaggccca

SEQ ID NO: 1708408 - DNA, 19 bp, Homo sapiens
cttaagcccagtgcactga

SEQ ID NO: 1708409 - DNA, 22 bp, Homo sapiens
cttaagtcagatttttatttat

SEQ ID NO: 1708410 - DNA, 18 bp, Homo sapiens
cttaagtgagcagaacag

SEQ ID NO: 1708411 - DNA, 20 bp, Homo sapiens
cttaagtgagcagaacaggt

SEQ ID NO: 1708412 - DNA, 16 bp, Homo sapiens
cttaagtgcacttttt

SEQ ID NO: 1708413 - DNA, 20 bp, Homo sapiens
cttaagtgcccacatttgat

SEQ ID NO: 1708414 - DNA, 20 bp, Homo sapiens
cttaagttagcctccaccac

SEQ ID NO: 1708415 - DNA, 15 bp, Homo sapiens
cttaagttttagtct

SEQ ID NO: 1708416 - DNA, 17 bp, Homo sapiens
cttaagttttagtcttt

SEQ ID NO: 1708417 - DNA, 14 bp, Homo sapiens
cttaagtttttcca

SEQ ID NO: 1708418 - DNA, 13 bp, Homo sapiens
cttaataagtatt

SEQ ID NO: 1708419 - DNA, 14 bp, Homo sapiens
cttaatatgttaac

SEQ ID NO: 1708420 - DNA, 20 bp, Homo sapiens
cttaatcaggtcctcagaga

SEQ ID NO: 1708421 - DNA, 23 bp, Homo sapiens
cttaatcattttttatatatatg

SEQ ID NO: 1708422 - DNA, 22 bp, Homo sapiens
cttaatccaatattttgccttt

SEQ ID NO: 1708423 - DNA, 22 bp, Homo sapiens
cttaatctaatctaaaagctct

SEQ ID NO: 1708424 - DNA, 14 bp, Homo sapiens
cttaatcttgcttt

SEQ ID NO: 1708425 - DNA, 16 bp, Homo sapiens
cttaatcttgctttct

SEQ ID NO: 1708426 - DNA, 17 bp, Homo sapiens
cttaatgcttgtaattt

SEQ ID NO: 1708427 - DNA, 17 bp, Homo sapiens
cttaatggagttcttgt

SEQ ID NO: 1708428 - DNA, 18 bp, Homo sapiens
cttaatggagttcttgtg

SEQ ID NO: 1708429 - DNA, 17 bp, Homo sapiens
cttaatgtatgttacca

SEQ ID NO: 1708430 - DNA, 21 bp, Homo sapiens
cttaatgtatgttaccaaaaa

SEQ ID NO: 1708431 - DNA, 12 bp, Homo sapiens
cttaatgtttat

SEQ ID NO: 1708432 - DNA, 17 bp, Homo sapiens
cttaattaaaagaatat

SEQ ID NO: 1708433 - DNA, 19 bp, Homo sapiens
cttaattaaaagaatattt

SEQ ID NO: 1708434 - DNA, 20 bp, Homo sapiens
cttaattaaaagaatatttt

SEQ ID NO: 1708435 - DNA, 14 bp, Homo sapiens
cttaattactttca

SEQ ID NO: 1708436 - DNA, 17 bp, Homo sapiens
cttaattactttcagaa

SEQ ID NO: 1708437 - DNA, 21 bp, Homo sapiens
cttaattcagtctcagctgct

SEQ ID NO: 1708438 - DNA, 19 bp, Homo sapiens
cttaattctttgttctgtt

SEQ ID NO: 1708439 - DNA, 12 bp, Homo sapiens
cttaatttcctt

SEQ ID NO: 1708440 - DNA, 17 bp, Homo sapiens
cttaatttcctttttga

SEQ ID NO: 1708441 - DNA, 20 bp, Homo sapiens
cttaatttttttttcataga

SEQ ID NO: 1708442 - DNA, 18 bp, Homo sapiens
agctccgagctgtaggag

SEQ ID NO: 1708443 - DNA, 17 bp, Homo sapiens
agctccgcctcccgggt

SEQ ID NO: 1708444 - DNA, 13 bp, Homo sapiens
agctccgcctgct

SEQ ID NO: 1708445 - DNA, 15 bp, Homo sapiens
agctccgggatcagc

SEQ ID NO: 1708446 - DNA, 15 bp, Homo sapiens
agctcctccgcagaa

SEQ ID NO: 1708447 - DNA, 22 bp, Homo sapiens
agctcctcctcttggagctgag

SEQ ID NO: 1708448 - DNA, 23 bp, Homo sapiens
agctcctcctcttggagctgaga

SEQ ID NO: 1708449 - DNA, 19 bp, Homo sapiens
agctcctctccccagccca

SEQ ID NO: 1708450 - DNA, 14 bp, Homo sapiens
agctcctctccttg

SEQ ID NO: 1708451 - DNA, 15 bp, Homo sapiens
agctcctcttccatg

SEQ ID NO: 1708452 - DNA, 18 bp, Homo sapiens
agctcctcttccatgctg

SEQ ID NO: 1708453 - DNA, 15 bp, Homo sapiens
agctcctgaataaag

SEQ ID NO: 1708454 - DNA, 22 bp, Homo sapiens
agctcctgctgcggaggagctg

SEQ ID NO: 1708455 - DNA, 14 bp, Homo sapiens
agctcctgggcagc

SEQ ID NO: 1708456 - DNA, 13 bp, Homo sapiens
agctcctggggcg

SEQ ID NO: 1708457 - DNA, 22 bp, Homo sapiens
agctcctggggcgtccaggccg

SEQ ID NO: 1708458 - DNA, 20 bp, Homo sapiens
agctcctggtcttgagatgt

SEQ ID NO: 1708459 - DNA, 22 bp, Homo sapiens
agctccttggggcagggcctgg

SEQ ID NO: 1708460 - DNA, 23 bp, Homo sapiens
agctccttggggcagggcctggg

SEQ ID NO: 1708461 - DNA, 13 bp, Homo sapiens
agctccttttgtc

SEQ ID NO: 1708462 - DNA, 19 bp, Homo sapiens
agctccttttgtccccagg

SEQ ID NO: 1708463 - DNA, 13 bp, Homo sapiens
agctcgctaaagt

SEQ ID NO: 1708464 - DNA, 17 bp, Homo sapiens
agctcgctggctttctc

SEQ ID NO: 1708465 - DNA, 15 bp, Homo sapiens
agctcggggagcctt

SEQ ID NO: 1708466 - DNA, 20 bp, Homo sapiens
agctcggtggacccagggat

SEQ ID NO: 1708467 - DNA, 18 bp, Homo sapiens
agctctaaagtagcaact

SEQ ID NO: 1708468 - DNA, 21 bp, Homo sapiens
agctctaaagtagcaactgct

SEQ ID NO: 1708469 - DNA, 15 bp, Homo sapiens
agctctagaatctgc

SEQ ID NO: 1708470 - DNA, 22 bp, Homo sapiens
agctctcagcaagtgcccagtg

SEQ ID NO: 1708471 - DNA, 16 bp, Homo sapiens
agctctccaggccagg

SEQ ID NO: 1708472 - DNA, 18 bp, Homo sapiens
agctctccaggccaggtg

SEQ ID NO: 1708473 - DNA, 18 bp, Homo sapiens
agctctccccaggcattt

SEQ ID NO: 1708474 - DNA, 19 bp, Homo sapiens
agctctcccctcctgctgg

SEQ ID NO: 1708475 - DNA, 20 bp, Homo sapiens
agctctcccctcctgctggg

SEQ ID NO: 1708476 - DNA, 11 bp, Homo sapiens
agctctccctc

SEQ ID NO: 1708477 - DNA, 13 bp, Homo sapiens
agctctccctctg

SEQ ID NO: 1708478 - DNA, 14 bp, Homo sapiens
agctctccctctgg

SEQ ID NO: 1708479 - DNA, 17 bp, Homo sapiens
agctctccctctggccc

SEQ ID NO: 1708480 - DNA, 20 bp, Homo sapiens
agctctccctctggccctgc

SEQ ID NO: 1708481 - DNA, 14 bp, Homo sapiens
agctctccgagctc

SEQ ID NO: 1708482 - DNA, 18 bp, Homo sapiens
agctctccgagctctggt

SEQ ID NO: 1708483 - DNA, 18 bp, Homo sapiens
agctctccggtctctctc

SEQ ID NO: 1708484 - DNA, 16 bp, Homo sapiens
agctctctaggcctct

SEQ ID NO: 1708485 - DNA, 11 bp, Homo sapiens
agctctctgac

SEQ ID NO: 1708486 - DNA, 13 bp, Homo sapiens
agctctctgacgc

SEQ ID NO: 1708487 - DNA, 15 bp, Homo sapiens
agctctctgcatcta

SEQ ID NO: 1708488 - DNA, 13 bp, Homo sapiens
agctctctgccct

SEQ ID NO: 1708489 - DNA, 16 bp, Homo sapiens
agctctctgccctgtg

SEQ ID NO: 1708490 - DNA, 14 bp, Homo sapiens
agctctctgggcct

SEQ ID NO: 1708491 - DNA, 12 bp, Homo sapiens
agctctcttcct

SEQ ID NO: 1708492 - DNA, 13 bp, Homo sapiens
agctctgaaatct

SEQ ID NO: 1708493 - DNA, 21 bp, Homo sapiens
agctctgaagaactctctgga

SEQ ID NO: 1708494 - DNA, 14 bp, Homo sapiens
agctctgacatccc

SEQ ID NO: 1708495 - DNA, 16 bp, Homo sapiens
agctctgacatccctt

SEQ ID NO: 1708496 - DNA, 21 bp, Homo sapiens
agctctgaccacttgaggcct

SEQ ID NO: 1708497 - DNA, 16 bp, Homo sapiens
agctctgagacagcag

SEQ ID NO: 1708498 - DNA, 11 bp, Homo sapiens
cttagaaactg

SEQ ID NO: 1708499 - DNA, 23 bp, Homo sapiens
cttagaaatcattgtagaaacac

SEQ ID NO: 1708500 - DNA, 18 bp, Homo sapiens
cttagaacctttctgtgt

SEQ ID NO: 1708501 - DNA, 20 bp, Homo sapiens
cttagaagtggaccaggaca

SEQ ID NO: 1708502 - DNA, 23 bp, Homo sapiens
cttagaagtggaccaggacagga

SEQ ID NO: 1708503 - DNA, 18 bp, Homo sapiens
cttagaatgcatctcatc

SEQ ID NO: 1708504 - DNA, 12 bp, Homo sapiens
cttagacctcag

SEQ ID NO: 1708505 - DNA, 15 bp, Homo sapiens
cttagacctcagcct

SEQ ID NO: 1708506 - DNA, 17 bp, Homo sapiens
cttagacctcagcctgt

SEQ ID NO: 1708507 - DNA, 16 bp, Homo sapiens
cttagaccttccataa

SEQ ID NO: 1708508 - DNA, 21 bp, Homo sapiens
cttagacttttccaatatgtg

SEQ ID NO: 1708509 - DNA, 14 bp, Homo sapiens
cttagagatatgta

SEQ ID NO: 1708510 - DNA, 20 bp, Homo sapiens
cttagagattgcatttttat

SEQ ID NO: 1708511 - DNA, 14 bp, Homo sapiens
cttagaggaaaagg

SEQ ID NO: 1708512 - DNA, 19 bp, Homo sapiens
cttagagtgtagctgtaag

SEQ ID NO: 1708513 - DNA, 18 bp, Homo sapiens
cttagatacactaaaaat

SEQ ID NO: 1708514 - DNA, 16 bp, Homo sapiens
cttagatgtttcacac

SEQ ID NO: 1708515 - DNA, 20 bp, Homo sapiens
cttagattctctgtgtctaa

SEQ ID NO: 1708516 - DNA, 16 bp, Homo sapiens
cttagcagctatctct

SEQ ID NO: 1708517 - DNA, 15 bp, Homo sapiens
cttagcagcttccag

SEQ ID NO: 1708518 - DNA, 16 bp, Homo sapiens
cttagcagcttccaga

SEQ ID NO: 1708519 - DNA, 21 bp, Homo sapiens
cttagcatcagaggtttgctt

SEQ ID NO: 1708520 - DNA, 20 bp, Homo sapiens
cttagccagttcaaagtgta

SEQ ID NO: 1708521 - DNA, 15 bp, Homo sapiens
cttagcccaagaggt

SEQ ID NO: 1708522 - DNA, 18 bp, Homo sapiens
cttagcccaagaggtctg

SEQ ID NO: 1708523 - DNA, 22 bp, Homo sapiens
cttagcccaagaggtctgagcc

SEQ ID NO: 1708524 - DNA, 15 bp, Homo sapiens
cttagccgcaccctg

SEQ ID NO: 1708525 - DNA, 18 bp, Homo sapiens
cttagccgcaccctgcac

SEQ ID NO: 1708526 - DNA, 22 bp, Homo sapiens
cttagccgcaccctgcacctgc

SEQ ID NO: 1708527 - DNA, 11 bp, Homo sapiens
cttagcctccc

SEQ ID NO: 1708528 - DNA, 14 bp, Homo sapiens
cttagcctctccca

SEQ ID NO: 1708529 - DNA, 18 bp, Homo sapiens
cttagcctctcccacccg

SEQ ID NO: 1708530 - DNA, 18 bp, Homo sapiens
cttagcctggatttcctt

SEQ ID NO: 1708531 - DNA, 16 bp, Homo sapiens
cttagccttgtgccct

SEQ ID NO: 1708532 - DNA, 16 bp, Homo sapiens
cttagcgtcaagacat

SEQ ID NO: 1708533 - DNA, 20 bp, Homo sapiens
cttagcgtcaagacatttgc

SEQ ID NO: 1708534 - DNA, 19 bp, Homo sapiens
cttagcgttctggactctg

SEQ ID NO: 1708535 - DNA, 22 bp, Homo sapiens
cttagcgttctggactctgccc

SEQ ID NO: 1708536 - DNA, 12 bp, Homo sapiens
cttagctcaggt

SEQ ID NO: 1708537 - DNA, 14 bp, Homo sapiens
cttagctctggacg

SEQ ID NO: 1708538 - DNA, 18 bp, Homo sapiens
cttagctgtactataagt

SEQ ID NO: 1708539 - DNA, 14 bp, Homo sapiens
cttagctgtctgct

SEQ ID NO: 1708540 - DNA, 15 bp, Homo sapiens
cttagcttacaggaa

SEQ ID NO: 1708541 - DNA, 14 bp, Homo sapiens
cttagcttagacct

SEQ ID NO: 1708542 - DNA, 16 bp, Homo sapiens
cttagcttagacctca

SEQ ID NO: 1708543 - DNA, 17 bp, Homo sapiens
cttagcttagacctcag

SEQ ID NO: 1708544 - DNA, 19 bp, Homo sapiens
cttagcttagacctcagcc

SEQ ID NO: 1708545 - DNA, 20 bp, Homo sapiens
cttagcttagacctcagcct

SEQ ID NO: 1708546 - DNA, 21 bp, Homo sapiens
cttagcttagacctcagcctg

SEQ ID NO: 1708547 - DNA, 22 bp, Homo sapiens
cttagcttagacctcagcctgt

SEQ ID NO: 1708548 - DNA, 13 bp, Homo sapiens
cttagctttgaaa

SEQ ID NO: 1708549 - DNA, 15 bp, Homo sapiens
cttaggaaaggagat

SEQ ID NO: 1708550 - DNA, 14 bp, Homo sapiens
cttaggatgtgtgc

SEQ ID NO: 1708551 - DNA, 18 bp, Homo sapiens
cttaggatgtgtgcatgt

SEQ ID NO: 1708552 - DNA, 17 bp, Homo sapiens
cttaggcatgcacagct

SEQ ID NO: 1708553 - DNA, 22 bp, Homo sapiens
cttagggaaagatgtagaaaga

SEQ ID NO: 1708554 - DNA, 17 bp, Homo sapiens
cttagggaagctggcct

SEQ ID NO: 1708555 - DNA, 19 bp, Homo sapiens
cttagggtttgcagagtgg

SEQ ID NO: 1708556 - DNA, 16 bp, Homo sapiens
cttagggtttggagct

SEQ ID NO: 1708557 - DNA, 15 bp, Homo sapiens
cttaggtctcatgga

SEQ ID NO: 1708558 - DNA, 22 bp, Homo sapiens
cttaggttattttgctttggtt

SEQ ID NO: 1708559 - DNA, 16 bp, Homo sapiens
cttaggtttactgtga

SEQ ID NO: 1708560 - DNA, 12 bp, Homo sapiens
cttagtaagtat

SEQ ID NO: 1708561 - DNA, 22 bp, Homo sapiens
ctgtgatgagctgatctgcgga

SEQ ID NO: 1708562 - DNA, 16 bp, Homo sapiens
ctgtgatgcatgagct

SEQ ID NO: 1708563 - DNA, 21 bp, Homo sapiens
ctgtgatgcatgagctccctc

SEQ ID NO: 1708564 - DNA, 16 bp, Homo sapiens
ctgtgatgccacacag

SEQ ID NO: 1708565 - DNA, 20 bp, Homo sapiens
ctgtgatggccaggccaggg

SEQ ID NO: 1708566 - DNA, 22 bp, Homo sapiens
ctgtgatggccaggccagggga

SEQ ID NO: 1708567 - DNA, 17 bp, Homo sapiens
ctgtgattaacttgctt

SEQ ID NO: 1708568 - DNA, 18 bp, Homo sapiens
ctgtgattaacttgctta

SEQ ID NO: 1708569 - DNA, 19 bp, Homo sapiens
ctgtgattaacttgcttag

SEQ ID NO: 1708570 - DNA, 15 bp, Homo sapiens
ctgtgattgctgcca

SEQ ID NO: 1708571 - DNA, 13 bp, Homo sapiens
ctgtgattggctg

SEQ ID NO: 1708572 - DNA, 22 bp, Homo sapiens
ctgtgattgggtgggatttttt

SEQ ID NO: 1708573 - DNA, 22 bp, Homo sapiens
ctgtgatttatttggagtggag

SEQ ID NO: 1708574 - DNA, 12 bp, Homo sapiens
ctgtgatttctg

SEQ ID NO: 1708575 - DNA, 17 bp, Homo sapiens
ctgtgcaacgccgtggg

SEQ ID NO: 1708576 - DNA, 22 bp, Homo sapiens
ctgtgcaacggtctcctgactg

SEQ ID NO: 1708577 - DNA, 21 bp, Homo sapiens
ctgtgcaatagacacatacat

SEQ ID NO: 1708578 - DNA, 15 bp, Homo sapiens
ctgtgcacacccacc

SEQ ID NO: 1708579 - DNA, 16 bp, Homo sapiens
ctgtgcacagtggctt

SEQ ID NO: 1708580 - DNA, 17 bp, Homo sapiens
ctgtgcacctattctgt

SEQ ID NO: 1708581 - DNA, 18 bp, Homo sapiens
ctgtgcacctattctgta

SEQ ID NO: 1708582 - DNA, 18 bp, Homo sapiens
ctgtgcactagcctgtga

SEQ ID NO: 1708583 - DNA, 20 bp, Homo sapiens
ctgtgcagcagcccagcttc

SEQ ID NO: 1708584 - DNA, 13 bp, Homo sapiens
ctgtgcagctctc

SEQ ID NO: 1708585 - DNA, 13 bp, Homo sapiens
ctgtgcagggagg

SEQ ID NO: 1708586 - DNA, 18 bp, Homo sapiens
ctgtgcagtcactggagg

SEQ ID NO: 1708587 - DNA, 17 bp, Homo sapiens
ctgtgcatgggtgaagg

SEQ ID NO: 1708588 - DNA, 21 bp, Homo sapiens
ctgtgccaactactactggtg

SEQ ID NO: 1708589 - DNA, 17 bp, Homo sapiens
ctgtgccaataaaagtt

SEQ ID NO: 1708590 - DNA, 13 bp, Homo sapiens
ctgtgccacccac

SEQ ID NO: 1708591 - DNA, 14 bp, Homo sapiens
ctgtgccactgact

SEQ ID NO: 1708592 - DNA, 14 bp, Homo sapiens
ctgtgccaggctga

SEQ ID NO: 1708593 - DNA, 14 bp, Homo sapiens
ctgtgccatgctgg

SEQ ID NO: 1708594 - DNA, 16 bp, Homo sapiens
ctgtgccatgctgggc

SEQ ID NO: 1708595 - DNA, 14 bp, Homo sapiens
ctgtgcccagcagg

SEQ ID NO: 1708596 - DNA, 19 bp, Homo sapiens
ctgtgcccagcaggcccag

SEQ ID NO: 1708597 - DNA, 21 bp, Homo sapiens
ctgtgcccagcaggcccagca

SEQ ID NO: 1708598 - DNA, 23 bp, Homo sapiens
ctgtgcccagcaggcccagcatg

SEQ ID NO: 1708599 - DNA, 20 bp, Homo sapiens
ctgtgcccctgatgcagcct

SEQ ID NO: 1708600 - DNA, 22 bp, Homo sapiens
ctgtgcccctgatgcagcctgt

SEQ ID NO: 1708601 - DNA, 13 bp, Homo sapiens
ctgtgccctcacc

SEQ ID NO: 1708602 - DNA, 17 bp, Homo sapiens
ctgtgccctcaccacca

SEQ ID NO: 1708603 - DNA, 11 bp, Homo sapiens
ctgtgccctgg

SEQ ID NO: 1708604 - DNA, 18 bp, Homo sapiens
ctgtgcctcagagaccag

SEQ ID NO: 1708605 - DNA, 13 bp, Homo sapiens
ctgtgcctcaggc

SEQ ID NO: 1708606 - DNA, 18 bp, Homo sapiens
ctgtgcctcaggccaggg

SEQ ID NO: 1708607 - DNA, 19 bp, Homo sapiens
ctgtgcctcaggccagggc

SEQ ID NO: 1708608 - DNA, 21 bp, Homo sapiens
ctgtgcctcaggccagggctc

SEQ ID NO: 1708609 - DNA, 15 bp, Homo sapiens
ctgtgcctcccccca

SEQ ID NO: 1708610 - DNA, 19 bp, Homo sapiens
ctgtgcctccccccagacc

SEQ ID NO: 1708611 - DNA, 18 bp, Homo sapiens
ctgtgcctccctccccag

SEQ ID NO: 1708612 - DNA, 19 bp, Homo sapiens
ctgtgcctccctccccagt

SEQ ID NO: 1708613 - DNA, 21 bp, Homo sapiens
ctgtgcctccctccccagtgc

SEQ ID NO: 1708614 - DNA, 16 bp, Homo sapiens
ctgtgcctctgggact

SEQ ID NO: 1708615 - DNA, 18 bp, Homo sapiens
ctgtgcctgcctttgtgt

SEQ ID NO: 1708616 - DNA, 12 bp, Homo sapiens
ctgtgcctgcta

SEQ ID NO: 1708617 - DNA, 21 bp, Homo sapiens
ctgtgcctgctcagcagccag

SEQ ID NO: 1708618 - DNA, 13 bp, Homo sapiens
ctgtgcctgggcc

SEQ ID NO: 1708619 - DNA, 14 bp, Homo sapiens
ctgtgcctgggccc

SEQ ID NO: 1708620 - DNA, 20 bp, Homo sapiens
ctgtgcctgggccctgggct

SEQ ID NO: 1708621 - DNA, 15 bp, Homo sapiens
ctgtgcgtctgtttt

SEQ ID NO: 1708622 - DNA, 17 bp, Homo sapiens
ctgtgcgttactaattg

SEQ ID NO: 1708623 - DNA, 22 bp, Homo sapiens
ctgtgctagggaaacttcccgt

SEQ ID NO: 1708624 - DNA, 13 bp, Homo sapiens
ctgtgctatttgt

SEQ ID NO: 1708625 - DNA, 17 bp, Homo sapiens
ctgtgctcagaagggct

SEQ ID NO: 1708626 - DNA, 13 bp, Homo sapiens
ctgtgctcagcca

SEQ ID NO: 1708627 - DNA, 13 bp, Homo sapiens
ctgtgctcctgcc

SEQ ID NO: 1708628 - DNA, 21 bp, Homo sapiens
ctgtgctcggaggccatctcg

SEQ ID NO: 1708629 - DNA, 12 bp, Homo sapiens
ctgtgctctggc

SEQ ID NO: 1708630 - DNA, 23 bp, Homo sapiens
ctgtgctctggggatttctggga

SEQ ID NO: 1708631 - DNA, 12 bp, Homo sapiens
ctgtgctgaggc

SEQ ID NO: 1708632 - DNA, 17 bp, Homo sapiens
ctgtgctgatcctgctg

SEQ ID NO: 1708633 - DNA, 18 bp, Homo sapiens
ctgtgctgatcctgctga

SEQ ID NO: 1708634 - DNA, 20 bp, Homo sapiens
ctgtgctgatcctgctgacc

SEQ ID NO: 1708635 - DNA, 21 bp, Homo sapiens
agccttagttaccctgatctg

SEQ ID NO: 1708636 - DNA, 14 bp, Homo sapiens
agccttattcacct

SEQ ID NO: 1708637 - DNA, 16 bp, Homo sapiens
agccttattctaaggt

SEQ ID NO: 1708638 - DNA, 22 bp, Homo sapiens
agccttatttctagaagcacat

SEQ ID NO: 1708639 - DNA, 18 bp, Homo sapiens
agccttattttgagtaaa

SEQ ID NO: 1708640 - DNA, 14 bp, Homo sapiens
agccttcagctcca

SEQ ID NO: 1708641 - DNA, 22 bp, Homo sapiens
agccttcataggcggtcatgtg

SEQ ID NO: 1708642 - DNA, 19 bp, Homo sapiens
agccttccccctcccaggg

SEQ ID NO: 1708643 - DNA, 12 bp, Homo sapiens
agccttcctcca

SEQ ID NO: 1708644 - DNA, 19 bp, Homo sapiens
agccttcctccacatcctt

SEQ ID NO: 1708645 - DNA, 14 bp, Homo sapiens
agccttcctctgca

SEQ ID NO: 1708646 - DNA, 17 bp, Homo sapiens
agccttcctttctcctg

SEQ ID NO: 1708647 - DNA, 21 bp, Homo sapiens
agccttcctttctcctgcccc

SEQ ID NO: 1708648 - DNA, 23 bp, Homo sapiens
agccttcctttctcctgccccaa

SEQ ID NO: 1708649 - DNA, 15 bp, Homo sapiens
agccttctcctccca

SEQ ID NO: 1708650 - DNA, 13 bp, Homo sapiens
agccttctggatc

SEQ ID NO: 1708651 - DNA, 18 bp, Homo sapiens
agccttctggatccatgg

SEQ ID NO: 1708652 - DNA, 14 bp, Homo sapiens
agccttgccagaga

SEQ ID NO: 1708653 - DNA, 17 bp, Homo sapiens
agccttgccagagatcc

SEQ ID NO: 1708654 - DNA, 12 bp, Homo sapiens
agccttgctgct

SEQ ID NO: 1708655 - DNA, 11 bp, Homo sapiens
agccttgctgg

SEQ ID NO: 1708656 - DNA, 18 bp, Homo sapiens
agccttgctgggccaggg

SEQ ID NO: 1708657 - DNA, 20 bp, Homo sapiens
agccttggataatgctgttg

SEQ ID NO: 1708658 - DNA, 14 bp, Homo sapiens
agccttggcccaca

SEQ ID NO: 1708659 - DNA, 19 bp, Homo sapiens
agccttggctcgttctctt

SEQ ID NO: 1708660 - DNA, 22 bp, Homo sapiens
agccttggctcgttctcttctc

SEQ ID NO: 1708661 - DNA, 16 bp, Homo sapiens
agccttggtgtccacc

SEQ ID NO: 1708662 - DNA, 18 bp, Homo sapiens
agccttggtgtccacctg

SEQ ID NO: 1708663 - DNA, 16 bp, Homo sapiens
agccttgtgccctgcc

SEQ ID NO: 1708664 - DNA, 20 bp, Homo sapiens
agccttgtgccctgccccca

SEQ ID NO: 1708665 - DNA, 21 bp, Homo sapiens
agccttgtgccctgcccccat

SEQ ID NO: 1708666 - DNA, 19 bp, Homo sapiens
agcctttactgtttgatat

SEQ ID NO: 1708667 - DNA, 16 bp, Homo sapiens
agcctttcattttgct

SEQ ID NO: 1708668 - DNA, 22 bp, Homo sapiens
agcctttccataaggaatgtag

SEQ ID NO: 1708669 - DNA, 16 bp, Homo sapiens
agcctttgccctgtca

SEQ ID NO: 1708670 - DNA, 15 bp, Homo sapiens
agcctttgcctcccc

SEQ ID NO: 1708671 - DNA, 19 bp, Homo sapiens
agcctttggttctggccag

SEQ ID NO: 1708672 - DNA, 13 bp, Homo sapiens
agccttttgctct

SEQ ID NO: 1708673 - DNA, 15 bp, Homo sapiens
agccttttgctctct

SEQ ID NO: 1708674 - DNA, 23 bp, Homo sapiens
agccttttgtttcccttgctttg

SEQ ID NO: 1708675 - DNA, 16 bp, Homo sapiens
agcctttttaaaacac

SEQ ID NO: 1708676 - DNA, 17 bp, Homo sapiens
agcctttttaaaacaca

SEQ ID NO: 1708677 - DNA, 20 bp, Homo sapiens
agcctttttaaaacacatgt

SEQ ID NO: 1708678 - DNA, 22 bp, Homo sapiens
agcctttttaaaacacatgttt

SEQ ID NO: 1708679 - DNA, 13 bp, Homo sapiens
agccaaatttcct

SEQ ID NO: 1708680 - DNA, 20 bp, Homo sapiens
agccaaatttcctgtttgaa

SEQ ID NO: 1708681 - DNA, 20 bp, Homo sapiens
agccaacaagaccgccccag

SEQ ID NO: 1708682 - DNA, 13 bp, Homo sapiens
agccaaccagcct

SEQ ID NO: 1708683 - DNA, 15 bp, Homo sapiens
agccaaccagccttt

SEQ ID NO: 1708684 - DNA, 13 bp, Homo sapiens
agccaacctggac

SEQ ID NO: 1708685 - DNA, 14 bp, Homo sapiens
agccaacctggact

SEQ ID NO: 1708686 - DNA, 23 bp, Homo sapiens
agccaacctggacttcctgtcat

SEQ ID NO: 1708687 - DNA, 17 bp, Homo sapiens
agccaactagcccctgg

SEQ ID NO: 1708688 - DNA, 14 bp, Homo sapiens
agccaactctccca

SEQ ID NO: 1708689 - DNA, 15 bp, Homo sapiens
agccaactctcccaa

SEQ ID NO: 1708690 - DNA, 17 bp, Homo sapiens
agccaactgtttccctg

SEQ ID NO: 1708691 - DNA, 22 bp, Homo sapiens
agccaactgtttccctgctgaa

SEQ ID NO: 1708692 - DNA, 18 bp, Homo sapiens
agccaacttgtaaataca

SEQ ID NO: 1708693 - DNA, 21 bp, Homo sapiens
agccaagacccaacaggtgct

SEQ ID NO: 1708694 - DNA, 18 bp, Homo sapiens
agccaagacggaggaggg

SEQ ID NO: 1708695 - DNA, 19 bp, Homo sapiens
agccaagatcgcaccactg

SEQ ID NO: 1708696 - DNA, 22 bp, Homo sapiens
agccaagatcgcaccactgcac

SEQ ID NO: 1708697 - DNA, 17 bp, Homo sapiens
agccaagcactgctcac

SEQ ID NO: 1708698 - DNA, 21 bp, Homo sapiens
agccaagcttcaaccctcagc

SEQ ID NO: 1708699 - DNA, 16 bp, Homo sapiens
agccaagctttaaatt

SEQ ID NO: 1708700 - DNA, 22 bp, Homo sapiens
agccaagctttaaattatgtga

SEQ ID NO: 1708701 - DNA, 14 bp, Homo sapiens
agccaagggaaagg

SEQ ID NO: 1708702 - DNA, 20 bp, Homo sapiens
agccaaggtgggctgagccc

SEQ ID NO: 1708703 - DNA, 23 bp, Homo sapiens
agccaaggtgggctgagccctgg

SEQ ID NO: 1708704 - DNA, 14 bp, Homo sapiens
agccaagtaaagtg

SEQ ID NO: 1708705 - DNA, 13 bp, Homo sapiens
agccaagtggggt

SEQ ID NO: 1708706 - DNA, 20 bp, Homo sapiens
agccaagtggggtgctggga

SEQ ID NO: 1708707 - DNA, 16 bp, Homo sapiens
agccaatcccctcctt

SEQ ID NO: 1708708 - DNA, 19 bp, Homo sapiens
agccaatctacaatctctt

SEQ ID NO: 1708709 - DNA, 12 bp, Homo sapiens
agccacactggg

SEQ ID NO: 1708710 - DNA, 18 bp, Homo sapiens
agccacagaccacctgct

SEQ ID NO: 1708711 - DNA, 15 bp, Homo sapiens
agccacagacccctg

SEQ ID NO: 1708712 - DNA, 18 bp, Homo sapiens
agccacagacccctggga

SEQ ID NO: 1708713 - DNA, 13 bp, Homo sapiens
agccacaggcctg

SEQ ID NO: 1708714 - DNA, 16 bp, Homo sapiens
agccacaggcctgaga

SEQ ID NO: 1708715 - DNA, 22 bp, Homo sapiens
agccacatgccccaggctctcg

SEQ ID NO: 1708716 - DNA, 14 bp, Homo sapiens
agccaccagttctc

SEQ ID NO: 1708717 - DNA, 19 bp, Homo sapiens
agccaccccgggctctctg

SEQ ID NO: 1708718 - DNA, 23 bp, Homo sapiens
agccaccccgggctctctgctgt

SEQ ID NO: 1708719 - DNA, 12 bp, Homo sapiens
agccaccctgag

SEQ ID NO: 1708720 - DNA, 14 bp, Homo sapiens
agccaccctgagtt

SEQ ID NO: 1708721 - DNA, 21 bp, Homo sapiens
agccaccgctgccagcacaga

SEQ ID NO: 1708722 - DNA, 13 bp, Homo sapiens
agccacctcccac

SEQ ID NO: 1708723 - DNA, 14 bp, Homo sapiens
agccacctcccacc

SEQ ID NO: 1708724 - DNA, 20 bp, Homo sapiens
agccacctcccaccccactc

SEQ ID NO: 1708725 - DNA, 23 bp, Homo sapiens
agccacctcccaccccactccag

SEQ ID NO: 1708726 - DNA, 11 bp, Homo sapiens
agccacctgca

SEQ ID NO: 1708727 - DNA, 14 bp, Homo sapiens
agccacctgcaaga

SEQ ID NO: 1708728 - DNA, 15 bp, Homo sapiens
agccacgactgccat

SEQ ID NO: 1708729 - DNA, 23 bp, Homo sapiens
agccacgcagggccatccactgt

SEQ ID NO: 1708730 - DNA, 21 bp, Homo sapiens
agccacggccccgggtccagg

SEQ ID NO: 1708731 - DNA, 23 bp, Homo sapiens
agccacggccccgggtccaggag

SEQ ID NO: 1708732 - DNA, 17 bp, Homo sapiens
agccacgttccttactg

SEQ ID NO: 1708733 - DNA, 22 bp, Homo sapiens
agccacgttccttactgcagaa

SEQ ID NO: 1708734 - DNA, 15 bp, Homo sapiens
agccactcaggaggc

SEQ ID NO: 1708735 - DNA, 16 bp, Homo sapiens
agccactcctgtcccg

SEQ ID NO: 1708736 - DNA, 23 bp, Homo sapiens
agccactcgcagtcgcaggatcc

SEQ ID NO: 1708737 - DNA, 21 bp, Homo sapiens
agccactctatgagttggact

SEQ ID NO: 1708738 - DNA, 16 bp, Homo sapiens
agccactgaagctggg

SEQ ID NO: 1708739 - DNA, 12 bp, Homo sapiens
agccactggaag

SEQ ID NO: 1708740 - DNA, 19 bp, Homo sapiens
agccactggaaggagcaca

SEQ ID NO: 1708741 - DNA, 20 bp, Homo sapiens
agccactggaaggagcacat

SEQ ID NO: 1708742 - DNA, 11 bp, Homo sapiens
agccactggca

SEQ ID NO: 1708743 - DNA, 14 bp, Homo sapiens
agccacttaggaca

SEQ ID NO: 1708744 - DNA, 16 bp, Homo sapiens
agccacttccccctct

SEQ ID NO: 1708745 - DNA, 13 bp, Homo sapiens
agccacttctccc

SEQ ID NO: 1708746 - DNA, 18 bp, Homo sapiens
agccactttcaagctgca

SEQ ID NO: 1708747 - DNA, 19 bp, Homo sapiens
agccagaaataaagttggt

SEQ ID NO: 1708748 - DNA, 23 bp, Homo sapiens
agccagaaataaagttggtgaca

SEQ ID NO: 1708749 - DNA, 13 bp, Homo sapiens
agccagaaattga

SEQ ID NO: 1708750 - DNA, 12 bp, Homo sapiens
agccagaattca

SEQ ID NO: 1708751 - DNA, 20 bp, Homo sapiens
agccagacaaaatttgagaa

SEQ ID NO: 1708752 - DNA, 16 bp, Homo sapiens
agccagacactctgct

SEQ ID NO: 1708753 - DNA, 20 bp, Homo sapiens
agccagacactctgctctgc

SEQ ID NO: 1708754 - DNA, 15 bp, Homo sapiens
agccagaccagcagg

SEQ ID NO: 1708755 - DNA, 14 bp, Homo sapiens
agccagactggcac

SEQ ID NO: 1708756 - DNA, 14 bp, Homo sapiens
agccagacttgctt

SEQ ID NO: 1708757 - DNA, 12 bp, Homo sapiens
agccagagagga

SEQ ID NO: 1708758 - DNA, 20 bp, Homo sapiens
agccagagaggagcacctga

SEQ ID NO: 1708759 - DNA, 17 bp, Homo sapiens
agccagagcccttcact

SEQ ID NO: 1708760 - DNA, 13 bp, Homo sapiens
agccagagcctgg

SEQ ID NO: 1708761 - DNA, 24 bp, Homo sapiens
agccagagctgtgcctgctcagca

SEQ ID NO: 1708762 - DNA, 15 bp, Homo sapiens
agccagagggagctg

SEQ ID NO: 1708763 - DNA, 22 bp, Homo sapiens
agccagagggtgggagcctaag

SEQ ID NO: 1708764 - DNA, 13 bp, Homo sapiens
agccagaggtgga

SEQ ID NO: 1708765 - DNA, 18 bp, Homo sapiens
agccagaggtggagccaa

SEQ ID NO: 1708766 - DNA, 15 bp, Homo sapiens
agccagagttcctgc

SEQ ID NO: 1708767 - DNA, 21 bp, Homo sapiens
agccagagtttttaaagcctt

SEQ ID NO: 1708768 - DNA, 19 bp, Homo sapiens
agccagatgcaggacagga

SEQ ID NO: 1708769 - DNA, 15 bp, Homo sapiens
agccagatgcctccc

SEQ ID NO: 1708770 - DNA, 16 bp, Homo sapiens
agccagattctcttga

SEQ ID NO: 1708771 - DNA, 15 bp, Homo sapiens
agccagcaagtaagc

SEQ ID NO: 1708772 - DNA, 13 bp, Homo sapiens
agccagcacctgg

SEQ ID NO: 1708773 - DNA, 18 bp, Homo sapiens
agccagcagcaaaaacta

SEQ ID NO: 1708774 - DNA, 16 bp, Homo sapiens
agccagcagcagccca

SEQ ID NO: 1708775 - DNA, 16 bp, Homo sapiens
agccagcagccagctc

SEQ ID NO: 1708776 - DNA, 10 bp, Homo sapiens
agccagccac

SEQ ID NO: 1708777 - DNA, 23 bp, Homo sapiens
agccagcccatggcccccaataa

SEQ ID NO: 1708778 - DNA, 21 bp, Homo sapiens
agccagccccctccagctcat

SEQ ID NO: 1708779 - DNA, 19 bp, Homo sapiens
agccagcccgtgtgtataa

SEQ ID NO: 1708780 - DNA, 16 bp, Homo sapiens
agccagccctccctgt

SEQ ID NO: 1708781 - DNA, 18 bp, Homo sapiens
agccagccctccctgtcc

SEQ ID NO: 1708782 - DNA, 22 bp, Homo sapiens
agccagcctcagaaggccccag

SEQ ID NO: 1708783 - DNA, 11 bp, Homo sapiens
agccagcctgg

SEQ ID NO: 1708784 - DNA, 16 bp, Homo sapiens
agccagcctggctctg

SEQ ID NO: 1708785 - DNA, 14 bp, Homo sapiens
agccagcctgggac

SEQ ID NO: 1708786 - DNA, 16 bp, Homo sapiens
agccagcctgggactc

SEQ ID NO: 1708787 - DNA, 21 bp, Homo sapiens
agccagctcacagtgctgtgt

SEQ ID NO: 1708788 - DNA, 23 bp, Homo sapiens
ctgtgacacctggtgcgggcctg

SEQ ID NO: 1708789 - DNA, 22 bp, Homo sapiens
ctgtgacatggtgcctgagagg

SEQ ID NO: 1708790 - DNA, 23 bp, Homo sapiens
ctgtgacatggtgcctgagaggc

SEQ ID NO: 1708791 - DNA, 17 bp, Homo sapiens
ctgtgaccatttataat

SEQ ID NO: 1708792 - DNA, 15 bp, Homo sapiens
ctgtgacccatctgt

SEQ ID NO: 1708793 - DNA, 18 bp, Homo sapiens
ctgtgactataaagctgt

SEQ ID NO: 1708794 - DNA, 12 bp, Homo sapiens
ctgtgactctgg

SEQ ID NO: 1708795 - DNA, 16 bp, Homo sapiens
ctgtgactctgggcag

SEQ ID NO: 1708796 - DNA, 22 bp, Homo sapiens
ctgtgactggatcttctatcat

SEQ ID NO: 1708797 - DNA, 23 bp, Homo sapiens
ctgtgagaacccagtttcccgtc

SEQ ID NO: 1708798 - DNA, 17 bp, Homo sapiens
ctgtgagaagtcactca

SEQ ID NO: 1708799 - DNA, 17 bp, Homo sapiens
ctgtgagacccccacac

SEQ ID NO: 1708800 - DNA, 19 bp, Homo sapiens
ctgtgagacccccacacct

SEQ ID NO: 1708801 - DNA, 19 bp, Homo sapiens
ctgtgagacgaggcagggg

SEQ ID NO: 1708802 - DNA, 19 bp, Homo sapiens
ctgtgagcagcctccactg

SEQ ID NO: 1708803 - DNA, 16 bp, Homo sapiens
ctgtgagcatcctggc

SEQ ID NO: 1708804 - DNA, 19 bp, Homo sapiens
ctgtgagcatcctggcagg

SEQ ID NO: 1708805 - DNA, 22 bp, Homo sapiens
ctgtgagcgctggctccctggg

SEQ ID NO: 1708806 - DNA, 23 bp, Homo sapiens
ctgtgagcgctggctccctgggc

SEQ ID NO: 1708807 - DNA, 18 bp, Homo sapiens
ctgtgaggcaggggcgga

SEQ ID NO: 1708808 - DNA, 14 bp, Homo sapiens
ctgtgaggcggcag

SEQ ID NO: 1708809 - DNA, 15 bp, Homo sapiens
ctgtgaggcggcagc

SEQ ID NO: 1708810 - DNA, 18 bp, Homo sapiens
ctgtgaggcggcagctgg

SEQ ID NO: 1708811 - DNA, 19 bp, Homo sapiens
ctgtgaggcggcagctggg

SEQ ID NO: 1708812 - DNA, 21 bp, Homo sapiens
ctgtgaggtgctgatgagtga

SEQ ID NO: 1708813 - DNA, 14 bp, Homo sapiens
ctgtgagtaggctg

SEQ ID NO: 1708814 - DNA, 19 bp, Homo sapiens
ctgtgagtaggctgggcct

SEQ ID NO: 1708815 - DNA, 20 bp, Homo sapiens
ctgtgagtctttggttctaa

SEQ ID NO: 1708816 - DNA, 21 bp, Homo sapiens
ctgtgagtctttggttctaag

SEQ ID NO: 1708817 - DNA, 22 bp, Homo sapiens
ctgtgagtggttcaagcacact

SEQ ID NO: 1708818 - DNA, 20 bp, Homo sapiens
ctgtgatatgtctgctgagt

SEQ ID NO: 1708819 - DNA, 19 bp, Homo sapiens
ctgtgatcagtgattttca

SEQ ID NO: 1708820 - DNA, 20 bp, Homo sapiens
ctgtgatccttggtgctgtg

SEQ ID NO: 1708821 - DNA, 15 bp, Homo sapiens
ctgtgatgagctgat

SEQ ID NO: 1708822 - DNA, 18 bp, Homo sapiens
ctgtgatgagctgatctg

SEQ ID NO: 1708823 - DNA, 20 bp, Homo sapiens
agcctagcggagcccagcct

SEQ ID NO: 1708824 - DNA, 19 bp, Homo sapiens
agcctagtgtgtgtgcttt

SEQ ID NO: 1708825 - DNA, 15 bp, Homo sapiens
agcctagttcatcca

SEQ ID NO: 1708826 - DNA, 14 bp, Homo sapiens
agcctatggcagaa

SEQ ID NO: 1708827 - DNA, 16 bp, Homo sapiens
agcctatggcagaaaa

SEQ ID NO: 1708828 - DNA, 19 bp, Homo sapiens
agcctatggcagaaaaaat

SEQ ID NO: 1708829 - DNA, 15 bp, Homo sapiens
agcctatttttcaaa

SEQ ID NO: 1708830 - DNA, 17 bp, Homo sapiens
agcctatttttttagat

SEQ ID NO: 1708831 - DNA, 22 bp, Homo sapiens
agcctcaaaacgggtcagtatt

SEQ ID NO: 1708832 - DNA, 21 bp, Homo sapiens
agcctcaaggttttaggttct

SEQ ID NO: 1708833 - DNA, 21 bp, Homo sapiens
agcctcacggggttggctgtt

SEQ ID NO: 1708834 - DNA, 23 bp, Homo sapiens
agcctcacgtatttcacagagca

SEQ ID NO: 1708835 - DNA, 12 bp, Homo sapiens
agcctcagaaga

SEQ ID NO: 1708836 - DNA, 13 bp, Homo sapiens
agcctcagaagaa

SEQ ID NO: 1708837 - DNA, 15 bp, Homo sapiens
agcctcagaaggccc

SEQ ID NO: 1708838 - DNA, 12 bp, Homo sapiens
agcctcagagtg

SEQ ID NO: 1708839 - DNA, 15 bp, Homo sapiens
agcctcagcctactc

SEQ ID NO: 1708840 - DNA, 13 bp, Homo sapiens
agcctcagtgcca

SEQ ID NO: 1708841 - DNA, 14 bp, Homo sapiens
agcctcatccgagg

SEQ ID NO: 1708842 - DNA, 20 bp, Homo sapiens
agcctcatccgaggcagggt

SEQ ID NO: 1708843 - DNA, 15 bp, Homo sapiens
agcctcatgttctgt

SEQ ID NO: 1708844 - DNA, 16 bp, Homo sapiens
agcctcatgttctgtg

SEQ ID NO: 1708845 - DNA, 21 bp, Homo sapiens
agcctccaaagtggagctggg

SEQ ID NO: 1708846 - DNA, 19 bp, Homo sapiens
agcctccaagcctgcctcc

SEQ ID NO: 1708847 - DNA, 18 bp, Homo sapiens
agcctccaagggtttcga

SEQ ID NO: 1708848 - DNA, 19 bp, Homo sapiens
agcctccaccttgctcttc

SEQ ID NO: 1708849 - DNA, 13 bp, Homo sapiens
agcctccagagcc

SEQ ID NO: 1708850 - DNA, 15 bp, Homo sapiens
agcctccagagccag

SEQ ID NO: 1708851 - DNA, 16 bp, Homo sapiens
agcctccagagccagc

SEQ ID NO: 1708852 - DNA, 17 bp, Homo sapiens
agcctccagagccagcc

SEQ ID NO: 1708853 - DNA, 19 bp, Homo sapiens
agcctccagagccagcctg

SEQ ID NO: 1708854 - DNA, 14 bp, Homo sapiens
agcctccagggcat

SEQ ID NO: 1708855 - DNA, 16 bp, Homo sapiens
agcctccagggcattg

SEQ ID NO: 1708856 - DNA, 18 bp, Homo sapiens
agcctccagggcattgct

SEQ ID NO: 1708857 - DNA, 19 bp, Homo sapiens
agcctccagggcattgctc

SEQ ID NO: 1708858 - DNA, 20 bp, Homo sapiens
agcctccagggcattgctca

SEQ ID NO: 1708859 - DNA, 21 bp, Homo sapiens
agcctccagggcattgctcag

SEQ ID NO: 1708860 - DNA, 15 bp, Homo sapiens
agcctccatttagtt

SEQ ID NO: 1708861 - DNA, 20 bp, Homo sapiens
agcctccatttagttctttg

SEQ ID NO: 1708862 - DNA, 21 bp, Homo sapiens
agcctccatttagttctttgt

SEQ ID NO: 1708863 - DNA, 21 bp, Homo sapiens
agcctcccaccagagccggga

SEQ ID NO: 1708864 - DNA, 14 bp, Homo sapiens
agcctccctctgac

SEQ ID NO: 1708865 - DNA, 21 bp, Homo sapiens
agcctccctctgacctgcagg

SEQ ID NO: 1708866 - DNA, 17 bp, Homo sapiens
agcctccctgaagacca

SEQ ID NO: 1708867 - DNA, 14 bp, Homo sapiens
agcctccctgaagc

SEQ ID NO: 1708868 - DNA, 13 bp, Homo sapiens
agcctccctgtca

SEQ ID NO: 1708869 - DNA, 14 bp, Homo sapiens
agcctccctgtcac

SEQ ID NO: 1708870 - DNA, 15 bp, Homo sapiens
agcctccctgtctcc

SEQ ID NO: 1708871 - DNA, 18 bp, Homo sapiens
agcctccctgtctccagc

SEQ ID NO: 1708872 - DNA, 20 bp, Homo sapiens
agcctcccttccatgcccca

SEQ ID NO: 1708873 - DNA, 18 bp, Homo sapiens
agcctccgacgctgcctc

SEQ ID NO: 1708874 - DNA, 18 bp, Homo sapiens
agcctccgcctcccgggt

SEQ ID NO: 1708875 - DNA, 16 bp, Homo sapiens
agcctccgctgggctt

SEQ ID NO: 1708876 - DNA, 22 bp, Homo sapiens
agcctccgctgggcttcattcc

SEQ ID NO: 1708877 - DNA, 18 bp, Homo sapiens
agcctccgtttatgggcc

SEQ ID NO: 1708878 - DNA, 22 bp, Homo sapiens
agcctccgtttatgggccttgc

SEQ ID NO: 1708879 - DNA, 12 bp, Homo sapiens
agcctcctcctg

SEQ ID NO: 1708880 - DNA, 16 bp, Homo sapiens
agcctcctcctgacca

SEQ ID NO: 1708881 - DNA, 12 bp, Homo sapiens
agcctcctctgg

SEQ ID NO: 1708882 - DNA, 18 bp, Homo sapiens
agcctcctgtttgcaggc

SEQ ID NO: 1708883 - DNA, 14 bp, Homo sapiens
agcctccttgtgca

SEQ ID NO: 1708884 - DNA, 23 bp, Homo sapiens
agcctccttgtgcaattgtcttt

SEQ ID NO: 1708885 - DNA, 15 bp, Homo sapiens
agcctcgcacaggcc

SEQ ID NO: 1708886 - DNA, 15 bp, Homo sapiens
agcctcgttggagag

SEQ ID NO: 1708887 - DNA, 18 bp, Homo sapiens
agcctcgttggagagcag

SEQ ID NO: 1708888 - DNA, 17 bp, Homo sapiens
agcctctacagccgtcc

SEQ ID NO: 1708889 - DNA, 18 bp, Homo sapiens
agcctctcccacccggcc

SEQ ID NO: 1708890 - DNA, 16 bp, Homo sapiens
agcctctccccaggtc

SEQ ID NO: 1708891 - DNA, 18 bp, Homo sapiens
agcctctccccaggtcca

SEQ ID NO: 1708892 - DNA, 22 bp, Homo sapiens
agcctctccccaggtccagctc

SEQ ID NO: 1708893 - DNA, 14 bp, Homo sapiens
agcctctcccggct

SEQ ID NO: 1708894 - DNA, 16 bp, Homo sapiens
agcctctcccggctgc

SEQ ID NO: 1708895 - DNA, 17 bp, Homo sapiens
agcctctccgactctgc

SEQ ID NO: 1708896 - DNA, 13 bp, Homo sapiens
agcctctctcctt

SEQ ID NO: 1708897 - DNA, 18 bp, Homo sapiens
agcctctctccttggcca

SEQ ID NO: 1708898 - DNA, 12 bp, Homo sapiens
agcctctctctc

SEQ ID NO: 1708899 - DNA, 18 bp, Homo sapiens
agcctctctctccctccc

SEQ ID NO: 1708900 - DNA, 20 bp, Homo sapiens
agcctctctctccctccctc

SEQ ID NO: 1708901 - DNA, 15 bp, Homo sapiens
agcctctctgctata

SEQ ID NO: 1708902 - DNA, 17 bp, Homo sapiens
ctgctcgtggactgtgc

SEQ ID NO: 1708903 - DNA, 12 bp, Homo sapiens
ctgctctaacag

SEQ ID NO: 1708904 - DNA, 23 bp, Homo sapiens
ctgctctagattcataaatacaa

SEQ ID NO: 1708905 - DNA, 14 bp, Homo sapiens
ctgctctagccagg

SEQ ID NO: 1708906 - DNA, 15 bp, Homo sapiens
ctgctctagctggca

SEQ ID NO: 1708907 - DNA, 17 bp, Homo sapiens
ctgctctagctggcagg

SEQ ID NO: 1708908 - DNA, 21 bp, Homo sapiens
ctgctctattccaaaaaggtt

SEQ ID NO: 1708909 - DNA, 14 bp, Homo sapiens
ctgctctcagcctc

SEQ ID NO: 1708910 - DNA, 18 bp, Homo sapiens
ctgctctcagcctcccaa

SEQ ID NO: 1708911 - DNA, 15 bp, Homo sapiens
ctgctctccttcctg

SEQ ID NO: 1708912 - DNA, 12 bp, Homo sapiens
ctgctctgagaa

SEQ ID NO: 1708913 - DNA, 12 bp, Homo sapiens
ctgctctgcccc

SEQ ID NO: 1708914 - DNA, 14 bp, Homo sapiens
ctgctctgcctgga

SEQ ID NO: 1708915 - DNA, 23 bp, Homo sapiens
ctgctctggaataaagttgcaga

SEQ ID NO: 1708916 - DNA, 14 bp, Homo sapiens
ctgctcttcccagt

SEQ ID NO: 1708917 - DNA, 13 bp, Homo sapiens
ctgctcttttcct

SEQ ID NO: 1708918 - DNA, 14 bp, Homo sapiens
ctgctcttttcctg

SEQ ID NO: 1708919 - DNA, 22 bp, Homo sapiens
ctgctcttttgtgatgaacata

SEQ ID NO: 1708920 - DNA, 18 bp, Homo sapiens
ctgctgaaacaacaaata

SEQ ID NO: 1708921 - DNA, 18 bp, Homo sapiens
ctgctgaacacagtgtct

SEQ ID NO: 1708922 - DNA, 19 bp, Homo sapiens
ctgctgaacacagtgtctg

SEQ ID NO: 1708923 - DNA, 20 bp, Homo sapiens
ctgctgaacacagtgtctgt

SEQ ID NO: 1708924 - DNA, 21 bp, Homo sapiens
ctgctgaacacagtgtctgtt

SEQ ID NO: 1708925 - DNA, 15 bp, Homo sapiens
ctgctgaagctgctg

SEQ ID NO: 1708926 - DNA, 23 bp, Homo sapiens
ctgctgaatgcctcgctcccttc

SEQ ID NO: 1708927 - DNA, 11 bp, Homo sapiens
ctgctgaccaa

SEQ ID NO: 1708928 - DNA, 15 bp, Homo sapiens
ctgctgaccaaatgg

SEQ ID NO: 1708929 - DNA, 15 bp, Homo sapiens
ctgctgagagaccca

SEQ ID NO: 1708930 - DNA, 14 bp, Homo sapiens
ctgctgagccactc

SEQ ID NO: 1708931 - DNA, 22 bp, Homo sapiens
ctgctgagccactcgcagtcgc

SEQ ID NO: 1708932 - DNA, 21 bp, Homo sapiens
ctgctgaggaggggcctgggc

SEQ ID NO: 1708933 - DNA, 20 bp, Homo sapiens
ctgctgagttggcctggcca

SEQ ID NO: 1708934 - DNA, 21 bp, Homo sapiens
ctgctgatatcaacagcttcc

SEQ ID NO: 1708935 - DNA, 17 bp, Homo sapiens
ctgctgatgtaggagct

SEQ ID NO: 1708936 - DNA, 21 bp, Homo sapiens
ctgctgatgtaggagctggat

SEQ ID NO: 1708937 - DNA, 20 bp, Homo sapiens
ctgctgcaaggtggcctctg

SEQ ID NO: 1708938 - DNA, 22 bp, Homo sapiens
ctgctgcaaggtggcctctgcc

SEQ ID NO: 1708939 - DNA, 13 bp, Homo sapiens
ctgctgcacaggc

SEQ ID NO: 1708940 - DNA, 14 bp, Homo sapiens
ctgctgcacaggcc

SEQ ID NO: 1708941 - DNA, 11 bp, Homo sapiens
ctgctgcaccc

SEQ ID NO: 1708942 - DNA, 22 bp, Homo sapiens
ctgctgcaccctgcgcctccag

SEQ ID NO: 1708943 - DNA, 18 bp, Homo sapiens
ctgctgcagccctgccag

SEQ ID NO: 1708944 - DNA, 15 bp, Homo sapiens
ctgctgccagcacag

SEQ ID NO: 1708945 - DNA, 16 bp, Homo sapiens
ctgctgccagcacagt

SEQ ID NO: 1708946 - DNA, 13 bp, Homo sapiens
ctgctgccagtgc

SEQ ID NO: 1708947 - DNA, 22 bp, Homo sapiens
ctgctgccatggcgtgtccctc

SEQ ID NO: 1708948 - DNA, 15 bp, Homo sapiens
ctgctgccccagctg

SEQ ID NO: 1708949 - DNA, 22 bp, Homo sapiens
ctgctgccccagctgactgtgg

SEQ ID NO: 1708950 - DNA, 20 bp, Homo sapiens
ctgctgccccgcttccccac

SEQ ID NO: 1708951 - DNA, 13 bp, Homo sapiens
ctgctgcccctgc

SEQ ID NO: 1708952 - DNA, 22 bp, Homo sapiens
ctgctgcccggggtggggtgca

SEQ ID NO: 1708953 - DNA, 13 bp, Homo sapiens
ctgctgccctccc

SEQ ID NO: 1708954 - DNA, 22 bp, Homo sapiens
ctgctgccctcccacagcctcc

SEQ ID NO: 1708955 - DNA, 16 bp, Homo sapiens
ctgctgccggctctgg

SEQ ID NO: 1708956 - DNA, 18 bp, Homo sapiens
ctgctgccggctctgggc

SEQ ID NO: 1708957 - DNA, 20 bp, Homo sapiens
ctgctgccggctctgggcct

SEQ ID NO: 1708958 - DNA, 18 bp, Homo sapiens
ctgctgcctccctgggga

SEQ ID NO: 1708959 - DNA, 21 bp, Homo sapiens
ctgctgcctccctggggacca

SEQ ID NO: 1708960 - DNA, 15 bp, Homo sapiens
ctgctgccttcacat

SEQ ID NO: 1708961 - DNA, 15 bp, Homo sapiens
ctgctgccttttctg

SEQ ID NO: 1708962 - DNA, 21 bp, Homo sapiens
ctgctgcgcccttaccttccc

SEQ ID NO: 1708963 - DNA, 18 bp, Homo sapiens
ctgctgcggaggagctgc

SEQ ID NO: 1708964 - DNA, 13 bp, Homo sapiens
ctgctgctaccag

SEQ ID NO: 1708965 - DNA, 14 bp, Homo sapiens
ctgctgctgcctcc

SEQ ID NO: 1708966 - DNA, 15 bp, Homo sapiens
ctgctgctgcgccct

SEQ ID NO: 1708967 - DNA, 16 bp, Homo sapiens
ctgctgctgcgccctt

SEQ ID NO: 1708968 - DNA, 14 bp, Homo sapiens
ctgctgctgtccct

SEQ ID NO: 1708969 - DNA, 11 bp, Homo sapiens
ctgctggacat

SEQ ID NO: 1708970 - DNA, 14 bp, Homo sapiens
ctgctggaggcctc

SEQ ID NO: 1708971 - DNA, 16 bp, Homo sapiens
ctgctggaggcctcag

SEQ ID NO: 1708972 - DNA, 21 bp, Homo sapiens
ctgctggaggcctcaggtgct

SEQ ID NO: 1708973 - DNA, 14 bp, Homo sapiens
ctgctggatcttgc

SEQ ID NO: 1708974 - DNA, 14 bp, Homo sapiens
ctgctggcacccac

SEQ ID NO: 1708975 - DNA, 16 bp, Homo sapiens
ctgctggcccagccaa

SEQ ID NO: 1708976 - DNA, 15 bp, Homo sapiens
ctgctggctgcctta

SEQ ID NO: 1708977 - DNA, 15 bp, Homo sapiens
ctgctggctgcggcc

SEQ ID NO: 1708978 - DNA, 19 bp, Homo sapiens
ctgctggctgcggccccct

SEQ ID NO: 1708979 - DNA, 14 bp, Homo sapiens
ctgctggcttgcag

SEQ ID NO: 1708980 - DNA, 16 bp, Homo sapiens
ctgctggcttgcagtg

SEQ ID NO: 1708981 - DNA, 21 bp, Homo sapiens
ctgctgggaaccccgcagccc

SEQ ID NO: 1708982 - DNA, 23 bp, Homo sapiens
ctgctgggacccacctccccctc

SEQ ID NO: 1708983 - DNA, 19 bp, Homo sapiens
ctgctgggcgtgtgtgaca

SEQ ID NO: 1708984 - DNA, 15 bp, Homo sapiens
ctgctgggctctcca

SEQ ID NO: 1708985 - DNA, 19 bp, Homo sapiens
ctgctgggctctccacctc

SEQ ID NO: 1708986 - DNA, 14 bp, Homo sapiens
ctgctgggctgagt

SEQ ID NO: 1708987 - DNA, 15 bp, Homo sapiens
ctgctggggaagaca

SEQ ID NO: 1708988 - DNA, 22 bp, Homo sapiens
ctgctggggaagacagtggccc

SEQ ID NO: 1708989 - DNA, 17 bp, Homo sapiens
ctgctggggatccccgc

SEQ ID NO: 1708990 - DNA, 17 bp, Homo sapiens
ctgctggggcatgtgtg

SEQ ID NO: 1708991 - DNA, 22 bp, Homo sapiens
ctgctggggcatgtgtgcctgt

SEQ ID NO: 1708992 - DNA, 21 bp, Homo sapiens
ctgctggtacctgccctctat

SEQ ID NO: 1708993 - DNA, 14 bp, Homo sapiens
ctgctggtatttct

SEQ ID NO: 1708994 - DNA, 17 bp, Homo sapiens
ctgctggtatttctaat

SEQ ID NO: 1708995 - DNA, 22 bp, Homo sapiens
ctgctggtgattttttttttct

SEQ ID NO: 1708996 - DNA, 18 bp, Homo sapiens
ctgctggttgttgccagg

SEQ ID NO: 1708997 - DNA, 23 bp, Homo sapiens
ctgctggttgttgccaggttgca

SEQ ID NO: 1708998 - DNA, 19 bp, Homo sapiens
ctgctgtaactgctgagcc

SEQ ID NO: 1708999 - DNA, 12 bp, Homo sapiens
ctgctgtatttc

SEQ ID NO: 1709000 - DNA, 13 bp, Homo sapiens
ctgctgtatttcc

SEQ ID NO: 1709001 - DNA, 15 bp, Homo sapiens
ctgctgtcctgcagt

SEQ ID NO: 1709002 - DNA, 16 bp, Homo sapiens
ctgctgtcctgcagta

SEQ ID NO: 1709003 - DNA, 14 bp, Homo sapiens
ctgctgtcctggtg

SEQ ID NO: 1709004 - DNA, 16 bp, Homo sapiens
ctgctgtcctggtggc

SEQ ID NO: 1709005 - DNA, 18 bp, Homo sapiens
ctgctgtcctggtggctg

SEQ ID NO: 1709006 - DNA, 20 bp, Homo sapiens
ctgctgtcctggtggctggg

SEQ ID NO: 1709007 - DNA, 11 bp, Homo sapiens
ctgctgtctct

SEQ ID NO: 1709008 - DNA, 16 bp, Homo sapiens
ctgctgtctctctggg

SEQ ID NO: 1709009 - DNA, 21 bp, Homo sapiens
ctgctgtgaaaactctggtac

SEQ ID NO: 1709010 - DNA, 15 bp, Homo sapiens
ctgctgtgaaccctg

SEQ ID NO: 1709011 - DNA, 21 bp, Homo sapiens
ctgctgtgatacgatgcttca

SEQ ID NO: 1709012 - DNA, 16 bp, Homo sapiens
ctgctgtgattccact

SEQ ID NO: 1709013 - DNA, 22 bp, Homo sapiens
ctgctgtgattccactacacct

SEQ ID NO: 1709014 - DNA, 14 bp, Homo sapiens
ctgctgtgcaacgg

SEQ ID NO: 1709015 - DNA, 21 bp, Homo sapiens
ctgctgtgccatgctgggcca

SEQ ID NO: 1709016 - DNA, 19 bp, Homo sapiens
ctgctgtgccccaccacgt

SEQ ID NO: 1709017 - DNA, 15 bp, Homo sapiens
ctgctgtgctggaat

SEQ ID NO: 1709018 - DNA, 16 bp, Homo sapiens
ctgctgttgccatagc

SEQ ID NO: 1709019 - DNA, 14 bp, Homo sapiens
ctgccatgtggcag

SEQ ID NO: 1709020 - DNA, 15 bp, Homo sapiens
ctgccatgtggcaga

SEQ ID NO: 1709021 - DNA, 21 bp, Homo sapiens
ctgccattagactgaatttaa

SEQ ID NO: 1709022 - DNA, 15 bp, Homo sapiens
ctgccattcttctgg

SEQ ID NO: 1709023 - DNA, 22 bp, Homo sapiens
ctgccattcttctggtgctact

SEQ ID NO: 1709024 - DNA, 23 bp, Homo sapiens
ctgccattgggaccctccagtgc

SEQ ID NO: 1709025 - DNA, 13 bp, Homo sapiens
ctgccatttaaaa

SEQ ID NO: 1709026 - DNA, 13 bp, Homo sapiens
ctgccatttccct

SEQ ID NO: 1709027 - DNA, 19 bp, Homo sapiens
ctgccatttgcaccctccg

SEQ ID NO: 1709028 - DNA, 20 bp, Homo sapiens
ctgccatttgcaccctccgc

SEQ ID NO: 1709029 - DNA, 21 bp, Homo sapiens
ctgcccacatttgggctcagg

SEQ ID NO: 1709030 - DNA, 16 bp, Homo sapiens
ctgcccaccccctcaa

SEQ ID NO: 1709031 - DNA, 21 bp, Homo sapiens
ctgcccacctcagcctcccaa

SEQ ID NO: 1709032 - DNA, 15 bp, Homo sapiens
ctgcccacctcggcc

SEQ ID NO: 1709033 - DNA, 17 bp, Homo sapiens
ctgcccacgatcccctc

SEQ ID NO: 1709034 - DNA, 18 bp, Homo sapiens
ctgcccacgatcccctcc

SEQ ID NO: 1709035 - DNA, 23 bp, Homo sapiens
ctgcccactgtttctcttgagct

SEQ ID NO: 1709036 - DNA, 19 bp, Homo sapiens
ctgcccagacacatgggct

SEQ ID NO: 1709037 - DNA, 20 bp, Homo sapiens
ctgcccagacacatgggctt

SEQ ID NO: 1709038 - DNA, 22 bp, Homo sapiens
ctgcccagacccctctggccag

SEQ ID NO: 1709039 - DNA, 18 bp, Homo sapiens
ctgcccagagttgctggg

SEQ ID NO: 1709040 - DNA, 14 bp, Homo sapiens
ctgcccagccactc

SEQ ID NO: 1709041 - DNA, 13 bp, Homo sapiens
ctgcccagcccat

SEQ ID NO: 1709042 - DNA, 19 bp, Homo sapiens
ctgcccagcttgggcccag

SEQ ID NO: 1709043 - DNA, 21 bp, Homo sapiens
ctgcccagcttgggcccagct

SEQ ID NO: 1709044 - DNA, 22 bp, Homo sapiens
ctgcccagcttgggcccagctg

SEQ ID NO: 1709045 - DNA, 17 bp, Homo sapiens
ctgcccaggagagccag

SEQ ID NO: 1709046 - DNA, 19 bp, Homo sapiens
ctgcccaggagagccagcc

SEQ ID NO: 1709047 - DNA, 21 bp, Homo sapiens
ctgcccaggagagccagccct

SEQ ID NO: 1709048 - DNA, 21 bp, Homo sapiens
ctgcccaggcagtctttgctc

SEQ ID NO: 1709049 - DNA, 21 bp, Homo sapiens
ctgcccaggcctctcggtgct

SEQ ID NO: 1709050 - DNA, 13 bp, Homo sapiens
ctgcccaggggtg

SEQ ID NO: 1709051 - DNA, 15 bp, Homo sapiens
ctgcccaggggtgcc

SEQ ID NO: 1709052 - DNA, 19 bp, Homo sapiens
ctgcccaggggtgccccct

SEQ ID NO: 1709053 - DNA, 20 bp, Homo sapiens
ctgcccaggggtgccccctc

SEQ ID NO: 1709054 - DNA, 20 bp, Homo sapiens
ctgcccagtgcaaaccactt

SEQ ID NO: 1709055 - DNA, 22 bp, Homo sapiens
ctgcccagtgttgtttgtaaat

SEQ ID NO: 1709056 - DNA, 15 bp, Homo sapiens
ctgcccatcccagtc

SEQ ID NO: 1709057 - DNA, 20 bp, Homo sapiens
ctgcccatcccagtccctcg

SEQ ID NO: 1709058 - DNA, 18 bp, Homo sapiens
ctgcccatcgtgaagaag

SEQ ID NO: 1709059 - DNA, 21 bp, Homo sapiens
ctgcccattcaccaaaattat

SEQ ID NO: 1709060 - DNA, 21 bp, Homo sapiens
ctgccccaaacaaatatgcaa

SEQ ID NO: 1709061 - DNA, 14 bp, Homo sapiens
ctgccccaactcct

SEQ ID NO: 1709062 - DNA, 17 bp, Homo sapiens
ctgccccaagcagccag

SEQ ID NO: 1709063 - DNA, 21 bp, Homo sapiens
ctgccccaagcagccagccag

SEQ ID NO: 1709064 - DNA, 22 bp, Homo sapiens
ctgccccaagcagccagccagt

SEQ ID NO: 1709065 - DNA, 16 bp, Homo sapiens
ctgccccaagccccca

SEQ ID NO: 1709066 - DNA, 18 bp, Homo sapiens
ctgccccaagggcccaga

SEQ ID NO: 1709067 - DNA, 20 bp, Homo sapiens
ctgccccaatcgggtccaga

SEQ ID NO: 1709068 - DNA, 22 bp, Homo sapiens
ctgccccaatcgggtccagaga

SEQ ID NO: 1709069 - DNA, 21 bp, Homo sapiens
ctgccccacatgtggccatgg

SEQ ID NO: 1709070 - DNA, 13 bp, Homo sapiens
ctgccccacccca

SEQ ID NO: 1709071 - DNA, 14 bp, Homo sapiens
ctgccccaccccac

SEQ ID NO: 1709072 - DNA, 23 bp, Homo sapiens
ctgccccaccccacctcacagct

SEQ ID NO: 1709073 - DNA, 14 bp, Homo sapiens
ctgccccaccccat

SEQ ID NO: 1709074 - DNA, 20 bp, Homo sapiens
ctgccccacggccctgtcag

SEQ ID NO: 1709075 - DNA, 14 bp, Homo sapiens
ctgccccagaggtc

SEQ ID NO: 1709076 - DNA, 20 bp, Homo sapiens
ctgccccagaggtcgcagct

SEQ ID NO: 1709077 - DNA, 21 bp, Homo sapiens
ctgccccagaggtcgcagcta

SEQ ID NO: 1709078 - DNA, 13 bp, Homo sapiens
ctgccccagagtg

SEQ ID NO: 1709079 - DNA, 16 bp, Homo sapiens
ctgccccagcccagat

SEQ ID NO: 1709080 - DNA, 12 bp, Homo sapiens
ctgccccagcct

SEQ ID NO: 1709081 - DNA, 13 bp, Homo sapiens
ctgccccagcctg

SEQ ID NO: 1709082 - DNA, 19 bp, Homo sapiens
ctgccccagcctgtccttg

SEQ ID NO: 1709083 - DNA, 14 bp, Homo sapiens
ctgccccagctctg

SEQ ID NO: 1709084 - DNA, 16 bp, Homo sapiens
ctgccccagctgactg

SEQ ID NO: 1709085 - DNA, 21 bp, Homo sapiens
ctgccccagctgactgtggcc

SEQ ID NO: 1709086 - DNA, 23 bp, Homo sapiens
ctgccccaggccggagcccagat

SEQ ID NO: 1709087 - DNA, 19 bp, Homo sapiens
ctgccccatcattgcacct

SEQ ID NO: 1709088 - DNA, 20 bp, Homo sapiens
ctgccccatcattgcacctg

SEQ ID NO: 1709089 - DNA, 16 bp, Homo sapiens
ctgcccccagccccgg

SEQ ID NO: 1709090 - DNA, 13 bp, Homo sapiens
ctgcccccaggac

SEQ ID NO: 1709091 - DNA, 18 bp, Homo sapiens
ctgcccccatctccccag

SEQ ID NO: 1709092 - DNA, 19 bp, Homo sapiens
ctgcccccatctccccagg

SEQ ID NO: 1709093 - DNA, 16 bp, Homo sapiens
ctgccccccagcctct

SEQ ID NO: 1709094 - DNA, 20 bp, Homo sapiens
ctgcccccgcgggttctaga

SEQ ID NO: 1709095 - DNA, 21 bp, Homo sapiens
ctgcccccgcgggttctagac

SEQ ID NO: 1709096 - DNA, 17 bp, Homo sapiens
ctgcccccgttccagct

SEQ ID NO: 1709097 - DNA, 18 bp, Homo sapiens
ctgcccccgttccagctg

SEQ ID NO: 1709098 - DNA, 15 bp, Homo sapiens
ctgccccctccccca

SEQ ID NO: 1709099 - DNA, 16 bp, Homo sapiens
ctgccccctcccccat

SEQ ID NO: 1709100 - DNA, 21 bp, Homo sapiens
ctgccccctcccccatgggct

SEQ ID NO: 1709101 - DNA, 14 bp, Homo sapiens
ctgccccctctttg

SEQ ID NO: 1709102 - DNA, 12 bp, Homo sapiens
ctgccccctggt

SEQ ID NO: 1709103 - DNA, 14 bp, Homo sapiens
ctgccccctggtgg

SEQ ID NO: 1709104 - DNA, 16 bp, Homo sapiens
ctgccccgcccccagt

SEQ ID NO: 1709105 - DNA, 14 bp, Homo sapiens
ctgccccggcctcc

SEQ ID NO: 1709106 - DNA, 18 bp, Homo sapiens
ctgccccgggtccccagc

SEQ ID NO: 1709107 - DNA, 17 bp, Homo sapiens
ctgcccctaccctggac

SEQ ID NO: 1709108 - DNA, 19 bp, Homo sapiens
ctgcccctacgggcgctgc

SEQ ID NO: 1709109 - DNA, 13 bp, Homo sapiens
ctgcccctaggat

SEQ ID NO: 1709110 - DNA, 22 bp, Homo sapiens
ctgcccctaggatgctgcagca

SEQ ID NO: 1709111 - DNA, 15 bp, Homo sapiens
ctgcccctcatgcca

SEQ ID NO: 1709112 - DNA, 13 bp, Homo sapiens
ctgcccctccccc

SEQ ID NO: 1709113 - DNA, 16 bp, Homo sapiens
ctgccccttaacccca

SEQ ID NO: 1709114 - DNA, 19 bp, Homo sapiens
ctgcccgcaccctggcctg

SEQ ID NO: 1709115 - DNA, 20 bp, Homo sapiens
ctgcccgcaccctggcctgg

SEQ ID NO: 1709116 - DNA, 13 bp, Homo sapiens
ctgcccgctccca

SEQ ID NO: 1709117 - DNA, 13 bp, Homo sapiens
ctgcccggctaca

SEQ ID NO: 1709118 - DNA, 20 bp, Homo sapiens
ctgcccggtggtttgccatg

SEQ ID NO: 1709119 - DNA, 23 bp, Homo sapiens
ctgcccggtggtttgccatgtcg

SEQ ID NO: 1709120 - DNA, 17 bp, Homo sapiens
ctgcccgtcttcagcct

SEQ ID NO: 1709121 - DNA, 18 bp, Homo sapiens
ctgcccgtcttcagccta

SEQ ID NO: 1709122 - DNA, 19 bp, Homo sapiens
ctgccctaacctgacagag

SEQ ID NO: 1709123 - DNA, 17 bp, Homo sapiens
ctgccctaagcccccag

SEQ ID NO: 1709124 - DNA, 19 bp, Homo sapiens
ctgccctaagcccccaggg

SEQ ID NO: 1709125 - DNA, 22 bp, Homo sapiens
ctgccctaagcccccagggcct

SEQ ID NO: 1709126 - DNA, 15 bp, Homo sapiens
ctgccctagagcaca

SEQ ID NO: 1709127 - DNA, 19 bp, Homo sapiens
ctgccctagagcacactgt

SEQ ID NO: 1709128 - DNA, 16 bp, Homo sapiens
ctgccctagctccaca

SEQ ID NO: 1709129 - DNA, 12 bp, Homo sapiens
ctgccctcccaa

SEQ ID NO: 1709130 - DNA, 15 bp, Homo sapiens
ctgccctcccaagtc

SEQ ID NO: 1709131 - DNA, 16 bp, Homo sapiens
ctgccctcccaagtcc

SEQ ID NO: 1709132 - DNA, 19 bp, Homo sapiens
ctgccctcccacagcctcc

SEQ ID NO: 1709133 - DNA, 20 bp, Homo sapiens
ctgccctcccctgctcccag

SEQ ID NO: 1709134 - DNA, 17 bp, Homo sapiens
ctgccctccccttcccc

SEQ ID NO: 1709135 - DNA, 18 bp, Homo sapiens
tacttgtgttacttgcca

SEQ ID NO: 1709136 - DNA, 21 bp, Homo sapiens
tacttgtgttacttgccaagc

SEQ ID NO: 1709137 - DNA, 13 bp, Homo sapiens
tacttgtttctat

SEQ ID NO: 1709138 - DNA, 14 bp, Homo sapiens
tacttgtttgctat

SEQ ID NO: 1709139 - DNA, 14 bp, Homo sapiens
tactttaaaaagga

SEQ ID NO: 1709140 - DNA, 22 bp, Homo sapiens
tactttaacttagttttgcata

SEQ ID NO: 1709141 - DNA, 22 bp, Homo sapiens
tactttacaaaccattacctgt

SEQ ID NO: 1709142 - DNA, 17 bp, Homo sapiens
tactttagaagcctgca

SEQ ID NO: 1709143 - DNA, 21 bp, Homo sapiens
tactttagccatcataactca

SEQ ID NO: 1709144 - DNA, 15 bp, Homo sapiens
tactttagttagcat

SEQ ID NO: 1709145 - DNA, 21 bp, Homo sapiens
tactttatcatgaatgctttt

SEQ ID NO: 1709146 - DNA, 22 bp, Homo sapiens
tactttatcatgaatgctttta

SEQ ID NO: 1709147 - DNA, 19 bp, Homo sapiens
tactttattaatatgagtt

SEQ ID NO: 1709148 - DNA, 14 bp, Homo sapiens
tactttattgtaca

SEQ ID NO: 1709149 - DNA, 19 bp, Homo sapiens
tactttcagaatattttca

SEQ ID NO: 1709150 - DNA, 22 bp, Homo sapiens
tactttcagaatattttcaaaa

SEQ ID NO: 1709151 - DNA, 20 bp, Homo sapiens
tactttcatcttaaactaat

SEQ ID NO: 1709152 - DNA, 15 bp, Homo sapiens
tactttccatgtttt

SEQ ID NO: 1709153 - DNA, 13 bp, Homo sapiens
tactttgcttccg

SEQ ID NO: 1709154 - DNA, 20 bp, Homo sapiens
tactttgcttgagaatcctc

SEQ ID NO: 1709155 - DNA, 20 bp, Homo sapiens
tactttggtagctgggaaag

SEQ ID NO: 1709156 - DNA, 23 bp, Homo sapiens
tactttggtagctgggaaagcat

SEQ ID NO: 1709157 - DNA, 13 bp, Homo sapiens
tactttgtaaata

SEQ ID NO: 1709158 - DNA, 22 bp, Homo sapiens
tactttgtaagtgagagagaca

SEQ ID NO: 1709159 - DNA, 17 bp, Homo sapiens
tactttgttctgttgtc

SEQ ID NO: 1709160 - DNA, 15 bp, Homo sapiens
tacttttaaaaacat

SEQ ID NO: 1709161 - DNA, 18 bp, Homo sapiens
tacttttaaaaacataac

SEQ ID NO: 1709162 - DNA, 21 bp, Homo sapiens
tacttttaaacagtgagcctg

SEQ ID NO: 1709163 - DNA, 15 bp, Homo sapiens
tacttttaaactgtg

SEQ ID NO: 1709164 - DNA, 18 bp, Homo sapiens
tacttttaaatattaact

SEQ ID NO: 1709165 - DNA, 18 bp, Homo sapiens
tacttttaccactattta

SEQ ID NO: 1709166 - DNA, 23 bp, Homo sapiens
tacttttattttacacagaaaca

SEQ ID NO: 1709167 - DNA, 20 bp, Homo sapiens
tacttttcacactgtcttcc

SEQ ID NO: 1709168 - DNA, 17 bp, Homo sapiens
tacttttgcatgaaaat

SEQ ID NO: 1709169 - DNA, 18 bp, Homo sapiens
tacttttgcatttttcct

SEQ ID NO: 1709170 - DNA, 20 bp, Homo sapiens
tacttttgtaatctattcct

SEQ ID NO: 1709171 - DNA, 16 bp, Homo sapiens
tacttttgtgtattct

SEQ ID NO: 1709172 - DNA, 18 bp, Homo sapiens
tacttttgtgtattctgt

SEQ ID NO: 1709173 - DNA, 14 bp, Homo sapiens
tactttttaaatgt

SEQ ID NO: 1709174 - DNA, 17 bp, Homo sapiens
tactttttatactccat

SEQ ID NO: 1709175 - DNA, 21 bp, Homo sapiens
tactttttatgtgctatgcaa

SEQ ID NO: 1709176 - DNA, 19 bp, Homo sapiens
tacttttttctagtttcag

SEQ ID NO: 1709177 - DNA, 15 bp, Homo sapiens
tagaaaaaaattact

SEQ ID NO: 1709178 - DNA, 19 bp, Homo sapiens
tagaaaaaggggcctgagt

SEQ ID NO: 1709179 - DNA, 18 bp, Homo sapiens
tagaaaaataaaatgttt

SEQ ID NO: 1709180 - DNA, 17 bp, Homo sapiens
tagaaaaatctcattcc

SEQ ID NO: 1709181 - DNA, 18 bp, Homo sapiens
tagaaaaatgtataaaaa

SEQ ID NO: 1709182 - DNA, 16 bp, Homo sapiens
tagaaaacataatctt

SEQ ID NO: 1709183 - DNA, 21 bp, Homo sapiens
tagaaaacctaattaaggaag

SEQ ID NO: 1709184 - DNA, 21 bp, Homo sapiens
tagaaaagaaaaaaaaaatat

SEQ ID NO: 1709185 - DNA, 22 bp, Homo sapiens
tagaaaagcagtcccattcata

SEQ ID NO: 1709186 - DNA, 23 bp, Homo sapiens
tagaaaagcagtcccattcatat

SEQ ID NO: 1709187 - DNA, 17 bp, Homo sapiens
tagaaaaggactataag

SEQ ID NO: 1709188 - DNA, 21 bp, Homo sapiens
tagaaaatagagcttttaaaa

SEQ ID NO: 1709189 - DNA, 16 bp, Homo sapiens
tagaaaatccttcagc

SEQ ID NO: 1709190 - DNA, 20 bp, Homo sapiens
tagaaaatgacttatttctg

SEQ ID NO: 1709191 - DNA, 13 bp, Homo sapiens
tagaaaatgagga

SEQ ID NO: 1709192 - DNA, 11 bp, Homo sapiens
tagaaaatttt

SEQ ID NO: 1709193 - DNA, 23 bp, Homo sapiens
tagaaaattttgtaaaacaatgc

SEQ ID NO: 1709194 - DNA, 17 bp, Homo sapiens
tagaaacaaaaagagct

SEQ ID NO: 1709195 - DNA, 17 bp, Homo sapiens
tagaaacaaacatctaa

SEQ ID NO: 1709196 - DNA, 16 bp, Homo sapiens
tagaaacacataatta

SEQ ID NO: 1709197 - DNA, 13 bp, Homo sapiens
tagaaacatgaca

SEQ ID NO: 1709198 - DNA, 17 bp, Homo sapiens
tagaaacatgacactga

SEQ ID NO: 1709199 - DNA, 18 bp, Homo sapiens
tagaaacctctctatttt

SEQ ID NO: 1709200 - DNA, 19 bp, Homo sapiens
tagaaactcaccatgtaaa

SEQ ID NO: 1709201 - DNA, 14 bp, Homo sapiens
tagaaactggaaat

SEQ ID NO: 1709202 - DNA, 14 bp, Homo sapiens
tagaaagaagccca

SEQ ID NO: 1709203 - DNA, 21 bp, Homo sapiens
tagaaagaagcccaatattat

SEQ ID NO: 1709204 - DNA, 13 bp, Homo sapiens
tagaaagcatttt

SEQ ID NO: 1709205 - DNA, 19 bp, Homo sapiens
tagaaagctggactgacca

SEQ ID NO: 1709206 - DNA, 16 bp, Homo sapiens
tagaaaggggagaatg

SEQ ID NO: 1709207 - DNA, 22 bp, Homo sapiens
tagaaaggggcagtttaaagca

SEQ ID NO: 1709208 - DNA, 15 bp, Homo sapiens
tagaaagtgctgata

SEQ ID NO: 1709209 - DNA, 15 bp, Homo sapiens
tagaaataatatgca

SEQ ID NO: 1709210 - DNA, 14 bp, Homo sapiens
tagaaatatgattt

SEQ ID NO: 1709211 - DNA, 16 bp, Homo sapiens
tagaaatattttaaaa

SEQ ID NO: 1709212 - DNA, 19 bp, Homo sapiens
tagaaatattttaaaatca

SEQ ID NO: 1709213 - DNA, 14 bp, Homo sapiens
tagaaatgcatatt

SEQ ID NO: 1709214 - DNA, 17 bp, Homo sapiens
tagaaatggaaattttg

SEQ ID NO: 1709215 - DNA, 21 bp, Homo sapiens
tagaaatggaaattttgctat

SEQ ID NO: 1709216 - DNA, 18 bp, Homo sapiens
tagaaatggtttcctctg

SEQ ID NO: 1709217 - DNA, 16 bp, Homo sapiens
tagaaatgtaggtcct

SEQ ID NO: 1709218 - DNA, 20 bp, Homo sapiens
tagaaatgtaggtcctcaga

SEQ ID NO: 1709219 - DNA, 15 bp, Homo sapiens
tagaaatgtttgctg

SEQ ID NO: 1709220 - DNA, 17 bp, Homo sapiens
tagaaattagatttgtg

SEQ ID NO: 1709221 - DNA, 14 bp, Homo sapiens
tagaaattttacaa

SEQ ID NO: 1709222 - DNA, 14 bp, Homo sapiens
tagaaattttgtaa

SEQ ID NO: 1709223 - DNA, 16 bp, Homo sapiens
tagaaattttgtaaga

SEQ ID NO: 1709224 - DNA, 19 bp, Homo sapiens
tagaaatttttcagatgct

SEQ ID NO: 1709225 - DNA, 18 bp, Homo sapiens
tagaacacaaaacttgaa

SEQ ID NO: 1709226 - DNA, 22 bp, Homo sapiens
tagaacacaagggatataaaat

SEQ ID NO: 1709227 - DNA, 23 bp, Homo sapiens
tagaacacaagggatataaaatg

SEQ ID NO: 1709228 - DNA, 18 bp, Homo sapiens
tagaacactaattcataa

SEQ ID NO: 1709229 - DNA, 17 bp, Homo sapiens
tagaacagataatcagt

SEQ ID NO: 1709230 - DNA, 16 bp, Homo sapiens
tagaacataaagcaaa

SEQ ID NO: 1709231 - DNA, 17 bp, Homo sapiens
tagaacatgcacattta

SEQ ID NO: 1709232 - DNA, 15 bp, Homo sapiens
tagaacctaacaccc

SEQ ID NO: 1709233 - DNA, 16 bp, Homo sapiens
tagaacctttctgtgt

SEQ ID NO: 1709234 - DNA, 16 bp, Homo sapiens
tagaacgttaaactat

SEQ ID NO: 1709235 - DNA, 18 bp, Homo sapiens
tagaacgttaaactatta

SEQ ID NO: 1709236 - DNA, 23 bp, Homo sapiens
tagaactacttgcatttgatttt

SEQ ID NO: 1709237 - DNA, 14 bp, Homo sapiens
tagaactagccaaa

SEQ ID NO: 1709238 - DNA, 19 bp, Homo sapiens
tagaactcagttttaacta

SEQ ID NO: 1709239 - DNA, 19 bp, Homo sapiens
tagaactccaggccctcct

SEQ ID NO: 1709240 - DNA, 19 bp, Homo sapiens
tagaactctagagagcctt

SEQ ID NO: 1709241 - DNA, 20 bp, Homo sapiens
tagaactctagagagcctta

SEQ ID NO: 1709242 - DNA, 14 bp, Homo sapiens
tagaactgtactgt

SEQ ID NO: 1709243 - DNA, 20 bp, Homo sapiens
tagaactgtcccacaaaata

SEQ ID NO: 1709244 - DNA, 23 bp, Homo sapiens
tagaacttcaagaagtaagagct

SEQ ID NO: 1709245 - DNA, 19 bp, Homo sapiens
tagaactttaagcaacaag

SEQ ID NO: 1709246 - DNA, 16 bp, Homo sapiens
tagaagaaaagcccat

SEQ ID NO: 1709247 - DNA, 16 bp, Homo sapiens
tagaagaaagatgttt

SEQ ID NO: 1709248 - DNA, 23 bp, Homo sapiens
tagaagaaccaaatacctcaatt

SEQ ID NO: 1709249 - DNA, 15 bp, Homo sapiens
tagaagaagaggaag

SEQ ID NO: 1709250 - DNA, 22 bp, Homo sapiens
tagaagagagaggttgaaaaac

SEQ ID NO: 1709251 - DNA, 20 bp, Homo sapiens
gttgttaaaggcaatggttt

SEQ ID NO: 1709252 - DNA, 17 bp, Homo sapiens
gttgttatgtgatcatg

SEQ ID NO: 1709253 - DNA, 24 bp, Homo sapiens
gttgttccagggagcttctacctg

SEQ ID NO: 1709254 - DNA, 19 bp, Homo sapiens
gttgttccattttatgcag

SEQ ID NO: 1709255 - DNA, 20 bp, Homo sapiens
gttgttcctctatactttgt

SEQ ID NO: 1709256 - DNA, 22 bp, Homo sapiens
gttgttgactgtgattagatca

SEQ ID NO: 1709257 - DNA, 23 bp, Homo sapiens
gttgttgccaggttgcagctgct

SEQ ID NO: 1709258 - DNA, 15 bp, Homo sapiens
gttgttggtctgtgt

SEQ ID NO: 1709259 - DNA, 13 bp, Homo sapiens
gttgttgttgttt

SEQ ID NO: 1709260 - DNA, 18 bp, Homo sapiens
gttgtttaaagtatatgt

SEQ ID NO: 1709261 - DNA, 15 bp, Homo sapiens
gttgtttgtaaataa

SEQ ID NO: 1709262 - DNA, 20 bp, Homo sapiens
gttgtttgtaaataagagat

SEQ ID NO: 1709263 - DNA, 14 bp, Homo sapiens
gttgttttctactt

SEQ ID NO: 1709264 - DNA, 15 bp, Homo sapiens
gttgttttgtacaga

SEQ ID NO: 1709265 - DNA, 19 bp, Homo sapiens
gttgttttttgaaaacatg

SEQ ID NO: 1709266 - DNA, 19 bp, Homo sapiens
gtttaaaaggctaagaata

SEQ ID NO: 1709267 - DNA, 16 bp, Homo sapiens
gtttaaaatcatttct

SEQ ID NO: 1709268 - DNA, 20 bp, Homo sapiens
gtttaaaatgtaatttaaat

SEQ ID NO: 1709269 - DNA, 14 bp, Homo sapiens
gtttaaagaaagtg

SEQ ID NO: 1709270 - DNA, 16 bp, Homo sapiens
gtttaaagaaagtgta

SEQ ID NO: 1709271 - DNA, 18 bp, Homo sapiens
gtttaaagtatatgtgca

SEQ ID NO: 1709272 - DNA, 22 bp, Homo sapiens
gtttaaagtcacatccctgtaa

SEQ ID NO: 1709273 - DNA, 11 bp, Homo sapiens
gtttaaataaa

SEQ ID NO: 1709274 - DNA, 16 bp, Homo sapiens
gtttaaatatgaatga

SEQ ID NO: 1709275 - DNA, 14 bp, Homo sapiens
gtttaaatatttca

SEQ ID NO: 1709276 - DNA, 14 bp, Homo sapiens
gtttaacaaatcta

SEQ ID NO: 1709277 - DNA, 15 bp, Homo sapiens
gtttaacaaatctaa

SEQ ID NO: 1709278 - DNA, 17 bp, Homo sapiens
gtttaagaccagcctgg

SEQ ID NO: 1709279 - DNA, 21 bp, Homo sapiens
gtttaagtgactgatggctaa

SEQ ID NO: 1709280 - DNA, 17 bp, Homo sapiens
gtttaatattgagaaag

SEQ ID NO: 1709281 - DNA, 19 bp, Homo sapiens
gtttaatattgagaaagaa

SEQ ID NO: 1709282 - DNA, 14 bp, Homo sapiens
gtttaatcccagca

SEQ ID NO: 1709283 - DNA, 19 bp, Homo sapiens
gtttaattgtttgtcctca

SEQ ID NO: 1709284 - DNA, 15 bp, Homo sapiens
gtttaatttaaagcc

SEQ ID NO: 1709285 - DNA, 20 bp, Homo sapiens
gtttacaaaaatttctgtaa

SEQ ID NO: 1709286 - DNA, 23 bp, Homo sapiens
gtttacagcactactctgtgcca

SEQ ID NO: 1709287 - DNA, 17 bp, Homo sapiens
gtttacaggtttgaatt

SEQ ID NO: 1709288 - DNA, 20 bp, Homo sapiens
gtttaccatttgtaataaag

SEQ ID NO: 1709289 - DNA, 16 bp, Homo sapiens
gtttacctgaataaat

SEQ ID NO: 1709290 - DNA, 21 bp, Homo sapiens
gtttacctggcttatttaata

SEQ ID NO: 1709291 - DNA, 22 bp, Homo sapiens
gtttactatgtgccagttcctg

SEQ ID NO: 1709292 - DNA, 12 bp, Homo sapiens
gtttactgcttt

SEQ ID NO: 1709293 - DNA, 12 bp, Homo sapiens
gtttactgtaaa

SEQ ID NO: 1709294 - DNA, 16 bp, Homo sapiens
gtttactgtgaagaga

SEQ ID NO: 1709295 - DNA, 14 bp, Homo sapiens
gtttagaaaaaaca

SEQ ID NO: 1709296 - DNA, 17 bp, Homo sapiens
gtttagagagcctgtca

SEQ ID NO: 1709297 - DNA, 17 bp, Homo sapiens
gtttagattttgtgttt

SEQ ID NO: 1709298 - DNA, 15 bp, Homo sapiens
gtttagctttggaaa

SEQ ID NO: 1709299 - DNA, 22 bp, Homo sapiens
gtttagctttggaaagttactg

SEQ ID NO: 1709300 - DNA, 17 bp, Homo sapiens
gtttaggattacttaga

SEQ ID NO: 1709301 - DNA, 23 bp, Homo sapiens
gtttaggctatttgtaaatctgc

SEQ ID NO: 1709302 - DNA, 18 bp, Homo sapiens
gtttagtacaataatctc

SEQ ID NO: 1709303 - DNA, 20 bp, Homo sapiens
gtttagtttctagaggcctc

SEQ ID NO: 1709304 - DNA, 18 bp, Homo sapiens
gtttataaaatataaaca

SEQ ID NO: 1709305 - DNA, 19 bp, Homo sapiens
gtttataaaatataaacaa

SEQ ID NO: 1709306 - DNA, 14 bp, Homo sapiens
gtttataaacagaa

SEQ ID NO: 1709307 - DNA, 13 bp, Homo sapiens
gtttataaatctt

SEQ ID NO: 1709308 - DNA, 13 bp, Homo sapiens
gtttataatgtta

SEQ ID NO: 1709309 - DNA, 15 bp, Homo sapiens
gtttataattggctt

SEQ ID NO: 1709310 - DNA, 20 bp, Homo sapiens
gtttatacagtgtacatgta

SEQ ID NO: 1709311 - DNA, 23 bp, Homo sapiens
gtttatatactgggttcttgttt

SEQ ID NO: 1709312 - DNA, 19 bp, Homo sapiens
gtttatatctcctttgtat

SEQ ID NO: 1709313 - DNA, 20 bp, Homo sapiens
gtttatattactctcattct

SEQ ID NO: 1709314 - DNA, 13 bp, Homo sapiens
gtttatgcatgta

SEQ ID NO: 1709315 - DNA, 22 bp, Homo sapiens
gtttatggcctcagctgcctca

SEQ ID NO: 1709316 - DNA, 23 bp, Homo sapiens
gtttatggcctcagctgcctcac

SEQ ID NO: 1709317 - DNA, 13 bp, Homo sapiens
gtttatgtaatag

SEQ ID NO: 1709318 - DNA, 18 bp, Homo sapiens
gtttattaactactgaat

SEQ ID NO: 1709319 - DNA, 21 bp, Homo sapiens
gtttattaatcttagtgtatg

SEQ ID NO: 1709320 - DNA, 23 bp, Homo sapiens
gtttattaatcttagtgtatgat

SEQ ID NO: 1709321 - DNA, 22 bp, Homo sapiens
gtttattaatgcctctcccgca

SEQ ID NO: 1709322 - DNA, 14 bp, Homo sapiens
gtttattatacagt

SEQ ID NO: 1709323 - DNA, 19 bp, Homo sapiens
gtttattcaaactgaaaag

SEQ ID NO: 1709324 - DNA, 19 bp, Homo sapiens
gtttattcttccagaatgc

SEQ ID NO: 1709325 - DNA, 17 bp, Homo sapiens
gtttattcttgatgaaa

SEQ ID NO: 1709326 - DNA, 21 bp, Homo sapiens
gtttattggtgagttaggaac

SEQ ID NO: 1709327 - DNA, 13 bp, Homo sapiens
gtttatttaagga

SEQ ID NO: 1709328 - DNA, 14 bp, Homo sapiens
gtttatttaaggat

SEQ ID NO: 1709329 - DNA, 15 bp, Homo sapiens
gtttatttaaggatg

SEQ ID NO: 1709330 - DNA, 16 bp, Homo sapiens
gtttatttaaggatgg

SEQ ID NO: 1709331 - DNA, 19 bp, Homo sapiens
gtttatttaaggatggatg

SEQ ID NO: 1709332 - DNA, 14 bp, Homo sapiens
gtttatttattcac

SEQ ID NO: 1709333 - DNA, 19 bp, Homo sapiens
gtttatttttccactatta

SEQ ID NO: 1709334 - DNA, 13 bp, Homo sapiens
gtttattttttct

SEQ ID NO: 1709335 - DNA, 18 bp, Homo sapiens
gtttattttttctacaca

SEQ ID NO: 1709336 - DNA, 18 bp, Homo sapiens
gtttattttttttggcct

SEQ ID NO: 1709337 - DNA, 22 bp, Homo sapiens
gtttcaaagtgatagaaaagtg

SEQ ID NO: 1709338 - DNA, 18 bp, Homo sapiens
gtttcaaggcactctaga

SEQ ID NO: 1709339 - DNA, 23 bp, Homo sapiens
gtttcaaggcactctagattcca

SEQ ID NO: 1709340 - DNA, 21 bp, Homo sapiens
gtttcacagagtgtgctgcta

SEQ ID NO: 1709341 - DNA, 21 bp, Homo sapiens
gtttcacaggtcaataaactt

SEQ ID NO: 1709342 - DNA, 18 bp, Homo sapiens
gtttcactgaaatgtttg

SEQ ID NO: 1709343 - DNA, 21 bp, Homo sapiens
gtttcactttcacatagatgt

SEQ ID NO: 1709344 - DNA, 16 bp, Homo sapiens
gtttcagaattttgta

SEQ ID NO: 1709345 - DNA, 13 bp, Homo sapiens
gtttcagacaggg

SEQ ID NO: 1709346 - DNA, 13 bp, Homo sapiens
gtttcagaccccc

SEQ ID NO: 1709347 - DNA, 14 bp, Homo sapiens
gtttcagacccccc

SEQ ID NO: 1709348 - DNA, 22 bp, Homo sapiens
gtttcagatgtgcaataatttg

SEQ ID NO: 1709349 - DNA, 19 bp, Homo sapiens
gtttcatattttaaatctg

SEQ ID NO: 1709350 - DNA, 12 bp, Homo sapiens
gtttcatgttct

SEQ ID NO: 1709351 - DNA, 20 bp, Homo sapiens
gtttcattgcgaatcttttt

SEQ ID NO: 1709352 - DNA, 14 bp, Homo sapiens
gtttcatttctgca

SEQ ID NO: 1709353 - DNA, 16 bp, Homo sapiens
gtttcattttcctgtg

SEQ ID NO: 1709354 - DNA, 23 bp, Homo sapiens
gtttccacaggaacaacagcatc

SEQ ID NO: 1709355 - DNA, 14 bp, Homo sapiens
gtttccagggaggg

SEQ ID NO: 1709356 - DNA, 23 bp, Homo sapiens
gtttccagtacacctttcagcca

SEQ ID NO: 1709357 - DNA, 16 bp, Homo sapiens
gtttccatcatgtctg

SEQ ID NO: 1709358 - DNA, 18 bp, Homo sapiens
gtttccatcatgtctgta

SEQ ID NO: 1709359 - DNA, 21 bp, Homo sapiens
gtttcccattggttcacctgt

SEQ ID NO: 1709360 - DNA, 14 bp, Homo sapiens
gtttccccagggaa

SEQ ID NO: 1709361 - DNA, 22 bp, Homo sapiens
gtttccccagggaaggaaaaat

SEQ ID NO: 1709362 - DNA, 19 bp, Homo sapiens
gtttcccccacagttttaa

SEQ ID NO: 1709363 - DNA, 22 bp, Homo sapiens
gtttcccccacagttttaataa

SEQ ID NO: 1709364 - DNA, 21 bp, Homo sapiens
gtttcccggttcaggaccact

SEQ ID NO: 1709365 - DNA, 14 bp, Homo sapiens
gtttccctgctgaa

SEQ ID NO: 1709366 - DNA, 17 bp, Homo sapiens
gtttccgaatctctttc

SEQ ID NO: 1709367 - DNA, 14 bp, Homo sapiens
taagttctcccaac

SEQ ID NO: 1709368 - DNA, 23 bp, Homo sapiens
taagttctcccaacaacatgaaa

SEQ ID NO: 1709369 - DNA, 12 bp, Homo sapiens
taagttcttatg

SEQ ID NO: 1709370 - DNA, 20 bp, Homo sapiens
taagttgaaaaaggaaatat

SEQ ID NO: 1709371 - DNA, 17 bp, Homo sapiens
taagttggaccagagga

SEQ ID NO: 1709372 - DNA, 18 bp, Homo sapiens
taagttgtcaaagaagct

SEQ ID NO: 1709373 - DNA, 22 bp, Homo sapiens
taagttgtcaaagaagcttcca

SEQ ID NO: 1709374 - DNA, 13 bp, Homo sapiens
taagttgtttgca

SEQ ID NO: 1709375 - DNA, 20 bp, Homo sapiens
taagtttcaaacttactatt

SEQ ID NO: 1709376 - DNA, 15 bp, Homo sapiens
taagtttctaagatt

SEQ ID NO: 1709377 - DNA, 16 bp, Homo sapiens
taagtttctaagattc

SEQ ID NO: 1709378 - DNA, 21 bp, Homo sapiens
taagtttctaagattctaaag

SEQ ID NO: 1709379 - DNA, 14 bp, Homo sapiens
taagtttctgggac

SEQ ID NO: 1709380 - DNA, 12 bp, Homo sapiens
taagtttgaagg

SEQ ID NO: 1709381 - DNA, 18 bp, Homo sapiens
taagtttgaaggaaacag

SEQ ID NO: 1709382 - DNA, 13 bp, Homo sapiens
taagtttgcactc

SEQ ID NO: 1709383 - DNA, 15 bp, Homo sapiens
taagttttagtcttt

SEQ ID NO: 1709384 - DNA, 19 bp, Homo sapiens
taagttttagtctttagaa

SEQ ID NO: 1709385 - DNA, 12 bp, Homo sapiens
taagtttttcca

SEQ ID NO: 1709386 - DNA, 19 bp, Homo sapiens
taataaaaaatggaaagaa

SEQ ID NO: 1709387 - DNA, 20 bp, Homo sapiens
taataaaaaatggaaagaat

SEQ ID NO: 1709388 - DNA, 15 bp, Homo sapiens
taataaaaaattatg

SEQ ID NO: 1709389 - DNA, 13 bp, Homo sapiens
taataaaaagatt

SEQ ID NO: 1709390 - DNA, 13 bp, Homo sapiens
taataaaaataaa

SEQ ID NO: 1709391 - DNA, 18 bp, Homo sapiens
taataaaaatacacatga

SEQ ID NO: 1709392 - DNA, 12 bp, Homo sapiens
taataaaagatt

SEQ ID NO: 1709393 - DNA, 12 bp, Homo sapiens
taataaactgta

SEQ ID NO: 1709394 - DNA, 15 bp, Homo sapiens
taataaactgtatta

SEQ ID NO: 1709395 - DNA, 20 bp, Homo sapiens
taataaactgtattaaatct

SEQ ID NO: 1709396 - DNA, 14 bp, Homo sapiens
taataaactgtgtt

SEQ ID NO: 1709397 - DNA, 16 bp, Homo sapiens
taataaactttatttt

SEQ ID NO: 1709398 - DNA, 14 bp, Homo sapiens
taataaagatgagt

SEQ ID NO: 1709399 - DNA, 13 bp, Homo sapiens
taataaagatgtg

SEQ ID NO: 1709400 - DNA, 15 bp, Homo sapiens
taataaagatgtgaa

SEQ ID NO: 1709401 - DNA, 16 bp, Homo sapiens
taataaagatgtgaaa

SEQ ID NO: 1709402 - DNA, 10 bp, Homo sapiens
taataaagca

SEQ ID NO: 1709403 - DNA, 12 bp, Homo sapiens
taataaagcatt

SEQ ID NO: 1709404 - DNA, 13 bp, Homo sapiens
taataaagcattc

SEQ ID NO: 1709405 - DNA, 19 bp, Homo sapiens
taataaaggctgaagcttt

SEQ ID NO: 1709406 - DNA, 17 bp, Homo sapiens
taataaagtttccatta

SEQ ID NO: 1709407 - DNA, 17 bp, Homo sapiens
taataaatatactatga

SEQ ID NO: 1709408 - DNA, 17 bp, Homo sapiens
taataaatatgtaatat

SEQ ID NO: 1709409 - DNA, 13 bp, Homo sapiens
taataaatattga

SEQ ID NO: 1709410 - DNA, 15 bp, Homo sapiens
taataaatatttatg

SEQ ID NO: 1709411 - DNA, 21 bp, Homo sapiens
taataaatctaggatgtgatg

SEQ ID NO: 1709412 - DNA, 18 bp, Homo sapiens
taataaatgccctcttct

SEQ ID NO: 1709413 - DNA, 21 bp, Homo sapiens
taataaatttaataaatattg

SEQ ID NO: 1709414 - DNA, 18 bp, Homo sapiens
taataacaaggagatttc

SEQ ID NO: 1709415 - DNA, 20 bp, Homo sapiens
taataacaaggagatttctt

SEQ ID NO: 1709416 - DNA, 21 bp, Homo sapiens
cagttagcagggatgttcctt

SEQ ID NO: 1709417 - DNA, 20 bp, Homo sapiens
cagttagggttttgcaataa

SEQ ID NO: 1709418 - DNA, 16 bp, Homo sapiens
cagttagttgtgaaag

SEQ ID NO: 1709419 - DNA, 15 bp, Homo sapiens
cagttataagaagaa

SEQ ID NO: 1709420 - DNA, 19 bp, Homo sapiens
cagttatggtgatgactta

SEQ ID NO: 1709421 - DNA, 18 bp, Homo sapiens
cagttatgtgaatgatct

SEQ ID NO: 1709422 - DNA, 20 bp, Homo sapiens
cagttatgtgaatgatctct

SEQ ID NO: 1709423 - DNA, 12 bp, Homo sapiens
cagttatttctg

SEQ ID NO: 1709424 - DNA, 14 bp, Homo sapiens
cagttattttgata

SEQ ID NO: 1709425 - DNA, 17 bp, Homo sapiens
cagttattttgataaca

SEQ ID NO: 1709426 - DNA, 16 bp, Homo sapiens
cagttcaaagtgtata

SEQ ID NO: 1709427 - DNA, 18 bp, Homo sapiens
cagttcaaagtgtatatt

SEQ ID NO: 1709428 - DNA, 15 bp, Homo sapiens
cagttcaaatcctca

SEQ ID NO: 1709429 - DNA, 17 bp, Homo sapiens
cagttcaaatcctcacc

SEQ ID NO: 1709430 - DNA, 14 bp, Homo sapiens
cagttcaagaaagc

SEQ ID NO: 1709431 - DNA, 13 bp, Homo sapiens
cagttcaccctga

SEQ ID NO: 1709432 - DNA, 21 bp, Homo sapiens
cagttcagaaggaataagcat

SEQ ID NO: 1709433 - DNA, 17 bp, Homo sapiens
cagttcaggagtcccaa

SEQ ID NO: 1709434 - DNA, 23 bp, Homo sapiens
cagttcatatgtaccatgtacat

SEQ ID NO: 1709435 - DNA, 17 bp, Homo sapiens
cagttcatcaaatcatc

SEQ ID NO: 1709436 - DNA, 23 bp, Homo sapiens
cagttcatcaccatttcctcctt

SEQ ID NO: 1709437 - DNA, 18 bp, Homo sapiens
cagttcatgtttgcttca

SEQ ID NO: 1709438 - DNA, 17 bp, Homo sapiens
cagttcattagaaatat

SEQ ID NO: 1709439 - DNA, 20 bp, Homo sapiens
cagttcattagaaatatttt

SEQ ID NO: 1709440 - DNA, 19 bp, Homo sapiens
cagttccaaagtcacagga

SEQ ID NO: 1709441 - DNA, 15 bp, Homo sapiens
cagttcccagctccc

SEQ ID NO: 1709442 - DNA, 18 bp, Homo sapiens
cagttcccccagtacctc

SEQ ID NO: 1709443 - DNA, 20 bp, Homo sapiens
cagttcccggagcacagccc

SEQ ID NO: 1709444 - DNA, 15 bp, Homo sapiens
cagttcccttggcct

SEQ ID NO: 1709445 - DNA, 16 bp, Homo sapiens
cagttcccttggcctc

SEQ ID NO: 1709446 - DNA, 20 bp, Homo sapiens
cagttcccttggcctcagaa

SEQ ID NO: 1709447 - DNA, 17 bp, Homo sapiens
cagttcctatgacacag

SEQ ID NO: 1709448 - DNA, 18 bp, Homo sapiens
cagttcctcgccctgggt

SEQ ID NO: 1709449 - DNA, 15 bp, Homo sapiens
cagttcctgggaaca

SEQ ID NO: 1709450 - DNA, 15 bp, Homo sapiens
cagttcctttagaaa

SEQ ID NO: 1709451 - DNA, 22 bp, Homo sapiens
cagttcgaccaaactcagttca

SEQ ID NO: 1709452 - DNA, 23 bp, Homo sapiens
cagttcgaccaaactcagttcaa

SEQ ID NO: 1709453 - DNA, 15 bp, Homo sapiens
cagttctaacctcct

SEQ ID NO: 1709454 - DNA, 18 bp, Homo sapiens
cagttctaacctcctaag

SEQ ID NO: 1709455 - DNA, 17 bp, Homo sapiens
cagttctctcccttcct

SEQ ID NO: 1709456 - DNA, 18 bp, Homo sapiens
cagttctctgtggaagca

SEQ ID NO: 1709457 - DNA, 14 bp, Homo sapiens
cagttctttcctct

SEQ ID NO: 1709458 - DNA, 17 bp, Homo sapiens
cagttctttcctctttc

SEQ ID NO: 1709459 - DNA, 19 bp, Homo sapiens
cagttctttgggccagaca

SEQ ID NO: 1709460 - DNA, 21 bp, Homo sapiens
cagttctttgggccagacatg

SEQ ID NO: 1709461 - DNA, 22 bp, Homo sapiens
cagttctttgggccagacatgc

SEQ ID NO: 1709462 - DNA, 14 bp, Homo sapiens
cagttgaaaagact

SEQ ID NO: 1709463 - DNA, 18 bp, Homo sapiens
cagttgaaaagactccaa

SEQ ID NO: 1709464 - DNA, 23 bp, Homo sapiens
cagttgaaaagactccaaagaaa

SEQ ID NO: 1709465 - DNA, 17 bp, Homo sapiens
cagttgcaataatactt

SEQ ID NO: 1709466 - DNA, 20 bp, Homo sapiens
cagttgcagcccttgtgatg

SEQ ID NO: 1709467 - DNA, 18 bp, Homo sapiens
cagttgcatgctagcatg

SEQ ID NO: 1709468 - DNA, 16 bp, Homo sapiens
cagttgcatgtagtaa

SEQ ID NO: 1709469 - DNA, 19 bp, Homo sapiens
cagttgcatgtagtaacac

SEQ ID NO: 1709470 - DNA, 21 bp, Homo sapiens
cagttgcatgtagtaacacta

SEQ ID NO: 1709471 - DNA, 13 bp, Homo sapiens
cagttgcctttta

SEQ ID NO: 1709472 - DNA, 13 bp, Homo sapiens
cagttgctgtgaa

SEQ ID NO: 1709473 - DNA, 22 bp, Homo sapiens
cagttgggacccaaaacacagg

SEQ ID NO: 1709474 - DNA, 20 bp, Homo sapiens
cagttgggagcactggagtg

SEQ ID NO: 1709475 - DNA, 21 bp, Homo sapiens
cagttgggagcactggagtgc

SEQ ID NO: 1709476 - DNA, 16 bp, Homo sapiens
cagttggtaacttttg

SEQ ID NO: 1709477 - DNA, 17 bp, Homo sapiens
cagttggtaacttttgt

SEQ ID NO: 1709478 - DNA, 22 bp, Homo sapiens
cagttggtgactgggaaagtta

SEQ ID NO: 1709479 - DNA, 21 bp, Homo sapiens
cagttgtagggttacagagac

SEQ ID NO: 1709480 - DNA, 19 bp, Homo sapiens
cagttgtctattctgagcc

SEQ ID NO: 1709481 - DNA, 20 bp, Homo sapiens
cagttgtctattctgagcct

SEQ ID NO: 1709482 - DNA, 14 bp, Homo sapiens
cagttgtgatttct

SEQ ID NO: 1709483 - DNA, 19 bp, Homo sapiens
cagttgtgatttctgtgga

SEQ ID NO: 1709484 - DNA, 17 bp, Homo sapiens
cagttgtttctaagagc

SEQ ID NO: 1709485 - DNA, 22 bp, Homo sapiens
cagttgtttctaagagcagagt

SEQ ID NO: 1709486 - DNA, 17 bp, Homo sapiens
cagttgtttgcttcttg

SEQ ID NO: 1709487 - DNA, 21 bp, Homo sapiens
cagttgtttgtttttgcttgt

SEQ ID NO: 1709488 - DNA, 12 bp, Homo sapiens
cagtttaaagca

SEQ ID NO: 1709489 - DNA, 20 bp, Homo sapiens
cagtttaagtaattgcctac

SEQ ID NO: 1709490 - DNA, 22 bp, Homo sapiens
cagtttaatgtctcctttgctc

SEQ ID NO: 1709491 - DNA, 23 bp, Homo sapiens
cagtttacagacgctgctgtcac

SEQ ID NO: 1709492 - DNA, 20 bp, Homo sapiens
cagtttatggatatgctgct

SEQ ID NO: 1709493 - DNA, 20 bp, Homo sapiens
tacaaaatatttaagtgaag

SEQ ID NO: 1709494 - DNA, 14 bp, Homo sapiens
tacaaaatgccaag

SEQ ID NO: 1709495 - DNA, 23 bp, Homo sapiens
tacaaaattaagcaaatgttaaa

SEQ ID NO: 1709496 - DNA, 23 bp, Homo sapiens
tacaaaccaagagcttttacaga

SEQ ID NO: 1709497 - DNA, 11 bp, Homo sapiens
tacaaactgca

SEQ ID NO: 1709498 - DNA, 12 bp, Homo sapiens
tacaaactgcaa

SEQ ID NO: 1709499 - DNA, 13 bp, Homo sapiens
tacaaactgcaat

SEQ ID NO: 1709500 - DNA, 15 bp, Homo sapiens
tacaaagctttgcta

SEQ ID NO: 1709501 - DNA, 18 bp, Homo sapiens
tacaaagctttgctacaa

SEQ ID NO: 1709502 - DNA, 15 bp, Homo sapiens
tacaaagtaaaatga

SEQ ID NO: 1709503 - DNA, 20 bp, Homo sapiens
tacaaagtaaaatgaacatt

SEQ ID NO: 1709504 - DNA, 22 bp, Homo sapiens
tacaaagtaaaatgaacatttt

SEQ ID NO: 1709505 - DNA, 14 bp, Homo sapiens
tacaaagtagaagt

SEQ ID NO: 1709506 - DNA, 18 bp, Homo sapiens
tacaaagtagaagtctta

SEQ ID NO: 1709507 - DNA, 17 bp, Homo sapiens
tacaaataaacctgagg

SEQ ID NO: 1709508 - DNA, 19 bp, Homo sapiens
tacaaataaacctgaggca

SEQ ID NO: 1709509 - DNA, 17 bp, Homo sapiens
tacaaatactcttagga

SEQ ID NO: 1709510 - DNA, 17 bp, Homo sapiens
tacaaatcagaagtcat

SEQ ID NO: 1709511 - DNA, 21 bp, Homo sapiens
tacaaatcagaagtcatcttg

SEQ ID NO: 1709512 - DNA, 16 bp, Homo sapiens
tacaaatgaagaaagt

SEQ ID NO: 1709513 - DNA, 22 bp, Homo sapiens
tacaaatgtgaaacggaagctc

SEQ ID NO: 1709514 - DNA, 15 bp, Homo sapiens
tacaaattgcttact

SEQ ID NO: 1709515 - DNA, 13 bp, Homo sapiens
tacaaatttatgc

SEQ ID NO: 1709516 - DNA, 14 bp, Homo sapiens
tacaaatttatgca

SEQ ID NO: 1709517 - DNA, 19 bp, Homo sapiens
tacaaatttatgcatttca

SEQ ID NO: 1709518 - DNA, 15 bp, Homo sapiens
tacaaatttttctgt

SEQ ID NO: 1709519 - DNA, 16 bp, Homo sapiens
tacaacaccaaaaaat

SEQ ID NO: 1709520 - DNA, 22 bp, Homo sapiens
tacaacataatctagtttacag

SEQ ID NO: 1709521 - DNA, 22 bp, Homo sapiens
tacaacggagtcaaaaattaaa

SEQ ID NO: 1709522 - DNA, 18 bp, Homo sapiens
tacaactatgtaatttat

SEQ ID NO: 1709523 - DNA, 17 bp, Homo sapiens
tacaacttaagttggtc

SEQ ID NO: 1709524 - DNA, 16 bp, Homo sapiens
tacaacttaatggaaa

SEQ ID NO: 1709525 - DNA, 14 bp, Homo sapiens
tacaacttcaagtg

SEQ ID NO: 1709526 - DNA, 14 bp, Homo sapiens
tacaagagatggga

SEQ ID NO: 1709527 - DNA, 20 bp, Homo sapiens
tacaagagcagcctgtggca

SEQ ID NO: 1709528 - DNA, 21 bp, Homo sapiens
tacaagccattctaaggaaat

SEQ ID NO: 1709529 - DNA, 17 bp, Homo sapiens
tacaaggtaattgtttt

SEQ ID NO: 1709530 - DNA, 15 bp, Homo sapiens
cagttttgtaaatgt

SEQ ID NO: 1709531 - DNA, 22 bp, Homo sapiens
cagtttttaaaatatattgctg

SEQ ID NO: 1709532 - DNA, 13 bp, Homo sapiens
cagtttttcattt

SEQ ID NO: 1709533 - DNA, 22 bp, Homo sapiens
cagtttttgtttttgcatgaaa

SEQ ID NO: 1709534 - DNA, 17 bp, Homo sapiens
cagtttttttctttgtg

SEQ ID NO: 1709535 - DNA, 23 bp, Homo sapiens
cataaaaacaactttatacccag

SEQ ID NO: 1709536 - DNA, 21 bp, Homo sapiens
cataaaaataaaatctgtaaa

SEQ ID NO: 1709537 - DNA, 12 bp, Homo sapiens
cataaaacaaaa

SEQ ID NO: 1709538 - DNA, 21 bp, Homo sapiens
cataaaacaaaaccaagcctt

SEQ ID NO: 1709539 - DNA, 23 bp, Homo sapiens
cataaaacaaaaccaagccttgg

SEQ ID NO: 1709540 - DNA, 14 bp, Homo sapiens
cataaaagaatttt

SEQ ID NO: 1709541 - DNA, 19 bp, Homo sapiens
cataaaataaagtatatat

SEQ ID NO: 1709542 - DNA, 20 bp, Homo sapiens
cataaaataaagtatatata

SEQ ID NO: 1709543 - DNA, 16 bp, Homo sapiens
cataaaatttacattt

SEQ ID NO: 1709544 - DNA, 23 bp, Homo sapiens
cataaacagcacacctgtgtcca

SEQ ID NO: 1709545 - DNA, 12 bp, Homo sapiens
cataaaccttaa

SEQ ID NO: 1709546 - DNA, 14 bp, Homo sapiens
cataaaccttaagt

SEQ ID NO: 1709547 - DNA, 14 bp, Homo sapiens
cataaactaagaga

SEQ ID NO: 1709548 - DNA, 16 bp, Homo sapiens
cataaactaagagaaa

SEQ ID NO: 1709549 - DNA, 19 bp, Homo sapiens
cataaagacaatcactgcc

SEQ ID NO: 1709550 - DNA, 13 bp, Homo sapiens
cataaagcaaata

SEQ ID NO: 1709551 - DNA, 20 bp, Homo sapiens
cataaagcaaatagacacag

SEQ ID NO: 1709552 - DNA, 21 bp, Homo sapiens
cataaagggtgtaggggccac

SEQ ID NO: 1709553 - DNA, 11 bp, Homo sapiens
cataaagtcag

SEQ ID NO: 1709554 - DNA, 14 bp, Homo sapiens
cataaagttgtatt

SEQ ID NO: 1709555 - DNA, 19 bp, Homo sapiens
cataaatacaaaaatgaat

SEQ ID NO: 1709556 - DNA, 14 bp, Homo sapiens
cataaatactgtca

SEQ ID NO: 1709557 - DNA, 13 bp, Homo sapiens
cataaatgaagca

SEQ ID NO: 1709558 - DNA, 20 bp, Homo sapiens
cataaatgcataatttatgg

SEQ ID NO: 1709559 - DNA, 20 bp, Homo sapiens
cataaatggattaattacta

SEQ ID NO: 1709560 - DNA, 21 bp, Homo sapiens
cataaatggattaattactaa

SEQ ID NO: 1709561 - DNA, 23 bp, Homo sapiens
cataacctgtctcacctggactt

SEQ ID NO: 1709562 - DNA, 18 bp, Homo sapiens
cataactaaaattaagta

SEQ ID NO: 1709563 - DNA, 20 bp, Homo sapiens
cataactaaaattaagtata

SEQ ID NO: 1709564 - DNA, 14 bp, Homo sapiens
cataactatctttt

SEQ ID NO: 1709565 - DNA, 19 bp, Homo sapiens
cataactatctttttgaaa

SEQ ID NO: 1709566 - DNA, 11 bp, Homo sapiens
cataactgaaa

SEQ ID NO: 1709567 - DNA, 14 bp, Homo sapiens
cataactgaaaatg

SEQ ID NO: 1709568 - DNA, 21 bp, Homo sapiens
cataactgcttcttggagctt

SEQ ID NO: 1709569 - DNA, 12 bp, Homo sapiens
cataagaatgaa

SEQ ID NO: 1709570 - DNA, 15 bp, Homo sapiens
cataagacagagaag

SEQ ID NO: 1709571 - DNA, 15 bp, Homo sapiens
cataagaccgtgtcc

SEQ ID NO: 1709572 - DNA, 11 bp, Homo sapiens
cataagattaa

SEQ ID NO: 1709573 - DNA, 17 bp, Homo sapiens
cataagattaaaggaag

SEQ ID NO: 1709574 - DNA, 21 bp, Homo sapiens
cataagcctccatttagttct

SEQ ID NO: 1709575 - DNA, 22 bp, Homo sapiens
cataagctatcacctagcagcc

SEQ ID NO: 1709576 - DNA, 14 bp, Homo sapiens
cataagctcagaat

SEQ ID NO: 1709577 - DNA, 16 bp, Homo sapiens
cataagctcagaatcc

SEQ ID NO: 1709578 - DNA, 23 bp, Homo sapiens
cataaggatacacttatttgtca

SEQ ID NO: 1709579 - DNA, 21 bp, Homo sapiens
cataaggccagtatgatttat

SEQ ID NO: 1709580 - DNA, 23 bp, Homo sapiens
cataaggctggatggcacctcag

SEQ ID NO: 1709581 - DNA, 15 bp, Homo sapiens
cataaggcttcaaaa

SEQ ID NO: 1709582 - DNA, 19 bp, Homo sapiens
cataaggcttcaaaatgtt

SEQ ID NO: 1709583 - DNA, 15 bp, Homo sapiens
cataaggtttcgttt

SEQ ID NO: 1709584 - DNA, 16 bp, Homo sapiens
cataagtaattcaaga

SEQ ID NO: 1709585 - DNA, 17 bp, Homo sapiens
cataagtaattcaagaa

SEQ ID NO: 1709586 - DNA, 18 bp, Homo sapiens
cataagtaattcaagaaa

SEQ ID NO: 1709587 - DNA, 23 bp, Homo sapiens
cataagtgacaccaataaatgtt

SEQ ID NO: 1709588 - DNA, 20 bp, Homo sapiens
cataagttatgcctctgaca

SEQ ID NO: 1709589 - DNA, 18 bp, Homo sapiens
cataagttggaccagagg

SEQ ID NO: 1709590 - DNA, 19 bp, Homo sapiens
cataagttggaccagagga

SEQ ID NO: 1709591 - DNA, 18 bp, Homo sapiens
cataataaaaggctttga

SEQ ID NO: 1709592 - DNA, 12 bp, Homo sapiens
cataataaacta

SEQ ID NO: 1709593 - DNA, 17 bp, Homo sapiens
cataataagctaaagag

SEQ ID NO: 1709594 - DNA, 17 bp, Homo sapiens
cataatagttagccctc

SEQ ID NO: 1709595 - DNA, 15 bp, Homo sapiens
cataatcactctaat

SEQ ID NO: 1709596 - DNA, 18 bp, Homo sapiens
cataatcctagccccgag

SEQ ID NO: 1709597 - DNA, 19 bp, Homo sapiens
cataatcctagccccgaga

SEQ ID NO: 1709598 - DNA, 21 bp, Homo sapiens
cataatctagtttacagaaaa

SEQ ID NO: 1709599 - DNA, 18 bp, Homo sapiens
cataatctggtctcttct

SEQ ID NO: 1709600 - DNA, 23 bp, Homo sapiens
cataatctggtctcttcttcttt

SEQ ID NO: 1709601 - DNA, 12 bp, Homo sapiens
cataatgcagaa

SEQ ID NO: 1709602 - DNA, 13 bp, Homo sapiens
cataatgcagaag

SEQ ID NO: 1709603 - DNA, 19 bp, Homo sapiens
cataatgcagaagtattct

SEQ ID NO: 1709604 - DNA, 16 bp, Homo sapiens
cataatgctactgtct

SEQ ID NO: 1709605 - DNA, 21 bp, Homo sapiens
cataatgctcccatctcctga

SEQ ID NO: 1709606 - DNA, 15 bp, Homo sapiens
cataatgctttgtta

SEQ ID NO: 1709607 - DNA, 17 bp, Homo sapiens
cataatgtccctctctt

SEQ ID NO: 1709608 - DNA, 19 bp, Homo sapiens
cataatgtccctctcttgg

SEQ ID NO: 1709609 - DNA, 15 bp, Homo sapiens
cataatgttctgcta

SEQ ID NO: 1709610 - DNA, 15 bp, Homo sapiens
cataatgttgcttct

SEQ ID NO: 1709611 - DNA, 23 bp, Homo sapiens
cataatgtttctggatttcatac

SEQ ID NO: 1709612 - DNA, 13 bp, Homo sapiens
cataattaaattt

SEQ ID NO: 1709613 - DNA, 13 bp, Homo sapiens
cataattaacact

SEQ ID NO: 1709614 - DNA, 17 bp, Homo sapiens
cataattatgacagtta

SEQ ID NO: 1709615 - DNA, 16 bp, Homo sapiens
cataattcttgtatat

SEQ ID NO: 1709616 - DNA, 14 bp, Homo sapiens
cataattgaagtgt

SEQ ID NO: 1709617 - DNA, 23 bp, Homo sapiens
cataattgtgaccaatacatttg

SEQ ID NO: 1709618 - DNA, 21 bp, Homo sapiens
cataattgtgattagacagaa

SEQ ID NO: 1709619 - DNA, 23 bp, Homo sapiens
cataattgtggattataaaaaat

SEQ ID NO: 1709620 - DNA, 12 bp, Homo sapiens
cataatttatgg

SEQ ID NO: 1709621 - DNA, 23 bp, Homo sapiens
cataatttgtacatatgtaaaat

SEQ ID NO: 1709622 - DNA, 12 bp, Homo sapiens
cataattttgca

SEQ ID NO: 1709623 - DNA, 23 bp, Homo sapiens
catacaaaatatttaagtgaagg

SEQ ID NO: 1709624 - DNA, 16 bp, Homo sapiens
catacaaactctcacc

SEQ ID NO: 1709625 - DNA, 15 bp, Homo sapiens
catacaacacaaaga

SEQ ID NO: 1709626 - DNA, 17 bp, Homo sapiens
catacaacagaaaccag

SEQ ID NO: 1709627 - DNA, 16 bp, Homo sapiens
catacaagaaaatgta

SEQ ID NO: 1709628 - DNA, 15 bp, Homo sapiens
catacaatgtatgta

SEQ ID NO: 1709629 - DNA, 17 bp, Homo sapiens
catacaatgtatgtaca

SEQ ID NO: 1709630 - DNA, 19 bp, Homo sapiens
catacacacatgccctcct

SEQ ID NO: 1709631 - DNA, 21 bp, Homo sapiens
catacacacatgccctcctgg

SEQ ID NO: 1709632 - DNA, 14 bp, Homo sapiens
catacacctcgtca

SEQ ID NO: 1709633 - DNA, 14 bp, Homo sapiens
catacactgtgaac

SEQ ID NO: 1709634 - DNA, 22 bp, Homo sapiens
catacagaggatgccttttctg

SEQ ID NO: 1709635 - DNA, 22 bp, Homo sapiens
catacagagtgggccccgggct

SEQ ID NO: 1709636 - DNA, 17 bp, Homo sapiens
catacagctgcctacct

SEQ ID NO: 1709637 - DNA, 12 bp, Homo sapiens
catacagttttc

SEQ ID NO: 1709638 - DNA, 16 bp, Homo sapiens
catacataatatatga

SEQ ID NO: 1709639 - DNA, 11 bp, Homo sapiens
catacatattt

SEQ ID NO: 1709640 - DNA, 12 bp, Homo sapiens
catacatatttt

SEQ ID NO: 1709641 - DNA, 21 bp, Homo sapiens
catacatttataatgtttgct

SEQ ID NO: 1709642 - DNA, 22 bp, Homo sapiens
catacatttataatgtttgcta

SEQ ID NO: 1709643 - DNA, 13 bp, Homo sapiens
cataccaggcaac

SEQ ID NO: 1709644 - DNA, 20 bp, Homo sapiens
cataccaggcaacctcccat

SEQ ID NO: 1709645 - DNA, 15 bp, Homo sapiens
cataggtcactggct

SEQ ID NO: 1709646 - DNA, 15 bp, Homo sapiens
cataggttaaaaaaa

SEQ ID NO: 1709647 - DNA, 17 bp, Homo sapiens
cataggttttaaatctg

SEQ ID NO: 1709648 - DNA, 23 bp, Homo sapiens
catagtaaaatacctctaataaa

SEQ ID NO: 1709649 - DNA, 15 bp, Homo sapiens
catagtataacttta

SEQ ID NO: 1709650 - DNA, 17 bp, Homo sapiens
catagtataactttaaa

SEQ ID NO: 1709651 - DNA, 11 bp, Homo sapiens
catagtcagtg

SEQ ID NO: 1709652 - DNA, 20 bp, Homo sapiens
catagtgagacccctgtctc

SEQ ID NO: 1709653 - DNA, 19 bp, Homo sapiens
catagtgatggttcccctg

SEQ ID NO: 1709654 - DNA, 18 bp, Homo sapiens
catagtggggcctgggag

SEQ ID NO: 1709655 - DNA, 22 bp, Homo sapiens
catagttctagtgcagctgaaa

SEQ ID NO: 1709656 - DNA, 21 bp, Homo sapiens
catagttgtagacaaagtaca

SEQ ID NO: 1709657 - DNA, 14 bp, Homo sapiens
catagttttatatc

SEQ ID NO: 1709658 - DNA, 18 bp, Homo sapiens
catataaattttttgtga

SEQ ID NO: 1709659 - DNA, 13 bp, Homo sapiens
catataacatgca

SEQ ID NO: 1709660 - DNA, 15 bp, Homo sapiens
catataagtttgaag

SEQ ID NO: 1709661 - DNA, 17 bp, Homo sapiens
catataatgttgttatt

SEQ ID NO: 1709662 - DNA, 18 bp, Homo sapiens
catataatgttgttattt

SEQ ID NO: 1709663 - DNA, 22 bp, Homo sapiens
catatacaacaccaaaaaatat

SEQ ID NO: 1709664 - DNA, 23 bp, Homo sapiens
catatacaacaccaaaaaatatc

SEQ ID NO: 1709665 - DNA, 16 bp, Homo sapiens
catatacatattgtat

SEQ ID NO: 1709666 - DNA, 18 bp, Homo sapiens
catataggtgatgtttgc

SEQ ID NO: 1709667 - DNA, 22 bp, Homo sapiens
catatataactattttaaatat

SEQ ID NO: 1709668 - DNA, 16 bp, Homo sapiens
catatatgtataatat

SEQ ID NO: 1709669 - DNA, 18 bp, Homo sapiens
catatatgtataatatat

SEQ ID NO: 1709670 - DNA, 20 bp, Homo sapiens
catatatgtataatatatat

SEQ ID NO: 1709671 - DNA, 13 bp, Homo sapiens
catatatttattg

SEQ ID NO: 1709672 - DNA, 21 bp, Homo sapiens
catatatttgcagtatgaact

SEQ ID NO: 1709673 - DNA, 23 bp, Homo sapiens
catatatttgtttcatttctgca

SEQ ID NO: 1709674 - DNA, 20 bp, Homo sapiens
catatcaacttagtcaataa

SEQ ID NO: 1709675 - DNA, 15 bp, Homo sapiens
catatcacccttccc

SEQ ID NO: 1709676 - DNA, 14 bp, Homo sapiens
catatcatttgagt

SEQ ID NO: 1709677 - DNA, 17 bp, Homo sapiens
catatccaaaataatga

SEQ ID NO: 1709678 - DNA, 17 bp, Homo sapiens
catatccaagtaccaat

SEQ ID NO: 1709679 - DNA, 19 bp, Homo sapiens
catatccatagtgactttt

SEQ ID NO: 1709680 - DNA, 14 bp, Homo sapiens
catatcctgagcca

SEQ ID NO: 1709681 - DNA, 12 bp, Homo sapiens
catatcctgcct

SEQ ID NO: 1709682 - DNA, 15 bp, Homo sapiens
catatcctggtgtct

SEQ ID NO: 1709683 - DNA, 20 bp, Homo sapiens
catatcctggtgtctagttt

SEQ ID NO: 1709684 - DNA, 23 bp, Homo sapiens
catatcgctgggctcaacataga

SEQ ID NO: 1709685 - DNA, 17 bp, Homo sapiens
catatctagtatgaaat

SEQ ID NO: 1709686 - DNA, 22 bp, Homo sapiens
catatcttctatatctgaagag

SEQ ID NO: 1709687 - DNA, 22 bp, Homo sapiens
catatgaaaaaaatgcatttta

SEQ ID NO: 1709688 - DNA, 18 bp, Homo sapiens
catatgaaaatacaactt

SEQ ID NO: 1709689 - DNA, 17 bp, Homo sapiens
catatgaattgtacaga

SEQ ID NO: 1709690 - DNA, 23 bp, Homo sapiens
catatgactgattactcagagca

SEQ ID NO: 1709691 - DNA, 15 bp, Homo sapiens
catatgacttgatct

SEQ ID NO: 1709692 - DNA, 23 bp, Homo sapiens
catatgagaatataccttattta

SEQ ID NO: 1709693 - DNA, 14 bp, Homo sapiens
catatgattctgct

SEQ ID NO: 1709694 - DNA, 16 bp, Homo sapiens
catatgattgaaaaga

SEQ ID NO: 1709695 - DNA, 21 bp, Homo sapiens
catatgattgaaaagaagaaa

SEQ ID NO: 1709696 - DNA, 22 bp, Homo sapiens
catatgattgaaaagaagaaag

SEQ ID NO: 1709697 - DNA, 17 bp, Homo sapiens
catatgcaccttgtgtc

SEQ ID NO: 1709698 - DNA, 19 bp, Homo sapiens
catatgcaccttgtgtctg

SEQ ID NO: 1709699 - DNA, 21 bp, Homo sapiens
catatgcaccttgtgtctgta

SEQ ID NO: 1709700 - DNA, 23 bp, Homo sapiens
catatgcaccttgtgtctgtaca

SEQ ID NO: 1709701 - DNA, 20 bp, Homo sapiens
catatgcagaaatagacaaa

SEQ ID NO: 1709702 - DNA, 20 bp, Homo sapiens
catatgcagccaaccaagat

SEQ ID NO: 1709703 - DNA, 17 bp, Homo sapiens
catatgcttactcttgc

SEQ ID NO: 1709704 - DNA, 22 bp, Homo sapiens
catatgggatattcccaagccg

SEQ ID NO: 1709705 - DNA, 22 bp, Homo sapiens
catatgggtgggattttgcaaa

SEQ ID NO: 1709706 - DNA, 18 bp, Homo sapiens
catatgggttagatgttg

SEQ ID NO: 1709707 - DNA, 13 bp, Homo sapiens
catatgtaaaata

SEQ ID NO: 1709708 - DNA, 14 bp, Homo sapiens
catatgtaaaataa

SEQ ID NO: 1709709 - DNA, 17 bp, Homo sapiens
catatgtaacagtcaaa

SEQ ID NO: 1709710 - DNA, 15 bp, Homo sapiens
catatgtaccatgta

SEQ ID NO: 1709711 - DNA, 21 bp, Homo sapiens
catatgtaccatgtacatgaa

SEQ ID NO: 1709712 - DNA, 13 bp, Homo sapiens
catatgtacttgt

SEQ ID NO: 1709713 - DNA, 15 bp, Homo sapiens
catatgtatacatgt

SEQ ID NO: 1709714 - DNA, 17 bp, Homo sapiens
catatgtattcctgatc

SEQ ID NO: 1709715 - DNA, 15 bp, Homo sapiens
catatgttacactaa

SEQ ID NO: 1709716 - DNA, 23 bp, Homo sapiens
catattaaaatctgatgtaacaa

SEQ ID NO: 1709717 - DNA, 18 bp, Homo sapiens
catattaagacagtgtac

SEQ ID NO: 1709718 - DNA, 17 bp, Homo sapiens
catattactccacacct

SEQ ID NO: 1709719 - DNA, 19 bp, Homo sapiens
catattactccacaccttt

SEQ ID NO: 1709720 - DNA, 19 bp, Homo sapiens
catattactgttgcattta

SEQ ID NO: 1709721 - DNA, 21 bp, Homo sapiens
catattactgttgcatttact

SEQ ID NO: 1709722 - DNA, 14 bp, Homo sapiens
catattaggaaaat

SEQ ID NO: 1709723 - DNA, 20 bp, Homo sapiens
catattaggaaaatatgggt

SEQ ID NO: 1709724 - DNA, 15 bp, Homo sapiens
catattagtgtcatc

SEQ ID NO: 1709725 - DNA, 16 bp, Homo sapiens
catattcagacatcaa

SEQ ID NO: 1709726 - DNA, 17 bp, Homo sapiens
catattccatatttatt

SEQ ID NO: 1709727 - DNA, 13 bp, Homo sapiens
catattctgtctg

SEQ ID NO: 1709728 - DNA, 15 bp, Homo sapiens
catattcttgtgctt

SEQ ID NO: 1709729 - DNA, 22 bp, Homo sapiens
catattgagatcagcattcaaa

SEQ ID NO: 1709730 - DNA, 14 bp, Homo sapiens
catattgtatgtaa

SEQ ID NO: 1709731 - DNA, 21 bp, Homo sapiens
catattgtgcttcacagtaga

SEQ ID NO: 1709732 - DNA, 21 bp, Homo sapiens
catattgtgtaatttaagtga

SEQ ID NO: 1709733 - DNA, 23 bp, Homo sapiens
catattgtgtaatttaagtgaca

SEQ ID NO: 1709734 - DNA, 22 bp, Homo sapiens
catattgttagggtcagccatt

SEQ ID NO: 1709735 - DNA, 23 bp, Homo sapiens
catattgttagggtcagccattt

SEQ ID NO: 1709736 - DNA, 13 bp, Homo sapiens
catattgttgaaa

SEQ ID NO: 1709737 - DNA, 17 bp, Homo sapiens
catatttaataatgctt

SEQ ID NO: 1709738 - DNA, 17 bp, Homo sapiens
catatttacttcttata

SEQ ID NO: 1709739 - DNA, 16 bp, Homo sapiens
catatttatactttgc

SEQ ID NO: 1709740 - DNA, 22 bp, Homo sapiens
catatttatccaaaatgtgtat

SEQ ID NO: 1709741 - DNA, 23 bp, Homo sapiens
catatttctgtggagggttgcca

SEQ ID NO: 1709742 - DNA, 14 bp, Homo sapiens
catatttctttggc

SEQ ID NO: 1709743 - DNA, 18 bp, Homo sapiens
catatttgatttctaatt

SEQ ID NO: 1709744 - DNA, 22 bp, Homo sapiens
catatttgatttctaattgtaa

SEQ ID NO: 1709745 - DNA, 21 bp, Homo sapiens
catatttgccaataaagcttt

SEQ ID NO: 1709746 - DNA, 18 bp, Homo sapiens
catatttgtactttctgt

SEQ ID NO: 1709747 - DNA, 22 bp, Homo sapiens
catatttgtatagttgcttgcc

SEQ ID NO: 1709748 - DNA, 19 bp, Homo sapiens
catatttgtgccgtaatta

SEQ ID NO: 1709749 - DNA, 23 bp, Homo sapiens
catatttgtttatggtaaaaaat

SEQ ID NO: 1709750 - DNA, 18 bp, Homo sapiens
catcaaaaagccttattt

SEQ ID NO: 1709751 - DNA, 18 bp, Homo sapiens
catcaaacctttgagtag

SEQ ID NO: 1709752 - DNA, 18 bp, Homo sapiens
catcaaagcagaagtctg

SEQ ID NO: 1709753 - DNA, 22 bp, Homo sapiens
catcaaagcagaagtctggctt

SEQ ID NO: 1709754 - DNA, 14 bp, Homo sapiens
catcaaagcctggc

SEQ ID NO: 1709755 - DNA, 17 bp, Homo sapiens
catcaaagcctggccta

SEQ ID NO: 1709756 - DNA, 19 bp, Homo sapiens
catcaaagtggtaaatact

SEQ ID NO: 1709757 - DNA, 14 bp, Homo sapiens
catcaaatatttct

SEQ ID NO: 1709758 - DNA, 16 bp, Homo sapiens
catcaaatatttcttg

SEQ ID NO: 1709759 - DNA, 19 bp, Homo sapiens
catcaactaaagttgtact

SEQ ID NO: 1709760 - DNA, 22 bp, Homo sapiens
catcaactcccaacttcttcct

SEQ ID NO: 1709761 - DNA, 12 bp, Homo sapiens
catcaactgaat

SEQ ID NO: 1709762 - DNA, 12 bp, Homo sapiens
catcaagaaata

SEQ ID NO: 1709763 - DNA, 16 bp, Homo sapiens
catcaagaagggctgc

SEQ ID NO: 1709764 - DNA, 14 bp, Homo sapiens
catcaagtccatct

SEQ ID NO: 1709765 - DNA, 17 bp, Homo sapiens
catcaagttctccccag

SEQ ID NO: 1709766 - DNA, 21 bp, Homo sapiens
catcaatatccctcttgtaag

SEQ ID NO: 1709767 - DNA, 21 bp, Homo sapiens
catcaatcctgattcctctct

SEQ ID NO: 1709768 - DNA, 13 bp, Homo sapiens
catcaatcttgtt

SEQ ID NO: 1709769 - DNA, 14 bp, Homo sapiens
catcaatcttgtta

SEQ ID NO: 1709770 - DNA, 16 bp, Homo sapiens
catcaatcttgttact

SEQ ID NO: 1709771 - DNA, 17 bp, Homo sapiens
catcaatcttgttactg

SEQ ID NO: 1709772 - DNA, 22 bp, Homo sapiens
catcaatggggccagtcaggcc

SEQ ID NO: 1709773 - DNA, 18 bp, Homo sapiens
catcaattaacatcgtgg

SEQ ID NO: 1709774 - DNA, 11 bp, Homo sapiens
catcacacaca

SEQ ID NO: 1709775 - DNA, 12 bp, Homo sapiens
catcacacacac

SEQ ID NO: 1709776 - DNA, 17 bp, Homo sapiens
catcacacttcattgta

SEQ ID NO: 1709777 - DNA, 19 bp, Homo sapiens
catcacagggtgggcctcg

SEQ ID NO: 1709778 - DNA, 21 bp, Homo sapiens
catcacagggtgggcctcggc

SEQ ID NO: 1709779 - DNA, 22 bp, Homo sapiens
catcacagggttgggcccagat

SEQ ID NO: 1709780 - DNA, 18 bp, Homo sapiens
catcacctatttaatgtt

SEQ ID NO: 1709781 - DNA, 13 bp, Homo sapiens
catcacctcaggc

SEQ ID NO: 1709782 - DNA, 14 bp, Homo sapiens
catcacctgcctgt

SEQ ID NO: 1709783 - DNA, 14 bp, Homo sapiens
catcacctgggacc

SEQ ID NO: 1709784 - DNA, 21 bp, Homo sapiens
catcacggatggtgcatgggc

SEQ ID NO: 1709785 - DNA, 23 bp, Homo sapiens
catcacggatggtgcatgggctc

SEQ ID NO: 1709786 - DNA, 18 bp, Homo sapiens
catcacgtaccccactgg

SEQ ID NO: 1709787 - DNA, 24 bp, Homo sapiens
catcacgtaccccactgggccagc

SEQ ID NO: 1709788 - DNA, 15 bp, Homo sapiens
catcactccctggat

SEQ ID NO: 1709789 - DNA, 23 bp, Homo sapiens
catcactggtccaggtcttcagt

SEQ ID NO: 1709790 - DNA, 14 bp, Homo sapiens
catcactgtaaaga

SEQ ID NO: 1709791 - DNA, 12 bp, Homo sapiens
catcacttccct

SEQ ID NO: 1709792 - DNA, 17 bp, Homo sapiens
catcacttctccccgca

SEQ ID NO: 1709793 - DNA, 15 bp, Homo sapiens
catcacttgtacaaa

SEQ ID NO: 1709794 - DNA, 19 bp, Homo sapiens
catcacttgtacaaaataa

SEQ ID NO: 1709795 - DNA, 14 bp, Homo sapiens
catcagaaaataaa

SEQ ID NO: 1709796 - DNA, 22 bp, Homo sapiens
catcagaaaataaaatattcac

SEQ ID NO: 1709797 - DNA, 14 bp, Homo sapiens
catcagaaaggaat

SEQ ID NO: 1709798 - DNA, 13 bp, Homo sapiens
catcagaagataa

SEQ ID NO: 1709799 - DNA, 11 bp, Homo sapiens
catcagaagga

SEQ ID NO: 1709800 - DNA, 14 bp, Homo sapiens
catcagaaggagaa

SEQ ID NO: 1709801 - DNA, 15 bp, Homo sapiens
catcagaaggagaag

SEQ ID NO: 1709802 - DNA, 12 bp, Homo sapiens
catcagacctgt

SEQ ID NO: 1709803 - DNA, 19 bp, Homo sapiens
catcagacctgtcttccaa

SEQ ID NO: 1709804 - DNA, 22 bp, Homo sapiens
catcagacctgtcttccaagga

SEQ ID NO: 1709805 - DNA, 15 bp, Homo sapiens
catcagatgcctgct

SEQ ID NO: 1709806 - DNA, 18 bp, Homo sapiens
catcagattctgtgagac

SEQ ID NO: 1709807 - DNA, 19 bp, Homo sapiens
catcagcaagactttataa

SEQ ID NO: 1709808 - DNA, 22 bp, Homo sapiens
catcagcagcccatggcctctg

SEQ ID NO: 1709809 - DNA, 18 bp, Homo sapiens
catcagcgggtctcctcc

SEQ ID NO: 1709810 - DNA, 22 bp, Homo sapiens
catcagcgggtctcctcccagc

SEQ ID NO: 1709811 - DNA, 13 bp, Homo sapiens
catcagctgaatt

SEQ ID NO: 1709812 - DNA, 14 bp, Homo sapiens
catcagctgaattc

SEQ ID NO: 1709813 - DNA, 21 bp, Homo sapiens
catcagctgaattcacttaag

SEQ ID NO: 1709814 - DNA, 17 bp, Homo sapiens
catcagctgctgaaaca

SEQ ID NO: 1709815 - DNA, 17 bp, Homo sapiens
catcagctgtaagaaga

SEQ ID NO: 1709816 - DNA, 16 bp, Homo sapiens
catcaggaagcctgtg

SEQ ID NO: 1709817 - DNA, 14 bp, Homo sapiens
catcaggagactgg

SEQ ID NO: 1709818 - DNA, 20 bp, Homo sapiens
catcaggctaagaccctgtg

SEQ ID NO: 1709819 - DNA, 21 bp, Homo sapiens
catcaggctaagaccctgtgt

SEQ ID NO: 1709820 - DNA, 15 bp, Homo sapiens
catcaggtgaggtgt

SEQ ID NO: 1709821 - DNA, 16 bp, Homo sapiens
catcaggttccatccc

SEQ ID NO: 1709822 - DNA, 19 bp, Homo sapiens
catcagtagatttctggca

SEQ ID NO: 1709823 - DNA, 15 bp, Homo sapiens
catcagtccctatgt

SEQ ID NO: 1709824 - DNA, 18 bp, Homo sapiens
catcagtgttaaaaaatt

SEQ ID NO: 1709825 - DNA, 14 bp, Homo sapiens
catcagttcattga

SEQ ID NO: 1709826 - DNA, 14 bp, Homo sapiens
catcataattacat

SEQ ID NO: 1709827 - DNA, 17 bp, Homo sapiens
catcataattacattcc

SEQ ID NO: 1709828 - DNA, 22 bp, Homo sapiens
catcatagcaagacctcatctc

SEQ ID NO: 1709829 - DNA, 17 bp, Homo sapiens
catcataggaagggacc

SEQ ID NO: 1709830 - DNA, 23 bp, Homo sapiens
catcataggaagggaccaaggca

SEQ ID NO: 1709831 - DNA, 15 bp, Homo sapiens
catcatctcagctca

SEQ ID NO: 1709832 - DNA, 14 bp, Homo sapiens
catcatgaactggc

SEQ ID NO: 1709833 - DNA, 18 bp, Homo sapiens
catcatgatggaaaaaat

SEQ ID NO: 1709834 - DNA, 16 bp, Homo sapiens
catcatgcatcttact

SEQ ID NO: 1709835 - DNA, 21 bp, Homo sapiens
catcatggaaagactgggaca

SEQ ID NO: 1709836 - DNA, 14 bp, Homo sapiens
catcatggctgctt

SEQ ID NO: 1709837 - DNA, 23 bp, Homo sapiens
catcatggctgcttgattttgta

SEQ ID NO: 1709838 - DNA, 17 bp, Homo sapiens
catcatgtctgtatact

SEQ ID NO: 1709839 - DNA, 22 bp, Homo sapiens
catcatgtggccccacccaatc

SEQ ID NO: 1709840 - DNA, 21 bp, Homo sapiens
catcatgtttacagaggacag

SEQ ID NO: 1709841 - DNA, 23 bp, Homo sapiens
catcatgtttcagtgaagatgct

SEQ ID NO: 1709842 - DNA, 21 bp, Homo sapiens
catcattaataagtgaagaat

SEQ ID NO: 1709843 - DNA, 21 bp, Homo sapiens
catcattccaaaaagaacaat

SEQ ID NO: 1709844 - DNA, 16 bp, Homo sapiens
catcattccctctcat

SEQ ID NO: 1709845 - DNA, 20 bp, Homo sapiens
catcattccctctcatctca

SEQ ID NO: 1709846 - DNA, 22 bp, Homo sapiens
catcattcttgtgggagacagc

SEQ ID NO: 1709847 - DNA, 19 bp, Homo sapiens
catcattgcacctgcaggc

SEQ ID NO: 1709848 - DNA, 17 bp, Homo sapiens
catcattgtttctgcat

SEQ ID NO: 1709849 - DNA, 20 bp, Homo sapiens
catcatttctttttgggaga

SEQ ID NO: 1709850 - DNA, 22 bp, Homo sapiens
catcattttccatatcctggtg

SEQ ID NO: 1709851 - DNA, 13 bp, Homo sapiens
catccaaagttcc

SEQ ID NO: 1709852 - DNA, 15 bp, Homo sapiens
catccaaccccccac

SEQ ID NO: 1709853 - DNA, 16 bp, Homo sapiens
catccaaccccccacc

SEQ ID NO: 1709854 - DNA, 15 bp, Homo sapiens
catccaactccagca

SEQ ID NO: 1709855 - DNA, 17 bp, Homo sapiens
catccaactccagcaac

SEQ ID NO: 1709856 - DNA, 16 bp, Homo sapiens
catccaagccagagtt

SEQ ID NO: 1709857 - DNA, 21 bp, Homo sapiens
catccaaggagaaacagagac

SEQ ID NO: 1709858 - DNA, 23 bp, Homo sapiens
catccaaggagaaacagagacag

SEQ ID NO: 1709859 - DNA, 13 bp, Homo sapiens
catccaatcctca

SEQ ID NO: 1709860 - DNA, 14 bp, Homo sapiens
catccaatcctcac

SEQ ID NO: 1709861 - DNA, 16 bp, Homo sapiens
catccaatcctcactg

SEQ ID NO: 1709862 - DNA, 12 bp, Homo sapiens
catccaccacct

SEQ ID NO: 1709863 - DNA, 13 bp, Homo sapiens
catccaccacctt

SEQ ID NO: 1709864 - DNA, 19 bp, Homo sapiens
catccacccagtgctgcca

SEQ ID NO: 1709865 - DNA, 20 bp, Homo sapiens
catccacccagtgctgccat

SEQ ID NO: 1709866 - DNA, 12 bp, Homo sapiens
catccaccccat

SEQ ID NO: 1709867 - DNA, 20 bp, Homo sapiens
catccacctcatcactggac

SEQ ID NO: 1709868 - DNA, 22 bp, Homo sapiens
catccactctaccctcccaccc

SEQ ID NO: 1709869 - DNA, 16 bp, Homo sapiens
catccagacctggctc

SEQ ID NO: 1709870 - DNA, 15 bp, Homo sapiens
catccagaggagctg

SEQ ID NO: 1709871 - DNA, 22 bp, Homo sapiens
catccagccagaccccacgctg

SEQ ID NO: 1709872 - DNA, 12 bp, Homo sapiens
catccagcctcc

SEQ ID NO: 1709873 - DNA, 23 bp, Homo sapiens
catccagcctccagggcattgct

SEQ ID NO: 1709874 - DNA, 22 bp, Homo sapiens
catccagcgagagagtttcaaa

SEQ ID NO: 1709875 - DNA, 23 bp, Homo sapiens
catccagcgagagagtttcaaaa

SEQ ID NO: 1709876 - DNA, 15 bp, Homo sapiens
tacatacgatttaag

SEQ ID NO: 1709877 - DNA, 13 bp, Homo sapiens
tacatactgctgt

SEQ ID NO: 1709878 - DNA, 15 bp, Homo sapiens
tacatagtaaagtat

SEQ ID NO: 1709879 - DNA, 13 bp, Homo sapiens
tacatagtgaaaa

SEQ ID NO: 1709880 - DNA, 17 bp, Homo sapiens
tacatagtgctgctgtg

SEQ ID NO: 1709881 - DNA, 17 bp, Homo sapiens
tacatatatacattgct

SEQ ID NO: 1709882 - DNA, 18 bp, Homo sapiens
tacatatatatatataac

SEQ ID NO: 1709883 - DNA, 14 bp, Homo sapiens
tacatatatatatt

SEQ ID NO: 1709884 - DNA, 22 bp, Homo sapiens
tacatatatgtataatatatat

SEQ ID NO: 1709885 - DNA, 21 bp, Homo sapiens
tacatatgagaatatacctta

SEQ ID NO: 1709886 - DNA, 19 bp, Homo sapiens
tacatatgctgatctttta

SEQ ID NO: 1709887 - DNA, 17 bp, Homo sapiens
tacatatgtaaaataaa

SEQ ID NO: 1709888 - DNA, 20 bp, Homo sapiens
tacatatgtaaaataaaatt

SEQ ID NO: 1709889 - DNA, 15 bp, Homo sapiens
tacatatgtaattct

SEQ ID NO: 1709890 - DNA, 16 bp, Homo sapiens
tacatatgtaattctt

SEQ ID NO: 1709891 - DNA, 18 bp, Homo sapiens
tacatatgtatacatgtg

SEQ ID NO: 1709892 - DNA, 15 bp, Homo sapiens
tacatattactgttg

SEQ ID NO: 1709893 - DNA, 18 bp, Homo sapiens
tacatattactgttgcat

SEQ ID NO: 1709894 - DNA, 23 bp, Homo sapiens
tacatattactgttgcatttact

SEQ ID NO: 1709895 - DNA, 15 bp, Homo sapiens
tacatattgtatata

SEQ ID NO: 1709896 - DNA, 17 bp, Homo sapiens
tacatatttgagactag

SEQ ID NO: 1709897 - DNA, 17 bp, Homo sapiens
tacatatttttgtagca

SEQ ID NO: 1709898 - DNA, 19 bp, Homo sapiens
tacatcaaagcttcttcac

SEQ ID NO: 1709899 - DNA, 23 bp, Homo sapiens
tacatcaagtccatctgacaaaa

SEQ ID NO: 1709900 - DNA, 16 bp, Homo sapiens
tacatcagaaaataaa

SEQ ID NO: 1709901 - DNA, 20 bp, Homo sapiens
tacatcagaaaataaaatat

SEQ ID NO: 1709902 - DNA, 22 bp, Homo sapiens
tacatcagccttcaagaatcag

SEQ ID NO: 1709903 - DNA, 12 bp, Homo sapiens
tacatcatttct

SEQ ID NO: 1709904 - DNA, 14 bp, Homo sapiens
tacatcatttcttt

SEQ ID NO: 1709905 - DNA, 15 bp, Homo sapiens
tacatcctcatgcag

SEQ ID NO: 1709906 - DNA, 14 bp, Homo sapiens
tacatctaagtcag

SEQ ID NO: 1709907 - DNA, 15 bp, Homo sapiens
tacatctaagtcagt

SEQ ID NO: 1709908 - DNA, 20 bp, Homo sapiens
tacatctttcacattggcta

SEQ ID NO: 1709909 - DNA, 20 bp, Homo sapiens
tacatcttttttcacaaatt

SEQ ID NO: 1709910 - DNA, 18 bp, Homo sapiens
tacatgaattgcatttta

SEQ ID NO: 1709911 - DNA, 19 bp, Homo sapiens
tacatgaggaactgtagat

SEQ ID NO: 1709912 - DNA, 17 bp, Homo sapiens
tacatgcaacagaagtg

SEQ ID NO: 1709913 - DNA, 18 bp, Homo sapiens
tacatgcacactcatgtg

SEQ ID NO: 1709914 - DNA, 14 bp, Homo sapiens
tacatgcagcccat

SEQ ID NO: 1709915 - DNA, 12 bp, Homo sapiens
tacatgctgcta

SEQ ID NO: 1709916 - DNA, 14 bp, Homo sapiens
tacatgctgctaat

SEQ ID NO: 1709917 - DNA, 18 bp, Homo sapiens
tacatggaataacatgta

SEQ ID NO: 1709918 - DNA, 15 bp, Homo sapiens
tacatggcaacgtgt

SEQ ID NO: 1709919 - DNA, 15 bp, Homo sapiens
tacatggtgtttgtg

SEQ ID NO: 1709920 - DNA, 19 bp, Homo sapiens
tacatgtaaaacattatct

SEQ ID NO: 1709921 - DNA, 17 bp, Homo sapiens
tacatgtatgaaattgg

SEQ ID NO: 1709922 - DNA, 18 bp, Homo sapiens
tacatgtattaaattaca

SEQ ID NO: 1709923 - DNA, 20 bp, Homo sapiens
tacatgtattaaattacatt

SEQ ID NO: 1709924 - DNA, 15 bp, Homo sapiens
tacatgtgtacatat

SEQ ID NO: 1709925 - DNA, 16 bp, Homo sapiens
tacatgtgtacatata

SEQ ID NO: 1709926 - DNA, 16 bp, Homo sapiens
tacatgtgtagcctgt

SEQ ID NO: 1709927 - DNA, 17 bp, Homo sapiens
tacatgtttataaatct

SEQ ID NO: 1709928 - DNA, 18 bp, Homo sapiens
tacatgtttatgtaaaca

SEQ ID NO: 1709929 - DNA, 15 bp, Homo sapiens
tacattaacggtgct

SEQ ID NO: 1709930 - DNA, 16 bp, Homo sapiens
tacattaacggtgcta

SEQ ID NO: 1709931 - DNA, 20 bp, Homo sapiens
tacattaatgttaattcagc

SEQ ID NO: 1709932 - DNA, 19 bp, Homo sapiens
tacattattaaacgatttc

SEQ ID NO: 1709933 - DNA, 22 bp, Homo sapiens
tacattcctaactagaattagt

SEQ ID NO: 1709934 - DNA, 10 bp, Homo sapiens
tacattcctc

SEQ ID NO: 1709935 - DNA, 19 bp, Homo sapiens
tacattcctcagctgccaa

SEQ ID NO: 1709936 - DNA, 20 bp, Homo sapiens
tacattcctcagctgccaag

SEQ ID NO: 1709937 - DNA, 17 bp, Homo sapiens
tacattctccagttgat

SEQ ID NO: 1709938 - DNA, 19 bp, Homo sapiens
tacattcttccatcatcac

SEQ ID NO: 1709939 - DNA, 21 bp, Homo sapiens
tacattcttccatcatcactg

SEQ ID NO: 1709940 - DNA, 23 bp, Homo sapiens
tacattcttccatcatcactgta

SEQ ID NO: 1709941 - DNA, 22 bp, Homo sapiens
tacattctttttgctctaaaat

SEQ ID NO: 1709942 - DNA, 23 bp, Homo sapiens
tacattgaaaacagatattacag

SEQ ID NO: 1709943 - DNA, 19 bp, Homo sapiens
tacattggctggtaacagt

SEQ ID NO: 1709944 - DNA, 19 bp, Homo sapiens
tacattgtaaaataaagtt

SEQ ID NO: 1709945 - DNA, 22 bp, Homo sapiens
tacattgtacgaagagtatttt

SEQ ID NO: 1709946 - DNA, 13 bp, Homo sapiens
tacattgtgtgaa

SEQ ID NO: 1709947 - DNA, 23 bp, Homo sapiens
tacattgtgtgaaaaaagaaaat

SEQ ID NO: 1709948 - DNA, 23 bp, Homo sapiens
tacattgtttgtctgtcttcata

SEQ ID NO: 1709949 - DNA, 18 bp, Homo sapiens
tacatttaaaattgctat

SEQ ID NO: 1709950 - DNA, 16 bp, Homo sapiens
tacatttaatacagat

SEQ ID NO: 1709951 - DNA, 22 bp, Homo sapiens
tacatttatttacactcttgat

SEQ ID NO: 1709952 - DNA, 22 bp, Homo sapiens
tacatttctcctttgataaaat

SEQ ID NO: 1709953 - DNA, 16 bp, Homo sapiens
tacatttctctgagca

SEQ ID NO: 1709954 - DNA, 11 bp, Homo sapiens
tacatttctgc

SEQ ID NO: 1709955 - DNA, 14 bp, Homo sapiens
tacatttgtattta

SEQ ID NO: 1709956 - DNA, 17 bp, Homo sapiens
tacatttgtttgtattc

SEQ ID NO: 1709957 - DNA, 13 bp, Homo sapiens
tacattttagttt

SEQ ID NO: 1709958 - DNA, 11 bp, Homo sapiens
tacattttata

SEQ ID NO: 1709959 - DNA, 22 bp, Homo sapiens
tacattttatatttttgtacat

SEQ ID NO: 1709960 - DNA, 22 bp, Homo sapiens
tacattttgaggttttgtaaaa

SEQ ID NO: 1709961 - DNA, 12 bp, Homo sapiens
tacattttgtat

SEQ ID NO: 1709962 - DNA, 14 bp, Homo sapiens
tacattttgtatat

SEQ ID NO: 1709963 - DNA, 12 bp, Homo sapiens
tacattttgtta

SEQ ID NO: 1709964 - DNA, 16 bp, Homo sapiens
tacatttttaaattct

SEQ ID NO: 1709965 - DNA, 17 bp, Homo sapiens
tacatttttaaattctt

SEQ ID NO: 1709966 - DNA, 16 bp, Homo sapiens
tacattttttgaaatg

SEQ ID NO: 1709967 - DNA, 15 bp, Homo sapiens
taccaaaaaccatgt

SEQ ID NO: 1709968 - DNA, 19 bp, Homo sapiens
taccaaaaaccatgttgcg

SEQ ID NO: 1709969 - DNA, 15 bp, Homo sapiens
taccaaaaataaata

SEQ ID NO: 1709970 - DNA, 23 bp, Homo sapiens
taccaaaattttaaaaaagggag

SEQ ID NO: 1709971 - DNA, 15 bp, Homo sapiens
taccaaacaaggaag

SEQ ID NO: 1709972 - DNA, 18 bp, Homo sapiens
taccaaacaaggaagcca

SEQ ID NO: 1709973 - DNA, 15 bp, Homo sapiens
taccaaagactattt

SEQ ID NO: 1709974 - DNA, 20 bp, Homo sapiens
taccaaagactatttcaaaa

SEQ ID NO: 1709975 - DNA, 17 bp, Homo sapiens
taccaaagtgtcttttg

SEQ ID NO: 1709976 - DNA, 20 bp, Homo sapiens
taccaaagtgtcttttgaca

SEQ ID NO: 1709977 - DNA, 19 bp, Homo sapiens
taccaaattaaaaaaaaat

SEQ ID NO: 1709978 - DNA, 23 bp, Homo sapiens
taccaaattaaaaaaaaattgta

SEQ ID NO: 1709979 - DNA, 15 bp, Homo sapiens
taccaaggatgaatt

SEQ ID NO: 1709980 - DNA, 14 bp, Homo sapiens
taccaagtgaaatt

SEQ ID NO: 1709981 - DNA, 14 bp, Homo sapiens
taccaagttgtgct

SEQ ID NO: 1709982 - DNA, 18 bp, Homo sapiens
taccaatagcctgaattt

SEQ ID NO: 1709983 - DNA, 20 bp, Homo sapiens
taccaatcaacagcatgtct

SEQ ID NO: 1709984 - DNA, 22 bp, Homo sapiens
taccaatcaacagcatgtctac

SEQ ID NO: 1709985 - DNA, 15 bp, Homo sapiens
taccaatcattttaa

SEQ ID NO: 1709986 - DNA, 17 bp, Homo sapiens
taccaatgctgttgtaa

SEQ ID NO: 1709987 - DNA, 16 bp, Homo sapiens
taccacagacttgcac

SEQ ID NO: 1709988 - DNA, 21 bp, Homo sapiens
taccacagacttgcactgaag

SEQ ID NO: 1709989 - DNA, 13 bp, Homo sapiens
taccacagtgtct

SEQ ID NO: 1709990 - DNA, 17 bp, Homo sapiens
taccacatcaaataaga

SEQ ID NO: 1709991 - DNA, 16 bp, Homo sapiens
taccacatctgctcta

SEQ ID NO: 1709992 - DNA, 15 bp, Homo sapiens
taccacatggctttt

SEQ ID NO: 1709993 - DNA, 12 bp, Homo sapiens
catccaggcagt

SEQ ID NO: 1709994 - DNA, 18 bp, Homo sapiens
catccaggccagggctcc

SEQ ID NO: 1709995 - DNA, 15 bp, Homo sapiens
catccagtgggcccg

SEQ ID NO: 1709996 - DNA, 18 bp, Homo sapiens
catccatagtagtatgat

SEQ ID NO: 1709997 - DNA, 13 bp, Homo sapiens
catccatctccag

SEQ ID NO: 1709998 - DNA, 14 bp, Homo sapiens
catccatctccagg

SEQ ID NO: 1709999 - DNA, 22 bp, Homo sapiens
catccatctccagggagcaaga

SEQ ID NO: 1710000 - DNA, 19 bp, Homo sapiens
catccatggggctgattgt

SEQ ID NO: 1710001 - DNA, 19 bp, Homo sapiens
catccattacctccatcca

SEQ ID NO: 1710002 - DNA, 17 bp, Homo sapiens
catcccaacagccaaga

SEQ ID NO: 1710003 - DNA, 18 bp, Homo sapiens
catcccaaccaggcacct

SEQ ID NO: 1710004 - DNA, 14 bp, Homo sapiens
catcccacaccctg

SEQ ID NO: 1710005 - DNA, 18 bp, Homo sapiens
catcccacccccgaccct

SEQ ID NO: 1710006 - DNA, 15 bp, Homo sapiens
catcccactgactgt

SEQ ID NO: 1710007 - DNA, 11 bp, Homo sapiens
catcccactta

SEQ ID NO: 1710008 - DNA, 19 bp, Homo sapiens
catcccacttagccgcacc

SEQ ID NO: 1710009 - DNA, 14 bp, Homo sapiens
catcccaggggacc

SEQ ID NO: 1710010 - DNA, 19 bp, Homo sapiens
catcccaggggaccacacc

SEQ ID NO: 1710011 - DNA, 14 bp, Homo sapiens
catcccagtccctc

SEQ ID NO: 1710012 - DNA, 13 bp, Homo sapiens
catcccattccag

SEQ ID NO: 1710013 - DNA, 22 bp, Homo sapiens
catcccattgctagcaggattg

SEQ ID NO: 1710014 - DNA, 15 bp, Homo sapiens
catccccaactccat

SEQ ID NO: 1710015 - DNA, 12 bp, Homo sapiens
catccccagagc

SEQ ID NO: 1710016 - DNA, 13 bp, Homo sapiens
catccccagagcc

SEQ ID NO: 1710017 - DNA, 17 bp, Homo sapiens
catccccagagcccagc

SEQ ID NO: 1710018 - DNA, 14 bp, Homo sapiens
catccccaggtctc

SEQ ID NO: 1710019 - DNA, 14 bp, Homo sapiens
catcccccaaagtt

SEQ ID NO: 1710020 - DNA, 14 bp, Homo sapiens
catcccccactgcc

SEQ ID NO: 1710021 - DNA, 17 bp, Homo sapiens
catcccccactgccaca

SEQ ID NO: 1710022 - DNA, 20 bp, Homo sapiens
catcccccactgccacaccc

SEQ ID NO: 1710023 - DNA, 18 bp, Homo sapiens
catcccccctgctgccca

SEQ ID NO: 1710024 - DNA, 18 bp, Homo sapiens
catcccctcgtcctgtcc

SEQ ID NO: 1710025 - DNA, 21 bp, Homo sapiens
catcccctcgtcctgtcccag

SEQ ID NO: 1710026 - DNA, 14 bp, Homo sapiens
catcccggcctctt

SEQ ID NO: 1710027 - DNA, 18 bp, Homo sapiens
catcccggcctcttccac

SEQ ID NO: 1710028 - DNA, 16 bp, Homo sapiens
catcccgtatcacagt

SEQ ID NO: 1710029 - DNA, 17 bp, Homo sapiens
catcccgtatcacagtg

SEQ ID NO: 1710030 - DNA, 19 bp, Homo sapiens
catcccgtatcacagtgtt

SEQ ID NO: 1710031 - DNA, 14 bp, Homo sapiens
catcccgtgttctc

SEQ ID NO: 1710032 - DNA, 21 bp, Homo sapiens
catcccgtgttctccttttcc

SEQ ID NO: 1710033 - DNA, 12 bp, Homo sapiens
catccctacccc

SEQ ID NO: 1710034 - DNA, 17 bp, Homo sapiens
catccctcaactgaggg

SEQ ID NO: 1710035 - DNA, 23 bp, Homo sapiens
catccctcaactgagggccaggg

SEQ ID NO: 1710036 - DNA, 13 bp, Homo sapiens
catccctccccag

SEQ ID NO: 1710037 - DNA, 17 bp, Homo sapiens
catccctcccccagcag

SEQ ID NO: 1710038 - DNA, 18 bp, Homo sapiens
catccctcccccagcaga

SEQ ID NO: 1710039 - DNA, 20 bp, Homo sapiens
catccctcgggaagcagcca

SEQ ID NO: 1710040 - DNA, 13 bp, Homo sapiens
catccctgcttct

SEQ ID NO: 1710041 - DNA, 16 bp, Homo sapiens
catccctgcttctggc

SEQ ID NO: 1710042 - DNA, 18 bp, Homo sapiens
catccctggagcaggagc

SEQ ID NO: 1710043 - DNA, 13 bp, Homo sapiens
catccctgtcatt

SEQ ID NO: 1710044 - DNA, 11 bp, Homo sapiens
catcccttcct

SEQ ID NO: 1710045 - DNA, 13 bp, Homo sapiens
catcccttcctgg

SEQ ID NO: 1710046 - DNA, 14 bp, Homo sapiens
catcccttcctgga

SEQ ID NO: 1710047 - DNA, 15 bp, Homo sapiens
catcccttcctggaa

SEQ ID NO: 1710048 - DNA, 21 bp, Homo sapiens
catcccttcctggaaacagca

SEQ ID NO: 1710049 - DNA, 19 bp, Homo sapiens
catcccttcggagccaaca

SEQ ID NO: 1710050 - DNA, 13 bp, Homo sapiens
catccctttccag

SEQ ID NO: 1710051 - DNA, 16 bp, Homo sapiens
catccctttgcccaga

SEQ ID NO: 1710052 - DNA, 13 bp, Homo sapiens
catccgcactgta

SEQ ID NO: 1710053 - DNA, 14 bp, Homo sapiens
catccgcaggtgct

SEQ ID NO: 1710054 - DNA, 16 bp, Homo sapiens
catccgtagttccctg

SEQ ID NO: 1710055 - DNA, 17 bp, Homo sapiens
catccgtagttccctga

SEQ ID NO: 1710056 - DNA, 18 bp, Homo sapiens
catccgtagttccctgaa

SEQ ID NO: 1710057 - DNA, 17 bp, Homo sapiens
catcctaagacagagga

SEQ ID NO: 1710058 - DNA, 13 bp, Homo sapiens
catcctaccctcg

SEQ ID NO: 1710059 - DNA, 19 bp, Homo sapiens
catcctaccctcgggccca

SEQ ID NO: 1710060 - DNA, 14 bp, Homo sapiens
catcctaccctttt

SEQ ID NO: 1710061 - DNA, 17 bp, Homo sapiens
catcctcattgcctcct

SEQ ID NO: 1710062 - DNA, 20 bp, Homo sapiens
catcctcattgcctcctgtt

SEQ ID NO: 1710063 - DNA, 12 bp, Homo sapiens
catcctcctccc

SEQ ID NO: 1710064 - DNA, 14 bp, Homo sapiens
catcctcctcccca

SEQ ID NO: 1710065 - DNA, 18 bp, Homo sapiens
catcctcctccccagctc

SEQ ID NO: 1710066 - DNA, 19 bp, Homo sapiens
catcctcctccccagctct

SEQ ID NO: 1710067 - DNA, 19 bp, Homo sapiens
catcctctaaagcagaggc

SEQ ID NO: 1710068 - DNA, 23 bp, Homo sapiens
catcctcttttaatggcatttct

SEQ ID NO: 1710069 - DNA, 19 bp, Homo sapiens
catcctgaccagctgctcc

SEQ ID NO: 1710070 - DNA, 21 bp, Homo sapiens
catcctgagagacctgccctc

SEQ ID NO: 1710071 - DNA, 14 bp, Homo sapiens
catcctgagccagg

SEQ ID NO: 1710072 - DNA, 14 bp, Homo sapiens
catcctgattattg

SEQ ID NO: 1710073 - DNA, 12 bp, Homo sapiens
catcctgcagcc

SEQ ID NO: 1710074 - DNA, 20 bp, Homo sapiens
catcctgcagcctcctcctg

SEQ ID NO: 1710075 - DNA, 15 bp, Homo sapiens
catcctggcacgccc

SEQ ID NO: 1710076 - DNA, 12 bp, Homo sapiens
catcctggccaa

SEQ ID NO: 1710077 - DNA, 19 bp, Homo sapiens
catcctggcccctccagac

SEQ ID NO: 1710078 - DNA, 18 bp, Homo sapiens
catcctggcctggcacat

SEQ ID NO: 1710079 - DNA, 11 bp, Homo sapiens
catcctggctg

SEQ ID NO: 1710080 - DNA, 12 bp, Homo sapiens
catcctggctgc

SEQ ID NO: 1710081 - DNA, 15 bp, Homo sapiens
catcctggctgcggc

SEQ ID NO: 1710082 - DNA, 15 bp, Homo sapiens
catcctggggcagca

SEQ ID NO: 1710083 - DNA, 17 bp, Homo sapiens
catcctggggcagcact

SEQ ID NO: 1710084 - DNA, 20 bp, Homo sapiens
catcctggggcagcactccc

SEQ ID NO: 1710085 - DNA, 20 bp, Homo sapiens
catcctgtttgtatgaaatt

SEQ ID NO: 1710086 - DNA, 20 bp, Homo sapiens
catccttcaaggtggcagct

SEQ ID NO: 1710087 - DNA, 16 bp, Homo sapiens
catccttcaccagagc

SEQ ID NO: 1710088 - DNA, 22 bp, Homo sapiens
catccttcaccagagcccatgc

SEQ ID NO: 1710089 - DNA, 16 bp, Homo sapiens
catccttcccagcaga

SEQ ID NO: 1710090 - DNA, 14 bp, Homo sapiens
catccttcctgggg

SEQ ID NO: 1710091 - DNA, 16 bp, Homo sapiens
catccttcctggggac

SEQ ID NO: 1710092 - DNA, 14 bp, Homo sapiens
catccttccttccc

SEQ ID NO: 1710093 - DNA, 16 bp, Homo sapiens
catccttgctgcagct

SEQ ID NO: 1710094 - DNA, 15 bp, Homo sapiens
catcctttacgtgtt

SEQ ID NO: 1710095 - DNA, 15 bp, Homo sapiens
catcctttgttctga

SEQ ID NO: 1710096 - DNA, 17 bp, Homo sapiens
catccttttctgcagag

SEQ ID NO: 1710097 - DNA, 21 bp, Homo sapiens
catcgaccacaccagcctcct

SEQ ID NO: 1710098 - DNA, 21 bp, Homo sapiens
catcgattcaaactgctccaa

SEQ ID NO: 1710099 - DNA, 20 bp, Homo sapiens
catcgcaatagttttttact

SEQ ID NO: 1710100 - DNA, 16 bp, Homo sapiens
catcgccatcttcttc

SEQ ID NO: 1710101 - DNA, 19 bp, Homo sapiens
catcgccatcttcttccct

SEQ ID NO: 1710102 - DNA, 16 bp, Homo sapiens
catcggaaaaataatc

SEQ ID NO: 1710103 - DNA, 21 bp, Homo sapiens
catcggacaagacccccagca

SEQ ID NO: 1710104 - DNA, 18 bp, Homo sapiens
catcggagactgccccac

SEQ ID NO: 1710105 - DNA, 20 bp, Homo sapiens
catcggccaagaatacttga

SEQ ID NO: 1710106 - DNA, 20 bp, Homo sapiens
catcgggagcacccagagca

SEQ ID NO: 1710107 - DNA, 14 bp, Homo sapiens
catcgtagaagaga

SEQ ID NO: 1710108 - DNA, 21 bp, Homo sapiens
catcgtagaagagatgtggca

SEQ ID NO: 1710109 - DNA, 21 bp, Homo sapiens
catcgtataacacaatatgaa

SEQ ID NO: 1710110 - DNA, 18 bp, Homo sapiens
catcgtgacccttcaggg

SEQ ID NO: 1710111 - DNA, 16 bp, Homo sapiens
taccacctttactgtg

SEQ ID NO: 1710112 - DNA, 20 bp, Homo sapiens
taccacttgaatttattgat

SEQ ID NO: 1710113 - DNA, 21 bp, Homo sapiens
taccactttcttattctgtat

SEQ ID NO: 1710114 - DNA, 21 bp, Homo sapiens
taccagattctgcctatgtaa

SEQ ID NO: 1710115 - DNA, 16 bp, Homo sapiens
taccagcaaagcaaat

SEQ ID NO: 1710116 - DNA, 21 bp, Homo sapiens
taccagcaagaataaaaaaga

SEQ ID NO: 1710117 - DNA, 21 bp, Homo sapiens
taccagcgccaaatgttcatc

SEQ ID NO: 1710118 - DNA, 17 bp, Homo sapiens
taccagcgcccgctggg

SEQ ID NO: 1710119 - DNA, 18 bp, Homo sapiens
taccagcgcccgctgggc

SEQ ID NO: 1710120 - DNA, 20 bp, Homo sapiens
taccagcgcccgctgggctg

SEQ ID NO: 1710121 - DNA, 16 bp, Homo sapiens
taccaggatgctaaag

SEQ ID NO: 1710122 - DNA, 20 bp, Homo sapiens
taccaggcaacctcccatcc

SEQ ID NO: 1710123 - DNA, 21 bp, Homo sapiens
taccaggcaacctcccatccc

SEQ ID NO: 1710124 - DNA, 15 bp, Homo sapiens
taccaggttgaaaga

SEQ ID NO: 1710125 - DNA, 16 bp, Homo sapiens
taccaggttgaaagac

SEQ ID NO: 1710126 - DNA, 13 bp, Homo sapiens
taccagtctattt

SEQ ID NO: 1710127 - DNA, 22 bp, Homo sapiens
taccagtctatttccactgaac

SEQ ID NO: 1710128 - DNA, 15 bp, Homo sapiens
taccagtgagtggcc

SEQ ID NO: 1710129 - DNA, 17 bp, Homo sapiens
taccagtgagtggcccc

SEQ ID NO: 1710130 - DNA, 17 bp, Homo sapiens
taccagtgttgggtttt

SEQ ID NO: 1710131 - DNA, 17 bp, Homo sapiens
catctagcctaaagtat

SEQ ID NO: 1710132 - DNA, 14 bp, Homo sapiens
catctataaattgt

SEQ ID NO: 1710133 - DNA, 19 bp, Homo sapiens
catctatcgagtttgcaat

SEQ ID NO: 1710134 - DNA, 17 bp, Homo sapiens
catctatctagttctaa

SEQ ID NO: 1710135 - DNA, 22 bp, Homo sapiens
catctatggcagtccagccagc

SEQ ID NO: 1710136 - DNA, 19 bp, Homo sapiens
catctatgtcccttgctgt

SEQ ID NO: 1710137 - DNA, 19 bp, Homo sapiens
catctattgcagagactca

SEQ ID NO: 1710138 - DNA, 13 bp, Homo sapiens
catctcaaaaaaa

SEQ ID NO: 1710139 - DNA, 16 bp, Homo sapiens
catctcaaaacaaaac

SEQ ID NO: 1710140 - DNA, 16 bp, Homo sapiens
catctcaaaacagagg

SEQ ID NO: 1710141 - DNA, 20 bp, Homo sapiens
catctcaaaacagagggctg

SEQ ID NO: 1710142 - DNA, 21 bp, Homo sapiens
catctcaaaacagagggctgc

SEQ ID NO: 1710143 - DNA, 22 bp, Homo sapiens
catctcaaaacagagggctgca

SEQ ID NO: 1710144 - DNA, 14 bp, Homo sapiens
catctcaaaattat

SEQ ID NO: 1710145 - DNA, 19 bp, Homo sapiens
catctcactggatgcaaag

SEQ ID NO: 1710146 - DNA, 20 bp, Homo sapiens
catctcagcctaccatgaga

SEQ ID NO: 1710147 - DNA, 23 bp, Homo sapiens
catctcaggagatggagggcttg

SEQ ID NO: 1710148 - DNA, 19 bp, Homo sapiens
catctcagggtccagaccc

SEQ ID NO: 1710149 - DNA, 12 bp, Homo sapiens
catctcaggtgc

SEQ ID NO: 1710150 - DNA, 14 bp, Homo sapiens
catctcaggtgcca

SEQ ID NO: 1710151 - DNA, 15 bp, Homo sapiens
catctcaggtgccac

SEQ ID NO: 1710152 - DNA, 17 bp, Homo sapiens
catctcaggtgccactc

SEQ ID NO: 1710153 - DNA, 21 bp, Homo sapiens
catctcaggtgccactccctg

SEQ ID NO: 1710154 - DNA, 12 bp, Homo sapiens
catctcatcctg

SEQ ID NO: 1710155 - DNA, 21 bp, Homo sapiens
catctcatttgtattccattg

SEQ ID NO: 1710156 - DNA, 14 bp, Homo sapiens
catctccagggagt

SEQ ID NO: 1710157 - DNA, 17 bp, Homo sapiens
catctccagggagtccc

SEQ ID NO: 1710158 - DNA, 21 bp, Homo sapiens
catctccccaggcctccagcc

SEQ ID NO: 1710159 - DNA, 20 bp, Homo sapiens
catctcccctagctcaccag

SEQ ID NO: 1710160 - DNA, 21 bp, Homo sapiens
catctcccctagctcaccagg

SEQ ID NO: 1710161 - DNA, 16 bp, Homo sapiens
catctcccctcctggc

SEQ ID NO: 1710162 - DNA, 17 bp, Homo sapiens
catctccctgcctggcc

SEQ ID NO: 1710163 - DNA, 19 bp, Homo sapiens
catctccctgcctggcccc

SEQ ID NO: 1710164 - DNA, 19 bp, Homo sapiens
catctccgcctccacactg

SEQ ID NO: 1710165 - DNA, 14 bp, Homo sapiens
catctcctgtcctg

SEQ ID NO: 1710166 - DNA, 15 bp, Homo sapiens
catctccttccccca

SEQ ID NO: 1710167 - DNA, 19 bp, Homo sapiens
catctccttcccccagccc

SEQ ID NO: 1710168 - DNA, 21 bp, Homo sapiens
catctccttcccccagcccaa

SEQ ID NO: 1710169 - DNA, 23 bp, Homo sapiens
catctccttcccccagcccaata

SEQ ID NO: 1710170 - DNA, 19 bp, Homo sapiens
catctcgagccccctggat

SEQ ID NO: 1710171 - DNA, 23 bp, Homo sapiens
catctctccctcccctgccattt

SEQ ID NO: 1710172 - DNA, 16 bp, Homo sapiens
catctctctacctcca

SEQ ID NO: 1710173 - DNA, 17 bp, Homo sapiens
catctctctacctccac

SEQ ID NO: 1710174 - DNA, 22 bp, Homo sapiens
catctctctactcctacctcag

SEQ ID NO: 1710175 - DNA, 17 bp, Homo sapiens
catctctctactgctgg

SEQ ID NO: 1710176 - DNA, 13 bp, Homo sapiens
catctctctgccc

SEQ ID NO: 1710177 - DNA, 15 bp, Homo sapiens
catctctctgcccaa

SEQ ID NO: 1710178 - DNA, 16 bp, Homo sapiens
catctctctgcccaac

SEQ ID NO: 1710179 - DNA, 14 bp, Homo sapiens
catctctctgcccc

SEQ ID NO: 1710180 - DNA, 21 bp, Homo sapiens
catctctctgccccacataat

SEQ ID NO: 1710181 - DNA, 12 bp, Homo sapiens
catctctgcagt

SEQ ID NO: 1710182 - DNA, 22 bp, Homo sapiens
catctctgcagtttttcccaag

SEQ ID NO: 1710183 - DNA, 12 bp, Homo sapiens
catctctgcctg

SEQ ID NO: 1710184 - DNA, 13 bp, Homo sapiens
catctctgcctgt

SEQ ID NO: 1710185 - DNA, 13 bp, Homo sapiens
catctctgcttgg

SEQ ID NO: 1710186 - DNA, 23 bp, Homo sapiens
catctctgttcttttcccgcctc

SEQ ID NO: 1710187 - DNA, 18 bp, Homo sapiens
catctcttagctcccctc

SEQ ID NO: 1710188 - DNA, 10 bp, Homo sapiens
catctcttca

SEQ ID NO: 1710189 - DNA, 23 bp, Homo sapiens
catctcttcctacccaaccactc

SEQ ID NO: 1710190 - DNA, 15 bp, Homo sapiens
catctcttgaggcca

SEQ ID NO: 1710191 - DNA, 14 bp, Homo sapiens
catctctttaaaaa

SEQ ID NO: 1710192 - DNA, 17 bp, Homo sapiens
catctctttaaaaacaa

SEQ ID NO: 1710193 - DNA, 12 bp, Homo sapiens
catctgaaaaga

SEQ ID NO: 1710194 - DNA, 15 bp, Homo sapiens
catctgaaaagcagt

SEQ ID NO: 1710195 - DNA, 15 bp, Homo sapiens
catctgaatcccggg

SEQ ID NO: 1710196 - DNA, 18 bp, Homo sapiens
catctgaccatctgtgac

SEQ ID NO: 1710197 - DNA, 12 bp, Homo sapiens
catctgactgcc

SEQ ID NO: 1710198 - DNA, 20 bp, Homo sapiens
catctgactgccaagccaga

SEQ ID NO: 1710199 - DNA, 18 bp, Homo sapiens
catctgagaaggccctgt

SEQ ID NO: 1710200 - DNA, 13 bp, Homo sapiens
catctgagaggct

SEQ ID NO: 1710201 - DNA, 11 bp, Homo sapiens
catctgaggag

SEQ ID NO: 1710202 - DNA, 11 bp, Homo sapiens
catctgattta

SEQ ID NO: 1710203 - DNA, 17 bp, Homo sapiens
catctgcaccccttctc

SEQ ID NO: 1710204 - DNA, 23 bp, Homo sapiens
catctgcaccctcgatgaagccc

SEQ ID NO: 1710205 - DNA, 11 bp, Homo sapiens
catctgcccag

SEQ ID NO: 1710206 - DNA, 13 bp, Homo sapiens
catctgcccaggg

SEQ ID NO: 1710207 - DNA, 15 bp, Homo sapiens
catctgcccaggggt

SEQ ID NO: 1710208 - DNA, 16 bp, Homo sapiens
catctgcccaggggtg

SEQ ID NO: 1710209 - DNA, 11 bp, Homo sapiens
catctgcccct

SEQ ID NO: 1710210 - DNA, 18 bp, Homo sapiens
catctgcccctcccccaa

SEQ ID NO: 1710211 - DNA, 20 bp, Homo sapiens
catctgccttaaaaccaaag

SEQ ID NO: 1710212 - DNA, 22 bp, Homo sapiens
catctgctctagattcataaat

SEQ ID NO: 1710213 - DNA, 14 bp, Homo sapiens
catctgctctaggg

SEQ ID NO: 1710214 - DNA, 13 bp, Homo sapiens
catctgctctcct

SEQ ID NO: 1710215 - DNA, 13 bp, Homo sapiens
catctgctgcccc

SEQ ID NO: 1710216 - DNA, 15 bp, Homo sapiens
catctggaaaggggg

SEQ ID NO: 1710217 - DNA, 11 bp, Homo sapiens
catctggatgt

SEQ ID NO: 1710218 - DNA, 12 bp, Homo sapiens
catctggccctg

SEQ ID NO: 1710219 - DNA, 14 bp, Homo sapiens
catctggcggaggt

SEQ ID NO: 1710220 - DNA, 18 bp, Homo sapiens
catctggcggaggtctct

SEQ ID NO: 1710221 - DNA, 20 bp, Homo sapiens
catctggcggaggtctctgg

SEQ ID NO: 1710222 - DNA, 16 bp, Homo sapiens
catctggctgtctaga

SEQ ID NO: 1710223 - DNA, 22 bp, Homo sapiens
catctggctgtctagaatgtgg

SEQ ID NO: 1710224 - DNA, 20 bp, Homo sapiens
catctggctttttctgccac

SEQ ID NO: 1710225 - DNA, 18 bp, Homo sapiens
catctgggagtccccttt

SEQ ID NO: 1710226 - DNA, 21 bp, Homo sapiens
catctggggcccatactggtt

SEQ ID NO: 1710227 - DNA, 14 bp, Homo sapiens
catctgggtgccct

SEQ ID NO: 1710228 - DNA, 19 bp, Homo sapiens
catctgggtgccctgaaag

SEQ ID NO: 1710229 - DNA, 15 bp, Homo sapiens
tacctaattgtggat

SEQ ID NO: 1710230 - DNA, 16 bp, Homo sapiens
tacctaccacagtgtc

SEQ ID NO: 1710231 - DNA, 18 bp, Homo sapiens
tacctaccacagtgtctg

SEQ ID NO: 1710232 - DNA, 21 bp, Homo sapiens
tacctactttgactttttgca

SEQ ID NO: 1710233 - DNA, 22 bp, Homo sapiens
tacctagaagtaagaagaggag

SEQ ID NO: 1710234 - DNA, 13 bp, Homo sapiens
tacctagatttac

SEQ ID NO: 1710235 - DNA, 13 bp, Homo sapiens
tacctatccacaa

SEQ ID NO: 1710236 - DNA, 21 bp, Homo sapiens
tacctatggaagtggttctat

SEQ ID NO: 1710237 - DNA, 18 bp, Homo sapiens
tacctcaaagggcagttt

SEQ ID NO: 1710238 - DNA, 11 bp, Homo sapiens
tacctcagcct

SEQ ID NO: 1710239 - DNA, 12 bp, Homo sapiens
tacctcagccta

SEQ ID NO: 1710240 - DNA, 14 bp, Homo sapiens
tacctcagcctaga

SEQ ID NO: 1710241 - DNA, 16 bp, Homo sapiens
tacctcagcctagacc

SEQ ID NO: 1710242 - DNA, 15 bp, Homo sapiens
tacctcaggcaggaa

SEQ ID NO: 1710243 - DNA, 15 bp, Homo sapiens
tacctccaagcaagt

SEQ ID NO: 1710244 - DNA, 20 bp, Homo sapiens
tacctccatccatccttcca

SEQ ID NO: 1710245 - DNA, 21 bp, Homo sapiens
tacctccatccatccttccaa

SEQ ID NO: 1710246 - DNA, 17 bp, Homo sapiens
tacctcccacactccca

SEQ ID NO: 1710247 - DNA, 17 bp, Homo sapiens
catcttcctgctgctgt

SEQ ID NO: 1710248 - DNA, 18 bp, Homo sapiens
catcttcctgctgctgta

SEQ ID NO: 1710249 - DNA, 12 bp, Homo sapiens
catcttcctgtg

SEQ ID NO: 1710250 - DNA, 14 bp, Homo sapiens
catcttctccatct

SEQ ID NO: 1710251 - DNA, 16 bp, Homo sapiens
catcttctccatctgg

SEQ ID NO: 1710252 - DNA, 17 bp, Homo sapiens
catcttctccatctggc

SEQ ID NO: 1710253 - DNA, 18 bp, Homo sapiens
catcttctccccgaggct

SEQ ID NO: 1710254 - DNA, 21 bp, Homo sapiens
catcttctccccgaggctgcc

SEQ ID NO: 1710255 - DNA, 14 bp, Homo sapiens
catcttctgaagag

SEQ ID NO: 1710256 - DNA, 13 bp, Homo sapiens
catcttctggaat

SEQ ID NO: 1710257 - DNA, 12 bp, Homo sapiens
catcttctggag

SEQ ID NO: 1710258 - DNA, 17 bp, Homo sapiens
catcttgaatccttcca

SEQ ID NO: 1710259 - DNA, 23 bp, Homo sapiens
catcttgaatccttccattccac

SEQ ID NO: 1710260 - DNA, 21 bp, Homo sapiens
catcttgagccacagtcactg

SEQ ID NO: 1710261 - DNA, 14 bp, Homo sapiens
catcttgcagcatt

SEQ ID NO: 1710262 - DNA, 15 bp, Homo sapiens
catcttgcagcattt

SEQ ID NO: 1710263 - DNA, 18 bp, Homo sapiens
catcttgcagcatttact

SEQ ID NO: 1710264 - DNA, 19 bp, Homo sapiens
catcttgccaagggtccct

SEQ ID NO: 1710265 - DNA, 15 bp, Homo sapiens
catcttgcctccagg

SEQ ID NO: 1710266 - DNA, 19 bp, Homo sapiens
catcttgcctccaggtgca

SEQ ID NO: 1710267 - DNA, 22 bp, Homo sapiens
catcttgctaccagtatttaga

SEQ ID NO: 1710268 - DNA, 13 bp, Homo sapiens
catcttgcttccc

SEQ ID NO: 1710269 - DNA, 14 bp, Homo sapiens
catcttgcttccct

SEQ ID NO: 1710270 - DNA, 14 bp, Homo sapiens
catcttggcagggt

SEQ ID NO: 1710271 - DNA, 15 bp, Homo sapiens
catcttgtgagtgga

SEQ ID NO: 1710272 - DNA, 13 bp, Homo sapiens
catcttgtggggc

SEQ ID NO: 1710273 - DNA, 20 bp, Homo sapiens
catcttgtggggccaggacc

SEQ ID NO: 1710274 - DNA, 15 bp, Homo sapiens
catcttgtgttttat

SEQ ID NO: 1710275 - DNA, 12 bp, Homo sapiens
catctttaacat

SEQ ID NO: 1710276 - DNA, 20 bp, Homo sapiens
catctttaacatagtcctgt

SEQ ID NO: 1710277 - DNA, 21 bp, Homo sapiens
catctttattgaaattctatt

SEQ ID NO: 1710278 - DNA, 21 bp, Homo sapiens
catctttcttctattttattc

SEQ ID NO: 1710279 - DNA, 17 bp, Homo sapiens
catctttgatccttctg

SEQ ID NO: 1710280 - DNA, 18 bp, Homo sapiens
catcttttattttggaac

SEQ ID NO: 1710281 - DNA, 14 bp, Homo sapiens
catcttttcttgcc

SEQ ID NO: 1710282 - DNA, 19 bp, Homo sapiens
catcttttgtattaagaaa

SEQ ID NO: 1710283 - DNA, 14 bp, Homo sapiens
catctttttctttt

SEQ ID NO: 1710284 - DNA, 13 bp, Homo sapiens
catgaaaaagcag

SEQ ID NO: 1710285 - DNA, 15 bp, Homo sapiens
catgaaaaagctgct

SEQ ID NO: 1710286 - DNA, 23 bp, Homo sapiens
catgaaacggaggcagatggaga

SEQ ID NO: 1710287 - DNA, 14 bp, Homo sapiens
catgaaatatgcat

SEQ ID NO: 1710288 - DNA, 16 bp, Homo sapiens
catgaaatgtgaattt

SEQ ID NO: 1710289 - DNA, 19 bp, Homo sapiens
catgaaatgtgaattttta

SEQ ID NO: 1710290 - DNA, 14 bp, Homo sapiens
catgaacaaattct

SEQ ID NO: 1710291 - DNA, 13 bp, Homo sapiens
catgaacagcttg

SEQ ID NO: 1710292 - DNA, 14 bp, Homo sapiens
catgaacagcttgc

SEQ ID NO: 1710293 - DNA, 19 bp, Homo sapiens
catgaactggcttgtacat

SEQ ID NO: 1710294 - DNA, 14 bp, Homo sapiens
catgaactgtacta

SEQ ID NO: 1710295 - DNA, 14 bp, Homo sapiens
catgaacttgatac

SEQ ID NO: 1710296 - DNA, 15 bp, Homo sapiens
catgaagacaggaca

SEQ ID NO: 1710297 - DNA, 16 bp, Homo sapiens
catgaagctaataaaa

SEQ ID NO: 1710298 - DNA, 22 bp, Homo sapiens
catgaaggtaaataaaaagaaa

SEQ ID NO: 1710299 - DNA, 18 bp, Homo sapiens
catgaagtaaattatgta

SEQ ID NO: 1710300 - DNA, 13 bp, Homo sapiens
catgaataaaaca

SEQ ID NO: 1710301 - DNA, 14 bp, Homo sapiens
catgaataaaacac

SEQ ID NO: 1710302 - DNA, 20 bp, Homo sapiens
catgaatcactgtgctcagc

SEQ ID NO: 1710303 - DNA, 16 bp, Homo sapiens
catgaatgcacactag

SEQ ID NO: 1710304 - DNA, 13 bp, Homo sapiens
catgaatgctttt

SEQ ID NO: 1710305 - DNA, 13 bp, Homo sapiens
catgaatgtaaat

SEQ ID NO: 1710306 - DNA, 20 bp, Homo sapiens
catgaattactgtatataaa

SEQ ID NO: 1710307 - DNA, 21 bp, Homo sapiens
catgaattatataattttcca

SEQ ID NO: 1710308 - DNA, 18 bp, Homo sapiens
catgaattcccttttaat

SEQ ID NO: 1710309 - DNA, 17 bp, Homo sapiens
catgaattttaaagtat

SEQ ID NO: 1710310 - DNA, 17 bp, Homo sapiens
catgacaagatgggaca

SEQ ID NO: 1710311 - DNA, 23 bp, Homo sapiens
catgacaagatgggacagcaaca

SEQ ID NO: 1710312 - DNA, 12 bp, Homo sapiens
catgacactgac

SEQ ID NO: 1710313 - DNA, 13 bp, Homo sapiens
catgacactgacc

SEQ ID NO: 1710314 - DNA, 15 bp, Homo sapiens
catgacactgacctt

SEQ ID NO: 1710315 - DNA, 16 bp, Homo sapiens
catgacacttccaaag

SEQ ID NO: 1710316 - DNA, 14 bp, Homo sapiens
catgacagaaaata

SEQ ID NO: 1710317 - DNA, 19 bp, Homo sapiens
catgacagaaaatatgtat

SEQ ID NO: 1710318 - DNA, 12 bp, Homo sapiens
catgacagccag

SEQ ID NO: 1710319 - DNA, 14 bp, Homo sapiens
catgacagccagag

SEQ ID NO: 1710320 - DNA, 18 bp, Homo sapiens
catgacatatgacttgat

SEQ ID NO: 1710321 - DNA, 15 bp, Homo sapiens
catgaccagcaaata

SEQ ID NO: 1710322 - DNA, 17 bp, Homo sapiens
catgacccacccctgtg

SEQ ID NO: 1710323 - DNA, 15 bp, Homo sapiens
catgacccagcctga

SEQ ID NO: 1710324 - DNA, 12 bp, Homo sapiens
catgacctccat

SEQ ID NO: 1710325 - DNA, 14 bp, Homo sapiens
catgacctgtgacc

SEQ ID NO: 1710326 - DNA, 16 bp, Homo sapiens
catgacctgtgaccag

SEQ ID NO: 1710327 - DNA, 16 bp, Homo sapiens
catgactaatgctttt

SEQ ID NO: 1710328 - DNA, 18 bp, Homo sapiens
catgactcttgactcttg

SEQ ID NO: 1710329 - DNA, 18 bp, Homo sapiens
catgactggctgtctgcc

SEQ ID NO: 1710330 - DNA, 21 bp, Homo sapiens
catgactggctgtctgcctgt

SEQ ID NO: 1710331 - DNA, 12 bp, Homo sapiens
catgagaatcta

SEQ ID NO: 1710332 - DNA, 19 bp, Homo sapiens
catgagaccactgttatca

SEQ ID NO: 1710333 - DNA, 15 bp, Homo sapiens
catgagactttctgc

SEQ ID NO: 1710334 - DNA, 12 bp, Homo sapiens
catgagatgtgt

SEQ ID NO: 1710335 - DNA, 20 bp, Homo sapiens
catgagccactgagcctggc

SEQ ID NO: 1710336 - DNA, 12 bp, Homo sapiens
catgagcctgct

SEQ ID NO: 1710337 - DNA, 14 bp, Homo sapiens
catgagcctgctgg

SEQ ID NO: 1710338 - DNA, 22 bp, Homo sapiens
catgagcctgctggaagcccag

SEQ ID NO: 1710339 - DNA, 21 bp, Homo sapiens
catgagctggcaaccagccag

SEQ ID NO: 1710340 - DNA, 22 bp, Homo sapiens
catgagctggcaaccagccagc

SEQ ID NO: 1710341 - DNA, 23 bp, Homo sapiens
catgagctgggtactgactgaga

SEQ ID NO: 1710342 - DNA, 18 bp, Homo sapiens
catgaggaactgtagatg

SEQ ID NO: 1710343 - DNA, 13 bp, Homo sapiens
catgaggacagaa

SEQ ID NO: 1710344 - DNA, 20 bp, Homo sapiens
catgaggacatgatggagcg

SEQ ID NO: 1710345 - DNA, 21 bp, Homo sapiens
catgaggacatgatggagcgc

SEQ ID NO: 1710346 - DNA, 20 bp, Homo sapiens
catgaggagggtgggggagg

SEQ ID NO: 1710347 - DNA, 23 bp, Homo sapiens
catgaggcaatgtcaggaacaga

SEQ ID NO: 1710348 - DNA, 20 bp, Homo sapiens
catgagggatcacagggccc

SEQ ID NO: 1710349 - DNA, 19 bp, Homo sapiens
tactagttacacatcttca

SEQ ID NO: 1710350 - DNA, 19 bp, Homo sapiens
tactagttttagttttctc

SEQ ID NO: 1710351 - DNA, 14 bp, Homo sapiens
tactataagtagtt

SEQ ID NO: 1710352 - DNA, 14 bp, Homo sapiens
tactatatttgtga

SEQ ID NO: 1710353 - DNA, 17 bp, Homo sapiens
tactatccagttactgc

SEQ ID NO: 1710354 - DNA, 15 bp, Homo sapiens
tactatccatttctt

SEQ ID NO: 1710355 - DNA, 22 bp, Homo sapiens
tactatgatctcaggagcttgc

SEQ ID NO: 1710356 - DNA, 12 bp, Homo sapiens
tactatgcacaa

SEQ ID NO: 1710357 - DNA, 13 bp, Homo sapiens
tactatgtatcaa

SEQ ID NO: 1710358 - DNA, 16 bp, Homo sapiens
tactatgtatcaatga

SEQ ID NO: 1710359 - DNA, 17 bp, Homo sapiens
tactattaagcagtaaa

SEQ ID NO: 1710360 - DNA, 12 bp, Homo sapiens
tactatttaaag

SEQ ID NO: 1710361 - DNA, 22 bp, Homo sapiens
tactatttaaagcctcctcatc

SEQ ID NO: 1710362 - DNA, 16 bp, Homo sapiens
tactatttaactgact

SEQ ID NO: 1710363 - DNA, 19 bp, Homo sapiens
catgatggcaacagatctg

SEQ ID NO: 1710364 - DNA, 20 bp, Homo sapiens
catgatggcaacagatctgg

SEQ ID NO: 1710365 - DNA, 12 bp, Homo sapiens
catgatgggaaa

SEQ ID NO: 1710366 - DNA, 22 bp, Homo sapiens
catgatgggaaaatatttcctg

SEQ ID NO: 1710367 - DNA, 22 bp, Homo sapiens
catgatgggaatagggagacag

SEQ ID NO: 1710368 - DNA, 22 bp, Homo sapiens
catgatgtgaagagtttcacaa

SEQ ID NO: 1710369 - DNA, 22 bp, Homo sapiens
catgatgttaaccagaataaag

SEQ ID NO: 1710370 - DNA, 12 bp, Homo sapiens
catgatgtttgc

SEQ ID NO: 1710371 - DNA, 12 bp, Homo sapiens
catgattagcaa

SEQ ID NO: 1710372 - DNA, 20 bp, Homo sapiens
catgattgcagaattgttta

SEQ ID NO: 1710373 - DNA, 16 bp, Homo sapiens
catgatttacagagaa

SEQ ID NO: 1710374 - DNA, 14 bp, Homo sapiens
catgcaaacaggtt

SEQ ID NO: 1710375 - DNA, 16 bp, Homo sapiens
catgcaaatgagctct

SEQ ID NO: 1710376 - DNA, 20 bp, Homo sapiens
catgcaaatgagctctgaaa

SEQ ID NO: 1710377 - DNA, 14 bp, Homo sapiens
catgcaaatgctgt

SEQ ID NO: 1710378 - DNA, 22 bp, Homo sapiens
catgcaaatgctgtattcttct

SEQ ID NO: 1710379 - DNA, 16 bp, Homo sapiens
catgcaacagaagtga

SEQ ID NO: 1710380 - DNA, 21 bp, Homo sapiens
catgcaacagaagtgacttct

SEQ ID NO: 1710381 - DNA, 15 bp, Homo sapiens
catgcaactggagtt

SEQ ID NO: 1710382 - DNA, 15 bp, Homo sapiens
catgcaagagtttct

SEQ ID NO: 1710383 - DNA, 15 bp, Homo sapiens
catgcaagcagagga

SEQ ID NO: 1710384 - DNA, 14 bp, Homo sapiens
catgcaataaaatt

SEQ ID NO: 1710385 - DNA, 15 bp, Homo sapiens
catgcaataaaattt

SEQ ID NO: 1710386 - DNA, 21 bp, Homo sapiens
catgcaatgaaaaatacttta

SEQ ID NO: 1710387 - DNA, 16 bp, Homo sapiens
catgcaatttgaagta

SEQ ID NO: 1710388 - DNA, 19 bp, Homo sapiens
catgcacacggctggtcac

SEQ ID NO: 1710389 - DNA, 20 bp, Homo sapiens
catgcacacggctggtcact

SEQ ID NO: 1710390 - DNA, 21 bp, Homo sapiens
catgcacacggctggtcactc

SEQ ID NO: 1710391 - DNA, 14 bp, Homo sapiens
catgcacagctgct

SEQ ID NO: 1710392 - DNA, 15 bp, Homo sapiens
catgcacagtacaat

SEQ ID NO: 1710393 - DNA, 19 bp, Homo sapiens
catgcacagtatttgtaat

SEQ ID NO: 1710394 - DNA, 21 bp, Homo sapiens
catgcacatgctgtctggccc

SEQ ID NO: 1710395 - DNA, 22 bp, Homo sapiens
catgcacatgctgtctggccct

SEQ ID NO: 1710396 - DNA, 17 bp, Homo sapiens
catgcacattttgtaca

SEQ ID NO: 1710397 - DNA, 16 bp, Homo sapiens
catgcacgggcatgca

SEQ ID NO: 1710398 - DNA, 21 bp, Homo sapiens
catgcacgggcatgcacacgg

SEQ ID NO: 1710399 - DNA, 14 bp, Homo sapiens
catgcactgaccct

SEQ ID NO: 1710400 - DNA, 19 bp, Homo sapiens
catgcactgacccttccag

SEQ ID NO: 1710401 - DNA, 20 bp, Homo sapiens
catgcactgacccttccaga

SEQ ID NO: 1710402 - DNA, 15 bp, Homo sapiens
catgcactgatgttg

SEQ ID NO: 1710403 - DNA, 20 bp, Homo sapiens
catgcactgatgttgtgttt

SEQ ID NO: 1710404 - DNA, 13 bp, Homo sapiens
catgcactgtgaa

SEQ ID NO: 1710405 - DNA, 18 bp, Homo sapiens
catgcactgtgaaggacc

SEQ ID NO: 1710406 - DNA, 22 bp, Homo sapiens
catgcactgtgaaggacccttg

SEQ ID NO: 1710407 - DNA, 14 bp, Homo sapiens
catgcagaaagcat

SEQ ID NO: 1710408 - DNA, 22 bp, Homo sapiens
catgcagacctcatgcccagct

SEQ ID NO: 1710409 - DNA, 18 bp, Homo sapiens
catgcagactcctcagat

SEQ ID NO: 1710410 - DNA, 19 bp, Homo sapiens
catgcagccacttaggaca

SEQ ID NO: 1710411 - DNA, 16 bp, Homo sapiens
catgcagcccatgccc

SEQ ID NO: 1710412 - DNA, 19 bp, Homo sapiens
catgcagcccatgcccacc

SEQ ID NO: 1710413 - DNA, 20 bp, Homo sapiens
catgcagcccatgcccacct

SEQ ID NO: 1710414 - DNA, 23 bp, Homo sapiens
catgcagcccatgcccacctgcc

SEQ ID NO: 1710415 - DNA, 12 bp, Homo sapiens
catgcagccttg

SEQ ID NO: 1710416 - DNA, 19 bp, Homo sapiens
catgcagccttggggcatt

SEQ ID NO: 1710417 - DNA, 14 bp, Homo sapiens
catgcagctgctcc

SEQ ID NO: 1710418 - DNA, 16 bp, Homo sapiens
catgcagctgctcccc

SEQ ID NO: 1710419 - DNA, 23 bp, Homo sapiens
catgcagctgctccccaggccac

SEQ ID NO: 1710420 - DNA, 16 bp, Homo sapiens
catgcaggaagaggcc

SEQ ID NO: 1710421 - DNA, 14 bp, Homo sapiens
catgcaggaggtgg

SEQ ID NO: 1710422 - DNA, 22 bp, Homo sapiens
catgcaggccttaactttccca

SEQ ID NO: 1710423 - DNA, 21 bp, Homo sapiens
catgcaggtggtgggacactg

SEQ ID NO: 1710424 - DNA, 9 bp, Homo sapiens
catgcagtt

SEQ ID NO: 1710425 - DNA, 14 bp, Homo sapiens
catgcagttcctgg

SEQ ID NO: 1710426 - DNA, 16 bp, Homo sapiens
catgcatggaggactc

SEQ ID NO: 1710427 - DNA, 20 bp, Homo sapiens
catgcatggaggactctcct

SEQ ID NO: 1710428 - DNA, 16 bp, Homo sapiens
catgcatgtcctgtaa

SEQ ID NO: 1710429 - DNA, 21 bp, Homo sapiens
catgcatgtcctgtaaaggtt

SEQ ID NO: 1710430 - DNA, 21 bp, Homo sapiens
catgccacaaggacttcctgt

SEQ ID NO: 1710431 - DNA, 17 bp, Homo sapiens
catgccaccacccaccc

SEQ ID NO: 1710432 - DNA, 22 bp, Homo sapiens
catgccacgccccgtgtctgga

SEQ ID NO: 1710433 - DNA, 16 bp, Homo sapiens
catgccactgccaggc

SEQ ID NO: 1710434 - DNA, 17 bp, Homo sapiens
catgccactgccaggca

SEQ ID NO: 1710435 - DNA, 19 bp, Homo sapiens
catgccactgccaggcacc

SEQ ID NO: 1710436 - DNA, 21 bp, Homo sapiens
catgccactgccaggcacctg

SEQ ID NO: 1710437 - DNA, 16 bp, Homo sapiens
catgccagacccactg

SEQ ID NO: 1710438 - DNA, 19 bp, Homo sapiens
catgccaggaacctgtcct

SEQ ID NO: 1710439 - DNA, 21 bp, Homo sapiens
catgccaggacccgccagccc

SEQ ID NO: 1710440 - DNA, 14 bp, Homo sapiens
catgccagtatttt

SEQ ID NO: 1710441 - DNA, 15 bp, Homo sapiens
catgccatgtctgag

SEQ ID NO: 1710442 - DNA, 13 bp, Homo sapiens
catgcccaccccc

SEQ ID NO: 1710443 - DNA, 16 bp, Homo sapiens
catgcccaccccctgc

SEQ ID NO: 1710444 - DNA, 20 bp, Homo sapiens
catgcccaccccctgccctg

SEQ ID NO: 1710445 - DNA, 22 bp, Homo sapiens
catgcccaccccctgccctgca

SEQ ID NO: 1710446 - DNA, 23 bp, Homo sapiens
catgcccaccccctgccctgcac

SEQ ID NO: 1710447 - DNA, 14 bp, Homo sapiens
catgcccacctgcc

SEQ ID NO: 1710448 - DNA, 16 bp, Homo sapiens
catgcccacctgccca

SEQ ID NO: 1710449 - DNA, 17 bp, Homo sapiens
catgcccacctgcccat

SEQ ID NO: 1710450 - DNA, 17 bp, Homo sapiens
catgcccagctctctga

SEQ ID NO: 1710451 - DNA, 13 bp, Homo sapiens
catgccccaggct

SEQ ID NO: 1710452 - DNA, 22 bp, Homo sapiens
catgccccagtcggccccatct

SEQ ID NO: 1710453 - DNA, 19 bp, Homo sapiens
catgcccccctcaaacctc

SEQ ID NO: 1710454 - DNA, 21 bp, Homo sapiens
catgcccccctcaaacctcct

SEQ ID NO: 1710455 - DNA, 11 bp, Homo sapiens
catgccccctg

SEQ ID NO: 1710456 - DNA, 15 bp, Homo sapiens
catgcccctcccctc

SEQ ID NO: 1710457 - DNA, 16 bp, Homo sapiens
catgcccctcccctcc

SEQ ID NO: 1710458 - DNA, 17 bp, Homo sapiens
catgcccctcccctccc

SEQ ID NO: 1710459 - DNA, 19 bp, Homo sapiens
catgcccctcccctccccg

SEQ ID NO: 1710460 - DNA, 21 bp, Homo sapiens
catgccctccactccactgcc

SEQ ID NO: 1710461 - DNA, 13 bp, Homo sapiens
catgccctcctgg

SEQ ID NO: 1710462 - DNA, 13 bp, Homo sapiens
catgccctgtgtg

SEQ ID NO: 1710463 - DNA, 21 bp, Homo sapiens
catgccgcgggcggccaggca

SEQ ID NO: 1710464 - DNA, 19 bp, Homo sapiens
catgcctcatgccacacct

SEQ ID NO: 1710465 - DNA, 12 bp, Homo sapiens
catgcctctgat

SEQ ID NO: 1710466 - DNA, 20 bp, Homo sapiens
catgcctgagggtggagact

SEQ ID NO: 1710467 - DNA, 12 bp, Homo sapiens
tactgcccaagg

SEQ ID NO: 1710468 - DNA, 15 bp, Homo sapiens
tactgccctcccctt

SEQ ID NO: 1710469 - DNA, 18 bp, Homo sapiens
tactgccctccccttccc

SEQ ID NO: 1710470 - DNA, 21 bp, Homo sapiens
tactgcctaggagttaatgat

SEQ ID NO: 1710471 - DNA, 21 bp, Homo sapiens
tactgcctctacagttaatag

SEQ ID NO: 1710472 - DNA, 12 bp, Homo sapiens
tactgccttgaa

SEQ ID NO: 1710473 - DNA, 12 bp, Homo sapiens
tactgcgacttt

SEQ ID NO: 1710474 - DNA, 17 bp, Homo sapiens
tactgcgactttctgcc

SEQ ID NO: 1710475 - DNA, 19 bp, Homo sapiens
tactgcgactttctgcctg

SEQ ID NO: 1710476 - DNA, 21 bp, Homo sapiens
tactgcgactttctgcctgga

SEQ ID NO: 1710477 - DNA, 10 bp, Homo sapiens
taaatgcata

SEQ ID NO: 1710478 - DNA, 20 bp, Homo sapiens
taaatgcatatcctgagcca

SEQ ID NO: 1710479 - DNA, 12 bp, Homo sapiens
taaatgccagag

SEQ ID NO: 1710480 - DNA, 16 bp, Homo sapiens
taaatgccagagccaa

SEQ ID NO: 1710481 - DNA, 22 bp, Homo sapiens
taaatgccagagccaacctgga

SEQ ID NO: 1710482 - DNA, 16 bp, Homo sapiens
taaatgcctcttaaat

SEQ ID NO: 1710483 - DNA, 17 bp, Homo sapiens
taaatgccttgcttgta

SEQ ID NO: 1710484 - DNA, 19 bp, Homo sapiens
taaatgcttcattgaaagc

SEQ ID NO: 1710485 - DNA, 17 bp, Homo sapiens
taaatgctttatgcaaa

SEQ ID NO: 1710486 - DNA, 17 bp, Homo sapiens
taaatggaaaaaatgat

SEQ ID NO: 1710487 - DNA, 23 bp, Homo sapiens
taaatggaattattttgaatgtc

SEQ ID NO: 1710488 - DNA, 16 bp, Homo sapiens
taaatggcctcatgtg

SEQ ID NO: 1710489 - DNA, 16 bp, Homo sapiens
taaatggcttgatttt

SEQ ID NO: 1710490 - DNA, 16 bp, Homo sapiens
taaatgggaattctca

SEQ ID NO: 1710491 - DNA, 18 bp, Homo sapiens
taaatggtaataagcact

SEQ ID NO: 1710492 - DNA, 14 bp, Homo sapiens
taaatggtatagca

SEQ ID NO: 1710493 - DNA, 20 bp, Homo sapiens
taaatggtatagcaaatgtt

SEQ ID NO: 1710494 - DNA, 16 bp, Homo sapiens
taaatggtgtacataa

SEQ ID NO: 1710495 - DNA, 17 bp, Homo sapiens
taaatggtgtacataat

SEQ ID NO: 1710496 - DNA, 14 bp, Homo sapiens
taaatgtaacttat

SEQ ID NO: 1710497 - DNA, 21 bp, Homo sapiens
taaatgtaccttcagaataag

SEQ ID NO: 1710498 - DNA, 15 bp, Homo sapiens
taaatgtactggtaa

SEQ ID NO: 1710499 - DNA, 17 bp, Homo sapiens
taaatgtactggtaatt

SEQ ID NO: 1710500 - DNA, 22 bp, Homo sapiens
taaatgtactggtaattgtaca

SEQ ID NO: 1710501 - DNA, 16 bp, Homo sapiens
taaatgtaggtatgaa

SEQ ID NO: 1710502 - DNA, 15 bp, Homo sapiens
taaatgtataaatat

SEQ ID NO: 1710503 - DNA, 22 bp, Homo sapiens
taaatgtataaatatacagtat

SEQ ID NO: 1710504 - DNA, 18 bp, Homo sapiens
taaatgtattttaaaata

SEQ ID NO: 1710505 - DNA, 10 bp, Homo sapiens
taaatgtgaa

SEQ ID NO: 1710506 - DNA, 20 bp, Homo sapiens
taaatgtgtgagtgcatgta

SEQ ID NO: 1710507 - DNA, 12 bp, Homo sapiens
taaatgttacct

SEQ ID NO: 1710508 - DNA, 15 bp, Homo sapiens
taaatgttacctaat

SEQ ID NO: 1710509 - DNA, 18 bp, Homo sapiens
taaatgttacctaattat

SEQ ID NO: 1710510 - DNA, 20 bp, Homo sapiens
taaatgttacctaattatta

SEQ ID NO: 1710511 - DNA, 18 bp, Homo sapiens
taaatgttacctctgaat

SEQ ID NO: 1710512 - DNA, 14 bp, Homo sapiens
taaatgttatgtat

SEQ ID NO: 1710513 - DNA, 19 bp, Homo sapiens
taaatgttatgtatatggt

SEQ ID NO: 1710514 - DNA, 19 bp, Homo sapiens
taaatgtttcttttgtttg

SEQ ID NO: 1710515 - DNA, 19 bp, Homo sapiens
taaatgtttgttatttaca

SEQ ID NO: 1710516 - DNA, 20 bp, Homo sapiens
taaattaaacatttttcaca

SEQ ID NO: 1710517 - DNA, 16 bp, Homo sapiens
taaattacaattttat

SEQ ID NO: 1710518 - DNA, 16 bp, Homo sapiens
taaattacatttgtaa

SEQ ID NO: 1710519 - DNA, 17 bp, Homo sapiens
taaattacatttgtaat

SEQ ID NO: 1710520 - DNA, 21 bp, Homo sapiens
taaattacatttgtaatttaa

SEQ ID NO: 1710521 - DNA, 17 bp, Homo sapiens
taaattaggaataaata

SEQ ID NO: 1710522 - DNA, 17 bp, Homo sapiens
taaattatgtaatgcaa

SEQ ID NO: 1710523 - DNA, 21 bp, Homo sapiens
taaattatgtgaccataatgt

SEQ ID NO: 1710524 - DNA, 22 bp, Homo sapiens
taaattatgtgaccataatgta

SEQ ID NO: 1710525 - DNA, 19 bp, Homo sapiens
taaattattagtttacatc

SEQ ID NO: 1710526 - DNA, 15 bp, Homo sapiens
taaattcaaagaagt

SEQ ID NO: 1710527 - DNA, 18 bp, Homo sapiens
taaattcaacacttattt

SEQ ID NO: 1710528 - DNA, 22 bp, Homo sapiens
taaattcaacacttattttctg

SEQ ID NO: 1710529 - DNA, 15 bp, Homo sapiens
taaattcaactttgt

SEQ ID NO: 1710530 - DNA, 14 bp, Homo sapiens
taaattcagtccta

SEQ ID NO: 1710531 - DNA, 17 bp, Homo sapiens
taaattcatttctagac

SEQ ID NO: 1710532 - DNA, 14 bp, Homo sapiens
taaattccactgga

SEQ ID NO: 1710533 - DNA, 16 bp, Homo sapiens
taaattccactggact

SEQ ID NO: 1710534 - DNA, 19 bp, Homo sapiens
taaattcccgttttgtcac

SEQ ID NO: 1710535 - DNA, 16 bp, Homo sapiens
taaattgatgttgctg

SEQ ID NO: 1710536 - DNA, 16 bp, Homo sapiens
taaattgattgaatta

SEQ ID NO: 1710537 - DNA, 12 bp, Homo sapiens
taaattgcaata

SEQ ID NO: 1710538 - DNA, 16 bp, Homo sapiens
taaattggattatttt

SEQ ID NO: 1710539 - DNA, 22 bp, Homo sapiens
caggttgaggggctcctggaaa

SEQ ID NO: 1710540 - DNA, 14 bp, Homo sapiens
caggttgtcctcaa

SEQ ID NO: 1710541 - DNA, 23 bp, Homo sapiens
caggttgtctgaagtcactgcac

SEQ ID NO: 1710542 - DNA, 17 bp, Homo sapiens
caggtttgaattaggct

SEQ ID NO: 1710543 - DNA, 15 bp, Homo sapiens
caggtttgccagtga

SEQ ID NO: 1710544 - DNA, 21 bp, Homo sapiens
caggtttggggagggggaaga

SEQ ID NO: 1710545 - DNA, 17 bp, Homo sapiens
caggttttaaaagcctt

SEQ ID NO: 1710546 - DNA, 19 bp, Homo sapiens
caggtttttcatctgaaaa

SEQ ID NO: 1710547 - DNA, 23 bp, Homo sapiens
cagtaaaagccttattctaaggt

SEQ ID NO: 1710548 - DNA, 16 bp, Homo sapiens
cagtaaaatactattc

SEQ ID NO: 1710549 - DNA, 21 bp, Homo sapiens
cagtaaacgggaacatgcccc

SEQ ID NO: 1710550 - DNA, 16 bp, Homo sapiens
cagtaaataactggaa

SEQ ID NO: 1710551 - DNA, 17 bp, Homo sapiens
cagtaaataactggaaa

SEQ ID NO: 1710552 - DNA, 20 bp, Homo sapiens
cagtaaatagtgtcatataa

SEQ ID NO: 1710553 - DNA, 18 bp, Homo sapiens
cagtaacccccttaaatt

SEQ ID NO: 1710554 - DNA, 21 bp, Homo sapiens
cagtaacccccttaaatttaa

SEQ ID NO: 1710555 - DNA, 14 bp, Homo sapiens
cagtaactaaagct

SEQ ID NO: 1710556 - DNA, 14 bp, Homo sapiens
cagtaactaatttt

SEQ ID NO: 1710557 - DNA, 21 bp, Homo sapiens
cagtaactaattttgttgaaa

SEQ ID NO: 1710558 - DNA, 10 bp, Homo sapiens
cagtaactgt

SEQ ID NO: 1710559 - DNA, 19 bp, Homo sapiens
cagtaactttatgtgtaaa

SEQ ID NO: 1710560 - DNA, 19 bp, Homo sapiens
cagtaagctgctctattgt

SEQ ID NO: 1710561 - DNA, 22 bp, Homo sapiens
cagtaagtctcataggttaaaa

SEQ ID NO: 1710562 - DNA, 13 bp, Homo sapiens
cagtaagttccta

SEQ ID NO: 1710563 - DNA, 12 bp, Homo sapiens
cagtaataactc

SEQ ID NO: 1710564 - DNA, 17 bp, Homo sapiens
cagtaatttgaggacaa

SEQ ID NO: 1710565 - DNA, 15 bp, Homo sapiens
cagtacaataatgta

SEQ ID NO: 1710566 - DNA, 20 bp, Homo sapiens
cagtacacaccagaagatgt

SEQ ID NO: 1710567 - DNA, 13 bp, Homo sapiens
cagtacatatgta

SEQ ID NO: 1710568 - DNA, 22 bp, Homo sapiens
cagtacatttaaattttttggc

SEQ ID NO: 1710569 - DNA, 16 bp, Homo sapiens
cagtacccaccacctt

SEQ ID NO: 1710570 - DNA, 23 bp, Homo sapiens
cagtaccccatggagctgggcta

SEQ ID NO: 1710571 - DNA, 14 bp, Homo sapiens
cagtaccctctcag

SEQ ID NO: 1710572 - DNA, 15 bp, Homo sapiens
cagtaccctctcagc

SEQ ID NO: 1710573 - DNA, 13 bp, Homo sapiens
cagtacctccaag

SEQ ID NO: 1710574 - DNA, 21 bp, Homo sapiens
cagtacctgggaaaggaccca

SEQ ID NO: 1710575 - DNA, 23 bp, Homo sapiens
cagtacctgggaaaggacccacc

SEQ ID NO: 1710576 - DNA, 13 bp, Homo sapiens
cagtaccttgctt

SEQ ID NO: 1710577 - DNA, 18 bp, Homo sapiens
cagtaccttgttgcagat

SEQ ID NO: 1710578 - DNA, 22 bp, Homo sapiens
cagtacgatcaagttgttgact

SEQ ID NO: 1710579 - DNA, 21 bp, Homo sapiens
cagtacgtcccgctgctgtgc

SEQ ID NO: 1710580 - DNA, 22 bp, Homo sapiens
cagtactattcaggtaacacta

SEQ ID NO: 1710581 - DNA, 12 bp, Homo sapiens
cagtactcactt

SEQ ID NO: 1710582 - DNA, 19 bp, Homo sapiens
cagtactcactttttccaa

SEQ ID NO: 1710583 - DNA, 17 bp, Homo sapiens
cagtactgactttctga

SEQ ID NO: 1710584 - DNA, 23 bp, Homo sapiens
cagtacttgtgaaacacagctgt

SEQ ID NO: 1710585 - DNA, 22 bp, Homo sapiens
cagtagaactccaggccctcct

SEQ ID NO: 1710586 - DNA, 20 bp, Homo sapiens
cagtagaccttgttacttct

SEQ ID NO: 1710587 - DNA, 12 bp, Homo sapiens
cagtagagccag

SEQ ID NO: 1710588 - DNA, 23 bp, Homo sapiens
cagtagaggctatggacagggca

SEQ ID NO: 1710589 - DNA, 15 bp, Homo sapiens
cagtagagtcatctc

SEQ ID NO: 1710590 - DNA, 16 bp, Homo sapiens
cagtagattttccaaa

SEQ ID NO: 1710591 - DNA, 18 bp, Homo sapiens
cagtagattttccaaatg

SEQ ID NO: 1710592 - DNA, 16 bp, Homo sapiens
cagtagccaaggcccg

SEQ ID NO: 1710593 - DNA, 22 bp, Homo sapiens
cagtaggagacacgacagcaca

SEQ ID NO: 1710594 - DNA, 14 bp, Homo sapiens
taacacaaaggaag

SEQ ID NO: 1710595 - DNA, 13 bp, Homo sapiens
taacacactggcc

SEQ ID NO: 1710596 - DNA, 19 bp, Homo sapiens
taacacagtgccttcaata

SEQ ID NO: 1710597 - DNA, 20 bp, Homo sapiens
taacacatttttttgcatgc

SEQ ID NO: 1710598 - DNA, 21 bp, Homo sapiens
taacaccgtcccagggctctg

SEQ ID NO: 1710599 - DNA, 15 bp, Homo sapiens
taacacgctgcctgg

SEQ ID NO: 1710600 - DNA, 22 bp, Homo sapiens
taacactaatatatttaaaaat

SEQ ID NO: 1710601 - DNA, 16 bp, Homo sapiens
taacactataaaggtt

SEQ ID NO: 1710602 - DNA, 17 bp, Homo sapiens
taacactggttaaatta

SEQ ID NO: 1710603 - DNA, 15 bp, Homo sapiens
taacactgtgaagag

SEQ ID NO: 1710604 - DNA, 14 bp, Homo sapiens
taacacttaaattt

SEQ ID NO: 1710605 - DNA, 16 bp, Homo sapiens
taacacttaaatttct

SEQ ID NO: 1710606 - DNA, 22 bp, Homo sapiens
taacacttcttacgcaatgctt

SEQ ID NO: 1710607 - DNA, 13 bp, Homo sapiens
taacactttgtat

SEQ ID NO: 1710608 - DNA, 18 bp, Homo sapiens
taacactttgtattactt

SEQ ID NO: 1710609 - DNA, 20 bp, Homo sapiens
taacactttgtattacttag

SEQ ID NO: 1710610 - DNA, 16 bp, Homo sapiens
taacagaaactttcaa

SEQ ID NO: 1710611 - DNA, 13 bp, Homo sapiens
taacagaaattgt

SEQ ID NO: 1710612 - DNA, 15 bp, Homo sapiens
taacagaaattgtat

SEQ ID NO: 1710613 - DNA, 17 bp, Homo sapiens
taacagagagaatgaga

SEQ ID NO: 1710614 - DNA, 15 bp, Homo sapiens
taacagatgcaatgt

SEQ ID NO: 1710615 - DNA, 18 bp, Homo sapiens
taacagcatgctgctttg

SEQ ID NO: 1710616 - DNA, 18 bp, Homo sapiens
taacagccctcctctgca

SEQ ID NO: 1710617 - DNA, 12 bp, Homo sapiens
taacagctgagg

SEQ ID NO: 1710618 - DNA, 13 bp, Homo sapiens
taacaggcaaaca

SEQ ID NO: 1710619 - DNA, 15 bp, Homo sapiens
taacaggcatttgtt

SEQ ID NO: 1710620 - DNA, 23 bp, Homo sapiens
taacaggctcaatattcctgaat

SEQ ID NO: 1710621 - DNA, 23 bp, Homo sapiens
taacagggagaagtagctagtag

SEQ ID NO: 1710622 - DNA, 22 bp, Homo sapiens
taacagggagactgcatctcaa

SEQ ID NO: 1710623 - DNA, 15 bp, Homo sapiens
taacaggtctcctct

SEQ ID NO: 1710624 - DNA, 18 bp, Homo sapiens
taacaggtctcctcttaa

SEQ ID NO: 1710625 - DNA, 12 bp, Homo sapiens
taacagtggctg

SEQ ID NO: 1710626 - DNA, 14 bp, Homo sapiens
taacagtgtttaaa

SEQ ID NO: 1710627 - DNA, 14 bp, Homo sapiens
taacagttatattt

SEQ ID NO: 1710628 - DNA, 18 bp, Homo sapiens
taacagttatatttttgt

SEQ ID NO: 1710629 - DNA, 20 bp, Homo sapiens
taacagttatatttttgtgt

SEQ ID NO: 1710630 - DNA, 14 bp, Homo sapiens
taacagttcatgtt

SEQ ID NO: 1710631 - DNA, 18 bp, Homo sapiens
taacagttcatgtttgct

SEQ ID NO: 1710632 - DNA, 18 bp, Homo sapiens
taacagttgtatttaaca

SEQ ID NO: 1710633 - DNA, 19 bp, Homo sapiens
taacagttgtatttaacag

SEQ ID NO: 1710634 - DNA, 23 bp, Homo sapiens
taacagttgtatttaacagaaat

SEQ ID NO: 1710635 - DNA, 19 bp, Homo sapiens
taacagttttgtgtaactc

SEQ ID NO: 1710636 - DNA, 21 bp, Homo sapiens
taacataaaatccaatattgt

SEQ ID NO: 1710637 - DNA, 21 bp, Homo sapiens
taacataaaatctgtgaatta

SEQ ID NO: 1710638 - DNA, 15 bp, Homo sapiens
taacataactgcttc

SEQ ID NO: 1710639 - DNA, 18 bp, Homo sapiens
taacatacaagaaaatgt

SEQ ID NO: 1710640 - DNA, 19 bp, Homo sapiens
taacatagtcctgttacta

SEQ ID NO: 1710641 - DNA, 14 bp, Homo sapiens
taacatataatgtt

SEQ ID NO: 1710642 - DNA, 13 bp, Homo sapiens
taacatatctaaa

SEQ ID NO: 1710643 - DNA, 12 bp, Homo sapiens
taacatattctt

SEQ ID NO: 1710644 - DNA, 14 bp, Homo sapiens
taacatcaaagatt

SEQ ID NO: 1710645 - DNA, 23 bp, Homo sapiens
taacatcataattacattcctaa

SEQ ID NO: 1710646 - DNA, 17 bp, Homo sapiens
taacatccaagccagag

SEQ ID NO: 1710647 - DNA, 22 bp, Homo sapiens
taacatctacaatcagttgact

SEQ ID NO: 1710648 - DNA, 17 bp, Homo sapiens
taacatctttattgaaa

SEQ ID NO: 1710649 - DNA, 21 bp, Homo sapiens
taacatctttattgaaattct

SEQ ID NO: 1710650 - DNA, 11 bp, Homo sapiens
taacatctttt

SEQ ID NO: 1710651 - DNA, 18 bp, Homo sapiens
taacatggacatgatctt

SEQ ID NO: 1710652 - DNA, 12 bp, Homo sapiens
taacatgtaaaa

SEQ ID NO: 1710653 - DNA, 21 bp, Homo sapiens
taacattaatgcctgcttttt

SEQ ID NO: 1710654 - DNA, 12 bp, Homo sapiens
cagtgactggca

SEQ ID NO: 1710655 - DNA, 13 bp, Homo sapiens
cagtgactggcag

SEQ ID NO: 1710656 - DNA, 17 bp, Homo sapiens
cagtgactggcaggtgc

SEQ ID NO: 1710657 - DNA, 18 bp, Homo sapiens
cagtgactggcaggtgca

SEQ ID NO: 1710658 - DNA, 22 bp, Homo sapiens
cagtgacttggccccagacgca

SEQ ID NO: 1710659 - DNA, 19 bp, Homo sapiens
cagtgactttacaggaggt

SEQ ID NO: 1710660 - DNA, 19 bp, Homo sapiens
cagtgactttttctgagct

SEQ ID NO: 1710661 - DNA, 22 bp, Homo sapiens
cagtgagaactctctccctggt

SEQ ID NO: 1710662 - DNA, 21 bp, Homo sapiens
cagtgagagacgccctatttc

SEQ ID NO: 1710663 - DNA, 12 bp, Homo sapiens
cagtgagctcta

SEQ ID NO: 1710664 - DNA, 13 bp, Homo sapiens
cagtgagctgaga

SEQ ID NO: 1710665 - DNA, 15 bp, Homo sapiens
cagtgagctgagatc

SEQ ID NO: 1710666 - DNA, 22 bp, Homo sapiens
cagtgagcttggaaaggaccag

SEQ ID NO: 1710667 - DNA, 21 bp, Homo sapiens
cagtgaggaaccctgatctct

SEQ ID NO: 1710668 - DNA, 13 bp, Homo sapiens
cagtgaggaggga

SEQ ID NO: 1710669 - DNA, 21 bp, Homo sapiens
cagtgaggagggtggaggaag

SEQ ID NO: 1710670 - DNA, 17 bp, Homo sapiens
cagtgagtacctgcaaa

SEQ ID NO: 1710671 - DNA, 22 bp, Homo sapiens
cagtgatctatgtttgtgtgat

SEQ ID NO: 1710672 - DNA, 16 bp, Homo sapiens
cagtgatctcagggca

SEQ ID NO: 1710673 - DNA, 17 bp, Homo sapiens
cagtgatctcagggcag

SEQ ID NO: 1710674 - DNA, 21 bp, Homo sapiens
cagtgatgacttgctgtccag

SEQ ID NO: 1710675 - DNA, 23 bp, Homo sapiens
cagtgatggcgcgggaggcacca

SEQ ID NO: 1710676 - DNA, 16 bp, Homo sapiens
cagtgattcagcaggc

SEQ ID NO: 1710677 - DNA, 16 bp, Homo sapiens
cagtgattttcaaacc

SEQ ID NO: 1710678 - DNA, 20 bp, Homo sapiens
cagtgcaaatgcatgcttct

SEQ ID NO: 1710679 - DNA, 15 bp, Homo sapiens
cagtgcaaatgtcag

SEQ ID NO: 1710680 - DNA, 20 bp, Homo sapiens
cagtgcaaatgtcagataca

SEQ ID NO: 1710681 - DNA, 14 bp, Homo sapiens
cagtgcacatttca

SEQ ID NO: 1710682 - DNA, 13 bp, Homo sapiens
cagtgcactccgg

SEQ ID NO: 1710683 - DNA, 14 bp, Homo sapiens
cagtgcagaatgta

SEQ ID NO: 1710684 - DNA, 12 bp, Homo sapiens
cagtgcagacag

SEQ ID NO: 1710685 - DNA, 13 bp, Homo sapiens
cagtgcagacagg

SEQ ID NO: 1710686 - DNA, 16 bp, Homo sapiens
cagtgcagagccttct

SEQ ID NO: 1710687 - DNA, 19 bp, Homo sapiens
cagtgcagagccttctcag

SEQ ID NO: 1710688 - DNA, 14 bp, Homo sapiens
cagtgcagccactg

SEQ ID NO: 1710689 - DNA, 15 bp, Homo sapiens
cagtgcagccactgg

SEQ ID NO: 1710690 - DNA, 16 bp, Homo sapiens
cagtgcagccactggc

SEQ ID NO: 1710691 - DNA, 17 bp, Homo sapiens
cagtgcagtgatacatg

SEQ ID NO: 1710692 - DNA, 21 bp, Homo sapiens
cagtgcagtttcttttcacat

SEQ ID NO: 1710693 - DNA, 17 bp, Homo sapiens
cagtgcatatgcaatgt

SEQ ID NO: 1710694 - DNA, 12 bp, Homo sapiens
cagtgcatctca

SEQ ID NO: 1710695 - DNA, 15 bp, Homo sapiens
cagtgcatctcagcc

SEQ ID NO: 1710696 - DNA, 15 bp, Homo sapiens
cagtgcatggtggcc

SEQ ID NO: 1710697 - DNA, 18 bp, Homo sapiens
cagtgcatggtggccaga

SEQ ID NO: 1710698 - DNA, 20 bp, Homo sapiens
cagtgcatgtgaagcatgct

SEQ ID NO: 1710699 - DNA, 22 bp, Homo sapiens
cagtgcatgtgaagcatgcttt

SEQ ID NO: 1710700 - DNA, 17 bp, Homo sapiens
cagtgcattatgtacac

SEQ ID NO: 1710701 - DNA, 18 bp, Homo sapiens
cagtgcattttgtttctg

SEQ ID NO: 1710702 - DNA, 21 bp, Homo sapiens
cagtgcattttgtttctgtat

SEQ ID NO: 1710703 - DNA, 12 bp, Homo sapiens
cagtgccaccca

SEQ ID NO: 1710704 - DNA, 20 bp, Homo sapiens
cagtgccacccatgcagctg

SEQ ID NO: 1710705 - DNA, 17 bp, Homo sapiens
cagtgccactgcccccc

SEQ ID NO: 1710706 - DNA, 21 bp, Homo sapiens
cagtgccacttgacattcctt

SEQ ID NO: 1710707 - DNA, 13 bp, Homo sapiens
cagtgccagctcc

SEQ ID NO: 1710708 - DNA, 17 bp, Homo sapiens
cagtgccaggaaagagt

SEQ ID NO: 1710709 - DNA, 20 bp, Homo sapiens
cagtgcccccactgaccaga

SEQ ID NO: 1710710 - DNA, 22 bp, Homo sapiens
cagtgcccccactgaccagaac

SEQ ID NO: 1710711 - DNA, 24 bp, Homo sapiens
cagtgccctggggctgatctcagg

SEQ ID NO: 1710712 - DNA, 11 bp, Homo sapiens
cagtgcccttt

SEQ ID NO: 1710713 - DNA, 14 bp, Homo sapiens
cagtgccgaggaca

SEQ ID NO: 1710714 - DNA, 17 bp, Homo sapiens
cagtgccgaggacatgc

SEQ ID NO: 1710715 - DNA, 16 bp, Homo sapiens
taactactaagaataa

SEQ ID NO: 1710716 - DNA, 22 bp, Homo sapiens
taactactatattgattgtcct

SEQ ID NO: 1710717 - DNA, 18 bp, Homo sapiens
taactactttttatactc

SEQ ID NO: 1710718 - DNA, 19 bp, Homo sapiens
taactactttttatactcc

SEQ ID NO: 1710719 - DNA, 20 bp, Homo sapiens
taactagaattagtatgtct

SEQ ID NO: 1710720 - DNA, 18 bp, Homo sapiens
taactagacaccaaagtt

SEQ ID NO: 1710721 - DNA, 23 bp, Homo sapiens
taactagattaagatctgtgttt

SEQ ID NO: 1710722 - DNA, 17 bp, Homo sapiens
taactatatttgctttt

SEQ ID NO: 1710723 - DNA, 18 bp, Homo sapiens
taactatatttgcttttt

SEQ ID NO: 1710724 - DNA, 13 bp, Homo sapiens
taactatttcaca

SEQ ID NO: 1710725 - DNA, 13 bp, Homo sapiens
taactcacattct

SEQ ID NO: 1710726 - DNA, 18 bp, Homo sapiens
taactcaccagatttact

SEQ ID NO: 1710727 - DNA, 21 bp, Homo sapiens
taactcataatttttgcagaa

SEQ ID NO: 1710728 - DNA, 22 bp, Homo sapiens
taactcataatttttgcagaaa

SEQ ID NO: 1710729 - DNA, 15 bp, Homo sapiens
taactcatcataaaa

SEQ ID NO: 1710730 - DNA, 17 bp, Homo sapiens
taactcatcataaaata

SEQ ID NO: 1710731 - DNA, 12 bp, Homo sapiens
taactcatttgt

SEQ ID NO: 1710732 - DNA, 16 bp, Homo sapiens
taactccaccaaccca

SEQ ID NO: 1710733 - DNA, 22 bp, Homo sapiens
taactccaccaacccatcagaa

SEQ ID NO: 1710734 - DNA, 22 bp, Homo sapiens
taactctaattcccattttgca

SEQ ID NO: 1710735 - DNA, 13 bp, Homo sapiens
taactctctttcc

SEQ ID NO: 1710736 - DNA, 14 bp, Homo sapiens
taactctctttcct

SEQ ID NO: 1710737 - DNA, 21 bp, Homo sapiens
taactctgcactactcctctg

SEQ ID NO: 1710738 - DNA, 11 bp, Homo sapiens
taactctggga

SEQ ID NO: 1710739 - DNA, 16 bp, Homo sapiens
taactcttgtctattt

SEQ ID NO: 1710740 - DNA, 17 bp, Homo sapiens
taactcttttctatttt

SEQ ID NO: 1710741 - DNA, 18 bp, Homo sapiens
taactcttttctattttg

SEQ ID NO: 1710742 - DNA, 13 bp, Homo sapiens
taactcttttgga

SEQ ID NO: 1710743 - DNA, 21 bp, Homo sapiens
taactgaaaatgtgctatact

SEQ ID NO: 1710744 - DNA, 17 bp, Homo sapiens
taactgacaagccatct

SEQ ID NO: 1710745 - DNA, 14 bp, Homo sapiens
taactgactattct

SEQ ID NO: 1710746 - DNA, 14 bp, Homo sapiens
taactgagttatat

SEQ ID NO: 1710747 - DNA, 20 bp, Homo sapiens
taactgatctcaagtatatg

SEQ ID NO: 1710748 - DNA, 12 bp, Homo sapiens
taactgcaattt

SEQ ID NO: 1710749 - DNA, 17 bp, Homo sapiens
taactgcatatagataa

SEQ ID NO: 1710750 - DNA, 17 bp, Homo sapiens
taactgcattgagaact

SEQ ID NO: 1710751 - DNA, 16 bp, Homo sapiens
taactgcatttttaga

SEQ ID NO: 1710752 - DNA, 18 bp, Homo sapiens
taactggaaaacagaaca

SEQ ID NO: 1710753 - DNA, 21 bp, Homo sapiens
taactggaaaacagaacactt

SEQ ID NO: 1710754 - DNA, 23 bp, Homo sapiens
taactggcagttttccattggtt

SEQ ID NO: 1710755 - DNA, 14 bp, Homo sapiens
taactgggttaaat

SEQ ID NO: 1710756 - DNA, 16 bp, Homo sapiens
taactgggttaaatat

SEQ ID NO: 1710757 - DNA, 21 bp, Homo sapiens
taactgggttaaatattttgc

SEQ ID NO: 1710758 - DNA, 18 bp, Homo sapiens
taactggtagtgttcagt

SEQ ID NO: 1710759 - DNA, 12 bp, Homo sapiens
taactgtaaatc

SEQ ID NO: 1710760 - DNA, 14 bp, Homo sapiens
taactgtaaatcat

SEQ ID NO: 1710761 - DNA, 12 bp, Homo sapiens
taactgtcctgt

SEQ ID NO: 1710762 - DNA, 18 bp, Homo sapiens
taactgtgtatgtacata

SEQ ID NO: 1710763 - DNA, 20 bp, Homo sapiens
taactgtgtatgtacatata

SEQ ID NO: 1710764 - DNA, 17 bp, Homo sapiens
taactgttcccttatct

SEQ ID NO: 1710765 - DNA, 18 bp, Homo sapiens
taacttaaaaaaatgaca

SEQ ID NO: 1710766 - DNA, 19 bp, Homo sapiens
taacttaaaaatgtaaata

SEQ ID NO: 1710767 - DNA, 22 bp, Homo sapiens
taacttaaaagaacatgtatat

SEQ ID NO: 1710768 - DNA, 16 bp, Homo sapiens
taacttaaaatatttt

SEQ ID NO: 1710769 - DNA, 22 bp, Homo sapiens
taagaggagtaggccctggttc

SEQ ID NO: 1710770 - DNA, 17 bp, Homo sapiens
taagaggcagaaaattg

SEQ ID NO: 1710771 - DNA, 15 bp, Homo sapiens
taagaggcccagccc

SEQ ID NO: 1710772 - DNA, 22 bp, Homo sapiens
taagaggcccagccctcagaaa

SEQ ID NO: 1710773 - DNA, 23 bp, Homo sapiens
taagagggattagggagagaaga

SEQ ID NO: 1710774 - DNA, 23 bp, Homo sapiens
taagagggcagactgtgaacttg

SEQ ID NO: 1710775 - DNA, 18 bp, Homo sapiens
taagagggcatatacagt

SEQ ID NO: 1710776 - DNA, 18 bp, Homo sapiens
taagagtgaaaattgtct

SEQ ID NO: 1710777 - DNA, 19 bp, Homo sapiens
taagagtgtcactgagctg

SEQ ID NO: 1710778 - DNA, 15 bp, Homo sapiens
taagatagaaagctg

SEQ ID NO: 1710779 - DNA, 17 bp, Homo sapiens
taagatagaaagctgga

SEQ ID NO: 1710780 - DNA, 21 bp, Homo sapiens
taagatagaaagctggactga

SEQ ID NO: 1710781 - DNA, 15 bp, Homo sapiens
taagatatatacatg

SEQ ID NO: 1710782 - DNA, 21 bp, Homo sapiens
taagatatccatctttttctt

SEQ ID NO: 1710783 - DNA, 15 bp, Homo sapiens
taagatccagaaata

SEQ ID NO: 1710784 - DNA, 13 bp, Homo sapiens
taagatctgactg

SEQ ID NO: 1710785 - DNA, 16 bp, Homo sapiens
taagatcttagattct

SEQ ID NO: 1710786 - DNA, 20 bp, Homo sapiens
taagatcttagattctctgt

SEQ ID NO: 1710787 - DNA, 20 bp, Homo sapiens
taagatgccagcatatactg

SEQ ID NO: 1710788 - DNA, 19 bp, Homo sapiens
taagatggataatgtgtat

SEQ ID NO: 1710789 - DNA, 19 bp, Homo sapiens
taagatggctgtggcattt

SEQ ID NO: 1710790 - DNA, 23 bp, Homo sapiens
taagatgtgatattctaagactt

SEQ ID NO: 1710791 - DNA, 15 bp, Homo sapiens
taagatgtgttctta

SEQ ID NO: 1710792 - DNA, 15 bp, Homo sapiens
taagattaaaggaag

SEQ ID NO: 1710793 - DNA, 18 bp, Homo sapiens
taagattaaaggaaggaa

SEQ ID NO: 1710794 - DNA, 16 bp, Homo sapiens
taagattatagattct

SEQ ID NO: 1710795 - DNA, 17 bp, Homo sapiens
taagattatagattcta

SEQ ID NO: 1710796 - DNA, 18 bp, Homo sapiens
taagattatagattctaa

SEQ ID NO: 1710797 - DNA, 19 bp, Homo sapiens
taagattatagattctaaa

SEQ ID NO: 1710798 - DNA, 21 bp, Homo sapiens
taagattatagattctaaaga

SEQ ID NO: 1710799 - DNA, 23 bp, Homo sapiens
taagattatagattctaaagatt

SEQ ID NO: 1710800 - DNA, 16 bp, Homo sapiens
taagattatctgggga

SEQ ID NO: 1710801 - DNA, 10 bp, Homo sapiens
taagattcta

SEQ ID NO: 1710802 - DNA, 16 bp, Homo sapiens
taagattctaaaggtc

SEQ ID NO: 1710803 - DNA, 12 bp, Homo sapiens
taagattctaat

SEQ ID NO: 1710804 - DNA, 14 bp, Homo sapiens
taagattctaatga

SEQ ID NO: 1710805 - DNA, 13 bp, Homo sapiens
taagattctagat

SEQ ID NO: 1710806 - DNA, 19 bp, Homo sapiens
taagattctctgcccagcc

SEQ ID NO: 1710807 - DNA, 20 bp, Homo sapiens
taagattctctgcccagccg

SEQ ID NO: 1710808 - DNA, 13 bp, Homo sapiens
taagattggaaat

SEQ ID NO: 1710809 - DNA, 20 bp, Homo sapiens
taagcaaaggctccctcgcc

SEQ ID NO: 1710810 - DNA, 23 bp, Homo sapiens
taagcaaagggagcactgggttg

SEQ ID NO: 1710811 - DNA, 15 bp, Homo sapiens
taagcaacagaaata

SEQ ID NO: 1710812 - DNA, 18 bp, Homo sapiens
taagcaagagagatgttt

SEQ ID NO: 1710813 - DNA, 23 bp, Homo sapiens
taagcacacacatctggccctga

SEQ ID NO: 1710814 - DNA, 20 bp, Homo sapiens
taagcagaacaaatgtgttt

SEQ ID NO: 1710815 - DNA, 21 bp, Homo sapiens
taagcagaacaaatgtgtttt

SEQ ID NO: 1710816 - DNA, 15 bp, Homo sapiens
taagcagcatggaaa

SEQ ID NO: 1710817 - DNA, 17 bp, Homo sapiens
taagcaggtttgttttc

SEQ ID NO: 1710818 - DNA, 12 bp, Homo sapiens
taagcagtatat

SEQ ID NO: 1710819 - DNA, 17 bp, Homo sapiens
taagcagtgttacttgc

SEQ ID NO: 1710820 - DNA, 23 bp, Homo sapiens
taagcagttatggtgatgactta

SEQ ID NO: 1710821 - DNA, 18 bp, Homo sapiens
taagcagttttgtaaatg

SEQ ID NO: 1710822 - DNA, 12 bp, Homo sapiens
taagcatgtcaa

SEQ ID NO: 1710823 - DNA, 18 bp, Homo sapiens
taagcattgggtgggtaa

SEQ ID NO: 1710824 - DNA, 10 bp, Homo sapiens
taagcattta

SEQ ID NO: 1710825 - DNA, 11 bp, Homo sapiens
taagccaaaga

SEQ ID NO: 1710826 - DNA, 22 bp, Homo sapiens
taagccaaagaaacaagctgtg

SEQ ID NO: 1710827 - DNA, 14 bp, Homo sapiens
taagccacttgaaa

SEQ ID NO: 1710828 - DNA, 19 bp, Homo sapiens
taagccagttttcattttg

SEQ ID NO: 1710829 - DNA, 20 bp, Homo sapiens
taagcccccagggcctccag

SEQ ID NO: 1710830 - DNA, 22 bp, Homo sapiens
taagcccccagggcctccaggg

SEQ ID NO: 1710831 - DNA, 23 bp, Homo sapiens
taagcccccagggcctccagggc

SEQ ID NO: 1710832 - DNA, 17 bp, Homo sapiens
taagcctccatttagtt

SEQ ID NO: 1710833 - DNA, 21 bp, Homo sapiens
taagcctccatttagttcttt

SEQ ID NO: 1710834 - DNA, 15 bp, Homo sapiens
taagcctttccataa

SEQ ID NO: 1710835 - DNA, 21 bp, Homo sapiens
taagcctttgttgaactgtta

SEQ ID NO: 1710836 - DNA, 16 bp, Homo sapiens
taagcgatttgaaaca

SEQ ID NO: 1710837 - DNA, 14 bp, Homo sapiens
taagctaaaatgtt

SEQ ID NO: 1710838 - DNA, 16 bp, Homo sapiens
taagctaacccccttc

SEQ ID NO: 1710839 - DNA, 21 bp, Homo sapiens
taagctctctgggcctgggtt

SEQ ID NO: 1710840 - DNA, 16 bp, Homo sapiens
taagctctttgagaac

SEQ ID NO: 1710841 - DNA, 10 bp, Homo sapiens
taagctgcaa

SEQ ID NO: 1710842 - DNA, 12 bp, Homo sapiens
taagctggagct

SEQ ID NO: 1710843 - DNA, 16 bp, Homo sapiens
taagctggagtgcagt

SEQ ID NO: 1710844 - DNA, 17 bp, Homo sapiens
taagctggctctgtttg

SEQ ID NO: 1710845 - DNA, 22 bp, Homo sapiens
taagctgttcctgttcagtaat

SEQ ID NO: 1710846 - DNA, 11 bp, Homo sapiens
taagctgtttc

SEQ ID NO: 1710847 - DNA, 15 bp, Homo sapiens
taagcttattgcttc

SEQ ID NO: 1710848 - DNA, 15 bp, Homo sapiens
taagcttatttctaa

SEQ ID NO: 1710849 - DNA, 13 bp, Homo sapiens
taagctttttgga

SEQ ID NO: 1710850 - DNA, 15 bp, Homo sapiens
taagctttttggaat

SEQ ID NO: 1710851 - DNA, 20 bp, Homo sapiens
taaggaaacacttctattta

SEQ ID NO: 1710852 - DNA, 18 bp, Homo sapiens
taaggaaagcaataaatg

SEQ ID NO: 1710853 - DNA, 21 bp, Homo sapiens
taaggacctgaaattccaaag

SEQ ID NO: 1710854 - DNA, 13 bp, Homo sapiens
taaggactgtaaa

SEQ ID NO: 1710855 - DNA, 15 bp, Homo sapiens
taaggactgtaaaca

SEQ ID NO: 1710856 - DNA, 17 bp, Homo sapiens
taaggagaatcatgttt

SEQ ID NO: 1710857 - DNA, 20 bp, Homo sapiens
taaggagaatcatgtttctt

SEQ ID NO: 1710858 - DNA, 14 bp, Homo sapiens
taaggagaatggcc

SEQ ID NO: 1710859 - DNA, 16 bp, Homo sapiens
taaggagatgggcctt

SEQ ID NO: 1710860 - DNA, 12 bp, Homo sapiens
taaggagctggg

SEQ ID NO: 1710861 - DNA, 21 bp, Homo sapiens
taaggaggaggagggagaaga

SEQ ID NO: 1710862 - DNA, 21 bp, Homo sapiens
taaggagggaaggtggaccag

SEQ ID NO: 1710863 - DNA, 16 bp, Homo sapiens
taaggatctctcagga

SEQ ID NO: 1710864 - DNA, 12 bp, Homo sapiens
taaggatgactt

SEQ ID NO: 1710865 - DNA, 13 bp, Homo sapiens
taaggatgacttt

SEQ ID NO: 1710866 - DNA, 19 bp, Homo sapiens
taaggatggagccagctct

SEQ ID NO: 1710867 - DNA, 11 bp, Homo sapiens
taaggatggat

SEQ ID NO: 1710868 - DNA, 15 bp, Homo sapiens
taaggatggatggca

SEQ ID NO: 1710869 - DNA, 15 bp, Homo sapiens
taaggattctggaat

SEQ ID NO: 1710870 - DNA, 20 bp, Homo sapiens
taaggcacagtgggagctga

SEQ ID NO: 1710871 - DNA, 23 bp, Homo sapiens
taaggcacagtgggagctgagct

SEQ ID NO: 1710872 - DNA, 22 bp, Homo sapiens
taaggcagacccagtatgaaat

SEQ ID NO: 1710873 - DNA, 15 bp, Homo sapiens
taaggccagggcctc

SEQ ID NO: 1710874 - DNA, 19 bp, Homo sapiens
taaggcctaggattctaaa

SEQ ID NO: 1710875 - DNA, 12 bp, Homo sapiens
taaggctctaga

SEQ ID NO: 1710876 - DNA, 14 bp, Homo sapiens
taaggctctagatc

SEQ ID NO: 1710877 - DNA, 19 bp, Homo sapiens
taaggctctatgagtctag

SEQ ID NO: 1710878 - DNA, 17 bp, Homo sapiens
taagggaaaagataaag

SEQ ID NO: 1710879 - DNA, 22 bp, Homo sapiens
taagggactgatgtttgtgcag

SEQ ID NO: 1710880 - DNA, 17 bp, Homo sapiens
taaggggaggctgcttt

SEQ ID NO: 1710881 - DNA, 22 bp, Homo sapiens
taaggtatatcattctaaagat

SEQ ID NO: 1710882 - DNA, 14 bp, Homo sapiens
taaggtatatttag

SEQ ID NO: 1710883 - DNA, 19 bp, Homo sapiens
taaggtccaacaagaatgc

SEQ ID NO: 1710884 - DNA, 23 bp, Homo sapiens
gttttgaactaataaaagcataa

SEQ ID NO: 1710885 - DNA, 16 bp, Homo sapiens
gttttgacacttccca

SEQ ID NO: 1710886 - DNA, 16 bp, Homo sapiens
gttttgacggatgatt

SEQ ID NO: 1710887 - DNA, 12 bp, Homo sapiens
gttttgagcttt

SEQ ID NO: 1710888 - DNA, 18 bp, Homo sapiens
gttttgaggcatgactaa

SEQ ID NO: 1710889 - DNA, 21 bp, Homo sapiens
gttttgatgaaattcttgaag

SEQ ID NO: 1710890 - DNA, 15 bp, Homo sapiens
gttttgatggctggg

SEQ ID NO: 1710891 - DNA, 18 bp, Homo sapiens
gttttgatggctgggtcc

SEQ ID NO: 1710892 - DNA, 20 bp, Homo sapiens
gttttgcaaagggaaacagg

SEQ ID NO: 1710893 - DNA, 13 bp, Homo sapiens
gttttgcaataac

SEQ ID NO: 1710894 - DNA, 13 bp, Homo sapiens
gttttgcactttt

SEQ ID NO: 1710895 - DNA, 16 bp, Homo sapiens
gttttgccaagaatat

SEQ ID NO: 1710896 - DNA, 16 bp, Homo sapiens
gttttggaagctctga

SEQ ID NO: 1710897 - DNA, 18 bp, Homo sapiens
gttttggacagtttacca

SEQ ID NO: 1710898 - DNA, 22 bp, Homo sapiens
gttttggctgaaattctcctgg

SEQ ID NO: 1710899 - DNA, 13 bp, Homo sapiens
gttttgtaaaact

SEQ ID NO: 1710900 - DNA, 14 bp, Homo sapiens
gttttgtaaaactg

SEQ ID NO: 1710901 - DNA, 15 bp, Homo sapiens
gttttgtaaaactgt

SEQ ID NO: 1710902 - DNA, 13 bp, Homo sapiens
gttttgtaaaaga

SEQ ID NO: 1710903 - DNA, 22 bp, Homo sapiens
gttttgtaaatgtactggtaat

SEQ ID NO: 1710904 - DNA, 19 bp, Homo sapiens
gttttgtacatgtaacatt

SEQ ID NO: 1710905 - DNA, 21 bp, Homo sapiens
gttttgtataaaatctgaatt

SEQ ID NO: 1710906 - DNA, 21 bp, Homo sapiens
gttttgtataaataataaaga

SEQ ID NO: 1710907 - DNA, 13 bp, Homo sapiens
gttttgtcagaaa

SEQ ID NO: 1710908 - DNA, 16 bp, Homo sapiens
gttttgtcagacttcc

SEQ ID NO: 1710909 - DNA, 20 bp, Homo sapiens
gttttgtcattcagagtcag

SEQ ID NO: 1710910 - DNA, 17 bp, Homo sapiens
gttttgtctgtctccct

SEQ ID NO: 1710911 - DNA, 14 bp, Homo sapiens
gttttgtcttgaat

SEQ ID NO: 1710912 - DNA, 17 bp, Homo sapiens
gttttgtgtctggtgca

SEQ ID NO: 1710913 - DNA, 14 bp, Homo sapiens
gttttgttccagag

SEQ ID NO: 1710914 - DNA, 14 bp, Homo sapiens
gttttgttcccctc

SEQ ID NO: 1710915 - DNA, 13 bp, Homo sapiens
gttttgttgtttg

SEQ ID NO: 1710916 - DNA, 14 bp, Homo sapiens
gtttttaaaaatta

SEQ ID NO: 1710917 - DNA, 18 bp, Homo sapiens
gtttttaaatagagtttg

SEQ ID NO: 1710918 - DNA, 23 bp, Homo sapiens
gtttttaaatagagtttgctatt

SEQ ID NO: 1710919 - DNA, 18 bp, Homo sapiens
gtttttaacaatctaaca

SEQ ID NO: 1710920 - DNA, 23 bp, Homo sapiens
gtttttaagaaaaacatgtcatg

SEQ ID NO: 1710921 - DNA, 17 bp, Homo sapiens
gtttttaataaagacag

SEQ ID NO: 1710922 - DNA, 17 bp, Homo sapiens
gtttttacagttagggt

SEQ ID NO: 1710923 - DNA, 16 bp, Homo sapiens
cagggccatgcctgcc

SEQ ID NO: 1710924 - DNA, 14 bp, Homo sapiens
cagggccatgctga

SEQ ID NO: 1710925 - DNA, 17 bp, Homo sapiens
cagggccatgctgaggc

SEQ ID NO: 1710926 - DNA, 21 bp, Homo sapiens
cagggccatgctgaggcctgg

SEQ ID NO: 1710927 - DNA, 23 bp, Homo sapiens
cagggccatgctgaggcctgggc

SEQ ID NO: 1710928 - DNA, 16 bp, Homo sapiens
cagggccatggctcag

SEQ ID NO: 1710929 - DNA, 18 bp, Homo sapiens
cagggccatggctcaggg

SEQ ID NO: 1710930 - DNA, 17 bp, Homo sapiens
cagggcccaagtccctg

SEQ ID NO: 1710931 - DNA, 18 bp, Homo sapiens
cagggcccaagtccctgt

SEQ ID NO: 1710932 - DNA, 14 bp, Homo sapiens
cagggcccagagcc

SEQ ID NO: 1710933 - DNA, 18 bp, Homo sapiens
cagggcccagagcccagc

SEQ ID NO: 1710934 - DNA, 21 bp, Homo sapiens
cagggcccagagcccagctcc

SEQ ID NO: 1710935 - DNA, 14 bp, Homo sapiens
cagggcccccacag

SEQ ID NO: 1710936 - DNA, 15 bp, Homo sapiens
cagggcccccacagg

SEQ ID NO: 1710937 - DNA, 18 bp, Homo sapiens
cagggcccccggccacgc

SEQ ID NO: 1710938 - DNA, 21 bp, Homo sapiens
cagggcccctcaccctgcctt

SEQ ID NO: 1710939 - DNA, 15 bp, Homo sapiens
cagggcccctccctc

SEQ ID NO: 1710940 - DNA, 22 bp, Homo sapiens
cagggcccctccctctgcccca

SEQ ID NO: 1710941 - DNA, 17 bp, Homo sapiens
cagggcccgcagtgctg

SEQ ID NO: 1710942 - DNA, 18 bp, Homo sapiens
cagggcccgcagtgctgg

SEQ ID NO: 1710943 - DNA, 18 bp, Homo sapiens
cagggcccggccacaccc

SEQ ID NO: 1710944 - DNA, 15 bp, Homo sapiens
cagggccctcccagc

SEQ ID NO: 1710945 - DNA, 16 bp, Homo sapiens
cagggccctcccagcc

SEQ ID NO: 1710946 - DNA, 15 bp, Homo sapiens
cagggccctgagctc

SEQ ID NO: 1710947 - DNA, 21 bp, Homo sapiens
cagggccctgagctcggtgga

SEQ ID NO: 1710948 - DNA, 14 bp, Homo sapiens
cagggccgaccaga

SEQ ID NO: 1710949 - DNA, 23 bp, Homo sapiens
cagggccgaccagaggagccttt

SEQ ID NO: 1710950 - DNA, 16 bp, Homo sapiens
cagggccgcgagaggc

SEQ ID NO: 1710951 - DNA, 14 bp, Homo sapiens
cagggcctccaggg

SEQ ID NO: 1710952 - DNA, 15 bp, Homo sapiens
cagggcctccagggc

SEQ ID NO: 1710953 - DNA, 23 bp, Homo sapiens
cagggcctcccgcatcaaggtca

SEQ ID NO: 1710954 - DNA, 14 bp, Homo sapiens
cagggcctgacacc

SEQ ID NO: 1710955 - DNA, 17 bp, Homo sapiens
cagggcctgacaccccc

SEQ ID NO: 1710956 - DNA, 19 bp, Homo sapiens
cagggcctgacaccccctc

SEQ ID NO: 1710957 - DNA, 20 bp, Homo sapiens
cagggcctgacaccccctcc

SEQ ID NO: 1710958 - DNA, 13 bp, Homo sapiens
cagggcctggagc

SEQ ID NO: 1710959 - DNA, 13 bp, Homo sapiens
cagggcctgggcc

SEQ ID NO: 1710960 - DNA, 15 bp, Homo sapiens
cagggcctgggcctc

SEQ ID NO: 1710961 - DNA, 18 bp, Homo sapiens
cagggcctgggggcagtg

SEQ ID NO: 1710962 - DNA, 19 bp, Homo sapiens
cagggcctgggggcagtga

SEQ ID NO: 1710963 - DNA, 22 bp, Homo sapiens
cagggcctgggggcagtgactg

SEQ ID NO: 1710964 - DNA, 16 bp, Homo sapiens
cagggccttgcccaga

SEQ ID NO: 1710965 - DNA, 20 bp, Homo sapiens
cagggccttttctggcaccg

SEQ ID NO: 1710966 - DNA, 13 bp, Homo sapiens
cagggcgctcaga

SEQ ID NO: 1710967 - DNA, 15 bp, Homo sapiens
cagggcgctcagacg

SEQ ID NO: 1710968 - DNA, 16 bp, Homo sapiens
cagggcgctcagacgg

SEQ ID NO: 1710969 - DNA, 23 bp, Homo sapiens
cagggcgctcagacggcggccag

SEQ ID NO: 1710970 - DNA, 16 bp, Homo sapiens
cagggcgggcagaggg

SEQ ID NO: 1710971 - DNA, 19 bp, Homo sapiens
cagggcgggcagagggctg

SEQ ID NO: 1710972 - DNA, 17 bp, Homo sapiens
cagggctcaccagctgg

SEQ ID NO: 1710973 - DNA, 13 bp, Homo sapiens
cagggctccaaat

SEQ ID NO: 1710974 - DNA, 18 bp, Homo sapiens
cagggctcccacagagac

SEQ ID NO: 1710975 - DNA, 12 bp, Homo sapiens
cagggctcccat

SEQ ID NO: 1710976 - DNA, 15 bp, Homo sapiens
cagggctcctgtggc

SEQ ID NO: 1710977 - DNA, 22 bp, Homo sapiens
cagggctcctgtggcagctgcc

SEQ ID NO: 1710978 - DNA, 16 bp, Homo sapiens
cagggctctgcaggcc

SEQ ID NO: 1710979 - DNA, 20 bp, Homo sapiens
cagggctctgcaggccactg

SEQ ID NO: 1710980 - DNA, 19 bp, Homo sapiens
cagggctggactgaggcct

SEQ ID NO: 1710981 - DNA, 18 bp, Homo sapiens
cagggctggagtgcgctc

SEQ ID NO: 1710982 - DNA, 20 bp, Homo sapiens
cagggctggagtgcgctctt

SEQ ID NO: 1710983 - DNA, 19 bp, Homo sapiens
cagggctgggaggaaggac

SEQ ID NO: 1710984 - DNA, 17 bp, Homo sapiens
cagggctgggccaggtc

SEQ ID NO: 1710985 - DNA, 14 bp, Homo sapiens
cagggctttaaaat

SEQ ID NO: 1710986 - DNA, 18 bp, Homo sapiens
caggggaagaccaaagtt

SEQ ID NO: 1710987 - DNA, 20 bp, Homo sapiens
caggggaattccctccccct

SEQ ID NO: 1710988 - DNA, 21 bp, Homo sapiens
caggggacaagggaggcagtg

SEQ ID NO: 1710989 - DNA, 15 bp, Homo sapiens
caggggaccacacct

SEQ ID NO: 1710990 - DNA, 21 bp, Homo sapiens
caggggactcagccctgaggt

SEQ ID NO: 1710991 - DNA, 14 bp, Homo sapiens
caggggactgtctc

SEQ ID NO: 1710992 - DNA, 15 bp, Homo sapiens
caggggactgtctca

SEQ ID NO: 1710993 - DNA, 21 bp, Homo sapiens
caggggactgtctcagaagac

SEQ ID NO: 1710994 - DNA, 17 bp, Homo sapiens
caggggagacaggagcc

SEQ ID NO: 1710995 - DNA, 21 bp, Homo sapiens
caggggagacaggagcctagc

SEQ ID NO: 1710996 - DNA, 22 bp, Homo sapiens
caggggagacaggagcctagcg

SEQ ID NO: 1710997 - DNA, 13 bp, Homo sapiens
caggggagaggca

SEQ ID NO: 1710998 - DNA, 17 bp, Homo sapiens
caggggagagggtctgg

SEQ ID NO: 1710999 - DNA, 21 bp, Homo sapiens
taaaaagcagaattttaatgt

SEQ ID NO: 1711000 - DNA, 17 bp, Homo sapiens
taaaaagcctctttctt

SEQ ID NO: 1711001 - DNA, 18 bp, Homo sapiens
taaaaaggaaatttgttt

SEQ ID NO: 1711002 - DNA, 22 bp, Homo sapiens
taaaaaggaaatttgtttgtat

SEQ ID NO: 1711003 - DNA, 16 bp, Homo sapiens
taaaaaggaattttgt

SEQ ID NO: 1711004 - DNA, 19 bp, Homo sapiens
taaaaaggaattttgtaaa

SEQ ID NO: 1711005 - DNA, 22 bp, Homo sapiens
taaaaaggccaaagataaaagg

SEQ ID NO: 1711006 - DNA, 20 bp, Homo sapiens
taaaaagggcagggcatctc

SEQ ID NO: 1711007 - DNA, 18 bp, Homo sapiens
taaaaagggccagaaaaa

SEQ ID NO: 1711008 - DNA, 17 bp, Homo sapiens
taaaaagtgacacagca

SEQ ID NO: 1711009 - DNA, 18 bp, Homo sapiens
taaaaagtgacacagcag

SEQ ID NO: 1711010 - DNA, 15 bp, Homo sapiens
taaaaagtggctgcg

SEQ ID NO: 1711011 - DNA, 18 bp, Homo sapiens
taaaaataaccaaaaaat

SEQ ID NO: 1711012 - DNA, 22 bp, Homo sapiens
taaaaataaccaaaaaatgtga

SEQ ID NO: 1711013 - DNA, 15 bp, Homo sapiens
taaaaataagtcaac

SEQ ID NO: 1711014 - DNA, 21 bp, Homo sapiens
taaaaatagatcaataaatgt

SEQ ID NO: 1711015 - DNA, 15 bp, Homo sapiens
taaaaatatacatgt

SEQ ID NO: 1711016 - DNA, 17 bp, Homo sapiens
taaaaatatacatgttt

SEQ ID NO: 1711017 - DNA, 21 bp, Homo sapiens
taaaaatatacatgtttatgt

SEQ ID NO: 1711018 - DNA, 14 bp, Homo sapiens
taaaaatattgtgt

SEQ ID NO: 1711019 - DNA, 21 bp, Homo sapiens
taaaaatattgtgttgtgaat

SEQ ID NO: 1711020 - DNA, 17 bp, Homo sapiens
taaaaatcactatgatt

SEQ ID NO: 1711021 - DNA, 11 bp, Homo sapiens
taaaaatcttt

SEQ ID NO: 1711022 - DNA, 22 bp, Homo sapiens
taaaaatgaggtactctcctgg

SEQ ID NO: 1711023 - DNA, 14 bp, Homo sapiens
taaaaatgctgctc

SEQ ID NO: 1711024 - DNA, 23 bp, Homo sapiens
taaaaatggcagggggtggaatt

SEQ ID NO: 1711025 - DNA, 21 bp, Homo sapiens
taaaaattaatagttttatct

SEQ ID NO: 1711026 - DNA, 20 bp, Homo sapiens
taaaaattacttttaaatat

SEQ ID NO: 1711027 - DNA, 16 bp, Homo sapiens
taaaaattatcaaaaa

SEQ ID NO: 1711028 - DNA, 19 bp, Homo sapiens
taaaaattatcaaaaagct

SEQ ID NO: 1711029 - DNA, 14 bp, Homo sapiens
taaaaattccacca

SEQ ID NO: 1711030 - DNA, 22 bp, Homo sapiens
taaaaattgttaatttttccta

SEQ ID NO: 1711031 - DNA, 17 bp, Homo sapiens
taaaaattgtttcttga

SEQ ID NO: 1711032 - DNA, 15 bp, Homo sapiens
taaaacaaatataca

SEQ ID NO: 1711033 - DNA, 19 bp, Homo sapiens
taaaacaaatatacatttt

SEQ ID NO: 1711034 - DNA, 21 bp, Homo sapiens
taaaacaaatatacattttct

SEQ ID NO: 1711035 - DNA, 20 bp, Homo sapiens
taaaacaataaatgaatgaa

SEQ ID NO: 1711036 - DNA, 18 bp, Homo sapiens
taaaacaatattgtttct

SEQ ID NO: 1711037 - DNA, 13 bp, Homo sapiens
taaaacaatgcca

SEQ ID NO: 1711038 - DNA, 14 bp, Homo sapiens
taaaacaatgccat

SEQ ID NO: 1711039 - DNA, 20 bp, Homo sapiens
taaaacaatgccatgaacaa

SEQ ID NO: 1711040 - DNA, 13 bp, Homo sapiens
taaaacacagctt

SEQ ID NO: 1711041 - DNA, 16 bp, Homo sapiens
cagggggcctggagca

SEQ ID NO: 1711042 - DNA, 18 bp, Homo sapiens
caggggtcctgcaggtcc

SEQ ID NO: 1711043 - DNA, 20 bp, Homo sapiens
caggggtcctgcaggtcctg

SEQ ID NO: 1711044 - DNA, 21 bp, Homo sapiens
caggggtcgtcaccacctctc

SEQ ID NO: 1711045 - DNA, 19 bp, Homo sapiens
caggggtctccctggctcc

SEQ ID NO: 1711046 - DNA, 21 bp, Homo sapiens
caggggtctccctggctccct

SEQ ID NO: 1711047 - DNA, 22 bp, Homo sapiens
caggggtgccccctcctctccc

SEQ ID NO: 1711048 - DNA, 17 bp, Homo sapiens
caggggtgctgtggaca

SEQ ID NO: 1711049 - DNA, 13 bp, Homo sapiens
caggggtggagaa

SEQ ID NO: 1711050 - DNA, 22 bp, Homo sapiens
caggggtggctgcctcatttag

SEQ ID NO: 1711051 - DNA, 12 bp, Homo sapiens
caggggtggggg

SEQ ID NO: 1711052 - DNA, 19 bp, Homo sapiens
caggggttggtcaaggcca

SEQ ID NO: 1711053 - DNA, 13 bp, Homo sapiens
caggggtttctcg

SEQ ID NO: 1711054 - DNA, 22 bp, Homo sapiens
cagggtacccgcctgagctcct

SEQ ID NO: 1711055 - DNA, 17 bp, Homo sapiens
cagggtacctcaagccc

SEQ ID NO: 1711056 - DNA, 23 bp, Homo sapiens
cagggtagacttggagctgtcct

SEQ ID NO: 1711057 - DNA, 15 bp, Homo sapiens
cagggtaggaaaggg

SEQ ID NO: 1711058 - DNA, 23 bp, Homo sapiens
cagggtatggactatctgtctgg

SEQ ID NO: 1711059 - DNA, 16 bp, Homo sapiens
cagggtcaaagacaga

SEQ ID NO: 1711060 - DNA, 13 bp, Homo sapiens
cagggtccacagc

SEQ ID NO: 1711061 - DNA, 17 bp, Homo sapiens
cagggtccacagctgga

SEQ ID NO: 1711062 - DNA, 19 bp, Homo sapiens
cagggtccacagctggaaa

SEQ ID NO: 1711063 - DNA, 14 bp, Homo sapiens
cagggtccagaccc

SEQ ID NO: 1711064 - DNA, 13 bp, Homo sapiens
cagggtccctctg

SEQ ID NO: 1711065 - DNA, 17 bp, Homo sapiens
cagggtccgcaccagct

SEQ ID NO: 1711066 - DNA, 19 bp, Homo sapiens
cagggtccgcaccagctgc

SEQ ID NO: 1711067 - DNA, 20 bp, Homo sapiens
cagggtccgcaccagctgct

SEQ ID NO: 1711068 - DNA, 23 bp, Homo sapiens
cagggtccgcaccagctgctctg

SEQ ID NO: 1711069 - DNA, 13 bp, Homo sapiens
cagggtcctgtgc

SEQ ID NO: 1711070 - DNA, 21 bp, Homo sapiens
cagggtccttttgacactgct

SEQ ID NO: 1711071 - DNA, 22 bp, Homo sapiens
cagggtccttttgacactgctc

SEQ ID NO: 1711072 - DNA, 20 bp, Homo sapiens
cagggtctgctctttctctg

SEQ ID NO: 1711073 - DNA, 17 bp, Homo sapiens
cagggtcttccctacct

SEQ ID NO: 1711074 - DNA, 22 bp, Homo sapiens
cagggtcttggctgcctgtggg

SEQ ID NO: 1711075 - DNA, 14 bp, Homo sapiens
cagggtcttgggct

SEQ ID NO: 1711076 - DNA, 15 bp, Homo sapiens
cagggtcttgggcta

SEQ ID NO: 1711077 - DNA, 21 bp, Homo sapiens
cagggtcttgggctactggca

SEQ ID NO: 1711078 - DNA, 15 bp, Homo sapiens
cagggtgagaagcta

SEQ ID NO: 1711079 - DNA, 20 bp, Homo sapiens
cagggtgggaagaaagaatg

SEQ ID NO: 1711080 - DNA, 14 bp, Homo sapiens
cagggtgggagagc

SEQ ID NO: 1711081 - DNA, 12 bp, Homo sapiens
cagggtgggggg

SEQ ID NO: 1711082 - DNA, 22 bp, Homo sapiens
cagggtggtctcttcttggggc

SEQ ID NO: 1711083 - DNA, 17 bp, Homo sapiens
cagggtggtgctgggac

SEQ ID NO: 1711084 - DNA, 19 bp, Homo sapiens
cagggtgtggccctgccat

SEQ ID NO: 1711085 - DNA, 15 bp, Homo sapiens
cagggttaagaagac

SEQ ID NO: 1711086 - DNA, 20 bp, Homo sapiens
cagggttaggaatctcttca

SEQ ID NO: 1711087 - DNA, 18 bp, Homo sapiens
cagggttcaaaatgtctg

SEQ ID NO: 1711088 - DNA, 23 bp, Homo sapiens
cagggttctcttagcaactcaga

SEQ ID NO: 1711089 - DNA, 14 bp, Homo sapiens
cagggttgggccca

SEQ ID NO: 1711090 - DNA, 15 bp, Homo sapiens
cagggttgggcccag

SEQ ID NO: 1711091 - DNA, 20 bp, Homo sapiens
cagggttgggcccagatctg

SEQ ID NO: 1711092 - DNA, 21 bp, Homo sapiens
cagggttgggcccagatctgg

SEQ ID NO: 1711093 - DNA, 22 bp, Homo sapiens
cagggtttcaccatgttggcca

SEQ ID NO: 1711094 - DNA, 23 bp, Homo sapiens
cagggttttgccccaagtcctca

SEQ ID NO: 1711095 - DNA, 14 bp, Homo sapiens
caggtaaaacaggg

SEQ ID NO: 1711096 - DNA, 15 bp, Homo sapiens
caggtaaaacagggc

SEQ ID NO: 1711097 - DNA, 14 bp, Homo sapiens
caggtaatatacct

SEQ ID NO: 1711098 - DNA, 20 bp, Homo sapiens
caggtaatatacctggttta

SEQ ID NO: 1711099 - DNA, 13 bp, Homo sapiens
caggtaatgtgaa

SEQ ID NO: 1711100 - DNA, 15 bp, Homo sapiens
caggtacaggagagg

SEQ ID NO: 1711101 - DNA, 17 bp, Homo sapiens
caggtacaggagaggca

SEQ ID NO: 1711102 - DNA, 18 bp, Homo sapiens
caggtacaggagaggcag

SEQ ID NO: 1711103 - DNA, 20 bp, Homo sapiens
caggtacaggagaggcagca

SEQ ID NO: 1711104 - DNA, 14 bp, Homo sapiens
caggtaccagctgc

SEQ ID NO: 1711105 - DNA, 15 bp, Homo sapiens
caggtaccagctgcg

SEQ ID NO: 1711106 - DNA, 17 bp, Homo sapiens
caggtaccagctgcgct

SEQ ID NO: 1711107 - DNA, 14 bp, Homo sapiens
caggtaccgtgctc

SEQ ID NO: 1711108 - DNA, 16 bp, Homo sapiens
caggtacttcctcctg

SEQ ID NO: 1711109 - DNA, 17 bp, Homo sapiens
caggtacttcctcctga

SEQ ID NO: 1711110 - DNA, 22 bp, Homo sapiens
caggtacttcctcctgatggcc

SEQ ID NO: 1711111 - DNA, 13 bp, Homo sapiens
caggtactttggt

SEQ ID NO: 1711112 - DNA, 20 bp, Homo sapiens
caggtagaattatctaattt

SEQ ID NO: 1711113 - DNA, 17 bp, Homo sapiens
taaaagttgaaaagcca

SEQ ID NO: 1711114 - DNA, 18 bp, Homo sapiens
taaaagttgaaaagccaa

SEQ ID NO: 1711115 - DNA, 19 bp, Homo sapiens
taaaagttttatatgcttt

SEQ ID NO: 1711116 - DNA, 15 bp, Homo sapiens
taaaataaaaatgaa

SEQ ID NO: 1711117 - DNA, 13 bp, Homo sapiens
taaaataaactag

SEQ ID NO: 1711118 - DNA, 13 bp, Homo sapiens
taaaataaagcct

SEQ ID NO: 1711119 - DNA, 15 bp, Homo sapiens
taaaataaagcctat

SEQ ID NO: 1711120 - DNA, 22 bp, Homo sapiens
taaaataagaatagaacaacat

SEQ ID NO: 1711121 - DNA, 20 bp, Homo sapiens
taaaataattatataactgt

SEQ ID NO: 1711122 - DNA, 14 bp, Homo sapiens
taaaataccactgt

SEQ ID NO: 1711123 - DNA, 16 bp, Homo sapiens
taaaataccactgtaa

SEQ ID NO: 1711124 - DNA, 21 bp, Homo sapiens
taaaatacgatcggtttcata

SEQ ID NO: 1711125 - DNA, 22 bp, Homo sapiens
taaaatactctagcctgggcca

SEQ ID NO: 1711126 - DNA, 23 bp, Homo sapiens
taaaatactctagcctgggccag

SEQ ID NO: 1711127 - DNA, 14 bp, Homo sapiens
taaaatacttttac

SEQ ID NO: 1711128 - DNA, 21 bp, Homo sapiens
taaaatacttttactctgcct

SEQ ID NO: 1711129 - DNA, 19 bp, Homo sapiens
taaaatagaataattcttt

SEQ ID NO: 1711130 - DNA, 16 bp, Homo sapiens
taaaatagagtgtagt

SEQ ID NO: 1711131 - DNA, 22 bp, Homo sapiens
taaaatatattgctgcatttta

SEQ ID NO: 1711132 - DNA, 18 bp, Homo sapiens
taaaatatcataaagcat

SEQ ID NO: 1711133 - DNA, 19 bp, Homo sapiens
taaaatatcataaagcatt

SEQ ID NO: 1711134 - DNA, 14 bp, Homo sapiens
taaaatatgtaaaa

SEQ ID NO: 1711135 - DNA, 15 bp, Homo sapiens
taaaatattcactct

SEQ ID NO: 1711136 - DNA, 16 bp, Homo sapiens
taaaatattcactctc

SEQ ID NO: 1711137 - DNA, 20 bp, Homo sapiens
taaaatatttatgaagaaaa

SEQ ID NO: 1711138 - DNA, 13 bp, Homo sapiens
taaaatatttccc

SEQ ID NO: 1711139 - DNA, 18 bp, Homo sapiens
taaaatcaacttaacatg

SEQ ID NO: 1711140 - DNA, 21 bp, Homo sapiens
taaaatcataagtatttggaa

SEQ ID NO: 1711141 - DNA, 18 bp, Homo sapiens
taaaatcatgaaacttgt

SEQ ID NO: 1711142 - DNA, 10 bp, Homo sapiens
taaaatcatt

SEQ ID NO: 1711143 - DNA, 22 bp, Homo sapiens
taaaatcatttctgcatcagct

SEQ ID NO: 1711144 - DNA, 20 bp, Homo sapiens
taaaatccaaaatgaatgca

SEQ ID NO: 1711145 - DNA, 12 bp, Homo sapiens
taaaatctctga

SEQ ID NO: 1711146 - DNA, 13 bp, Homo sapiens
taaaatctgtgaa

SEQ ID NO: 1711147 - DNA, 14 bp, Homo sapiens
taaaatctgtgaat

SEQ ID NO: 1711148 - DNA, 18 bp, Homo sapiens
taaaatctgtttttctca

SEQ ID NO: 1711149 - DNA, 20 bp, Homo sapiens
taaaatcttggcacagaaac

SEQ ID NO: 1711150 - DNA, 11 bp, Homo sapiens
taaaatcttgt

SEQ ID NO: 1711151 - DNA, 15 bp, Homo sapiens
taaaatcttgtcatg

SEQ ID NO: 1711152 - DNA, 18 bp, Homo sapiens
taaaatcttgtcatgtgt

SEQ ID NO: 1711153 - DNA, 19 bp, Homo sapiens
taaaatcttgtcatgtgta

SEQ ID NO: 1711154 - DNA, 21 bp, Homo sapiens
taaaatcttgtcatgtgtata

SEQ ID NO: 1711155 - DNA, 14 bp, Homo sapiens
taaaatgaaattac

SEQ ID NO: 1711156 - DNA, 21 bp, Homo sapiens
taaaatgaacatctcttgaaa

SEQ ID NO: 1711157 - DNA, 15 bp, Homo sapiens
taaaatgaacatttt

SEQ ID NO: 1711158 - DNA, 17 bp, Homo sapiens
taaaatgcaaaaaatct

SEQ ID NO: 1711159 - DNA, 14 bp, Homo sapiens
gtggctccccctct

SEQ ID NO: 1711160 - DNA, 18 bp, Homo sapiens
gtggctccccctctgctt

SEQ ID NO: 1711161 - DNA, 15 bp, Homo sapiens
gtggctcgctccctg

SEQ ID NO: 1711162 - DNA, 11 bp, Homo sapiens
gtggctgaaaa

SEQ ID NO: 1711163 - DNA, 14 bp, Homo sapiens
gtggctgacccagt

SEQ ID NO: 1711164 - DNA, 16 bp, Homo sapiens
gtggctgcctcattta

SEQ ID NO: 1711165 - DNA, 17 bp, Homo sapiens
gtggctgctagcacttg

SEQ ID NO: 1711166 - DNA, 17 bp, Homo sapiens
gtggctggaggagctgg

SEQ ID NO: 1711167 - DNA, 22 bp, Homo sapiens
gtggctggaggagctggcctgt

SEQ ID NO: 1711168 - DNA, 23 bp, Homo sapiens
gtggctggaggagctggcctgtg

SEQ ID NO: 1711169 - DNA, 12 bp, Homo sapiens
gtggctgggccc

SEQ ID NO: 1711170 - DNA, 16 bp, Homo sapiens
gtggctgggggcagga

SEQ ID NO: 1711171 - DNA, 17 bp, Homo sapiens
gtggctgggggcaggag

SEQ ID NO: 1711172 - DNA, 17 bp, Homo sapiens
gtggctggtccagggct

SEQ ID NO: 1711173 - DNA, 19 bp, Homo sapiens
gtggcttaagtgagcagaa

SEQ ID NO: 1711174 - DNA, 20 bp, Homo sapiens
gtggcttcccgctcagccct

SEQ ID NO: 1711175 - DNA, 21 bp, Homo sapiens
gtggcttcccgctcagccctc

SEQ ID NO: 1711176 - DNA, 12 bp, Homo sapiens
gtggcttgggga

SEQ ID NO: 1711177 - DNA, 16 bp, Homo sapiens
gtggctttggcagtgt

SEQ ID NO: 1711178 - DNA, 18 bp, Homo sapiens
gtggctttggcagtgttt

SEQ ID NO: 1711179 - DNA, 18 bp, Homo sapiens
gtggctttttgttcagaa

SEQ ID NO: 1711180 - DNA, 20 bp, Homo sapiens
gtgggacacctgggagaagg

SEQ ID NO: 1711181 - DNA, 22 bp, Homo sapiens
gtgggacactgggcagcaaggc

SEQ ID NO: 1711182 - DNA, 16 bp, Homo sapiens
gtgggagacagcagcc

SEQ ID NO: 1711183 - DNA, 14 bp, Homo sapiens
gtgggagagcccag

SEQ ID NO: 1711184 - DNA, 15 bp, Homo sapiens
gtgggagagcccagc

SEQ ID NO: 1711185 - DNA, 17 bp, Homo sapiens
gtgggagctcctccgca

SEQ ID NO: 1711186 - DNA, 17 bp, Homo sapiens
gtgggagctgaaaagga

SEQ ID NO: 1711187 - DNA, 14 bp, Homo sapiens
gtgggagctgagct

SEQ ID NO: 1711188 - DNA, 20 bp, Homo sapiens
gtgggaggaaagggcctggc

SEQ ID NO: 1711189 - DNA, 21 bp, Homo sapiens
gtgggaggaaagggcctggcc

SEQ ID NO: 1711190 - DNA, 23 bp, Homo sapiens
gtgggaggaaagggcctggccag

SEQ ID NO: 1711191 - DNA, 13 bp, Homo sapiens
gtgggaggggcag

SEQ ID NO: 1711192 - DNA, 17 bp, Homo sapiens
gtgggaggggcaggctg

SEQ ID NO: 1711193 - DNA, 19 bp, Homo sapiens
gtgggaggggcccacagga

SEQ ID NO: 1711194 - DNA, 15 bp, Homo sapiens
gtgggatacttagtg

SEQ ID NO: 1711195 - DNA, 15 bp, Homo sapiens
gtgggatcctccctc

SEQ ID NO: 1711196 - DNA, 20 bp, Homo sapiens
gtgggatcctccctcatggc

SEQ ID NO: 1711197 - DNA, 17 bp, Homo sapiens
gtgggatgaaccagccg

SEQ ID NO: 1711198 - DNA, 14 bp, Homo sapiens
gtgggatttgtaaa

SEQ ID NO: 1711199 - DNA, 15 bp, Homo sapiens
gtgggcagctgggcc

SEQ ID NO: 1711200 - DNA, 17 bp, Homo sapiens
gtgggcagctgggcccc

SEQ ID NO: 1711201 - DNA, 21 bp, Homo sapiens
gtgggcaggatctcaagccag

SEQ ID NO: 1711202 - DNA, 12 bp, Homo sapiens
gtgggcaggtgg

SEQ ID NO: 1711203 - DNA, 14 bp, Homo sapiens
gtgggcaggtggcc

SEQ ID NO: 1711204 - DNA, 17 bp, Homo sapiens
gtgggcaggtggtggca

SEQ ID NO: 1711205 - DNA, 21 bp, Homo sapiens
gtgggccaccatgtctggcta

SEQ ID NO: 1711206 - DNA, 12 bp, Homo sapiens
gtgggccagagc

SEQ ID NO: 1711207 - DNA, 15 bp, Homo sapiens
gtgggccagagctga

SEQ ID NO: 1711208 - DNA, 19 bp, Homo sapiens
gtgggccagccacagagca

SEQ ID NO: 1711209 - DNA, 22 bp, Homo sapiens
gtgggcccacccggtgggaccc

SEQ ID NO: 1711210 - DNA, 11 bp, Homo sapiens
gtgggcccagg

SEQ ID NO: 1711211 - DNA, 19 bp, Homo sapiens
gtgggcccaggaccagctg

SEQ ID NO: 1711212 - DNA, 22 bp, Homo sapiens
gtgggcccaggaccagctgggg

SEQ ID NO: 1711213 - DNA, 21 bp, Homo sapiens
gtgggccccgggctggagaaa

SEQ ID NO: 1711214 - DNA, 19 bp, Homo sapiens
gtgggccctgagtcctggt

SEQ ID NO: 1711215 - DNA, 20 bp, Homo sapiens
gtgggcctcctctgtccagg

SEQ ID NO: 1711216 - DNA, 23 bp, Homo sapiens
gtgggcctcctctgtccagggcc

SEQ ID NO: 1711217 - DNA, 15 bp, Homo sapiens
gtgggcctggcctga

SEQ ID NO: 1711218 - DNA, 17 bp, Homo sapiens
gtgggcctggcctgagc

SEQ ID NO: 1711219 - DNA, 19 bp, Homo sapiens
gtgggcctggcctgagctg

SEQ ID NO: 1711220 - DNA, 20 bp, Homo sapiens
gtgggcctggcctgagctgg

SEQ ID NO: 1711221 - DNA, 22 bp, Homo sapiens
gtgggcctggcctgagctgggg

SEQ ID NO: 1711222 - DNA, 22 bp, Homo sapiens
gtgggcctgtcgtgccagtcct

SEQ ID NO: 1711223 - DNA, 15 bp, Homo sapiens
gtgggcctgtgtgtg

SEQ ID NO: 1711224 - DNA, 17 bp, Homo sapiens
gtgggcgcccaccctgg

SEQ ID NO: 1711225 - DNA, 22 bp, Homo sapiens
gtgggcgcccaccctgggctcc

SEQ ID NO: 1711226 - DNA, 16 bp, Homo sapiens
gtgggctacatgctgg

SEQ ID NO: 1711227 - DNA, 19 bp, Homo sapiens
gtgggctacatgctggggt

SEQ ID NO: 1711228 - DNA, 14 bp, Homo sapiens
gtgggctgagccct

SEQ ID NO: 1711229 - DNA, 20 bp, Homo sapiens
gtgggctgggccctctcttc

SEQ ID NO: 1711230 - DNA, 12 bp, Homo sapiens
gtgggctggggc

SEQ ID NO: 1711231 - DNA, 13 bp, Homo sapiens
gtgggctggggct

SEQ ID NO: 1711232 - DNA, 12 bp, Homo sapiens
gtgggctgttca

SEQ ID NO: 1711233 - DNA, 17 bp, Homo sapiens
gtgggctgttcagcttc

SEQ ID NO: 1711234 - DNA, 17 bp, Homo sapiens
gtgggcttatgtctctg

SEQ ID NO: 1711235 - DNA, 16 bp, Homo sapiens
gtggggaacacagcta

SEQ ID NO: 1711236 - DNA, 20 bp, Homo sapiens
gtggggaacatggctggcct

SEQ ID NO: 1711237 - DNA, 19 bp, Homo sapiens
gtggggacacagcagtgag

SEQ ID NO: 1711238 - DNA, 13 bp, Homo sapiens
gtggggagacctg

SEQ ID NO: 1711239 - DNA, 17 bp, Homo sapiens
gtggggagacctggttg

SEQ ID NO: 1711240 - DNA, 20 bp, Homo sapiens
gtggggagcagttttcccct

SEQ ID NO: 1711241 - DNA, 21 bp, Homo sapiens
gtggggagcagttttcccctg

SEQ ID NO: 1711242 - DNA, 23 bp, Homo sapiens
gtggggagcagttttcccctggc

SEQ ID NO: 1711243 - DNA, 16 bp, Homo sapiens
gtggggaggaaataga

SEQ ID NO: 1711244 - DNA, 13 bp, Homo sapiens
gtggggagggccg

SEQ ID NO: 1711245 - DNA, 13 bp, Homo sapiens
gtggggcagggag

SEQ ID NO: 1711246 - DNA, 12 bp, Homo sapiens
gtggggccagga

SEQ ID NO: 1711247 - DNA, 12 bp, Homo sapiens
gtggggcccact

SEQ ID NO: 1711248 - DNA, 13 bp, Homo sapiens
gtggggccctgcc

SEQ ID NO: 1711249 - DNA, 23 bp, Homo sapiens
gtggggcccttgggccacgctct

SEQ ID NO: 1711250 - DNA, 15 bp, Homo sapiens
gtggggcgtggatcg

SEQ ID NO: 1711251 - DNA, 21 bp, Homo sapiens
gtggggctcacttttcatcct

SEQ ID NO: 1711252 - DNA, 12 bp, Homo sapiens
gtggggctgctc

SEQ ID NO: 1711253 - DNA, 12 bp, Homo sapiens
gtggggctggca

SEQ ID NO: 1711254 - DNA, 12 bp, Homo sapiens
gtggggcttggg

SEQ ID NO: 1711255 - DNA, 14 bp, Homo sapiens
gtgggggagggagg

SEQ ID NO: 1711256 - DNA, 17 bp, Homo sapiens
gtgggggcagagggcag

SEQ ID NO: 1711257 - DNA, 18 bp, Homo sapiens
gtgggggcagagggcaga

SEQ ID NO: 1711258 - DNA, 22 bp, Homo sapiens
gtgggggcagagggcagaggct

SEQ ID NO: 1711259 - DNA, 17 bp, Homo sapiens
gtgggggctgtcctgct

SEQ ID NO: 1711260 - DNA, 21 bp, Homo sapiens
gtgggggctgtcctgctcacc

SEQ ID NO: 1711261 - DNA, 16 bp, Homo sapiens
gtggggggtccagtct

SEQ ID NO: 1711262 - DNA, 13 bp, Homo sapiens
gtggggggtcctt

SEQ ID NO: 1711263 - DNA, 17 bp, Homo sapiens
gtggggggtctgtgtca

SEQ ID NO: 1711264 - DNA, 19 bp, Homo sapiens
gtgggggtagagctgatcc

SEQ ID NO: 1711265 - DNA, 19 bp, Homo sapiens
gtgggggtcatcagggagg

SEQ ID NO: 1711266 - DNA, 20 bp, Homo sapiens
gtgggggtggaggcttcctg

SEQ ID NO: 1711267 - DNA, 16 bp, Homo sapiens
gtggggtacaggcagt

SEQ ID NO: 1711268 - DNA, 13 bp, Homo sapiens
gtgtatgtggggg

SEQ ID NO: 1711269 - DNA, 18 bp, Homo sapiens
gtgtatgtttcttagccc

SEQ ID NO: 1711270 - DNA, 14 bp, Homo sapiens
gtgtattatcattt

SEQ ID NO: 1711271 - DNA, 19 bp, Homo sapiens
gtgtatttccagtgcaatt

SEQ ID NO: 1711272 - DNA, 19 bp, Homo sapiens
gtgtatttgctaattttta

SEQ ID NO: 1711273 - DNA, 14 bp, Homo sapiens
gtgtatttgtatta

SEQ ID NO: 1711274 - DNA, 15 bp, Homo sapiens
gtgtatttgtattaa

SEQ ID NO: 1711275 - DNA, 21 bp, Homo sapiens
gtgtatttgtattaataaagc

SEQ ID NO: 1711276 - DNA, 21 bp, Homo sapiens
gtgtcaagctgctctgagcca

SEQ ID NO: 1711277 - DNA, 23 bp, Homo sapiens
gtgtcaagttgtgcttgtttaca

SEQ ID NO: 1711278 - DNA, 19 bp, Homo sapiens
caggagcagctgtgctgca

SEQ ID NO: 1711279 - DNA, 21 bp, Homo sapiens
caggagcagcttttggtctcc

SEQ ID NO: 1711280 - DNA, 22 bp, Homo sapiens
caggagcccctggggctgtatt

SEQ ID NO: 1711281 - DNA, 19 bp, Homo sapiens
caggagcctaccccctgaa

SEQ ID NO: 1711282 - DNA, 12 bp, Homo sapiens
caggagcctagc

SEQ ID NO: 1711283 - DNA, 16 bp, Homo sapiens
caggagcctagcggag

SEQ ID NO: 1711284 - DNA, 11 bp, Homo sapiens
caggagcctgg

SEQ ID NO: 1711285 - DNA, 12 bp, Homo sapiens
caggagcctggc

SEQ ID NO: 1711286 - DNA, 19 bp, Homo sapiens
caggagccttcctttctcc

SEQ ID NO: 1711287 - DNA, 15 bp, Homo sapiens
caggagcgcaagata

SEQ ID NO: 1711288 - DNA, 21 bp, Homo sapiens
caggagctagttctcagcttg

SEQ ID NO: 1711289 - DNA, 13 bp, Homo sapiens
caggagctctgcg

SEQ ID NO: 1711290 - DNA, 20 bp, Homo sapiens
caggagctctgcgccaggca

SEQ ID NO: 1711291 - DNA, 18 bp, Homo sapiens
caggagctcttcaggcct

SEQ ID NO: 1711292 - DNA, 19 bp, Homo sapiens
caggagctcttcaggcctc

SEQ ID NO: 1711293 - DNA, 15 bp, Homo sapiens
caggagctgatggca

SEQ ID NO: 1711294 - DNA, 19 bp, Homo sapiens
caggagctgatggcagctg

SEQ ID NO: 1711295 - DNA, 20 bp, Homo sapiens
caggagctgatggcagctgg

SEQ ID NO: 1711296 - DNA, 13 bp, Homo sapiens
caggagctgccca

SEQ ID NO: 1711297 - DNA, 12 bp, Homo sapiens
caggagctgggc

SEQ ID NO: 1711298 - DNA, 22 bp, Homo sapiens
caggagctgtcaccaaggaaac

SEQ ID NO: 1711299 - DNA, 15 bp, Homo sapiens
caggaggcaggcatg

SEQ ID NO: 1711300 - DNA, 21 bp, Homo sapiens
caggaggcaggcatggccctg

SEQ ID NO: 1711301 - DNA, 18 bp, Homo sapiens
caggaggcccctggccca

SEQ ID NO: 1711302 - DNA, 20 bp, Homo sapiens
caggaggcccctggcccagc

SEQ ID NO: 1711303 - DNA, 23 bp, Homo sapiens
caggaggccgagtggctgccgga

SEQ ID NO: 1711304 - DNA, 13 bp, Homo sapiens
caggaggcgccct

SEQ ID NO: 1711305 - DNA, 16 bp, Homo sapiens
caggaggcggcccggc

SEQ ID NO: 1711306 - DNA, 13 bp, Homo sapiens
caggaggctgaga

SEQ ID NO: 1711307 - DNA, 15 bp, Homo sapiens
caggaggctgaggca

SEQ ID NO: 1711308 - DNA, 16 bp, Homo sapiens
caggaggctgaggcag

SEQ ID NO: 1711309 - DNA, 14 bp, Homo sapiens
caggaggctgaggt

SEQ ID NO: 1711310 - DNA, 13 bp, Homo sapiens
caggaggctggag

SEQ ID NO: 1711311 - DNA, 18 bp, Homo sapiens
caggaggctggaggaagg

SEQ ID NO: 1711312 - DNA, 19 bp, Homo sapiens
caggagggaggtttgtgag

SEQ ID NO: 1711313 - DNA, 23 bp, Homo sapiens
caggagggaggtttgtgagagcg

SEQ ID NO: 1711314 - DNA, 13 bp, Homo sapiens
caggagggccagc

SEQ ID NO: 1711315 - DNA, 15 bp, Homo sapiens
caggaggggcagcgc

SEQ ID NO: 1711316 - DNA, 19 bp, Homo sapiens
caggaggggtgagtcccct

SEQ ID NO: 1711317 - DNA, 17 bp, Homo sapiens
caggaggtgcttgaggc

SEQ ID NO: 1711318 - DNA, 19 bp, Homo sapiens
caggaggtggaggttgcag

SEQ ID NO: 1711319 - DNA, 20 bp, Homo sapiens
caggaggttctgggcctctg

SEQ ID NO: 1711320 - DNA, 23 bp, Homo sapiens
caggaggttctgggcctctgaac

SEQ ID NO: 1711321 - DNA, 20 bp, Homo sapiens
caggaggttggtgactgaaa

SEQ ID NO: 1711322 - DNA, 21 bp, Homo sapiens
caggaggttgtggatgctcca

SEQ ID NO: 1711323 - DNA, 23 bp, Homo sapiens
caggaggttgtggatgctccagg

SEQ ID NO: 1711324 - DNA, 18 bp, Homo sapiens
caggagtccactttgttt

SEQ ID NO: 1711325 - DNA, 16 bp, Homo sapiens
caggagtcccaaggaa

SEQ ID NO: 1711326 - DNA, 13 bp, Homo sapiens
caggagtccctgg

SEQ ID NO: 1711327 - DNA, 14 bp, Homo sapiens
caggagtccctggt

SEQ ID NO: 1711328 - DNA, 13 bp, Homo sapiens
caggagtctgcca

SEQ ID NO: 1711329 - DNA, 14 bp, Homo sapiens
caggagtctgccac

SEQ ID NO: 1711330 - DNA, 16 bp, Homo sapiens
caggagtcttcagacc

SEQ ID NO: 1711331 - DNA, 14 bp, Homo sapiens
caggagtgccagga

SEQ ID NO: 1711332 - DNA, 15 bp, Homo sapiens
caggagtgccaggac

SEQ ID NO: 1711333 - DNA, 18 bp, Homo sapiens
caggagtgccaggaccag

SEQ ID NO: 1711334 - DNA, 16 bp, Homo sapiens
caggagtgtcctgccc

SEQ ID NO: 1711335 - DNA, 18 bp, Homo sapiens
caggagtgtcctggctgt

SEQ ID NO: 1711336 - DNA, 19 bp, Homo sapiens
caggagtgtcctggctgtg

SEQ ID NO: 1711337 - DNA, 17 bp, Homo sapiens
caggagttagaggccag

SEQ ID NO: 1711338 - DNA, 18 bp, Homo sapiens
caggagttagaggccagc

SEQ ID NO: 1711339 - DNA, 20 bp, Homo sapiens
caggagttagaggccagcct

SEQ ID NO: 1711340 - DNA, 21 bp, Homo sapiens
caggagttcaagaccagcctg

SEQ ID NO: 1711341 - DNA, 21 bp, Homo sapiens
caggagttcaagactagcctg

SEQ ID NO: 1711342 - DNA, 23 bp, Homo sapiens
caggagttcaataaatgtctgtt

SEQ ID NO: 1711343 - DNA, 14 bp, Homo sapiens
caggagttgtgtct

SEQ ID NO: 1711344 - DNA, 21 bp, Homo sapiens
caggagtttaagaccagcctg

SEQ ID NO: 1711345 - DNA, 20 bp, Homo sapiens
caggagtttgagacaagccc

SEQ ID NO: 1711346 - DNA, 21 bp, Homo sapiens
caggagtttgagacaagccct

SEQ ID NO: 1711347 - DNA, 23 bp, Homo sapiens
caggagtttgagacaagccctgg

SEQ ID NO: 1711348 - DNA, 16 bp, Homo sapiens
caggagtttgagacca

SEQ ID NO: 1711349 - DNA, 22 bp, Homo sapiens
caggagtttgaggctgcagcga

SEQ ID NO: 1711350 - DNA, 17 bp, Homo sapiens
caggatactctgtcaga

SEQ ID NO: 1711351 - DNA, 20 bp, Homo sapiens
caggatactctgtcagatgg

SEQ ID NO: 1711352 - DNA, 19 bp, Homo sapiens
caggatactggcacagagg

SEQ ID NO: 1711353 - DNA, 16 bp, Homo sapiens
caggatatctgaaaat

SEQ ID NO: 1711354 - DNA, 13 bp, Homo sapiens
caggatattagtt

SEQ ID NO: 1711355 - DNA, 20 bp, Homo sapiens
caggatattagttaatgagc

SEQ ID NO: 1711356 - DNA, 22 bp, Homo sapiens
caggatattggttcttcccctc

SEQ ID NO: 1711357 - DNA, 16 bp, Homo sapiens
caggatcactctctgc

SEQ ID NO: 1711358 - DNA, 17 bp, Homo sapiens
caggatcactctctgct

SEQ ID NO: 1711359 - DNA, 19 bp, Homo sapiens
caggatcactctctgctgg

SEQ ID NO: 1711360 - DNA, 20 bp, Homo sapiens
caggatcactctctgctggc

SEQ ID NO: 1711361 - DNA, 13 bp, Homo sapiens
caggatccctcct

SEQ ID NO: 1711362 - DNA, 19 bp, Homo sapiens
caggatccctcctgagctc

SEQ ID NO: 1711363 - DNA, 21 bp, Homo sapiens
caggatccctcctgagctcgg

SEQ ID NO: 1711364 - DNA, 22 bp, Homo sapiens
caggatccctcctgagctcggg

SEQ ID NO: 1711365 - DNA, 18 bp, Homo sapiens
caggatccgctgccacca

SEQ ID NO: 1711366 - DNA, 15 bp, Homo sapiens
caggatctcaagcca

SEQ ID NO: 1711367 - DNA, 20 bp, Homo sapiens
caggatctcaagccagcccc

SEQ ID NO: 1711368 - DNA, 15 bp, Homo sapiens
caggatctttgactg

SEQ ID NO: 1711369 - DNA, 16 bp, Homo sapiens
caggatctttgactga

SEQ ID NO: 1711370 - DNA, 21 bp, Homo sapiens
caggatgacacctccatttct

SEQ ID NO: 1711371 - DNA, 15 bp, Homo sapiens
caggatgaccctgcg

SEQ ID NO: 1711372 - DNA, 14 bp, Homo sapiens
caggatgaggacag

SEQ ID NO: 1711373 - DNA, 19 bp, Homo sapiens
caggatgaggacagagggc

SEQ ID NO: 1711374 - DNA, 17 bp, Homo sapiens
caggatgcacatttctg

SEQ ID NO: 1711375 - DNA, 18 bp, Homo sapiens
caggatgccacgcctgga

SEQ ID NO: 1711376 - DNA, 19 bp, Homo sapiens
caggatgctaaagatgatg

SEQ ID NO: 1711377 - DNA, 21 bp, Homo sapiens
caggatggaggggtggtcctg

SEQ ID NO: 1711378 - DNA, 22 bp, Homo sapiens
caggatggaggggtggtcctga

SEQ ID NO: 1711379 - DNA, 23 bp, Homo sapiens
caggatggaggggtggtcctgac

SEQ ID NO: 1711380 - DNA, 18 bp, Homo sapiens
caggatggtctcgatctc

SEQ ID NO: 1711381 - DNA, 19 bp, Homo sapiens
caggatggtctcgatctcc

SEQ ID NO: 1711382 - DNA, 23 bp, Homo sapiens
caggatggtctcgatctcctgac

SEQ ID NO: 1711383 - DNA, 20 bp, Homo sapiens
caggatggtgggcaggatct

SEQ ID NO: 1711384 - DNA, 18 bp, Homo sapiens
caggatgtaggggttaac

SEQ ID NO: 1711385 - DNA, 17 bp, Homo sapiens
caggattcttcccgctc

SEQ ID NO: 1711386 - DNA, 19 bp, Homo sapiens
caggatttaaaaactggaa

SEQ ID NO: 1711387 - DNA, 15 bp, Homo sapiens
caggatttaggcctt

SEQ ID NO: 1711388 - DNA, 16 bp, Homo sapiens
caggattttaatcttt

SEQ ID NO: 1711389 - DNA, 21 bp, Homo sapiens
caggcaaaacacgcaagggca

SEQ ID NO: 1711390 - DNA, 14 bp, Homo sapiens
caggcaaaatcctt

SEQ ID NO: 1711391 - DNA, 21 bp, Homo sapiens
caggcaaacattttctcttag

SEQ ID NO: 1711392 - DNA, 11 bp, Homo sapiens
caggcaaatca

SEQ ID NO: 1711393 - DNA, 12 bp, Homo sapiens
caggcaaattgt

SEQ ID NO: 1711394 - DNA, 14 bp, Homo sapiens
gtgtcactgagctg

SEQ ID NO: 1711395 - DNA, 23 bp, Homo sapiens
gtgtcactttttaaaccactgta

SEQ ID NO: 1711396 - DNA, 14 bp, Homo sapiens
gtgtcagagcccag

SEQ ID NO: 1711397 - DNA, 21 bp, Homo sapiens
gtgtcagagcccagcccagga

SEQ ID NO: 1711398 - DNA, 17 bp, Homo sapiens
gtgtcagctgaggctgg

SEQ ID NO: 1711399 - DNA, 13 bp, Homo sapiens
gtgtcaggcaggt

SEQ ID NO: 1711400 - DNA, 14 bp, Homo sapiens
gtgtcaggcaggtt

SEQ ID NO: 1711401 - DNA, 13 bp, Homo sapiens
gtgtcaggcccgt

SEQ ID NO: 1711402 - DNA, 21 bp, Homo sapiens
gtgtcaggcccgtcggagctg

SEQ ID NO: 1711403 - DNA, 23 bp, Homo sapiens
gtgtcaggcccgtcggagctgcc

SEQ ID NO: 1711404 - DNA, 16 bp, Homo sapiens
gtgtcaggccctctgc

SEQ ID NO: 1711405 - DNA, 19 bp, Homo sapiens
gtgtcaggccctctgcctg

SEQ ID NO: 1711406 - DNA, 21 bp, Homo sapiens
gtgtcaggccctctgcctgca

SEQ ID NO: 1711407 - DNA, 16 bp, Homo sapiens
gtgtcagtatccaggc

SEQ ID NO: 1711408 - DNA, 17 bp, Homo sapiens
gtgtcatgaagaatgtt

SEQ ID NO: 1711409 - DNA, 20 bp, Homo sapiens
gtgtccagagacatgggcct

SEQ ID NO: 1711410 - DNA, 17 bp, Homo sapiens
gtgtccagcacagaagg

SEQ ID NO: 1711411 - DNA, 15 bp, Homo sapiens
gtgtccagcagctgc

SEQ ID NO: 1711412 - DNA, 22 bp, Homo sapiens
gtgtccagcttccaaagcctag

SEQ ID NO: 1711413 - DNA, 13 bp, Homo sapiens
gtgtccagggtcc

SEQ ID NO: 1711414 - DNA, 19 bp, Homo sapiens
gtgtccatgcgctcagggc

SEQ ID NO: 1711415 - DNA, 15 bp, Homo sapiens
gtgtcccaaggagct

SEQ ID NO: 1711416 - DNA, 22 bp, Homo sapiens
gtgtcccagccacgcagggcca

SEQ ID NO: 1711417 - DNA, 19 bp, Homo sapiens
gtgtcccaggcagggagac

SEQ ID NO: 1711418 - DNA, 19 bp, Homo sapiens
gtgtcccatgacccacccc

SEQ ID NO: 1711419 - DNA, 21 bp, Homo sapiens
gtgtcccatgacccacccctg

SEQ ID NO: 1711420 - DNA, 14 bp, Homo sapiens
gtgtccccaacgtc

SEQ ID NO: 1711421 - DNA, 15 bp, Homo sapiens
gtgtcccctgcccca

SEQ ID NO: 1711422 - DNA, 16 bp, Homo sapiens
gtgtcccgcggtgctg

SEQ ID NO: 1711423 - DNA, 18 bp, Homo sapiens
gtgtcccgcggtgctgac

SEQ ID NO: 1711424 - DNA, 14 bp, Homo sapiens
gtgtccctaatgtg

SEQ ID NO: 1711425 - DNA, 14 bp, Homo sapiens
gtgtccctgccttc

SEQ ID NO: 1711426 - DNA, 18 bp, Homo sapiens
gtgtccctggacacagct

SEQ ID NO: 1711427 - DNA, 20 bp, Homo sapiens
gtgtccctggacacagctct

SEQ ID NO: 1711428 - DNA, 16 bp, Homo sapiens
gtgtcctaaggcccat

SEQ ID NO: 1711429 - DNA, 15 bp, Homo sapiens
gtgtcctccaccatg

SEQ ID NO: 1711430 - DNA, 21 bp, Homo sapiens
gtgtcctgaagctgctggagc

SEQ ID NO: 1711431 - DNA, 16 bp, Homo sapiens
gtgtcctgcccatgcc

SEQ ID NO: 1711432 - DNA, 16 bp, Homo sapiens
gtgtcctgcctgtctg

SEQ ID NO: 1711433 - DNA, 20 bp, Homo sapiens
gtgtcctgcctgtctgcccc

SEQ ID NO: 1711434 - DNA, 17 bp, Homo sapiens
gtgtccttgcacctgca

SEQ ID NO: 1711435 - DNA, 22 bp, Homo sapiens
gtgtcgtcttgaacgagcagcc

SEQ ID NO: 1711436 - DNA, 14 bp, Homo sapiens
gtgtctaaaaacac

SEQ ID NO: 1711437 - DNA, 15 bp, Homo sapiens
gtgtctaagattcta

SEQ ID NO: 1711438 - DNA, 18 bp, Homo sapiens
gtgtctaagattctagat

SEQ ID NO: 1711439 - DNA, 19 bp, Homo sapiens
gtgtctaagattctagatc

SEQ ID NO: 1711440 - DNA, 20 bp, Homo sapiens
gtgtctaagattctagatca

SEQ ID NO: 1711441 - DNA, 21 bp, Homo sapiens
gtgtctaggctggaagagcca

SEQ ID NO: 1711442 - DNA, 18 bp, Homo sapiens
gtgtctcactaaagcatg

SEQ ID NO: 1711443 - DNA, 14 bp, Homo sapiens
gtgtctcagcctct

SEQ ID NO: 1711444 - DNA, 13 bp, Homo sapiens
gtgtctccaaccc

SEQ ID NO: 1711445 - DNA, 18 bp, Homo sapiens
gtgtctccaaccccccag

SEQ ID NO: 1711446 - DNA, 19 bp, Homo sapiens
gtgtctccaaccccccagc

SEQ ID NO: 1711447 - DNA, 21 bp, Homo sapiens
gtgtctccaaccccccagcac

SEQ ID NO: 1711448 - DNA, 20 bp, Homo sapiens
gtgtctctcccaccccggcc

SEQ ID NO: 1711449 - DNA, 19 bp, Homo sapiens
gtgtctgaacaatctccaa

SEQ ID NO: 1711450 - DNA, 15 bp, Homo sapiens
gtgtctgcagtcctg

SEQ ID NO: 1711451 - DNA, 18 bp, Homo sapiens
gtgtctgctgctgcctcc

SEQ ID NO: 1711452 - DNA, 23 bp, Homo sapiens
gtgtctggcgttctcaagaatct

SEQ ID NO: 1711453 - DNA, 12 bp, Homo sapiens
gtgtctggtgca

SEQ ID NO: 1711454 - DNA, 21 bp, Homo sapiens
gtgtctgtacacgtgtcctgt

SEQ ID NO: 1711455 - DNA, 12 bp, Homo sapiens
gtgtcttccata

SEQ ID NO: 1711456 - DNA, 17 bp, Homo sapiens
gtgtcttcctagaattc

SEQ ID NO: 1711457 - DNA, 22 bp, Homo sapiens
gtgtcttgagctctaaagtagc

SEQ ID NO: 1711458 - DNA, 18 bp, Homo sapiens
gtgtgaaagtcagatgcc

SEQ ID NO: 1711459 - DNA, 17 bp, Homo sapiens
gtgtgacagtttccaaa

SEQ ID NO: 1711460 - DNA, 19 bp, Homo sapiens
gtgtgacatttggagaggg

SEQ ID NO: 1711461 - DNA, 17 bp, Homo sapiens
gtgtgactctagcaagg

SEQ ID NO: 1711462 - DNA, 17 bp, Homo sapiens
gtgtgagtaagagctgg

SEQ ID NO: 1711463 - DNA, 14 bp, Homo sapiens
gtgtgagtggcagc

SEQ ID NO: 1711464 - DNA, 18 bp, Homo sapiens
gtgtgagtggcagccatg

SEQ ID NO: 1711465 - DNA, 21 bp, Homo sapiens
gtgtgagtggcagccatgcct

SEQ ID NO: 1711466 - DNA, 19 bp, Homo sapiens
gtgtgatcccaagtgccag

SEQ ID NO: 1711467 - DNA, 20 bp, Homo sapiens
gtgtgatttcctaaacataa

SEQ ID NO: 1711468 - DNA, 22 bp, Homo sapiens
gtgtgcacactcatacacatgt

SEQ ID NO: 1711469 - DNA, 23 bp, Homo sapiens
gtgtgcacatccgcgtgtgcctg

SEQ ID NO: 1711470 - DNA, 18 bp, Homo sapiens
gtgtgcacccctccccat

SEQ ID NO: 1711471 - DNA, 16 bp, Homo sapiens
gtgtgcacgcctgcag

SEQ ID NO: 1711472 - DNA, 14 bp, Homo sapiens
gtgtgcactccagc

SEQ ID NO: 1711473 - DNA, 14 bp, Homo sapiens
gtgtgcagcaacca

SEQ ID NO: 1711474 - DNA, 19 bp, Homo sapiens
gtgtgcatagcgtcctgcc

SEQ ID NO: 1711475 - DNA, 22 bp, Homo sapiens
gtgtgcatagcgtcctgccctg

SEQ ID NO: 1711476 - DNA, 15 bp, Homo sapiens
gtgtgcatgtgctgt

SEQ ID NO: 1711477 - DNA, 15 bp, Homo sapiens
gtgtgccccactcca

SEQ ID NO: 1711478 - DNA, 20 bp, Homo sapiens
gtgtgccccactccagcctg

SEQ ID NO: 1711479 - DNA, 16 bp, Homo sapiens
gtgtgcccccttcaag

SEQ ID NO: 1711480 - DNA, 16 bp, Homo sapiens
gtgtgcctgcagcccc

SEQ ID NO: 1711481 - DNA, 13 bp, Homo sapiens
gtgtgcctgtgct

SEQ ID NO: 1711482 - DNA, 14 bp, Homo sapiens
gtgtgcctgtgctc

SEQ ID NO: 1711483 - DNA, 18 bp, Homo sapiens
gtgtgcctgtgctcctgc

SEQ ID NO: 1711484 - DNA, 19 bp, Homo sapiens
gtgtgcctgtgctcctgcc

SEQ ID NO: 1711485 - DNA, 15 bp, Homo sapiens
gtgtgcctgtggcag

SEQ ID NO: 1711486 - DNA, 16 bp, Homo sapiens
gtgtgcctgtggcaga

SEQ ID NO: 1711487 - DNA, 19 bp, Homo sapiens
gtgtgcgctgcctggccag

SEQ ID NO: 1711488 - DNA, 18 bp, Homo sapiens
gtgtgcggagtctcctct

SEQ ID NO: 1711489 - DNA, 19 bp, Homo sapiens
gtgtgcggagtctcctctc

SEQ ID NO: 1711490 - DNA, 23 bp, Homo sapiens
gtgtgctctccccggcaggcctg

SEQ ID NO: 1711491 - DNA, 20 bp, Homo sapiens
gtgtgctgacaacttagctc

SEQ ID NO: 1711492 - DNA, 11 bp, Homo sapiens
gtgtgctggga

SEQ ID NO: 1711493 - DNA, 23 bp, Homo sapiens
gtgtggaaatcataccagttgtt

SEQ ID NO: 1711494 - DNA, 15 bp, Homo sapiens
gtgtggactgtgatg

SEQ ID NO: 1711495 - DNA, 21 bp, Homo sapiens
gtgtggactgtggcacttgcc

SEQ ID NO: 1711496 - DNA, 15 bp, Homo sapiens
caggcccactcccca

SEQ ID NO: 1711497 - DNA, 18 bp, Homo sapiens
caggcccactccccagcc

SEQ ID NO: 1711498 - DNA, 15 bp, Homo sapiens
caggcccactgtgcc

SEQ ID NO: 1711499 - DNA, 17 bp, Homo sapiens
caggcccactgtgcctc

SEQ ID NO: 1711500 - DNA, 19 bp, Homo sapiens
caggcccactgtgcctcag

SEQ ID NO: 1711501 - DNA, 10 bp, Homo sapiens
caggcccagc

SEQ ID NO: 1711502 - DNA, 12 bp, Homo sapiens
caggcccagcat

SEQ ID NO: 1711503 - DNA, 17 bp, Homo sapiens
caggcccagcatgcagg

SEQ ID NO: 1711504 - DNA, 21 bp, Homo sapiens
caggcccagcattgctggttc

SEQ ID NO: 1711505 - DNA, 22 bp, Homo sapiens
caggcccagcattgctggttct

SEQ ID NO: 1711506 - DNA, 11 bp, Homo sapiens
caggcccagcg

SEQ ID NO: 1711507 - DNA, 15 bp, Homo sapiens
caggcccagcgcggc

SEQ ID NO: 1711508 - DNA, 22 bp, Homo sapiens
caggcccatctcaggtgccact

SEQ ID NO: 1711509 - DNA, 22 bp, Homo sapiens
caggccccaccaagagggtgga

SEQ ID NO: 1711510 - DNA, 15 bp, Homo sapiens
caggccccaccggcc

SEQ ID NO: 1711511 - DNA, 17 bp, Homo sapiens
caggccccaccggccag

SEQ ID NO: 1711512 - DNA, 16 bp, Homo sapiens
gtgtgtcaggccctct

SEQ ID NO: 1711513 - DNA, 18 bp, Homo sapiens
gtgtgtcaggccctctgc

SEQ ID NO: 1711514 - DNA, 22 bp, Homo sapiens
gtgtgtcaggccctctgcctgc

SEQ ID NO: 1711515 - DNA, 19 bp, Homo sapiens
gtgtgtccaaaactgcctc

SEQ ID NO: 1711516 - DNA, 14 bp, Homo sapiens
gtgtgtcccaggca

SEQ ID NO: 1711517 - DNA, 13 bp, Homo sapiens
gtgtgtccctgga

SEQ ID NO: 1711518 - DNA, 15 bp, Homo sapiens
gtgtgtccctggaca

SEQ ID NO: 1711519 - DNA, 15 bp, Homo sapiens
gtgtgtctgctcagt

SEQ ID NO: 1711520 - DNA, 14 bp, Homo sapiens
gtgtgtctggtggg

SEQ ID NO: 1711521 - DNA, 17 bp, Homo sapiens
gtgtgtctgtctttgtg

SEQ ID NO: 1711522 - DNA, 18 bp, Homo sapiens
gtgtgtctgtctttgtgg

SEQ ID NO: 1711523 - DNA, 14 bp, Homo sapiens
gtgtgtcttaatta

SEQ ID NO: 1711524 - DNA, 11 bp, Homo sapiens
gtgtgtgcaag

SEQ ID NO: 1711525 - DNA, 19 bp, Homo sapiens
gtgtgtgcagagtccattt

SEQ ID NO: 1711526 - DNA, 13 bp, Homo sapiens
gtgtgtgcatgtg

SEQ ID NO: 1711527 - DNA, 18 bp, Homo sapiens
gtgtgtggtgaggggctt

SEQ ID NO: 1711528 - DNA, 13 bp, Homo sapiens
gtgtgtgtatgtg

SEQ ID NO: 1711529 - DNA, 14 bp, Homo sapiens
gtgtgtgtatgtgt

SEQ ID NO: 1711530 - DNA, 15 bp, Homo sapiens
gtgtgtgtctgcttt

SEQ ID NO: 1711531 - DNA, 9 bp, Homo sapiens
gtgtgtgtg

SEQ ID NO: 1711532 - DNA, 15 bp, Homo sapiens
gtgtgtgtgcatgtg

SEQ ID NO: 1711533 - DNA, 14 bp, Homo sapiens
gtgtgtgtgtgcac

SEQ ID NO: 1711534 - DNA, 13 bp, Homo sapiens
gtgtgtgtgtgtg

SEQ ID NO: 1711535 - DNA, 18 bp, Homo sapiens
gtgtgttatttccccagc

SEQ ID NO: 1711536 - DNA, 24 bp, Homo sapiens
gtgtgttatttccccagccacagg

SEQ ID NO: 1711537 - DNA, 22 bp, Homo sapiens
gtgtgttcaccttcaaaatgtt

SEQ ID NO: 1711538 - DNA, 23 bp, Homo sapiens
gtgtgttcaccttcaaaatgttc

SEQ ID NO: 1711539 - DNA, 16 bp, Homo sapiens
gtgtgttgtcttgaaa

SEQ ID NO: 1711540 - DNA, 17 bp, Homo sapiens
gtgtgttgtgtgtggga

SEQ ID NO: 1711541 - DNA, 14 bp, Homo sapiens
gtgtgtttatgtgt

SEQ ID NO: 1711542 - DNA, 16 bp, Homo sapiens
gtgtgttttctcctag

SEQ ID NO: 1711543 - DNA, 19 bp, Homo sapiens
gtgttaaaggttttctcta

SEQ ID NO: 1711544 - DNA, 17 bp, Homo sapiens
gtgttaacattccaaga

SEQ ID NO: 1711545 - DNA, 22 bp, Homo sapiens
gtgttaatactggatagcatga

SEQ ID NO: 1711546 - DNA, 18 bp, Homo sapiens
gtgttactgctttgcaaa

SEQ ID NO: 1711547 - DNA, 16 bp, Homo sapiens
gtgttacttatggaag

SEQ ID NO: 1711548 - DNA, 14 bp, Homo sapiens
gtgttagtggcacc

SEQ ID NO: 1711549 - DNA, 16 bp, Homo sapiens
gtgttattctttgcgt

SEQ ID NO: 1711550 - DNA, 17 bp, Homo sapiens
gtgttatttaaagaaga

SEQ ID NO: 1711551 - DNA, 21 bp, Homo sapiens
gtgttatttggaaccttgttt

SEQ ID NO: 1711552 - DNA, 14 bp, Homo sapiens
gtgttcaatatcag

SEQ ID NO: 1711553 - DNA, 14 bp, Homo sapiens
gtgttcaatattta

SEQ ID NO: 1711554 - DNA, 17 bp, Homo sapiens
gtgttcagctctttcca

SEQ ID NO: 1711555 - DNA, 18 bp, Homo sapiens
gtgttcagctctttccaa

SEQ ID NO: 1711556 - DNA, 21 bp, Homo sapiens
gtgttcagctctttccaaatt

SEQ ID NO: 1711557 - DNA, 22 bp, Homo sapiens
gtgttcatttggtgttcctgga

SEQ ID NO: 1711558 - DNA, 23 bp, Homo sapiens
gtgttcatttggtgttcctggaa

SEQ ID NO: 1711559 - DNA, 17 bp, Homo sapiens
gtgttcccatttcagct

SEQ ID NO: 1711560 - DNA, 20 bp, Homo sapiens
gtgttcctcggtgggccaga

SEQ ID NO: 1711561 - DNA, 12 bp, Homo sapiens
gtgttcctggaa

SEQ ID NO: 1711562 - DNA, 15 bp, Homo sapiens
gtgttcctggaagca

SEQ ID NO: 1711563 - DNA, 21 bp, Homo sapiens
gtgttcctggcccactctgta

SEQ ID NO: 1711564 - DNA, 14 bp, Homo sapiens
gtgttcctggctga

SEQ ID NO: 1711565 - DNA, 20 bp, Homo sapiens
gtgttcctttttaaatgtga

SEQ ID NO: 1711566 - DNA, 23 bp, Homo sapiens
gtgttcgtttccatcatgtctgt

SEQ ID NO: 1711567 - DNA, 13 bp, Homo sapiens
gtgttctaagatg

SEQ ID NO: 1711568 - DNA, 16 bp, Homo sapiens
gtgttctcatgaagca

SEQ ID NO: 1711569 - DNA, 16 bp, Homo sapiens
gtgttctccttttcct

SEQ ID NO: 1711570 - DNA, 13 bp, Homo sapiens
gtgttctgctcct

SEQ ID NO: 1711571 - DNA, 17 bp, Homo sapiens
gtgttctgtttgttaaa

SEQ ID NO: 1711572 - DNA, 21 bp, Homo sapiens
gtgttcttaggtttactgtga

SEQ ID NO: 1711573 - DNA, 21 bp, Homo sapiens
gtgttcttttctcctttacca

SEQ ID NO: 1711574 - DNA, 17 bp, Homo sapiens
gtgttgaaaatgttcag

SEQ ID NO: 1711575 - DNA, 15 bp, Homo sapiens
gtgttgatcccaaga

SEQ ID NO: 1711576 - DNA, 12 bp, Homo sapiens
gtgttgcaaatt

SEQ ID NO: 1711577 - DNA, 17 bp, Homo sapiens
gtgttgccaaatatgtc

SEQ ID NO: 1711578 - DNA, 14 bp, Homo sapiens
gtgttgccaagctc

SEQ ID NO: 1711579 - DNA, 18 bp, Homo sapiens
gtgttgccaagctccaag

SEQ ID NO: 1711580 - DNA, 15 bp, Homo sapiens
gtgttggctgtgtga

SEQ ID NO: 1711581 - DNA, 16 bp, Homo sapiens
gtgttgggacctgctg

SEQ ID NO: 1711582 - DNA, 17 bp, Homo sapiens
gtgttgttgctctagga

SEQ ID NO: 1711583 - DNA, 18 bp, Homo sapiens
gtgttgttgttgctgctg

SEQ ID NO: 1711584 - DNA, 19 bp, Homo sapiens
gtgttgttttttgttcaat

SEQ ID NO: 1711585 - DNA, 12 bp, Homo sapiens
gtgtttaaaact

SEQ ID NO: 1711586 - DNA, 14 bp, Homo sapiens
gtgtttaaataaac

SEQ ID NO: 1711587 - DNA, 19 bp, Homo sapiens
gtgtttaggatcatctctg

SEQ ID NO: 1711588 - DNA, 15 bp, Homo sapiens
gtgtttagttgcaga

SEQ ID NO: 1711589 - DNA, 22 bp, Homo sapiens
gtgtttataaaatataaacaaa

SEQ ID NO: 1711590 - DNA, 18 bp, Homo sapiens
gtgtttatatctcctttg

SEQ ID NO: 1711591 - DNA, 15 bp, Homo sapiens
gtgtttattcttgat

SEQ ID NO: 1711592 - DNA, 13 bp, Homo sapiens
gtgtttattgcaa

SEQ ID NO: 1711593 - DNA, 15 bp, Homo sapiens
gtgtttctagggaaa

SEQ ID NO: 1711594 - DNA, 14 bp, Homo sapiens
gtgtttctcaaaag

SEQ ID NO: 1711595 - DNA, 14 bp, Homo sapiens
gtgtttgattggct

SEQ ID NO: 1711596 - DNA, 15 bp, Homo sapiens
gtgtttgattggctt

SEQ ID NO: 1711597 - DNA, 20 bp, Homo sapiens
gtgtttgcagcctgctctag

SEQ ID NO: 1711598 - DNA, 15 bp, Homo sapiens
gtgtttgcagctgtg

SEQ ID NO: 1711599 - DNA, 18 bp, Homo sapiens
gtgtttgcagctgtgaga

SEQ ID NO: 1711600 - DNA, 15 bp, Homo sapiens
gtgtttgcattgtct

SEQ ID NO: 1711601 - DNA, 16 bp, Homo sapiens
gtgtttggcaatgcta

SEQ ID NO: 1711602 - DNA, 22 bp, Homo sapiens
gtgtttgggaagcaacaaagag

SEQ ID NO: 1711603 - DNA, 14 bp, Homo sapiens
gtgtttgtatgtct

SEQ ID NO: 1711604 - DNA, 16 bp, Homo sapiens
gtgttttagatggttt

SEQ ID NO: 1711605 - DNA, 20 bp, Homo sapiens
gtgttttgaaagaatagaac

SEQ ID NO: 1711606 - DNA, 17 bp, Homo sapiens
gtgtttttcatgtttta

SEQ ID NO: 1711607 - DNA, 14 bp, Homo sapiens
gtgtttttgggaag

SEQ ID NO: 1711608 - DNA, 21 bp, Homo sapiens
gtgttttttaagatagtgtaa

SEQ ID NO: 1711609 - DNA, 15 bp, Homo sapiens
gtgttttttaagatg

SEQ ID NO: 1711610 - DNA, 13 bp, Homo sapiens
gttaaaaaaaaaa

SEQ ID NO: 1711611 - DNA, 14 bp, Homo sapiens
gttaaaaaagcgag

SEQ ID NO: 1711612 - DNA, 23 bp, Homo sapiens
gttagttaccttatagttactgt

SEQ ID NO: 1711613 - DNA, 19 bp, Homo sapiens
gttagttctgtgtgtctgg

SEQ ID NO: 1711614 - DNA, 15 bp, Homo sapiens
gttagtttagtgtgt

SEQ ID NO: 1711615 - DNA, 16 bp, Homo sapiens
gttagtttctttggga

SEQ ID NO: 1711616 - DNA, 18 bp, Homo sapiens
gttataaatcaatgtcac

SEQ ID NO: 1711617 - DNA, 16 bp, Homo sapiens
gttatagccctgccct

SEQ ID NO: 1711618 - DNA, 17 bp, Homo sapiens
gttataggtcactcctg

SEQ ID NO: 1711619 - DNA, 21 bp, Homo sapiens
gttataggtcctttagaaaca

SEQ ID NO: 1711620 - DNA, 21 bp, Homo sapiens
gttatagtgaatactgctaca

SEQ ID NO: 1711621 - DNA, 16 bp, Homo sapiens
gttatagttgatatgt

SEQ ID NO: 1711622 - DNA, 18 bp, Homo sapiens
gttatatataataaatac

SEQ ID NO: 1711623 - DNA, 16 bp, Homo sapiens
gttatatcatatgtat

SEQ ID NO: 1711624 - DNA, 14 bp, Homo sapiens
gttatatcatcaat

SEQ ID NO: 1711625 - DNA, 16 bp, Homo sapiens
gttatatgagtagata

SEQ ID NO: 1711626 - DNA, 22 bp, Homo sapiens
gttatatttgacttgaaaagaa

SEQ ID NO: 1711627 - DNA, 16 bp, Homo sapiens
gttatcagtgcttccc

SEQ ID NO: 1711628 - DNA, 17 bp, Homo sapiens
gttatcagtgcttcccg

SEQ ID NO: 1711629 - DNA, 17 bp, Homo sapiens
gttatcattttttcctg

SEQ ID NO: 1711630 - DNA, 18 bp, Homo sapiens
gttatcggctctattctc

SEQ ID NO: 1711631 - DNA, 10 bp, Homo sapiens
gttcatacat

SEQ ID NO: 1711632 - DNA, 22 bp, Homo sapiens
gttcatagggtctcttcaggtt

SEQ ID NO: 1711633 - DNA, 20 bp, Homo sapiens
gttcatatatcaagaagtct

SEQ ID NO: 1711634 - DNA, 22 bp, Homo sapiens
gttcatatctggagcctgatgt

SEQ ID NO: 1711635 - DNA, 22 bp, Homo sapiens
gttcatatgtacttgtttgcta

SEQ ID NO: 1711636 - DNA, 14 bp, Homo sapiens
gttcatcagtgtta

SEQ ID NO: 1711637 - DNA, 16 bp, Homo sapiens
gttcatcagtgttaaa

SEQ ID NO: 1711638 - DNA, 15 bp, Homo sapiens
gttcatccaatcctc

SEQ ID NO: 1711639 - DNA, 12 bp, Homo sapiens
gttcatgagaat

SEQ ID NO: 1711640 - DNA, 14 bp, Homo sapiens
gttcatgtttgctt

SEQ ID NO: 1711641 - DNA, 15 bp, Homo sapiens
gttcatgtttgcttc

SEQ ID NO: 1711642 - DNA, 24 bp, Homo sapiens
gttcatgtttgcttcataaatgaa

SEQ ID NO: 1711643 - DNA, 16 bp, Homo sapiens
gttcattaaagcatga

SEQ ID NO: 1711644 - DNA, 16 bp, Homo sapiens
gttcattagaaatatt

SEQ ID NO: 1711645 - DNA, 19 bp, Homo sapiens
gttcattagaaatatttta

SEQ ID NO: 1711646 - DNA, 20 bp, Homo sapiens
gttcattataatctcaaagg

SEQ ID NO: 1711647 - DNA, 21 bp, Homo sapiens
gttcattctcccgcttcctgg

SEQ ID NO: 1711648 - DNA, 12 bp, Homo sapiens
gttcattctgat

SEQ ID NO: 1711649 - DNA, 18 bp, Homo sapiens
gttcattgacctcatcat

SEQ ID NO: 1711650 - DNA, 19 bp, Homo sapiens
gttcattgatggatgtctt

SEQ ID NO: 1711651 - DNA, 18 bp, Homo sapiens
gttcattttagtgactgt

SEQ ID NO: 1711652 - DNA, 17 bp, Homo sapiens
gtcctggctacatccca

SEQ ID NO: 1711653 - DNA, 21 bp, Homo sapiens
gtcctggctacatcccagcct

SEQ ID NO: 1711654 - DNA, 22 bp, Homo sapiens
gtcctggctacatcccagcctg

SEQ ID NO: 1711655 - DNA, 19 bp, Homo sapiens
gtcctggctcctgaggggc

SEQ ID NO: 1711656 - DNA, 15 bp, Homo sapiens
gtcctggctgcactc

SEQ ID NO: 1711657 - DNA, 16 bp, Homo sapiens
gtcctggctgcactct

SEQ ID NO: 1711658 - DNA, 19 bp, Homo sapiens
gtcctgggagaacctcagg

SEQ ID NO: 1711659 - DNA, 15 bp, Homo sapiens
gtcctgggcaggtgg

SEQ ID NO: 1711660 - DNA, 13 bp, Homo sapiens
gtcctgggcctgc

SEQ ID NO: 1711661 - DNA, 17 bp, Homo sapiens
gtcctgggcctgcagaa

SEQ ID NO: 1711662 - DNA, 16 bp, Homo sapiens
gtcctgggcgccctgg

SEQ ID NO: 1711663 - DNA, 17 bp, Homo sapiens
gtcctgggcgccctgga

SEQ ID NO: 1711664 - DNA, 19 bp, Homo sapiens
gtcctgggcgccctggaag

SEQ ID NO: 1711665 - DNA, 23 bp, Homo sapiens
gtcctgggcgccctggaagccgg

SEQ ID NO: 1711666 - DNA, 17 bp, Homo sapiens
gtcctgggctcaaatga

SEQ ID NO: 1711667 - DNA, 19 bp, Homo sapiens
gtcctggtaattcctctcc

SEQ ID NO: 1711668 - DNA, 16 bp, Homo sapiens
gtcctggtcctgatgc

SEQ ID NO: 1711669 - DNA, 17 bp, Homo sapiens
gtcctggtcctgatgcc

SEQ ID NO: 1711670 - DNA, 17 bp, Homo sapiens
gtcctggtcctggctgc

SEQ ID NO: 1711671 - DNA, 17 bp, Homo sapiens
gtcctggtgctctctgc

SEQ ID NO: 1711672 - DNA, 15 bp, Homo sapiens
gtcctggtggctggg

SEQ ID NO: 1711673 - DNA, 16 bp, Homo sapiens
gtcctggtggctgggc

SEQ ID NO: 1711674 - DNA, 22 bp, Homo sapiens
gtcctggtggctgggcccagca

SEQ ID NO: 1711675 - DNA, 16 bp, Homo sapiens
gtcctggtggggctga

SEQ ID NO: 1711676 - DNA, 23 bp, Homo sapiens
gtcctggtgggtcagcccagcac

SEQ ID NO: 1711677 - DNA, 19 bp, Homo sapiens
gtcctggtttcctggcagc

SEQ ID NO: 1711678 - DNA, 12 bp, Homo sapiens
gtcctgtcccag

SEQ ID NO: 1711679 - DNA, 14 bp, Homo sapiens
gtcctgtcccagag

SEQ ID NO: 1711680 - DNA, 16 bp, Homo sapiens
gtcctgtcccagaggt

SEQ ID NO: 1711681 - DNA, 15 bp, Homo sapiens
gtcctgtcctggtcc

SEQ ID NO: 1711682 - DNA, 16 bp, Homo sapiens
gtcctgtcctttcttg

SEQ ID NO: 1711683 - DNA, 22 bp, Homo sapiens
gtcctgtcgaaggggaggcaca

SEQ ID NO: 1711684 - DNA, 22 bp, Homo sapiens
gtcctgtgaagtaacccctcct

SEQ ID NO: 1711685 - DNA, 18 bp, Homo sapiens
gtcctgtgaatgccactg

SEQ ID NO: 1711686 - DNA, 17 bp, Homo sapiens
gtcctgtgacaacactc

SEQ ID NO: 1711687 - DNA, 18 bp, Homo sapiens
gtcctgtgttaaacacta

SEQ ID NO: 1711688 - DNA, 23 bp, Homo sapiens
gtcctgttaacgtcatctcaggg

SEQ ID NO: 1711689 - DNA, 16 bp, Homo sapiens
gtcctgttccctaccc

SEQ ID NO: 1711690 - DNA, 20 bp, Homo sapiens
gtccttaatgatccgttcca

SEQ ID NO: 1711691 - DNA, 18 bp, Homo sapiens
gtccttagcaaggggctc

SEQ ID NO: 1711692 - DNA, 15 bp, Homo sapiens
gtccttagtggaggg

SEQ ID NO: 1711693 - DNA, 16 bp, Homo sapiens
gtccttattcttgtgg

SEQ ID NO: 1711694 - DNA, 18 bp, Homo sapiens
gtccttatttatttaact

SEQ ID NO: 1711695 - DNA, 17 bp, Homo sapiens
gtccttcactggcgcct

SEQ ID NO: 1711696 - DNA, 15 bp, Homo sapiens
gtccttctcattcat

SEQ ID NO: 1711697 - DNA, 17 bp, Homo sapiens
gtccttgatgccagagg

SEQ ID NO: 1711698 - DNA, 22 bp, Homo sapiens
gtccttgatgccagagggccag

SEQ ID NO: 1711699 - DNA, 23 bp, Homo sapiens
gtccttgatgccagagggccagc

SEQ ID NO: 1711700 - DNA, 14 bp, Homo sapiens
gtccttgatttcaa

SEQ ID NO: 1711701 - DNA, 19 bp, Homo sapiens
gtccttgatttcaaagttt

SEQ ID NO: 1711702 - DNA, 13 bp, Homo sapiens
gtccttggagtga

SEQ ID NO: 1711703 - DNA, 13 bp, Homo sapiens
gtcctttatgtgg

SEQ ID NO: 1711704 - DNA, 20 bp, Homo sapiens
gtcctttatgtggaaaacag

SEQ ID NO: 1711705 - DNA, 22 bp, Homo sapiens
gtcctttccaaggcttctccaa

SEQ ID NO: 1711706 - DNA, 19 bp, Homo sapiens
gtcctttccatctgtccac

SEQ ID NO: 1711707 - DNA, 14 bp, Homo sapiens
gtcctttcccacca

SEQ ID NO: 1711708 - DNA, 20 bp, Homo sapiens
gtcctttcccaccattcctg

SEQ ID NO: 1711709 - DNA, 18 bp, Homo sapiens
gtccttttcactacacca

SEQ ID NO: 1711710 - DNA, 16 bp, Homo sapiens
gtccttttgacactgc

SEQ ID NO: 1711711 - DNA, 17 bp, Homo sapiens
gtccttttgacactgct

SEQ ID NO: 1711712 - DNA, 19 bp, Homo sapiens
gtccttttgacactgctct

SEQ ID NO: 1711713 - DNA, 12 bp, Homo sapiens
gtcgagacactt

SEQ ID NO: 1711714 - DNA, 13 bp, Homo sapiens
gtcgagagctggc

SEQ ID NO: 1711715 - DNA, 15 bp, Homo sapiens
gtcgaggagtaacaa

SEQ ID NO: 1711716 - DNA, 15 bp, Homo sapiens
gtcgagtcaaaatgt

SEQ ID NO: 1711717 - DNA, 17 bp, Homo sapiens
gtcgcagaccagagctg

SEQ ID NO: 1711718 - DNA, 17 bp, Homo sapiens
gtcgcagctaccctcag

SEQ ID NO: 1711719 - DNA, 19 bp, Homo sapiens
gtcgcaggatccgctgcca

SEQ ID NO: 1711720 - DNA, 21 bp, Homo sapiens
gtcgcaggatccgctgccacc

SEQ ID NO: 1711721 - DNA, 16 bp, Homo sapiens
gtcgctcatgtgtgca

SEQ ID NO: 1711722 - DNA, 22 bp, Homo sapiens
gtcgctgcctccatggcagcag

SEQ ID NO: 1711723 - DNA, 14 bp, Homo sapiens
gtcggagtgcctgg

SEQ ID NO: 1711724 - DNA, 15 bp, Homo sapiens
gtcggcatgccagga

SEQ ID NO: 1711725 - DNA, 17 bp, Homo sapiens
gtcggcatgccaggacc

SEQ ID NO: 1711726 - DNA, 16 bp, Homo sapiens
gtcggccgaccaggct

SEQ ID NO: 1711727 - DNA, 15 bp, Homo sapiens
gtcgggcagccagca

SEQ ID NO: 1711728 - DNA, 21 bp, Homo sapiens
gtcgggcagtggaggctgctg

SEQ ID NO: 1711729 - DNA, 16 bp, Homo sapiens
gtcgggcttgcggtgg

SEQ ID NO: 1711730 - DNA, 14 bp, Homo sapiens
gtcgggggctgagg

SEQ ID NO: 1711731 - DNA, 15 bp, Homo sapiens
gtcgggggctggcct

SEQ ID NO: 1711732 - DNA, 16 bp, Homo sapiens
gtcgggggctggccta

SEQ ID NO: 1711733 - DNA, 18 bp, Homo sapiens
gtgattatctctttgatc

SEQ ID NO: 1711734 - DNA, 19 bp, Homo sapiens
gtgattatctctttgatct

SEQ ID NO: 1711735 - DNA, 14 bp, Homo sapiens
gtgattcaatctgt

SEQ ID NO: 1711736 - DNA, 16 bp, Homo sapiens
gtgattcaatctgtaa

SEQ ID NO: 1711737 - DNA, 23 bp, Homo sapiens
gtgattccagcaagtacagagat

SEQ ID NO: 1711738 - DNA, 20 bp, Homo sapiens
gtgattcccaactcctttct

SEQ ID NO: 1711739 - DNA, 21 bp, Homo sapiens
gtgattcctaagccacttgaa

SEQ ID NO: 1711740 - DNA, 23 bp, Homo sapiens
gtgattcctcccaggaggtgctt

SEQ ID NO: 1711741 - DNA, 12 bp, Homo sapiens
gtgattctagag

SEQ ID NO: 1711742 - DNA, 14 bp, Homo sapiens
gtgattctgatttc

SEQ ID NO: 1711743 - DNA, 13 bp, Homo sapiens
gtgattctgcctt

SEQ ID NO: 1711744 - DNA, 20 bp, Homo sapiens
gtgattgacacacagcactc

SEQ ID NO: 1711745 - DNA, 12 bp, Homo sapiens
gtgattgcagct

SEQ ID NO: 1711746 - DNA, 13 bp, Homo sapiens
gtgattgcagctt

SEQ ID NO: 1711747 - DNA, 24 bp, Homo sapiens
gtgattggcctgtagagttgctga

SEQ ID NO: 1711748 - DNA, 14 bp, Homo sapiens
gtgattggctgcag

SEQ ID NO: 1711749 - DNA, 15 bp, Homo sapiens
gtgattggctgcagg

SEQ ID NO: 1711750 - DNA, 13 bp, Homo sapiens
gtgattgtgtctg

SEQ ID NO: 1711751 - DNA, 16 bp, Homo sapiens
gtgatttaatccagtt

SEQ ID NO: 1711752 - DNA, 15 bp, Homo sapiens
gtgatttcctaaaca

SEQ ID NO: 1711753 - DNA, 14 bp, Homo sapiens
gtgatttgaaaaat

SEQ ID NO: 1711754 - DNA, 21 bp, Homo sapiens
gtgattttatgatcagtgttg

SEQ ID NO: 1711755 - DNA, 18 bp, Homo sapiens
gtgattttatgtttaaaa

SEQ ID NO: 1711756 - DNA, 11 bp, Homo sapiens
gtgatttttgt

SEQ ID NO: 1711757 - DNA, 19 bp, Homo sapiens
gtgcaaaagcttcaaatta

SEQ ID NO: 1711758 - DNA, 19 bp, Homo sapiens
gtgcaaacccactcagaga

SEQ ID NO: 1711759 - DNA, 19 bp, Homo sapiens
gtgcaaagatagatggctg

SEQ ID NO: 1711760 - DNA, 23 bp, Homo sapiens
gtgcaaatgtcagatacaatgta

SEQ ID NO: 1711761 - DNA, 13 bp, Homo sapiens
gtgcaacagacaa

SEQ ID NO: 1711762 - DNA, 15 bp, Homo sapiens
gtgcaacagacaagt

SEQ ID NO: 1711763 - DNA, 14 bp, Homo sapiens
gtgcaacagggtat

SEQ ID NO: 1711764 - DNA, 14 bp, Homo sapiens
gtgcaacatctctg

SEQ ID NO: 1711765 - DNA, 18 bp, Homo sapiens
gtgcaacggccagggttg

SEQ ID NO: 1711766 - DNA, 15 bp, Homo sapiens
gtgcaagtagcacat

SEQ ID NO: 1711767 - DNA, 20 bp, Homo sapiens
gtgcaagttgaggacttctt

SEQ ID NO: 1711768 - DNA, 15 bp, Homo sapiens
gtgcaataatttgta

SEQ ID NO: 1711769 - DNA, 21 bp, Homo sapiens
gtgcaataatttgtacaatgg

SEQ ID NO: 1711770 - DNA, 21 bp, Homo sapiens
gtgcaataggtgagagaatgt

SEQ ID NO: 1711771 - DNA, 22 bp, Homo sapiens
gtgcaattgtaggggtgtgtgt

SEQ ID NO: 1711772 - DNA, 14 bp, Homo sapiens
gtgcaattgtcttt

SEQ ID NO: 1711773 - DNA, 23 bp, Homo sapiens
gtgcaattgtcttttttttcctt

SEQ ID NO: 1711774 - DNA, 19 bp, Homo sapiens
gtgcaatttcaaggttcta

SEQ ID NO: 1711775 - DNA, 23 bp, Homo sapiens
gtgcacaacccaccacccccttt

SEQ ID NO: 1711776 - DNA, 20 bp, Homo sapiens
gtgcacacacacgcactctc

SEQ ID NO: 1711777 - DNA, 13 bp, Homo sapiens
gtgcacagctgtc

SEQ ID NO: 1711778 - DNA, 14 bp, Homo sapiens
gtgcacagctgtcc

SEQ ID NO: 1711779 - DNA, 15 bp, Homo sapiens
gtgcacaggcctctg

SEQ ID NO: 1711780 - DNA, 18 bp, Homo sapiens
gtgcacaggcctctgcct

SEQ ID NO: 1711781 - DNA, 20 bp, Homo sapiens
gtgcacaggcctctgcctgc

SEQ ID NO: 1711782 - DNA, 14 bp, Homo sapiens
gtgcacagtggctt

SEQ ID NO: 1711783 - DNA, 13 bp, Homo sapiens
gtgcacccacctg

SEQ ID NO: 1711784 - DNA, 22 bp, Homo sapiens
gtgcacccacctgttttctgaa

SEQ ID NO: 1711785 - DNA, 17 bp, Homo sapiens
gtgcacccactcaccag

SEQ ID NO: 1711786 - DNA, 18 bp, Homo sapiens
gtgcacccactcaccagg

SEQ ID NO: 1711787 - DNA, 22 bp, Homo sapiens
gtgcacccactcaccagggtcc

SEQ ID NO: 1711788 - DNA, 16 bp, Homo sapiens
gtgcacccctccccat

SEQ ID NO: 1711789 - DNA, 13 bp, Homo sapiens
gtgcacctgcccc

SEQ ID NO: 1711790 - DNA, 15 bp, Homo sapiens
gtgcacctgcctcca

SEQ ID NO: 1711791 - DNA, 21 bp, Homo sapiens
gtgcacctgcctccaccagca

SEQ ID NO: 1711792 - DNA, 18 bp, Homo sapiens
gtgcacgcaggcacagca

SEQ ID NO: 1711793 - DNA, 22 bp, Homo sapiens
gtgcacgcaggcacagcagctg

SEQ ID NO: 1711794 - DNA, 15 bp, Homo sapiens
gtgcacggttcaatg

SEQ ID NO: 1711795 - DNA, 15 bp, Homo sapiens
gtgcacgtggagagc

SEQ ID NO: 1711796 - DNA, 21 bp, Homo sapiens
gtgcacgtggagagctggtgc

SEQ ID NO: 1711797 - DNA, 18 bp, Homo sapiens
gtgcacgtggcatgtggc

SEQ ID NO: 1711798 - DNA, 21 bp, Homo sapiens
gtgcacgtggcatgtggcctg

SEQ ID NO: 1711799 - DNA, 13 bp, Homo sapiens
gtgcactcgccat

SEQ ID NO: 1711800 - DNA, 22 bp, Homo sapiens
gtgcacttacacttataaaata

SEQ ID NO: 1711801 - DNA, 17 bp, Homo sapiens
gtgcactttctaatgtt

SEQ ID NO: 1711802 - DNA, 16 bp, Homo sapiens
gtgcagacagccatgc

SEQ ID NO: 1711803 - DNA, 19 bp, Homo sapiens
gtgcagaggtaccctgggt

SEQ ID NO: 1711804 - DNA, 16 bp, Homo sapiens
gtgcagagtgcccaga

SEQ ID NO: 1711805 - DNA, 15 bp, Homo sapiens
gtgcagatctgtgct

SEQ ID NO: 1711806 - DNA, 14 bp, Homo sapiens
gtgcagcagcccag

SEQ ID NO: 1711807 - DNA, 18 bp, Homo sapiens
gtgcagcagcccagcttc

SEQ ID NO: 1711808 - DNA, 18 bp, Homo sapiens
gtgcagggatattgcctt

SEQ ID NO: 1711809 - DNA, 23 bp, Homo sapiens
gtgcagggcctgtaatcccagca

SEQ ID NO: 1711810 - DNA, 11 bp, Homo sapiens
gtgcaggtgct

SEQ ID NO: 1711811 - DNA, 18 bp, Homo sapiens
gtgcagtaacttgggagt

SEQ ID NO: 1711812 - DNA, 14 bp, Homo sapiens
gtgcagtcactgga

SEQ ID NO: 1711813 - DNA, 19 bp, Homo sapiens
gtgcagtgatacatgtact

SEQ ID NO: 1711814 - DNA, 24 bp, Homo sapiens
gtgcagtggcgtgatctcagctca

SEQ ID NO: 1711815 - DNA, 19 bp, Homo sapiens
gtgcagttctagtttgcat

SEQ ID NO: 1711816 - DNA, 14 bp, Homo sapiens
gtgcagtttctttt

SEQ ID NO: 1711817 - DNA, 19 bp, Homo sapiens
gtgcataagttaacttcca

SEQ ID NO: 1711818 - DNA, 15 bp, Homo sapiens
gtgcatagcgtcctg

SEQ ID NO: 1711819 - DNA, 19 bp, Homo sapiens
gtgcatatctgcctcccct

SEQ ID NO: 1711820 - DNA, 19 bp, Homo sapiens
gtgcatccttgtaatacct

SEQ ID NO: 1711821 - DNA, 21 bp, Homo sapiens
gtgcatccttgtaatacctga

SEQ ID NO: 1711822 - DNA, 18 bp, Homo sapiens
gtgcatctcagcccacat

SEQ ID NO: 1711823 - DNA, 16 bp, Homo sapiens
gtgcatggctcctgtc

SEQ ID NO: 1711824 - DNA, 15 bp, Homo sapiens
gtgcatggtggccag

SEQ ID NO: 1711825 - DNA, 23 bp, Homo sapiens
gtgcatgtatgtcttggacactg

SEQ ID NO: 1711826 - DNA, 14 bp, Homo sapiens
gtgcatgtcctttg

SEQ ID NO: 1711827 - DNA, 19 bp, Homo sapiens
gtgcatgtgagcacatgcg

SEQ ID NO: 1711828 - DNA, 17 bp, Homo sapiens
gtgcattcatgcaagag

SEQ ID NO: 1711829 - DNA, 14 bp, Homo sapiens
gtgcattgctgtgt

SEQ ID NO: 1711830 - DNA, 22 bp, Homo sapiens
gtgcatttcacctgtgacaaag

SEQ ID NO: 1711831 - DNA, 13 bp, Homo sapiens
gtgcatttttaaa

SEQ ID NO: 1711832 - DNA, 16 bp, Homo sapiens
gtgcatttttaaactt

SEQ ID NO: 1711833 - DNA, 22 bp, Homo sapiens
gtgcatttttaaacttgaaata

SEQ ID NO: 1711834 - DNA, 23 bp, Homo sapiens
gtgcatttttaaacttgaaatat

SEQ ID NO: 1711835 - DNA, 16 bp, Homo sapiens
gtgcatttttgtgaaa

SEQ ID NO: 1711836 - DNA, 16 bp, Homo sapiens
cagctgctctgcccct

SEQ ID NO: 1711837 - DNA, 21 bp, Homo sapiens
cagctgctctgccccttgggc

SEQ ID NO: 1711838 - DNA, 20 bp, Homo sapiens
cagctgctgaaacaacaaat

SEQ ID NO: 1711839 - DNA, 14 bp, Homo sapiens
cagctgctgctgga

SEQ ID NO: 1711840 - DNA, 15 bp, Homo sapiens
cagctgctggccagg

SEQ ID NO: 1711841 - DNA, 13 bp, Homo sapiens
cagctgctgggac

SEQ ID NO: 1711842 - DNA, 12 bp, Homo sapiens
cagctgctgtct

SEQ ID NO: 1711843 - DNA, 15 bp, Homo sapiens
cagctgctgtgcccc

SEQ ID NO: 1711844 - DNA, 16 bp, Homo sapiens
cagctgctgtgcccca

SEQ ID NO: 1711845 - DNA, 20 bp, Homo sapiens
cagctggaaagttgggcccc

SEQ ID NO: 1711846 - DNA, 11 bp, Homo sapiens
cagctggccac

SEQ ID NO: 1711847 - DNA, 15 bp, Homo sapiens
cagctggcccactgc

SEQ ID NO: 1711848 - DNA, 21 bp, Homo sapiens
gtgaaccaacccccatctccc

SEQ ID NO: 1711849 - DNA, 18 bp, Homo sapiens
gtgaaccctggggcctga

SEQ ID NO: 1711850 - DNA, 16 bp, Homo sapiens
gtgaacgatttagaaa

SEQ ID NO: 1711851 - DNA, 21 bp, Homo sapiens
gtgaacgtccacatgaaacct

SEQ ID NO: 1711852 - DNA, 19 bp, Homo sapiens
gtgaactatttctacacag

SEQ ID NO: 1711853 - DNA, 17 bp, Homo sapiens
gtgaactggaagaaagc

SEQ ID NO: 1711854 - DNA, 17 bp, Homo sapiens
gtgaactgttggagccc

SEQ ID NO: 1711855 - DNA, 18 bp, Homo sapiens
gtgaactgttggagcccg

SEQ ID NO: 1711856 - DNA, 21 bp, Homo sapiens
gtgaacttacacttggagccc

SEQ ID NO: 1711857 - DNA, 14 bp, Homo sapiens
gtgaactttttgta

SEQ ID NO: 1711858 - DNA, 12 bp, Homo sapiens
gtgaactttttt

SEQ ID NO: 1711859 - DNA, 21 bp, Homo sapiens
gtgaagaaccctgcagggccc

SEQ ID NO: 1711860 - DNA, 16 bp, Homo sapiens
gtgaagacccagcagg

SEQ ID NO: 1711861 - DNA, 23 bp, Homo sapiens
gtgaagagaaaaaggctgaaaag

SEQ ID NO: 1711862 - DNA, 12 bp, Homo sapiens
gtgaagaggctg

SEQ ID NO: 1711863 - DNA, 19 bp, Homo sapiens
gtgaagagggagaagcatg

SEQ ID NO: 1711864 - DNA, 12 bp, Homo sapiens
gtgaagaggggc

SEQ ID NO: 1711865 - DNA, 13 bp, Homo sapiens
gtgaagaggggca

SEQ ID NO: 1711866 - DNA, 16 bp, Homo sapiens
gtgaagaggggcagcc

SEQ ID NO: 1711867 - DNA, 20 bp, Homo sapiens
gtgaagaggtctgattggct

SEQ ID NO: 1711868 - DNA, 16 bp, Homo sapiens
gtgaagagtttcacaa

SEQ ID NO: 1711869 - DNA, 14 bp, Homo sapiens
gtgaagctgaaccc

SEQ ID NO: 1711870 - DNA, 22 bp, Homo sapiens
gtgaagctgaaccccctccaga

SEQ ID NO: 1711871 - DNA, 12 bp, Homo sapiens
gtgaaggaccct

SEQ ID NO: 1711872 - DNA, 14 bp, Homo sapiens
gtgaaggagaagtc

SEQ ID NO: 1711873 - DNA, 15 bp, Homo sapiens
gtgaagggaagtggg

SEQ ID NO: 1711874 - DNA, 16 bp, Homo sapiens
gtgaaggtgacagcag

SEQ ID NO: 1711875 - DNA, 17 bp, Homo sapiens
gtgaaggtgacagcagt

SEQ ID NO: 1711876 - DNA, 18 bp, Homo sapiens
gtgaagtaacccctcctg

SEQ ID NO: 1711877 - DNA, 20 bp, Homo sapiens
gtgaagtagcctcttgtgta

SEQ ID NO: 1711878 - DNA, 19 bp, Homo sapiens
gtgaagtatactgtatttt

SEQ ID NO: 1711879 - DNA, 21 bp, Homo sapiens
gtgaagtcacattccacatct

SEQ ID NO: 1711880 - DNA, 23 bp, Homo sapiens
gtgaagtcacattccacatctgt

SEQ ID NO: 1711881 - DNA, 15 bp, Homo sapiens
gtgaagttcatcttg

SEQ ID NO: 1711882 - DNA, 17 bp, Homo sapiens
gtgaagttcatcttgca

SEQ ID NO: 1711883 - DNA, 18 bp, Homo sapiens
gtgaagttcatcttgcag

SEQ ID NO: 1711884 - DNA, 19 bp, Homo sapiens
gtgaagttcatcttgcagc

SEQ ID NO: 1711885 - DNA, 15 bp, Homo sapiens
gtgaataataaaagt

SEQ ID NO: 1711886 - DNA, 22 bp, Homo sapiens
gtgaatacattaacggtgctaa

SEQ ID NO: 1711887 - DNA, 17 bp, Homo sapiens
gtgaatacattctttgc

SEQ ID NO: 1711888 - DNA, 19 bp, Homo sapiens
gtgaatacattctttgcta

SEQ ID NO: 1711889 - DNA, 19 bp, Homo sapiens
gtgaatactgctacagcaa

SEQ ID NO: 1711890 - DNA, 17 bp, Homo sapiens
gtgaatacttactataa

SEQ ID NO: 1711891 - DNA, 17 bp, Homo sapiens
gtgaataggttatatgc

SEQ ID NO: 1711892 - DNA, 15 bp, Homo sapiens
gtgaatcagacccta

SEQ ID NO: 1711893 - DNA, 21 bp, Homo sapiens
gtgaatctaaggataatgaaa

SEQ ID NO: 1711894 - DNA, 22 bp, Homo sapiens
gtgaatgccaaagccattctcc

SEQ ID NO: 1711895 - DNA, 13 bp, Homo sapiens
gtgaatgctggga

SEQ ID NO: 1711896 - DNA, 19 bp, Homo sapiens
gtgaatgttggtgtgaaac

SEQ ID NO: 1711897 - DNA, 22 bp, Homo sapiens
gtgaattaggctgtaactactt

SEQ ID NO: 1711898 - DNA, 16 bp, Homo sapiens
gtgaattattgacact

SEQ ID NO: 1711899 - DNA, 19 bp, Homo sapiens
gtgaattattgacactgaa

SEQ ID NO: 1711900 - DNA, 14 bp, Homo sapiens
gtgaattgctttat

SEQ ID NO: 1711901 - DNA, 19 bp, Homo sapiens
gtgaattgtcttttagaca

SEQ ID NO: 1711902 - DNA, 16 bp, Homo sapiens
gtgaatttctaaatgt

SEQ ID NO: 1711903 - DNA, 23 bp, Homo sapiens
gtgacaagctcctggtcttgaga

SEQ ID NO: 1711904 - DNA, 19 bp, Homo sapiens
gtgacaattctgtttttaa

SEQ ID NO: 1711905 - DNA, 16 bp, Homo sapiens
gtgacaattttgtaca

SEQ ID NO: 1711906 - DNA, 13 bp, Homo sapiens
gtgacacagacat

SEQ ID NO: 1711907 - DNA, 23 bp, Homo sapiens
gtgacacagacattttgtgtgag

SEQ ID NO: 1711908 - DNA, 15 bp, Homo sapiens
gtgacaccaataaat

SEQ ID NO: 1711909 - DNA, 21 bp, Homo sapiens
gtgacactgatgagtttcact

SEQ ID NO: 1711910 - DNA, 14 bp, Homo sapiens
gtgacactggacca

SEQ ID NO: 1711911 - DNA, 15 bp, Homo sapiens
gtgacagacaggctc

SEQ ID NO: 1711912 - DNA, 23 bp, Homo sapiens
gtgacagctttcctcaaaaagca

SEQ ID NO: 1711913 - DNA, 16 bp, Homo sapiens
gtgacagtcataaata

SEQ ID NO: 1711914 - DNA, 13 bp, Homo sapiens
gtgacagtgaaat

SEQ ID NO: 1711915 - DNA, 18 bp, Homo sapiens
gtgacagtgcctcttcca

SEQ ID NO: 1711916 - DNA, 22 bp, Homo sapiens
gtgacagttgcagcccttgtga

SEQ ID NO: 1711917 - DNA, 13 bp, Homo sapiens
gtgacagtttcca

SEQ ID NO: 1711918 - DNA, 14 bp, Homo sapiens
gtgacagtttccaa

SEQ ID NO: 1711919 - DNA, 15 bp, Homo sapiens
gtgacagtttccaaa

SEQ ID NO: 1711920 - DNA, 22 bp, Homo sapiens
gtgacatccacaaatgcagttt

SEQ ID NO: 1711921 - DNA, 23 bp, Homo sapiens
gtgacatcctgcttcttcttcca

SEQ ID NO: 1711922 - DNA, 16 bp, Homo sapiens
gtgacatcggaaaaat

SEQ ID NO: 1711923 - DNA, 18 bp, Homo sapiens
gtgacatcggaaaaataa

SEQ ID NO: 1711924 - DNA, 17 bp, Homo sapiens
gtgacatgcccaaggcc

SEQ ID NO: 1711925 - DNA, 19 bp, Homo sapiens
gtgacatgcccaaggccac

SEQ ID NO: 1711926 - DNA, 15 bp, Homo sapiens
gtgacatggtgcctg

SEQ ID NO: 1711927 - DNA, 22 bp, Homo sapiens
gtgacatggtgcctgagaggca

SEQ ID NO: 1711928 - DNA, 24 bp, Homo sapiens
gtgacatggtgcctgagaggcagg

SEQ ID NO: 1711929 - DNA, 17 bp, Homo sapiens
gtgaccaatacatttgt

SEQ ID NO: 1711930 - DNA, 17 bp, Homo sapiens
gtgaccaatgatggtca

SEQ ID NO: 1711931 - DNA, 13 bp, Homo sapiens
gtgaccactgaat

SEQ ID NO: 1711932 - DNA, 22 bp, Homo sapiens
gtgaccactgaattcactccag

SEQ ID NO: 1711933 - DNA, 12 bp, Homo sapiens
gtgaccagccac

SEQ ID NO: 1711934 - DNA, 17 bp, Homo sapiens
gtgaccaggcatcctcc

SEQ ID NO: 1711935 - DNA, 11 bp, Homo sapiens
gtgaccatgtt

SEQ ID NO: 1711936 - DNA, 17 bp, Homo sapiens
gtgacccaccagtgcct

SEQ ID NO: 1711937 - DNA, 16 bp, Homo sapiens
gtgacccctttcactt

SEQ ID NO: 1711938 - DNA, 20 bp, Homo sapiens
gtgaccccttttagtcagga

SEQ ID NO: 1711939 - DNA, 19 bp, Homo sapiens
gtgacccttcagggccaga

SEQ ID NO: 1711940 - DNA, 19 bp, Homo sapiens
gtgaccgactaccccagtc

SEQ ID NO: 1711941 - DNA, 19 bp, Homo sapiens
gtgaccggacttttctgca

SEQ ID NO: 1711942 - DNA, 19 bp, Homo sapiens
gtgacctattcaccctcca

SEQ ID NO: 1711943 - DNA, 18 bp, Homo sapiens
gtgacctccacagctacc

SEQ ID NO: 1711944 - DNA, 21 bp, Homo sapiens
gtgacctgggtatcccctgcc

SEQ ID NO: 1711945 - DNA, 20 bp, Homo sapiens
cagctcaatggactggaagg

SEQ ID NO: 1711946 - DNA, 18 bp, Homo sapiens
cagctcacaccctacctt

SEQ ID NO: 1711947 - DNA, 17 bp, Homo sapiens
cagctcacgtcacactt

SEQ ID NO: 1711948 - DNA, 13 bp, Homo sapiens
cagctcactgcaa

SEQ ID NO: 1711949 - DNA, 16 bp, Homo sapiens
cagctcactgctgctg

SEQ ID NO: 1711950 - DNA, 17 bp, Homo sapiens
cagctcagaggcccagg

SEQ ID NO: 1711951 - DNA, 22 bp, Homo sapiens
cagctcaggacagatgccacac

SEQ ID NO: 1711952 - DNA, 23 bp, Homo sapiens
cagctcaggcacacttcttcttg

SEQ ID NO: 1711953 - DNA, 23 bp, Homo sapiens
cagctcatgacactgtttggcct

SEQ ID NO: 1711954 - DNA, 14 bp, Homo sapiens
cagctccaacctgc

SEQ ID NO: 1711955 - DNA, 17 bp, Homo sapiens
cagctccaggtggctct

SEQ ID NO: 1711956 - DNA, 21 bp, Homo sapiens
cagctcccaacagaggcctcc

SEQ ID NO: 1711957 - DNA, 14 bp, Homo sapiens
cagctcccacccca

SEQ ID NO: 1711958 - DNA, 15 bp, Homo sapiens
cagctcccaccccac

SEQ ID NO: 1711959 - DNA, 20 bp, Homo sapiens
cagctcccactccctttcca

SEQ ID NO: 1711960 - DNA, 14 bp, Homo sapiens
cagctccccaggac

SEQ ID NO: 1711961 - DNA, 20 bp, Homo sapiens
cagctccccaggactcaccc

SEQ ID NO: 1711962 - DNA, 18 bp, Homo sapiens
gtgacttttcaagtattt

SEQ ID NO: 1711963 - DNA, 15 bp, Homo sapiens
gtgacttttgcttta

SEQ ID NO: 1711964 - DNA, 15 bp, Homo sapiens
gtgactttttagcca

SEQ ID NO: 1711965 - DNA, 21 bp, Homo sapiens
gtgagaaagggattgctgagg

SEQ ID NO: 1711966 - DNA, 18 bp, Homo sapiens
gtgagaactctctccctg

SEQ ID NO: 1711967 - DNA, 14 bp, Homo sapiens
gtgagaactgagga

SEQ ID NO: 1711968 - DNA, 18 bp, Homo sapiens
gtgagaatccctggcaaa

SEQ ID NO: 1711969 - DNA, 18 bp, Homo sapiens
gtgagaattgtgctttca

SEQ ID NO: 1711970 - DNA, 16 bp, Homo sapiens
gtgagacccccacacc

SEQ ID NO: 1711971 - DNA, 16 bp, Homo sapiens
gtgagaccctgtctct

SEQ ID NO: 1711972 - DNA, 14 bp, Homo sapiens
gtgagacgaggcag

SEQ ID NO: 1711973 - DNA, 17 bp, Homo sapiens
gtgagactcgagaactt

SEQ ID NO: 1711974 - DNA, 14 bp, Homo sapiens
gtgagacttaaaac

SEQ ID NO: 1711975 - DNA, 15 bp, Homo sapiens
gtgagacttaaaaca

SEQ ID NO: 1711976 - DNA, 13 bp, Homo sapiens
gtgagagaaagag

SEQ ID NO: 1711977 - DNA, 17 bp, Homo sapiens
gtgagagaaagagagaa

SEQ ID NO: 1711978 - DNA, 22 bp, Homo sapiens
gtgagagaaagagagaagccag

SEQ ID NO: 1711979 - DNA, 23 bp, Homo sapiens
gtgagagaaagagagaagccagc

SEQ ID NO: 1711980 - DNA, 13 bp, Homo sapiens
gtgagagtgagct

SEQ ID NO: 1711981 - DNA, 21 bp, Homo sapiens
gtgagatccttcacaggcagt

SEQ ID NO: 1711982 - DNA, 14 bp, Homo sapiens
gtgagcacagccta

SEQ ID NO: 1711983 - DNA, 15 bp, Homo sapiens
gtgagcagcctccac

SEQ ID NO: 1711984 - DNA, 23 bp, Homo sapiens
gtgagccaagatcgcaccactgc

SEQ ID NO: 1711985 - DNA, 16 bp, Homo sapiens
gtgagccacagaccac

SEQ ID NO: 1711986 - DNA, 18 bp, Homo sapiens
gtgagccgcatcttctcc

SEQ ID NO: 1711987 - DNA, 11 bp, Homo sapiens
gtgagcgcccc

SEQ ID NO: 1711988 - DNA, 17 bp, Homo sapiens
gtgagcgccccgccccc

SEQ ID NO: 1711989 - DNA, 20 bp, Homo sapiens
gtgagctctggtggagacaa

SEQ ID NO: 1711990 - DNA, 23 bp, Homo sapiens
gtgagctcttcctatccctctcc

SEQ ID NO: 1711991 - DNA, 20 bp, Homo sapiens
gtgagctggatagacttggg

SEQ ID NO: 1711992 - DNA, 16 bp, Homo sapiens
gtgagctgggaagctg

SEQ ID NO: 1711993 - DNA, 23 bp, Homo sapiens
gtgagctggggactcagggaccg

SEQ ID NO: 1711994 - DNA, 19 bp, Homo sapiens
gtgaggaaccctgatctct

SEQ ID NO: 1711995 - DNA, 16 bp, Homo sapiens
gtgaggaccactcctg

SEQ ID NO: 1711996 - DNA, 14 bp, Homo sapiens
gtgaggagctgctg

SEQ ID NO: 1711997 - DNA, 13 bp, Homo sapiens
gtgaggagctggg

SEQ ID NO: 1711998 - DNA, 20 bp, Homo sapiens
gtgaggaggaaaaggaaaaa

SEQ ID NO: 1711999 - DNA, 13 bp, Homo sapiens
gtgaggagggatg

SEQ ID NO: 1712000 - DNA, 21 bp, Homo sapiens
gtgaggagggatgtgggtaag

SEQ ID NO: 1712001 - DNA, 21 bp, Homo sapiens
gtgaggataacacaagtaaaa

SEQ ID NO: 1712002 - DNA, 14 bp, Homo sapiens
gtgaggattccaaa

SEQ ID NO: 1712003 - DNA, 20 bp, Homo sapiens
gtgaggattccaaaaacatt

SEQ ID NO: 1712004 - DNA, 20 bp, Homo sapiens
gtgaggcattcggggaagct

SEQ ID NO: 1712005 - DNA, 22 bp, Homo sapiens
gtgaggcattcggggaagctgc

SEQ ID NO: 1712006 - DNA, 11 bp, Homo sapiens
gtgaggcccaa

SEQ ID NO: 1712007 - DNA, 19 bp, Homo sapiens
gtgaggcggcagctggggc

SEQ ID NO: 1712008 - DNA, 14 bp, Homo sapiens
gtgaggctgctgcc

SEQ ID NO: 1712009 - DNA, 16 bp, Homo sapiens
gtgaggcttccaggct

SEQ ID NO: 1712010 - DNA, 13 bp, Homo sapiens
gtgagggagggga

SEQ ID NO: 1712011 - DNA, 17 bp, Homo sapiens
gtgaggggcaagctagg

SEQ ID NO: 1712012 - DNA, 13 bp, Homo sapiens
gtgaggggtccct

SEQ ID NO: 1712013 - DNA, 19 bp, Homo sapiens
gtgaggtgcagagtgccca

SEQ ID NO: 1712014 - DNA, 18 bp, Homo sapiens
gtgaggtgctgatgagtg

SEQ ID NO: 1712015 - DNA, 20 bp, Homo sapiens
gtgaggtgggttttcttccc

SEQ ID NO: 1712016 - DNA, 16 bp, Homo sapiens
gtgagtaagagctggt

SEQ ID NO: 1712017 - DNA, 22 bp, Homo sapiens
gtgagtcaatacatagtgctgc

SEQ ID NO: 1712018 - DNA, 20 bp, Homo sapiens
gtgagtcacctgctccagaa

SEQ ID NO: 1712019 - DNA, 23 bp, Homo sapiens
gtgagtcacctgctccagaagat

SEQ ID NO: 1712020 - DNA, 12 bp, Homo sapiens
gtgagtcagcac

SEQ ID NO: 1712021 - DNA, 15 bp, Homo sapiens
gtgagtccattctcc

SEQ ID NO: 1712022 - DNA, 17 bp, Homo sapiens
gtgagtcccagagcccg

SEQ ID NO: 1712023 - DNA, 18 bp, Homo sapiens
gtgagtcccctactccct

SEQ ID NO: 1712024 - DNA, 21 bp, Homo sapiens
gtgagtcttggcggcagcagc

SEQ ID NO: 1712025 - DNA, 17 bp, Homo sapiens
gtgagtctttggttcta

SEQ ID NO: 1712026 - DNA, 17 bp, Homo sapiens
gtgagtgccttttgcag

SEQ ID NO: 1712027 - DNA, 11 bp, Homo sapiens
gtgagtggagt

SEQ ID NO: 1712028 - DNA, 13 bp, Homo sapiens
gtgagtggcagcc

SEQ ID NO: 1712029 - DNA, 14 bp, Homo sapiens
gtgagtggcagcca

SEQ ID NO: 1712030 - DNA, 17 bp, Homo sapiens
gtgagtggcagccatgc

SEQ ID NO: 1712031 - DNA, 21 bp, Homo sapiens
gtgataaaatcataagtattt

SEQ ID NO: 1712032 - DNA, 13 bp, Homo sapiens
gtgataaactttg

SEQ ID NO: 1712033 - DNA, 20 bp, Homo sapiens
gtgatacatgtactccagag

SEQ ID NO: 1712034 - DNA, 22 bp, Homo sapiens
gtgatagtcttttgcttttggc

SEQ ID NO: 1712035 - DNA, 14 bp, Homo sapiens
gtgatattaaattt

SEQ ID NO: 1712036 - DNA, 12 bp, Homo sapiens
gtgatattcccc

SEQ ID NO: 1712037 - DNA, 13 bp, Homo sapiens
gtgatatttcaga

SEQ ID NO: 1712038 - DNA, 17 bp, Homo sapiens
gtgatcaataaaatgtg

SEQ ID NO: 1712039 - DNA, 24 bp, Homo sapiens
gtgatccacccgcctcagcctccc

SEQ ID NO: 1712040 - DNA, 21 bp, Homo sapiens
gtgatcctctcacctcagcct

SEQ ID NO: 1712041 - DNA, 13 bp, Homo sapiens
gtgatcctgttct

SEQ ID NO: 1712042 - DNA, 19 bp, Homo sapiens
gtgatccttccacctcagt

SEQ ID NO: 1712043 - DNA, 17 bp, Homo sapiens
gtgatccttggtgctgt

SEQ ID NO: 1712044 - DNA, 18 bp, Homo sapiens
gtgatctagtccttgtct

SEQ ID NO: 1712045 - DNA, 19 bp, Homo sapiens
gtgatctagtccttgtctt

SEQ ID NO: 1712046 - DNA, 12 bp, Homo sapiens
gtgatctccata

SEQ ID NO: 1712047 - DNA, 16 bp, Homo sapiens
gtgatctcccctcaca

SEQ ID NO: 1712048 - DNA, 23 bp, Homo sapiens
gtgatctcccctcacactttgcc

SEQ ID NO: 1712049 - DNA, 18 bp, Homo sapiens
gtgatctgtagacttctg

SEQ ID NO: 1712050 - DNA, 22 bp, Homo sapiens
gtgatcttaattactttcagaa

SEQ ID NO: 1712051 - DNA, 14 bp, Homo sapiens
gtgatcttggctca

SEQ ID NO: 1712052 - DNA, 15 bp, Homo sapiens
gtgatcttttaaagt

SEQ ID NO: 1712053 - DNA, 16 bp, Homo sapiens
gtgatgacttgctgtc

SEQ ID NO: 1712054 - DNA, 12 bp, Homo sapiens
gtgatgagctga

SEQ ID NO: 1712055 - DNA, 17 bp, Homo sapiens
gtgatgagtgtccttgc

SEQ ID NO: 1712056 - DNA, 11 bp, Homo sapiens
gtgatgatggg

SEQ ID NO: 1712057 - DNA, 15 bp, Homo sapiens
gtgatgccacacaga

SEQ ID NO: 1712058 - DNA, 13 bp, Homo sapiens
gtgatgcctccct

SEQ ID NO: 1712059 - DNA, 21 bp, Homo sapiens
gtgatggcgcgggaggcacca

SEQ ID NO: 1712060 - DNA, 20 bp, Homo sapiens
gtgatgggagaattggtata

SEQ ID NO: 1712061 - DNA, 14 bp, Homo sapiens
gtgatggggcaagg

SEQ ID NO: 1712062 - DNA, 22 bp, Homo sapiens
gtgatgggggcatgggtggagg

SEQ ID NO: 1712063 - DNA, 18 bp, Homo sapiens
gtctcctttgcaggctca

SEQ ID NO: 1712064 - DNA, 18 bp, Homo sapiens
gtctcgaatgtaattgga

SEQ ID NO: 1712065 - DNA, 15 bp, Homo sapiens
gtctcgatgcctgat

SEQ ID NO: 1712066 - DNA, 17 bp, Homo sapiens
gtctcgatgcctgattc

SEQ ID NO: 1712067 - DNA, 13 bp, Homo sapiens
gtctcgcagcctg

SEQ ID NO: 1712068 - DNA, 17 bp, Homo sapiens
gtctcgcagcctgaagc

SEQ ID NO: 1712069 - DNA, 23 bp, Homo sapiens
gtctcgcagcctgaagcctggat

SEQ ID NO: 1712070 - DNA, 23 bp, Homo sapiens
gtctcgggtggctagtcagagag

SEQ ID NO: 1712071 - DNA, 21 bp, Homo sapiens
gtctctaattctattaaagtg

SEQ ID NO: 1712072 - DNA, 21 bp, Homo sapiens
gtctctataccaataaagtga

SEQ ID NO: 1712073 - DNA, 20 bp, Homo sapiens
gtctctatattatgtcttct

SEQ ID NO: 1712074 - DNA, 21 bp, Homo sapiens
gtctctcactgtcgcccaggc

SEQ ID NO: 1712075 - DNA, 13 bp, Homo sapiens
gtctctccactgc

SEQ ID NO: 1712076 - DNA, 23 bp, Homo sapiens
gtctctccactgctctcagcctc

SEQ ID NO: 1712077 - DNA, 14 bp, Homo sapiens
gtctctcccacccc

SEQ ID NO: 1712078 - DNA, 21 bp, Homo sapiens
gtctctcccaccccctcccca

SEQ ID NO: 1712079 - DNA, 22 bp, Homo sapiens
gtctctcgtagtgttaagttat

SEQ ID NO: 1712080 - DNA, 16 bp, Homo sapiens
gtctctctccaggtca

SEQ ID NO: 1712081 - DNA, 19 bp, Homo sapiens
gtctctctctctctacaaa

SEQ ID NO: 1712082 - DNA, 15 bp, Homo sapiens
gtctctcttctctcc

SEQ ID NO: 1712083 - DNA, 23 bp, Homo sapiens
gtctctcttctctccagctgact

SEQ ID NO: 1712084 - DNA, 12 bp, Homo sapiens
gtctctcttgct

SEQ ID NO: 1712085 - DNA, 10 bp, Homo sapiens
gtctctgaag

SEQ ID NO: 1712086 - DNA, 12 bp, Homo sapiens
gtctctgcccca

SEQ ID NO: 1712087 - DNA, 17 bp, Homo sapiens
gtctctgccccagcctg

SEQ ID NO: 1712088 - DNA, 12 bp, Homo sapiens
gtctctgctgaa

SEQ ID NO: 1712089 - DNA, 11 bp, Homo sapiens
gtctctgctgg

SEQ ID NO: 1712090 - DNA, 19 bp, Homo sapiens
gtctctggaaaagctgggg

SEQ ID NO: 1712091 - DNA, 23 bp, Homo sapiens
gtcttaacaaaccaacatctttg

SEQ ID NO: 1712092 - DNA, 20 bp, Homo sapiens
gtcttaagatggaaatacag

SEQ ID NO: 1712093 - DNA, 21 bp, Homo sapiens
gtcttaagatggaaatacagt

SEQ ID NO: 1712094 - DNA, 15 bp, Homo sapiens
gtcttaagtgtttct

SEQ ID NO: 1712095 - DNA, 19 bp, Homo sapiens
gtcttaagtgtttctcaaa

SEQ ID NO: 1712096 - DNA, 21 bp, Homo sapiens
gtcttaagtgtttctcaaaag

SEQ ID NO: 1712097 - DNA, 19 bp, Homo sapiens
gtcttaattaaaagaatat

SEQ ID NO: 1712098 - DNA, 13 bp, Homo sapiens
gtcttaattatta

SEQ ID NO: 1712099 - DNA, 18 bp, Homo sapiens
gtcttaattattatttgt

SEQ ID NO: 1712100 - DNA, 21 bp, Homo sapiens
gtcttaattattatttgtgtt

SEQ ID NO: 1712101 - DNA, 16 bp, Homo sapiens
gtcttaatttatttct

SEQ ID NO: 1712102 - DNA, 19 bp, Homo sapiens
gtcttaatttatttcttaa

SEQ ID NO: 1712103 - DNA, 21 bp, Homo sapiens
gtcttagctctggacgtgaaa

SEQ ID NO: 1712104 - DNA, 18 bp, Homo sapiens
gtcttatgtgaaaaatta

SEQ ID NO: 1712105 - DNA, 20 bp, Homo sapiens
gtcttatgtgaaaaattaac

SEQ ID NO: 1712106 - DNA, 14 bp, Homo sapiens
gtcttatttcctca

SEQ ID NO: 1712107 - DNA, 16 bp, Homo sapiens
gtcttcacactgcgca

SEQ ID NO: 1712108 - DNA, 22 bp, Homo sapiens
gtcttcacactgcgcaggtctc

SEQ ID NO: 1712109 - DNA, 17 bp, Homo sapiens
gtcttcacatgtatgga

SEQ ID NO: 1712110 - DNA, 14 bp, Homo sapiens
gtcttcagacccag

SEQ ID NO: 1712111 - DNA, 15 bp, Homo sapiens
gtcttcagacccaga

SEQ ID NO: 1712112 - DNA, 22 bp, Homo sapiens
gtcttcagagataggcctgtgg

SEQ ID NO: 1712113 - DNA, 12 bp, Homo sapiens
gtcttcagccta

SEQ ID NO: 1712114 - DNA, 17 bp, Homo sapiens
gtcttcccttacctcaa

SEQ ID NO: 1712115 - DNA, 22 bp, Homo sapiens
gtcttccgatcaacatttatga

SEQ ID NO: 1712116 - DNA, 23 bp, Homo sapiens
gtcttccgatcaacatttatgac

SEQ ID NO: 1712117 - DNA, 16 bp, Homo sapiens
gtcttcctatttcaga

SEQ ID NO: 1712118 - DNA, 19 bp, Homo sapiens
gtcttcctcttagcctctg

SEQ ID NO: 1712119 - DNA, 14 bp, Homo sapiens
gtcttcctgacact

SEQ ID NO: 1712120 - DNA, 18 bp, Homo sapiens
gtcttcctgacactttaa

SEQ ID NO: 1712121 - DNA, 20 bp, Homo sapiens
gtcttcctgcattcacccag

SEQ ID NO: 1712122 - DNA, 22 bp, Homo sapiens
gtcttctcaggctctgccctgc

SEQ ID NO: 1712123 - DNA, 18 bp, Homo sapiens
gtcttctctctggctcag

SEQ ID NO: 1712124 - DNA, 23 bp, Homo sapiens
gtcttctgccctaacctgacaga

SEQ ID NO: 1712125 - DNA, 11 bp, Homo sapiens
gtcttcttggc

SEQ ID NO: 1712126 - DNA, 15 bp, Homo sapiens
gtcttcttggcagct

SEQ ID NO: 1712127 - DNA, 13 bp, Homo sapiens
gtcttcttttgtg

SEQ ID NO: 1712128 - DNA, 12 bp, Homo sapiens
gtcttgaaagat

SEQ ID NO: 1712129 - DNA, 15 bp, Homo sapiens
gtcttgaaatgaaag

SEQ ID NO: 1712130 - DNA, 16 bp, Homo sapiens
gtcttgaaatgaaagg

SEQ ID NO: 1712131 - DNA, 22 bp, Homo sapiens
gtcttgaacgagcagcccaggg

SEQ ID NO: 1712132 - DNA, 18 bp, Homo sapiens
gtcttgaattagtatttc

SEQ ID NO: 1712133 - DNA, 21 bp, Homo sapiens
gtcttgacgggagcattggcc

SEQ ID NO: 1712134 - DNA, 13 bp, Homo sapiens
gtcttgagaaaaa

SEQ ID NO: 1712135 - DNA, 21 bp, Homo sapiens
gtcttgatgttttttctgtaa

SEQ ID NO: 1712136 - DNA, 16 bp, Homo sapiens
gtcttgccagccagaa

SEQ ID NO: 1712137 - DNA, 18 bp, Homo sapiens
gtcttgcccagcagctca

SEQ ID NO: 1712138 - DNA, 15 bp, Homo sapiens
gtcttgcctatattt

SEQ ID NO: 1712139 - DNA, 18 bp, Homo sapiens
gtcttggacactgtacaa

SEQ ID NO: 1712140 - DNA, 20 bp, Homo sapiens
gtcttgggcagagctggctc

SEQ ID NO: 1712141 - DNA, 16 bp, Homo sapiens
gtcttgggctactggc

SEQ ID NO: 1712142 - DNA, 19 bp, Homo sapiens
gtcttgggctactggcagc

SEQ ID NO: 1712143 - DNA, 20 bp, Homo sapiens
gtcttgggctactggcagct

SEQ ID NO: 1712144 - DNA, 24 bp, Homo sapiens
gtcttgggctactggcagctcctc

SEQ ID NO: 1712145 - DNA, 15 bp, Homo sapiens
gtcttggggccactt

SEQ ID NO: 1712146 - DNA, 19 bp, Homo sapiens
gtcttgggggtcagggggg

SEQ ID NO: 1712147 - DNA, 16 bp, Homo sapiens
gtcttggttctaaagg

SEQ ID NO: 1712148 - DNA, 15 bp, Homo sapiens
gtcttgtacatgtgt

SEQ ID NO: 1712149 - DNA, 15 bp, Homo sapiens
gtcttgtacttctgt

SEQ ID NO: 1712150 - DNA, 18 bp, Homo sapiens
gtcttgtacttctgtgtt

SEQ ID NO: 1712151 - DNA, 20 bp, Homo sapiens
gtcttgtacttctgtgttca

SEQ ID NO: 1712152 - DNA, 22 bp, Homo sapiens
gtcttgtacttctgtgttcatt

SEQ ID NO: 1712153 - DNA, 17 bp, Homo sapiens
gtcttgttcattttgag

SEQ ID NO: 1712154 - DNA, 16 bp, Homo sapiens
gtctttaaatagatac

SEQ ID NO: 1712155 - DNA, 15 bp, Homo sapiens
gtctttattcttatt

SEQ ID NO: 1712156 - DNA, 18 bp, Homo sapiens
gtctttattcttattact

SEQ ID NO: 1712157 - DNA, 15 bp, Homo sapiens
gtctttcacagctcc

SEQ ID NO: 1712158 - DNA, 15 bp, Homo sapiens
gtctttcagtacttt

SEQ ID NO: 1712159 - DNA, 16 bp, Homo sapiens
gtctttcagtactttt

SEQ ID NO: 1712160 - DNA, 19 bp, Homo sapiens
gtctttcatggctgctgtt

SEQ ID NO: 1712161 - DNA, 16 bp, Homo sapiens
gtctttgcacatgtga

SEQ ID NO: 1712162 - DNA, 13 bp, Homo sapiens
gtctttgctcagt

SEQ ID NO: 1712163 - DNA, 17 bp, Homo sapiens
gtctttgctcagtggat

SEQ ID NO: 1712164 - DNA, 16 bp, Homo sapiens
gtctttgtaatgtcac

SEQ ID NO: 1712165 - DNA, 19 bp, Homo sapiens
gtctttgtaatgtcaccac

SEQ ID NO: 1712166 - DNA, 21 bp, Homo sapiens
gtctttgtaatgtcaccacct

SEQ ID NO: 1712167 - DNA, 22 bp, Homo sapiens
gtctttgtgggagggtaagaca

SEQ ID NO: 1712168 - DNA, 15 bp, Homo sapiens
gtctttgttgtctcc

SEQ ID NO: 1712169 - DNA, 13 bp, Homo sapiens
gtcttttaaaatg

SEQ ID NO: 1712170 - DNA, 20 bp, Homo sapiens
gtcttttccactcctatgga

SEQ ID NO: 1712171 - DNA, 14 bp, Homo sapiens
gtcttttgaatatt

SEQ ID NO: 1712172 - DNA, 16 bp, Homo sapiens
gtcttttgacatttta

SEQ ID NO: 1712173 - DNA, 14 bp, Homo sapiens
gtcttttgcttttg

SEQ ID NO: 1712174 - DNA, 18 bp, Homo sapiens
gtcttttttctcttccct

SEQ ID NO: 1712175 - DNA, 19 bp, Homo sapiens
gtcttttttttcctttgaa

SEQ ID NO: 1712176 - DNA, 20 bp, Homo sapiens
gtgaaaaaagaaaatggcta

SEQ ID NO: 1712177 - DNA, 12 bp, Homo sapiens
gtgaaaaaggaa

SEQ ID NO: 1712178 - DNA, 18 bp, Homo sapiens
gtgaaaaatgttaggaca

SEQ ID NO: 1712179 - DNA, 20 bp, Homo sapiens
gtgaaaaccaaccctgtggg

SEQ ID NO: 1712180 - DNA, 22 bp, Homo sapiens
gtgaaaaccaaccctgtgggct

SEQ ID NO: 1712181 - DNA, 17 bp, Homo sapiens
gtgaaaataagacaaaa

SEQ ID NO: 1712182 - DNA, 13 bp, Homo sapiens
gtgaaaatagtgt

SEQ ID NO: 1712183 - DNA, 20 bp, Homo sapiens
gtgaaaatagtgtaagaact

SEQ ID NO: 1712184 - DNA, 15 bp, Homo sapiens
cagccaaaccctgtc

SEQ ID NO: 1712185 - DNA, 18 bp, Homo sapiens
cagccaaatgcagggagg

SEQ ID NO: 1712186 - DNA, 22 bp, Homo sapiens
cagccaaatgtaattgaataaa

SEQ ID NO: 1712187 - DNA, 21 bp, Homo sapiens
cagccaacgagtaatttattg

SEQ ID NO: 1712188 - DNA, 20 bp, Homo sapiens
cagccaactagcccctgggg

SEQ ID NO: 1712189 - DNA, 23 bp, Homo sapiens
cagccaaggccgaagctctggct

SEQ ID NO: 1712190 - DNA, 23 bp, Homo sapiens
cagccaaggttttataaggctga

SEQ ID NO: 1712191 - DNA, 20 bp, Homo sapiens
cagccaatctagaggcaagc

SEQ ID NO: 1712192 - DNA, 16 bp, Homo sapiens
cagccacaccactgcc

SEQ ID NO: 1712193 - DNA, 13 bp, Homo sapiens
cagccacactggg

SEQ ID NO: 1712194 - DNA, 14 bp, Homo sapiens
cagccacactgggc

SEQ ID NO: 1712195 - DNA, 20 bp, Homo sapiens
cagccacagacccctgggag

SEQ ID NO: 1712196 - DNA, 13 bp, Homo sapiens
cagccacagagca

SEQ ID NO: 1712197 - DNA, 23 bp, Homo sapiens
cagccacagagcaaaagagggtt

SEQ ID NO: 1712198 - DNA, 10 bp, Homo sapiens
cagccacagg

SEQ ID NO: 1712199 - DNA, 12 bp, Homo sapiens
cagccacaggcc

SEQ ID NO: 1712200 - DNA, 23 bp, Homo sapiens
cagccacagtacatatgtaattc

SEQ ID NO: 1712201 - DNA, 15 bp, Homo sapiens
cagccacatgcccca

SEQ ID NO: 1712202 - DNA, 18 bp, Homo sapiens
cagccacatgccccaggc

SEQ ID NO: 1712203 - DNA, 19 bp, Homo sapiens
cagccacatgccccaggct

SEQ ID NO: 1712204 - DNA, 17 bp, Homo sapiens
cagccaccatctggagt

SEQ ID NO: 1712205 - DNA, 21 bp, Homo sapiens
cagccacccaagcctgctggc

SEQ ID NO: 1712206 - DNA, 11 bp, Homo sapiens
cagccaccccg

SEQ ID NO: 1712207 - DNA, 17 bp, Homo sapiens
cagccaccccgggctct

SEQ ID NO: 1712208 - DNA, 17 bp, Homo sapiens
cagccacctaaaaacat

SEQ ID NO: 1712209 - DNA, 15 bp, Homo sapiens
cagccacgactgcca

SEQ ID NO: 1712210 - DNA, 16 bp, Homo sapiens
cagccacgactgccat

SEQ ID NO: 1712211 - DNA, 15 bp, Homo sapiens
cagccacgcagggcc

SEQ ID NO: 1712212 - DNA, 21 bp, Homo sapiens
cagccacgcagggccatccac

SEQ ID NO: 1712213 - DNA, 22 bp, Homo sapiens
cagccacgcagggccatccact

SEQ ID NO: 1712214 - DNA, 14 bp, Homo sapiens
cagccacggccccg

SEQ ID NO: 1712215 - DNA, 16 bp, Homo sapiens
cagccactccccggca

SEQ ID NO: 1712216 - DNA, 22 bp, Homo sapiens
cagccagaaagcactacaatca

SEQ ID NO: 1712217 - DNA, 16 bp, Homo sapiens
cagccagaccagcagg

SEQ ID NO: 1712218 - DNA, 14 bp, Homo sapiens
cagccagactggca

SEQ ID NO: 1712219 - DNA, 20 bp, Homo sapiens
cagccagactggcacagttt

SEQ ID NO: 1712220 - DNA, 17 bp, Homo sapiens
cagccagagctgtgcct

SEQ ID NO: 1712221 - DNA, 20 bp, Homo sapiens
cagccagagctgtgcctgct

SEQ ID NO: 1712222 - DNA, 23 bp, Homo sapiens
cagccagagctgtgcctgctcag

SEQ ID NO: 1712223 - DNA, 14 bp, Homo sapiens
cagccagaggtgga

SEQ ID NO: 1712224 - DNA, 15 bp, Homo sapiens
cagccagagttcctg

SEQ ID NO: 1712225 - DNA, 15 bp, Homo sapiens
cagccagcacccacc

SEQ ID NO: 1712226 - DNA, 12 bp, Homo sapiens
cagccagcacct

SEQ ID NO: 1712227 - DNA, 13 bp, Homo sapiens
cagccagcacctg

SEQ ID NO: 1712228 - DNA, 14 bp, Homo sapiens
cagccagcacctgg

SEQ ID NO: 1712229 - DNA, 11 bp, Homo sapiens
cagccagcagc

SEQ ID NO: 1712230 - DNA, 12 bp, Homo sapiens
cagccagcagcc

SEQ ID NO: 1712231 - DNA, 14 bp, Homo sapiens
cagccagcagccag

SEQ ID NO: 1712232 - DNA, 12 bp, Homo sapiens
gtcactctgccc

SEQ ID NO: 1712233 - DNA, 14 bp, Homo sapiens
gtcactctgccctc

SEQ ID NO: 1712234 - DNA, 19 bp, Homo sapiens
gtcactctgccctctgctg

SEQ ID NO: 1712235 - DNA, 22 bp, Homo sapiens
gtcactctgccctctgctgctg

SEQ ID NO: 1712236 - DNA, 23 bp, Homo sapiens
gtcactgaaccactgcttctctt

SEQ ID NO: 1712237 - DNA, 20 bp, Homo sapiens
gtcactgcatggcttctgaa

SEQ ID NO: 1712238 - DNA, 12 bp, Homo sapiens
gtcactgcctct

SEQ ID NO: 1712239 - DNA, 20 bp, Homo sapiens
gtcactgcctctccctggcc

SEQ ID NO: 1712240 - DNA, 15 bp, Homo sapiens
gtcactgctctggac

SEQ ID NO: 1712241 - DNA, 22 bp, Homo sapiens
gtcactgctgcttcatgtttgc

SEQ ID NO: 1712242 - DNA, 15 bp, Homo sapiens
gtcactggcagcctg

SEQ ID NO: 1712243 - DNA, 14 bp, Homo sapiens
gtcactggctctcc

SEQ ID NO: 1712244 - DNA, 18 bp, Homo sapiens
gtcactggctctccaagt

SEQ ID NO: 1712245 - DNA, 17 bp, Homo sapiens
gtcactgttccttgtca

SEQ ID NO: 1712246 - DNA, 16 bp, Homo sapiens
gtcacttatttcataa

SEQ ID NO: 1712247 - DNA, 22 bp, Homo sapiens
gtcacttccagtgttggctgtg

SEQ ID NO: 1712248 - DNA, 13 bp, Homo sapiens
gtcacttctccat

SEQ ID NO: 1712249 - DNA, 21 bp, Homo sapiens
gtcacttcttcacctcttcca

SEQ ID NO: 1712250 - DNA, 22 bp, Homo sapiens
gtcacttcttcacctcttccac

SEQ ID NO: 1712251 - DNA, 14 bp, Homo sapiens
gtcactttttatgc

SEQ ID NO: 1712252 - DNA, 14 bp, Homo sapiens
gtcagaacatgtta

SEQ ID NO: 1712253 - DNA, 18 bp, Homo sapiens
gtcagaagcctccaagcc

SEQ ID NO: 1712254 - DNA, 20 bp, Homo sapiens
gtcagaagtcaataggccta

SEQ ID NO: 1712255 - DNA, 19 bp, Homo sapiens
gtcagaatgtgaaaaagga

SEQ ID NO: 1712256 - DNA, 15 bp, Homo sapiens
gtcagaccctggagg

SEQ ID NO: 1712257 - DNA, 20 bp, Homo sapiens
gtcagactgctgggactggc

SEQ ID NO: 1712258 - DNA, 16 bp, Homo sapiens
gtcagactttaaagaa

SEQ ID NO: 1712259 - DNA, 22 bp, Homo sapiens
gtcagactttgtgttcatttca

SEQ ID NO: 1712260 - DNA, 20 bp, Homo sapiens
gtcagagaaaatgagaaagg

SEQ ID NO: 1712261 - DNA, 16 bp, Homo sapiens
gtcagagcccagccca

SEQ ID NO: 1712262 - DNA, 13 bp, Homo sapiens
gtcagaggagaag

SEQ ID NO: 1712263 - DNA, 22 bp, Homo sapiens
gtcagagggactgtcagctgag

SEQ ID NO: 1712264 - DNA, 15 bp, Homo sapiens
gtcagagtgccactg

SEQ ID NO: 1712265 - DNA, 15 bp, Homo sapiens
gtcagatacaatgta

SEQ ID NO: 1712266 - DNA, 17 bp, Homo sapiens
gtcagatcctgttactt

SEQ ID NO: 1712267 - DNA, 15 bp, Homo sapiens
gtcagatgaggcaaa

SEQ ID NO: 1712268 - DNA, 13 bp, Homo sapiens
gtcagatttctgg

SEQ ID NO: 1712269 - DNA, 21 bp, Homo sapiens
gtcagatttctggttgatttg

SEQ ID NO: 1712270 - DNA, 21 bp, Homo sapiens
gtcagcaccttggcccaggag

SEQ ID NO: 1712271 - DNA, 23 bp, Homo sapiens
gtcagcaccttggcccaggagct

SEQ ID NO: 1712272 - DNA, 15 bp, Homo sapiens
gtcagcagctctgag

SEQ ID NO: 1712273 - DNA, 9 bp, Homo sapiens
gtcagcatc

SEQ ID NO: 1712274 - DNA, 12 bp, Homo sapiens
gtcagcatctga

SEQ ID NO: 1712275 - DNA, 15 bp, Homo sapiens
gtcagcatctgacca

SEQ ID NO: 1712276 - DNA, 23 bp, Homo sapiens
gtcagcatctgaccatctgtgac

SEQ ID NO: 1712277 - DNA, 14 bp, Homo sapiens
gtcagccacactgg

SEQ ID NO: 1712278 - DNA, 19 bp, Homo sapiens
gtcagccaggaccataccg

SEQ ID NO: 1712279 - DNA, 12 bp, Homo sapiens
gtcagccatttt

SEQ ID NO: 1712280 - DNA, 12 bp, Homo sapiens
gtcagcccagca

SEQ ID NO: 1712281 - DNA, 17 bp, Homo sapiens
gtcagcccagcacctgc

SEQ ID NO: 1712282 - DNA, 21 bp, Homo sapiens
gtcagccgagccgggcctggg

SEQ ID NO: 1712283 - DNA, 14 bp, Homo sapiens
gtcagctactaatg

SEQ ID NO: 1712284 - DNA, 17 bp, Homo sapiens
gtcagctactaatgatg

SEQ ID NO: 1712285 - DNA, 13 bp, Homo sapiens
gtcagctccagct

SEQ ID NO: 1712286 - DNA, 21 bp, Homo sapiens
gtcagctcccctcggagaaga

SEQ ID NO: 1712287 - DNA, 23 bp, Homo sapiens
gtcagctcccctcggagaagagc

SEQ ID NO: 1712288 - DNA, 13 bp, Homo sapiens
gtcagctctctgc

SEQ ID NO: 1712289 - DNA, 16 bp, Homo sapiens
gtcagctgagcttgag

SEQ ID NO: 1712290 - DNA, 13 bp, Homo sapiens
gtcagctgtgggg

SEQ ID NO: 1712291 - DNA, 22 bp, Homo sapiens
gtcagctgtggggaacacagct

SEQ ID NO: 1712292 - DNA, 14 bp, Homo sapiens
gtcagcttgaatgt

SEQ ID NO: 1712293 - DNA, 19 bp, Homo sapiens
gtcaggagttagaggccag

SEQ ID NO: 1712294 - DNA, 22 bp, Homo sapiens
gtcaggagttagaggccagcct

SEQ ID NO: 1712295 - DNA, 22 bp, Homo sapiens
gtcaggagttcaagaccagcct

SEQ ID NO: 1712296 - DNA, 22 bp, Homo sapiens
gtcaggagttgtttctgaccca

SEQ ID NO: 1712297 - DNA, 20 bp, Homo sapiens
gtcaggatgcacatttctgg

SEQ ID NO: 1712298 - DNA, 22 bp, Homo sapiens
gtcaggatgcacatttctggat

SEQ ID NO: 1712299 - DNA, 21 bp, Homo sapiens
gtcaggcaggtttgccagtga

SEQ ID NO: 1712300 - DNA, 17 bp, Homo sapiens
gtcaggcccgtcggagc

SEQ ID NO: 1712301 - DNA, 14 bp, Homo sapiens
gtcaggccctctgc

SEQ ID NO: 1712302 - DNA, 15 bp, Homo sapiens
cagcccatgcccacc

SEQ ID NO: 1712303 - DNA, 17 bp, Homo sapiens
cagcccatgcccacctg

SEQ ID NO: 1712304 - DNA, 21 bp, Homo sapiens
cagcccatgcccacctgccca

SEQ ID NO: 1712305 - DNA, 19 bp, Homo sapiens
cagcccatggcccccaata

SEQ ID NO: 1712306 - DNA, 23 bp, Homo sapiens
cagcccatggcccccaataaagg

SEQ ID NO: 1712307 - DNA, 20 bp, Homo sapiens
cagcccattctctctcctgt

SEQ ID NO: 1712308 - DNA, 22 bp, Homo sapiens
cagcccattctctctcctgtcc

SEQ ID NO: 1712309 - DNA, 23 bp, Homo sapiens
cagcccattctctctcctgtcca

SEQ ID NO: 1712310 - DNA, 16 bp, Homo sapiens
cagcccattgctgcca

SEQ ID NO: 1712311 - DNA, 18 bp, Homo sapiens
cagcccatttgggctctg

SEQ ID NO: 1712312 - DNA, 21 bp, Homo sapiens
cagccccacccaggagggagg

SEQ ID NO: 1712313 - DNA, 18 bp, Homo sapiens
cagccccaccctggccta

SEQ ID NO: 1712314 - DNA, 14 bp, Homo sapiens
cagccccactgaca

SEQ ID NO: 1712315 - DNA, 19 bp, Homo sapiens
cagccccactgacacccag

SEQ ID NO: 1712316 - DNA, 14 bp, Homo sapiens
cagccccactgcca

SEQ ID NO: 1712317 - DNA, 16 bp, Homo sapiens
cagccccactgccagc

SEQ ID NO: 1712318 - DNA, 22 bp, Homo sapiens
cagccccactgccagcagcagc

SEQ ID NO: 1712319 - DNA, 18 bp, Homo sapiens
cagccccacttcaccccc

SEQ ID NO: 1712320 - DNA, 17 bp, Homo sapiens
cagcccccaccagggga

SEQ ID NO: 1712321 - DNA, 14 bp, Homo sapiens
cagccccctccagc

SEQ ID NO: 1712322 - DNA, 14 bp, Homo sapiens
cagccccctggatg

SEQ ID NO: 1712323 - DNA, 15 bp, Homo sapiens
cagccccctggatgg

SEQ ID NO: 1712324 - DNA, 19 bp, Homo sapiens
cagcccccttgccctccgc

SEQ ID NO: 1712325 - DNA, 20 bp, Homo sapiens
cagcccccttgccctccgcc

SEQ ID NO: 1712326 - DNA, 21 bp, Homo sapiens
cagcccccttgccctccgcct

SEQ ID NO: 1712327 - DNA, 23 bp, Homo sapiens
cagcccccttgccctccgcctgg

SEQ ID NO: 1712328 - DNA, 19 bp, Homo sapiens
cagccccgacttcctgact

SEQ ID NO: 1712329 - DNA, 22 bp, Homo sapiens
cagccccgacttcctgactctc

SEQ ID NO: 1712330 - DNA, 17 bp, Homo sapiens
cagccccgccccgttgt

SEQ ID NO: 1712331 - DNA, 14 bp, Homo sapiens
cagccccgctccca

SEQ ID NO: 1712332 - DNA, 15 bp, Homo sapiens
cagccccgctcccac

SEQ ID NO: 1712333 - DNA, 17 bp, Homo sapiens
cagccccgctcccacct

SEQ ID NO: 1712334 - DNA, 22 bp, Homo sapiens
cagccccggcccccagcaggga

SEQ ID NO: 1712335 - DNA, 18 bp, Homo sapiens
cagccccggtggctgggc

SEQ ID NO: 1712336 - DNA, 19 bp, Homo sapiens
cagccccggtggctgggca

SEQ ID NO: 1712337 - DNA, 13 bp, Homo sapiens
cagcccctcctct

SEQ ID NO: 1712338 - DNA, 14 bp, Homo sapiens
cagcccctcctctg

SEQ ID NO: 1712339 - DNA, 19 bp, Homo sapiens
cagcccctcctctgccacc

SEQ ID NO: 1712340 - DNA, 21 bp, Homo sapiens
cagcccctcctctgccacctc

SEQ ID NO: 1712341 - DNA, 14 bp, Homo sapiens
cagcccctctggtc

SEQ ID NO: 1712342 - DNA, 18 bp, Homo sapiens
cagcccctctggtcgctc

SEQ ID NO: 1712343 - DNA, 23 bp, Homo sapiens
cagcccctcttggagaagtctca

SEQ ID NO: 1712344 - DNA, 14 bp, Homo sapiens
cagccccttctggc

SEQ ID NO: 1712345 - DNA, 16 bp, Homo sapiens
cagccccttctggccg

SEQ ID NO: 1712346 - DNA, 19 bp, Homo sapiens
gtccaggagaagtgctccc

SEQ ID NO: 1712347 - DNA, 20 bp, Homo sapiens
gtccaggagaagtgctccct

SEQ ID NO: 1712348 - DNA, 21 bp, Homo sapiens
gtccaggagaagtgctccctg

SEQ ID NO: 1712349 - DNA, 17 bp, Homo sapiens
gtccaggagctaatctg

SEQ ID NO: 1712350 - DNA, 15 bp, Homo sapiens
gtccaggcagctccc

SEQ ID NO: 1712351 - DNA, 19 bp, Homo sapiens
gtccaggcagctccctcct

SEQ ID NO: 1712352 - DNA, 21 bp, Homo sapiens
gtccaggcagctccctcctgc

SEQ ID NO: 1712353 - DNA, 17 bp, Homo sapiens
gtccaggccactgtggc

SEQ ID NO: 1712354 - DNA, 13 bp, Homo sapiens
gtccaggctgccg

SEQ ID NO: 1712355 - DNA, 13 bp, Homo sapiens
gtccagggaagct

SEQ ID NO: 1712356 - DNA, 19 bp, Homo sapiens
gtccagggagggagctgag

SEQ ID NO: 1712357 - DNA, 16 bp, Homo sapiens
gtccagggccctgagc

SEQ ID NO: 1712358 - DNA, 21 bp, Homo sapiens
gtccagggcctgacaccccct

SEQ ID NO: 1712359 - DNA, 15 bp, Homo sapiens
gtccagggtcctcta

SEQ ID NO: 1712360 - DNA, 12 bp, Homo sapiens
gtccagtctgtg

SEQ ID NO: 1712361 - DNA, 13 bp, Homo sapiens
gtccagtctgtga

SEQ ID NO: 1712362 - DNA, 20 bp, Homo sapiens
gtccagtctgtgatccttgg

SEQ ID NO: 1712363 - DNA, 21 bp, Homo sapiens
gtccagtgcattttgtttctg

SEQ ID NO: 1712364 - DNA, 15 bp, Homo sapiens
gtccatacactttgt

SEQ ID NO: 1712365 - DNA, 21 bp, Homo sapiens
gtccatatcagaactgtgcca

SEQ ID NO: 1712366 - DNA, 16 bp, Homo sapiens
gtccatggcaccagcc

SEQ ID NO: 1712367 - DNA, 19 bp, Homo sapiens
gtccatggcaccagccccc

SEQ ID NO: 1712368 - DNA, 20 bp, Homo sapiens
gtccatggcaccagccccct

SEQ ID NO: 1712369 - DNA, 23 bp, Homo sapiens
gtccatgtattcacacacccctc

SEQ ID NO: 1712370 - DNA, 23 bp, Homo sapiens
gtccattcattaattagttccag

SEQ ID NO: 1712371 - DNA, 13 bp, Homo sapiens
gtccattctccca

SEQ ID NO: 1712372 - DNA, 15 bp, Homo sapiens
gtccattctcccagg

SEQ ID NO: 1712373 - DNA, 15 bp, Homo sapiens
gtccatttgttcctg

SEQ ID NO: 1712374 - DNA, 16 bp, Homo sapiens
gtccatttgttcctgc

SEQ ID NO: 1712375 - DNA, 21 bp, Homo sapiens
gtcccaaatatgtattttcct

SEQ ID NO: 1712376 - DNA, 18 bp, Homo sapiens
gtcccaagcctgatactt

SEQ ID NO: 1712377 - DNA, 23 bp, Homo sapiens
gtcccaaggaaagccccagcact

SEQ ID NO: 1712378 - DNA, 13 bp, Homo sapiens
gtcccaaggagct

SEQ ID NO: 1712379 - DNA, 16 bp, Homo sapiens
gtcccaaggagctgat

SEQ ID NO: 1712380 - DNA, 22 bp, Homo sapiens
gtcccacaaaatatttctaagc

SEQ ID NO: 1712381 - DNA, 15 bp, Homo sapiens
gtcccacactttgaa

SEQ ID NO: 1712382 - DNA, 19 bp, Homo sapiens
gtcccaccaactctgcact

SEQ ID NO: 1712383 - DNA, 21 bp, Homo sapiens
gtcccacccacacagctgccc

SEQ ID NO: 1712384 - DNA, 22 bp, Homo sapiens
gtcccacccacacagctgccct

SEQ ID NO: 1712385 - DNA, 19 bp, Homo sapiens
gtcccacccccttccccca

SEQ ID NO: 1712386 - DNA, 13 bp, Homo sapiens
gtcccaccctccc

SEQ ID NO: 1712387 - DNA, 13 bp, Homo sapiens
gtcccagagcccg

SEQ ID NO: 1712388 - DNA, 22 bp, Homo sapiens
gtcccagagcttattggccact

SEQ ID NO: 1712389 - DNA, 20 bp, Homo sapiens
gtcccagaggttatctgcct

SEQ ID NO: 1712390 - DNA, 23 bp, Homo sapiens
gtcccagaggttatctgcctggc

SEQ ID NO: 1712391 - DNA, 21 bp, Homo sapiens
gtcccagattggctcacactg

SEQ ID NO: 1712392 - DNA, 14 bp, Homo sapiens
gtcccagcatccct

SEQ ID NO: 1712393 - DNA, 20 bp, Homo sapiens
gtcccagctgaaggcagtgg

SEQ ID NO: 1712394 - DNA, 12 bp, Homo sapiens
gtcccaggcaga

SEQ ID NO: 1712395 - DNA, 19 bp, Homo sapiens
gtcccagggccctcccagc

SEQ ID NO: 1712396 - DNA, 21 bp, Homo sapiens
gtcccaggggcagccacacca

SEQ ID NO: 1712397 - DNA, 17 bp, Homo sapiens
gtcccagtagccaaggc

SEQ ID NO: 1712398 - DNA, 17 bp, Homo sapiens
gtcccagtctctggcag

SEQ ID NO: 1712399 - DNA, 11 bp, Homo sapiens
gtcccagtggg

SEQ ID NO: 1712400 - DNA, 19 bp, Homo sapiens
gtcccagtgggaggggcag

SEQ ID NO: 1712401 - DNA, 15 bp, Homo sapiens
gtcccagttttgttg

SEQ ID NO: 1712402 - DNA, 23 bp, Homo sapiens
gtcccagttttgttgccccagaa

SEQ ID NO: 1712403 - DNA, 18 bp, Homo sapiens
gtcccatatcctgcctca

SEQ ID NO: 1712404 - DNA, 14 bp, Homo sapiens
gtcccatccaggca

SEQ ID NO: 1712405 - DNA, 17 bp, Homo sapiens
gtcccatgacccacccc

SEQ ID NO: 1712406 - DNA, 23 bp, Homo sapiens
gtcccatgacccacccctgtgct

SEQ ID NO: 1712407 - DNA, 14 bp, Homo sapiens
gtcccatgctccac

SEQ ID NO: 1712408 - DNA, 15 bp, Homo sapiens
gtcccatgctccacc

SEQ ID NO: 1712409 - DNA, 13 bp, Homo sapiens
gtcccattctaga

SEQ ID NO: 1712410 - DNA, 18 bp, Homo sapiens
gtcccatttccttggagg

SEQ ID NO: 1712411 - DNA, 16 bp, Homo sapiens
gtcccatttttctctt

SEQ ID NO: 1712412 - DNA, 14 bp, Homo sapiens
gtccccaaggcctc

SEQ ID NO: 1712413 - DNA, 20 bp, Homo sapiens
gtccccaaggcctctctctg

SEQ ID NO: 1712414 - DNA, 16 bp, Homo sapiens
gtccccaccctccact

SEQ ID NO: 1712415 - DNA, 14 bp, Homo sapiens
gtccccagcccttc

SEQ ID NO: 1712416 - DNA, 19 bp, Homo sapiens
gtccccagcccttctgcct

SEQ ID NO: 1712417 - DNA, 20 bp, Homo sapiens
gtccccagcccttctgcctt

SEQ ID NO: 1712418 - DNA, 13 bp, Homo sapiens
gtccccagctccc

SEQ ID NO: 1712419 - DNA, 18 bp, Homo sapiens
gtccccagctccccagga

SEQ ID NO: 1712420 - DNA, 13 bp, Homo sapiens
gtcccccagctct

SEQ ID NO: 1712421 - DNA, 15 bp, Homo sapiens
gtcccccagctctgg

SEQ ID NO: 1712422 - DNA, 12 bp, Homo sapiens
gtccccccaccc

SEQ ID NO: 1712423 - DNA, 18 bp, Homo sapiens
gtatgactaaagagagaa

SEQ ID NO: 1712424 - DNA, 20 bp, Homo sapiens
gtatgactaaagagagaatg

SEQ ID NO: 1712425 - DNA, 16 bp, Homo sapiens
gtatgagatggttaaa

SEQ ID NO: 1712426 - DNA, 15 bp, Homo sapiens
gtatgatgaaaataa

SEQ ID NO: 1712427 - DNA, 20 bp, Homo sapiens
gtatgatgaaaataattttc

SEQ ID NO: 1712428 - DNA, 21 bp, Homo sapiens
gtatgattactggcctttttc

SEQ ID NO: 1712429 - DNA, 23 bp, Homo sapiens
gtatgatttataaacagacaata

SEQ ID NO: 1712430 - DNA, 16 bp, Homo sapiens
gtatgatttgttttga

SEQ ID NO: 1712431 - DNA, 17 bp, Homo sapiens
gtatgcagtactaaaat

SEQ ID NO: 1712432 - DNA, 17 bp, Homo sapiens
gtatgccacacctggcc

SEQ ID NO: 1712433 - DNA, 14 bp, Homo sapiens
gtatgccttaagca

SEQ ID NO: 1712434 - DNA, 16 bp, Homo sapiens
gtatgccttaagcaga

SEQ ID NO: 1712435 - DNA, 22 bp, Homo sapiens
gtatgcgaaaaggtttttagga

SEQ ID NO: 1712436 - DNA, 13 bp, Homo sapiens
gtatgctgatcat

SEQ ID NO: 1712437 - DNA, 18 bp, Homo sapiens
gtatgcttgggccctgca

SEQ ID NO: 1712438 - DNA, 16 bp, Homo sapiens
gtatgctttccctgag

SEQ ID NO: 1712439 - DNA, 16 bp, Homo sapiens
gtatggaagttttcct

SEQ ID NO: 1712440 - DNA, 18 bp, Homo sapiens
gtatggaatacagtgtta

SEQ ID NO: 1712441 - DNA, 20 bp, Homo sapiens
gtatggacgtgtgtgaatgg

SEQ ID NO: 1712442 - DNA, 22 bp, Homo sapiens
gtatgggggcgactggggagtc

SEQ ID NO: 1712443 - DNA, 22 bp, Homo sapiens
gtatggtattacaaaacaaaca

SEQ ID NO: 1712444 - DNA, 13 bp, Homo sapiens
gtatggtctaaca

SEQ ID NO: 1712445 - DNA, 11 bp, Homo sapiens
gtatgtacaat

SEQ ID NO: 1712446 - DNA, 23 bp, Homo sapiens
gtatgtacaatacaatgtacaat

SEQ ID NO: 1712447 - DNA, 20 bp, Homo sapiens
gtatgtgggatattgaatgt

SEQ ID NO: 1712448 - DNA, 14 bp, Homo sapiens
gtatgtgtggctgt

SEQ ID NO: 1712449 - DNA, 15 bp, Homo sapiens
gtatgtgtggctgtg

SEQ ID NO: 1712450 - DNA, 17 bp, Homo sapiens
gtatgtgtgtgtgtatg

SEQ ID NO: 1712451 - DNA, 22 bp, Homo sapiens
gtatgttaaagcatcagagatg

SEQ ID NO: 1712452 - DNA, 18 bp, Homo sapiens
gtatgttaagctctttat

SEQ ID NO: 1712453 - DNA, 11 bp, Homo sapiens
gtatgttgtcc

SEQ ID NO: 1712454 - DNA, 18 bp, Homo sapiens
gtatgttgtccaattgtt

SEQ ID NO: 1712455 - DNA, 21 bp, Homo sapiens
gtatgtttgcacacttgtgtg

SEQ ID NO: 1712456 - DNA, 20 bp, Homo sapiens
gtattaaaactaaatttcac

SEQ ID NO: 1712457 - DNA, 19 bp, Homo sapiens
gtattaaaggggggagggg

SEQ ID NO: 1712458 - DNA, 21 bp, Homo sapiens
gtattaaattacatttgtaat

SEQ ID NO: 1712459 - DNA, 22 bp, Homo sapiens
gtattaactttatacacttgga

SEQ ID NO: 1712460 - DNA, 16 bp, Homo sapiens
gtattaagaaaggaag

SEQ ID NO: 1712461 - DNA, 20 bp, Homo sapiens
gtattaatccccatcattac

SEQ ID NO: 1712462 - DNA, 23 bp, Homo sapiens
gtattacagtgtcctaccactct

SEQ ID NO: 1712463 - DNA, 22 bp, Homo sapiens
gtattactgaataatatcaaat

SEQ ID NO: 1712464 - DNA, 18 bp, Homo sapiens
gtattagagcgccagctc

SEQ ID NO: 1712465 - DNA, 19 bp, Homo sapiens
gtattagagcgccagctcc

SEQ ID NO: 1712466 - DNA, 13 bp, Homo sapiens
gtattagcaaagc

SEQ ID NO: 1712467 - DNA, 15 bp, Homo sapiens
gtattagctcactga

SEQ ID NO: 1712468 - DNA, 22 bp, Homo sapiens
gtattagctgtattatccattt

SEQ ID NO: 1712469 - DNA, 16 bp, Homo sapiens
gtattagtgctagtct

SEQ ID NO: 1712470 - DNA, 17 bp, Homo sapiens
gtattatgcatatataa

SEQ ID NO: 1712471 - DNA, 20 bp, Homo sapiens
gtattatgccccagttcaga

SEQ ID NO: 1712472 - DNA, 18 bp, Homo sapiens
gtattatgtgcctaattt

SEQ ID NO: 1712473 - DNA, 16 bp, Homo sapiens
gtattattctgcagca

SEQ ID NO: 1712474 - DNA, 16 bp, Homo sapiens
gtattatttacattta

SEQ ID NO: 1712475 - DNA, 20 bp, Homo sapiens
gtattatttcaccagcagca

SEQ ID NO: 1712476 - DNA, 23 bp, Homo sapiens
gtattcaaatttgtgtcatacca

SEQ ID NO: 1712477 - DNA, 18 bp, Homo sapiens
gtattcaacaatttcaat

SEQ ID NO: 1712478 - DNA, 20 bp, Homo sapiens
gtattcaacaatttcaataa

SEQ ID NO: 1712479 - DNA, 21 bp, Homo sapiens
gtattcaataccgctcagtat

SEQ ID NO: 1712480 - DNA, 19 bp, Homo sapiens
gtattcagaggcagtgatg

SEQ ID NO: 1712481 - DNA, 16 bp, Homo sapiens
gtattcatgttcatgt

SEQ ID NO: 1712482 - DNA, 11 bp, Homo sapiens
cagatttttat

SEQ ID NO: 1712483 - DNA, 16 bp, Homo sapiens
cagatttttatttatg

SEQ ID NO: 1712484 - DNA, 17 bp, Homo sapiens
cagatttttatttatga

SEQ ID NO: 1712485 - DNA, 20 bp, Homo sapiens
cagattttttttggactgtt

SEQ ID NO: 1712486 - DNA, 13 bp, Homo sapiens
cagcaaaatgttg

SEQ ID NO: 1712487 - DNA, 15 bp, Homo sapiens
cagcaaacactccac

SEQ ID NO: 1712488 - DNA, 24 bp, Homo sapiens
cagcaaaccatttttaaagtagaa

SEQ ID NO: 1712489 - DNA, 18 bp, Homo sapiens
cagcaaagcagctgattc

SEQ ID NO: 1712490 - DNA, 22 bp, Homo sapiens
cagcaaagggaccaggggagag

SEQ ID NO: 1712491 - DNA, 13 bp, Homo sapiens
cagcaaatatatg

SEQ ID NO: 1712492 - DNA, 13 bp, Homo sapiens
cagcaaattttca

SEQ ID NO: 1712493 - DNA, 13 bp, Homo sapiens
cagcaacaagact

SEQ ID NO: 1712494 - DNA, 17 bp, Homo sapiens
cagcaacaagactgcca

SEQ ID NO: 1712495 - DNA, 19 bp, Homo sapiens
cagcaacaagactgccagg

SEQ ID NO: 1712496 - DNA, 20 bp, Homo sapiens
cagcaacaagactgccaggt

SEQ ID NO: 1712497 - DNA, 14 bp, Homo sapiens
cagcaacacagcct

SEQ ID NO: 1712498 - DNA, 19 bp, Homo sapiens
cagcaacacagcctgggcc

SEQ ID NO: 1712499 - DNA, 22 bp, Homo sapiens
cagcaacaggaatctcagagac

SEQ ID NO: 1712500 - DNA, 24 bp, Homo sapiens
cagcaacccttcctgctgctgcta

SEQ ID NO: 1712501 - DNA, 15 bp, Homo sapiens
cagcaacgcccctcc

SEQ ID NO: 1712502 - DNA, 19 bp, Homo sapiens
cagcaacgcccctccaaac

SEQ ID NO: 1712503 - DNA, 23 bp, Homo sapiens
cagcaacgcccctccaaacctcc

SEQ ID NO: 1712504 - DNA, 13 bp, Homo sapiens
cagcaactgccct

SEQ ID NO: 1712505 - DNA, 16 bp, Homo sapiens
cagcaactgcccttcc

SEQ ID NO: 1712506 - DNA, 20 bp, Homo sapiens
cagcaacttcttctccatcc

SEQ ID NO: 1712507 - DNA, 15 bp, Homo sapiens
cagcaacttgtcttt

SEQ ID NO: 1712508 - DNA, 21 bp, Homo sapiens
cagcaagactttataattcct

SEQ ID NO: 1712509 - DNA, 19 bp, Homo sapiens
cagcaagaggaggacagaa

SEQ ID NO: 1712510 - DNA, 18 bp, Homo sapiens
cagcaagagtaagcagtg

SEQ ID NO: 1712511 - DNA, 19 bp, Homo sapiens
cagcaagagtaagcagtgt

SEQ ID NO: 1712512 - DNA, 20 bp, Homo sapiens
cagcaagcgggagcccgtgg

SEQ ID NO: 1712513 - DNA, 10 bp, Homo sapiens
cagcaaggcc

SEQ ID NO: 1712514 - DNA, 22 bp, Homo sapiens
cagcaaggccttggtggagcag

SEQ ID NO: 1712515 - DNA, 23 bp, Homo sapiens
cagcaaggccttggtggagcagc

SEQ ID NO: 1712516 - DNA, 16 bp, Homo sapiens
cagcaaggctgctgcc

SEQ ID NO: 1712517 - DNA, 17 bp, Homo sapiens
cagcaagggacctgctc

SEQ ID NO: 1712518 - DNA, 18 bp, Homo sapiens
cagcaagggacctgctca

SEQ ID NO: 1712519 - DNA, 16 bp, Homo sapiens
cagcaaggggctctgc

SEQ ID NO: 1712520 - DNA, 15 bp, Homo sapiens
cagcaagtgagcaga

SEQ ID NO: 1712521 - DNA, 14 bp, Homo sapiens
cagcaagtgcccag

SEQ ID NO: 1712522 - DNA, 15 bp, Homo sapiens
cagcaagtgcccagt

SEQ ID NO: 1712523 - DNA, 16 bp, Homo sapiens
cagcaagtgcccagtg

SEQ ID NO: 1712524 - DNA, 17 bp, Homo sapiens
cagcaagtgcccagtgg

SEQ ID NO: 1712525 - DNA, 18 bp, Homo sapiens
cagcaagtgcccagtgga

SEQ ID NO: 1712526 - DNA, 22 bp, Homo sapiens
cagcaatatattaccagcaaga

SEQ ID NO: 1712527 - DNA, 22 bp, Homo sapiens
cagcaatgatgtccagaagaat

SEQ ID NO: 1712528 - DNA, 15 bp, Homo sapiens
cagcaatttcagaac

SEQ ID NO: 1712529 - DNA, 23 bp, Homo sapiens
cagcaatttctaatttttaagaa

SEQ ID NO: 1712530 - DNA, 14 bp, Homo sapiens
cagcacaagggcac

SEQ ID NO: 1712531 - DNA, 14 bp, Homo sapiens
cagcacacacagtg

SEQ ID NO: 1712532 - DNA, 16 bp, Homo sapiens
cagcacaccaagtggc

SEQ ID NO: 1712533 - DNA, 21 bp, Homo sapiens
cagcacaccaagtggctgggt

SEQ ID NO: 1712534 - DNA, 16 bp, Homo sapiens
cagcacacctcagccc

SEQ ID NO: 1712535 - DNA, 20 bp, Homo sapiens
cagcacacctcagccccact

SEQ ID NO: 1712536 - DNA, 23 bp, Homo sapiens
cagcacacctcagccccactgac

SEQ ID NO: 1712537 - DNA, 15 bp, Homo sapiens
gtcaaaaagtaatga

SEQ ID NO: 1712538 - DNA, 15 bp, Homo sapiens
gtcaaaactggttta

SEQ ID NO: 1712539 - DNA, 16 bp, Homo sapiens
gtcaaacaggctgtaa

SEQ ID NO: 1712540 - DNA, 18 bp, Homo sapiens
gtcaaacaggctgtaatt

SEQ ID NO: 1712541 - DNA, 17 bp, Homo sapiens
gtcaaacattcgtgagc

SEQ ID NO: 1712542 - DNA, 20 bp, Homo sapiens
gtcaaacattcgtgagctgg

SEQ ID NO: 1712543 - DNA, 20 bp, Homo sapiens
gtcaaactgtagaaatgatg

SEQ ID NO: 1712544 - DNA, 12 bp, Homo sapiens
gtcaaagaagct

SEQ ID NO: 1712545 - DNA, 16 bp, Homo sapiens
gtcaaagacagaatgg

SEQ ID NO: 1712546 - DNA, 22 bp, Homo sapiens
gtcaaagctttgactctataag

SEQ ID NO: 1712547 - DNA, 13 bp, Homo sapiens
gtcaaatccagtg

SEQ ID NO: 1712548 - DNA, 14 bp, Homo sapiens
gtcaaatccagtgg

SEQ ID NO: 1712549 - DNA, 19 bp, Homo sapiens
gtcaaatccagtggtgggt

SEQ ID NO: 1712550 - DNA, 14 bp, Homo sapiens
gtcaaatgccaaac

SEQ ID NO: 1712551 - DNA, 21 bp, Homo sapiens
gtcaaatgccaaacactagct

SEQ ID NO: 1712552 - DNA, 15 bp, Homo sapiens
gtcaaatgtttcctt

SEQ ID NO: 1712553 - DNA, 23 bp, Homo sapiens
gtcaacagagaaggcaggaatgt

SEQ ID NO: 1712554 - DNA, 17 bp, Homo sapiens
gtcaacagttcaaagaa

SEQ ID NO: 1712555 - DNA, 17 bp, Homo sapiens
gtcaactggagcaagaa

SEQ ID NO: 1712556 - DNA, 20 bp, Homo sapiens
gtcaactggagcaagaagga

SEQ ID NO: 1712557 - DNA, 17 bp, Homo sapiens
gtcaacttgacaccact

SEQ ID NO: 1712558 - DNA, 21 bp, Homo sapiens
gtcaacttgacaccactaaga

SEQ ID NO: 1712559 - DNA, 14 bp, Homo sapiens
gtcaagacatttct

SEQ ID NO: 1712560 - DNA, 15 bp, Homo sapiens
gtcaagacatttgct

SEQ ID NO: 1712561 - DNA, 13 bp, Homo sapiens
gtcaagctgctct

SEQ ID NO: 1712562 - DNA, 19 bp, Homo sapiens
gtcaagctgctctgagcca

SEQ ID NO: 1712563 - DNA, 19 bp, Homo sapiens
gtcaaggccacctctgcct

SEQ ID NO: 1712564 - DNA, 20 bp, Homo sapiens
gtcaaggccacctctgcctc

SEQ ID NO: 1712565 - DNA, 15 bp, Homo sapiens
gtcaaggcctgctcc

SEQ ID NO: 1712566 - DNA, 16 bp, Homo sapiens
gtcaaggcctgctccc

SEQ ID NO: 1712567 - DNA, 13 bp, Homo sapiens
gtcaagtcaacca

SEQ ID NO: 1712568 - DNA, 18 bp, Homo sapiens
gtcaagttaacaaggaat

SEQ ID NO: 1712569 - DNA, 14 bp, Homo sapiens
gtcaagttcccaac

SEQ ID NO: 1712570 - DNA, 22 bp, Homo sapiens
gtcaagttgggttcacttgcca

SEQ ID NO: 1712571 - DNA, 18 bp, Homo sapiens
gtcaagttgtgcttgttt

SEQ ID NO: 1712572 - DNA, 18 bp, Homo sapiens
gtcaataaacttagagga

SEQ ID NO: 1712573 - DNA, 19 bp, Homo sapiens
gtcaataacactgtatttt

SEQ ID NO: 1712574 - DNA, 16 bp, Homo sapiens
gtcaatacaaatgtta

SEQ ID NO: 1712575 - DNA, 16 bp, Homo sapiens
gtcaatattaaataca

SEQ ID NO: 1712576 - DNA, 17 bp, Homo sapiens
gtcaatattaaatacag

SEQ ID NO: 1712577 - DNA, 19 bp, Homo sapiens
gtcaatatttagtaaagct

SEQ ID NO: 1712578 - DNA, 17 bp, Homo sapiens
gtcaatcccctcattca

SEQ ID NO: 1712579 - DNA, 13 bp, Homo sapiens
gtcaattctgtta

SEQ ID NO: 1712580 - DNA, 22 bp, Homo sapiens
gtcaatttctgtgttgccaagc

SEQ ID NO: 1712581 - DNA, 21 bp, Homo sapiens
gtcaatttgtatatcatgaaa

SEQ ID NO: 1712582 - DNA, 21 bp, Homo sapiens
gtcacaaatcctaaaagaagc

SEQ ID NO: 1712583 - DNA, 15 bp, Homo sapiens
gtcacaacctctctg

SEQ ID NO: 1712584 - DNA, 19 bp, Homo sapiens
gtcacacaacactgatgtg

SEQ ID NO: 1712585 - DNA, 19 bp, Homo sapiens
gtcacacagtgttggaggt

SEQ ID NO: 1712586 - DNA, 22 bp, Homo sapiens
gtcacactgttactccacagcg

SEQ ID NO: 1712587 - DNA, 19 bp, Homo sapiens
gtcacagaaatcagaggag

SEQ ID NO: 1712588 - DNA, 17 bp, Homo sapiens
gtcacagaaattatgat

SEQ ID NO: 1712589 - DNA, 20 bp, Homo sapiens
gtcacagagtgagactccat

SEQ ID NO: 1712590 - DNA, 22 bp, Homo sapiens
gtcacagcatggaggaggaggg

SEQ ID NO: 1712591 - DNA, 11 bp, Homo sapiens
gtcacagctgc

SEQ ID NO: 1712592 - DNA, 12 bp, Homo sapiens
gtcacagctgca

SEQ ID NO: 1712593 - DNA, 18 bp, Homo sapiens
gtcacagctgcagctggg

SEQ ID NO: 1712594 - DNA, 21 bp, Homo sapiens
gtcacagtccaaccagaaaca

SEQ ID NO: 1712595 - DNA, 15 bp, Homo sapiens
gtcacatcacaggac

SEQ ID NO: 1712596 - DNA, 14 bp, Homo sapiens
gtcacatccatccc

SEQ ID NO: 1712597 - DNA, 23 bp, Homo sapiens
gtcacatggcctatgcacatatg

SEQ ID NO: 1712598 - DNA, 19 bp, Homo sapiens
gtcacatggggcctggccc

SEQ ID NO: 1712599 - DNA, 22 bp, Homo sapiens
gtcaccaaatcagctgctacta

SEQ ID NO: 1712600 - DNA, 15 bp, Homo sapiens
cagcagcagcaggtg

SEQ ID NO: 1712601 - DNA, 21 bp, Homo sapiens
cagcagcatagaacaggacct

SEQ ID NO: 1712602 - DNA, 23 bp, Homo sapiens
cagcagcatagaacaggacctct

SEQ ID NO: 1712603 - DNA, 15 bp, Homo sapiens
cagcagccagctctc

SEQ ID NO: 1712604 - DNA, 19 bp, Homo sapiens
cagcagccagctctcagcc

SEQ ID NO: 1712605 - DNA, 21 bp, Homo sapiens
cagcagccagctctcagccaa

SEQ ID NO: 1712606 - DNA, 15 bp, Homo sapiens
cagcagccagggacc

SEQ ID NO: 1712607 - DNA, 16 bp, Homo sapiens
cagcagccagggaccc

SEQ ID NO: 1712608 - DNA, 20 bp, Homo sapiens
cagcagccagggacccccag

SEQ ID NO: 1712609 - DNA, 14 bp, Homo sapiens
cagcagccagtctc

SEQ ID NO: 1712610 - DNA, 19 bp, Homo sapiens
cagcagccagtctcagaga

SEQ ID NO: 1712611 - DNA, 23 bp, Homo sapiens
cagcagccagtctcagagaccag

SEQ ID NO: 1712612 - DNA, 20 bp, Homo sapiens
cagcagcccaagcttccctc

SEQ ID NO: 1712613 - DNA, 11 bp, Homo sapiens
cagcagcccta

SEQ ID NO: 1712614 - DNA, 23 bp, Homo sapiens
cagcagccctaaggatctctcag

SEQ ID NO: 1712615 - DNA, 15 bp, Homo sapiens
cagcagccctcctca

SEQ ID NO: 1712616 - DNA, 19 bp, Homo sapiens
cagcagccctcctcacccc

SEQ ID NO: 1712617 - DNA, 12 bp, Homo sapiens
cagcagcctccc

SEQ ID NO: 1712618 - DNA, 14 bp, Homo sapiens
cagcagcctcgcac

SEQ ID NO: 1712619 - DNA, 18 bp, Homo sapiens
cagcagcctcgcacaggc

SEQ ID NO: 1712620 - DNA, 20 bp, Homo sapiens
cagcagcctcgcacaggccc

SEQ ID NO: 1712621 - DNA, 18 bp, Homo sapiens
cagcagcgcgcaggcctg

SEQ ID NO: 1712622 - DNA, 17 bp, Homo sapiens
cagcagctaggactgag

SEQ ID NO: 1712623 - DNA, 17 bp, Homo sapiens
cagcagctcaacctacc

SEQ ID NO: 1712624 - DNA, 16 bp, Homo sapiens
cagcagctcaggcaca

SEQ ID NO: 1712625 - DNA, 17 bp, Homo sapiens
cagcagctgcaggggcc

SEQ ID NO: 1712626 - DNA, 11 bp, Homo sapiens
cagcagctgcg

SEQ ID NO: 1712627 - DNA, 19 bp, Homo sapiens
cagcagctgggacccctcc

SEQ ID NO: 1712628 - DNA, 22 bp, Homo sapiens
cagcagctgggacccctcccaa

SEQ ID NO: 1712629 - DNA, 19 bp, Homo sapiens
cagcagctggtgccccacc

SEQ ID NO: 1712630 - DNA, 21 bp, Homo sapiens
cagcagctggtgccccacctg

SEQ ID NO: 1712631 - DNA, 12 bp, Homo sapiens
cagcagcttcac

SEQ ID NO: 1712632 - DNA, 16 bp, Homo sapiens
cagcagcttcaccaga

SEQ ID NO: 1712633 - DNA, 13 bp, Homo sapiens
cagcaggaagcca

SEQ ID NO: 1712634 - DNA, 22 bp, Homo sapiens
cagcaggacttgctaaagcact

SEQ ID NO: 1712635 - DNA, 21 bp, Homo sapiens
cagcaggagagactgagcagc

SEQ ID NO: 1712636 - DNA, 17 bp, Homo sapiens
cagcaggaggagtggaa

SEQ ID NO: 1712637 - DNA, 20 bp, Homo sapiens
cagcaggaggttctgggcct

SEQ ID NO: 1712638 - DNA, 15 bp, Homo sapiens
cagcaggcccagcat

SEQ ID NO: 1712639 - DNA, 16 bp, Homo sapiens
cagcaggcccagcatg

SEQ ID NO: 1712640 - DNA, 23 bp, Homo sapiens
cagcaggcggcctttgttgctca

SEQ ID NO: 1712641 - DNA, 17 bp, Homo sapiens
cagcaggctcctggctg

SEQ ID NO: 1712642 - DNA, 21 bp, Homo sapiens
cagcaggctcctggctgtgcc

SEQ ID NO: 1712643 - DNA, 23 bp, Homo sapiens
cagcaggctcctggctgtgccca

SEQ ID NO: 1712644 - DNA, 17 bp, Homo sapiens
cagcagggaagggatga

SEQ ID NO: 1712645 - DNA, 21 bp, Homo sapiens
cagcaggggccctcactcttg

SEQ ID NO: 1712646 - DNA, 14 bp, Homo sapiens
cagcaggggtgtga

SEQ ID NO: 1712647 - DNA, 17 bp, Homo sapiens
cagcaggtcacactggg

SEQ ID NO: 1712648 - DNA, 22 bp, Homo sapiens
cagcaggtcctccatcccaaca

SEQ ID NO: 1712649 - DNA, 20 bp, Homo sapiens
cagcaggtgattggaccagg

SEQ ID NO: 1712650 - DNA, 21 bp, Homo sapiens
cagcaggtgattggaccaggc

SEQ ID NO: 1712651 - DNA, 22 bp, Homo sapiens
cagagagaggggagaagcctgg

SEQ ID NO: 1712652 - DNA, 19 bp, Homo sapiens
cagagagaggggcctgcag

SEQ ID NO: 1712653 - DNA, 21 bp, Homo sapiens
cagagagaggggcctgcaggt

SEQ ID NO: 1712654 - DNA, 16 bp, Homo sapiens
cagagagccaaatctg

SEQ ID NO: 1712655 - DNA, 17 bp, Homo sapiens
cagagagccaaatctga

SEQ ID NO: 1712656 - DNA, 20 bp, Homo sapiens
cagagaggactgtagggagg

SEQ ID NO: 1712657 - DNA, 15 bp, Homo sapiens
cagagaggagcacct

SEQ ID NO: 1712658 - DNA, 16 bp, Homo sapiens
cagagaggatacattt

SEQ ID NO: 1712659 - DNA, 18 bp, Homo sapiens
cagagaggatacatttaa

SEQ ID NO: 1712660 - DNA, 13 bp, Homo sapiens
cagagagggccca

SEQ ID NO: 1712661 - DNA, 14 bp, Homo sapiens
cagagagggcccag

SEQ ID NO: 1712662 - DNA, 16 bp, Homo sapiens
cagagagggcccagct

SEQ ID NO: 1712663 - DNA, 23 bp, Homo sapiens
cagagagggcccagctgtagcca

SEQ ID NO: 1712664 - DNA, 21 bp, Homo sapiens
cagagaggtggagaactggga

SEQ ID NO: 1712665 - DNA, 17 bp, Homo sapiens
cagagatgagtgtctgg

SEQ ID NO: 1712666 - DNA, 13 bp, Homo sapiens
cagagatgcctcc

SEQ ID NO: 1712667 - DNA, 21 bp, Homo sapiens
cagagatgcctccaccgctgc

SEQ ID NO: 1712668 - DNA, 21 bp, Homo sapiens
cagagattctggatctcctgc

SEQ ID NO: 1712669 - DNA, 24 bp, Homo sapiens
cagagattctggatctcctgctgc

SEQ ID NO: 1712670 - DNA, 20 bp, Homo sapiens
cagagatttctcattgactt

SEQ ID NO: 1712671 - DNA, 15 bp, Homo sapiens
cagagcaaagcgccc

SEQ ID NO: 1712672 - DNA, 20 bp, Homo sapiens
cagagcaagactctgtctca

SEQ ID NO: 1712673 - DNA, 18 bp, Homo sapiens
cagagcaagatcctgtct

SEQ ID NO: 1712674 - DNA, 20 bp, Homo sapiens
cagagcaagatcctgtcttt

SEQ ID NO: 1712675 - DNA, 18 bp, Homo sapiens
cagagcaattccaggctg

SEQ ID NO: 1712676 - DNA, 20 bp, Homo sapiens
cagagcaatttacaagagct

SEQ ID NO: 1712677 - DNA, 15 bp, Homo sapiens
cagagcacacaggta

SEQ ID NO: 1712678 - DNA, 12 bp, Homo sapiens
cagagcacgcct

SEQ ID NO: 1712679 - DNA, 14 bp, Homo sapiens
cagagcagctaact

SEQ ID NO: 1712680 - DNA, 13 bp, Homo sapiens
cagagcaggaagc

SEQ ID NO: 1712681 - DNA, 17 bp, Homo sapiens
cagagcaggaaggacag

SEQ ID NO: 1712682 - DNA, 13 bp, Homo sapiens
cagagcaggagcc

SEQ ID NO: 1712683 - DNA, 15 bp, Homo sapiens
cagagcaggaggccc

SEQ ID NO: 1712684 - DNA, 13 bp, Homo sapiens
cagagcaggcaat

SEQ ID NO: 1712685 - DNA, 14 bp, Homo sapiens
cagagcaggggcag

SEQ ID NO: 1712686 - DNA, 12 bp, Homo sapiens
ggtggggctcgt

SEQ ID NO: 1712687 - DNA, 15 bp, Homo sapiens
ggtggggctgagcct

SEQ ID NO: 1712688 - DNA, 22 bp, Homo sapiens
ggtggggctgctcctccagggc

SEQ ID NO: 1712689 - DNA, 12 bp, Homo sapiens
ggtgggggagga

SEQ ID NO: 1712690 - DNA, 14 bp, Homo sapiens
ggtgggggagggag

SEQ ID NO: 1712691 - DNA, 15 bp, Homo sapiens
ggtgggggctgtcct

SEQ ID NO: 1712692 - DNA, 18 bp, Homo sapiens
ggtgggggctgtcctgct

SEQ ID NO: 1712693 - DNA, 15 bp, Homo sapiens
ggtggggggtccagt

SEQ ID NO: 1712694 - DNA, 17 bp, Homo sapiens
ggtggggggtccagtct

SEQ ID NO: 1712695 - DNA, 16 bp, Homo sapiens
ggtgggggtgccgctg

SEQ ID NO: 1712696 - DNA, 21 bp, Homo sapiens
ggtgggggtgccgctgtctct

SEQ ID NO: 1712697 - DNA, 22 bp, Homo sapiens
ggtgggggtgccgctgtctctg

SEQ ID NO: 1712698 - DNA, 13 bp, Homo sapiens
ggtgggggtgctc

SEQ ID NO: 1712699 - DNA, 16 bp, Homo sapiens
ggtgggggtggaggct

SEQ ID NO: 1712700 - DNA, 18 bp, Homo sapiens
ggtggggtgcactcgcca

SEQ ID NO: 1712701 - DNA, 20 bp, Homo sapiens
ggtgggtccgcatccctgct

SEQ ID NO: 1712702 - DNA, 22 bp, Homo sapiens
ggtgggtctatgttccccagga

SEQ ID NO: 1712703 - DNA, 18 bp, Homo sapiens
ggtgggtggagtcaggct

SEQ ID NO: 1712704 - DNA, 16 bp, Homo sapiens
ggtgggttttcttccc

SEQ ID NO: 1712705 - DNA, 17 bp, Homo sapiens
ggtgggttttcttccca

SEQ ID NO: 1712706 - DNA, 15 bp, Homo sapiens
ggtggtaactgccag

SEQ ID NO: 1712707 - DNA, 17 bp, Homo sapiens
ggtggtaactgccagcc

SEQ ID NO: 1712708 - DNA, 23 bp, Homo sapiens
ggtggtactttattcttgctggg

SEQ ID NO: 1712709 - DNA, 14 bp, Homo sapiens
ggtggtaggcctat

SEQ ID NO: 1712710 - DNA, 19 bp, Homo sapiens
ggtggtcctgactcaacat

SEQ ID NO: 1712711 - DNA, 12 bp, Homo sapiens
ggtggtggacag

SEQ ID NO: 1712712 - DNA, 13 bp, Homo sapiens
ggtggtggggaca

SEQ ID NO: 1712713 - DNA, 16 bp, Homo sapiens
ggtggttattggactc

SEQ ID NO: 1712714 - DNA, 17 bp, Homo sapiens
ggtggttattggactcc

SEQ ID NO: 1712715 - DNA, 18 bp, Homo sapiens
ggtggttattggactcca

SEQ ID NO: 1712716 - DNA, 20 bp, Homo sapiens
ggtggttattggactccagg

SEQ ID NO: 1712717 - DNA, 21 bp, Homo sapiens
ggtggttattggactccaggc

SEQ ID NO: 1712718 - DNA, 19 bp, Homo sapiens
ggtggttcgtgctgtgctc

SEQ ID NO: 1712719 - DNA, 17 bp, Homo sapiens
ggtgtaacttcctgctg

SEQ ID NO: 1712720 - DNA, 12 bp, Homo sapiens
ggtgtaggggcc

SEQ ID NO: 1712721 - DNA, 13 bp, Homo sapiens
ggtgtatagtgtt

SEQ ID NO: 1712722 - DNA, 23 bp, Homo sapiens
ggtgtatagtgttcacaaactgt

SEQ ID NO: 1712723 - DNA, 23 bp, Homo sapiens
ggtgtcaaacattcgtgagctgg

SEQ ID NO: 1712724 - DNA, 21 bp, Homo sapiens
ggtgtcacccaaaccggcagg

SEQ ID NO: 1712725 - DNA, 13 bp, Homo sapiens
ggtgtcaggcccg

SEQ ID NO: 1712726 - DNA, 14 bp, Homo sapiens
ggtgtcctgaccac

SEQ ID NO: 1712727 - DNA, 17 bp, Homo sapiens
ggtgtcctgaccaccct

SEQ ID NO: 1712728 - DNA, 18 bp, Homo sapiens
ggtgtcctgaccaccctc

SEQ ID NO: 1712729 - DNA, 23 bp, Homo sapiens
ggtgtcgccgcctgctccctgca

SEQ ID NO: 1712730 - DNA, 14 bp, Homo sapiens
ggtgtctggggtga

SEQ ID NO: 1712731 - DNA, 21 bp, Homo sapiens
ggtgtcttttccactcctatg

SEQ ID NO: 1712732 - DNA, 16 bp, Homo sapiens
ggtgtgaacccgggag

SEQ ID NO: 1712733 - DNA, 11 bp, Homo sapiens
ggtgtgaccat

SEQ ID NO: 1712734 - DNA, 15 bp, Homo sapiens
ggtgtgactctagca

SEQ ID NO: 1712735 - DNA, 21 bp, Homo sapiens
ggtgtgagaatgatcaaggat

SEQ ID NO: 1712736 - DNA, 13 bp, Homo sapiens
ggtgtgcctgtgc

SEQ ID NO: 1712737 - DNA, 20 bp, Homo sapiens
ggtgtgcctgtgctcctgcc

SEQ ID NO: 1712738 - DNA, 23 bp, Homo sapiens
ggtgtgcctgtgctcctgcccag

SEQ ID NO: 1712739 - DNA, 22 bp, Homo sapiens
ggtgtgctgggagctccactct

SEQ ID NO: 1712740 - DNA, 12 bp, Homo sapiens
ggtgtggccagc

SEQ ID NO: 1712741 - DNA, 15 bp, Homo sapiens
ggtgtggccctgcca

SEQ ID NO: 1712742 - DNA, 18 bp, Homo sapiens
ggtgtggccctgccatct

SEQ ID NO: 1712743 - DNA, 22 bp, Homo sapiens
ggtgtggggacacagcagtgag

SEQ ID NO: 1712744 - DNA, 23 bp, Homo sapiens
ggtgtggggctgccgatgggaaa

SEQ ID NO: 1712745 - DNA, 15 bp, Homo sapiens
ggtgtggtggctcat

SEQ ID NO: 1712746 - DNA, 18 bp, Homo sapiens
ggtgtggtggctcatggc

SEQ ID NO: 1712747 - DNA, 14 bp, Homo sapiens
ggtgtgtccagggg

SEQ ID NO: 1712748 - DNA, 18 bp, Homo sapiens
ggtgtgtccctggacaca

SEQ ID NO: 1712749 - DNA, 22 bp, Homo sapiens
ggtgtgtccctggacacagctc

SEQ ID NO: 1712750 - DNA, 12 bp, Homo sapiens
ggtgtgtctgct

SEQ ID NO: 1712751 - DNA, 19 bp, Homo sapiens
ggtgtgtggtgaggggctt

SEQ ID NO: 1712752 - DNA, 18 bp, Homo sapiens
ggtgtgtgttcaccttca

SEQ ID NO: 1712753 - DNA, 19 bp, Homo sapiens
ggtgttactagaaggcgtc

SEQ ID NO: 1712754 - DNA, 22 bp, Homo sapiens
ggtgttgccatttctctgctta

SEQ ID NO: 1712755 - DNA, 12 bp, Homo sapiens
ggtgtttattgc

SEQ ID NO: 1712756 - DNA, 14 bp, Homo sapiens
ggtgtttcaacaga

SEQ ID NO: 1712757 - DNA, 14 bp, Homo sapiens
ggtgttttgtcaga

SEQ ID NO: 1712758 - DNA, 15 bp, Homo sapiens
ggtgtttttaataaa

SEQ ID NO: 1712759 - DNA, 16 bp, Homo sapiens
ggttaaaaaaaaaagt

SEQ ID NO: 1712760 - DNA, 23 bp, Homo sapiens
ggttaaaaaaaggcattgtttga

SEQ ID NO: 1712761 - DNA, 13 bp, Homo sapiens
ggttaaaaacctg

SEQ ID NO: 1712762 - DNA, 13 bp, Homo sapiens
ggttaaaaaggcc

SEQ ID NO: 1712763 - DNA, 18 bp, Homo sapiens
ggttaaatattttgctaa

SEQ ID NO: 1712764 - DNA, 13 bp, Homo sapiens
ggttaacaaatga

SEQ ID NO: 1712765 - DNA, 19 bp, Homo sapiens
ggttaaggtgggtccagga

SEQ ID NO: 1712766 - DNA, 15 bp, Homo sapiens
cagaggacagtctgg

SEQ ID NO: 1712767 - DNA, 18 bp, Homo sapiens
cagaggacagtctggaga

SEQ ID NO: 1712768 - DNA, 13 bp, Homo sapiens
cagaggaccacag

SEQ ID NO: 1712769 - DNA, 18 bp, Homo sapiens
cagaggaccacagtgggt

SEQ ID NO: 1712770 - DNA, 16 bp, Homo sapiens
cagaggaccagggcct

SEQ ID NO: 1712771 - DNA, 22 bp, Homo sapiens
cagaggacccttacgtgagaaa

SEQ ID NO: 1712772 - DNA, 15 bp, Homo sapiens
cagaggagaagacaa

SEQ ID NO: 1712773 - DNA, 22 bp, Homo sapiens
cagaggagatgccacttctcac

SEQ ID NO: 1712774 - DNA, 15 bp, Homo sapiens
cagaggagccttttt

SEQ ID NO: 1712775 - DNA, 18 bp, Homo sapiens
cagaggagggcagcagaa

SEQ ID NO: 1712776 - DNA, 17 bp, Homo sapiens
cagaggatgccttttct

SEQ ID NO: 1712777 - DNA, 15 bp, Homo sapiens
cagaggatgctcttt

SEQ ID NO: 1712778 - DNA, 11 bp, Homo sapiens
cagaggcagag

SEQ ID NO: 1712779 - DNA, 18 bp, Homo sapiens
cagaggcagaggttgcag

SEQ ID NO: 1712780 - DNA, 13 bp, Homo sapiens
cagaggcccagga

SEQ ID NO: 1712781 - DNA, 17 bp, Homo sapiens
cagaggccccagcctcc

SEQ ID NO: 1712782 - DNA, 12 bp, Homo sapiens
cagaggccctgg

SEQ ID NO: 1712783 - DNA, 15 bp, Homo sapiens
cagaggccctggagg

SEQ ID NO: 1712784 - DNA, 21 bp, Homo sapiens
cagaggccgaaggtgcctcag

SEQ ID NO: 1712785 - DNA, 22 bp, Homo sapiens
cagaggccgaaggtgcctcaga

SEQ ID NO: 1712786 - DNA, 21 bp, Homo sapiens
cagaggcctcccccagccagg

SEQ ID NO: 1712787 - DNA, 23 bp, Homo sapiens
cagaggcctcccccagccaggac

SEQ ID NO: 1712788 - DNA, 21 bp, Homo sapiens
cagaggcctggcatcttctgg

SEQ ID NO: 1712789 - DNA, 22 bp, Homo sapiens
cagaggcctggcatcttctgga

SEQ ID NO: 1712790 - DNA, 15 bp, Homo sapiens
cagaggcctggggga

SEQ ID NO: 1712791 - DNA, 21 bp, Homo sapiens
cagaggcctgttttggggctt

SEQ ID NO: 1712792 - DNA, 23 bp, Homo sapiens
cagaggcgtactacccagctctg

SEQ ID NO: 1712793 - DNA, 24 bp, Homo sapiens
cagaggcgtactacccagctctgt

SEQ ID NO: 1712794 - DNA, 20 bp, Homo sapiens
cagaggctattattttcact

SEQ ID NO: 1712795 - DNA, 13 bp, Homo sapiens
cagaggctgcagg

SEQ ID NO: 1712796 - DNA, 16 bp, Homo sapiens
cagaggctggaggcag

SEQ ID NO: 1712797 - DNA, 17 bp, Homo sapiens
cagaggctggaggcagg

SEQ ID NO: 1712798 - DNA, 18 bp, Homo sapiens
cagaggctggaggcaggg

SEQ ID NO: 1712799 - DNA, 20 bp, Homo sapiens
cagaggctggaggcagggcc

SEQ ID NO: 1712800 - DNA, 12 bp, Homo sapiens
cagaggctgggt

SEQ ID NO: 1712801 - DNA, 13 bp, Homo sapiens
cagaggctgggtt

SEQ ID NO: 1712802 - DNA, 20 bp, Homo sapiens
cagaggcttcttcagatcag

SEQ ID NO: 1712803 - DNA, 18 bp, Homo sapiens
cagagggaatgttccctg

SEQ ID NO: 1712804 - DNA, 17 bp, Homo sapiens
cagagggacagggtgga

SEQ ID NO: 1712805 - DNA, 18 bp, Homo sapiens
cagagggactgtcagctg

SEQ ID NO: 1712806 - DNA, 14 bp, Homo sapiens
cagagggcacatga

SEQ ID NO: 1712807 - DNA, 14 bp, Homo sapiens
gtaaaacaatgcca

SEQ ID NO: 1712808 - DNA, 19 bp, Homo sapiens
gtaaaacaatgccatgaac

SEQ ID NO: 1712809 - DNA, 18 bp, Homo sapiens
gtaaaaccctttaaatgt

SEQ ID NO: 1712810 - DNA, 21 bp, Homo sapiens
gtaaaagatcaggttatactt

SEQ ID NO: 1712811 - DNA, 18 bp, Homo sapiens
gtaaaagtggtctctgct

SEQ ID NO: 1712812 - DNA, 20 bp, Homo sapiens
gtaaaagtggtctctgctgg

SEQ ID NO: 1712813 - DNA, 21 bp, Homo sapiens
gtaaaagtggtctctgctggg

SEQ ID NO: 1712814 - DNA, 17 bp, Homo sapiens
gtaaaatactattgcct

SEQ ID NO: 1712815 - DNA, 13 bp, Homo sapiens
gtaaaatactttt

SEQ ID NO: 1712816 - DNA, 16 bp, Homo sapiens
gtaaaatatgtaaaac

SEQ ID NO: 1712817 - DNA, 15 bp, Homo sapiens
gtaaaatcttgtcat

SEQ ID NO: 1712818 - DNA, 18 bp, Homo sapiens
gtaaaatcttgtcatgtg

SEQ ID NO: 1712819 - DNA, 20 bp, Homo sapiens
gtaaaatcttgtcatgtgta

SEQ ID NO: 1712820 - DNA, 23 bp, Homo sapiens
gtaaaatcttgtcatgtgtataa

SEQ ID NO: 1712821 - DNA, 22 bp, Homo sapiens
gtaaaatgtgaagtgaatgaaa

SEQ ID NO: 1712822 - DNA, 18 bp, Homo sapiens
gtaaaatgtgggattatg

SEQ ID NO: 1712823 - DNA, 17 bp, Homo sapiens
gtaaaattgagtgcact

SEQ ID NO: 1712824 - DNA, 16 bp, Homo sapiens
gtaaaattgttcctga

SEQ ID NO: 1712825 - DNA, 17 bp, Homo sapiens
gtaaaatttatttatat

SEQ ID NO: 1712826 - DNA, 13 bp, Homo sapiens
gtaaaattttagg

SEQ ID NO: 1712827 - DNA, 23 bp, Homo sapiens
gtaaacaacgtgtatagtgccta

SEQ ID NO: 1712828 - DNA, 20 bp, Homo sapiens
gtaaacagatggcactttga

SEQ ID NO: 1712829 - DNA, 14 bp, Homo sapiens
gtaaacagggtacc

SEQ ID NO: 1712830 - DNA, 17 bp, Homo sapiens
gtaaacaggtatttttt

SEQ ID NO: 1712831 - DNA, 20 bp, Homo sapiens
gtaaacaggtatttttttaa

SEQ ID NO: 1712832 - DNA, 14 bp, Homo sapiens
gtaaacagtgcctg

SEQ ID NO: 1712833 - DNA, 17 bp, Homo sapiens
gtaaacagtgcctgctg

SEQ ID NO: 1712834 - DNA, 18 bp, Homo sapiens
gtaaacagtgcctgctga

SEQ ID NO: 1712835 - DNA, 23 bp, Homo sapiens
gtaaacataattcttgtatatta

SEQ ID NO: 1712836 - DNA, 21 bp, Homo sapiens
gtaaacattaagtaaatgctg

SEQ ID NO: 1712837 - DNA, 12 bp, Homo sapiens
gtaaaccactga

SEQ ID NO: 1712838 - DNA, 13 bp, Homo sapiens
gtaaaccactgaa

SEQ ID NO: 1712839 - DNA, 19 bp, Homo sapiens
gtaaaccactgaaaaaata

SEQ ID NO: 1712840 - DNA, 17 bp, Homo sapiens
gtaaacgaaggcataat

SEQ ID NO: 1712841 - DNA, 22 bp, Homo sapiens
gtaaactgatgtactgaattcc

SEQ ID NO: 1712842 - DNA, 19 bp, Homo sapiens
gtaaactttatcacttaaa

SEQ ID NO: 1712843 - DNA, 15 bp, Homo sapiens
gtaaagaaaaatatt

SEQ ID NO: 1712844 - DNA, 16 bp, Homo sapiens
gtaaagactgtagaag

SEQ ID NO: 1712845 - DNA, 21 bp, Homo sapiens
gtaaagcccatttttaaaata

SEQ ID NO: 1712846 - DNA, 20 bp, Homo sapiens
gtaaagctatttatgggccc

SEQ ID NO: 1712847 - DNA, 19 bp, Homo sapiens
gtaaaggatattaaatgtt

SEQ ID NO: 1712848 - DNA, 22 bp, Homo sapiens
gtaaagtatgtattatttacat

SEQ ID NO: 1712849 - DNA, 19 bp, Homo sapiens
gtaaagtcggtgattatat

SEQ ID NO: 1712850 - DNA, 16 bp, Homo sapiens
gtaaagttatgtattt

SEQ ID NO: 1712851 - DNA, 14 bp, Homo sapiens
gtaaataaaaagaa

SEQ ID NO: 1712852 - DNA, 22 bp, Homo sapiens
gtaaataaaatgtgtacagtga

SEQ ID NO: 1712853 - DNA, 17 bp, Homo sapiens
gtaaataaactatttat

SEQ ID NO: 1712854 - DNA, 15 bp, Homo sapiens
gtaaataaagtctat

SEQ ID NO: 1712855 - DNA, 13 bp, Homo sapiens
gtaaataagagat

SEQ ID NO: 1712856 - DNA, 18 bp, Homo sapiens
gtaaatacaacacatcta

SEQ ID NO: 1712857 - DNA, 16 bp, Homo sapiens
gtaaatacaatttgta

SEQ ID NO: 1712858 - DNA, 17 bp, Homo sapiens
gtaaatacaatttgtac

SEQ ID NO: 1712859 - DNA, 14 bp, Homo sapiens
gtaaatactggact

SEQ ID NO: 1712860 - DNA, 18 bp, Homo sapiens
gtaaatactggactcagg

SEQ ID NO: 1712861 - DNA, 19 bp, Homo sapiens
gtaaatactggactcagga

SEQ ID NO: 1712862 - DNA, 19 bp, Homo sapiens
gtaaatactttccatgttt

SEQ ID NO: 1712863 - DNA, 20 bp, Homo sapiens
gtaaatactttccatgtttt

SEQ ID NO: 1712864 - DNA, 15 bp, Homo sapiens
gtaaatagtatttga

SEQ ID NO: 1712865 - DNA, 16 bp, Homo sapiens
gtaaatagtatttgag

SEQ ID NO: 1712866 - DNA, 14 bp, Homo sapiens
gtaaatatatatgg

SEQ ID NO: 1712867 - DNA, 14 bp, Homo sapiens
gtaaatattctaca

SEQ ID NO: 1712868 - DNA, 13 bp, Homo sapiens
gtaaatattctat

SEQ ID NO: 1712869 - DNA, 15 bp, Homo sapiens
gtaaatattctatat

SEQ ID NO: 1712870 - DNA, 16 bp, Homo sapiens
gtaaatcagaaagtaa

SEQ ID NO: 1712871 - DNA, 14 bp, Homo sapiens
gtaaatcagtaaga

SEQ ID NO: 1712872 - DNA, 17 bp, Homo sapiens
gtaaatcagtaagaggt

SEQ ID NO: 1712873 - DNA, 16 bp, Homo sapiens
gtaaatcctgccattt

SEQ ID NO: 1712874 - DNA, 15 bp, Homo sapiens
gtaaatcctttttct

SEQ ID NO: 1712875 - DNA, 22 bp, Homo sapiens
gtaaatctagagtttatacagt

SEQ ID NO: 1712876 - DNA, 13 bp, Homo sapiens
gtaaatctgccac

SEQ ID NO: 1712877 - DNA, 12 bp, Homo sapiens
gtaaatcttttt

SEQ ID NO: 1712878 - DNA, 10 bp, Homo sapiens
gtaaatgcct

SEQ ID NO: 1712879 - DNA, 19 bp, Homo sapiens
gtaaatgctcgtgtgattt

SEQ ID NO: 1712880 - DNA, 21 bp, Homo sapiens
gtaaatgctcgtgtgatttcc

SEQ ID NO: 1712881 - DNA, 21 bp, Homo sapiens
gtaccatagaaaaatgtataa

SEQ ID NO: 1712882 - DNA, 11 bp, Homo sapiens
gtaccatcaat

SEQ ID NO: 1712883 - DNA, 16 bp, Homo sapiens
gtaccatcaataaagt

SEQ ID NO: 1712884 - DNA, 16 bp, Homo sapiens
gtaccatgaatattta

SEQ ID NO: 1712885 - DNA, 20 bp, Homo sapiens
gtaccatggtttgatatgta

SEQ ID NO: 1712886 - DNA, 13 bp, Homo sapiens
gtaccattttaaa

SEQ ID NO: 1712887 - DNA, 13 bp, Homo sapiens
gtaccccaccctc

SEQ ID NO: 1712888 - DNA, 23 bp, Homo sapiens
gtaccccaccctcagcacccctt

SEQ ID NO: 1712889 - DNA, 17 bp, Homo sapiens
gtaccctctcagctcca

SEQ ID NO: 1712890 - DNA, 19 bp, Homo sapiens
gtaccctctcagctccagg

SEQ ID NO: 1712891 - DNA, 14 bp, Homo sapiens
gtacccttccacct

SEQ ID NO: 1712892 - DNA, 18 bp, Homo sapiens
gtaccgccagcagctgtc

SEQ ID NO: 1712893 - DNA, 19 bp, Homo sapiens
gtaccgcccggcagcccct

SEQ ID NO: 1712894 - DNA, 18 bp, Homo sapiens
gtacctcctctcagtgtt

SEQ ID NO: 1712895 - DNA, 21 bp, Homo sapiens
gtacctcgggtgggagggatg

SEQ ID NO: 1712896 - DNA, 18 bp, Homo sapiens
gtacctgaaaagtaactt

SEQ ID NO: 1712897 - DNA, 17 bp, Homo sapiens
gtacctgcaagcagaac

SEQ ID NO: 1712898 - DNA, 19 bp, Homo sapiens
gtacctgcaagcagaactt

SEQ ID NO: 1712899 - DNA, 14 bp, Homo sapiens
gtacctgccctcta

SEQ ID NO: 1712900 - DNA, 19 bp, Homo sapiens
gtacctgctgccccagctg

SEQ ID NO: 1712901 - DNA, 18 bp, Homo sapiens
gtacctgggaaaggaccc

SEQ ID NO: 1712902 - DNA, 19 bp, Homo sapiens
gtacctgggaaaggaccca

SEQ ID NO: 1712903 - DNA, 15 bp, Homo sapiens
gtacctgtccctcca

SEQ ID NO: 1712904 - DNA, 16 bp, Homo sapiens
gtacctgtccctccag

SEQ ID NO: 1712905 - DNA, 18 bp, Homo sapiens
gtacctgtccctccaggc

SEQ ID NO: 1712906 - DNA, 16 bp, Homo sapiens
gtaccttcatgtgatt

SEQ ID NO: 1712907 - DNA, 14 bp, Homo sapiens
gtaccttgctgtgg

SEQ ID NO: 1712908 - DNA, 17 bp, Homo sapiens
gtaccttgttgcagatg

SEQ ID NO: 1712909 - DNA, 23 bp, Homo sapiens
gtacgatcaagttgttgactgtg

SEQ ID NO: 1712910 - DNA, 24 bp, Homo sapiens
gtacgatcaagttgttgactgtga

SEQ ID NO: 1712911 - DNA, 13 bp, Homo sapiens
gtactaagcattt

SEQ ID NO: 1712912 - DNA, 23 bp, Homo sapiens
gtactaaggaatctttctgcttt

SEQ ID NO: 1712913 - DNA, 18 bp, Homo sapiens
gtactacagctatatttg

SEQ ID NO: 1712914 - DNA, 19 bp, Homo sapiens
gtactacagctatatttga

SEQ ID NO: 1712915 - DNA, 14 bp, Homo sapiens
gtactacccagctc

SEQ ID NO: 1712916 - DNA, 16 bp, Homo sapiens
gtactacccagctctg

SEQ ID NO: 1712917 - DNA, 17 bp, Homo sapiens
gtactacccagctctgt

SEQ ID NO: 1712918 - DNA, 15 bp, Homo sapiens
gtactactagatgtc

SEQ ID NO: 1712919 - DNA, 18 bp, Homo sapiens
gtactactgccttgtact

SEQ ID NO: 1712920 - DNA, 19 bp, Homo sapiens
gtactatcttatctcagat

SEQ ID NO: 1712921 - DNA, 17 bp, Homo sapiens
gtactatgtatcaatga

SEQ ID NO: 1712922 - DNA, 13 bp, Homo sapiens
gtactatgtctga

SEQ ID NO: 1712923 - DNA, 13 bp, Homo sapiens
gtactatgttaat

SEQ ID NO: 1712924 - DNA, 15 bp, Homo sapiens
gtactatttaactga

SEQ ID NO: 1712925 - DNA, 18 bp, Homo sapiens
gtactatttaactgacta

SEQ ID NO: 1712926 - DNA, 15 bp, Homo sapiens
gtactatttcttaat

SEQ ID NO: 1712927 - DNA, 16 bp, Homo sapiens
gtactcacatataaca

SEQ ID NO: 1712928 - DNA, 15 bp, Homo sapiens
gtactcagagcagag

SEQ ID NO: 1712929 - DNA, 17 bp, Homo sapiens
gtactcaggaggctgag

SEQ ID NO: 1712930 - DNA, 20 bp, Homo sapiens
gtactccctctcaggatcca

SEQ ID NO: 1712931 - DNA, 22 bp, Homo sapiens
gtactctctgctctagccagga

SEQ ID NO: 1712932 - DNA, 11 bp, Homo sapiens
gtactctttaa

SEQ ID NO: 1712933 - DNA, 23 bp, Homo sapiens
gtactgaaagccttagggaagct

SEQ ID NO: 1712934 - DNA, 14 bp, Homo sapiens
gtactgacccagga

SEQ ID NO: 1712935 - DNA, 21 bp, Homo sapiens
gtactgactgagataagaaaa

SEQ ID NO: 1712936 - DNA, 16 bp, Homo sapiens
gtactgagccttgtaa

SEQ ID NO: 1712937 - DNA, 18 bp, Homo sapiens
gtactgattcaagaacaa

SEQ ID NO: 1712938 - DNA, 16 bp, Homo sapiens
gtactgatttttgtaa

SEQ ID NO: 1712939 - DNA, 15 bp, Homo sapiens
gtactgcatgtgact

SEQ ID NO: 1712940 - DNA, 18 bp, Homo sapiens
gtactgcattctctccca

SEQ ID NO: 1712941 - DNA, 21 bp, Homo sapiens
gtactgccccccatgaggaag

SEQ ID NO: 1712942 - DNA, 23 bp, Homo sapiens
gtactgccccccatgaggaagga

SEQ ID NO: 1712943 - DNA, 23 bp, Homo sapiens
gtactggagcttttaaaaatgtt

SEQ ID NO: 1712944 - DNA, 14 bp, Homo sapiens
gtactggcatggta

SEQ ID NO: 1712945 - DNA, 13 bp, Homo sapiens
gtactggtccctt

SEQ ID NO: 1712946 - DNA, 14 bp, Homo sapiens
gtactgtagcaggg

SEQ ID NO: 1712947 - DNA, 18 bp, Homo sapiens
gtactgttactgggccct

SEQ ID NO: 1712948 - DNA, 19 bp, Homo sapiens
gtactgttcccaactcagc

SEQ ID NO: 1712949 - DNA, 17 bp, Homo sapiens
gtactgttctgtgtctt

SEQ ID NO: 1712950 - DNA, 18 bp, Homo sapiens
gtactgttgctttaatat

SEQ ID NO: 1712951 - DNA, 14 bp, Homo sapiens
gtacttaactattc

SEQ ID NO: 1712952 - DNA, 23 bp, Homo sapiens
gtacttacccggagaaggccgct

SEQ ID NO: 1712953 - DNA, 18 bp, Homo sapiens
gtacttattactgctaag

SEQ ID NO: 1712954 - DNA, 21 bp, Homo sapiens
gtacttcactgtcaggaagaa

SEQ ID NO: 1712955 - DNA, 18 bp, Homo sapiens
gtacttcaggggcacttc

SEQ ID NO: 1712956 - DNA, 22 bp, Homo sapiens
gtacttcccgggccagggctgc

SEQ ID NO: 1712957 - DNA, 15 bp, Homo sapiens
gtacttcctcctgat

SEQ ID NO: 1712958 - DNA, 12 bp, Homo sapiens
gtacttcctgtg

SEQ ID NO: 1712959 - DNA, 15 bp, Homo sapiens
gtacttctctgtgtg

SEQ ID NO: 1712960 - DNA, 13 bp, Homo sapiens
gtacttctgtgtt

SEQ ID NO: 1712961 - DNA, 15 bp, Homo sapiens
gtacttctgtgttca

SEQ ID NO: 1712962 - DNA, 19 bp, Homo sapiens
gtacttctgtgttcatttt

SEQ ID NO: 1712963 - DNA, 19 bp, Homo sapiens
gtacttcttgaatataaaa

SEQ ID NO: 1712964 - DNA, 18 bp, Homo sapiens
gtacttgtaatatgtata

SEQ ID NO: 1712965 - DNA, 13 bp, Homo sapiens
gtactttattctt

SEQ ID NO: 1712966 - DNA, 22 bp, Homo sapiens
gtactttattgcaactctttta

SEQ ID NO: 1712967 - DNA, 12 bp, Homo sapiens
gtactttctgtt

SEQ ID NO: 1712968 - DNA, 13 bp, Homo sapiens
gtactttctgtta

SEQ ID NO: 1712969 - DNA, 15 bp, Homo sapiens
gtactttctgttaaa

SEQ ID NO: 1712970 - DNA, 16 bp, Homo sapiens
gtactttctgttaaaa

SEQ ID NO: 1712971 - DNA, 18 bp, Homo sapiens
gtactttctgttaaaatg

SEQ ID NO: 1712972 - DNA, 17 bp, Homo sapiens
gtacttttcattctctt

SEQ ID NO: 1712973 - DNA, 21 bp, Homo sapiens
gtacttttcattctcttttaa

SEQ ID NO: 1712974 - DNA, 23 bp, Homo sapiens
gtactttttagtaatttcttttt

SEQ ID NO: 1712975 - DNA, 12 bp, Homo sapiens
gtagaaaaacat

SEQ ID NO: 1712976 - DNA, 18 bp, Homo sapiens
gtagaaacacagttttga

SEQ ID NO: 1712977 - DNA, 15 bp, Homo sapiens
gtagaaacttaaaca

SEQ ID NO: 1712978 - DNA, 21 bp, Homo sapiens
gtagaaatatctgaaaatgta

SEQ ID NO: 1712979 - DNA, 23 bp, Homo sapiens
gtagaaattttacaataggtgct

SEQ ID NO: 1712980 - DNA, 18 bp, Homo sapiens
gtagaacactaattcata

SEQ ID NO: 1712981 - DNA, 22 bp, Homo sapiens
gtagaactcactctgggctgta

SEQ ID NO: 1712982 - DNA, 13 bp, Homo sapiens
gtagaactcagca

SEQ ID NO: 1712983 - DNA, 22 bp, Homo sapiens
gtagaagatggactctgaaaaa

SEQ ID NO: 1712984 - DNA, 20 bp, Homo sapiens
gtagaagtaggaggaaacag

SEQ ID NO: 1712985 - DNA, 18 bp, Homo sapiens
gtagaattaccattaatt

SEQ ID NO: 1712986 - DNA, 22 bp, Homo sapiens
gtagaattatctaatttataaa

SEQ ID NO: 1712987 - DNA, 23 bp, Homo sapiens
gtagaattccttcgaaaggcctt

SEQ ID NO: 1712988 - DNA, 22 bp, Homo sapiens
gtagacagatatttcaaacatc

SEQ ID NO: 1712989 - DNA, 19 bp, Homo sapiens
gtagaccttgttacttctg

SEQ ID NO: 1712990 - DNA, 14 bp, Homo sapiens
gtagactaggaagt

SEQ ID NO: 1712991 - DNA, 23 bp, Homo sapiens
gtagacttctggttgtatttcta

SEQ ID NO: 1712992 - DNA, 15 bp, Homo sapiens
gtagagacccccagg

SEQ ID NO: 1712993 - DNA, 14 bp, Homo sapiens
gtagagacgaggtc

SEQ ID NO: 1712994 - DNA, 15 bp, Homo sapiens
gtagaggtataattg

SEQ ID NO: 1712995 - DNA, 16 bp, Homo sapiens
gtagaggtataattgt

SEQ ID NO: 1712996 - DNA, 20 bp, Homo sapiens
gtagtctcactgcttgaact

SEQ ID NO: 1712997 - DNA, 13 bp, Homo sapiens
gtagtctcagcta

SEQ ID NO: 1712998 - DNA, 22 bp, Homo sapiens
gtagtcttgtcttagctctgga

SEQ ID NO: 1712999 - DNA, 17 bp, Homo sapiens
gtagtggaaatgagtga

SEQ ID NO: 1713000 - DNA, 14 bp, Homo sapiens
gtagtggaagagca

SEQ ID NO: 1713001 - DNA, 16 bp, Homo sapiens
gtagtggaagagcagc

SEQ ID NO: 1713002 - DNA, 15 bp, Homo sapiens
gtagttaaataactg

SEQ ID NO: 1713003 - DNA, 13 bp, Homo sapiens
gtagttccctgaa

SEQ ID NO: 1713004 - DNA, 17 bp, Homo sapiens
gtagttccctgaaaacc

SEQ ID NO: 1713005 - DNA, 20 bp, Homo sapiens
gtagttccctgaaaacccag

SEQ ID NO: 1713006 - DNA, 17 bp, Homo sapiens
gtagttctgtgtacttt

SEQ ID NO: 1713007 - DNA, 15 bp, Homo sapiens
gtagttggtttgtat

SEQ ID NO: 1713008 - DNA, 17 bp, Homo sapiens
gtagttttcaaaacaca

SEQ ID NO: 1713009 - DNA, 11 bp, Homo sapiens
gtagtttttca

SEQ ID NO: 1713010 - DNA, 19 bp, Homo sapiens
gtataaaaataaaaaagat

SEQ ID NO: 1713011 - DNA, 15 bp, Homo sapiens
gtataaaactttcct

SEQ ID NO: 1713012 - DNA, 19 bp, Homo sapiens
gtataaaactttcctcgcc

SEQ ID NO: 1713013 - DNA, 21 bp, Homo sapiens
gtataaaactttcctcgcctg

SEQ ID NO: 1713014 - DNA, 15 bp, Homo sapiens
gtataaaatctgaat

SEQ ID NO: 1713015 - DNA, 20 bp, Homo sapiens
gtataaaatctgaattttgc

SEQ ID NO: 1713016 - DNA, 13 bp, Homo sapiens
gtataaagaaaag

SEQ ID NO: 1713017 - DNA, 13 bp, Homo sapiens
gtataaagacaag

SEQ ID NO: 1713018 - DNA, 18 bp, Homo sapiens
gtataaagattgtactta

SEQ ID NO: 1713019 - DNA, 12 bp, Homo sapiens
gtataaatatac

SEQ ID NO: 1713020 - DNA, 21 bp, Homo sapiens
gtataacggtttaattctgtc

SEQ ID NO: 1713021 - DNA, 22 bp, Homo sapiens
gtataagatcctagatcctaag

SEQ ID NO: 1713022 - DNA, 17 bp, Homo sapiens
gtataagtcaagcacat

SEQ ID NO: 1713023 - DNA, 17 bp, Homo sapiens
gtataagttgaaggaaa

SEQ ID NO: 1713024 - DNA, 18 bp, Homo sapiens
gtataatcccacccacct

SEQ ID NO: 1713025 - DNA, 19 bp, Homo sapiens
gtataatggttgactgggt

SEQ ID NO: 1713026 - DNA, 18 bp, Homo sapiens
gtataatgtgcagaaaat

SEQ ID NO: 1713027 - DNA, 20 bp, Homo sapiens
gtataatgtttattaaatgc

SEQ ID NO: 1713028 - DNA, 14 bp, Homo sapiens
gtataattgtgtga

SEQ ID NO: 1713029 - DNA, 19 bp, Homo sapiens
gtatacaaccctggcatta

SEQ ID NO: 1713030 - DNA, 14 bp, Homo sapiens
gtatacaactgcct

SEQ ID NO: 1713031 - DNA, 18 bp, Homo sapiens
gtatacatgtgtacatat

SEQ ID NO: 1713032 - DNA, 16 bp, Homo sapiens
gtatactcctgtcacc

SEQ ID NO: 1713033 - DNA, 11 bp, Homo sapiens
gtatactgtgt

SEQ ID NO: 1713034 - DNA, 15 bp, Homo sapiens
gtatacttcagtgct

SEQ ID NO: 1713035 - DNA, 22 bp, Homo sapiens
gtatagaccaaagcaaagaaaa

SEQ ID NO: 1713036 - DNA, 16 bp, Homo sapiens
gtatagatgcaagata

SEQ ID NO: 1713037 - DNA, 16 bp, Homo sapiens
gtatagtatctgtata

SEQ ID NO: 1713038 - DNA, 18 bp, Homo sapiens
gtatagtgcctaaaattg

SEQ ID NO: 1713039 - DNA, 18 bp, Homo sapiens
gtatagtgttcacaaact

SEQ ID NO: 1713040 - DNA, 23 bp, Homo sapiens
gtatagtgttcacaaactgtgaa

SEQ ID NO: 1713041 - DNA, 16 bp, Homo sapiens
gtatagttgcttgcct

SEQ ID NO: 1713042 - DNA, 18 bp, Homo sapiens
gtatagttgcttgcctga

SEQ ID NO: 1713043 - DNA, 21 bp, Homo sapiens
gtatataagtactgaccactg

SEQ ID NO: 1713044 - DNA, 12 bp, Homo sapiens
gtatataatttt

SEQ ID NO: 1713045 - DNA, 16 bp, Homo sapiens
gtatatacgcatctat

SEQ ID NO: 1713046 - DNA, 12 bp, Homo sapiens
gtatatactttg

SEQ ID NO: 1713047 - DNA, 18 bp, Homo sapiens
gtatatatacatatatat

SEQ ID NO: 1713048 - DNA, 15 bp, Homo sapiens
gtatatatatatagt

SEQ ID NO: 1713049 - DNA, 14 bp, Homo sapiens
gtatatatattcat

SEQ ID NO: 1713050 - DNA, 13 bp, Homo sapiens
gtatatattccca

SEQ ID NO: 1713051 - DNA, 22 bp, Homo sapiens
gtatatattttgtgtgaaattg

SEQ ID NO: 1713052 - DNA, 21 bp, Homo sapiens
gtatatctggacaagccaact

SEQ ID NO: 1713053 - DNA, 18 bp, Homo sapiens
ggctgccggatctgggct

SEQ ID NO: 1713054 - DNA, 19 bp, Homo sapiens
ggctgccggatctgggctg

SEQ ID NO: 1713055 - DNA, 16 bp, Homo sapiens
ggctgccgtggggccg

SEQ ID NO: 1713056 - DNA, 14 bp, Homo sapiens
ggctgcctcctttg

SEQ ID NO: 1713057 - DNA, 12 bp, Homo sapiens
ggctgcctgccg

SEQ ID NO: 1713058 - DNA, 13 bp, Homo sapiens
ggctgcctgccgc

SEQ ID NO: 1713059 - DNA, 11 bp, Homo sapiens
ggctgcctggg

SEQ ID NO: 1713060 - DNA, 15 bp, Homo sapiens
ggctgcctgggctgt

SEQ ID NO: 1713061 - DNA, 14 bp, Homo sapiens
ggctgcgcactgtg

SEQ ID NO: 1713062 - DNA, 15 bp, Homo sapiens
ggctgcgcactgtgt

SEQ ID NO: 1713063 - DNA, 12 bp, Homo sapiens
ggctgcggcccc

SEQ ID NO: 1713064 - DNA, 13 bp, Homo sapiens
ggctgctcaagcc

SEQ ID NO: 1713065 - DNA, 12 bp, Homo sapiens
ggctgctcccca

SEQ ID NO: 1713066 - DNA, 18 bp, Homo sapiens
ggctgctcctccagggcc

SEQ ID NO: 1713067 - DNA, 19 bp, Homo sapiens
ggctgctcctccagggcca

SEQ ID NO: 1713068 - DNA, 16 bp, Homo sapiens
ggctgctctgcctgtg

SEQ ID NO: 1713069 - DNA, 11 bp, Homo sapiens
ggctgctgccc

SEQ ID NO: 1713070 - DNA, 13 bp, Homo sapiens
ggctgctggggca

SEQ ID NO: 1713071 - DNA, 22 bp, Homo sapiens
ggctgctggggcatgtgtgcct

SEQ ID NO: 1713072 - DNA, 23 bp, Homo sapiens
ggctgctggggcatgtgtgcctg

SEQ ID NO: 1713073 - DNA, 18 bp, Homo sapiens
ggctgcttaaactggaaa

SEQ ID NO: 1713074 - DNA, 19 bp, Homo sapiens
ggctgcttaaactggaaag

SEQ ID NO: 1713075 - DNA, 15 bp, Homo sapiens
ggctgcttcctcctg

SEQ ID NO: 1713076 - DNA, 22 bp, Homo sapiens
ggctggaagatcctgcgggtgg

SEQ ID NO: 1713077 - DNA, 16 bp, Homo sapiens
ggctggaaggggtcca

SEQ ID NO: 1713078 - DNA, 16 bp, Homo sapiens
ggctggacaccctctg

SEQ ID NO: 1713079 - DNA, 16 bp, Homo sapiens
ggctggacctatgtcc

SEQ ID NO: 1713080 - DNA, 14 bp, Homo sapiens
ggctggactgaggc

SEQ ID NO: 1713081 - DNA, 21 bp, Homo sapiens
ggctggacttctacctgccct

SEQ ID NO: 1713082 - DNA, 13 bp, Homo sapiens
ggctggagaaaga

SEQ ID NO: 1713083 - DNA, 23 bp, Homo sapiens
ggctggagaaagagctgcctgga

SEQ ID NO: 1713084 - DNA, 18 bp, Homo sapiens
ggctggaggagctggcct

SEQ ID NO: 1713085 - DNA, 21 bp, Homo sapiens
ggctggaggagctggcctgtg

SEQ ID NO: 1713086 - DNA, 13 bp, Homo sapiens
ggctggaggcagg

SEQ ID NO: 1713087 - DNA, 20 bp, Homo sapiens
ggctggagtgcagtggcgcg

SEQ ID NO: 1713088 - DNA, 20 bp, Homo sapiens
ggctggagtgcagtggtgcc

SEQ ID NO: 1713089 - DNA, 14 bp, Homo sapiens
ggctggagtgcgct

SEQ ID NO: 1713090 - DNA, 18 bp, Homo sapiens
ggctggatgtggtggcat

SEQ ID NO: 1713091 - DNA, 16 bp, Homo sapiens
ggctggccagtccagg

SEQ ID NO: 1713092 - DNA, 22 bp, Homo sapiens
ggctggccagtccaggctgccg

SEQ ID NO: 1713093 - DNA, 10 bp, Homo sapiens
ggctggcctg

SEQ ID NO: 1713094 - DNA, 12 bp, Homo sapiens
ggctggcctggt

SEQ ID NO: 1713095 - DNA, 17 bp, Homo sapiens
ggctggcgcagccaagg

SEQ ID NO: 1713096 - DNA, 14 bp, Homo sapiens
ggctggcggcctcg

SEQ ID NO: 1713097 - DNA, 17 bp, Homo sapiens
ggctggctaactggaag

SEQ ID NO: 1713098 - DNA, 13 bp, Homo sapiens
ggctggctcctct

SEQ ID NO: 1713099 - DNA, 14 bp, Homo sapiens
ggctggctgaagaa

SEQ ID NO: 1713100 - DNA, 14 bp, Homo sapiens
ggctggctgcagtg

SEQ ID NO: 1713101 - DNA, 15 bp, Homo sapiens
ggctggctggcctca

SEQ ID NO: 1713102 - DNA, 11 bp, Homo sapiens
ggctgggccat

SEQ ID NO: 1713103 - DNA, 20 bp, Homo sapiens
ggctgggccatgtccaaaga

SEQ ID NO: 1713104 - DNA, 13 bp, Homo sapiens
ggctgggcccagc

SEQ ID NO: 1713105 - DNA, 19 bp, Homo sapiens
ggctggggactgctacctc

SEQ ID NO: 1713106 - DNA, 11 bp, Homo sapiens
ggctggggagg

SEQ ID NO: 1713107 - DNA, 14 bp, Homo sapiens
ggctggggcagagg

SEQ ID NO: 1713108 - DNA, 16 bp, Homo sapiens
ggctggggcagagggg

SEQ ID NO: 1713109 - DNA, 14 bp, Homo sapiens
ggctggggccgctg

SEQ ID NO: 1713110 - DNA, 14 bp, Homo sapiens
ggctggggctgctc

SEQ ID NO: 1713111 - DNA, 18 bp, Homo sapiens
ggctgggggagagccgtg

SEQ ID NO: 1713112 - DNA, 19 bp, Homo sapiens
ggctgggggagagccgtgg

SEQ ID NO: 1713113 - DNA, 20 bp, Homo sapiens
ggctgggggaggtccaagca

SEQ ID NO: 1713114 - DNA, 18 bp, Homo sapiens
ggctgggggcaggagggc

SEQ ID NO: 1713115 - DNA, 13 bp, Homo sapiens
ggctggggtcctc

SEQ ID NO: 1713116 - DNA, 17 bp, Homo sapiens
ggctggggtcctcctgt

SEQ ID NO: 1713117 - DNA, 15 bp, Homo sapiens
ggctggggtcttggg

SEQ ID NO: 1713118 - DNA, 19 bp, Homo sapiens
ggctgggtccttgggcctg

SEQ ID NO: 1713119 - DNA, 23 bp, Homo sapiens
ggctggtagcagcaggctcaggc

SEQ ID NO: 1713120 - DNA, 14 bp, Homo sapiens
ggctggtcactctg

SEQ ID NO: 1713121 - DNA, 18 bp, Homo sapiens
ggctggtcactctgccct

SEQ ID NO: 1713122 - DNA, 18 bp, Homo sapiens
ggctggtgccagccttcc

SEQ ID NO: 1713123 - DNA, 14 bp, Homo sapiens
ggctggtggcaagt

SEQ ID NO: 1713124 - DNA, 21 bp, Homo sapiens
ggctggttttgatggctgggt

SEQ ID NO: 1713125 - DNA, 18 bp, Homo sapiens
ggctgtagatcaggtttg

SEQ ID NO: 1713126 - DNA, 15 bp, Homo sapiens
ggctgtcactgcttg

SEQ ID NO: 1713127 - DNA, 18 bp, Homo sapiens
ggctgtcagtatgacatt

SEQ ID NO: 1713128 - DNA, 13 bp, Homo sapiens
ggctgtcctgtac

SEQ ID NO: 1713129 - DNA, 22 bp, Homo sapiens
ggctgtcctgtacattgtggga

SEQ ID NO: 1713130 - DNA, 10 bp, Homo sapiens
ggctgtctga

SEQ ID NO: 1713131 - DNA, 15 bp, Homo sapiens
ggctgtctgcctgta

SEQ ID NO: 1713132 - DNA, 18 bp, Homo sapiens
ggctgtgacacctggtgc

SEQ ID NO: 1713133 - DNA, 11 bp, Homo sapiens
ggctgtgagca

SEQ ID NO: 1713134 - DNA, 20 bp, Homo sapiens
ggctgtgcccagcaggccca

SEQ ID NO: 1713135 - DNA, 22 bp, Homo sapiens
ggctgtgcccctgatgcagcct

SEQ ID NO: 1713136 - DNA, 19 bp, Homo sapiens
ggctgtgcttgaaggccct

SEQ ID NO: 1713137 - DNA, 23 bp, Homo sapiens
ggctgtgcttgaaggccctgctg

SEQ ID NO: 1713138 - DNA, 21 bp, Homo sapiens
ggctgtggaccgtggacaggc

SEQ ID NO: 1713139 - DNA, 13 bp, Homo sapiens
ggctgtggaggcc

SEQ ID NO: 1713140 - DNA, 15 bp, Homo sapiens
ggctgtggaggcctg

SEQ ID NO: 1713141 - DNA, 13 bp, Homo sapiens
ggctgtggcacag

SEQ ID NO: 1713142 - DNA, 15 bp, Homo sapiens
ggctgtggcatttcc

SEQ ID NO: 1713143 - DNA, 19 bp, Homo sapiens
ggctgtggcatttccaaac

SEQ ID NO: 1713144 - DNA, 22 bp, Homo sapiens
ggctgtggccgtctcctccctc

SEQ ID NO: 1713145 - DNA, 21 bp, Homo sapiens
ggctgtggcctccctgctcta

SEQ ID NO: 1713146 - DNA, 16 bp, Homo sapiens
ggctgtgttatgaaaa

SEQ ID NO: 1713147 - DNA, 18 bp, Homo sapiens
ggctgtgtttccatctca

SEQ ID NO: 1713148 - DNA, 20 bp, Homo sapiens
ggctgtgtttgcagcctgct

SEQ ID NO: 1713149 - DNA, 17 bp, Homo sapiens
ggctgttctgcactgaa

SEQ ID NO: 1713150 - DNA, 19 bp, Homo sapiens
ggctgttctgcactgaaaa

SEQ ID NO: 1713151 - DNA, 21 bp, Homo sapiens
ggctgttctgtggttcctctg

SEQ ID NO: 1713152 - DNA, 18 bp, Homo sapiens
ggctgttggacagctgct

SEQ ID NO: 1713153 - DNA, 12 bp, Homo sapiens
ggctgtttactg

SEQ ID NO: 1713154 - DNA, 17 bp, Homo sapiens
ggctgtttcaaaaaaat

SEQ ID NO: 1713155 - DNA, 15 bp, Homo sapiens
cacgcagccaggaca

SEQ ID NO: 1713156 - DNA, 16 bp, Homo sapiens
cacgcaggcacagcag

SEQ ID NO: 1713157 - DNA, 16 bp, Homo sapiens
cacgcaggctgagtcc

SEQ ID NO: 1713158 - DNA, 20 bp, Homo sapiens
cacgcagggccatccactgt

SEQ ID NO: 1713159 - DNA, 22 bp, Homo sapiens
cacgccactgcactccagcctg

SEQ ID NO: 1713160 - DNA, 19 bp, Homo sapiens
cacgccattgtactccagc

SEQ ID NO: 1713161 - DNA, 21 bp, Homo sapiens
cacgccattgtactccagcct

SEQ ID NO: 1713162 - DNA, 14 bp, Homo sapiens
cacgccccgtgtct

SEQ ID NO: 1713163 - DNA, 14 bp, Homo sapiens
cacgcccgtcctgc

SEQ ID NO: 1713164 - DNA, 20 bp, Homo sapiens
cacgcccgtcctgcctgtgg

SEQ ID NO: 1713165 - DNA, 17 bp, Homo sapiens
cacgccctactccactg

SEQ ID NO: 1713166 - DNA, 23 bp, Homo sapiens
cacgccctactccactgccctgg

SEQ ID NO: 1713167 - DNA, 20 bp, Homo sapiens
cacgccgggagaagccacct

SEQ ID NO: 1713168 - DNA, 15 bp, Homo sapiens
cacgcctgcaggctg

SEQ ID NO: 1713169 - DNA, 22 bp, Homo sapiens
cacgcctgcaggctggagactg

SEQ ID NO: 1713170 - DNA, 12 bp, Homo sapiens
cacgcctggaag

SEQ ID NO: 1713171 - DNA, 18 bp, Homo sapiens
cacgcctgtaatcccagc

SEQ ID NO: 1713172 - DNA, 20 bp, Homo sapiens
cacgcctgtaatcccagcac

SEQ ID NO: 1713173 - DNA, 16 bp, Homo sapiens
cacgccttcccctcag

SEQ ID NO: 1713174 - DNA, 16 bp, Homo sapiens
cacgcgctctccacca

SEQ ID NO: 1713175 - DNA, 22 bp, Homo sapiens
cacgctaatcccgattcaccct

SEQ ID NO: 1713176 - DNA, 13 bp, Homo sapiens
cacgctgcctggt

SEQ ID NO: 1713177 - DNA, 22 bp, Homo sapiens
cacgctgcctggtctgtctgga

SEQ ID NO: 1713178 - DNA, 17 bp, Homo sapiens
cacgctttctagctgtt

SEQ ID NO: 1713179 - DNA, 21 bp, Homo sapiens
cacgcttttaattctcatttg

SEQ ID NO: 1713180 - DNA, 15 bp, Homo sapiens
cacggactctcccag

SEQ ID NO: 1713181 - DNA, 23 bp, Homo sapiens
cacggactctcccaggcctgcct

SEQ ID NO: 1713182 - DNA, 20 bp, Homo sapiens
cacggagcagttcagagtgg

SEQ ID NO: 1713183 - DNA, 16 bp, Homo sapiens
cacggagggagcgaca

SEQ ID NO: 1713184 - DNA, 20 bp, Homo sapiens
cacggatccatgtagcagga

SEQ ID NO: 1713185 - DNA, 17 bp, Homo sapiens
cacggatggtgcatggg

SEQ ID NO: 1713186 - DNA, 11 bp, Homo sapiens
cacggccaccc

SEQ ID NO: 1713187 - DNA, 13 bp, Homo sapiens
cacggccaccctc

SEQ ID NO: 1713188 - DNA, 13 bp, Homo sapiens
cacggccctgtca

SEQ ID NO: 1713189 - DNA, 16 bp, Homo sapiens
cacggcctggctggtg

SEQ ID NO: 1713190 - DNA, 17 bp, Homo sapiens
cacggcgggatcctcca

SEQ ID NO: 1713191 - DNA, 19 bp, Homo sapiens
cacggcgggatcctccaca

SEQ ID NO: 1713192 - DNA, 23 bp, Homo sapiens
cacggcgggatcctccacagaga

SEQ ID NO: 1713193 - DNA, 22 bp, Homo sapiens
cacggcgtggtgtgtccctgga

SEQ ID NO: 1713194 - DNA, 15 bp, Homo sapiens
cacggcgttgtacct

SEQ ID NO: 1713195 - DNA, 16 bp, Homo sapiens
cacggctgcgcactgt

SEQ ID NO: 1713196 - DNA, 19 bp, Homo sapiens
cacggctggtcactctgcc

SEQ ID NO: 1713197 - DNA, 21 bp, Homo sapiens
cacggctggtcactctgccct

SEQ ID NO: 1713198 - DNA, 22 bp, Homo sapiens
cacggctggtcactctgccctc

SEQ ID NO: 1713199 - DNA, 16 bp, Homo sapiens
cacggcttcactgacc

SEQ ID NO: 1713200 - DNA, 12 bp, Homo sapiens
cacgggcagcct

SEQ ID NO: 1713201 - DNA, 14 bp, Homo sapiens
cacgggcatgcaca

SEQ ID NO: 1713202 - DNA, 17 bp, Homo sapiens
cacggtatttatagaga

SEQ ID NO: 1713203 - DNA, 17 bp, Homo sapiens
cacggttcaatggtaga

SEQ ID NO: 1713204 - DNA, 22 bp, Homo sapiens
cacgtaagatacaagtttcaga

SEQ ID NO: 1713205 - DNA, 15 bp, Homo sapiens
cacgtacaaaatcca

SEQ ID NO: 1713206 - DNA, 16 bp, Homo sapiens
cacgtacttaaatgaa

SEQ ID NO: 1713207 - DNA, 15 bp, Homo sapiens
cacgtattgctgtgt

SEQ ID NO: 1713208 - DNA, 22 bp, Homo sapiens
cacgtatttatatttggaaaga

SEQ ID NO: 1713209 - DNA, 20 bp, Homo sapiens
cacgtcaaatgcatacaagt

SEQ ID NO: 1713210 - DNA, 17 bp, Homo sapiens
cacgtcatgtttcttca

SEQ ID NO: 1713211 - DNA, 14 bp, Homo sapiens
cacgtcccagcatc

SEQ ID NO: 1713212 - DNA, 17 bp, Homo sapiens
cacgtccccctggggct

SEQ ID NO: 1713213 - DNA, 20 bp, Homo sapiens
cacgtccccctggggcttct

SEQ ID NO: 1713214 - DNA, 19 bp, Homo sapiens
cacgtcctgagaaagctca

SEQ ID NO: 1713215 - DNA, 15 bp, Homo sapiens
cacgtctcctcctcg

SEQ ID NO: 1713216 - DNA, 21 bp, Homo sapiens
cacgtctgccaggcccatctc

SEQ ID NO: 1713217 - DNA, 22 bp, Homo sapiens
cacgtctgccaggcccatctca

SEQ ID NO: 1713218 - DNA, 17 bp, Homo sapiens
cacgtctggctccctgc

SEQ ID NO: 1713219 - DNA, 12 bp, Homo sapiens
cacgtctgtcct

SEQ ID NO: 1713220 - DNA, 13 bp, Homo sapiens
cacgtcttcctcc

SEQ ID NO: 1713221 - DNA, 20 bp, Homo sapiens
cacgtgaaatatttaagtat

SEQ ID NO: 1713222 - DNA, 20 bp, Homo sapiens
cacgtgagagaatctgcctg

SEQ ID NO: 1713223 - DNA, 14 bp, Homo sapiens
cacgtgccaggccc

SEQ ID NO: 1713224 - DNA, 13 bp, Homo sapiens
cacgtggagagct

SEQ ID NO: 1713225 - DNA, 13 bp, Homo sapiens
cacgtggcctctt

SEQ ID NO: 1713226 - DNA, 12 bp, Homo sapiens
cacgtggctggc

SEQ ID NO: 1713227 - DNA, 16 bp, Homo sapiens
cacgtgggctcatatg

SEQ ID NO: 1713228 - DNA, 14 bp, Homo sapiens
cacgtggggcccac

SEQ ID NO: 1713229 - DNA, 23 bp, Homo sapiens
cacgtggttggggccctgccctg

SEQ ID NO: 1713230 - DNA, 15 bp, Homo sapiens
cacgtgtcctgtagt

SEQ ID NO: 1713231 - DNA, 16 bp, Homo sapiens
cacgtgtcctgtagtt

SEQ ID NO: 1713232 - DNA, 18 bp, Homo sapiens
cacgttctcacacccacc

SEQ ID NO: 1713233 - DNA, 14 bp, Homo sapiens
cacgttgccagggg

SEQ ID NO: 1713234 - DNA, 13 bp, Homo sapiens
cactaaaatacat

SEQ ID NO: 1713235 - DNA, 16 bp, Homo sapiens
cactaaagactgggtt

SEQ ID NO: 1713236 - DNA, 22 bp, Homo sapiens
cactaaagcatgaaatgtgaat

SEQ ID NO: 1713237 - DNA, 18 bp, Homo sapiens
cactaaagcttcagactc

SEQ ID NO: 1713238 - DNA, 13 bp, Homo sapiens
cactaaatcagag

SEQ ID NO: 1713239 - DNA, 15 bp, Homo sapiens
cactaaatcagagac

SEQ ID NO: 1713240 - DNA, 18 bp, Homo sapiens
cactaaatgagctcctgc

SEQ ID NO: 1713241 - DNA, 14 bp, Homo sapiens
cactaacagggaga

SEQ ID NO: 1713242 - DNA, 17 bp, Homo sapiens
cactaacagggagaagt

SEQ ID NO: 1713243 - DNA, 23 bp, Homo sapiens
cactaaccaatgcctttttagat

SEQ ID NO: 1713244 - DNA, 17 bp, Homo sapiens
cactaaccatccccaac

SEQ ID NO: 1713245 - DNA, 20 bp, Homo sapiens
cactaacgttgagcccctgg

SEQ ID NO: 1713246 - DNA, 14 bp, Homo sapiens
cactaactcaccag

SEQ ID NO: 1713247 - DNA, 13 bp, Homo sapiens
cactaactgctgg

SEQ ID NO: 1713248 - DNA, 17 bp, Homo sapiens
cactaagctctctgggc

SEQ ID NO: 1713249 - DNA, 19 bp, Homo sapiens
cactaagctctctgggcct

SEQ ID NO: 1713250 - DNA, 16 bp, Homo sapiens
cactaatctgaaagga

SEQ ID NO: 1713251 - DNA, 11 bp, Homo sapiens
cactaattcat

SEQ ID NO: 1713252 - DNA, 17 bp, Homo sapiens
cactaattggtactttt

SEQ ID NO: 1713253 - DNA, 22 bp, Homo sapiens
cactaatttgaataaactctcc

SEQ ID NO: 1713254 - DNA, 17 bp, Homo sapiens
cactaatttgatgttta

SEQ ID NO: 1713255 - DNA, 21 bp, Homo sapiens
cactaattttagtattcattc

SEQ ID NO: 1713256 - DNA, 23 bp, Homo sapiens
cactaatttttgtattatttttg

SEQ ID NO: 1713257 - DNA, 12 bp, Homo sapiens
cactacaatcat

SEQ ID NO: 1713258 - DNA, 15 bp, Homo sapiens
cactacacatttgaa

SEQ ID NO: 1713259 - DNA, 18 bp, Homo sapiens
cactacactcaactaatt

SEQ ID NO: 1713260 - DNA, 19 bp, Homo sapiens
cactacactccagcctgag

SEQ ID NO: 1713261 - DNA, 21 bp, Homo sapiens
cactacactccagcctgagca

SEQ ID NO: 1713262 - DNA, 15 bp, Homo sapiens
cactacatgcagccc

SEQ ID NO: 1713263 - DNA, 15 bp, Homo sapiens
cactaccagccagcc

SEQ ID NO: 1713264 - DNA, 22 bp, Homo sapiens
cactaccctgagatctgcacag

SEQ ID NO: 1713265 - DNA, 18 bp, Homo sapiens
cactacccttctcctttc

SEQ ID NO: 1713266 - DNA, 21 bp, Homo sapiens
cactacccttctcctttcctt

SEQ ID NO: 1713267 - DNA, 15 bp, Homo sapiens
cactaccgtggacca

SEQ ID NO: 1713268 - DNA, 23 bp, Homo sapiens
cactacgcctggctgatttttgt

SEQ ID NO: 1713269 - DNA, 16 bp, Homo sapiens
cactactacagaaatt

SEQ ID NO: 1713270 - DNA, 15 bp, Homo sapiens
cactactcctctgca

SEQ ID NO: 1713271 - DNA, 19 bp, Homo sapiens
cactactcctctgcagtgc

SEQ ID NO: 1713272 - DNA, 18 bp, Homo sapiens
ggctgtttcgtgtagtgg

SEQ ID NO: 1713273 - DNA, 23 bp, Homo sapiens
ggcttaaacccatattgtaaaac

SEQ ID NO: 1713274 - DNA, 20 bp, Homo sapiens
ggcttagggtcctgtcgaag

SEQ ID NO: 1713275 - DNA, 17 bp, Homo sapiens
ggcttagtatttctcag

SEQ ID NO: 1713276 - DNA, 21 bp, Homo sapiens
ggcttagtatttctcaggaag

SEQ ID NO: 1713277 - DNA, 19 bp, Homo sapiens
ggcttagtgccacccacct

SEQ ID NO: 1713278 - DNA, 18 bp, Homo sapiens
ggcttatatctggcctct

SEQ ID NO: 1713279 - DNA, 13 bp, Homo sapiens
ggcttatgtctct

SEQ ID NO: 1713280 - DNA, 17 bp, Homo sapiens
ggcttatgtctctgcct

SEQ ID NO: 1713281 - DNA, 13 bp, Homo sapiens
ggcttatttctat

SEQ ID NO: 1713282 - DNA, 14 bp, Homo sapiens
ggcttcactgacca

SEQ ID NO: 1713283 - DNA, 16 bp, Homo sapiens
ggcttcactgaccagc

SEQ ID NO: 1713284 - DNA, 14 bp, Homo sapiens
cactaggatcccac

SEQ ID NO: 1713285 - DNA, 18 bp, Homo sapiens
cactaggatcccactggc

SEQ ID NO: 1713286 - DNA, 17 bp, Homo sapiens
cactaggcccccacttg

SEQ ID NO: 1713287 - DNA, 21 bp, Homo sapiens
cactaggcccccacttgcctc

SEQ ID NO: 1713288 - DNA, 22 bp, Homo sapiens
cactaggcccccacttgcctct

SEQ ID NO: 1713289 - DNA, 21 bp, Homo sapiens
cactagtgaccccttccctgt

SEQ ID NO: 1713290 - DNA, 16 bp, Homo sapiens
cactatatatatttct

SEQ ID NO: 1713291 - DNA, 17 bp, Homo sapiens
cactatatatatttcta

SEQ ID NO: 1713292 - DNA, 14 bp, Homo sapiens
cactatctttctga

SEQ ID NO: 1713293 - DNA, 17 bp, Homo sapiens
cactatctttctgataa

SEQ ID NO: 1713294 - DNA, 14 bp, Homo sapiens
cactatgaagatgt

SEQ ID NO: 1713295 - DNA, 17 bp, Homo sapiens
cactatgaagctacctc

SEQ ID NO: 1713296 - DNA, 15 bp, Homo sapiens
cactatgacactgag

SEQ ID NO: 1713297 - DNA, 17 bp, Homo sapiens
cactatgacactgagca

SEQ ID NO: 1713298 - DNA, 15 bp, Homo sapiens
cactatgcactgctg

SEQ ID NO: 1713299 - DNA, 15 bp, Homo sapiens
cactattcctaggag

SEQ ID NO: 1713300 - DNA, 15 bp, Homo sapiens
cactatttccaaaag

SEQ ID NO: 1713301 - DNA, 14 bp, Homo sapiens
cactatttccacat

SEQ ID NO: 1713302 - DNA, 13 bp, Homo sapiens
cactatttccttt

SEQ ID NO: 1713303 - DNA, 17 bp, Homo sapiens
cactatttttatttata

SEQ ID NO: 1713304 - DNA, 22 bp, Homo sapiens
cactatttttatttatattttt

SEQ ID NO: 1713305 - DNA, 16 bp, Homo sapiens
cactcaaatcaagaaa

SEQ ID NO: 1713306 - DNA, 17 bp, Homo sapiens
cactcaaatcttaagaa

SEQ ID NO: 1713307 - DNA, 18 bp, Homo sapiens
cactcaaatcttaagaaa

SEQ ID NO: 1713308 - DNA, 16 bp, Homo sapiens
cactcaaattaatctt

SEQ ID NO: 1713309 - DNA, 22 bp, Homo sapiens
cactcaacaatggttgaatgaa

SEQ ID NO: 1713310 - DNA, 16 bp, Homo sapiens
cactcaactaattttt

SEQ ID NO: 1713311 - DNA, 17 bp, Homo sapiens
cactcaactaatttttg

SEQ ID NO: 1713312 - DNA, 17 bp, Homo sapiens
cactcaactctgagccc

SEQ ID NO: 1713313 - DNA, 18 bp, Homo sapiens
cactcaactctgagccca

SEQ ID NO: 1713314 - DNA, 19 bp, Homo sapiens
cactcaactctgagcccat

SEQ ID NO: 1713315 - DNA, 17 bp, Homo sapiens
cactcaagaccaggctg

SEQ ID NO: 1713316 - DNA, 19 bp, Homo sapiens
cactcacaatttaaaatat

SEQ ID NO: 1713317 - DNA, 18 bp, Homo sapiens
cactcaccagccctagct

SEQ ID NO: 1713318 - DNA, 14 bp, Homo sapiens
cactcaccagggtc

SEQ ID NO: 1713319 - DNA, 22 bp, Homo sapiens
cactcaccagggtccgcaccag

SEQ ID NO: 1713320 - DNA, 18 bp, Homo sapiens
cactcacccctagccctg

SEQ ID NO: 1713321 - DNA, 20 bp, Homo sapiens
cactcacccctagccctggt

SEQ ID NO: 1713322 - DNA, 17 bp, Homo sapiens
cactcaccgaagccact

SEQ ID NO: 1713323 - DNA, 17 bp, Homo sapiens
cactcacctttctccac

SEQ ID NO: 1713324 - DNA, 16 bp, Homo sapiens
cactcactaggccccc

SEQ ID NO: 1713325 - DNA, 13 bp, Homo sapiens
cactcactccagc

SEQ ID NO: 1713326 - DNA, 18 bp, Homo sapiens
cactcagccaccctgagt

SEQ ID NO: 1713327 - DNA, 15 bp, Homo sapiens
cactcagccatttcc

SEQ ID NO: 1713328 - DNA, 19 bp, Homo sapiens
cactcagccatttccccct

SEQ ID NO: 1713329 - DNA, 21 bp, Homo sapiens
cactcagccatttccccctcc

SEQ ID NO: 1713330 - DNA, 22 bp, Homo sapiens
cactcagctgagaaggccagcc

SEQ ID NO: 1713331 - DNA, 18 bp, Homo sapiens
cactcagctgtcctgcag

SEQ ID NO: 1713332 - DNA, 22 bp, Homo sapiens
cactcagctgtcctgcagcaaa

SEQ ID NO: 1713333 - DNA, 19 bp, Homo sapiens
cactcaggccaacaagcca

SEQ ID NO: 1713334 - DNA, 16 bp, Homo sapiens
cactcagttgcagggt

SEQ ID NO: 1713335 - DNA, 18 bp, Homo sapiens
cactcattctgaattaat

SEQ ID NO: 1713336 - DNA, 21 bp, Homo sapiens
cactcattgctgagcctctgc

SEQ ID NO: 1713337 - DNA, 23 bp, Homo sapiens
cactcattgctgagcctctgctc

SEQ ID NO: 1713338 - DNA, 22 bp, Homo sapiens
cactcatttttttttgaggaga

SEQ ID NO: 1713339 - DNA, 16 bp, Homo sapiens
cactccaatctgggtg

SEQ ID NO: 1713340 - DNA, 11 bp, Homo sapiens
cactccaccac

SEQ ID NO: 1713341 - DNA, 14 bp, Homo sapiens
cactccaccaccca

SEQ ID NO: 1713342 - DNA, 15 bp, Homo sapiens
cactccaccacccaa

SEQ ID NO: 1713343 - DNA, 12 bp, Homo sapiens
cactccaccatc

SEQ ID NO: 1713344 - DNA, 15 bp, Homo sapiens
cactccaccctccac

SEQ ID NO: 1713345 - DNA, 12 bp, Homo sapiens
cactccactctg

SEQ ID NO: 1713346 - DNA, 14 bp, Homo sapiens
cactccactctgat

SEQ ID NO: 1713347 - DNA, 12 bp, Homo sapiens
cactccagccct

SEQ ID NO: 1713348 - DNA, 13 bp, Homo sapiens
cactccagccctg

SEQ ID NO: 1713349 - DNA, 16 bp, Homo sapiens
cactccagccctgtcc

SEQ ID NO: 1713350 - DNA, 13 bp, Homo sapiens
cactccagcctgg

SEQ ID NO: 1713351 - DNA, 16 bp, Homo sapiens
cactccagcctgggcg

SEQ ID NO: 1713352 - DNA, 23 bp, Homo sapiens
cactccagcctgggcgacagagc

SEQ ID NO: 1713353 - DNA, 16 bp, Homo sapiens
cactccagcctgggga

SEQ ID NO: 1713354 - DNA, 19 bp, Homo sapiens
cactccagcctggggaccc

SEQ ID NO: 1713355 - DNA, 11 bp, Homo sapiens
cactccagtgc

SEQ ID NO: 1713356 - DNA, 13 bp, Homo sapiens
cactccagtggca

SEQ ID NO: 1713357 - DNA, 22 bp, Homo sapiens
cactccagtttttgtttttgca

SEQ ID NO: 1713358 - DNA, 14 bp, Homo sapiens
cactccatccctcc

SEQ ID NO: 1713359 - DNA, 21 bp, Homo sapiens
cactccatgcttagtcactgc

SEQ ID NO: 1713360 - DNA, 22 bp, Homo sapiens
cactccatgcttagtcactgcc

SEQ ID NO: 1713361 - DNA, 16 bp, Homo sapiens
cactccatggccaccc

SEQ ID NO: 1713362 - DNA, 17 bp, Homo sapiens
cactccatggccacccc

SEQ ID NO: 1713363 - DNA, 23 bp, Homo sapiens
cactccatggccaccccgtgcca

SEQ ID NO: 1713364 - DNA, 14 bp, Homo sapiens
cactcccaaccctg

SEQ ID NO: 1713365 - DNA, 14 bp, Homo sapiens
cactccccacatcc

SEQ ID NO: 1713366 - DNA, 15 bp, Homo sapiens
cactccccaccttca

SEQ ID NO: 1713367 - DNA, 23 bp, Homo sapiens
cactccccagagctgtgccagca

SEQ ID NO: 1713368 - DNA, 15 bp, Homo sapiens
cactccccagcccca

SEQ ID NO: 1713369 - DNA, 16 bp, Homo sapiens
cactccccagccccag

SEQ ID NO: 1713370 - DNA, 23 bp, Homo sapiens
cactccccagggagctctgggga

SEQ ID NO: 1713371 - DNA, 14 bp, Homo sapiens
cactcccctgcact

SEQ ID NO: 1713372 - DNA, 19 bp, Homo sapiens
cactcccggcctaggcacc

SEQ ID NO: 1713373 - DNA, 23 bp, Homo sapiens
cactccctcctggagctctgtgg

SEQ ID NO: 1713374 - DNA, 12 bp, Homo sapiens
cactccctgagc

SEQ ID NO: 1713375 - DNA, 12 bp, Homo sapiens
cactccctggcc

SEQ ID NO: 1713376 - DNA, 22 bp, Homo sapiens
cactccctttccaacctcactt

SEQ ID NO: 1713377 - DNA, 20 bp, Homo sapiens
cactccgcgccgatgccacc

SEQ ID NO: 1713378 - DNA, 21 bp, Homo sapiens
cactccggtgtgcctgcagcc

SEQ ID NO: 1713379 - DNA, 23 bp, Homo sapiens
cactcctatccccaggccaggtc

SEQ ID NO: 1713380 - DNA, 13 bp, Homo sapiens
cactcctcagggc

SEQ ID NO: 1713381 - DNA, 16 bp, Homo sapiens
cactcctcagggcagc

SEQ ID NO: 1713382 - DNA, 13 bp, Homo sapiens
cactcctccctcc

SEQ ID NO: 1713383 - DNA, 22 bp, Homo sapiens
cactcctctactcttacagagc

SEQ ID NO: 1713384 - DNA, 10 bp, Homo sapiens
cactcctggg

SEQ ID NO: 1713385 - DNA, 12 bp, Homo sapiens
cactcctgtccc

SEQ ID NO: 1713386 - DNA, 13 bp, Homo sapiens
cactcctgtcccg

SEQ ID NO: 1713387 - DNA, 18 bp, Homo sapiens
cactcctgttacttacct

SEQ ID NO: 1713388 - DNA, 17 bp, Homo sapiens
cactccttctctcactg

SEQ ID NO: 1713389 - DNA, 15 bp, Homo sapiens
cactcgaatcattga

SEQ ID NO: 1713390 - DNA, 14 bp, Homo sapiens
cactcgacccagaa

SEQ ID NO: 1713391 - DNA, 13 bp, Homo sapiens
gggaagcccagct

SEQ ID NO: 1713392 - DNA, 18 bp, Homo sapiens
gggaagcccatcctgacc

SEQ ID NO: 1713393 - DNA, 19 bp, Homo sapiens
gggaagcccatcctgacca

SEQ ID NO: 1713394 - DNA, 14 bp, Homo sapiens
gggaaggacaggac

SEQ ID NO: 1713395 - DNA, 18 bp, Homo sapiens
gggaaggacttggcgcgc

SEQ ID NO: 1713396 - DNA, 13 bp, Homo sapiens
gggaaggatttaa

SEQ ID NO: 1713397 - DNA, 14 bp, Homo sapiens
gggaaggccacctc

SEQ ID NO: 1713398 - DNA, 19 bp, Homo sapiens
gggaaggccacctcccact

SEQ ID NO: 1713399 - DNA, 24 bp, Homo sapiens
cactcgtccaagggacagcccacg

SEQ ID NO: 1713400 - DNA, 17 bp, Homo sapiens
cactcgtgcatccctga

SEQ ID NO: 1713401 - DNA, 20 bp, Homo sapiens
cactcgtgtgcaacagacaa

SEQ ID NO: 1713402 - DNA, 22 bp, Homo sapiens
cactcgtgtgcaacagacaagt

SEQ ID NO: 1713403 - DNA, 17 bp, Homo sapiens
cactctaccctatacaa

SEQ ID NO: 1713404 - DNA, 21 bp, Homo sapiens
cactctaccctcccaccccct

SEQ ID NO: 1713405 - DNA, 14 bp, Homo sapiens
cactctacttagca

SEQ ID NO: 1713406 - DNA, 14 bp, Homo sapiens
cactctagcctggc

SEQ ID NO: 1713407 - DNA, 17 bp, Homo sapiens
cactctagttctagatg

SEQ ID NO: 1713408 - DNA, 17 bp, Homo sapiens
cactctatatgtagtgc

SEQ ID NO: 1713409 - DNA, 14 bp, Homo sapiens
cactctccattaga

SEQ ID NO: 1713410 - DNA, 16 bp, Homo sapiens
cactctcccccacccc

SEQ ID NO: 1713411 - DNA, 18 bp, Homo sapiens
cactctcccccaccccct

SEQ ID NO: 1713412 - DNA, 21 bp, Homo sapiens
cactctcctgggccccaagga

SEQ ID NO: 1713413 - DNA, 15 bp, Homo sapiens
cactctcggggccct

SEQ ID NO: 1713414 - DNA, 19 bp, Homo sapiens
cactctctaaatcttcctt

SEQ ID NO: 1713415 - DNA, 14 bp, Homo sapiens
cactctctgggact

SEQ ID NO: 1713416 - DNA, 21 bp, Homo sapiens
cactctgattcacctcttcct

SEQ ID NO: 1713417 - DNA, 15 bp, Homo sapiens
cactctgccctctgc

SEQ ID NO: 1713418 - DNA, 22 bp, Homo sapiens
cactctgccctctgctgctgcc

SEQ ID NO: 1713419 - DNA, 19 bp, Homo sapiens
cactctgcctctgcctgca

SEQ ID NO: 1713420 - DNA, 12 bp, Homo sapiens
cactctgcctgc

SEQ ID NO: 1713421 - DNA, 21 bp, Homo sapiens
cactctgctctgcccttgttc

SEQ ID NO: 1713422 - DNA, 22 bp, Homo sapiens
cactctgtaattgcacttttta

SEQ ID NO: 1713423 - DNA, 20 bp, Homo sapiens
cactctgttatttagactca

SEQ ID NO: 1713424 - DNA, 17 bp, Homo sapiens
cactcttcagtgactcc

SEQ ID NO: 1713425 - DNA, 17 bp, Homo sapiens
cactcttgaactgggcg

SEQ ID NO: 1713426 - DNA, 19 bp, Homo sapiens
cactcttgaagtccaggac

SEQ ID NO: 1713427 - DNA, 20 bp, Homo sapiens
cactcttgaagtccaggact

SEQ ID NO: 1713428 - DNA, 20 bp, Homo sapiens
cactcttggctattgaagat

SEQ ID NO: 1713429 - DNA, 14 bp, Homo sapiens
cactgaaaaaatat

SEQ ID NO: 1713430 - DNA, 22 bp, Homo sapiens
cactgaaaacatttcaaagctg

SEQ ID NO: 1713431 - DNA, 22 bp, Homo sapiens
cactgaaaaggttcttcatccc

SEQ ID NO: 1713432 - DNA, 22 bp, Homo sapiens
cactgaaaataccatcaggcct

SEQ ID NO: 1713433 - DNA, 13 bp, Homo sapiens
cactgaaaggaaa

SEQ ID NO: 1713434 - DNA, 19 bp, Homo sapiens
cactgaaagttttgtaaaa

SEQ ID NO: 1713435 - DNA, 13 bp, Homo sapiens
cactgaaccactg

SEQ ID NO: 1713436 - DNA, 15 bp, Homo sapiens
cactgaactccaccg

SEQ ID NO: 1713437 - DNA, 23 bp, Homo sapiens
cactgaagaagtcactgaacaaa

SEQ ID NO: 1713438 - DNA, 19 bp, Homo sapiens
cactgaagtagtgtgcagt

SEQ ID NO: 1713439 - DNA, 19 bp, Homo sapiens
cactgaagttaacagagac

SEQ ID NO: 1713440 - DNA, 23 bp, Homo sapiens
cactgaatctcccctcctcacag

SEQ ID NO: 1713441 - DNA, 16 bp, Homo sapiens
cactgaattcactcca

SEQ ID NO: 1713442 - DNA, 13 bp, Homo sapiens
cactgaatttata

SEQ ID NO: 1713443 - DNA, 19 bp, Homo sapiens
cactgaatttataaagtac

SEQ ID NO: 1713444 - DNA, 18 bp, Homo sapiens
cactgacacccagtgtcc

SEQ ID NO: 1713445 - DNA, 15 bp, Homo sapiens
cactgacaccctggt

SEQ ID NO: 1713446 - DNA, 14 bp, Homo sapiens
cactgaccagcggc

SEQ ID NO: 1713447 - DNA, 16 bp, Homo sapiens
cactgaccagcggctg

SEQ ID NO: 1713448 - DNA, 19 bp, Homo sapiens
cactgaccagcggctgctc

SEQ ID NO: 1713449 - DNA, 17 bp, Homo sapiens
cactgaccatccactct

SEQ ID NO: 1713450 - DNA, 23 bp, Homo sapiens
cactgacccaactgatcctgctc

SEQ ID NO: 1713451 - DNA, 16 bp, Homo sapiens
cactgacccttccaga

SEQ ID NO: 1713452 - DNA, 22 bp, Homo sapiens
cactgacctgtcatgcccccct

SEQ ID NO: 1713453 - DNA, 20 bp, Homo sapiens
cactgaccttggagagacac

SEQ ID NO: 1713454 - DNA, 16 bp, Homo sapiens
cactgactgcagggac

SEQ ID NO: 1713455 - DNA, 15 bp, Homo sapiens
cactgactgtatggc

SEQ ID NO: 1713456 - DNA, 14 bp, Homo sapiens
cactgacttctaag

SEQ ID NO: 1713457 - DNA, 21 bp, Homo sapiens
cactgacttctaagtaaaacc

SEQ ID NO: 1713458 - DNA, 16 bp, Homo sapiens
cactgagactttcccc

SEQ ID NO: 1713459 - DNA, 18 bp, Homo sapiens
cactgagactttcccctc

SEQ ID NO: 1713460 - DNA, 17 bp, Homo sapiens
cactgagagcctttttg

SEQ ID NO: 1713461 - DNA, 17 bp, Homo sapiens
cactgagatctgtttga

SEQ ID NO: 1713462 - DNA, 13 bp, Homo sapiens
cactgagcatcac

SEQ ID NO: 1713463 - DNA, 13 bp, Homo sapiens
cactgaggaagaa

SEQ ID NO: 1713464 - DNA, 12 bp, Homo sapiens
cactgaggactg

SEQ ID NO: 1713465 - DNA, 13 bp, Homo sapiens
cactgagggccac

SEQ ID NO: 1713466 - DNA, 18 bp, Homo sapiens
cactgagggccacactat

SEQ ID NO: 1713467 - DNA, 13 bp, Homo sapiens
cactgatcaccca

SEQ ID NO: 1713468 - DNA, 22 bp, Homo sapiens
cactgatctctactaccacaag

SEQ ID NO: 1713469 - DNA, 20 bp, Homo sapiens
cactgatgagtttcactgta

SEQ ID NO: 1713470 - DNA, 23 bp, Homo sapiens
cactgatgagtttcactgtactg

SEQ ID NO: 1713471 - DNA, 21 bp, Homo sapiens
cactgatggctcaagacaagg

SEQ ID NO: 1713472 - DNA, 19 bp, Homo sapiens
cactgatgttgtgttttta

SEQ ID NO: 1713473 - DNA, 14 bp, Homo sapiens
cactgatttggaga

SEQ ID NO: 1713474 - DNA, 17 bp, Homo sapiens
cactgcaacctccacct

SEQ ID NO: 1713475 - DNA, 14 bp, Homo sapiens
cactgcaacctccg

SEQ ID NO: 1713476 - DNA, 15 bp, Homo sapiens
cactgcaagagcctt

SEQ ID NO: 1713477 - DNA, 19 bp, Homo sapiens
cactgcacagtgcatctca

SEQ ID NO: 1713478 - DNA, 14 bp, Homo sapiens
cactgcactccagc

SEQ ID NO: 1713479 - DNA, 15 bp, Homo sapiens
cactgcactccagcc

SEQ ID NO: 1713480 - DNA, 18 bp, Homo sapiens
cactgcactccagcctgg

SEQ ID NO: 1713481 - DNA, 19 bp, Homo sapiens
cactgcactccagcctggg

SEQ ID NO: 1713482 - DNA, 15 bp, Homo sapiens
cactgcagccctctc

SEQ ID NO: 1713483 - DNA, 13 bp, Homo sapiens
cactgcagtgatg

SEQ ID NO: 1713484 - DNA, 19 bp, Homo sapiens
cactgcatggctcccacag

SEQ ID NO: 1713485 - DNA, 18 bp, Homo sapiens
cactgcattcctgtgccc

SEQ ID NO: 1713486 - DNA, 22 bp, Homo sapiens
cactgcattcctgtgccctaga

SEQ ID NO: 1713487 - DNA, 14 bp, Homo sapiens
cactgccacaccct

SEQ ID NO: 1713488 - DNA, 20 bp, Homo sapiens
cactgccacaccctccccat

SEQ ID NO: 1713489 - DNA, 21 bp, Homo sapiens
cactgccagaagagaattcag

SEQ ID NO: 1713490 - DNA, 16 bp, Homo sapiens
cactgccagcagcagc

SEQ ID NO: 1713491 - DNA, 19 bp, Homo sapiens
cactgccagcagcagcagg

SEQ ID NO: 1713492 - DNA, 21 bp, Homo sapiens
cactgccagcagcagcaggtg

SEQ ID NO: 1713493 - DNA, 16 bp, Homo sapiens
cactgccaggcacctg

SEQ ID NO: 1713494 - DNA, 17 bp, Homo sapiens
cactgccaggcacctgg

SEQ ID NO: 1713495 - DNA, 18 bp, Homo sapiens
cactgccaggcacctggc

SEQ ID NO: 1713496 - DNA, 22 bp, Homo sapiens
cactgccaggcacctggcctgc

SEQ ID NO: 1713497 - DNA, 17 bp, Homo sapiens
cactgccaggccagcct

SEQ ID NO: 1713498 - DNA, 21 bp, Homo sapiens
cactgccaggggttcttgagc

SEQ ID NO: 1713499 - DNA, 11 bp, Homo sapiens
cactgccatga

SEQ ID NO: 1713500 - DNA, 21 bp, Homo sapiens
cactgccatgatagctggggc

SEQ ID NO: 1713501 - DNA, 17 bp, Homo sapiens
cactgcccaccccctca

SEQ ID NO: 1713502 - DNA, 18 bp, Homo sapiens
cactgcccaccccctcaa

SEQ ID NO: 1713503 - DNA, 20 bp, Homo sapiens
cactgccccctgctgccatg

SEQ ID NO: 1713504 - DNA, 12 bp, Homo sapiens
cactgccctgcc

SEQ ID NO: 1713505 - DNA, 13 bp, Homo sapiens
cactgccctgcct

SEQ ID NO: 1713506 - DNA, 16 bp, Homo sapiens
cactgccctgcctgcc

SEQ ID NO: 1713507 - DNA, 18 bp, Homo sapiens
cactgccctgcctgccca

SEQ ID NO: 1713508 - DNA, 13 bp, Homo sapiens
cactgccctggca

SEQ ID NO: 1713509 - DNA, 14 bp, Homo sapiens
gggaggagaatgag

SEQ ID NO: 1713510 - DNA, 13 bp, Homo sapiens
gggaggagggaga

SEQ ID NO: 1713511 - DNA, 17 bp, Homo sapiens
gggaggagggagaggga

SEQ ID NO: 1713512 - DNA, 20 bp, Homo sapiens
gggaggaggtggcagccctg

SEQ ID NO: 1713513 - DNA, 15 bp, Homo sapiens
gggcagcaaggctgc

SEQ ID NO: 1713514 - DNA, 19 bp, Homo sapiens
gggcagcaaggctgctgcc

SEQ ID NO: 1713515 - DNA, 15 bp, Homo sapiens
gggcagcaagggacc

SEQ ID NO: 1713516 - DNA, 21 bp, Homo sapiens
gggcagcactccccagagctg

SEQ ID NO: 1713517 - DNA, 13 bp, Homo sapiens
gggcagcaggagc

SEQ ID NO: 1713518 - DNA, 18 bp, Homo sapiens
gggcagccacaccactgc

SEQ ID NO: 1713519 - DNA, 22 bp, Homo sapiens
gggcagccacccaagcctgctg

SEQ ID NO: 1713520 - DNA, 11 bp, Homo sapiens
gggcagccagc

SEQ ID NO: 1713521 - DNA, 12 bp, Homo sapiens
gggcagccagca

SEQ ID NO: 1713522 - DNA, 13 bp, Homo sapiens
gggcagccagcag

SEQ ID NO: 1713523 - DNA, 14 bp, Homo sapiens
gggcagccaggctg

SEQ ID NO: 1713524 - DNA, 16 bp, Homo sapiens
gggcagccaggctgcc

SEQ ID NO: 1713525 - DNA, 20 bp, Homo sapiens
gggcagcccaacagcacttt

SEQ ID NO: 1713526 - DNA, 20 bp, Homo sapiens
gggcagccctccacttctgg

SEQ ID NO: 1713527 - DNA, 14 bp, Homo sapiens
gggcagcccttgct

SEQ ID NO: 1713528 - DNA, 18 bp, Homo sapiens
gggcagccgctaggagag

SEQ ID NO: 1713529 - DNA, 15 bp, Homo sapiens
gggcagcctggctcc

SEQ ID NO: 1713530 - DNA, 18 bp, Homo sapiens
gggcagcctggctcccag

SEQ ID NO: 1713531 - DNA, 14 bp, Homo sapiens
gggcagcgggccag

SEQ ID NO: 1713532 - DNA, 16 bp, Homo sapiens
gggcagcgggccaggc

SEQ ID NO: 1713533 - DNA, 20 bp, Homo sapiens
gggcagcgggccaggcccgc

SEQ ID NO: 1713534 - DNA, 14 bp, Homo sapiens
gggcagctgggccc

SEQ ID NO: 1713535 - DNA, 19 bp, Homo sapiens
gggcaggaaggagagcctg

SEQ ID NO: 1713536 - DNA, 17 bp, Homo sapiens
gggcaggagtgccagga

SEQ ID NO: 1713537 - DNA, 14 bp, Homo sapiens
gggcaggcctggga

SEQ ID NO: 1713538 - DNA, 21 bp, Homo sapiens
gggcaggcctgggacccagct

SEQ ID NO: 1713539 - DNA, 15 bp, Homo sapiens
gggcaggctgggcca

SEQ ID NO: 1713540 - DNA, 16 bp, Homo sapiens
gggcaggcttggggaa

SEQ ID NO: 1713541 - DNA, 23 bp, Homo sapiens
gggcagggacccggggtctcctg

SEQ ID NO: 1713542 - DNA, 19 bp, Homo sapiens
gggcagggagctgggcccg

SEQ ID NO: 1713543 - DNA, 19 bp, Homo sapiens
gggcagggatgatggcaga

SEQ ID NO: 1713544 - DNA, 23 bp, Homo sapiens
gggcagggatgatggcagagcca

SEQ ID NO: 1713545 - DNA, 20 bp, Homo sapiens
gggcagggcatctcctgtgc

SEQ ID NO: 1713546 - DNA, 11 bp, Homo sapiens
gggcagggctg

SEQ ID NO: 1713547 - DNA, 13 bp, Homo sapiens
gggcaggggctgg

SEQ ID NO: 1713548 - DNA, 13 bp, Homo sapiens
gggcagggtgggg

SEQ ID NO: 1713549 - DNA, 20 bp, Homo sapiens
gggcaggtggccacagcagg

SEQ ID NO: 1713550 - DNA, 13 bp, Homo sapiens
gggcaggtgggag

SEQ ID NO: 1713551 - DNA, 16 bp, Homo sapiens
gggcaggtggtggcac

SEQ ID NO: 1713552 - DNA, 14 bp, Homo sapiens
gggcagtacctggg

SEQ ID NO: 1713553 - DNA, 18 bp, Homo sapiens
gggcagtgactggcaggt

SEQ ID NO: 1713554 - DNA, 20 bp, Homo sapiens
gggcagtggaggctgctgtg

SEQ ID NO: 1713555 - DNA, 18 bp, Homo sapiens
gggcagtgggtcccagat

SEQ ID NO: 1713556 - DNA, 16 bp, Homo sapiens
gggcagtgtgaggacc

SEQ ID NO: 1713557 - DNA, 17 bp, Homo sapiens
gggcatccacccagtgc

SEQ ID NO: 1713558 - DNA, 19 bp, Homo sapiens
gggcatccacccagtgctg

SEQ ID NO: 1713559 - DNA, 21 bp, Homo sapiens
gggcatccacccagtgctgcc

SEQ ID NO: 1713560 - DNA, 19 bp, Homo sapiens
gggcatctgcccctccccc

SEQ ID NO: 1713561 - DNA, 16 bp, Homo sapiens
gggcatcttgctggct

SEQ ID NO: 1713562 - DNA, 17 bp, Homo sapiens
gggcatcttgctggcta

SEQ ID NO: 1713563 - DNA, 19 bp, Homo sapiens
gggcatgccatgtctgagc

SEQ ID NO: 1713564 - DNA, 17 bp, Homo sapiens
gggcatgctggggcaag

SEQ ID NO: 1713565 - DNA, 17 bp, Homo sapiens
gggcatggccaggtggc

SEQ ID NO: 1713566 - DNA, 19 bp, Homo sapiens
gggcatggtggcaggcgcc

SEQ ID NO: 1713567 - DNA, 22 bp, Homo sapiens
gggcatgtattggcctggaggt

SEQ ID NO: 1713568 - DNA, 16 bp, Homo sapiens
gggcatgtcctttcca

SEQ ID NO: 1713569 - DNA, 16 bp, Homo sapiens
gggcatgtgtgcctgt

SEQ ID NO: 1713570 - DNA, 21 bp, Homo sapiens
gggcatgtgtgcctgtggcag

SEQ ID NO: 1713571 - DNA, 23 bp, Homo sapiens
gggcatgtgtgcctgtggcagaa

SEQ ID NO: 1713572 - DNA, 23 bp, Homo sapiens
gggcattcacaacccgagttacc

SEQ ID NO: 1713573 - DNA, 14 bp, Homo sapiens
gggccaaagcacag

SEQ ID NO: 1713574 - DNA, 18 bp, Homo sapiens
gggccaagagatctgtgt

SEQ ID NO: 1713575 - DNA, 20 bp, Homo sapiens
gggccacacctgagcgctgt

SEQ ID NO: 1713576 - DNA, 19 bp, Homo sapiens
gggccaccaaagctgccca

SEQ ID NO: 1713577 - DNA, 14 bp, Homo sapiens
gggccacccctcct

SEQ ID NO: 1713578 - DNA, 19 bp, Homo sapiens
gggccaccgcaggggactg

SEQ ID NO: 1713579 - DNA, 18 bp, Homo sapiens
gggccacctcctccccct

SEQ ID NO: 1713580 - DNA, 17 bp, Homo sapiens
gggccacgctccagctg

SEQ ID NO: 1713581 - DNA, 18 bp, Homo sapiens
gggccacgtgccaggccc

SEQ ID NO: 1713582 - DNA, 18 bp, Homo sapiens
gggccacgtggatgggca

SEQ ID NO: 1713583 - DNA, 19 bp, Homo sapiens
gggccagaaggagggcaga

SEQ ID NO: 1713584 - DNA, 20 bp, Homo sapiens
gggccagaaggagggcagag

SEQ ID NO: 1713585 - DNA, 22 bp, Homo sapiens
gggccagaaggagggcagagcc

SEQ ID NO: 1713586 - DNA, 11 bp, Homo sapiens
gggccagagcc

SEQ ID NO: 1713587 - DNA, 13 bp, Homo sapiens
gggccagatccag

SEQ ID NO: 1713588 - DNA, 14 bp, Homo sapiens
gggccagatccagc

SEQ ID NO: 1713589 - DNA, 16 bp, Homo sapiens
gggccagatccagcct

SEQ ID NO: 1713590 - DNA, 18 bp, Homo sapiens
gggccagatccagcctgg

SEQ ID NO: 1713591 - DNA, 18 bp, Homo sapiens
gggccagcaggctcctgg

SEQ ID NO: 1713592 - DNA, 21 bp, Homo sapiens
gggccagcatactccgtgagg

SEQ ID NO: 1713593 - DNA, 13 bp, Homo sapiens
gggccagccaggc

SEQ ID NO: 1713594 - DNA, 16 bp, Homo sapiens
gggccagccaggcggg

SEQ ID NO: 1713595 - DNA, 19 bp, Homo sapiens
gggccagccctgcagccca

SEQ ID NO: 1713596 - DNA, 17 bp, Homo sapiens
gggccaggacaggcccg

SEQ ID NO: 1713597 - DNA, 12 bp, Homo sapiens
gggccaggcact

SEQ ID NO: 1713598 - DNA, 14 bp, Homo sapiens
gggccaggcccgca

SEQ ID NO: 1713599 - DNA, 16 bp, Homo sapiens
gggccagggacccagg

SEQ ID NO: 1713600 - DNA, 23 bp, Homo sapiens
gggccagggacccaggtgtgcct

SEQ ID NO: 1713601 - DNA, 14 bp, Homo sapiens
gggccagggccctg

SEQ ID NO: 1713602 - DNA, 16 bp, Homo sapiens
gggccagggccctgca

SEQ ID NO: 1713603 - DNA, 16 bp, Homo sapiens
gggccagggctgcccc

SEQ ID NO: 1713604 - DNA, 12 bp, Homo sapiens
gggccagggtgg

SEQ ID NO: 1713605 - DNA, 17 bp, Homo sapiens
gggccagggtgggaaga

SEQ ID NO: 1713606 - DNA, 22 bp, Homo sapiens
gggccagggtgggaagagaaga

SEQ ID NO: 1713607 - DNA, 15 bp, Homo sapiens
gggccagtcaggctg

SEQ ID NO: 1713608 - DNA, 22 bp, Homo sapiens
gggccagtctgtggatcagaga

SEQ ID NO: 1713609 - DNA, 17 bp, Homo sapiens
gggccagtggctggggg

SEQ ID NO: 1713610 - DNA, 15 bp, Homo sapiens
gggccatccactgtg

SEQ ID NO: 1713611 - DNA, 23 bp, Homo sapiens
gggccatgatggcaacagatctg

SEQ ID NO: 1713612 - DNA, 14 bp, Homo sapiens
gggccatgctgagg

SEQ ID NO: 1713613 - DNA, 17 bp, Homo sapiens
gggccatgctgaggcct

SEQ ID NO: 1713614 - DNA, 23 bp, Homo sapiens
gggccatgctgaggcctgggccg

SEQ ID NO: 1713615 - DNA, 15 bp, Homo sapiens
gggccatggctcagg

SEQ ID NO: 1713616 - DNA, 23 bp, Homo sapiens
gggccatgtccaaagaggctgcc

SEQ ID NO: 1713617 - DNA, 19 bp, Homo sapiens
gggccattgaactctgaga

SEQ ID NO: 1713618 - DNA, 19 bp, Homo sapiens
gggcccaagacagatgccc

SEQ ID NO: 1713619 - DNA, 23 bp, Homo sapiens
gggcccaagacagatgccccaga

SEQ ID NO: 1713620 - DNA, 16 bp, Homo sapiens
gggcccaagccccatc

SEQ ID NO: 1713621 - DNA, 18 bp, Homo sapiens
gggcccacacctggtgga

SEQ ID NO: 1713622 - DNA, 14 bp, Homo sapiens
gggcccacccacat

SEQ ID NO: 1713623 - DNA, 10 bp, Homo sapiens
gggcccacct

SEQ ID NO: 1713624 - DNA, 13 bp, Homo sapiens
gggcccacctggc

SEQ ID NO: 1713625 - DNA, 14 bp, Homo sapiens
gggcccacctggcc

SEQ ID NO: 1713626 - DNA, 15 bp, Homo sapiens
gggcccacctggcca

SEQ ID NO: 1713627 - DNA, 16 bp, Homo sapiens
gggcccacctggccac

SEQ ID NO: 1713628 - DNA, 17 bp, Homo sapiens
gggcctggccagtcttc

SEQ ID NO: 1713629 - DNA, 13 bp, Homo sapiens
gggcctggccctc

SEQ ID NO: 1713630 - DNA, 12 bp, Homo sapiens
gggcctggcctg

SEQ ID NO: 1713631 - DNA, 16 bp, Homo sapiens
gggcctggcctgagct

SEQ ID NO: 1713632 - DNA, 18 bp, Homo sapiens
gggcctggcctgagctgg

SEQ ID NO: 1713633 - DNA, 23 bp, Homo sapiens
gggctgtgcttgaaggccctgct

SEQ ID NO: 1713634 - DNA, 18 bp, Homo sapiens
gggcttatgtctctgcct

SEQ ID NO: 1713635 - DNA, 21 bp, Homo sapiens
gggcttcattccggactggca

SEQ ID NO: 1713636 - DNA, 14 bp, Homo sapiens
gggcttccatgcct

SEQ ID NO: 1713637 - DNA, 18 bp, Homo sapiens
gggcttccatgcctgtag

SEQ ID NO: 1713638 - DNA, 20 bp, Homo sapiens
gggcttcccttctccccagc

SEQ ID NO: 1713639 - DNA, 21 bp, Homo sapiens
gggcttcccttctccccagcc

SEQ ID NO: 1713640 - DNA, 23 bp, Homo sapiens
gggcttcccttctccccagccag

SEQ ID NO: 1713641 - DNA, 21 bp, Homo sapiens
gggcttctcctcctctgtctt

SEQ ID NO: 1713642 - DNA, 19 bp, Homo sapiens
gggcttctgcaccctccac

SEQ ID NO: 1713643 - DNA, 15 bp, Homo sapiens
gggcttgaagccaaa

SEQ ID NO: 1713644 - DNA, 17 bp, Homo sapiens
gggcttgaagccaaaga

SEQ ID NO: 1713645 - DNA, 17 bp, Homo sapiens
gggcttgacacctgtct

SEQ ID NO: 1713646 - DNA, 16 bp, Homo sapiens
gggcttgccccactct

SEQ ID NO: 1713647 - DNA, 16 bp, Homo sapiens
gggcttggacttcctg

SEQ ID NO: 1713648 - DNA, 15 bp, Homo sapiens
gggcttgggccctgc

SEQ ID NO: 1713649 - DNA, 19 bp, Homo sapiens
gggcttgggccctgcacag

SEQ ID NO: 1713650 - DNA, 17 bp, Homo sapiens
gggctttctcttcccct

SEQ ID NO: 1713651 - DNA, 15 bp, Homo sapiens
gggctttctggagag

SEQ ID NO: 1713652 - DNA, 12 bp, Homo sapiens
ggggaaaaatgg

SEQ ID NO: 1713653 - DNA, 21 bp, Homo sapiens
ggggaaaatggccatgcagga

SEQ ID NO: 1713654 - DNA, 18 bp, Homo sapiens
ggggaaaatgtgaagctg

SEQ ID NO: 1713655 - DNA, 23 bp, Homo sapiens
ggggaaagacactgcctgggctg

SEQ ID NO: 1713656 - DNA, 17 bp, Homo sapiens
ggggaaaggcaaggtcc

SEQ ID NO: 1713657 - DNA, 22 bp, Homo sapiens
ggggaaaggcaaggtccggccc

SEQ ID NO: 1713658 - DNA, 17 bp, Homo sapiens
ggggaacatggctggcc

SEQ ID NO: 1713659 - DNA, 20 bp, Homo sapiens
ggggaacatggctggcctgg

SEQ ID NO: 1713660 - DNA, 18 bp, Homo sapiens
ggggaactcagatccagg

SEQ ID NO: 1713661 - DNA, 12 bp, Homo sapiens
ggggaagacagt

SEQ ID NO: 1713662 - DNA, 16 bp, Homo sapiens
ggggaagacagtggcc

SEQ ID NO: 1713663 - DNA, 14 bp, Homo sapiens
ggggaagccctgga

SEQ ID NO: 1713664 - DNA, 19 bp, Homo sapiens
ggggaaggaaggagggcac

SEQ ID NO: 1713665 - DNA, 15 bp, Homo sapiens
ggggaaggagccagt

SEQ ID NO: 1713666 - DNA, 12 bp, Homo sapiens
ggggaatctaag

SEQ ID NO: 1713667 - DNA, 14 bp, Homo sapiens
ggggacaccagagc

SEQ ID NO: 1713668 - DNA, 15 bp, Homo sapiens
ggggacaccagagct

SEQ ID NO: 1713669 - DNA, 18 bp, Homo sapiens
ggggacagttggcagaga

SEQ ID NO: 1713670 - DNA, 20 bp, Homo sapiens
ggggacagttggcagagaag

SEQ ID NO: 1713671 - DNA, 14 bp, Homo sapiens
ggggactcagccct

SEQ ID NO: 1713672 - DNA, 10 bp, Homo sapiens
ggggagaaag

SEQ ID NO: 1713673 - DNA, 22 bp, Homo sapiens
ggggagaagtgatatggtgaag

SEQ ID NO: 1713674 - DNA, 13 bp, Homo sapiens
ggggagacctggt

SEQ ID NO: 1713675 - DNA, 14 bp, Homo sapiens
ggggagagcctgct

SEQ ID NO: 1713676 - DNA, 16 bp, Homo sapiens
ggggagagcctgctgg

SEQ ID NO: 1713677 - DNA, 19 bp, Homo sapiens
ggggagcacttgcgtcctg

SEQ ID NO: 1713678 - DNA, 19 bp, Homo sapiens
ggggagccagctgcttgac

SEQ ID NO: 1713679 - DNA, 19 bp, Homo sapiens
ggggagcccactgtcctgg

SEQ ID NO: 1713680 - DNA, 14 bp, Homo sapiens
ggggagcccagtga

SEQ ID NO: 1713681 - DNA, 20 bp, Homo sapiens
ggggagccgagggcgtcaga

SEQ ID NO: 1713682 - DNA, 22 bp, Homo sapiens
ggggagccgagggcgtcagaga

SEQ ID NO: 1713683 - DNA, 14 bp, Homo sapiens
ggggaggcagcaga

SEQ ID NO: 1713684 - DNA, 16 bp, Homo sapiens
ggggaggcccaaatga

SEQ ID NO: 1713685 - DNA, 21 bp, Homo sapiens
ggggaggcccctgaggcagcc

SEQ ID NO: 1713686 - DNA, 22 bp, Homo sapiens
ggggaggcctctttgccccgac

SEQ ID NO: 1713687 - DNA, 16 bp, Homo sapiens
ggggaggggcgctggc

SEQ ID NO: 1713688 - DNA, 15 bp, Homo sapiens
ggggagtagccaagc

SEQ ID NO: 1713689 - DNA, 17 bp, Homo sapiens
ggggagttaagacctgg

SEQ ID NO: 1713690 - DNA, 22 bp, Homo sapiens
ggggatcatctgccgtgcctgg

SEQ ID NO: 1713691 - DNA, 23 bp, Homo sapiens
ggggatcatgttaaaaatagcag

SEQ ID NO: 1713692 - DNA, 13 bp, Homo sapiens
ggggatccagcca

SEQ ID NO: 1713693 - DNA, 14 bp, Homo sapiens
ggggatccagccac

SEQ ID NO: 1713694 - DNA, 15 bp, Homo sapiens
ggggatccagccact

SEQ ID NO: 1713695 - DNA, 17 bp, Homo sapiens
ggggatccagccacttc

SEQ ID NO: 1713696 - DNA, 15 bp, Homo sapiens
ggggatccagtgaga

SEQ ID NO: 1713697 - DNA, 21 bp, Homo sapiens
ggggatccccgcctggccagg

SEQ ID NO: 1713698 - DNA, 23 bp, Homo sapiens
ggggatccccgcctggccaggag

SEQ ID NO: 1713699 - DNA, 13 bp, Homo sapiens
ggggatctcaggg

SEQ ID NO: 1713700 - DNA, 21 bp, Homo sapiens
ggggatgactagaggcaggga

SEQ ID NO: 1713701 - DNA, 14 bp, Homo sapiens
ggggatttctggga

SEQ ID NO: 1713702 - DNA, 12 bp, Homo sapiens
ggggcaagacag

SEQ ID NO: 1713703 - DNA, 18 bp, Homo sapiens
ggggcaaggtctccttac

SEQ ID NO: 1713704 - DNA, 21 bp, Homo sapiens
ggggcaatagggttaaatggt

SEQ ID NO: 1713705 - DNA, 15 bp, Homo sapiens
ggggcacaccactgc

SEQ ID NO: 1713706 - DNA, 16 bp, Homo sapiens
ggggcacaccactgcc

SEQ ID NO: 1713707 - DNA, 19 bp, Homo sapiens
ggggcacaccactgccctg

SEQ ID NO: 1713708 - DNA, 20 bp, Homo sapiens
ggggcacaccactgccctgc

SEQ ID NO: 1713709 - DNA, 17 bp, Homo sapiens
ggggcagaacagccgct

SEQ ID NO: 1713710 - DNA, 16 bp, Homo sapiens
ggggcagagggcagag

SEQ ID NO: 1713711 - DNA, 18 bp, Homo sapiens
ggggcagagggcagaggc

SEQ ID NO: 1713712 - DNA, 13 bp, Homo sapiens
ggggcaggactga

SEQ ID NO: 1713713 - DNA, 16 bp, Homo sapiens
ggggcaggagggccct

SEQ ID NO: 1713714 - DNA, 17 bp, Homo sapiens
ggggcaggagtgccagg

SEQ ID NO: 1713715 - DNA, 22 bp, Homo sapiens
ggggcaggagtgccaggaccag

SEQ ID NO: 1713716 - DNA, 14 bp, Homo sapiens
ggggcaggctgggc

SEQ ID NO: 1713717 - DNA, 15 bp, Homo sapiens
ggggcaggctgggcc

SEQ ID NO: 1713718 - DNA, 19 bp, Homo sapiens
ggggcagggaaggacagga

SEQ ID NO: 1713719 - DNA, 13 bp, Homo sapiens
ggggcagggagct

SEQ ID NO: 1713720 - DNA, 17 bp, Homo sapiens
ggggcagggagctgggc

SEQ ID NO: 1713721 - DNA, 13 bp, Homo sapiens
ggggcagggaggc

SEQ ID NO: 1713722 - DNA, 16 bp, Homo sapiens
ggggcagggcctgggc

SEQ ID NO: 1713723 - DNA, 12 bp, Homo sapiens
ggggcagggctg

SEQ ID NO: 1713724 - DNA, 14 bp, Homo sapiens
ggggcatcctggat

SEQ ID NO: 1713725 - DNA, 20 bp, Homo sapiens
ggggcatctgcccctccccc

SEQ ID NO: 1713726 - DNA, 15 bp, Homo sapiens
ggggcatgaccagat

SEQ ID NO: 1713727 - DNA, 17 bp, Homo sapiens
ggggcatgaccagatgc

SEQ ID NO: 1713728 - DNA, 17 bp, Homo sapiens
ggggcatggttccttcc

SEQ ID NO: 1713729 - DNA, 18 bp, Homo sapiens
ggggcatggttccttccc

SEQ ID NO: 1713730 - DNA, 21 bp, Homo sapiens
ggggcatggttccttccctgg

SEQ ID NO: 1713731 - DNA, 18 bp, Homo sapiens
ggggcatgtattggcctg

SEQ ID NO: 1713732 - DNA, 14 bp, Homo sapiens
ggggccaccaaagc

SEQ ID NO: 1713733 - DNA, 19 bp, Homo sapiens
ggggccaccaaagctgccc

SEQ ID NO: 1713734 - DNA, 19 bp, Homo sapiens
ggggccagatccagcctgg

SEQ ID NO: 1713735 - DNA, 10 bp, Homo sapiens
ggggccagga

SEQ ID NO: 1713736 - DNA, 11 bp, Homo sapiens
ggggccaggac

SEQ ID NO: 1713737 - DNA, 12 bp, Homo sapiens
ggggccaggacc

SEQ ID NO: 1713738 - DNA, 14 bp, Homo sapiens
ggggcccacccaca

SEQ ID NO: 1713739 - DNA, 15 bp, Homo sapiens
ggggccccagatctg

SEQ ID NO: 1713740 - DNA, 20 bp, Homo sapiens
ggggccccagatctgcctgg

SEQ ID NO: 1713741 - DNA, 17 bp, Homo sapiens
ggggccccgccagggct

SEQ ID NO: 1713742 - DNA, 18 bp, Homo sapiens
ggggccccgccagggctg

SEQ ID NO: 1713743 - DNA, 19 bp, Homo sapiens
ggggccccgccagggctgg

SEQ ID NO: 1713744 - DNA, 16 bp, Homo sapiens
ggggccctgccccacc

SEQ ID NO: 1713745 - DNA, 16 bp, Homo sapiens
ggggccctggccagga

SEQ ID NO: 1713746 - DNA, 11 bp, Homo sapiens
ggggccctgtg

SEQ ID NO: 1713747 - DNA, 19 bp, Homo sapiens
ggggcccttggggcctggc

SEQ ID NO: 1713748 - DNA, 21 bp, Homo sapiens
ggggcccttggggcctggctt

SEQ ID NO: 1713749 - DNA, 18 bp, Homo sapiens
ggggccgccacggcctgg

SEQ ID NO: 1713750 - DNA, 18 bp, Homo sapiens
ggggccgccgctgaccct

SEQ ID NO: 1713751 - DNA, 19 bp, Homo sapiens
ggggccgccgctgaccctg

SEQ ID NO: 1713752 - DNA, 20 bp, Homo sapiens
ggggccggccctgtgtgcag

SEQ ID NO: 1713753 - DNA, 20 bp, Homo sapiens
ggggccggcggggcccacgc

SEQ ID NO: 1713754 - DNA, 18 bp, Homo sapiens
ggggccgtgggggttgag

SEQ ID NO: 1713755 - DNA, 19 bp, Homo sapiens
ggggcctccagaagctgct

SEQ ID NO: 1713756 - DNA, 12 bp, Homo sapiens
ggggcctccctg

SEQ ID NO: 1713757 - DNA, 14 bp, Homo sapiens
ggggcctgactgct

SEQ ID NO: 1713758 - DNA, 20 bp, Homo sapiens
ggggcctgcagaaggaaaga

SEQ ID NO: 1713759 - DNA, 18 bp, Homo sapiens
ggagccggtaactgtcct

SEQ ID NO: 1713760 - DNA, 17 bp, Homo sapiens
ggagcctagcggagccc

SEQ ID NO: 1713761 - DNA, 21 bp, Homo sapiens
ggagcctagcggagcccagcc

SEQ ID NO: 1713762 - DNA, 17 bp, Homo sapiens
ggagcctagctcctgcc

SEQ ID NO: 1713763 - DNA, 21 bp, Homo sapiens
ggagcctcatccgaggcaggg

SEQ ID NO: 1713764 - DNA, 23 bp, Homo sapiens
ggagcctgccgcccccgcctggg

SEQ ID NO: 1713765 - DNA, 14 bp, Homo sapiens
ggagcctggcacag

SEQ ID NO: 1713766 - DNA, 19 bp, Homo sapiens
ggagcctggcacaggactg

SEQ ID NO: 1713767 - DNA, 18 bp, Homo sapiens
ggagccttgctgggccag

SEQ ID NO: 1713768 - DNA, 19 bp, Homo sapiens
ggagcgaagcagagaggtg

SEQ ID NO: 1713769 - DNA, 19 bp, Homo sapiens
ggagcgcacctgccccctg

SEQ ID NO: 1713770 - DNA, 19 bp, Homo sapiens
ggagcggaggttgcagtga

SEQ ID NO: 1713771 - DNA, 13 bp, Homo sapiens
ggagcggggggga

SEQ ID NO: 1713772 - DNA, 18 bp, Homo sapiens
ggagcgtggactctgcta

SEQ ID NO: 1713773 - DNA, 15 bp, Homo sapiens
ggagctagcccagtc

SEQ ID NO: 1713774 - DNA, 14 bp, Homo sapiens
ggagctcaccctgc

SEQ ID NO: 1713775 - DNA, 20 bp, Homo sapiens
ggagctccactctgcttctc

SEQ ID NO: 1713776 - DNA, 18 bp, Homo sapiens
ggagctctcaattttatg

SEQ ID NO: 1713777 - DNA, 20 bp, Homo sapiens
ggagctctggggacagcttc

SEQ ID NO: 1713778 - DNA, 16 bp, Homo sapiens
ggagctctgtatggtc

SEQ ID NO: 1713779 - DNA, 18 bp, Homo sapiens
ggagctcttcaggcctcc

SEQ ID NO: 1713780 - DNA, 13 bp, Homo sapiens
ggagctcttggaa

SEQ ID NO: 1713781 - DNA, 14 bp, Homo sapiens
ggagctcttggaag

SEQ ID NO: 1713782 - DNA, 19 bp, Homo sapiens
ggagctgaaagggagcccc

SEQ ID NO: 1713783 - DNA, 22 bp, Homo sapiens
ggagctgagctggaaggggcca

SEQ ID NO: 1713784 - DNA, 19 bp, Homo sapiens
ggagctgatttccaggccc

SEQ ID NO: 1713785 - DNA, 20 bp, Homo sapiens
ggagctgatttccaggcccc

SEQ ID NO: 1713786 - DNA, 14 bp, Homo sapiens
ggagctgcactgat

SEQ ID NO: 1713787 - DNA, 19 bp, Homo sapiens
ggagctgccacagagaagt

SEQ ID NO: 1713788 - DNA, 18 bp, Homo sapiens
ggagctgccgtgcctgtg

SEQ ID NO: 1713789 - DNA, 12 bp, Homo sapiens
ggagctgcctgc

SEQ ID NO: 1713790 - DNA, 13 bp, Homo sapiens
ggagctgcctgca

SEQ ID NO: 1713791 - DNA, 16 bp, Homo sapiens
ggagctgcctgcttgg

SEQ ID NO: 1713792 - DNA, 22 bp, Homo sapiens
ggagctgcctgcttggcccggc

SEQ ID NO: 1713793 - DNA, 16 bp, Homo sapiens
ggagctgcgccggaca

SEQ ID NO: 1713794 - DNA, 22 bp, Homo sapiens
ggagctgcgcttccctgcagtc

SEQ ID NO: 1713795 - DNA, 15 bp, Homo sapiens
ggagctgctgagtga

SEQ ID NO: 1713796 - DNA, 15 bp, Homo sapiens
ggagctgctggcttg

SEQ ID NO: 1713797 - DNA, 23 bp, Homo sapiens
ggagctggaggggtggggagcta

SEQ ID NO: 1713798 - DNA, 13 bp, Homo sapiens
ggagctggcccag

SEQ ID NO: 1713799 - DNA, 14 bp, Homo sapiens
ggagctggcccagg

SEQ ID NO: 1713800 - DNA, 15 bp, Homo sapiens
ggagctggcccaggg

SEQ ID NO: 1713801 - DNA, 22 bp, Homo sapiens
ggagctggcctgtggcacagcc

SEQ ID NO: 1713802 - DNA, 21 bp, Homo sapiens
ggagctggcggggaaccctgg

SEQ ID NO: 1713803 - DNA, 13 bp, Homo sapiens
ggagctggctggc

SEQ ID NO: 1713804 - DNA, 14 bp, Homo sapiens
ggagctggctggca

SEQ ID NO: 1713805 - DNA, 16 bp, Homo sapiens
ggagctggctggcagg

SEQ ID NO: 1713806 - DNA, 18 bp, Homo sapiens
ggagctggctggcaggtg

SEQ ID NO: 1713807 - DNA, 21 bp, Homo sapiens
ggagctgggacacttaacaga

SEQ ID NO: 1713808 - DNA, 12 bp, Homo sapiens
ggagctgggaga

SEQ ID NO: 1713809 - DNA, 14 bp, Homo sapiens
ggagctgggaggaa

SEQ ID NO: 1713810 - DNA, 15 bp, Homo sapiens
ggagctgggaggaaa

SEQ ID NO: 1713811 - DNA, 19 bp, Homo sapiens
ggagctgggcagaaggcca

SEQ ID NO: 1713812 - DNA, 17 bp, Homo sapiens
ggagctgggcccctgca

SEQ ID NO: 1713813 - DNA, 17 bp, Homo sapiens
ggagctggggatccctc

SEQ ID NO: 1713814 - DNA, 16 bp, Homo sapiens
ggagctggtgagatca

SEQ ID NO: 1713815 - DNA, 22 bp, Homo sapiens
ggagctgttactgaatattaaa

SEQ ID NO: 1713816 - DNA, 20 bp, Homo sapiens
ggagcttacccaagctgtgg

SEQ ID NO: 1713817 - DNA, 18 bp, Homo sapiens
ggagcttcggggcctcct

SEQ ID NO: 1713818 - DNA, 22 bp, Homo sapiens
ggagcttctcccagtgtgagac

SEQ ID NO: 1713819 - DNA, 15 bp, Homo sapiens
ggagcttgcaagaag

SEQ ID NO: 1713820 - DNA, 13 bp, Homo sapiens
ggagcttgcagtg

SEQ ID NO: 1713821 - DNA, 18 bp, Homo sapiens
ggagctttctcaatgtct

SEQ ID NO: 1713822 - DNA, 19 bp, Homo sapiens
ggagctttctcaatgtctt

SEQ ID NO: 1713823 - DNA, 13 bp, Homo sapiens
ggaggaaaaaaga

SEQ ID NO: 1713824 - DNA, 21 bp, Homo sapiens
ggaggaaaaccaagccgtggc

SEQ ID NO: 1713825 - DNA, 22 bp, Homo sapiens
ggaggaaaaccaagccgtggct

SEQ ID NO: 1713826 - DNA, 12 bp, Homo sapiens
ggctctccaagt

SEQ ID NO: 1713827 - DNA, 17 bp, Homo sapiens
ggctctccaagtgccag

SEQ ID NO: 1713828 - DNA, 20 bp, Homo sapiens
ggctctccaagtgccagagg

SEQ ID NO: 1713829 - DNA, 13 bp, Homo sapiens
ggctctccacctc

SEQ ID NO: 1713830 - DNA, 17 bp, Homo sapiens
ggctctccacctcagcc

SEQ ID NO: 1713831 - DNA, 18 bp, Homo sapiens
ggctctccacctcagcct

SEQ ID NO: 1713832 - DNA, 20 bp, Homo sapiens
ggctctccacctcagccttg

SEQ ID NO: 1713833 - DNA, 21 bp, Homo sapiens
ggctctccacctcagccttgg

SEQ ID NO: 1713834 - DNA, 22 bp, Homo sapiens
ggctctccacctcagccttgga

SEQ ID NO: 1713835 - DNA, 15 bp, Homo sapiens
ggctctgagagtcta

SEQ ID NO: 1713836 - DNA, 15 bp, Homo sapiens
ggctctgaggggcac

SEQ ID NO: 1713837 - DNA, 15 bp, Homo sapiens
ggctctgatctaaca

SEQ ID NO: 1713838 - DNA, 20 bp, Homo sapiens
ggctctgatctaacaaaata

SEQ ID NO: 1713839 - DNA, 20 bp, Homo sapiens
ggctctgcaattcccctctg

SEQ ID NO: 1713840 - DNA, 14 bp, Homo sapiens
ggctctgccaccct

SEQ ID NO: 1713841 - DNA, 13 bp, Homo sapiens
ggctctgccccag

SEQ ID NO: 1713842 - DNA, 21 bp, Homo sapiens
ggctctgccccagctctggct

SEQ ID NO: 1713843 - DNA, 21 bp, Homo sapiens
ggctctgccctccctccttcc

SEQ ID NO: 1713844 - DNA, 13 bp, Homo sapiens
ggctctgccttct

SEQ ID NO: 1713845 - DNA, 22 bp, Homo sapiens
ggctctgccttctcaggccccg

SEQ ID NO: 1713846 - DNA, 13 bp, Homo sapiens
ggctctggccacc

SEQ ID NO: 1713847 - DNA, 15 bp, Homo sapiens
ggctctgggaatggg

SEQ ID NO: 1713848 - DNA, 14 bp, Homo sapiens
ggctctgggctcag

SEQ ID NO: 1713849 - DNA, 17 bp, Homo sapiens
ggctctgggctcagggc

SEQ ID NO: 1713850 - DNA, 19 bp, Homo sapiens
ggctctgggctcagggctg

SEQ ID NO: 1713851 - DNA, 12 bp, Homo sapiens
ggctctgtgcct

SEQ ID NO: 1713852 - DNA, 16 bp, Homo sapiens
ggctctgtttgatgct

SEQ ID NO: 1713853 - DNA, 19 bp, Homo sapiens
ggctcttatgtgtgccttt

SEQ ID NO: 1713854 - DNA, 11 bp, Homo sapiens
ggctcttccaa

SEQ ID NO: 1713855 - DNA, 19 bp, Homo sapiens
ggctcttcctggacctgag

SEQ ID NO: 1713856 - DNA, 14 bp, Homo sapiens
ggctcttctccttt

SEQ ID NO: 1713857 - DNA, 19 bp, Homo sapiens
ggctcttgatacccccctc

SEQ ID NO: 1713858 - DNA, 21 bp, Homo sapiens
ggctcttgatacccccctctg

SEQ ID NO: 1713859 - DNA, 15 bp, Homo sapiens
ggctctttcagagag

SEQ ID NO: 1713860 - DNA, 20 bp, Homo sapiens
ggctgaaaatgcaaagctga

SEQ ID NO: 1713861 - DNA, 22 bp, Homo sapiens
ggctgaaattctcctggaggtc

SEQ ID NO: 1713862 - DNA, 21 bp, Homo sapiens
ggctgaaccctgtgctggtgt

SEQ ID NO: 1713863 - DNA, 23 bp, Homo sapiens
ggctgaaccctgtgctggtgtcc

SEQ ID NO: 1713864 - DNA, 20 bp, Homo sapiens
ggctgaacggggagaaaagg

SEQ ID NO: 1713865 - DNA, 18 bp, Homo sapiens
ggctgaactacaagtgta

SEQ ID NO: 1713866 - DNA, 12 bp, Homo sapiens
ggctgaagctgg

SEQ ID NO: 1713867 - DNA, 17 bp, Homo sapiens
ggctgaagctggagcag

SEQ ID NO: 1713868 - DNA, 21 bp, Homo sapiens
ggctgaatccgtggtggcacc

SEQ ID NO: 1713869 - DNA, 22 bp, Homo sapiens
ggctgaatgtatgtcagtgcta

SEQ ID NO: 1713870 - DNA, 16 bp, Homo sapiens
ggctgacacctaccat

SEQ ID NO: 1713871 - DNA, 17 bp, Homo sapiens
ggctgacacctaccatg

SEQ ID NO: 1713872 - DNA, 18 bp, Homo sapiens
ggctgacatctgtgtttc

SEQ ID NO: 1713873 - DNA, 15 bp, Homo sapiens
ggctgaccatgctca

SEQ ID NO: 1713874 - DNA, 23 bp, Homo sapiens
ggctgacccagcatctcccagca

SEQ ID NO: 1713875 - DNA, 17 bp, Homo sapiens
ggctgacccagtccctg

SEQ ID NO: 1713876 - DNA, 13 bp, Homo sapiens
ggctgacccctct

SEQ ID NO: 1713877 - DNA, 22 bp, Homo sapiens
ggctgacccctctggtgtgtgg

SEQ ID NO: 1713878 - DNA, 17 bp, Homo sapiens
ggctgacctgcctctca

SEQ ID NO: 1713879 - DNA, 19 bp, Homo sapiens
ggctgactagaagggccag

SEQ ID NO: 1713880 - DNA, 22 bp, Homo sapiens
ggctgactagaagggccagtcc

SEQ ID NO: 1713881 - DNA, 14 bp, Homo sapiens
ggctgagagcccca

SEQ ID NO: 1713882 - DNA, 19 bp, Homo sapiens
ggctgagagccccagctga

SEQ ID NO: 1713883 - DNA, 22 bp, Homo sapiens
ggctgagcaaatattaaaattg

SEQ ID NO: 1713884 - DNA, 12 bp, Homo sapiens
ggctgagccatg

SEQ ID NO: 1713885 - DNA, 13 bp, Homo sapiens
ggctgagccccta

SEQ ID NO: 1713886 - DNA, 18 bp, Homo sapiens
ggctgagcccctacccca

SEQ ID NO: 1713887 - DNA, 12 bp, Homo sapiens
ggctgagccctg

SEQ ID NO: 1713888 - DNA, 23 bp, Homo sapiens
ggctgagcctgaggccttccaga

SEQ ID NO: 1713889 - DNA, 20 bp, Homo sapiens
ggctgagctctctgtgggct

SEQ ID NO: 1713890 - DNA, 13 bp, Homo sapiens
ggctgagctgggg

SEQ ID NO: 1713891 - DNA, 12 bp, Homo sapiens
ggctgaggcagg

SEQ ID NO: 1713892 - DNA, 14 bp, Homo sapiens
ggctgaggcctgga

SEQ ID NO: 1713893 - DNA, 15 bp, Homo sapiens
ggctgagggacagga

SEQ ID NO: 1713894 - DNA, 16 bp, Homo sapiens
ggctgagggcctgctg

SEQ ID NO: 1713895 - DNA, 18 bp, Homo sapiens
ggctgagggcctgctgga

SEQ ID NO: 1713896 - DNA, 22 bp, Homo sapiens
ggctgaggttcctctgcctgcc

SEQ ID NO: 1713897 - DNA, 18 bp, Homo sapiens
ggctgagtctccagggcc

SEQ ID NO: 1713898 - DNA, 20 bp, Homo sapiens
ggctgagtggaatgcaggga

SEQ ID NO: 1713899 - DNA, 13 bp, Homo sapiens
ggctgagtggcag

SEQ ID NO: 1713900 - DNA, 14 bp, Homo sapiens
ggctgatgaagaag

SEQ ID NO: 1713901 - DNA, 16 bp, Homo sapiens
ggctgatgaagaaggg

SEQ ID NO: 1713902 - DNA, 17 bp, Homo sapiens
ggctgatgatccagaac

SEQ ID NO: 1713903 - DNA, 20 bp, Homo sapiens
ggctgatggattccaaacca

SEQ ID NO: 1713904 - DNA, 21 bp, Homo sapiens
ggctgatggattccaaaccag

SEQ ID NO: 1713905 - DNA, 18 bp, Homo sapiens
ggctgatgtcaatttctg

SEQ ID NO: 1713906 - DNA, 19 bp, Homo sapiens
ggctgcaaataaggacagc

SEQ ID NO: 1713907 - DNA, 13 bp, Homo sapiens
ggctgcaatgccc

SEQ ID NO: 1713908 - DNA, 12 bp, Homo sapiens
ggctgcactgca

SEQ ID NO: 1713909 - DNA, 13 bp, Homo sapiens
ggctgcactgcag

SEQ ID NO: 1713910 - DNA, 18 bp, Homo sapiens
ggctgcagagctgaccca

SEQ ID NO: 1713911 - DNA, 16 bp, Homo sapiens
ggctgcagaggccaga

SEQ ID NO: 1713912 - DNA, 20 bp, Homo sapiens
ggctgcagagtctgccccac

SEQ ID NO: 1713913 - DNA, 21 bp, Homo sapiens
ggctgcatacccgggcagggc

SEQ ID NO: 1713914 - DNA, 14 bp, Homo sapiens
ggctgcatgctctg

SEQ ID NO: 1713915 - DNA, 21 bp, Homo sapiens
ggctgcatgctctggaagcct

SEQ ID NO: 1713916 - DNA, 14 bp, Homo sapiens
ggctgccagcgtct

SEQ ID NO: 1713917 - DNA, 16 bp, Homo sapiens
ggctgccagcgtctgt

SEQ ID NO: 1713918 - DNA, 10 bp, Homo sapiens
ggctgccagg

SEQ ID NO: 1713919 - DNA, 11 bp, Homo sapiens
ggctgccaggc

SEQ ID NO: 1713920 - DNA, 23 bp, Homo sapiens
ggctgcccaggagacagaccact

SEQ ID NO: 1713921 - DNA, 23 bp, Homo sapiens
ggctgccccacctgccgcatgct

SEQ ID NO: 1713922 - DNA, 17 bp, Homo sapiens
ggctgccccaggccgga

SEQ ID NO: 1713923 - DNA, 20 bp, Homo sapiens
atttggatttaaaagcctgc

SEQ ID NO: 1713924 - DNA, 17 bp, Homo sapiens
atttggcatctcctgtc

SEQ ID NO: 1713925 - DNA, 16 bp, Homo sapiens
atttggcctgcactaa

SEQ ID NO: 1713926 - DNA, 20 bp, Homo sapiens
atttgggagaagcaaatata

SEQ ID NO: 1713927 - DNA, 22 bp, Homo sapiens
atttgggagaagggcagagtta

SEQ ID NO: 1713928 - DNA, 16 bp, Homo sapiens
atttgggagctgaacc

SEQ ID NO: 1713929 - DNA, 16 bp, Homo sapiens
atttgggatggagaag

SEQ ID NO: 1713930 - DNA, 12 bp, Homo sapiens
atttggtacttt

SEQ ID NO: 1713931 - DNA, 21 bp, Homo sapiens
atttggtagatgttcttttct

SEQ ID NO: 1713932 - DNA, 17 bp, Homo sapiens
atttggtataattatgg

SEQ ID NO: 1713933 - DNA, 15 bp, Homo sapiens
atttggtattaaact

SEQ ID NO: 1713934 - DNA, 20 bp, Homo sapiens
atttggtctgccagaatact

SEQ ID NO: 1713935 - DNA, 18 bp, Homo sapiens
atttggtgttcctggaag

SEQ ID NO: 1713936 - DNA, 18 bp, Homo sapiens
atttggtttagaacataa

SEQ ID NO: 1713937 - DNA, 21 bp, Homo sapiens
atttggttttacacaggaaga

SEQ ID NO: 1713938 - DNA, 19 bp, Homo sapiens
atttgtaaagctatttatg

SEQ ID NO: 1713939 - DNA, 18 bp, Homo sapiens
atttgtaaagctttacaa

SEQ ID NO: 1713940 - DNA, 12 bp, Homo sapiens
atttgtaaatct

SEQ ID NO: 1713941 - DNA, 18 bp, Homo sapiens
atttgtaagtaacacagt

SEQ ID NO: 1713942 - DNA, 21 bp, Homo sapiens
atttgtaagtgtaaaaaatgt

SEQ ID NO: 1713943 - DNA, 14 bp, Homo sapiens
atttgtaataaagt

SEQ ID NO: 1713944 - DNA, 17 bp, Homo sapiens
atttgtaatatttttgt

SEQ ID NO: 1713945 - DNA, 22 bp, Homo sapiens
atttgtaattaaaagcaaatca

SEQ ID NO: 1713946 - DNA, 13 bp, Homo sapiens
atttgtaatttaa

SEQ ID NO: 1713947 - DNA, 12 bp, Homo sapiens
atttgtaatttt

SEQ ID NO: 1713948 - DNA, 17 bp, Homo sapiens
atttgtaattttaaaag

SEQ ID NO: 1713949 - DNA, 13 bp, Homo sapiens
atttgtacaaata

SEQ ID NO: 1713950 - DNA, 14 bp, Homo sapiens
atttgtacaaataa

SEQ ID NO: 1713951 - DNA, 16 bp, Homo sapiens
atttgtacaaataaac

SEQ ID NO: 1713952 - DNA, 20 bp, Homo sapiens
atttgtacaaataaacctga

SEQ ID NO: 1713953 - DNA, 17 bp, Homo sapiens
atttgtacaatggttta

SEQ ID NO: 1713954 - DNA, 20 bp, Homo sapiens
atttgtacaggactgtaaag

SEQ ID NO: 1713955 - DNA, 23 bp, Homo sapiens
atttgtacaggactgtaaagatt

SEQ ID NO: 1713956 - DNA, 21 bp, Homo sapiens
atttgtacatagttatttatt

SEQ ID NO: 1713957 - DNA, 18 bp, Homo sapiens
atttgtactatttaactg

SEQ ID NO: 1713958 - DNA, 14 bp, Homo sapiens
atttgtacttctta

SEQ ID NO: 1713959 - DNA, 15 bp, Homo sapiens
atttgtacttcttat

SEQ ID NO: 1713960 - DNA, 13 bp, Homo sapiens
atttgtacttgct

SEQ ID NO: 1713961 - DNA, 19 bp, Homo sapiens
atttgtactttctgttaaa

SEQ ID NO: 1713962 - DNA, 23 bp, Homo sapiens
atttgtacttttttcttaaggca

SEQ ID NO: 1713963 - DNA, 18 bp, Homo sapiens
atttgtagctagaatatc

SEQ ID NO: 1713964 - DNA, 14 bp, Homo sapiens
atttgtaggagaaa

SEQ ID NO: 1713965 - DNA, 21 bp, Homo sapiens
atttgtatagttgcttgcctg

SEQ ID NO: 1713966 - DNA, 15 bp, Homo sapiens
atttgtatatcatga

SEQ ID NO: 1713967 - DNA, 14 bp, Homo sapiens
atttgtatattgtg

SEQ ID NO: 1713968 - DNA, 18 bp, Homo sapiens
atttgtatgtcaaagctt

SEQ ID NO: 1713969 - DNA, 12 bp, Homo sapiens
atttgtattaat

SEQ ID NO: 1713970 - DNA, 15 bp, Homo sapiens
atttgtattaataaa

SEQ ID NO: 1713971 - DNA, 19 bp, Homo sapiens
atttgtattaataaagcat

SEQ ID NO: 1713972 - DNA, 17 bp, Homo sapiens
atttgtattcaaatttg

SEQ ID NO: 1713973 - DNA, 17 bp, Homo sapiens
atttgtatttattcttt

SEQ ID NO: 1713974 - DNA, 20 bp, Homo sapiens
atttgtatttatttccagac

SEQ ID NO: 1713975 - DNA, 20 bp, Homo sapiens
atttgtatttctcttgtcct

SEQ ID NO: 1713976 - DNA, 17 bp, Homo sapiens
atttgtcaatgacagtt

SEQ ID NO: 1713977 - DNA, 21 bp, Homo sapiens
atttgtcacagaaatcagagg

SEQ ID NO: 1713978 - DNA, 17 bp, Homo sapiens
caagaaggaaggaggca

SEQ ID NO: 1713979 - DNA, 19 bp, Homo sapiens
caagaaggaaggaggcaga

SEQ ID NO: 1713980 - DNA, 20 bp, Homo sapiens
caagaaggaaggaggcagac

SEQ ID NO: 1713981 - DNA, 12 bp, Homo sapiens
caagaagggctg

SEQ ID NO: 1713982 - DNA, 16 bp, Homo sapiens
caagaagggctgcatg

SEQ ID NO: 1713983 - DNA, 17 bp, Homo sapiens
caagaagggctgcatga

SEQ ID NO: 1713984 - DNA, 22 bp, Homo sapiens
caagaagtgggtgcccttggta

SEQ ID NO: 1713985 - DNA, 23 bp, Homo sapiens
caagaagttaaaaaacagctgca

SEQ ID NO: 1713986 - DNA, 21 bp, Homo sapiens
caagaagttctttgattctgt

SEQ ID NO: 1713987 - DNA, 12 bp, Homo sapiens
caagaataaaaa

SEQ ID NO: 1713988 - DNA, 17 bp, Homo sapiens
caagaataatcacgctt

SEQ ID NO: 1713989 - DNA, 18 bp, Homo sapiens
caagaataatcacgcttt

SEQ ID NO: 1713990 - DNA, 21 bp, Homo sapiens
caagaataatcacgctttcct

SEQ ID NO: 1713991 - DNA, 17 bp, Homo sapiens
caagaatattgtatgtt

SEQ ID NO: 1713992 - DNA, 14 bp, Homo sapiens
caagaatcagaaga

SEQ ID NO: 1713993 - DNA, 15 bp, Homo sapiens
caagaatctagaaga

SEQ ID NO: 1713994 - DNA, 16 bp, Homo sapiens
caagaatctagaagat

SEQ ID NO: 1713995 - DNA, 19 bp, Homo sapiens
caagaatctagaagatgtg

SEQ ID NO: 1713996 - DNA, 18 bp, Homo sapiens
caagaatgcattccctga

SEQ ID NO: 1713997 - DNA, 19 bp, Homo sapiens
caagaatggaagcctgaac

SEQ ID NO: 1713998 - DNA, 14 bp, Homo sapiens
caagaatggatcac

SEQ ID NO: 1713999 - DNA, 22 bp, Homo sapiens
caagaatggatcacaagatgga

SEQ ID NO: 1714000 - DNA, 21 bp, Homo sapiens
caagaattggaagctgccctg

SEQ ID NO: 1714001 - DNA, 21 bp, Homo sapiens
caagaatttcctgttggattt

SEQ ID NO: 1714002 - DNA, 22 bp, Homo sapiens
caagaatttcttggtaagaagc

SEQ ID NO: 1714003 - DNA, 23 bp, Homo sapiens
caagaatttcttggtaagaagcc

SEQ ID NO: 1714004 - DNA, 15 bp, Homo sapiens
caagacacatcccta

SEQ ID NO: 1714005 - DNA, 14 bp, Homo sapiens
caagacagaaaagt

SEQ ID NO: 1714006 - DNA, 17 bp, Homo sapiens
caagacagaaaagtgcc

SEQ ID NO: 1714007 - DNA, 21 bp, Homo sapiens
caagacagagacgcaggaatg

SEQ ID NO: 1714008 - DNA, 21 bp, Homo sapiens
caagacagatgccccagagct

SEQ ID NO: 1714009 - DNA, 15 bp, Homo sapiens
caagacagattgtga

SEQ ID NO: 1714010 - DNA, 13 bp, Homo sapiens
caagacagccttc

SEQ ID NO: 1714011 - DNA, 14 bp, Homo sapiens
caagacagccttca

SEQ ID NO: 1714012 - DNA, 19 bp, Homo sapiens
caagaccaccacttcgaaa

SEQ ID NO: 1714013 - DNA, 18 bp, Homo sapiens
caagaccacggagggagc

SEQ ID NO: 1714014 - DNA, 22 bp, Homo sapiens
caagaccacggagggagcgaca

SEQ ID NO: 1714015 - DNA, 16 bp, Homo sapiens
caagaccagcctgtcc

SEQ ID NO: 1714016 - DNA, 17 bp, Homo sapiens
caagaccaggctgcagc

SEQ ID NO: 1714017 - DNA, 18 bp, Homo sapiens
caagaccaggctgcagcc

SEQ ID NO: 1714018 - DNA, 15 bp, Homo sapiens
caagacccccagcac

SEQ ID NO: 1714019 - DNA, 16 bp, Homo sapiens
caagacccccagcact

SEQ ID NO: 1714020 - DNA, 15 bp, Homo sapiens
caagacccctgtctt

SEQ ID NO: 1714021 - DNA, 16 bp, Homo sapiens
caagaccgccccaggg

SEQ ID NO: 1714022 - DNA, 20 bp, Homo sapiens
caagacctagtcccctttcc

SEQ ID NO: 1714023 - DNA, 17 bp, Homo sapiens
caagacctcagtgcctt

SEQ ID NO: 1714024 - DNA, 14 bp, Homo sapiens
caagacctcatctc

SEQ ID NO: 1714025 - DNA, 20 bp, Homo sapiens
caagacctcatctgtggagc

SEQ ID NO: 1714026 - DNA, 22 bp, Homo sapiens
caagacctcatctgtggagctg

SEQ ID NO: 1714027 - DNA, 14 bp, Homo sapiens
caagacctcttccc

SEQ ID NO: 1714028 - DNA, 19 bp, Homo sapiens
caagacctcttccctctgg

SEQ ID NO: 1714029 - DNA, 21 bp, Homo sapiens
caagacctcttccctctgggc

SEQ ID NO: 1714030 - DNA, 13 bp, Homo sapiens
caagacgaggggc

SEQ ID NO: 1714031 - DNA, 15 bp, Homo sapiens
caagacgaggggcag

SEQ ID NO: 1714032 - DNA, 15 bp, Homo sapiens
caagacggaggaggg

SEQ ID NO: 1714033 - DNA, 13 bp, Homo sapiens
caagacgtaaaga

SEQ ID NO: 1714034 - DNA, 14 bp, Homo sapiens
caagacgtaaagaa

SEQ ID NO: 1714035 - DNA, 12 bp, Homo sapiens
caagactgccag

SEQ ID NO: 1714036 - DNA, 13 bp, Homo sapiens
caagactgccagg

SEQ ID NO: 1714037 - DNA, 19 bp, Homo sapiens
caagactgtcattgcccct

SEQ ID NO: 1714038 - DNA, 16 bp, Homo sapiens
caagactgttagccct

SEQ ID NO: 1714039 - DNA, 17 bp, Homo sapiens
caagactgttgctcaaa

SEQ ID NO: 1714040 - DNA, 19 bp, Homo sapiens
caagagaaggggaagcact

SEQ ID NO: 1714041 - DNA, 23 bp, Homo sapiens
caagagaaggtggacctggcagt

SEQ ID NO: 1714042 - DNA, 13 bp, Homo sapiens
caagagagatgtt

SEQ ID NO: 1714043 - DNA, 15 bp, Homo sapiens
caagagagatgtttt

SEQ ID NO: 1714044 - DNA, 16 bp, Homo sapiens
caagagatctacacat

SEQ ID NO: 1714045 - DNA, 17 bp, Homo sapiens
caagagatctacacatg

SEQ ID NO: 1714046 - DNA, 19 bp, Homo sapiens
caagagatctgtgtggctc

SEQ ID NO: 1714047 - DNA, 20 bp, Homo sapiens
caagagatctgtgtggctcc

SEQ ID NO: 1714048 - DNA, 21 bp, Homo sapiens
caagagatctttctttccaaa

SEQ ID NO: 1714049 - DNA, 16 bp, Homo sapiens
caagagatgggatgct

SEQ ID NO: 1714050 - DNA, 14 bp, Homo sapiens
caagagcagcctgt

SEQ ID NO: 1714051 - DNA, 17 bp, Homo sapiens
caagagcagcctgtggc

SEQ ID NO: 1714052 - DNA, 18 bp, Homo sapiens
caagagcagcctgtggca

SEQ ID NO: 1714053 - DNA, 20 bp, Homo sapiens
caagagcagcctgtggcatc

SEQ ID NO: 1714054 - DNA, 17 bp, Homo sapiens
caagagcatgcacatgc

SEQ ID NO: 1714055 - DNA, 13 bp, Homo sapiens
caagagcccagca

SEQ ID NO: 1714056 - DNA, 12 bp, Homo sapiens
caagagccctgt

SEQ ID NO: 1714057 - DNA, 17 bp, Homo sapiens
caagagccctgtggccg

SEQ ID NO: 1714058 - DNA, 18 bp, Homo sapiens
caagagcgaaactccgtc

SEQ ID NO: 1714059 - DNA, 21 bp, Homo sapiens
caagagcgcaccattgcactc

SEQ ID NO: 1714060 - DNA, 14 bp, Homo sapiens
caagagctgctgtc

SEQ ID NO: 1714061 - DNA, 14 bp, Homo sapiens
caagagcttttaca

SEQ ID NO: 1714062 - DNA, 14 bp, Homo sapiens
caagaggaggacag

SEQ ID NO: 1714063 - DNA, 23 bp, Homo sapiens
caagaggcagagttctgtgaaga

SEQ ID NO: 1714064 - DNA, 14 bp, Homo sapiens
caagagggcactgg

SEQ ID NO: 1714065 - DNA, 17 bp, Homo sapiens
caagagggcactggtgg

SEQ ID NO: 1714066 - DNA, 18 bp, Homo sapiens
caagagggcactggtggc

SEQ ID NO: 1714067 - DNA, 14 bp, Homo sapiens
caagagggggtgga

SEQ ID NO: 1714068 - DNA, 16 bp, Homo sapiens
caagaggggtggagac

SEQ ID NO: 1714069 - DNA, 23 bp, Homo sapiens
caagaggggtggagactgcttcc

SEQ ID NO: 1714070 - DNA, 18 bp, Homo sapiens
caagagggttcacacagc

SEQ ID NO: 1714071 - DNA, 20 bp, Homo sapiens
caagaggtctgagccctggt

SEQ ID NO: 1714072 - DNA, 14 bp, Homo sapiens
caagaggtgaagtt

SEQ ID NO: 1714073 - DNA, 22 bp, Homo sapiens
caagagtgagactccacctcaa

SEQ ID NO: 1714074 - DNA, 18 bp, Homo sapiens
caagagtgattgcagctt

SEQ ID NO: 1714075 - DNA, 24 bp, Homo sapiens
caagagtttcttgtaagccatcag

SEQ ID NO: 1714076 - DNA, 14 bp, Homo sapiens
caagataaaagaat

SEQ ID NO: 1714077 - DNA, 17 bp, Homo sapiens
caagataaaagaatggc

SEQ ID NO: 1714078 - DNA, 15 bp, Homo sapiens
caagatacctttttt

SEQ ID NO: 1714079 - DNA, 17 bp, Homo sapiens
caagatagatttggaat

SEQ ID NO: 1714080 - DNA, 19 bp, Homo sapiens
caagatattgtacataaaa

SEQ ID NO: 1714081 - DNA, 16 bp, Homo sapiens
caagatatttatatat

SEQ ID NO: 1714082 - DNA, 22 bp, Homo sapiens
caagatcctgtctttaaggaaa

SEQ ID NO: 1714083 - DNA, 17 bp, Homo sapiens
caagatcgcaccactgc

SEQ ID NO: 1714084 - DNA, 14 bp, Homo sapiens
caagatgacagctc

SEQ ID NO: 1714085 - DNA, 15 bp, Homo sapiens
caagatgacagctct

SEQ ID NO: 1714086 - DNA, 19 bp, Homo sapiens
caagatgacagctcttcta

SEQ ID NO: 1714087 - DNA, 22 bp, Homo sapiens
caagatgctggatgtctgccaa

SEQ ID NO: 1714088 - DNA, 13 bp, Homo sapiens
caagatgcttggt

SEQ ID NO: 1714089 - DNA, 23 bp, Homo sapiens
caagatggcgccaccgcactcca

SEQ ID NO: 1714090 - DNA, 15 bp, Homo sapiens
caagatggctgctgc

SEQ ID NO: 1714091 - DNA, 21 bp, Homo sapiens
gctgagtgacacaagcacttt

SEQ ID NO: 1714092 - DNA, 15 bp, Homo sapiens
gctgagtggggagca

SEQ ID NO: 1714093 - DNA, 18 bp, Homo sapiens
caagatgggacagcaaca

SEQ ID NO: 1714094 - DNA, 16 bp, Homo sapiens
caagatgggcatcttt

SEQ ID NO: 1714095 - DNA, 17 bp, Homo sapiens
caagatgggcatctttt

SEQ ID NO: 1714096 - DNA, 20 bp, Homo sapiens
caagatgggggcagggctgt

SEQ ID NO: 1714097 - DNA, 14 bp, Homo sapiens
caagatggtccatt

SEQ ID NO: 1714098 - DNA, 15 bp, Homo sapiens
caagatgtcagactg

SEQ ID NO: 1714099 - DNA, 17 bp, Homo sapiens
caagatgtcagactggc

SEQ ID NO: 1714100 - DNA, 12 bp, Homo sapiens
caagatgtgaat

SEQ ID NO: 1714101 - DNA, 13 bp, Homo sapiens
caagatgtgaatt

SEQ ID NO: 1714102 - DNA, 18 bp, Homo sapiens
caagatgtgaattattga

SEQ ID NO: 1714103 - DNA, 19 bp, Homo sapiens
caagatgtgaattattgac

SEQ ID NO: 1714104 - DNA, 22 bp, Homo sapiens
caagatgtgaattattgacact

SEQ ID NO: 1714105 - DNA, 19 bp, Homo sapiens
caagatgttgatttttact

SEQ ID NO: 1714106 - DNA, 18 bp, Homo sapiens
caagatgttttgtataaa

SEQ ID NO: 1714107 - DNA, 19 bp, Homo sapiens
caagatgttttgtataaaa

SEQ ID NO: 1714108 - DNA, 21 bp, Homo sapiens
caagatgttttgtataaaatc

SEQ ID NO: 1714109 - DNA, 19 bp, Homo sapiens
caagattcacacctgactc

SEQ ID NO: 1714110 - DNA, 14 bp, Homo sapiens
caagattcccagag

SEQ ID NO: 1714111 - DNA, 17 bp, Homo sapiens
caagattcccagagaca

SEQ ID NO: 1714112 - DNA, 19 bp, Homo sapiens
caagattcccagagacagg

SEQ ID NO: 1714113 - DNA, 23 bp, Homo sapiens
caagattcccagagacaggaaaa

SEQ ID NO: 1714114 - DNA, 10 bp, Homo sapiens
caagattccg

SEQ ID NO: 1714115 - DNA, 22 bp, Homo sapiens
caagattccggatcctaagcat

SEQ ID NO: 1714116 - DNA, 12 bp, Homo sapiens
caagattctaga

SEQ ID NO: 1714117 - DNA, 19 bp, Homo sapiens
caagattgagctctctgcc

SEQ ID NO: 1714118 - DNA, 20 bp, Homo sapiens
caagattgagctctctgccc

SEQ ID NO: 1714119 - DNA, 23 bp, Homo sapiens
caagattgagctctctgcccttg

SEQ ID NO: 1714120 - DNA, 16 bp, Homo sapiens
caagatttaaatgcca

SEQ ID NO: 1714121 - DNA, 16 bp, Homo sapiens
caagatttagaaaaaa

SEQ ID NO: 1714122 - DNA, 18 bp, Homo sapiens
caagatttccctaaaaat

SEQ ID NO: 1714123 - DNA, 16 bp, Homo sapiens
caagatttccttgtgc

SEQ ID NO: 1714124 - DNA, 20 bp, Homo sapiens
caagattttagggcttttat

SEQ ID NO: 1714125 - DNA, 22 bp, Homo sapiens
caagattttgaatgcttcctga

SEQ ID NO: 1714126 - DNA, 16 bp, Homo sapiens
caagatttttttcctg

SEQ ID NO: 1714127 - DNA, 13 bp, Homo sapiens
caagcaacaagcc

SEQ ID NO: 1714128 - DNA, 18 bp, Homo sapiens
caagcaacattcttgtta

SEQ ID NO: 1714129 - DNA, 18 bp, Homo sapiens
caagcaagtcccttcaga

SEQ ID NO: 1714130 - DNA, 15 bp, Homo sapiens
caagcaagttctgag

SEQ ID NO: 1714131 - DNA, 18 bp, Homo sapiens
caagcacaaagctcaaga

SEQ ID NO: 1714132 - DNA, 20 bp, Homo sapiens
caagcacatctgcattttca

SEQ ID NO: 1714133 - DNA, 19 bp, Homo sapiens
caagcacctccaaccaaat

SEQ ID NO: 1714134 - DNA, 20 bp, Homo sapiens
caagcactatgcccttttat

SEQ ID NO: 1714135 - DNA, 22 bp, Homo sapiens
caagcactatgcccttttatat

SEQ ID NO: 1714136 - DNA, 20 bp, Homo sapiens
caagcactattttatattta

SEQ ID NO: 1714137 - DNA, 20 bp, Homo sapiens
caagcactcgagaccatcct

SEQ ID NO: 1714138 - DNA, 20 bp, Homo sapiens
caagcactgctcacgtctct

SEQ ID NO: 1714139 - DNA, 21 bp, Homo sapiens
caagcactgctcacgtctctg

SEQ ID NO: 1714140 - DNA, 23 bp, Homo sapiens
caagcactgctcacgtctctgcc

SEQ ID NO: 1714141 - DNA, 16 bp, Homo sapiens
caagcacttcccagga

SEQ ID NO: 1714142 - DNA, 21 bp, Homo sapiens
caagcactttaatggcctgga

SEQ ID NO: 1714143 - DNA, 11 bp, Homo sapiens
caagcagagga

SEQ ID NO: 1714144 - DNA, 14 bp, Homo sapiens
caagcagaggacca

SEQ ID NO: 1714145 - DNA, 18 bp, Homo sapiens
caagcagaggaccagggc

SEQ ID NO: 1714146 - DNA, 19 bp, Homo sapiens
caagcagaggaccagggcc

SEQ ID NO: 1714147 - DNA, 18 bp, Homo sapiens
caagcagagtgcacagct

SEQ ID NO: 1714148 - DNA, 19 bp, Homo sapiens
caagcagagtgcacagctg

SEQ ID NO: 1714149 - DNA, 17 bp, Homo sapiens
caagcagcatcttctgg

SEQ ID NO: 1714150 - DNA, 11 bp, Homo sapiens
caagcagccag

SEQ ID NO: 1714151 - DNA, 18 bp, Homo sapiens
caagcagccagccagtct

SEQ ID NO: 1714152 - DNA, 22 bp, Homo sapiens
caagcagcgaccgccccctcct

SEQ ID NO: 1714153 - DNA, 22 bp, Homo sapiens
caagcagctggtcagtctttgc

SEQ ID NO: 1714154 - DNA, 16 bp, Homo sapiens
caagcaggaattatgt

SEQ ID NO: 1714155 - DNA, 17 bp, Homo sapiens
caagcaggaattatgtc

SEQ ID NO: 1714156 - DNA, 21 bp, Homo sapiens
caagcagggaaagctccacgg

SEQ ID NO: 1714157 - DNA, 18 bp, Homo sapiens
caagcagtcgtgcctgtg

SEQ ID NO: 1714158 - DNA, 16 bp, Homo sapiens
caagcagtgcctgcct

SEQ ID NO: 1714159 - DNA, 17 bp, Homo sapiens
caagcatgcagctttgc

SEQ ID NO: 1714160 - DNA, 20 bp, Homo sapiens
caagcatgcttgtgaaaatg

SEQ ID NO: 1714161 - DNA, 17 bp, Homo sapiens
caagcattcaccaagtc

SEQ ID NO: 1714162 - DNA, 23 bp, Homo sapiens
caagcattgcttcagaatgaatt

SEQ ID NO: 1714163 - DNA, 21 bp, Homo sapiens
caagccaaacattcttatttt

SEQ ID NO: 1714164 - DNA, 20 bp, Homo sapiens
caagccaaagagcctcccac

SEQ ID NO: 1714165 - DNA, 18 bp, Homo sapiens
caagccaacttgtaaata

SEQ ID NO: 1714166 - DNA, 18 bp, Homo sapiens
caagccaagggaacctgt

SEQ ID NO: 1714167 - DNA, 22 bp, Homo sapiens
caagccaagggaacctgtgtcc

SEQ ID NO: 1714168 - DNA, 17 bp, Homo sapiens
caagccaatcccctcct

SEQ ID NO: 1714169 - DNA, 13 bp, Homo sapiens
caagccagaggct

SEQ ID NO: 1714170 - DNA, 15 bp, Homo sapiens
caagccagaggctgg

SEQ ID NO: 1714171 - DNA, 11 bp, Homo sapiens
caagccagagt

SEQ ID NO: 1714172 - DNA, 21 bp, Homo sapiens
caagccagagtttttaaagcc

SEQ ID NO: 1714173 - DNA, 22 bp, Homo sapiens
caagccagagtttttaaagcct

SEQ ID NO: 1714174 - DNA, 19 bp, Homo sapiens
caagccagattctcttgaa

SEQ ID NO: 1714175 - DNA, 12 bp, Homo sapiens
caagccagcccc

SEQ ID NO: 1714176 - DNA, 14 bp, Homo sapiens
caagccagccccct

SEQ ID NO: 1714177 - DNA, 14 bp, Homo sapiens
caagccagggtgtg

SEQ ID NO: 1714178 - DNA, 19 bp, Homo sapiens
caagccattcacttcccca

SEQ ID NO: 1714179 - DNA, 18 bp, Homo sapiens
caagcccaggcttcctgg

SEQ ID NO: 1714180 - DNA, 23 bp, Homo sapiens
caagcccaggcttcctgggtcct

SEQ ID NO: 1714181 - DNA, 13 bp, Homo sapiens
caagccccatctc

SEQ ID NO: 1714182 - DNA, 14 bp, Homo sapiens
caagccccatctca

SEQ ID NO: 1714183 - DNA, 14 bp, Homo sapiens
caagccccatttcc

SEQ ID NO: 1714184 - DNA, 11 bp, Homo sapiens
caagccctggc

SEQ ID NO: 1714185 - DNA, 12 bp, Homo sapiens
caagccctggca

SEQ ID NO: 1714186 - DNA, 13 bp, Homo sapiens
caagccctggcaa

SEQ ID NO: 1714187 - DNA, 16 bp, Homo sapiens
caagccgaccttccct

SEQ ID NO: 1714188 - DNA, 18 bp, Homo sapiens
caagccgcaagctctcag

SEQ ID NO: 1714189 - DNA, 19 bp, Homo sapiens
caagccgcaagctctcagc

SEQ ID NO: 1714190 - DNA, 16 bp, Homo sapiens
caagccgtggcttccc

SEQ ID NO: 1714191 - DNA, 18 bp, Homo sapiens
caagccgtggcttcccgc

SEQ ID NO: 1714192 - DNA, 22 bp, Homo sapiens
caagcctcatgccaaccctggg

SEQ ID NO: 1714193 - DNA, 14 bp, Homo sapiens
caagcctccacagc

SEQ ID NO: 1714194 - DNA, 17 bp, Homo sapiens
caagcctccacagcgag

SEQ ID NO: 1714195 - DNA, 14 bp, Homo sapiens
caagcctcttctga

SEQ ID NO: 1714196 - DNA, 14 bp, Homo sapiens
caagcctgctggct

SEQ ID NO: 1714197 - DNA, 20 bp, Homo sapiens
caagcctgctggctgcggcc

SEQ ID NO: 1714198 - DNA, 21 bp, Homo sapiens
caagcctgtaatcccagctac

SEQ ID NO: 1714199 - DNA, 16 bp, Homo sapiens
caagcgattctcctgt

SEQ ID NO: 1714200 - DNA, 12 bp, Homo sapiens
caagcgctcatg

SEQ ID NO: 1714201 - DNA, 16 bp, Homo sapiens
caagctaggccccaga

SEQ ID NO: 1714202 - DNA, 17 bp, Homo sapiens
caagctaggccccagag

SEQ ID NO: 1714203 - DNA, 22 bp, Homo sapiens
caagctaggccccagaggccct

SEQ ID NO: 1714204 - DNA, 23 bp, Homo sapiens
caagctaggccccagaggccctg

SEQ ID NO: 1714205 - DNA, 13 bp, Homo sapiens
caagctatttaat

SEQ ID NO: 1714206 - DNA, 19 bp, Homo sapiens
caagctcacagttcctcgc

SEQ ID NO: 1714207 - DNA, 16 bp, Homo sapiens
gctgctttcccctgtg

SEQ ID NO: 1714208 - DNA, 21 bp, Homo sapiens
gctgctttcccctgtggggat

SEQ ID NO: 1714209 - DNA, 11 bp, Homo sapiens
gctgcttttct

SEQ ID NO: 1714210 - DNA, 22 bp, Homo sapiens
caagctcagcacaatctgtaaa

SEQ ID NO: 1714211 - DNA, 20 bp, Homo sapiens
caagctccgcctcccgggtt

SEQ ID NO: 1714212 - DNA, 13 bp, Homo sapiens
caagctctctgca

SEQ ID NO: 1714213 - DNA, 13 bp, Homo sapiens
caagctgaaattt

SEQ ID NO: 1714214 - DNA, 14 bp, Homo sapiens
caagctgaaatttt

SEQ ID NO: 1714215 - DNA, 17 bp, Homo sapiens
caagctgacttggcact

SEQ ID NO: 1714216 - DNA, 22 bp, Homo sapiens
caagctgagtttcctatgggaa

SEQ ID NO: 1714217 - DNA, 15 bp, Homo sapiens
caagctgcactgaca

SEQ ID NO: 1714218 - DNA, 14 bp, Homo sapiens
caagctgcctctgg

SEQ ID NO: 1714219 - DNA, 17 bp, Homo sapiens
caagctgcctctgggcc

SEQ ID NO: 1714220 - DNA, 18 bp, Homo sapiens
caagctgctctgagccac

SEQ ID NO: 1714221 - DNA, 22 bp, Homo sapiens
caagctgctctgagccacagtg

SEQ ID NO: 1714222 - DNA, 21 bp, Homo sapiens
caagctggccactatcacata

SEQ ID NO: 1714223 - DNA, 19 bp, Homo sapiens
caagctgtcccctctgtca

SEQ ID NO: 1714224 - DNA, 12 bp, Homo sapiens
caagctgtgcag

SEQ ID NO: 1714225 - DNA, 21 bp, Homo sapiens
caagctgttatttcttccctg

SEQ ID NO: 1714226 - DNA, 22 bp, Homo sapiens
caagctgttatttcttccctgc

SEQ ID NO: 1714227 - DNA, 23 bp, Homo sapiens
caagctgttatttcttccctgct

SEQ ID NO: 1714228 - DNA, 17 bp, Homo sapiens
caagcttcaaccctcag

SEQ ID NO: 1714229 - DNA, 21 bp, Homo sapiens
caagcttcagagcctagccac

SEQ ID NO: 1714230 - DNA, 17 bp, Homo sapiens
caagcttgtccaacccg

SEQ ID NO: 1714231 - DNA, 13 bp, Homo sapiens
caagctttaaatt

SEQ ID NO: 1714232 - DNA, 14 bp, Homo sapiens
caagcttttgctca

SEQ ID NO: 1714233 - DNA, 15 bp, Homo sapiens
caaggaaaaggagga

SEQ ID NO: 1714234 - DNA, 16 bp, Homo sapiens
caaggaaaaggaggag

SEQ ID NO: 1714235 - DNA, 22 bp, Homo sapiens
caaggaaaatctatatttgtct

SEQ ID NO: 1714236 - DNA, 19 bp, Homo sapiens
caaggaaaggctcatttaa

SEQ ID NO: 1714237 - DNA, 23 bp, Homo sapiens
caaggaaaggctcatttaaaaca

SEQ ID NO: 1714238 - DNA, 15 bp, Homo sapiens
caaggaaataaagcg

SEQ ID NO: 1714239 - DNA, 13 bp, Homo sapiens
caaggaacagcca

SEQ ID NO: 1714240 - DNA, 16 bp, Homo sapiens
caaggaacagccacaa

SEQ ID NO: 1714241 - DNA, 17 bp, Homo sapiens
caaggaagaagaaatct

SEQ ID NO: 1714242 - DNA, 12 bp, Homo sapiens
caaggaaggaaa

SEQ ID NO: 1714243 - DNA, 13 bp, Homo sapiens
caaggaaggaaag

SEQ ID NO: 1714244 - DNA, 16 bp, Homo sapiens
caaggaaggaaagaaa

SEQ ID NO: 1714245 - DNA, 18 bp, Homo sapiens
caaggaaggaaagaaaga

SEQ ID NO: 1714246 - DNA, 23 bp, Homo sapiens
caaggaaggaaagaaagaaggaa

SEQ ID NO: 1714247 - DNA, 22 bp, Homo sapiens
caaggaagttttaactttaata

SEQ ID NO: 1714248 - DNA, 17 bp, Homo sapiens
caaggaatgcctgtgcc

SEQ ID NO: 1714249 - DNA, 18 bp, Homo sapiens
caaggaatgcctgtgcca

SEQ ID NO: 1714250 - DNA, 19 bp, Homo sapiens
caaggaatgcctgtgccaa

SEQ ID NO: 1714251 - DNA, 13 bp, Homo sapiens
caaggaatttaaa

SEQ ID NO: 1714252 - DNA, 18 bp, Homo sapiens
caaggaatttaaaactgt

SEQ ID NO: 1714253 - DNA, 11 bp, Homo sapiens
caaggacaaag

SEQ ID NO: 1714254 - DNA, 19 bp, Homo sapiens
caaggacaaagtctccagc

SEQ ID NO: 1714255 - DNA, 22 bp, Homo sapiens
caaggacaaagtctccagccca

SEQ ID NO: 1714256 - DNA, 23 bp, Homo sapiens
caaggacaaagtctccagcccac

SEQ ID NO: 1714257 - DNA, 21 bp, Homo sapiens
caaggacagggctggctcctc

SEQ ID NO: 1714258 - DNA, 13 bp, Homo sapiens
caaggaccaggac

SEQ ID NO: 1714259 - DNA, 16 bp, Homo sapiens
caaggaccaggactcc

SEQ ID NO: 1714260 - DNA, 17 bp, Homo sapiens
caaggacgctggctact

SEQ ID NO: 1714261 - DNA, 18 bp, Homo sapiens
caaggacgctggctactg

SEQ ID NO: 1714262 - DNA, 21 bp, Homo sapiens
caaggacgctggctactgtct

SEQ ID NO: 1714263 - DNA, 15 bp, Homo sapiens
caaggactaaggcct

SEQ ID NO: 1714264 - DNA, 12 bp, Homo sapiens
caaggactgagc

SEQ ID NO: 1714265 - DNA, 14 bp, Homo sapiens
caaggactgagggc

SEQ ID NO: 1714266 - DNA, 14 bp, Homo sapiens
caaggagaaacaga

SEQ ID NO: 1714267 - DNA, 16 bp, Homo sapiens
caaggagaaacagaga

SEQ ID NO: 1714268 - DNA, 20 bp, Homo sapiens
caaggagaaacagagacagg

SEQ ID NO: 1714269 - DNA, 21 bp, Homo sapiens
caaggagaatatgataaaaca

SEQ ID NO: 1714270 - DNA, 17 bp, Homo sapiens
caaggagctcaccctgc

SEQ ID NO: 1714271 - DNA, 21 bp, Homo sapiens
caaggagctcaccctgcccgc

SEQ ID NO: 1714272 - DNA, 22 bp, Homo sapiens
caaggagctcaccctgcccgct

SEQ ID NO: 1714273 - DNA, 19 bp, Homo sapiens
caaggagctgatttccagg

SEQ ID NO: 1714274 - DNA, 15 bp, Homo sapiens
caaggagcttaccca

SEQ ID NO: 1714275 - DNA, 20 bp, Homo sapiens
caaggaggaaaaacagacaa

SEQ ID NO: 1714276 - DNA, 24 bp, Homo sapiens
caaggagtttgagaccagcttagc

SEQ ID NO: 1714277 - DNA, 15 bp, Homo sapiens
caaggatagatgctg

SEQ ID NO: 1714278 - DNA, 17 bp, Homo sapiens
caaggatagatgctggc

SEQ ID NO: 1714279 - DNA, 18 bp, Homo sapiens
caaggatgtccaatcttt

SEQ ID NO: 1714280 - DNA, 16 bp, Homo sapiens
caaggcaaggcaggtg

SEQ ID NO: 1714281 - DNA, 18 bp, Homo sapiens
caaggcaaggcaggtgcc

SEQ ID NO: 1714282 - DNA, 16 bp, Homo sapiens
caaggcactctagatt

SEQ ID NO: 1714283 - DNA, 21 bp, Homo sapiens
caaggcacttttaaacgtgga

SEQ ID NO: 1714284 - DNA, 20 bp, Homo sapiens
caaggcagaggcctgggctg

SEQ ID NO: 1714285 - DNA, 12 bp, Homo sapiens
caaggcagcctc

SEQ ID NO: 1714286 - DNA, 17 bp, Homo sapiens
caaggcagcctccagag

SEQ ID NO: 1714287 - DNA, 20 bp, Homo sapiens
caaggcagcctccagagcca

SEQ ID NO: 1714288 - DNA, 15 bp, Homo sapiens
caaggcagcgggatc

SEQ ID NO: 1714289 - DNA, 13 bp, Homo sapiens
caaggcagggacc

SEQ ID NO: 1714290 - DNA, 16 bp, Homo sapiens
caaggcaggtgcctcc

SEQ ID NO: 1714291 - DNA, 17 bp, Homo sapiens
caaggcaggtgcctcca

SEQ ID NO: 1714292 - DNA, 18 bp, Homo sapiens
caaggcaggtgcctccag

SEQ ID NO: 1714293 - DNA, 17 bp, Homo sapiens
caaggccacctctgcct

SEQ ID NO: 1714294 - DNA, 18 bp, Homo sapiens
caaggccacctctgcctc

SEQ ID NO: 1714295 - DNA, 19 bp, Homo sapiens
caaggccacctctgcctct

SEQ ID NO: 1714296 - DNA, 19 bp, Homo sapiens
caaggccagagtggcctgg

SEQ ID NO: 1714297 - DNA, 12 bp, Homo sapiens
caaggcccagga

SEQ ID NO: 1714298 - DNA, 20 bp, Homo sapiens
caaggccgaagctctggctg

SEQ ID NO: 1714299 - DNA, 19 bp, Homo sapiens
caaggccgctgttcaccca

SEQ ID NO: 1714300 - DNA, 17 bp, Homo sapiens
caaggcctctctctgcc

SEQ ID NO: 1714301 - DNA, 21 bp, Homo sapiens
caaggcctggtgtttcttgat

SEQ ID NO: 1714302 - DNA, 22 bp, Homo sapiens
caaggcctggtgtttcttgata

SEQ ID NO: 1714303 - DNA, 13 bp, Homo sapiens
caaggcctgtgct

SEQ ID NO: 1714304 - DNA, 17 bp, Homo sapiens
caaggcctgtgctgcat

SEQ ID NO: 1714305 - DNA, 18 bp, Homo sapiens
caaggccttgcctggcct

SEQ ID NO: 1714306 - DNA, 23 bp, Homo sapiens
caaggccttggtggagcagccag

SEQ ID NO: 1714307 - DNA, 15 bp, Homo sapiens
caaggctgctgccgg

SEQ ID NO: 1714308 - DNA, 13 bp, Homo sapiens
caaggcttattta

SEQ ID NO: 1714309 - DNA, 20 bp, Homo sapiens
caagggaaaaatttttatgt

SEQ ID NO: 1714310 - DNA, 18 bp, Homo sapiens
caagggaaaggcaagctt

SEQ ID NO: 1714311 - DNA, 16 bp, Homo sapiens
caagggaacctgtgtc

SEQ ID NO: 1714312 - DNA, 20 bp, Homo sapiens
caagggaagaaacactctta

SEQ ID NO: 1714313 - DNA, 22 bp, Homo sapiens
caagggacagcaagtgagcaga

SEQ ID NO: 1714314 - DNA, 21 bp, Homo sapiens
caagggacaggagaagagagg

SEQ ID NO: 1714315 - DNA, 13 bp, Homo sapiens
caagggacctgct

SEQ ID NO: 1714316 - DNA, 15 bp, Homo sapiens
caagggacctgctca

SEQ ID NO: 1714317 - DNA, 22 bp, Homo sapiens
caagggactagtgagtcagcac

SEQ ID NO: 1714318 - DNA, 19 bp, Homo sapiens
caagggagaaaagagaaac

SEQ ID NO: 1714319 - DNA, 21 bp, Homo sapiens
caagggagaagacaacagaaa

SEQ ID NO: 1714320 - DNA, 14 bp, Homo sapiens
caagggaggcagtg

SEQ ID NO: 1714321 - DNA, 18 bp, Homo sapiens
gctgggcccagcaggggc

SEQ ID NO: 1714322 - DNA, 21 bp, Homo sapiens
gctgggccccatgctctgccc

SEQ ID NO: 1714323 - DNA, 23 bp, Homo sapiens
gctgggccccatgctctgcccca

SEQ ID NO: 1714324 - DNA, 20 bp, Homo sapiens
gctgggcccctgcacaggca

SEQ ID NO: 1714325 - DNA, 22 bp, Homo sapiens
gctgggcccgacatggctccgg

SEQ ID NO: 1714326 - DNA, 15 bp, Homo sapiens
gctgggccctctctt

SEQ ID NO: 1714327 - DNA, 18 bp, Homo sapiens
gctgtatttgttcagtga

SEQ ID NO: 1714328 - DNA, 17 bp, Homo sapiens
gctgtattttaacactt

SEQ ID NO: 1714329 - DNA, 17 bp, Homo sapiens
gctgtcacaaccaagaa

SEQ ID NO: 1714330 - DNA, 20 bp, Homo sapiens
gctgtcataaaatgaaactt

SEQ ID NO: 1714331 - DNA, 22 bp, Homo sapiens
gctgtcatggtcctttctggaa

SEQ ID NO: 1714332 - DNA, 21 bp, Homo sapiens
gctgtcattgcacataagctt

SEQ ID NO: 1714333 - DNA, 19 bp, Homo sapiens
gctgtccacatgacctcca

SEQ ID NO: 1714334 - DNA, 20 bp, Homo sapiens
gctgtccacatgacctccat

SEQ ID NO: 1714335 - DNA, 12 bp, Homo sapiens
gctgtccaggca

SEQ ID NO: 1714336 - DNA, 14 bp, Homo sapiens
gctgtccaggcagc

SEQ ID NO: 1714337 - DNA, 23 bp, Homo sapiens
caagggcacattgcccatggctg

SEQ ID NO: 1714338 - DNA, 18 bp, Homo sapiens
caagggcatcaggcactg

SEQ ID NO: 1714339 - DNA, 20 bp, Homo sapiens
caagggcatcaggcactggt

SEQ ID NO: 1714340 - DNA, 12 bp, Homo sapiens
caagggcccaga

SEQ ID NO: 1714341 - DNA, 19 bp, Homo sapiens
caagggcccagaccctggg

SEQ ID NO: 1714342 - DNA, 20 bp, Homo sapiens
caagggcccagaccctgggc

SEQ ID NO: 1714343 - DNA, 21 bp, Homo sapiens
caagggcccagaccctgggca

SEQ ID NO: 1714344 - DNA, 14 bp, Homo sapiens
caagggcccagagt

SEQ ID NO: 1714345 - DNA, 12 bp, Homo sapiens
caagggccctgg

SEQ ID NO: 1714346 - DNA, 13 bp, Homo sapiens
caagggccctggc

SEQ ID NO: 1714347 - DNA, 15 bp, Homo sapiens
caagggccctggcac

SEQ ID NO: 1714348 - DNA, 14 bp, Homo sapiens
caagggctgcaatg

SEQ ID NO: 1714349 - DNA, 13 bp, Homo sapiens
caagggctggcac

SEQ ID NO: 1714350 - DNA, 14 bp, Homo sapiens
caagggctgtaggt

SEQ ID NO: 1714351 - DNA, 20 bp, Homo sapiens
caagggcttctgcaccctcc

SEQ ID NO: 1714352 - DNA, 23 bp, Homo sapiens
caagggcttctgcaccctccacc

SEQ ID NO: 1714353 - DNA, 18 bp, Homo sapiens
caaggggaatcagaactc

SEQ ID NO: 1714354 - DNA, 17 bp, Homo sapiens
caaggggcccaaattct

SEQ ID NO: 1714355 - DNA, 17 bp, Homo sapiens
caagggggtgactggaa

SEQ ID NO: 1714356 - DNA, 17 bp, Homo sapiens
caaggggtggccgggca

SEQ ID NO: 1714357 - DNA, 19 bp, Homo sapiens
caagggtatctgctgcctc

SEQ ID NO: 1714358 - DNA, 21 bp, Homo sapiens
caagggtgatgggaaagcatt

SEQ ID NO: 1714359 - DNA, 17 bp, Homo sapiens
caagggttaaggcctga

SEQ ID NO: 1714360 - DNA, 15 bp, Homo sapiens
caagggttctttcct

SEQ ID NO: 1714361 - DNA, 16 bp, Homo sapiens
caaggtacaaaatctt

SEQ ID NO: 1714362 - DNA, 14 bp, Homo sapiens
caaggtactctggt

SEQ ID NO: 1714363 - DNA, 9 bp, Homo sapiens
caaggtata

SEQ ID NO: 1714364 - DNA, 16 bp, Homo sapiens
caaggtcggtaagttg

SEQ ID NO: 1714365 - DNA, 19 bp, Homo sapiens
caaggtgagaattaagttt

SEQ ID NO: 1714366 - DNA, 15 bp, Homo sapiens
caaggtgatttcaga

SEQ ID NO: 1714367 - DNA, 21 bp, Homo sapiens
caaggtgatttcagactgcag

SEQ ID NO: 1714368 - DNA, 15 bp, Homo sapiens
caaggtgcaaatcaa

SEQ ID NO: 1714369 - DNA, 20 bp, Homo sapiens
caaggtgccaccaccctgcc

SEQ ID NO: 1714370 - DNA, 21 bp, Homo sapiens
caaggtgccaccaccctgccc

SEQ ID NO: 1714371 - DNA, 15 bp, Homo sapiens
caaggtgctgatgtc

SEQ ID NO: 1714372 - DNA, 19 bp, Homo sapiens
caaggtgggctgagccctg

SEQ ID NO: 1714373 - DNA, 24 bp, Homo sapiens
caaggtgggctgagccctggcagg

SEQ ID NO: 1714374 - DNA, 23 bp, Homo sapiens
caaggtgggtgattcctcccagg

SEQ ID NO: 1714375 - DNA, 24 bp, Homo sapiens
caaggtgggtgattcctcccagga

SEQ ID NO: 1714376 - DNA, 17 bp, Homo sapiens
caaggtgtccagggtcc

SEQ ID NO: 1714377 - DNA, 18 bp, Homo sapiens
caaggtgtccagggtcct

SEQ ID NO: 1714378 - DNA, 13 bp, Homo sapiens
caaggtgtccctg

SEQ ID NO: 1714379 - DNA, 12 bp, Homo sapiens
caaggtgtcttt

SEQ ID NO: 1714380 - DNA, 16 bp, Homo sapiens
caaggttactgggagt

SEQ ID NO: 1714381 - DNA, 22 bp, Homo sapiens
caaggttataattttttttaaa

SEQ ID NO: 1714382 - DNA, 21 bp, Homo sapiens
caaggttggagcccagggcat

SEQ ID NO: 1714383 - DNA, 18 bp, Homo sapiens
caaggtttacactgcgga

SEQ ID NO: 1714384 - DNA, 16 bp, Homo sapiens
caaggtttgagtccct

SEQ ID NO: 1714385 - DNA, 21 bp, Homo sapiens
caaggttttaggttctaaagt

SEQ ID NO: 1714386 - DNA, 17 bp, Homo sapiens
caaggttttggagtcag

SEQ ID NO: 1714387 - DNA, 21 bp, Homo sapiens
caagtaaatagtttgaattca

SEQ ID NO: 1714388 - DNA, 15 bp, Homo sapiens
caagtaacacatttg

SEQ ID NO: 1714389 - DNA, 13 bp, Homo sapiens
caagtaagaagac

SEQ ID NO: 1714390 - DNA, 14 bp, Homo sapiens
caagtaagaagaca

SEQ ID NO: 1714391 - DNA, 16 bp, Homo sapiens
caagtaagaagacatg

SEQ ID NO: 1714392 - DNA, 11 bp, Homo sapiens
caagtaattgt

SEQ ID NO: 1714393 - DNA, 20 bp, Homo sapiens
caagtacatggctagctttt

SEQ ID NO: 1714394 - DNA, 20 bp, Homo sapiens
caagtaccaccaagggatct

SEQ ID NO: 1714395 - DNA, 13 bp, Homo sapiens
caagtactgctgt

SEQ ID NO: 1714396 - DNA, 14 bp, Homo sapiens
caagtactgctgta

SEQ ID NO: 1714397 - DNA, 17 bp, Homo sapiens
caagtactgttttgaag

SEQ ID NO: 1714398 - DNA, 15 bp, Homo sapiens
caagtagaaaagcag

SEQ ID NO: 1714399 - DNA, 17 bp, Homo sapiens
caagtagactactgttc

SEQ ID NO: 1714400 - DNA, 20 bp, Homo sapiens
caagtataaaaaattctcat

SEQ ID NO: 1714401 - DNA, 12 bp, Homo sapiens
caagtatgcctt

SEQ ID NO: 1714402 - DNA, 14 bp, Homo sapiens
caagtatgccttaa

SEQ ID NO: 1714403 - DNA, 18 bp, Homo sapiens
caagtatgccttaagcag

SEQ ID NO: 1714404 - DNA, 23 bp, Homo sapiens
caagtatgccttaagcagaacaa

SEQ ID NO: 1714405 - DNA, 22 bp, Homo sapiens
caagtatggtaggggagggcag

SEQ ID NO: 1714406 - DNA, 22 bp, Homo sapiens
caagtatgtgggcagattttca

SEQ ID NO: 1714407 - DNA, 12 bp, Homo sapiens
caagtattataa

SEQ ID NO: 1714408 - DNA, 19 bp, Homo sapiens
caagtcaaccaatgtagaa

SEQ ID NO: 1714409 - DNA, 12 bp, Homo sapiens
caagtcacagct

SEQ ID NO: 1714410 - DNA, 14 bp, Homo sapiens
caagtcacagctgc

SEQ ID NO: 1714411 - DNA, 16 bp, Homo sapiens
caagtcagctccagct

SEQ ID NO: 1714412 - DNA, 20 bp, Homo sapiens
caagtcatggagaatctgct

SEQ ID NO: 1714413 - DNA, 12 bp, Homo sapiens
caagtcatttta

SEQ ID NO: 1714414 - DNA, 20 bp, Homo sapiens
caagtcatttttgtattttt

SEQ ID NO: 1714415 - DNA, 14 bp, Homo sapiens
caagtccaagcata

SEQ ID NO: 1714416 - DNA, 13 bp, Homo sapiens
caagtcccaccct

SEQ ID NO: 1714417 - DNA, 19 bp, Homo sapiens
caagtccctgttttctgag

SEQ ID NO: 1714418 - DNA, 19 bp, Homo sapiens
caagtccgcagaagccctg

SEQ ID NO: 1714419 - DNA, 19 bp, Homo sapiens
caagtcctagctcctcctc

SEQ ID NO: 1714420 - DNA, 19 bp, Homo sapiens
caagtcctggatgttgtgt

SEQ ID NO: 1714421 - DNA, 15 bp, Homo sapiens
caagtctcagaagag

SEQ ID NO: 1714422 - DNA, 18 bp, Homo sapiens
caagtctctgctggccca

SEQ ID NO: 1714423 - DNA, 13 bp, Homo sapiens
caagtctgcagcc

SEQ ID NO: 1714424 - DNA, 18 bp, Homo sapiens
caagtctttccagaggag

SEQ ID NO: 1714425 - DNA, 12 bp, Homo sapiens
caagtgaagaat

SEQ ID NO: 1714426 - DNA, 17 bp, Homo sapiens
caagtgatatcacctct

SEQ ID NO: 1714427 - DNA, 16 bp, Homo sapiens
caagtgattctcctgc

SEQ ID NO: 1714428 - DNA, 14 bp, Homo sapiens
caagtgcaatagat

SEQ ID NO: 1714429 - DNA, 16 bp, Homo sapiens
caagtgcaatagatta

SEQ ID NO: 1714430 - DNA, 20 bp, Homo sapiens
caagtgcacggggcacagcg

SEQ ID NO: 1714431 - DNA, 20 bp, Homo sapiens
caagtgcactttctaatgtt

SEQ ID NO: 1714432 - DNA, 19 bp, Homo sapiens
caagtgcatgctctctgca

SEQ ID NO: 1714433 - DNA, 12 bp, Homo sapiens
caagtgccaaac

SEQ ID NO: 1714434 - DNA, 18 bp, Homo sapiens
caagtgccaaacagagta

SEQ ID NO: 1714435 - DNA, 16 bp, Homo sapiens
caagtgccagaggtgg

SEQ ID NO: 1714436 - DNA, 17 bp, Homo sapiens
caagtgccagaggtggg

SEQ ID NO: 1714437 - DNA, 12 bp, Homo sapiens
caagtgcccagt

SEQ ID NO: 1714438 - DNA, 12 bp, Homo sapiens
caagtgcctaga

SEQ ID NO: 1714439 - DNA, 17 bp, Homo sapiens
caagtgcctagactgtt

SEQ ID NO: 1714440 - DNA, 12 bp, Homo sapiens
caagtgcctcac

SEQ ID NO: 1714441 - DNA, 14 bp, Homo sapiens
caagtgcctcacct

SEQ ID NO: 1714442 - DNA, 12 bp, Homo sapiens
gctgtttctcat

SEQ ID NO: 1714443 - DNA, 13 bp, Homo sapiens
gctgtttctcatg

SEQ ID NO: 1714444 - DNA, 15 bp, Homo sapiens
gctgtttctcatgaa

SEQ ID NO: 1714445 - DNA, 21 bp, Homo sapiens
gctgttttgattcccgggctt

SEQ ID NO: 1714446 - DNA, 13 bp, Homo sapiens
gctgttttgtgga

SEQ ID NO: 1714447 - DNA, 14 bp, Homo sapiens
gctgtttttgttgt

SEQ ID NO: 1714448 - DNA, 15 bp, Homo sapiens
gctgtttttgttgtg

SEQ ID NO: 1714449 - DNA, 13 bp, Homo sapiens
gcttaaaacactt

SEQ ID NO: 1714450 - DNA, 15 bp, Homo sapiens
gcttaaaagaaacta

SEQ ID NO: 1714451 - DNA, 16 bp, Homo sapiens
gcttaaaagaaactat

SEQ ID NO: 1714452 - DNA, 13 bp, Homo sapiens
gcttaaaagacat

SEQ ID NO: 1714453 - DNA, 15 bp, Homo sapiens
gcttaaactggaaag

SEQ ID NO: 1714454 - DNA, 21 bp, Homo sapiens
gcttaaagcatcctcctcctg

SEQ ID NO: 1714455 - DNA, 22 bp, Homo sapiens
gcttaaattgcttttgttgtga

SEQ ID NO: 1714456 - DNA, 15 bp, Homo sapiens
gcttaaatttcttat

SEQ ID NO: 1714457 - DNA, 20 bp, Homo sapiens
gcttaagaaatctagtattt

SEQ ID NO: 1714458 - DNA, 20 bp, Homo sapiens
caagtgttggtcagtagttt

SEQ ID NO: 1714459 - DNA, 16 bp, Homo sapiens
caagttagaaaacata

SEQ ID NO: 1714460 - DNA, 19 bp, Homo sapiens
caagttagctcaggaggct

SEQ ID NO: 1714461 - DNA, 16 bp, Homo sapiens
caagttagggtctatg

SEQ ID NO: 1714462 - DNA, 17 bp, Homo sapiens
caagttctaagattcta

SEQ ID NO: 1714463 - DNA, 15 bp, Homo sapiens
caagttgctaataca

SEQ ID NO: 1714464 - DNA, 12 bp, Homo sapiens
caagttgtaaat

SEQ ID NO: 1714465 - DNA, 15 bp, Homo sapiens
caagttgtaaataat

SEQ ID NO: 1714466 - DNA, 12 bp, Homo sapiens
caagttgtgctt

SEQ ID NO: 1714467 - DNA, 22 bp, Homo sapiens
caagttgttaaaacatttaata

SEQ ID NO: 1714468 - DNA, 18 bp, Homo sapiens
caagttgttgactgtgat

SEQ ID NO: 1714469 - DNA, 15 bp, Homo sapiens
caagtttatatatat

SEQ ID NO: 1714470 - DNA, 23 bp, Homo sapiens
caagtttctagctagaaatatga

SEQ ID NO: 1714471 - DNA, 16 bp, Homo sapiens
caagttttccctgaag

SEQ ID NO: 1714472 - DNA, 12 bp, Homo sapiens
caagttttgtat

SEQ ID NO: 1714473 - DNA, 13 bp, Homo sapiens
caagttttgtata

SEQ ID NO: 1714474 - DNA, 19 bp, Homo sapiens
caataaaaacaactttcac

SEQ ID NO: 1714475 - DNA, 20 bp, Homo sapiens
caataaaaatgtttaacggt

SEQ ID NO: 1714476 - DNA, 18 bp, Homo sapiens
caataaaagtgactctca

SEQ ID NO: 1714477 - DNA, 21 bp, Homo sapiens
caataaaatgtgatttttctg

SEQ ID NO: 1714478 - DNA, 15 bp, Homo sapiens
caataaacagctccc

SEQ ID NO: 1714479 - DNA, 16 bp, Homo sapiens
caataaacaggaattt

SEQ ID NO: 1714480 - DNA, 17 bp, Homo sapiens
caataaacaggaatttt

SEQ ID NO: 1714481 - DNA, 19 bp, Homo sapiens
caataaacaggaattttat

SEQ ID NO: 1714482 - DNA, 17 bp, Homo sapiens
caataaacctcttttct

SEQ ID NO: 1714483 - DNA, 18 bp, Homo sapiens
caataaacttagaggaaa

SEQ ID NO: 1714484 - DNA, 13 bp, Homo sapiens
caataaagctttt

SEQ ID NO: 1714485 - DNA, 14 bp, Homo sapiens
caataaagcttttg

SEQ ID NO: 1714486 - DNA, 14 bp, Homo sapiens
caataaaggcagct

SEQ ID NO: 1714487 - DNA, 16 bp, Homo sapiens
caataaaggcagctgc

SEQ ID NO: 1714488 - DNA, 22 bp, Homo sapiens
caataaaggcagctgcctctgc

SEQ ID NO: 1714489 - DNA, 24 bp, Homo sapiens
caataaaggcagctgcctctgctc

SEQ ID NO: 1714490 - DNA, 13 bp, Homo sapiens
caataaagggaga

SEQ ID NO: 1714491 - DNA, 22 bp, Homo sapiens
caataaagggagaatggtgctg

SEQ ID NO: 1714492 - DNA, 14 bp, Homo sapiens
caataaagtgaccc

SEQ ID NO: 1714493 - DNA, 18 bp, Homo sapiens
caataaatctgacccagt

SEQ ID NO: 1714494 - DNA, 11 bp, Homo sapiens
caataaatgaa

SEQ ID NO: 1714495 - DNA, 14 bp, Homo sapiens
caataaatgtattc

SEQ ID NO: 1714496 - DNA, 15 bp, Homo sapiens
caataaatgtattca

SEQ ID NO: 1714497 - DNA, 14 bp, Homo sapiens
caataaatgtctgt

SEQ ID NO: 1714498 - DNA, 22 bp, Homo sapiens
caataaatgtttgttatttaca

SEQ ID NO: 1714499 - DNA, 17 bp, Homo sapiens
caataaattattagaga

SEQ ID NO: 1714500 - DNA, 15 bp, Homo sapiens
caataacactgtatt

SEQ ID NO: 1714501 - DNA, 13 bp, Homo sapiens
caataacactgtc

SEQ ID NO: 1714502 - DNA, 21 bp, Homo sapiens
caataaccgcttggtttgcaa

SEQ ID NO: 1714503 - DNA, 21 bp, Homo sapiens
caataactagtaataccaaag

SEQ ID NO: 1714504 - DNA, 14 bp, Homo sapiens
caataactctggga

SEQ ID NO: 1714505 - DNA, 17 bp, Homo sapiens
caataactctgggaggg

SEQ ID NO: 1714506 - DNA, 18 bp, Homo sapiens
caataacttctatatttt

SEQ ID NO: 1714507 - DNA, 21 bp, Homo sapiens
caataacttctatattttaat

SEQ ID NO: 1714508 - DNA, 14 bp, Homo sapiens
caataacttttcac

SEQ ID NO: 1714509 - DNA, 21 bp, Homo sapiens
caataagtacttatctttatt

SEQ ID NO: 1714510 - DNA, 10 bp, Homo sapiens
caataataaa

SEQ ID NO: 1714511 - DNA, 14 bp, Homo sapiens
caataatatttcaa

SEQ ID NO: 1714512 - DNA, 17 bp, Homo sapiens
caataatctctatttga

SEQ ID NO: 1714513 - DNA, 19 bp, Homo sapiens
caataatggggcagacaca

SEQ ID NO: 1714514 - DNA, 20 bp, Homo sapiens
caataatggggcagacacaa

SEQ ID NO: 1714515 - DNA, 17 bp, Homo sapiens
caataatggtcccatcc

SEQ ID NO: 1714516 - DNA, 16 bp, Homo sapiens
caataattctacatgt

SEQ ID NO: 1714517 - DNA, 14 bp, Homo sapiens
caataatttcaggt

SEQ ID NO: 1714518 - DNA, 15 bp, Homo sapiens
caataatttgtacaa

SEQ ID NO: 1714519 - DNA, 16 bp, Homo sapiens
caataatttgtacaat

SEQ ID NO: 1714520 - DNA, 13 bp, Homo sapiens
caatacaaatgga

SEQ ID NO: 1714521 - DNA, 14 bp, Homo sapiens
caatacaaatggat

SEQ ID NO: 1714522 - DNA, 12 bp, Homo sapiens
caatacaatgta

SEQ ID NO: 1714523 - DNA, 17 bp, Homo sapiens
caatacaatgtacaatt

SEQ ID NO: 1714524 - DNA, 21 bp, Homo sapiens
caatacaatgtacaattatgt

SEQ ID NO: 1714525 - DNA, 22 bp, Homo sapiens
caatacacataagaccgtgtcc

SEQ ID NO: 1714526 - DNA, 17 bp, Homo sapiens
caatacatgctgctaat

SEQ ID NO: 1714527 - DNA, 13 bp, Homo sapiens
caatacatttgta

SEQ ID NO: 1714528 - DNA, 21 bp, Homo sapiens
caatacatttgtattttgtga

SEQ ID NO: 1714529 - DNA, 17 bp, Homo sapiens
caataccgctcagtatt

SEQ ID NO: 1714530 - DNA, 17 bp, Homo sapiens
caatacgtttgtgcaga

SEQ ID NO: 1714531 - DNA, 22 bp, Homo sapiens
caatacgtttgtgcagaatctc

SEQ ID NO: 1714532 - DNA, 20 bp, Homo sapiens
caatacttttgtgtattctg

SEQ ID NO: 1714533 - DNA, 14 bp, Homo sapiens
caatagagactgta

SEQ ID NO: 1714534 - DNA, 15 bp, Homo sapiens
caatagagactgtag

SEQ ID NO: 1714535 - DNA, 19 bp, Homo sapiens
caatagatatttacctttt

SEQ ID NO: 1714536 - DNA, 16 bp, Homo sapiens
caatagatctccagcg

SEQ ID NO: 1714537 - DNA, 18 bp, Homo sapiens
caatagattactgatgtg

SEQ ID NO: 1714538 - DNA, 21 bp, Homo sapiens
caatagctctactgccctccc

SEQ ID NO: 1714539 - DNA, 23 bp, Homo sapiens
caatagctctactgccctcccct

SEQ ID NO: 1714540 - DNA, 23 bp, Homo sapiens
caatagctttaccctcaggcata

SEQ ID NO: 1714541 - DNA, 15 bp, Homo sapiens
caataggctgtaatc

SEQ ID NO: 1714542 - DNA, 15 bp, Homo sapiens
caataggctgttccc

SEQ ID NO: 1714543 - DNA, 23 bp, Homo sapiens
caatagggtagaatgattaatca

SEQ ID NO: 1714544 - DNA, 15 bp, Homo sapiens
caatagggttaaatg

SEQ ID NO: 1714545 - DNA, 21 bp, Homo sapiens
caatagtgcaacatctctgaa

SEQ ID NO: 1714546 - DNA, 22 bp, Homo sapiens
caatataaaactgtacttcact

SEQ ID NO: 1714547 - DNA, 14 bp, Homo sapiens
caatatagaaacac

SEQ ID NO: 1714548 - DNA, 22 bp, Homo sapiens
caatatatagtgggtacatcaa

SEQ ID NO: 1714549 - DNA, 13 bp, Homo sapiens
caatatatattat

SEQ ID NO: 1714550 - DNA, 17 bp, Homo sapiens
caatatatattatatat

SEQ ID NO: 1714551 - DNA, 21 bp, Homo sapiens
caatatatattatatatatct

SEQ ID NO: 1714552 - DNA, 18 bp, Homo sapiens
caatatattaccagcaag

SEQ ID NO: 1714553 - DNA, 15 bp, Homo sapiens
caatatattgaactt

SEQ ID NO: 1714554 - DNA, 18 bp, Homo sapiens
caatatcagctttgataa

SEQ ID NO: 1714555 - DNA, 18 bp, Homo sapiens
caatatccctcttgtaag

SEQ ID NO: 1714556 - DNA, 15 bp, Homo sapiens
caatatctaatatat

SEQ ID NO: 1714557 - DNA, 13 bp, Homo sapiens
gcttccctggaag

SEQ ID NO: 1714558 - DNA, 17 bp, Homo sapiens
gcttcccttctccccag

SEQ ID NO: 1714559 - DNA, 16 bp, Homo sapiens
gcttccgagacaccac

SEQ ID NO: 1714560 - DNA, 16 bp, Homo sapiens
gcttccgcacatgccg

SEQ ID NO: 1714561 - DNA, 18 bp, Homo sapiens
gcttccgccactcagcca

SEQ ID NO: 1714562 - DNA, 22 bp, Homo sapiens
gcttccgctttgaaagaagcaa

SEQ ID NO: 1714563 - DNA, 20 bp, Homo sapiens
gcttcctcacacccctgtcc

SEQ ID NO: 1714564 - DNA, 16 bp, Homo sapiens
gcttcctcagcctcca

SEQ ID NO: 1714565 - DNA, 14 bp, Homo sapiens
gcttcctcccaaca

SEQ ID NO: 1714566 - DNA, 21 bp, Homo sapiens
gcttcctcctccccaactgtg

SEQ ID NO: 1714567 - DNA, 13 bp, Homo sapiens
gcttcctcctgga

SEQ ID NO: 1714568 - DNA, 16 bp, Homo sapiens
gcttcctcctggaaat

SEQ ID NO: 1714569 - DNA, 21 bp, Homo sapiens
gcttcctgcttgccaaggcag

SEQ ID NO: 1714570 - DNA, 16 bp, Homo sapiens
gcttcctggcctccct

SEQ ID NO: 1714571 - DNA, 20 bp, Homo sapiens
gcttcctggcctcccttctc

SEQ ID NO: 1714572 - DNA, 19 bp, Homo sapiens
gcttcctgggtcctgcctg

SEQ ID NO: 1714573 - DNA, 16 bp, Homo sapiens
gcttcctgggtcctgt

SEQ ID NO: 1714574 - DNA, 22 bp, Homo sapiens
gcttcctggtgtatttttcagg

SEQ ID NO: 1714575 - DNA, 14 bp, Homo sapiens
gcttcctgtccact

SEQ ID NO: 1714576 - DNA, 17 bp, Homo sapiens
gcttcctgtccactctc

SEQ ID NO: 1714577 - DNA, 19 bp, Homo sapiens
caatcaacagcatgtctac

SEQ ID NO: 1714578 - DNA, 20 bp, Homo sapiens
caatcaaggttataattttt

SEQ ID NO: 1714579 - DNA, 21 bp, Homo sapiens
caatcactgtaacctgattca

SEQ ID NO: 1714580 - DNA, 12 bp, Homo sapiens
caatcagcactg

SEQ ID NO: 1714581 - DNA, 17 bp, Homo sapiens
caatcagcactgaaaat

SEQ ID NO: 1714582 - DNA, 19 bp, Homo sapiens
caatcagcccagtgcaaac

SEQ ID NO: 1714583 - DNA, 14 bp, Homo sapiens
caatcagtcccctc

SEQ ID NO: 1714584 - DNA, 17 bp, Homo sapiens
caatcagtcccctccca

SEQ ID NO: 1714585 - DNA, 17 bp, Homo sapiens
caatcatgaaatatgca

SEQ ID NO: 1714586 - DNA, 17 bp, Homo sapiens
caatcatggtcaagttc

SEQ ID NO: 1714587 - DNA, 22 bp, Homo sapiens
caatcatggtcaagttcccaac

SEQ ID NO: 1714588 - DNA, 21 bp, Homo sapiens
caatccatgttagtttttact

SEQ ID NO: 1714589 - DNA, 22 bp, Homo sapiens
caatccatgttagtttttactt

SEQ ID NO: 1714590 - DNA, 23 bp, Homo sapiens
caatccattttttaggtgcttta

SEQ ID NO: 1714591 - DNA, 22 bp, Homo sapiens
caatcccaccaaccctcagagc

SEQ ID NO: 1714592 - DNA, 19 bp, Homo sapiens
caatcctaatttctcctcc

SEQ ID NO: 1714593 - DNA, 22 bp, Homo sapiens
caatcctagaaccaagcttcag

SEQ ID NO: 1714594 - DNA, 20 bp, Homo sapiens
caatcctcaaacatggaaga

SEQ ID NO: 1714595 - DNA, 16 bp, Homo sapiens
caatcctcactgggtg

SEQ ID NO: 1714596 - DNA, 18 bp, Homo sapiens
caatcctcccacttcagc

SEQ ID NO: 1714597 - DNA, 13 bp, Homo sapiens
caatcctctaagc

SEQ ID NO: 1714598 - DNA, 13 bp, Homo sapiens
caatcctctctcc

SEQ ID NO: 1714599 - DNA, 20 bp, Homo sapiens
caatcctctctcccctctgc

SEQ ID NO: 1714600 - DNA, 20 bp, Homo sapiens
caatcctgggcaatcagaca

SEQ ID NO: 1714601 - DNA, 22 bp, Homo sapiens
caatccttccctgctcttgcag

SEQ ID NO: 1714602 - DNA, 21 bp, Homo sapiens
caatcgagatttgggagctga

SEQ ID NO: 1714603 - DNA, 23 bp, Homo sapiens
caatcgtcttaagttttttatgc

SEQ ID NO: 1714604 - DNA, 14 bp, Homo sapiens
caatctaacaataa

SEQ ID NO: 1714605 - DNA, 14 bp, Homo sapiens
caatctactggaaa

SEQ ID NO: 1714606 - DNA, 14 bp, Homo sapiens
caatctccagggct

SEQ ID NO: 1714607 - DNA, 17 bp, Homo sapiens
caatctccagggctcca

SEQ ID NO: 1714608 - DNA, 18 bp, Homo sapiens
caatctctggaaaaataa

SEQ ID NO: 1714609 - DNA, 15 bp, Homo sapiens
caatctcttcattat

SEQ ID NO: 1714610 - DNA, 17 bp, Homo sapiens
caatctgcattttaaca

SEQ ID NO: 1714611 - DNA, 16 bp, Homo sapiens
caatctggaagaaaaa

SEQ ID NO: 1714612 - DNA, 17 bp, Homo sapiens
caatctggaagaaaaaa

SEQ ID NO: 1714613 - DNA, 11 bp, Homo sapiens
caatctggctc

SEQ ID NO: 1714614 - DNA, 12 bp, Homo sapiens
caatctggctca

SEQ ID NO: 1714615 - DNA, 18 bp, Homo sapiens
caatctggcttagtgcca

SEQ ID NO: 1714616 - DNA, 23 bp, Homo sapiens
caatctgggtggtaactgccagc

SEQ ID NO: 1714617 - DNA, 14 bp, Homo sapiens
caatctgtcagttc

SEQ ID NO: 1714618 - DNA, 16 bp, Homo sapiens
caatcttcgacagctg

SEQ ID NO: 1714619 - DNA, 21 bp, Homo sapiens
caatcttctacttttaactaa

SEQ ID NO: 1714620 - DNA, 19 bp, Homo sapiens
caatcttggggctgatgaa

SEQ ID NO: 1714621 - DNA, 20 bp, Homo sapiens
caatcttggggctgatgaag

SEQ ID NO: 1714622 - DNA, 22 bp, Homo sapiens
caatcttggtttgtcagtttat

SEQ ID NO: 1714623 - DNA, 13 bp, Homo sapiens
caatcttgttact

SEQ ID NO: 1714624 - DNA, 14 bp, Homo sapiens
caatcttgttactg

SEQ ID NO: 1714625 - DNA, 14 bp, Homo sapiens
caatctttgccttt

SEQ ID NO: 1714626 - DNA, 13 bp, Homo sapiens
caatctttgctgt

SEQ ID NO: 1714627 - DNA, 17 bp, Homo sapiens
caatgaaagtttgcact

SEQ ID NO: 1714628 - DNA, 23 bp, Homo sapiens
caatgaaatacacaagtaaacat

SEQ ID NO: 1714629 - DNA, 19 bp, Homo sapiens
caatgaaccataaattcaa

SEQ ID NO: 1714630 - DNA, 17 bp, Homo sapiens
caatgaactgcttttcc

SEQ ID NO: 1714631 - DNA, 19 bp, Homo sapiens
caatgaactgcttttcctc

SEQ ID NO: 1714632 - DNA, 12 bp, Homo sapiens
caatgaagaaga

SEQ ID NO: 1714633 - DNA, 14 bp, Homo sapiens
caatgaagccagct

SEQ ID NO: 1714634 - DNA, 16 bp, Homo sapiens
caatgacaagatgttc

SEQ ID NO: 1714635 - DNA, 19 bp, Homo sapiens
caatgacacagtcttggct

SEQ ID NO: 1714636 - DNA, 23 bp, Homo sapiens
caatgacacccatgccagagagg

SEQ ID NO: 1714637 - DNA, 15 bp, Homo sapiens
caatgacatcttcaa

SEQ ID NO: 1714638 - DNA, 19 bp, Homo sapiens
caatgacatcttcaaagct

SEQ ID NO: 1714639 - DNA, 19 bp, Homo sapiens
caatgaccattcaattagt

SEQ ID NO: 1714640 - DNA, 17 bp, Homo sapiens
caatgaggtctgaaatg

SEQ ID NO: 1714641 - DNA, 18 bp, Homo sapiens
caatgaggtctgaaatgg

SEQ ID NO: 1714642 - DNA, 20 bp, Homo sapiens
caatgatagtaagaaaagtg

SEQ ID NO: 1714643 - DNA, 15 bp, Homo sapiens
caatgatgacccact

SEQ ID NO: 1714644 - DNA, 22 bp, Homo sapiens
caatgatgacccactaaagagt

SEQ ID NO: 1714645 - DNA, 23 bp, Homo sapiens
caatgatgaccccggcctgtctc

SEQ ID NO: 1714646 - DNA, 19 bp, Homo sapiens
caatgatgatgataatgat

SEQ ID NO: 1714647 - DNA, 24 bp, Homo sapiens
caatgatggcaattttgtaacgaa

SEQ ID NO: 1714648 - DNA, 14 bp, Homo sapiens
caatgatgtccaga

SEQ ID NO: 1714649 - DNA, 22 bp, Homo sapiens
caatgattatttgtatttacag

SEQ ID NO: 1714650 - DNA, 15 bp, Homo sapiens
caatgattgttaatt

SEQ ID NO: 1714651 - DNA, 22 bp, Homo sapiens
caatgcaagagtgattgcagct

SEQ ID NO: 1714652 - DNA, 23 bp, Homo sapiens
caatgcaagagtgattgcagctt

SEQ ID NO: 1714653 - DNA, 18 bp, Homo sapiens
caatgcattggcctctgt

SEQ ID NO: 1714654 - DNA, 15 bp, Homo sapiens
caatgcatttaaaat

SEQ ID NO: 1714655 - DNA, 16 bp, Homo sapiens
caatgcatttaaaata

SEQ ID NO: 1714656 - DNA, 13 bp, Homo sapiens
caatgccctgcca

SEQ ID NO: 1714657 - DNA, 15 bp, Homo sapiens
caatgccctgccatt

SEQ ID NO: 1714658 - DNA, 17 bp, Homo sapiens
caatgcctacagctgtc

SEQ ID NO: 1714659 - DNA, 22 bp, Homo sapiens
caatgcctttttagatgtattt

SEQ ID NO: 1714660 - DNA, 17 bp, Homo sapiens
caatgcggcccactttc

SEQ ID NO: 1714661 - DNA, 18 bp, Homo sapiens
caatgcttctagagtttt

SEQ ID NO: 1714662 - DNA, 13 bp, Homo sapiens
caatgcttgtaga

SEQ ID NO: 1714663 - DNA, 21 bp, Homo sapiens
caatgctttgcccctgagaca

SEQ ID NO: 1714664 - DNA, 13 bp, Homo sapiens
caatgctttggga

SEQ ID NO: 1714665 - DNA, 23 bp, Homo sapiens
caatgctttgggaggccaaggca

SEQ ID NO: 1714666 - DNA, 13 bp, Homo sapiens
caatggaataaat

SEQ ID NO: 1714667 - DNA, 17 bp, Homo sapiens
caatggatttgatgctg

SEQ ID NO: 1714668 - DNA, 17 bp, Homo sapiens
caatggcagctagactg

SEQ ID NO: 1714669 - DNA, 16 bp, Homo sapiens
caatgggctcttccaa

SEQ ID NO: 1714670 - DNA, 14 bp, Homo sapiens
caatggggccagca

SEQ ID NO: 1714671 - DNA, 20 bp, Homo sapiens
gcttgctccagattctgatg

SEQ ID NO: 1714672 - DNA, 12 bp, Homo sapiens
gcttgcttttct

SEQ ID NO: 1714673 - DNA, 15 bp, Homo sapiens
gcttggaagccaggt

SEQ ID NO: 1714674 - DNA, 15 bp, Homo sapiens
gcttggactacacaa

SEQ ID NO: 1714675 - DNA, 16 bp, Homo sapiens
gcttggacttcctggg

SEQ ID NO: 1714676 - DNA, 13 bp, Homo sapiens
gcttggcagctga

SEQ ID NO: 1714677 - DNA, 15 bp, Homo sapiens
gcttggcccagcgcc

SEQ ID NO: 1714678 - DNA, 19 bp, Homo sapiens
gcttggcccggccggcctg

SEQ ID NO: 1714679 - DNA, 23 bp, Homo sapiens
gcttggcccggccggcctggcac

SEQ ID NO: 1714680 - DNA, 13 bp, Homo sapiens
gcttggcctgctg

SEQ ID NO: 1714681 - DNA, 16 bp, Homo sapiens
gcttggcctgctgtga

SEQ ID NO: 1714682 - DNA, 21 bp, Homo sapiens
gcttggctcacaaggcccagg

SEQ ID NO: 1714683 - DNA, 20 bp, Homo sapiens
gcttgggccctgcacagata

SEQ ID NO: 1714684 - DNA, 16 bp, Homo sapiens
gcttgggctgacccag

SEQ ID NO: 1714685 - DNA, 19 bp, Homo sapiens
gcttggggccaccaaagct

SEQ ID NO: 1714686 - DNA, 11 bp, Homo sapiens
gcttggggcta

SEQ ID NO: 1714687 - DNA, 16 bp, Homo sapiens
gcttggggctcacaca

SEQ ID NO: 1714688 - DNA, 19 bp, Homo sapiens
gcttgggtgtaacaggtct

SEQ ID NO: 1714689 - DNA, 21 bp, Homo sapiens
gcttgggtgtaacaggtctcc

SEQ ID NO: 1714690 - DNA, 20 bp, Homo sapiens
gcttggtggggctcgtggcc

SEQ ID NO: 1714691 - DNA, 16 bp, Homo sapiens
gcttgtaacaagaaaa

SEQ ID NO: 1714692 - DNA, 16 bp, Homo sapiens
gcttgtaactccacca

SEQ ID NO: 1714693 - DNA, 11 bp, Homo sapiens
gcttgtacatt

SEQ ID NO: 1714694 - DNA, 16 bp, Homo sapiens
gcttgtactgggacat

SEQ ID NO: 1714695 - DNA, 23 bp, Homo sapiens
gcttgtagaactcactctgggct

SEQ ID NO: 1714696 - DNA, 14 bp, Homo sapiens
caatgtgaatcaga

SEQ ID NO: 1714697 - DNA, 18 bp, Homo sapiens
caatgtgagtcccagagc

SEQ ID NO: 1714698 - DNA, 16 bp, Homo sapiens
caatgtgctactgatt

SEQ ID NO: 1714699 - DNA, 17 bp, Homo sapiens
caatgttaatcagcccc

SEQ ID NO: 1714700 - DNA, 12 bp, Homo sapiens
caatgttccatt

SEQ ID NO: 1714701 - DNA, 15 bp, Homo sapiens
caatgttgagaagtt

SEQ ID NO: 1714702 - DNA, 22 bp, Homo sapiens
caatgttggttttttataaagt

SEQ ID NO: 1714703 - DNA, 16 bp, Homo sapiens
caatgttgtccaacaa

SEQ ID NO: 1714704 - DNA, 22 bp, Homo sapiens
caatgtttgggatattaaaaca

SEQ ID NO: 1714705 - DNA, 17 bp, Homo sapiens
caatgtttttaaaaatc

SEQ ID NO: 1714706 - DNA, 17 bp, Homo sapiens
caattaaaccgcatgtg

SEQ ID NO: 1714707 - DNA, 19 bp, Homo sapiens
caattaaacttccaaagaa

SEQ ID NO: 1714708 - DNA, 13 bp, Homo sapiens
caattaaatgtag

SEQ ID NO: 1714709 - DNA, 14 bp, Homo sapiens
caattaaatgtagg

SEQ ID NO: 1714710 - DNA, 18 bp, Homo sapiens
caattaataaaaaatgga

SEQ ID NO: 1714711 - DNA, 19 bp, Homo sapiens
caattaatagtttgtctat

SEQ ID NO: 1714712 - DNA, 22 bp, Homo sapiens
caattaatagtttgtctatttt

SEQ ID NO: 1714713 - DNA, 11 bp, Homo sapiens
caattaatgct

SEQ ID NO: 1714714 - DNA, 15 bp, Homo sapiens
caattactcaggttt

SEQ ID NO: 1714715 - DNA, 13 bp, Homo sapiens
caattactgtaca

SEQ ID NO: 1714716 - DNA, 15 bp, Homo sapiens
caattactgtacaca

SEQ ID NO: 1714717 - DNA, 16 bp, Homo sapiens
caattaggaagtgtaa

SEQ ID NO: 1714718 - DNA, 16 bp, Homo sapiens
caattaggtagcacag

SEQ ID NO: 1714719 - DNA, 15 bp, Homo sapiens
caattagtctgaaac

SEQ ID NO: 1714720 - DNA, 21 bp, Homo sapiens
caattagtctgaaactggctt

SEQ ID NO: 1714721 - DNA, 19 bp, Homo sapiens
caattagtggtcataaaat

SEQ ID NO: 1714722 - DNA, 23 bp, Homo sapiens
caattagtgtgacagtttccaaa

SEQ ID NO: 1714723 - DNA, 17 bp, Homo sapiens
caattagtttccttttt

SEQ ID NO: 1714724 - DNA, 15 bp, Homo sapiens
caattatagtttctg

SEQ ID NO: 1714725 - DNA, 22 bp, Homo sapiens
caattatagtttctgaggcttt

SEQ ID NO: 1714726 - DNA, 12 bp, Homo sapiens
caattattttgg

SEQ ID NO: 1714727 - DNA, 15 bp, Homo sapiens
caattcaaaagttcc

SEQ ID NO: 1714728 - DNA, 13 bp, Homo sapiens
caattccaggctg

SEQ ID NO: 1714729 - DNA, 14 bp, Homo sapiens
caattccaggctga

SEQ ID NO: 1714730 - DNA, 18 bp, Homo sapiens
caattcccacctatgagt

SEQ ID NO: 1714731 - DNA, 15 bp, Homo sapiens
caattcctagataaa

SEQ ID NO: 1714732 - DNA, 16 bp, Homo sapiens
caattcctagataaaa

SEQ ID NO: 1714733 - DNA, 16 bp, Homo sapiens
caattcctggccctgt

SEQ ID NO: 1714734 - DNA, 16 bp, Homo sapiens
caattcctgggcccca

SEQ ID NO: 1714735 - DNA, 20 bp, Homo sapiens
caattctaaatccgacttga

SEQ ID NO: 1714736 - DNA, 13 bp, Homo sapiens
caattctgactgt

SEQ ID NO: 1714737 - DNA, 23 bp, Homo sapiens
caattctgtttttaatgctattt

SEQ ID NO: 1714738 - DNA, 17 bp, Homo sapiens
caattgaaaagtgttct

SEQ ID NO: 1714739 - DNA, 13 bp, Homo sapiens
caattgaaagctt

SEQ ID NO: 1714740 - DNA, 18 bp, Homo sapiens
caattgaagtaaactttt

SEQ ID NO: 1714741 - DNA, 20 bp, Homo sapiens
caattgatacttcaggtgct

SEQ ID NO: 1714742 - DNA, 23 bp, Homo sapiens
caattgatgtatatgtttatata

SEQ ID NO: 1714743 - DNA, 13 bp, Homo sapiens
caattgcactgct

SEQ ID NO: 1714744 - DNA, 12 bp, Homo sapiens
caattgccctgt

SEQ ID NO: 1714745 - DNA, 20 bp, Homo sapiens
caattgggagctgccaagag

SEQ ID NO: 1714746 - DNA, 17 bp, Homo sapiens
caattggtggtaacagt

SEQ ID NO: 1714747 - DNA, 16 bp, Homo sapiens
caattgtcacttttta

SEQ ID NO: 1714748 - DNA, 13 bp, Homo sapiens
caattgtgctgcc

SEQ ID NO: 1714749 - DNA, 14 bp, Homo sapiens
caattgtgctgcca

SEQ ID NO: 1714750 - DNA, 15 bp, Homo sapiens
caattgtgctgccat

SEQ ID NO: 1714751 - DNA, 19 bp, Homo sapiens
caattgtgggatgtcctct

SEQ ID NO: 1714752 - DNA, 20 bp, Homo sapiens
caattgtgtagcctttttgt

SEQ ID NO: 1714753 - DNA, 13 bp, Homo sapiens
caattgtgtgaat

SEQ ID NO: 1714754 - DNA, 19 bp, Homo sapiens
caattgttacaagtgttct

SEQ ID NO: 1714755 - DNA, 14 bp, Homo sapiens
caattgttgacagt

SEQ ID NO: 1714756 - DNA, 23 bp, Homo sapiens
caattgttgacagttctgaagaa

SEQ ID NO: 1714757 - DNA, 22 bp, Homo sapiens
caattgtttgggtgattcctaa

SEQ ID NO: 1714758 - DNA, 15 bp, Homo sapiens
caatttaaaatattt

SEQ ID NO: 1714759 - DNA, 22 bp, Homo sapiens
caatttagtctagacacaattt

SEQ ID NO: 1714760 - DNA, 14 bp, Homo sapiens
caatttatgaattg

SEQ ID NO: 1714761 - DNA, 20 bp, Homo sapiens
caatttcaaaaaaataaaat

SEQ ID NO: 1714762 - DNA, 11 bp, Homo sapiens
caatttcaagt

SEQ ID NO: 1714763 - DNA, 14 bp, Homo sapiens
caatttcaataaaa

SEQ ID NO: 1714764 - DNA, 21 bp, Homo sapiens
caatttcatttccagcatttt

SEQ ID NO: 1714765 - DNA, 20 bp, Homo sapiens
caatttctgtgttgccaagc

SEQ ID NO: 1714766 - DNA, 16 bp, Homo sapiens
caatttgatacataat

SEQ ID NO: 1714767 - DNA, 23 bp, Homo sapiens
caatttgcacatcttggctatgt

SEQ ID NO: 1714768 - DNA, 21 bp, Homo sapiens
caatttggatttaaaagcctg

SEQ ID NO: 1714769 - DNA, 18 bp, Homo sapiens
caatttgggagatatatt

SEQ ID NO: 1714770 - DNA, 19 bp, Homo sapiens
caatttgggagatatattt

SEQ ID NO: 1714771 - DNA, 19 bp, Homo sapiens
caatttgtaaaaacagcat

SEQ ID NO: 1714772 - DNA, 21 bp, Homo sapiens
caatttgtaagtaacacagta

SEQ ID NO: 1714773 - DNA, 15 bp, Homo sapiens
caatttgtttaaaga

SEQ ID NO: 1714774 - DNA, 15 bp, Homo sapiens
caattttaaaaaata

SEQ ID NO: 1714775 - DNA, 16 bp, Homo sapiens
caattttaaaaaataa

SEQ ID NO: 1714776 - DNA, 18 bp, Homo sapiens
caattttaaaaaataaca

SEQ ID NO: 1714777 - DNA, 16 bp, Homo sapiens
caattttagtgtatta

SEQ ID NO: 1714778 - DNA, 17 bp, Homo sapiens
caattttagtgtattaa

SEQ ID NO: 1714779 - DNA, 12 bp, Homo sapiens
caattttatgta

SEQ ID NO: 1714780 - DNA, 18 bp, Homo sapiens
caattttcattaaacttg

SEQ ID NO: 1714781 - DNA, 20 bp, Homo sapiens
caattttcattaaacttgaa

SEQ ID NO: 1714782 - DNA, 19 bp, Homo sapiens
caattttctggaatacatg

SEQ ID NO: 1714783 - DNA, 13 bp, Homo sapiens
caattttctgtaa

SEQ ID NO: 1714784 - DNA, 12 bp, Homo sapiens
caattttgtctt

SEQ ID NO: 1714785 - DNA, 13 bp, Homo sapiens
caattttgtctta

SEQ ID NO: 1714786 - DNA, 20 bp, Homo sapiens
caattttgtcttaagtgttt

SEQ ID NO: 1714787 - DNA, 19 bp, Homo sapiens
ggaaaggcttggctggtgt

SEQ ID NO: 1714788 - DNA, 12 bp, Homo sapiens
ggaaaggggaca

SEQ ID NO: 1714789 - DNA, 18 bp, Homo sapiens
ggaaaggggagagcctgc

SEQ ID NO: 1714790 - DNA, 19 bp, Homo sapiens
ggaaaggggagagcctgct

SEQ ID NO: 1714791 - DNA, 21 bp, Homo sapiens
ggaaaggggagagcctgctgg

SEQ ID NO: 1714792 - DNA, 22 bp, Homo sapiens
ggaaagggggtcccagtgggag

SEQ ID NO: 1714793 - DNA, 15 bp, Homo sapiens
ggaaaggtcagcccg

SEQ ID NO: 1714794 - DNA, 17 bp, Homo sapiens
ggaaaggtcctgctgtg

SEQ ID NO: 1714795 - DNA, 23 bp, Homo sapiens
ggaaagtattctcttttcaagaa

SEQ ID NO: 1714796 - DNA, 18 bp, Homo sapiens
ggaaagtcagaatcagaa

SEQ ID NO: 1714797 - DNA, 23 bp, Homo sapiens
ggaaagttggaaccgtgtccagc

SEQ ID NO: 1714798 - DNA, 15 bp, Homo sapiens
ggaaataacagagag

SEQ ID NO: 1714799 - DNA, 14 bp, Homo sapiens
ggaaataatttgaa

SEQ ID NO: 1714800 - DNA, 17 bp, Homo sapiens
ggaaataatttgaatgt

SEQ ID NO: 1714801 - DNA, 17 bp, Homo sapiens
ggaaatcaaatatgcaa

SEQ ID NO: 1714802 - DNA, 17 bp, Homo sapiens
ggaaatctgtaaagcca

SEQ ID NO: 1714803 - DNA, 18 bp, Homo sapiens
ggaaatctgtaaagccag

SEQ ID NO: 1714804 - DNA, 13 bp, Homo sapiens
ggaaatcttaaac

SEQ ID NO: 1714805 - DNA, 15 bp, Homo sapiens
ggaaatgaaagaaag

SEQ ID NO: 1714806 - DNA, 19 bp, Homo sapiens
ggaaatgaaaggtgaatta

SEQ ID NO: 1714807 - DNA, 15 bp, Homo sapiens
ggaaatgaagcaggg

SEQ ID NO: 1714808 - DNA, 22 bp, Homo sapiens
ggaaatgatgttggtccaaagt

SEQ ID NO: 1714809 - DNA, 15 bp, Homo sapiens
ggaaatgtagcactt

SEQ ID NO: 1714810 - DNA, 17 bp, Homo sapiens
ggaaatgtagcacttac

SEQ ID NO: 1714811 - DNA, 16 bp, Homo sapiens
ggaaatgtctgctggt

SEQ ID NO: 1714812 - DNA, 12 bp, Homo sapiens
ggaacaacaaat

SEQ ID NO: 1714813 - DNA, 19 bp, Homo sapiens
ggaacaacttgtagcagct

SEQ ID NO: 1714814 - DNA, 18 bp, Homo sapiens
ggaacaaggagtcagaca

SEQ ID NO: 1714815 - DNA, 18 bp, Homo sapiens
ggaacaagtaatgtatta

SEQ ID NO: 1714816 - DNA, 21 bp, Homo sapiens
cacaaagaacttgctgctgcc

SEQ ID NO: 1714817 - DNA, 17 bp, Homo sapiens
cacaaagactccttcgt

SEQ ID NO: 1714818 - DNA, 22 bp, Homo sapiens
cacaaagcacagtttgaacaaa

SEQ ID NO: 1714819 - DNA, 14 bp, Homo sapiens
cacaaagccaagcc

SEQ ID NO: 1714820 - DNA, 18 bp, Homo sapiens
cacaaagcggggggaggg

SEQ ID NO: 1714821 - DNA, 19 bp, Homo sapiens
cacaaagctcaagatgaca

SEQ ID NO: 1714822 - DNA, 17 bp, Homo sapiens
cacaaagcttctaaagc

SEQ ID NO: 1714823 - DNA, 16 bp, Homo sapiens
cacaaaggtataattt

SEQ ID NO: 1714824 - DNA, 17 bp, Homo sapiens
cacaaaggtggaataaa

SEQ ID NO: 1714825 - DNA, 21 bp, Homo sapiens
cacaaatatttattttctttc

SEQ ID NO: 1714826 - DNA, 18 bp, Homo sapiens
cacaaatcaaagcaaggg

SEQ ID NO: 1714827 - DNA, 15 bp, Homo sapiens
cacaaatctttttct

SEQ ID NO: 1714828 - DNA, 15 bp, Homo sapiens
cacaaatgtcattgt

SEQ ID NO: 1714829 - DNA, 16 bp, Homo sapiens
cacaaatgtcattgtc

SEQ ID NO: 1714830 - DNA, 17 bp, Homo sapiens
cacaaatgtcattgtct

SEQ ID NO: 1714831 - DNA, 12 bp, Homo sapiens
cacaacacagat

SEQ ID NO: 1714832 - DNA, 15 bp, Homo sapiens
cacaacaccaggact

SEQ ID NO: 1714833 - DNA, 13 bp, Homo sapiens
cacaacagcagtc

SEQ ID NO: 1714834 - DNA, 19 bp, Homo sapiens
cacaacatttgcagatgtt

SEQ ID NO: 1714835 - DNA, 17 bp, Homo sapiens
cacaaccctgttttata

SEQ ID NO: 1714836 - DNA, 17 bp, Homo sapiens
cacaacctctctgatct

SEQ ID NO: 1714837 - DNA, 23 bp, Homo sapiens
cacaaccttctgtggctcacaga

SEQ ID NO: 1714838 - DNA, 14 bp, Homo sapiens
cacaactatttttc

SEQ ID NO: 1714839 - DNA, 18 bp, Homo sapiens
cacaactgacacaggaaa

SEQ ID NO: 1714840 - DNA, 22 bp, Homo sapiens
cacaactgtgtgattaaaaggt

SEQ ID NO: 1714841 - DNA, 15 bp, Homo sapiens
cacaacttgggttct

SEQ ID NO: 1714842 - DNA, 21 bp, Homo sapiens
cacaactttattgattgaatt

SEQ ID NO: 1714843 - DNA, 14 bp, Homo sapiens
cacaagaatggatc

SEQ ID NO: 1714844 - DNA, 15 bp, Homo sapiens
cacaagaggaagaga

SEQ ID NO: 1714845 - DNA, 16 bp, Homo sapiens
cacaagattcccagag

SEQ ID NO: 1714846 - DNA, 17 bp, Homo sapiens
cacaagattcccagaga

SEQ ID NO: 1714847 - DNA, 18 bp, Homo sapiens
cacaagattcccagagac

SEQ ID NO: 1714848 - DNA, 13 bp, Homo sapiens
cacaagcacaaag

SEQ ID NO: 1714849 - DNA, 17 bp, Homo sapiens
cacaagcacaaagctca

SEQ ID NO: 1714850 - DNA, 22 bp, Homo sapiens
cacaagcagagtgcacagctgt

SEQ ID NO: 1714851 - DNA, 21 bp, Homo sapiens
cacaagccacaagtcttccag

SEQ ID NO: 1714852 - DNA, 19 bp, Homo sapiens
cacaagcctgagaactgaa

SEQ ID NO: 1714853 - DNA, 11 bp, Homo sapiens
cacaagctgca

SEQ ID NO: 1714854 - DNA, 16 bp, Homo sapiens
cacaagctgcactgtg

SEQ ID NO: 1714855 - DNA, 16 bp, Homo sapiens
cacaagctgtccctgc

SEQ ID NO: 1714856 - DNA, 20 bp, Homo sapiens
cacaaggacgctggctactg

SEQ ID NO: 1714857 - DNA, 16 bp, Homo sapiens
cacaaggacttcctgt

SEQ ID NO: 1714858 - DNA, 18 bp, Homo sapiens
cacaaggctgaccaagag

SEQ ID NO: 1714859 - DNA, 16 bp, Homo sapiens
cacaagggatataaaa

SEQ ID NO: 1714860 - DNA, 17 bp, Homo sapiens
cacaaggtgcaaatcaa

SEQ ID NO: 1714861 - DNA, 21 bp, Homo sapiens
cacaagtcctggatgttgtgt

SEQ ID NO: 1714862 - DNA, 16 bp, Homo sapiens
cacaagtgaaaaacat

SEQ ID NO: 1714863 - DNA, 20 bp, Homo sapiens
cacaagttcatctcatttgt

SEQ ID NO: 1714864 - DNA, 17 bp, Homo sapiens
cacaatacagtattata

SEQ ID NO: 1714865 - DNA, 12 bp, Homo sapiens
cacaatatgaat

SEQ ID NO: 1714866 - DNA, 22 bp, Homo sapiens
cacaatcctaacacattatcgg

SEQ ID NO: 1714867 - DNA, 23 bp, Homo sapiens
cacaatcctaacacattatcggg

SEQ ID NO: 1714868 - DNA, 21 bp, Homo sapiens
cacaatctggcttagtgccac

SEQ ID NO: 1714869 - DNA, 22 bp, Homo sapiens
cacaatgtatacttcagtgctc

SEQ ID NO: 1714870 - DNA, 21 bp, Homo sapiens
cacaattccatttccagttca

SEQ ID NO: 1714871 - DNA, 18 bp, Homo sapiens
cacaattgatacttcagg

SEQ ID NO: 1714872 - DNA, 15 bp, Homo sapiens
cacaatttaaaatat

SEQ ID NO: 1714873 - DNA, 17 bp, Homo sapiens
cacaatttaaaatattt

SEQ ID NO: 1714874 - DNA, 18 bp, Homo sapiens
cacaatttcatttccagc

SEQ ID NO: 1714875 - DNA, 13 bp, Homo sapiens
cacaatttgcact

SEQ ID NO: 1714876 - DNA, 15 bp, Homo sapiens
cacacaaagactcct

SEQ ID NO: 1714877 - DNA, 16 bp, Homo sapiens
cacacaagaagaaggg

SEQ ID NO: 1714878 - DNA, 18 bp, Homo sapiens
cacacaagaagaagggca

SEQ ID NO: 1714879 - DNA, 15 bp, Homo sapiens
cacacaataaagaac

SEQ ID NO: 1714880 - DNA, 13 bp, Homo sapiens
cacacacaaacct

SEQ ID NO: 1714881 - DNA, 14 bp, Homo sapiens
cacacacaaacctt

SEQ ID NO: 1714882 - DNA, 10 bp, Homo sapiens
cacacacaca

SEQ ID NO: 1714883 - DNA, 12 bp, Homo sapiens
cacacacacaca

SEQ ID NO: 1714884 - DNA, 15 bp, Homo sapiens
cacacacacacacaa

SEQ ID NO: 1714885 - DNA, 14 bp, Homo sapiens
cacacacacacagt

SEQ ID NO: 1714886 - DNA, 13 bp, Homo sapiens
cacacacacccac

SEQ ID NO: 1714887 - DNA, 12 bp, Homo sapiens
cacacacagagg

SEQ ID NO: 1714888 - DNA, 14 bp, Homo sapiens
cacacacagctcct

SEQ ID NO: 1714889 - DNA, 13 bp, Homo sapiens
cacacacaggcaa

SEQ ID NO: 1714890 - DNA, 11 bp, Homo sapiens
cacacacctgt

SEQ ID NO: 1714891 - DNA, 13 bp, Homo sapiens
cacacacctgtag

SEQ ID NO: 1714892 - DNA, 19 bp, Homo sapiens
cacacacctgtagtcccag

SEQ ID NO: 1714893 - DNA, 22 bp, Homo sapiens
cacacacgatgcatttaataaa

SEQ ID NO: 1714894 - DNA, 18 bp, Homo sapiens
cacacacgcacgcacaca

SEQ ID NO: 1714895 - DNA, 15 bp, Homo sapiens
cacacacgctccctg

SEQ ID NO: 1714896 - DNA, 20 bp, Homo sapiens
cacacacggaggcatcctac

SEQ ID NO: 1714897 - DNA, 15 bp, Homo sapiens
cacacacgtgagaat

SEQ ID NO: 1714898 - DNA, 14 bp, Homo sapiens
cacacactttccat

SEQ ID NO: 1714899 - DNA, 18 bp, Homo sapiens
cacacactttccatctct

SEQ ID NO: 1714900 - DNA, 19 bp, Homo sapiens
cacacactttccatctctg

SEQ ID NO: 1714901 - DNA, 18 bp, Homo sapiens
cacacagaggaagagcag

SEQ ID NO: 1714902 - DNA, 16 bp, Homo sapiens
cacagactttctgtga

SEQ ID NO: 1714903 - DNA, 17 bp, Homo sapiens
cacagactttctgtgac

SEQ ID NO: 1714904 - DNA, 19 bp, Homo sapiens
cacagagaagctcctgcta

SEQ ID NO: 1714905 - DNA, 20 bp, Homo sapiens
cacagagaagtttgtagcca

SEQ ID NO: 1714906 - DNA, 18 bp, Homo sapiens
cacagagagggagagcag

SEQ ID NO: 1714907 - DNA, 16 bp, Homo sapiens
cacagagattctggat

SEQ ID NO: 1714908 - DNA, 18 bp, Homo sapiens
cacagagattctggatct

SEQ ID NO: 1714909 - DNA, 22 bp, Homo sapiens
cacagagattctggatctcctg

SEQ ID NO: 1714910 - DNA, 13 bp, Homo sapiens
cacagagcacgcc

SEQ ID NO: 1714911 - DNA, 15 bp, Homo sapiens
cacagagcacgcctg

SEQ ID NO: 1714912 - DNA, 18 bp, Homo sapiens
cacagagcacgcctgcca

SEQ ID NO: 1714913 - DNA, 19 bp, Homo sapiens
cacagagcgtccttccccc

SEQ ID NO: 1714914 - DNA, 15 bp, Homo sapiens
cacagaggaagagca

SEQ ID NO: 1714915 - DNA, 18 bp, Homo sapiens
cacagagtcaaggcctgc

SEQ ID NO: 1714916 - DNA, 21 bp, Homo sapiens
cacagagtcaaggcctgctcc

SEQ ID NO: 1714917 - DNA, 12 bp, Homo sapiens
cacagagtgaga

SEQ ID NO: 1714918 - DNA, 15 bp, Homo sapiens
cacagagtgagactc

SEQ ID NO: 1714919 - DNA, 18 bp, Homo sapiens
cacagagtggtctttctg

SEQ ID NO: 1714920 - DNA, 19 bp, Homo sapiens
cacagataccttgaaagga

SEQ ID NO: 1714921 - DNA, 14 bp, Homo sapiens
cacagatatttcca

SEQ ID NO: 1714922 - DNA, 20 bp, Homo sapiens
cacagatatttccatttctt

SEQ ID NO: 1714923 - DNA, 15 bp, Homo sapiens
cacagatcccctgga

SEQ ID NO: 1714924 - DNA, 14 bp, Homo sapiens
cacagatgccatgg

SEQ ID NO: 1714925 - DNA, 20 bp, Homo sapiens
cacagatgccatggcctgtg

SEQ ID NO: 1714926 - DNA, 22 bp, Homo sapiens
cacagatgccatggcctgtgct

SEQ ID NO: 1714927 - DNA, 17 bp, Homo sapiens
cacagatggatttgcct

SEQ ID NO: 1714928 - DNA, 22 bp, Homo sapiens
cacagatgggtattaaacttgt

SEQ ID NO: 1714929 - DNA, 19 bp, Homo sapiens
cacagcacaaacacacctc

SEQ ID NO: 1714930 - DNA, 15 bp, Homo sapiens
cacagcacaccagcc

SEQ ID NO: 1714931 - DNA, 19 bp, Homo sapiens
cacagcaccgggggagagg

SEQ ID NO: 1714932 - DNA, 16 bp, Homo sapiens
cacagcactttggttt

SEQ ID NO: 1714933 - DNA, 16 bp, Homo sapiens
cacagcagcagaacaa

SEQ ID NO: 1714934 - DNA, 23 bp, Homo sapiens
cacagcagcagaacaagtgcctc

SEQ ID NO: 1714935 - DNA, 15 bp, Homo sapiens
cacagcagcttcacc

SEQ ID NO: 1714936 - DNA, 22 bp, Homo sapiens
cacagcagcttcaccagagcat

SEQ ID NO: 1714937 - DNA, 22 bp, Homo sapiens
ggaagggaccaaggcaaggcag

SEQ ID NO: 1714938 - DNA, 12 bp, Homo sapiens
ggaagggatctg

SEQ ID NO: 1714939 - DNA, 12 bp, Homo sapiens
ggaagggcagga

SEQ ID NO: 1714940 - DNA, 21 bp, Homo sapiens
ggaagggcaggaaggagagcc

SEQ ID NO: 1714941 - DNA, 18 bp, Homo sapiens
ggaagggcatgcacgggc

SEQ ID NO: 1714942 - DNA, 11 bp, Homo sapiens
ggaagggccag

SEQ ID NO: 1714943 - DNA, 12 bp, Homo sapiens
ggaagggccagt

SEQ ID NO: 1714944 - DNA, 23 bp, Homo sapiens
ggaagggctttggttccttctct

SEQ ID NO: 1714945 - DNA, 13 bp, Homo sapiens
ggaaggggccacg

SEQ ID NO: 1714946 - DNA, 11 bp, Homo sapiens
ggaaggggctg

SEQ ID NO: 1714947 - DNA, 18 bp, Homo sapiens
ggaagggtttgtggctgg

SEQ ID NO: 1714948 - DNA, 21 bp, Homo sapiens
ggaaggtagcccagcactgtg

SEQ ID NO: 1714949 - DNA, 12 bp, Homo sapiens
ggaaggtggggc

SEQ ID NO: 1714950 - DNA, 15 bp, Homo sapiens
ggaaggtggggccct

SEQ ID NO: 1714951 - DNA, 20 bp, Homo sapiens
ggaaggtggggccctgcccc

SEQ ID NO: 1714952 - DNA, 19 bp, Homo sapiens
ggaaggttagaaaggcagc

SEQ ID NO: 1714953 - DNA, 20 bp, Homo sapiens
ggaaggttagaaaggcagcc

SEQ ID NO: 1714954 - DNA, 17 bp, Homo sapiens
ggaagtaacttttttcc

SEQ ID NO: 1714955 - DNA, 22 bp, Homo sapiens
ggaagtacgagccccacagagc

SEQ ID NO: 1714956 - DNA, 15 bp, Homo sapiens
ggaagtagctgtcag

SEQ ID NO: 1714957 - DNA, 14 bp, Homo sapiens
ggaagtagtccagc

SEQ ID NO: 1714958 - DNA, 19 bp, Homo sapiens
ggaagtcagtacgatcaag

SEQ ID NO: 1714959 - DNA, 20 bp, Homo sapiens
ggaagtcgaggctgcagtca

SEQ ID NO: 1714960 - DNA, 15 bp, Homo sapiens
ggaagtgaggcccaa

SEQ ID NO: 1714961 - DNA, 14 bp, Homo sapiens
ggaagtgcccagcc

SEQ ID NO: 1714962 - DNA, 18 bp, Homo sapiens
ggaagtggcagtgaaaaa

SEQ ID NO: 1714963 - DNA, 13 bp, Homo sapiens
ggaagtggggagt

SEQ ID NO: 1714964 - DNA, 18 bp, Homo sapiens
ggaagtgttcaagaaata

SEQ ID NO: 1714965 - DNA, 22 bp, Homo sapiens
ggaagtgttcaagaaataaaaa

SEQ ID NO: 1714966 - DNA, 17 bp, Homo sapiens
ggaagtgttccctgaga

SEQ ID NO: 1714967 - DNA, 18 bp, Homo sapiens
ggaagtgttccctgagaa

SEQ ID NO: 1714968 - DNA, 16 bp, Homo sapiens
ggaagttgtggatatc

SEQ ID NO: 1714969 - DNA, 17 bp, Homo sapiens
ggaagtttgtgttctgt

SEQ ID NO: 1714970 - DNA, 11 bp, Homo sapiens
ggaataaaaaa

SEQ ID NO: 1714971 - DNA, 17 bp, Homo sapiens
ggaataaaaggcttgaa

SEQ ID NO: 1714972 - DNA, 18 bp, Homo sapiens
ggaataaagttgcagatg

SEQ ID NO: 1714973 - DNA, 18 bp, Homo sapiens
ggaataacatgtaattaa

SEQ ID NO: 1714974 - DNA, 17 bp, Homo sapiens
ggaataacctttctgga

SEQ ID NO: 1714975 - DNA, 18 bp, Homo sapiens
ggaataaggcccagagcg

SEQ ID NO: 1714976 - DNA, 21 bp, Homo sapiens
ggaatagcaaaattcctgtgt

SEQ ID NO: 1714977 - DNA, 16 bp, Homo sapiens
ggaatagccagagagg

SEQ ID NO: 1714978 - DNA, 13 bp, Homo sapiens
ggaatagggagac

SEQ ID NO: 1714979 - DNA, 15 bp, Homo sapiens
ggaatagggagacag

SEQ ID NO: 1714980 - DNA, 16 bp, Homo sapiens
ggaatagttgagcccc

SEQ ID NO: 1714981 - DNA, 17 bp, Homo sapiens
ggaatagttgagcccca

SEQ ID NO: 1714982 - DNA, 22 bp, Homo sapiens
ggaatatgttcaatgcaaagta

SEQ ID NO: 1714983 - DNA, 23 bp, Homo sapiens
ggaatatgttcaatgcaaagtaa

SEQ ID NO: 1714984 - DNA, 21 bp, Homo sapiens
ggaatattttatcctgtattc

SEQ ID NO: 1714985 - DNA, 21 bp, Homo sapiens
ggaatcagacttcacactgca

SEQ ID NO: 1714986 - DNA, 19 bp, Homo sapiens
ggaatccgggacacctggg

SEQ ID NO: 1714987 - DNA, 13 bp, Homo sapiens
ggaatcctggcag

SEQ ID NO: 1714988 - DNA, 21 bp, Homo sapiens
ggaatcctggcagcccagaga

SEQ ID NO: 1714989 - DNA, 21 bp, Homo sapiens
ggaatctagccgatggaaaat

SEQ ID NO: 1714990 - DNA, 21 bp, Homo sapiens
ggaatctgtttctctgctgtc

SEQ ID NO: 1714991 - DNA, 19 bp, Homo sapiens
ggaatcttcacctcagagt

SEQ ID NO: 1714992 - DNA, 22 bp, Homo sapiens
ggaatcttggagcctaaagaga

SEQ ID NO: 1714993 - DNA, 17 bp, Homo sapiens
ggaatgaggaaaattct

SEQ ID NO: 1714994 - DNA, 13 bp, Homo sapiens
ggaatgcagcagg

SEQ ID NO: 1714995 - DNA, 20 bp, Homo sapiens
ggaatgcagggaagagggca

SEQ ID NO: 1714996 - DNA, 23 bp, Homo sapiens
ggaatgcggccgcattccctgag

SEQ ID NO: 1714997 - DNA, 21 bp, Homo sapiens
ggaatggaaaaagcagaaggc

SEQ ID NO: 1714998 - DNA, 17 bp, Homo sapiens
ggaatggatggggagaa

SEQ ID NO: 1714999 - DNA, 16 bp, Homo sapiens
ggaatgtagggcctgc

SEQ ID NO: 1715000 - DNA, 15 bp, Homo sapiens
ggaatgtcagggcca

SEQ ID NO: 1715001 - DNA, 16 bp, Homo sapiens
ggaatgtcagggccag

SEQ ID NO: 1715002 - DNA, 18 bp, Homo sapiens
ggaatgttccctgcaccc

SEQ ID NO: 1715003 - DNA, 19 bp, Homo sapiens
ggaatgttccctgcaccct

SEQ ID NO: 1715004 - DNA, 20 bp, Homo sapiens
ggaatgttccctgcaccctg

SEQ ID NO: 1715005 - DNA, 19 bp, Homo sapiens
ggaattacatgtaaaacat

SEQ ID NO: 1715006 - DNA, 15 bp, Homo sapiens
ggaattcagcaccct

SEQ ID NO: 1715007 - DNA, 16 bp, Homo sapiens
ggaattcagcaccctg

SEQ ID NO: 1715008 - DNA, 18 bp, Homo sapiens
ggaattcctcttttgctt

SEQ ID NO: 1715009 - DNA, 16 bp, Homo sapiens
ggaattctaaataaat

SEQ ID NO: 1715010 - DNA, 20 bp, Homo sapiens
ggaattgcttaccaaaggat

SEQ ID NO: 1715011 - DNA, 12 bp, Homo sapiens
ggaatttcaatg

SEQ ID NO: 1715012 - DNA, 15 bp, Homo sapiens
ggaatttcccaggac

SEQ ID NO: 1715013 - DNA, 19 bp, Homo sapiens
ggaatttcccaggaccctg

SEQ ID NO: 1715014 - DNA, 16 bp, Homo sapiens
ggaatttggtataatt

SEQ ID NO: 1715015 - DNA, 13 bp, Homo sapiens
ggaattttgtaaa

SEQ ID NO: 1715016 - DNA, 20 bp, Homo sapiens
ggaattttgtaaagtttcta

SEQ ID NO: 1715017 - DNA, 13 bp, Homo sapiens
cacaggccctccc

SEQ ID NO: 1715018 - DNA, 17 bp, Homo sapiens
cacaggccctggggagc

SEQ ID NO: 1715019 - DNA, 17 bp, Homo sapiens
cacaggcctctgcctgc

SEQ ID NO: 1715020 - DNA, 19 bp, Homo sapiens
cacaggcctctgcctgctg

SEQ ID NO: 1715021 - DNA, 15 bp, Homo sapiens
cacaggcctgagatt

SEQ ID NO: 1715022 - DNA, 20 bp, Homo sapiens
cacaggcctgagatttcatc

SEQ ID NO: 1715023 - DNA, 14 bp, Homo sapiens
cacaggccttgctt

SEQ ID NO: 1715024 - DNA, 17 bp, Homo sapiens
cacagggcaaggacaca

SEQ ID NO: 1715025 - DNA, 18 bp, Homo sapiens
cacagggcaccagaggcc

SEQ ID NO: 1715026 - DNA, 17 bp, Homo sapiens
cacagggcactgactga

SEQ ID NO: 1715027 - DNA, 17 bp, Homo sapiens
cacagggcagagccggg

SEQ ID NO: 1715028 - DNA, 14 bp, Homo sapiens
cacagggcggtacc

SEQ ID NO: 1715029 - DNA, 13 bp, Homo sapiens
cacagggctaaga

SEQ ID NO: 1715030 - DNA, 18 bp, Homo sapiens
cacaggggcaggcctggg

SEQ ID NO: 1715031 - DNA, 13 bp, Homo sapiens
cacaggggcccca

SEQ ID NO: 1715032 - DNA, 19 bp, Homo sapiens
cacaggggccccagatctg

SEQ ID NO: 1715033 - DNA, 18 bp, Homo sapiens
cacaggggcggggcagga

SEQ ID NO: 1715034 - DNA, 19 bp, Homo sapiens
cacaggggcggggcaggaa

SEQ ID NO: 1715035 - DNA, 17 bp, Homo sapiens
cacagggtctgctcttt

SEQ ID NO: 1715036 - DNA, 15 bp, Homo sapiens
cacagggttttgtat

SEQ ID NO: 1715037 - DNA, 16 bp, Homo sapiens
cacagtacaataatgt

SEQ ID NO: 1715038 - DNA, 17 bp, Homo sapiens
cacagtacaataatgta

SEQ ID NO: 1715039 - DNA, 13 bp, Homo sapiens
cacagtactttat

SEQ ID NO: 1715040 - DNA, 17 bp, Homo sapiens
cacagtactttattgta

SEQ ID NO: 1715041 - DNA, 21 bp, Homo sapiens
cacagtactttattgtacaga

SEQ ID NO: 1715042 - DNA, 24 bp, Homo sapiens
cacagtaggtcccggccagctctg

SEQ ID NO: 1715043 - DNA, 19 bp, Homo sapiens
cacagtcaaggtcacttaa

SEQ ID NO: 1715044 - DNA, 15 bp, Homo sapiens
cacagtcactgctct

SEQ ID NO: 1715045 - DNA, 14 bp, Homo sapiens
cacagtcagaagga

SEQ ID NO: 1715046 - DNA, 21 bp, Homo sapiens
cacagtcagaaggacggcagg

SEQ ID NO: 1715047 - DNA, 13 bp, Homo sapiens
cacagtcagtgga

SEQ ID NO: 1715048 - DNA, 22 bp, Homo sapiens
cacagtctctttaatcttcagt

SEQ ID NO: 1715049 - DNA, 11 bp, Homo sapiens
cacagtgaccc

SEQ ID NO: 1715050 - DNA, 17 bp, Homo sapiens
cacagtgacccttccca

SEQ ID NO: 1715051 - DNA, 16 bp, Homo sapiens
cacagtgacttctgag

SEQ ID NO: 1715052 - DNA, 19 bp, Homo sapiens
cacagtgccaggaaagagt

SEQ ID NO: 1715053 - DNA, 17 bp, Homo sapiens
cacagtgcccacctgct

SEQ ID NO: 1715054 - DNA, 12 bp, Homo sapiens
cacagtgctgct

SEQ ID NO: 1715055 - DNA, 15 bp, Homo sapiens
cacagtgctgcttct

SEQ ID NO: 1715056 - DNA, 16 bp, Homo sapiens
ggacagcccacggtct

SEQ ID NO: 1715057 - DNA, 20 bp, Homo sapiens
ggacagcccacggtctggag

SEQ ID NO: 1715058 - DNA, 21 bp, Homo sapiens
ggacagcccacggtctggagg

SEQ ID NO: 1715059 - DNA, 22 bp, Homo sapiens
ggacagcccacggtctggaggc

SEQ ID NO: 1715060 - DNA, 14 bp, Homo sapiens
ggacagcccagagc

SEQ ID NO: 1715061 - DNA, 18 bp, Homo sapiens
ggacagcccagagcctgg

SEQ ID NO: 1715062 - DNA, 17 bp, Homo sapiens
ggacagccccaccctgg

SEQ ID NO: 1715063 - DNA, 11 bp, Homo sapiens
ggacagccccc

SEQ ID NO: 1715064 - DNA, 12 bp, Homo sapiens
ggacagctgctt

SEQ ID NO: 1715065 - DNA, 12 bp, Homo sapiens
ggacagctgtgt

SEQ ID NO: 1715066 - DNA, 22 bp, Homo sapiens
ggacagctttgctccgctccca

SEQ ID NO: 1715067 - DNA, 19 bp, Homo sapiens
ggacaggaggcggcccggc

SEQ ID NO: 1715068 - DNA, 13 bp, Homo sapiens
ggacaggatctat

SEQ ID NO: 1715069 - DNA, 23 bp, Homo sapiens
ggacaggcccagcgcggccagcg

SEQ ID NO: 1715070 - DNA, 22 bp, Homo sapiens
ggacaggcccggcgcggtggct

SEQ ID NO: 1715071 - DNA, 18 bp, Homo sapiens
ggacaggctgaagagagg

SEQ ID NO: 1715072 - DNA, 23 bp, Homo sapiens
ggacaggctgaagagagggacag

SEQ ID NO: 1715073 - DNA, 19 bp, Homo sapiens
ggacagtacctgattgtat

SEQ ID NO: 1715074 - DNA, 18 bp, Homo sapiens
ggacagtatttgtgggga

SEQ ID NO: 1715075 - DNA, 19 bp, Homo sapiens
ggacagtatttgtggggag

SEQ ID NO: 1715076 - DNA, 13 bp, Homo sapiens
ggacagtcctggg

SEQ ID NO: 1715077 - DNA, 17 bp, Homo sapiens
ggacagtgcttcagcct

SEQ ID NO: 1715078 - DNA, 18 bp, Homo sapiens
ggacagtgcttcagcctg

SEQ ID NO: 1715079 - DNA, 20 bp, Homo sapiens
ggacagtgcttcagcctgag

SEQ ID NO: 1715080 - DNA, 23 bp, Homo sapiens
ggacagtgcttcagcctgaggct

SEQ ID NO: 1715081 - DNA, 16 bp, Homo sapiens
ggacagttggcagaga

SEQ ID NO: 1715082 - DNA, 23 bp, Homo sapiens
ggacagtttaccagttgcctttt

SEQ ID NO: 1715083 - DNA, 23 bp, Homo sapiens
ggacatcgtaggcagccacggcc

SEQ ID NO: 1715084 - DNA, 11 bp, Homo sapiens
ggacatgagat

SEQ ID NO: 1715085 - DNA, 18 bp, Homo sapiens
ggacatgcaataaaattt

SEQ ID NO: 1715086 - DNA, 20 bp, Homo sapiens
ggacatgcttttctgccact

SEQ ID NO: 1715087 - DNA, 12 bp, Homo sapiens
ggacattctctt

SEQ ID NO: 1715088 - DNA, 16 bp, Homo sapiens
ggacattctctttgat

SEQ ID NO: 1715089 - DNA, 21 bp, Homo sapiens
ggacattctctttgataacaa

SEQ ID NO: 1715090 - DNA, 22 bp, Homo sapiens
ggacattctctttgataacaaa

SEQ ID NO: 1715091 - DNA, 11 bp, Homo sapiens
ggacattgaga

SEQ ID NO: 1715092 - DNA, 18 bp, Homo sapiens
ggacattgctctctgggc

SEQ ID NO: 1715093 - DNA, 17 bp, Homo sapiens
ggaccaaccctggggaa

SEQ ID NO: 1715094 - DNA, 13 bp, Homo sapiens
ggaccaactggct

SEQ ID NO: 1715095 - DNA, 16 bp, Homo sapiens
ggaccaactggcttct

SEQ ID NO: 1715096 - DNA, 18 bp, Homo sapiens
ggaccaactggcttctgt

SEQ ID NO: 1715097 - DNA, 19 bp, Homo sapiens
ggaccaactggcttctgtg

SEQ ID NO: 1715098 - DNA, 23 bp, Homo sapiens
ggaccaactggcttctgtgcact

SEQ ID NO: 1715099 - DNA, 15 bp, Homo sapiens
ggaccaaggcaaggc

SEQ ID NO: 1715100 - DNA, 21 bp, Homo sapiens
ggaccacagctgctggccagg

SEQ ID NO: 1715101 - DNA, 22 bp, Homo sapiens
ggaccacagctgctggccaggg

SEQ ID NO: 1715102 - DNA, 22 bp, Homo sapiens
ggaccacaggcatctacacagc

SEQ ID NO: 1715103 - DNA, 15 bp, Homo sapiens
ggaccaccagcaggc

SEQ ID NO: 1715104 - DNA, 16 bp, Homo sapiens
ggaccaccagcaggca

SEQ ID NO: 1715105 - DNA, 21 bp, Homo sapiens
ggaccaccagcaggcaggtgg

SEQ ID NO: 1715106 - DNA, 15 bp, Homo sapiens
ggaccaccagcccca

SEQ ID NO: 1715107 - DNA, 17 bp, Homo sapiens
ggaccaccagccccagc

SEQ ID NO: 1715108 - DNA, 13 bp, Homo sapiens
ggaccactcctgt

SEQ ID NO: 1715109 - DNA, 19 bp, Homo sapiens
ggaccagaagccaaagact

SEQ ID NO: 1715110 - DNA, 23 bp, Homo sapiens
ggaccagaatgaaaactgtaaat

SEQ ID NO: 1715111 - DNA, 12 bp, Homo sapiens
ggaccagagcca

SEQ ID NO: 1715112 - DNA, 13 bp, Homo sapiens
ggaccagagccag

SEQ ID NO: 1715113 - DNA, 16 bp, Homo sapiens
ggaccagagccagatg

SEQ ID NO: 1715114 - DNA, 15 bp, Homo sapiens
ggaccagcctgtacc

SEQ ID NO: 1715115 - DNA, 14 bp, Homo sapiens
ggaccaggacagga

SEQ ID NO: 1715116 - DNA, 17 bp, Homo sapiens
ggaccaggacaggacca

SEQ ID NO: 1715117 - DNA, 11 bp, Homo sapiens
ggaccaggagc

SEQ ID NO: 1715118 - DNA, 12 bp, Homo sapiens
ggaccagggcct

SEQ ID NO: 1715119 - DNA, 16 bp, Homo sapiens
ggaccagtcccacacc

SEQ ID NO: 1715120 - DNA, 13 bp, Homo sapiens
ggaccagtggctg

SEQ ID NO: 1715121 - DNA, 22 bp, Homo sapiens
ggaccagtggtttccagtcatg

SEQ ID NO: 1715122 - DNA, 21 bp, Homo sapiens
ggaccattgacctcagctgca

SEQ ID NO: 1715123 - DNA, 24 bp, Homo sapiens
ggaccattgacctcagctgcacat

SEQ ID NO: 1715124 - DNA, 10 bp, Homo sapiens
ggacccacca

SEQ ID NO: 1715125 - DNA, 23 bp, Homo sapiens
ggacccacccatcttcctgctgc

SEQ ID NO: 1715126 - DNA, 12 bp, Homo sapiens
ggacccacccca

SEQ ID NO: 1715127 - DNA, 22 bp, Homo sapiens
ggacccaccccaactctcccca

SEQ ID NO: 1715128 - DNA, 19 bp, Homo sapiens
ggacccactacccttctcc

SEQ ID NO: 1715129 - DNA, 22 bp, Homo sapiens
ggacccactacccttctccttt

SEQ ID NO: 1715130 - DNA, 13 bp, Homo sapiens
ggacccagctact

SEQ ID NO: 1715131 - DNA, 14 bp, Homo sapiens
ggacccagctactc

SEQ ID NO: 1715132 - DNA, 17 bp, Homo sapiens
ggagaaagagctgcctg

SEQ ID NO: 1715133 - DNA, 19 bp, Homo sapiens
ggagaaagagctgcctgga

SEQ ID NO: 1715134 - DNA, 22 bp, Homo sapiens
ggagaaagagctgcctggatga

SEQ ID NO: 1715135 - DNA, 16 bp, Homo sapiens
ggagaaataaattttg

SEQ ID NO: 1715136 - DNA, 21 bp, Homo sapiens
ggagaacagtggttgcctggg

SEQ ID NO: 1715137 - DNA, 11 bp, Homo sapiens
ggagaaccagg

SEQ ID NO: 1715138 - DNA, 13 bp, Homo sapiens
ggagaactagaga

SEQ ID NO: 1715139 - DNA, 13 bp, Homo sapiens
ggagaagaagaat

SEQ ID NO: 1715140 - DNA, 14 bp, Homo sapiens
ggagaagaatggct

SEQ ID NO: 1715141 - DNA, 22 bp, Homo sapiens
ggagaagaattttcagacccca

SEQ ID NO: 1715142 - DNA, 14 bp, Homo sapiens
ggagaagacaacag

SEQ ID NO: 1715143 - DNA, 23 bp, Homo sapiens
ggagaagagctgttcacagccag

SEQ ID NO: 1715144 - DNA, 21 bp, Homo sapiens
ggagaagcacagctcctgcca

SEQ ID NO: 1715145 - DNA, 19 bp, Homo sapiens
ggagaagcagtgagccgca

SEQ ID NO: 1715146 - DNA, 13 bp, Homo sapiens
ggagaagccacct

SEQ ID NO: 1715147 - DNA, 13 bp, Homo sapiens
ggagaagccagga

SEQ ID NO: 1715148 - DNA, 15 bp, Homo sapiens
ggagaagctctgttt

SEQ ID NO: 1715149 - DNA, 22 bp, Homo sapiens
ggagaaggaaggagactcacct

SEQ ID NO: 1715150 - DNA, 17 bp, Homo sapiens
ggagaaggaagggcaga

SEQ ID NO: 1715151 - DNA, 18 bp, Homo sapiens
ggagaaggaagggcagag

SEQ ID NO: 1715152 - DNA, 22 bp, Homo sapiens
ggagaaggccgctgccccagcc

SEQ ID NO: 1715153 - DNA, 13 bp, Homo sapiens
ggagaagggctgg

SEQ ID NO: 1715154 - DNA, 20 bp, Homo sapiens
ggagaagggggctctgcccc

SEQ ID NO: 1715155 - DNA, 21 bp, Homo sapiens
ggagaagtgatatggtgaagg

SEQ ID NO: 1715156 - DNA, 18 bp, Homo sapiens
ggagaatagcagagagcc

SEQ ID NO: 1715157 - DNA, 12 bp, Homo sapiens
ggagaatatgat

SEQ ID NO: 1715158 - DNA, 20 bp, Homo sapiens
ggagaatcatgtttctttga

SEQ ID NO: 1715159 - DNA, 19 bp, Homo sapiens
ggagaatcctcccttccca

SEQ ID NO: 1715160 - DNA, 17 bp, Homo sapiens
ggagacaccctctgggg

SEQ ID NO: 1715161 - DNA, 19 bp, Homo sapiens
ggagacaccctctgggggt

SEQ ID NO: 1715162 - DNA, 18 bp, Homo sapiens
ggagacagaaagcctccg

SEQ ID NO: 1715163 - DNA, 17 bp, Homo sapiens
ggagacagaatagagtg

SEQ ID NO: 1715164 - DNA, 23 bp, Homo sapiens
ggagacagagccaagcactgctc

SEQ ID NO: 1715165 - DNA, 11 bp, Homo sapiens
ggagacagcag

SEQ ID NO: 1715166 - DNA, 19 bp, Homo sapiens
ggagacagggtaggaaagg

SEQ ID NO: 1715167 - DNA, 21 bp, Homo sapiens
ggagaccacactgcacacagt

SEQ ID NO: 1715168 - DNA, 15 bp, Homo sapiens
ggagaccctccccac

SEQ ID NO: 1715169 - DNA, 21 bp, Homo sapiens
ggagaccgcttcacccctgca

SEQ ID NO: 1715170 - DNA, 22 bp, Homo sapiens
ggagaccgcttcacccctgcac

SEQ ID NO: 1715171 - DNA, 15 bp, Homo sapiens
ggagacctgctctcc

SEQ ID NO: 1715172 - DNA, 16 bp, Homo sapiens
ggagacctgctctccg

SEQ ID NO: 1715173 - DNA, 13 bp, Homo sapiens
ggagacctgtgct

SEQ ID NO: 1715174 - DNA, 17 bp, Homo sapiens
cacagtgctgcttctct

SEQ ID NO: 1715175 - DNA, 22 bp, Homo sapiens
cacagtgctttccgtggcactg

SEQ ID NO: 1715176 - DNA, 20 bp, Homo sapiens
cacagtggcacaaaaaaata

SEQ ID NO: 1715177 - DNA, 15 bp, Homo sapiens
cacagtggctcacgc

SEQ ID NO: 1715178 - DNA, 14 bp, Homo sapiens
cacagtgggaactc

SEQ ID NO: 1715179 - DNA, 19 bp, Homo sapiens
cacagtgggagccagggct

SEQ ID NO: 1715180 - DNA, 14 bp, Homo sapiens
cacagtgggagctg

SEQ ID NO: 1715181 - DNA, 17 bp, Homo sapiens
cacagtgggagctgagc

SEQ ID NO: 1715182 - DNA, 16 bp, Homo sapiens
cacagtgggcctgtgt

SEQ ID NO: 1715183 - DNA, 20 bp, Homo sapiens
cacagtgtaatccaggggtg

SEQ ID NO: 1715184 - DNA, 21 bp, Homo sapiens
cacagtgtgtgacttacagaa

SEQ ID NO: 1715185 - DNA, 16 bp, Homo sapiens
cacagtgttagtgctg

SEQ ID NO: 1715186 - DNA, 21 bp, Homo sapiens
cacagtgtttttattgctcgc

SEQ ID NO: 1715187 - DNA, 22 bp, Homo sapiens
cacagttcctcgccctgggtct

SEQ ID NO: 1715188 - DNA, 19 bp, Homo sapiens
cacagttctttgggccaga

SEQ ID NO: 1715189 - DNA, 20 bp, Homo sapiens
cacagttctttgggccagac

SEQ ID NO: 1715190 - DNA, 23 bp, Homo sapiens
cacagttgaagggaggggctgtg

SEQ ID NO: 1715191 - DNA, 22 bp, Homo sapiens
cacagttgggacccaaaacaca

SEQ ID NO: 1715192 - DNA, 21 bp, Homo sapiens
cacagttgtctattctgagcc

SEQ ID NO: 1715193 - DNA, 17 bp, Homo sapiens
cacagttttaataagaa

SEQ ID NO: 1715194 - DNA, 19 bp, Homo sapiens
cacagttttaataagaaca

SEQ ID NO: 1715195 - DNA, 16 bp, Homo sapiens
cacataaaagccccag

SEQ ID NO: 1715196 - DNA, 20 bp, Homo sapiens
cacataaaagccccagcttg

SEQ ID NO: 1715197 - DNA, 21 bp, Homo sapiens
cacataccaggcaacctccca

SEQ ID NO: 1715198 - DNA, 18 bp, Homo sapiens
cacatacggcagacctct

SEQ ID NO: 1715199 - DNA, 22 bp, Homo sapiens
cacatacgtgagggggagctga

SEQ ID NO: 1715200 - DNA, 16 bp, Homo sapiens
cacatacgtgttagga

SEQ ID NO: 1715201 - DNA, 20 bp, Homo sapiens
cacatacgtgttaggaggct

SEQ ID NO: 1715202 - DNA, 17 bp, Homo sapiens
cacatactgtgttccaa

SEQ ID NO: 1715203 - DNA, 21 bp, Homo sapiens
cacatagaaagtaaataaaag

SEQ ID NO: 1715204 - DNA, 18 bp, Homo sapiens
cacatagattaatggcac

SEQ ID NO: 1715205 - DNA, 15 bp, Homo sapiens
cacatagccaactct

SEQ ID NO: 1715206 - DNA, 18 bp, Homo sapiens
cacataggctggtggcct

SEQ ID NO: 1715207 - DNA, 21 bp, Homo sapiens
cacatagtgatggttcccctg

SEQ ID NO: 1715208 - DNA, 14 bp, Homo sapiens
cacatatatattac

SEQ ID NO: 1715209 - DNA, 19 bp, Homo sapiens
cacatatccaggcaccagg

SEQ ID NO: 1715210 - DNA, 18 bp, Homo sapiens
cacatatgcaccttgtgt

SEQ ID NO: 1715211 - DNA, 15 bp, Homo sapiens
cacatattttaaaat

SEQ ID NO: 1715212 - DNA, 14 bp, Homo sapiens
cacatcaaaccttt

SEQ ID NO: 1715213 - DNA, 16 bp, Homo sapiens
cacatcaaatatttct

SEQ ID NO: 1715214 - DNA, 17 bp, Homo sapiens
cacatcaaatatttctt

SEQ ID NO: 1715215 - DNA, 19 bp, Homo sapiens
cacatcacacccatttaaa

SEQ ID NO: 1715216 - DNA, 13 bp, Homo sapiens
cacatcacctctt

SEQ ID NO: 1715217 - DNA, 18 bp, Homo sapiens
cacatcacctctttgccc

SEQ ID NO: 1715218 - DNA, 23 bp, Homo sapiens
cacatcagcttgccctgttaaaa

SEQ ID NO: 1715219 - DNA, 16 bp, Homo sapiens
cacatcagtgaggagg

SEQ ID NO: 1715220 - DNA, 12 bp, Homo sapiens
cacatccaactc

SEQ ID NO: 1715221 - DNA, 16 bp, Homo sapiens
cacatccatccctcca

SEQ ID NO: 1715222 - DNA, 21 bp, Homo sapiens
cacatccatttcatctatttc

SEQ ID NO: 1715223 - DNA, 13 bp, Homo sapiens
cacatcccaggag

SEQ ID NO: 1715224 - DNA, 18 bp, Homo sapiens
cacatccccagagcccag

SEQ ID NO: 1715225 - DNA, 19 bp, Homo sapiens
cacatccccagagcccagc

SEQ ID NO: 1715226 - DNA, 15 bp, Homo sapiens
cacatcccggcctct

SEQ ID NO: 1715227 - DNA, 19 bp, Homo sapiens
cacatcccggcctcttcca

SEQ ID NO: 1715228 - DNA, 14 bp, Homo sapiens
cacatcctccgtcc

SEQ ID NO: 1715229 - DNA, 15 bp, Homo sapiens
cacatcctttctaaa

SEQ ID NO: 1715230 - DNA, 13 bp, Homo sapiens
cacatcgttttgg

SEQ ID NO: 1715231 - DNA, 22 bp, Homo sapiens
cacatctggccctgacttctgg

SEQ ID NO: 1715232 - DNA, 21 bp, Homo sapiens
cacatcttggctatgtaattc

SEQ ID NO: 1715233 - DNA, 13 bp, Homo sapiens
cacatgaaagttt

SEQ ID NO: 1715234 - DNA, 24 bp, Homo sapiens
cacatgaatcccacccacatgtga

SEQ ID NO: 1715235 - DNA, 19 bp, Homo sapiens
cacatgacttattatgcat

SEQ ID NO: 1715236 - DNA, 17 bp, Homo sapiens
cacatgagaatgctagc

SEQ ID NO: 1715237 - DNA, 16 bp, Homo sapiens
cacatgaggccatctc

SEQ ID NO: 1715238 - DNA, 18 bp, Homo sapiens
cacatgagtcaaaacaaa

SEQ ID NO: 1715239 - DNA, 17 bp, Homo sapiens
cacatgagttcttgaag

SEQ ID NO: 1715240 - DNA, 14 bp, Homo sapiens
cacatgccccaggc

SEQ ID NO: 1715241 - DNA, 13 bp, Homo sapiens
cacatgccttgca

SEQ ID NO: 1715242 - DNA, 15 bp, Homo sapiens
cacatgctatgttct

SEQ ID NO: 1715243 - DNA, 20 bp, Homo sapiens
cacatgcttgaatggagctg

SEQ ID NO: 1715244 - DNA, 17 bp, Homo sapiens
cacatggaaggtgatgg

SEQ ID NO: 1715245 - DNA, 22 bp, Homo sapiens
cacatggacagacttcacagcg

SEQ ID NO: 1715246 - DNA, 19 bp, Homo sapiens
atgctttattaatgttttc

SEQ ID NO: 1715247 - DNA, 17 bp, Homo sapiens
atgctttgaacatctct

SEQ ID NO: 1715248 - DNA, 18 bp, Homo sapiens
atgctttgggaggccaag

SEQ ID NO: 1715249 - DNA, 21 bp, Homo sapiens
atgctttgggaggccaaggca

SEQ ID NO: 1715250 - DNA, 18 bp, Homo sapiens
atgcttttgcttgcaatg

SEQ ID NO: 1715251 - DNA, 17 bp, Homo sapiens
atgcttttggaagttaa

SEQ ID NO: 1715252 - DNA, 18 bp, Homo sapiens
atgcttttggaagttaaa

SEQ ID NO: 1715253 - DNA, 20 bp, Homo sapiens
atggaaaaggaagactagag

SEQ ID NO: 1715254 - DNA, 14 bp, Homo sapiens
atggaaaataaaca

SEQ ID NO: 1715255 - DNA, 16 bp, Homo sapiens
atggaaaataaacatc

SEQ ID NO: 1715256 - DNA, 20 bp, Homo sapiens
atggaaaatacctaattgtg

SEQ ID NO: 1715257 - DNA, 20 bp, Homo sapiens
atggaaaatgccatgaatta

SEQ ID NO: 1715258 - DNA, 13 bp, Homo sapiens
atggaaacggtga

SEQ ID NO: 1715259 - DNA, 20 bp, Homo sapiens
atggaaactggccaggggtc

SEQ ID NO: 1715260 - DNA, 15 bp, Homo sapiens
atggaaagacaaact

SEQ ID NO: 1715261 - DNA, 11 bp, Homo sapiens
atggaaagttg

SEQ ID NO: 1715262 - DNA, 14 bp, Homo sapiens
atggaaagttgtat

SEQ ID NO: 1715263 - DNA, 14 bp, Homo sapiens
atggaacacttcga

SEQ ID NO: 1715264 - DNA, 15 bp, Homo sapiens
atggaactactgtac

SEQ ID NO: 1715265 - DNA, 17 bp, Homo sapiens
atggaactactgtactt

SEQ ID NO: 1715266 - DNA, 14 bp, Homo sapiens
atggaactgacccc

SEQ ID NO: 1715267 - DNA, 13 bp, Homo sapiens
atggaagaaagta

SEQ ID NO: 1715268 - DNA, 14 bp, Homo sapiens
atggaagaaagtaa

SEQ ID NO: 1715269 - DNA, 20 bp, Homo sapiens
atggaagaggaaaaggctgg

SEQ ID NO: 1715270 - DNA, 22 bp, Homo sapiens
atggaagatggtccgtgcccag

SEQ ID NO: 1715271 - DNA, 20 bp, Homo sapiens
atggaagcctgaactgaggc

SEQ ID NO: 1715272 - DNA, 17 bp, Homo sapiens
atggaaggggcttctgg

SEQ ID NO: 1715273 - DNA, 16 bp, Homo sapiens
atggaagggtttgtgg

SEQ ID NO: 1715274 - DNA, 14 bp, Homo sapiens
atggaatagttctg

SEQ ID NO: 1715275 - DNA, 16 bp, Homo sapiens
atggaatagttctgta

SEQ ID NO: 1715276 - DNA, 17 bp, Homo sapiens
atggaatagttctgtat

SEQ ID NO: 1715277 - DNA, 21 bp, Homo sapiens
atggaatgatgggtcagttgt

SEQ ID NO: 1715278 - DNA, 21 bp, Homo sapiens
atggaatgctgtgttaaataa

SEQ ID NO: 1715279 - DNA, 15 bp, Homo sapiens
atggaatggaaaagc

SEQ ID NO: 1715280 - DNA, 23 bp, Homo sapiens
atggaattattttgaatgtcaca

SEQ ID NO: 1715281 - DNA, 21 bp, Homo sapiens
atggaatttaatgctgaatat

SEQ ID NO: 1715282 - DNA, 13 bp, Homo sapiens
atggaatttggaa

SEQ ID NO: 1715283 - DNA, 17 bp, Homo sapiens
atggaattttgcaaaga

SEQ ID NO: 1715284 - DNA, 17 bp, Homo sapiens
atggacaacttatttaa

SEQ ID NO: 1715285 - DNA, 14 bp, Homo sapiens
atggacacgagcca

SEQ ID NO: 1715286 - DNA, 14 bp, Homo sapiens
atggacatgatctt

SEQ ID NO: 1715287 - DNA, 17 bp, Homo sapiens
atggacatttagaagaa

SEQ ID NO: 1715288 - DNA, 18 bp, Homo sapiens
atggacccaagataaaag

SEQ ID NO: 1715289 - DNA, 20 bp, Homo sapiens
atggacccaagataaaagaa

SEQ ID NO: 1715290 - DNA, 22 bp, Homo sapiens
atggacccacgaacgctcttag

SEQ ID NO: 1715291 - DNA, 14 bp, Homo sapiens
atggaccccagcat

SEQ ID NO: 1715292 - DNA, 23 bp, Homo sapiens
atggaccgggtgggcctggcctg

SEQ ID NO: 1715293 - DNA, 12 bp, Homo sapiens
atggacctaaca

SEQ ID NO: 1715294 - DNA, 18 bp, Homo sapiens
atggactctgaaaaacat

SEQ ID NO: 1715295 - DNA, 15 bp, Homo sapiens
atggactctgcacat

SEQ ID NO: 1715296 - DNA, 20 bp, Homo sapiens
atggacttgtgattggctgc

SEQ ID NO: 1715297 - DNA, 22 bp, Homo sapiens
atggacttgtgattggctgcag

SEQ ID NO: 1715298 - DNA, 14 bp, Homo sapiens
atggagaaaccctg

SEQ ID NO: 1715299 - DNA, 13 bp, Homo sapiens
atggagaaagaag

SEQ ID NO: 1715300 - DNA, 18 bp, Homo sapiens
atggagaagggttctgcc

SEQ ID NO: 1715301 - DNA, 21 bp, Homo sapiens
atggagaagggttctgccctg

SEQ ID NO: 1715302 - DNA, 17 bp, Homo sapiens
atggagacaccctctgg

SEQ ID NO: 1715303 - DNA, 20 bp, Homo sapiens
atggagacaccctctggggg

SEQ ID NO: 1715304 - DNA, 15 bp, Homo sapiens
atggagagaggggaa

SEQ ID NO: 1715305 - DNA, 14 bp, Homo sapiens
atggagaggctgag

SEQ ID NO: 1715306 - DNA, 21 bp, Homo sapiens
atggagccagctctgcattat

SEQ ID NO: 1715307 - DNA, 13 bp, Homo sapiens
atggagccccacc

SEQ ID NO: 1715308 - DNA, 15 bp, Homo sapiens
atggagccccacctt

SEQ ID NO: 1715309 - DNA, 14 bp, Homo sapiens
atggagcctgctct

SEQ ID NO: 1715310 - DNA, 22 bp, Homo sapiens
atggagcctggcacaggactga

SEQ ID NO: 1715311 - DNA, 23 bp, Homo sapiens
atggagcgcacctgccccctggt

SEQ ID NO: 1715312 - DNA, 12 bp, Homo sapiens
atggaggaaaaa

SEQ ID NO: 1715313 - DNA, 22 bp, Homo sapiens
atggaggaaaaccaagccgtgg

SEQ ID NO: 1715314 - DNA, 18 bp, Homo sapiens
atggaggaagaacaacaa

SEQ ID NO: 1715315 - DNA, 13 bp, Homo sapiens
atggaggaatatg

SEQ ID NO: 1715316 - DNA, 16 bp, Homo sapiens
atggaggactctcctc

SEQ ID NO: 1715317 - DNA, 17 bp, Homo sapiens
atggaggactctcctct

SEQ ID NO: 1715318 - DNA, 21 bp, Homo sapiens
gccagccttcctctgcagctg

SEQ ID NO: 1715319 - DNA, 18 bp, Homo sapiens
gccagccttgagccctgg

SEQ ID NO: 1715320 - DNA, 19 bp, Homo sapiens
gccagccttgagccctggc

SEQ ID NO: 1715321 - DNA, 15 bp, Homo sapiens
gccagccttggagga

SEQ ID NO: 1715322 - DNA, 16 bp, Homo sapiens
gccagccttggaggat

SEQ ID NO: 1715323 - DNA, 16 bp, Homo sapiens
gccagcgaacttgaca

SEQ ID NO: 1715324 - DNA, 13 bp, Homo sapiens
gccagcgctgtgg

SEQ ID NO: 1715325 - DNA, 13 bp, Homo sapiens
gccagcgggcaca

SEQ ID NO: 1715326 - DNA, 15 bp, Homo sapiens
gccagcgggcacagg

SEQ ID NO: 1715327 - DNA, 20 bp, Homo sapiens
gccagcgggcacagggcacc

SEQ ID NO: 1715328 - DNA, 15 bp, Homo sapiens
gccagcgtcccaggg

SEQ ID NO: 1715329 - DNA, 17 bp, Homo sapiens
gccagcgtctgttgtgg

SEQ ID NO: 1715330 - DNA, 16 bp, Homo sapiens
gccagcgtggcgcagt

SEQ ID NO: 1715331 - DNA, 18 bp, Homo sapiens
gccagcgtgtggagcaga

SEQ ID NO: 1715332 - DNA, 17 bp, Homo sapiens
gccagctcctgggcagc

SEQ ID NO: 1715333 - DNA, 21 bp, Homo sapiens
gccagctctagttttcagcct

SEQ ID NO: 1715334 - DNA, 17 bp, Homo sapiens
gccagctctgaggggag

SEQ ID NO: 1715335 - DNA, 20 bp, Homo sapiens
gccagctctgaggggaggca

SEQ ID NO: 1715336 - DNA, 23 bp, Homo sapiens
gccagctctgaggggaggcacct

SEQ ID NO: 1715337 - DNA, 20 bp, Homo sapiens
gccagctgcactgatgctgc

SEQ ID NO: 1715338 - DNA, 20 bp, Homo sapiens
gccagctgccctatgggcct

SEQ ID NO: 1715339 - DNA, 14 bp, Homo sapiens
gccagctgccgcac

SEQ ID NO: 1715340 - DNA, 17 bp, Homo sapiens
gccagctgccgcaccag

SEQ ID NO: 1715341 - DNA, 15 bp, Homo sapiens
gccagctgcttgacc

SEQ ID NO: 1715342 - DNA, 17 bp, Homo sapiens
gccagctgggagcactg

SEQ ID NO: 1715343 - DNA, 15 bp, Homo sapiens
gccagctgggcccag

SEQ ID NO: 1715344 - DNA, 14 bp, Homo sapiens
gccagctgtgcact

SEQ ID NO: 1715345 - DNA, 18 bp, Homo sapiens
gccagcttctctctccag

SEQ ID NO: 1715346 - DNA, 22 bp, Homo sapiens
gccagcttctctctccagggtg

SEQ ID NO: 1715347 - DNA, 18 bp, Homo sapiens
gccaggaatttcccagga

SEQ ID NO: 1715348 - DNA, 20 bp, Homo sapiens
gccaggaatttcccaggacc

SEQ ID NO: 1715349 - DNA, 15 bp, Homo sapiens
gccaggacaccgggc

SEQ ID NO: 1715350 - DNA, 14 bp, Homo sapiens
gccaggacaggccc

SEQ ID NO: 1715351 - DNA, 17 bp, Homo sapiens
gccaggacccgccagcc

SEQ ID NO: 1715352 - DNA, 23 bp, Homo sapiens
gccaggaccctgacctccgcccc

SEQ ID NO: 1715353 - DNA, 12 bp, Homo sapiens
gccaggagaagc

SEQ ID NO: 1715354 - DNA, 13 bp, Homo sapiens
gccaggagaagct

SEQ ID NO: 1715355 - DNA, 19 bp, Homo sapiens
gccaggagaagctcagctg

SEQ ID NO: 1715356 - DNA, 13 bp, Homo sapiens
gccaggagcagat

SEQ ID NO: 1715357 - DNA, 21 bp, Homo sapiens
gccaggagcaggcacgggtgg

SEQ ID NO: 1715358 - DNA, 14 bp, Homo sapiens
gccaggagccgggc

SEQ ID NO: 1715359 - DNA, 18 bp, Homo sapiens
gccaggagccgggcctcc

SEQ ID NO: 1715360 - DNA, 20 bp, Homo sapiens
gccaggagctcttcaggcct

SEQ ID NO: 1715361 - DNA, 22 bp, Homo sapiens
gccaggagctcttcaggcctcc

SEQ ID NO: 1715362 - DNA, 23 bp, Homo sapiens
gccaggaggttggtgactgaaac

SEQ ID NO: 1715363 - DNA, 12 bp, Homo sapiens
gccaggatgccc

SEQ ID NO: 1715364 - DNA, 23 bp, Homo sapiens
gccaggatggtctcgatctcctg

SEQ ID NO: 1715365 - DNA, 18 bp, Homo sapiens
atggcagtcctggaggca

SEQ ID NO: 1715366 - DNA, 18 bp, Homo sapiens
atggcatatttttcacat

SEQ ID NO: 1715367 - DNA, 20 bp, Homo sapiens
atggcatatttttcacatat

SEQ ID NO: 1715368 - DNA, 23 bp, Homo sapiens
atggcatatttttcacatatcta

SEQ ID NO: 1715369 - DNA, 16 bp, Homo sapiens
atggcatcttcaatat

SEQ ID NO: 1715370 - DNA, 23 bp, Homo sapiens
atggcatgattagattgcaaagc

SEQ ID NO: 1715371 - DNA, 21 bp, Homo sapiens
atggcatttggtctcaggcag

SEQ ID NO: 1715372 - DNA, 22 bp, Homo sapiens
atggcatttggtctcaggcagc

SEQ ID NO: 1715373 - DNA, 15 bp, Homo sapiens
atggccacatttaat

SEQ ID NO: 1715374 - DNA, 15 bp, Homo sapiens
atggccaggccaggg

SEQ ID NO: 1715375 - DNA, 16 bp, Homo sapiens
atggccatagaggccc

SEQ ID NO: 1715376 - DNA, 16 bp, Homo sapiens
atggccatgcaggagg

SEQ ID NO: 1715377 - DNA, 22 bp, Homo sapiens
atggccatggagtgtacaagta

SEQ ID NO: 1715378 - DNA, 15 bp, Homo sapiens
atggccccagcacag

SEQ ID NO: 1715379 - DNA, 18 bp, Homo sapiens
atggccccatctggatgt

SEQ ID NO: 1715380 - DNA, 22 bp, Homo sapiens
atggccccatctggatgtaaat

SEQ ID NO: 1715381 - DNA, 15 bp, Homo sapiens
atggcccccaataaa

SEQ ID NO: 1715382 - DNA, 21 bp, Homo sapiens
atggcccccaataaaggcagc

SEQ ID NO: 1715383 - DNA, 13 bp, Homo sapiens
atggcccccaggg

SEQ ID NO: 1715384 - DNA, 21 bp, Homo sapiens
atggccctcggaggtccagct

SEQ ID NO: 1715385 - DNA, 22 bp, Homo sapiens
atggccctcggaggtccagctg

SEQ ID NO: 1715386 - DNA, 20 bp, Homo sapiens
atggcctattatattaaaat

SEQ ID NO: 1715387 - DNA, 17 bp, Homo sapiens
atggcctcagctgcctc

SEQ ID NO: 1715388 - DNA, 19 bp, Homo sapiens
atggcctcatgtggctgga

SEQ ID NO: 1715389 - DNA, 17 bp, Homo sapiens
atggcctctaagagtgc

SEQ ID NO: 1715390 - DNA, 19 bp, Homo sapiens
atggcctctaagagtgccc

SEQ ID NO: 1715391 - DNA, 14 bp, Homo sapiens
atggcctctggcca

SEQ ID NO: 1715392 - DNA, 17 bp, Homo sapiens
atggcctctggccaggc

SEQ ID NO: 1715393 - DNA, 19 bp, Homo sapiens
atggcctgccttgaagcca

SEQ ID NO: 1715394 - DNA, 19 bp, Homo sapiens
atggcctgtgctgggccag

SEQ ID NO: 1715395 - DNA, 17 bp, Homo sapiens
atggccttaatttcctt

SEQ ID NO: 1715396 - DNA, 19 bp, Homo sapiens
atggccttaatttcctttt

SEQ ID NO: 1715397 - DNA, 16 bp, Homo sapiens
atggccttacactgaa

SEQ ID NO: 1715398 - DNA, 16 bp, Homo sapiens
atggcgatgtgttata

SEQ ID NO: 1715399 - DNA, 20 bp, Homo sapiens
atggcgattccctctcaccc

SEQ ID NO: 1715400 - DNA, 15 bp, Homo sapiens
atggcgcgggaggca

SEQ ID NO: 1715401 - DNA, 17 bp, Homo sapiens
atggcgcgggaggcacc

SEQ ID NO: 1715402 - DNA, 19 bp, Homo sapiens
atggcgcgggaggcaccag

SEQ ID NO: 1715403 - DNA, 23 bp, Homo sapiens
atggcgcgggaggcaccagctct

SEQ ID NO: 1715404 - DNA, 17 bp, Homo sapiens
atggcgtaatgggcctg

SEQ ID NO: 1715405 - DNA, 18 bp, Homo sapiens
atggcgtaatgggcctgc

SEQ ID NO: 1715406 - DNA, 15 bp, Homo sapiens
atggcgttggtttgt

SEQ ID NO: 1715407 - DNA, 17 bp, Homo sapiens
atggctaacctgttaca

SEQ ID NO: 1715408 - DNA, 20 bp, Homo sapiens
atggctaataaactgtatta

SEQ ID NO: 1715409 - DNA, 22 bp, Homo sapiens
atggctactttggtttctgtct

SEQ ID NO: 1715410 - DNA, 15 bp, Homo sapiens
atggctagcctttct

SEQ ID NO: 1715411 - DNA, 15 bp, Homo sapiens
atggctataggtgct

SEQ ID NO: 1715412 - DNA, 23 bp, Homo sapiens
atggctataggtgctacaaaaac

SEQ ID NO: 1715413 - DNA, 15 bp, Homo sapiens
atggctcaagtagaa

SEQ ID NO: 1715414 - DNA, 16 bp, Homo sapiens
atggctcaagtagaaa

SEQ ID NO: 1715415 - DNA, 22 bp, Homo sapiens
atggctcaagtagaaaagcagt

SEQ ID NO: 1715416 - DNA, 16 bp, Homo sapiens
atggctcactatgaat

SEQ ID NO: 1715417 - DNA, 18 bp, Homo sapiens
atggctcactatgaatct

SEQ ID NO: 1715418 - DNA, 20 bp, Homo sapiens
atggctcactatgaatctat

SEQ ID NO: 1715419 - DNA, 12 bp, Homo sapiens
atggctcaggca

SEQ ID NO: 1715420 - DNA, 19 bp, Homo sapiens
atggctcaggcaagcccct

SEQ ID NO: 1715421 - DNA, 14 bp, Homo sapiens
atggctcagggtgg

SEQ ID NO: 1715422 - DNA, 16 bp, Homo sapiens
atggctccagaaatgt

SEQ ID NO: 1715423 - DNA, 17 bp, Homo sapiens
atggctccagaaatgtc

SEQ ID NO: 1715424 - DNA, 14 bp, Homo sapiens
atggctgaagctgg

SEQ ID NO: 1715425 - DNA, 19 bp, Homo sapiens
atggctgaagctggagcag

SEQ ID NO: 1715426 - DNA, 19 bp, Homo sapiens
atggctgcacctttttgca

SEQ ID NO: 1715427 - DNA, 17 bp, Homo sapiens
atggctgcatagtattc

SEQ ID NO: 1715428 - DNA, 12 bp, Homo sapiens
atggctgcccag

SEQ ID NO: 1715429 - DNA, 16 bp, Homo sapiens
atggctgcccaggaga

SEQ ID NO: 1715430 - DNA, 23 bp, Homo sapiens
atggctggcaggcagttctagaa

SEQ ID NO: 1715431 - DNA, 19 bp, Homo sapiens
atggctgggtcagggccag

SEQ ID NO: 1715432 - DNA, 23 bp, Homo sapiens
gccagtaaaatactattgcctca

SEQ ID NO: 1715433 - DNA, 21 bp, Homo sapiens
gccagtaggagacacgacagc

SEQ ID NO: 1715434 - DNA, 23 bp, Homo sapiens
gccagtatctatatatgtgtatg

SEQ ID NO: 1715435 - DNA, 17 bp, Homo sapiens
gccagtatttttaaagg

SEQ ID NO: 1715436 - DNA, 17 bp, Homo sapiens
gccagtcaagaagaaaa

SEQ ID NO: 1715437 - DNA, 13 bp, Homo sapiens
gccagtcactgct

SEQ ID NO: 1715438 - DNA, 13 bp, Homo sapiens
gccagtccccgct

SEQ ID NO: 1715439 - DNA, 12 bp, Homo sapiens
gccagtcctggt

SEQ ID NO: 1715440 - DNA, 18 bp, Homo sapiens
gccagtcctggtcctggc

SEQ ID NO: 1715441 - DNA, 13 bp, Homo sapiens
gccagtctcagag

SEQ ID NO: 1715442 - DNA, 16 bp, Homo sapiens
gccagtctcagagacc

SEQ ID NO: 1715443 - DNA, 17 bp, Homo sapiens
gccagtctcagagacca

SEQ ID NO: 1715444 - DNA, 19 bp, Homo sapiens
gccagtctcagagaccagc

SEQ ID NO: 1715445 - DNA, 20 bp, Homo sapiens
gccagtctcagagaccagca

SEQ ID NO: 1715446 - DNA, 21 bp, Homo sapiens
gccagtctcagagaccagcac

SEQ ID NO: 1715447 - DNA, 22 bp, Homo sapiens
gccagtctcagagaccagcact

SEQ ID NO: 1715448 - DNA, 15 bp, Homo sapiens
gccagtctcccaggc

SEQ ID NO: 1715449 - DNA, 12 bp, Homo sapiens
gccagtctgccc

SEQ ID NO: 1715450 - DNA, 13 bp, Homo sapiens
gccagtctgtgga

SEQ ID NO: 1715451 - DNA, 20 bp, Homo sapiens
gccagtctgtggatcagaga

SEQ ID NO: 1715452 - DNA, 23 bp, Homo sapiens
gccagtcttcctcttagcctctg

SEQ ID NO: 1715453 - DNA, 18 bp, Homo sapiens
gccagtcttgcctaggcc

SEQ ID NO: 1715454 - DNA, 15 bp, Homo sapiens
gccagtgactttttc

SEQ ID NO: 1715455 - DNA, 15 bp, Homo sapiens
gccagtgccttacct

SEQ ID NO: 1715456 - DNA, 17 bp, Homo sapiens
gccagtggcacaggaga

SEQ ID NO: 1715457 - DNA, 23 bp, Homo sapiens
gccagtggctggatctgtgaggg

SEQ ID NO: 1715458 - DNA, 13 bp, Homo sapiens
gccagtggctggg

SEQ ID NO: 1715459 - DNA, 15 bp, Homo sapiens
gccagtgggaccctc

SEQ ID NO: 1715460 - DNA, 12 bp, Homo sapiens
gccagtgggcct

SEQ ID NO: 1715461 - DNA, 17 bp, Homo sapiens
gccagtgtgatcccaag

SEQ ID NO: 1715462 - DNA, 22 bp, Homo sapiens
gccagttatggctataggtgct

SEQ ID NO: 1715463 - DNA, 14 bp, Homo sapiens
gccagttctctgtg

SEQ ID NO: 1715464 - DNA, 19 bp, Homo sapiens
gccagttctctgtggaagc

SEQ ID NO: 1715465 - DNA, 17 bp, Homo sapiens
gccataatcagaacaca

SEQ ID NO: 1715466 - DNA, 17 bp, Homo sapiens
gccataatgttgcttct

SEQ ID NO: 1715467 - DNA, 22 bp, Homo sapiens
gccataattctaagttatttac

SEQ ID NO: 1715468 - DNA, 18 bp, Homo sapiens
gccatagacctacagacc

SEQ ID NO: 1715469 - DNA, 23 bp, Homo sapiens
gccatagacctacagacctggct

SEQ ID NO: 1715470 - DNA, 20 bp, Homo sapiens
gccatagaggcccaggcacc

SEQ ID NO: 1715471 - DNA, 13 bp, Homo sapiens
gccatagccccat

SEQ ID NO: 1715472 - DNA, 16 bp, Homo sapiens
gccatataagtttgaa

SEQ ID NO: 1715473 - DNA, 18 bp, Homo sapiens
gccatataagtttgaagg

SEQ ID NO: 1715474 - DNA, 18 bp, Homo sapiens
gccatcaagcacttccca

SEQ ID NO: 1715475 - DNA, 19 bp, Homo sapiens
gccatcaagcacttcccag

SEQ ID NO: 1715476 - DNA, 21 bp, Homo sapiens
gccatcaagcacttcccagga

SEQ ID NO: 1715477 - DNA, 22 bp, Homo sapiens
gccatcaccacggctcactgca

SEQ ID NO: 1715478 - DNA, 19 bp, Homo sapiens
gccatcactagaagaaaag

SEQ ID NO: 1715479 - DNA, 16 bp, Homo sapiens
gccatcactggtccag

SEQ ID NO: 1715480 - DNA, 22 bp, Homo sapiens
gccatccaaagaaacactaagc

SEQ ID NO: 1715481 - DNA, 12 bp, Homo sapiens
gccatccactgt

SEQ ID NO: 1715482 - DNA, 15 bp, Homo sapiens
gccatccattctgga

SEQ ID NO: 1715483 - DNA, 17 bp, Homo sapiens
attgacatttgtagttg

SEQ ID NO: 1715484 - DNA, 14 bp, Homo sapiens
attgaccaagaact

SEQ ID NO: 1715485 - DNA, 20 bp, Homo sapiens
attgaccaagaactgcatgg

SEQ ID NO: 1715486 - DNA, 13 bp, Homo sapiens
attgaccagctct

SEQ ID NO: 1715487 - DNA, 15 bp, Homo sapiens
attgaccagctctct

SEQ ID NO: 1715488 - DNA, 17 bp, Homo sapiens
attgaccatgtggttca

SEQ ID NO: 1715489 - DNA, 22 bp, Homo sapiens
attgaccattttttaatttact

SEQ ID NO: 1715490 - DNA, 21 bp, Homo sapiens
attgacccaaatgtgtaatat

SEQ ID NO: 1715491 - DNA, 13 bp, Homo sapiens
attgacctcagct

SEQ ID NO: 1715492 - DNA, 15 bp, Homo sapiens
attgacgaactggct

SEQ ID NO: 1715493 - DNA, 23 bp, Homo sapiens
attgactaactcaaatacacatt

SEQ ID NO: 1715494 - DNA, 13 bp, Homo sapiens
attgactctcaca

SEQ ID NO: 1715495 - DNA, 18 bp, Homo sapiens
attgactctttctattgt

SEQ ID NO: 1715496 - DNA, 14 bp, Homo sapiens
attgactgatgatt

SEQ ID NO: 1715497 - DNA, 18 bp, Homo sapiens
attgacttcaatgatagt

SEQ ID NO: 1715498 - DNA, 23 bp, Homo sapiens
attgacttcttggtttggggaga

SEQ ID NO: 1715499 - DNA, 18 bp, Homo sapiens
attgacttttataaagca

SEQ ID NO: 1715500 - DNA, 16 bp, Homo sapiens
attgagaaccaaagca

SEQ ID NO: 1715501 - DNA, 18 bp, Homo sapiens
attgagaacctggcctgt

SEQ ID NO: 1715502 - DNA, 14 bp, Homo sapiens
attgagaactgcat

SEQ ID NO: 1715503 - DNA, 21 bp, Homo sapiens
attgagaattttaaattataa

SEQ ID NO: 1715504 - DNA, 14 bp, Homo sapiens
attgagagttttgt

SEQ ID NO: 1715505 - DNA, 19 bp, Homo sapiens
attgagataatatctgtga

SEQ ID NO: 1715506 - DNA, 21 bp, Homo sapiens
attgagataatgatacttaac

SEQ ID NO: 1715507 - DNA, 16 bp, Homo sapiens
attgaggagctgcact

SEQ ID NO: 1715508 - DNA, 15 bp, Homo sapiens
attgaggggccctgg

SEQ ID NO: 1715509 - DNA, 19 bp, Homo sapiens
attgaggggccctggccag

SEQ ID NO: 1715510 - DNA, 20 bp, Homo sapiens
attgagtaatggtgtagaac

SEQ ID NO: 1715511 - DNA, 22 bp, Homo sapiens
attgagtaatggtgtagaacac

SEQ ID NO: 1715512 - DNA, 14 bp, Homo sapiens
attgagtattgttt

SEQ ID NO: 1715513 - DNA, 21 bp, Homo sapiens
attgagtattgtttaaaatgt

SEQ ID NO: 1715514 - DNA, 23 bp, Homo sapiens
attgagtgcactaaacaaataag

SEQ ID NO: 1715515 - DNA, 17 bp, Homo sapiens
attgataagttcataca

SEQ ID NO: 1715516 - DNA, 18 bp, Homo sapiens
attgataagttcatacat

SEQ ID NO: 1715517 - DNA, 16 bp, Homo sapiens
attgataattgcattc

SEQ ID NO: 1715518 - DNA, 20 bp, Homo sapiens
attgatacttcaggtgcttt

SEQ ID NO: 1715519 - DNA, 17 bp, Homo sapiens
attgatcaaattcattt

SEQ ID NO: 1715520 - DNA, 19 bp, Homo sapiens
attgatcattttcccccca

SEQ ID NO: 1715521 - DNA, 20 bp, Homo sapiens
attgatcattttccccccac

SEQ ID NO: 1715522 - DNA, 23 bp, Homo sapiens
attgatcggagcctcctctctca

SEQ ID NO: 1715523 - DNA, 17 bp, Homo sapiens
attgatcttaaactgga

SEQ ID NO: 1715524 - DNA, 18 bp, Homo sapiens
attgatgaagatgtttat

SEQ ID NO: 1715525 - DNA, 12 bp, Homo sapiens
attgatgtatat

SEQ ID NO: 1715526 - DNA, 19 bp, Homo sapiens
attgattaaggctttcttt

SEQ ID NO: 1715527 - DNA, 22 bp, Homo sapiens
attgattattctgattccactt

SEQ ID NO: 1715528 - DNA, 16 bp, Homo sapiens
attgatttcaagacct

SEQ ID NO: 1715529 - DNA, 15 bp, Homo sapiens
attgattttaaaatg

SEQ ID NO: 1715530 - DNA, 16 bp, Homo sapiens
attgattttaaaatgt

SEQ ID NO: 1715531 - DNA, 16 bp, Homo sapiens
attgatttttctcttc

SEQ ID NO: 1715532 - DNA, 14 bp, Homo sapiens
attgcaacaaaata

SEQ ID NO: 1715533 - DNA, 17 bp, Homo sapiens
attgcaacaaaatacat

SEQ ID NO: 1715534 - DNA, 14 bp, Homo sapiens
attgcaacagactg

SEQ ID NO: 1715535 - DNA, 21 bp, Homo sapiens
attgcacattgttgttttttt

SEQ ID NO: 1715536 - DNA, 18 bp, Homo sapiens
attgcactccagcctggg

SEQ ID NO: 1715537 - DNA, 19 bp, Homo sapiens
attgcactctagcctggca

SEQ ID NO: 1715538 - DNA, 15 bp, Homo sapiens
attgcactgctgttc

SEQ ID NO: 1715539 - DNA, 21 bp, Homo sapiens
attgcacttggcctcatgctg

SEQ ID NO: 1715540 - DNA, 16 bp, Homo sapiens
attgcactttttaagt

SEQ ID NO: 1715541 - DNA, 20 bp, Homo sapiens
attgcactttttaagtttga

SEQ ID NO: 1715542 - DNA, 20 bp, Homo sapiens
attgcagaactaaactcatt

SEQ ID NO: 1715543 - DNA, 16 bp, Homo sapiens
attgcagaattgttta

SEQ ID NO: 1715544 - DNA, 19 bp, Homo sapiens
attgcagaattgtttagat

SEQ ID NO: 1715545 - DNA, 14 bp, Homo sapiens
attgcagacctgtc

SEQ ID NO: 1715546 - DNA, 16 bp, Homo sapiens
attgcagattgaatat

SEQ ID NO: 1715547 - DNA, 19 bp, Homo sapiens
attgcagattgaatatata

SEQ ID NO: 1715548 - DNA, 20 bp, Homo sapiens
attgcagctcactgctgctg

SEQ ID NO: 1715549 - DNA, 19 bp, Homo sapiens
attgcagcttttggttaat

SEQ ID NO: 1715550 - DNA, 17 bp, Homo sapiens
attgcaggaccttgggc

SEQ ID NO: 1715551 - DNA, 17 bp, Homo sapiens
attgcaggatggtgtct

SEQ ID NO: 1715552 - DNA, 14 bp, Homo sapiens
attgcagttagccc

SEQ ID NO: 1715553 - DNA, 23 bp, Homo sapiens
attgcagttagccccagaaaatg

SEQ ID NO: 1715554 - DNA, 20 bp, Homo sapiens
attgcagttcaaatcctcac

SEQ ID NO: 1715555 - DNA, 21 bp, Homo sapiens
attgcatactttgtattttga

SEQ ID NO: 1715556 - DNA, 14 bp, Homo sapiens
attgcatcactgta

SEQ ID NO: 1715557 - DNA, 16 bp, Homo sapiens
attgcatcactgtatc

SEQ ID NO: 1715558 - DNA, 19 bp, Homo sapiens
attgcatctcaaaattatt

SEQ ID NO: 1715559 - DNA, 16 bp, Homo sapiens
attgcatttcctgaca

SEQ ID NO: 1715560 - DNA, 17 bp, Homo sapiens
attgcatttcctgacag

SEQ ID NO: 1715561 - DNA, 21 bp, Homo sapiens
attgcccatggctgggaacat

SEQ ID NO: 1715562 - DNA, 17 bp, Homo sapiens
attgccctatgctgtgc

SEQ ID NO: 1715563 - DNA, 11 bp, Homo sapiens
attgccctggt

SEQ ID NO: 1715564 - DNA, 19 bp, Homo sapiens
attgcctacaataaaaaga

SEQ ID NO: 1715565 - DNA, 16 bp, Homo sapiens
attgcctcccaggcaa

SEQ ID NO: 1715566 - DNA, 18 bp, Homo sapiens
attgcctctgaaaagtgt

SEQ ID NO: 1715567 - DNA, 15 bp, Homo sapiens
attgcctggactgac

SEQ ID NO: 1715568 - DNA, 18 bp, Homo sapiens
attgcctggactgaccac

SEQ ID NO: 1715569 - DNA, 19 bp, Homo sapiens
attgcctggactgaccaca

SEQ ID NO: 1715570 - DNA, 17 bp, Homo sapiens
attgcctgttctgcttc

SEQ ID NO: 1715571 - DNA, 12 bp, Homo sapiens
attgccttcagc

SEQ ID NO: 1715572 - DNA, 15 bp, Homo sapiens
attgccttcagccct

SEQ ID NO: 1715573 - DNA, 13 bp, Homo sapiens
attgcctttctgt

SEQ ID NO: 1715574 - DNA, 20 bp, Homo sapiens
attgcgtagaggctacaggg

SEQ ID NO: 1715575 - DNA, 23 bp, Homo sapiens
attgctaaaaaataaataaaagc

SEQ ID NO: 1715576 - DNA, 18 bp, Homo sapiens
attgctaattgtgtatat

SEQ ID NO: 1715577 - DNA, 19 bp, Homo sapiens
attgctacaacatcactaa

SEQ ID NO: 1715578 - DNA, 16 bp, Homo sapiens
attgctagataaaagc

SEQ ID NO: 1715579 - DNA, 19 bp, Homo sapiens
attgctatcgccctccttt

SEQ ID NO: 1715580 - DNA, 20 bp, Homo sapiens
attgctatcgccctcctttc

SEQ ID NO: 1715581 - DNA, 23 bp, Homo sapiens
attgctatctggaggccttccag

SEQ ID NO: 1715582 - DNA, 18 bp, Homo sapiens
attgctatgttactattt

SEQ ID NO: 1715583 - DNA, 23 bp, Homo sapiens
attgctcaagttcattgatgacc

SEQ ID NO: 1715584 - DNA, 21 bp, Homo sapiens
attgctcacagttattacata

SEQ ID NO: 1715585 - DNA, 12 bp, Homo sapiens
attgctcagccc

SEQ ID NO: 1715586 - DNA, 16 bp, Homo sapiens
attgctcagcccgctt

SEQ ID NO: 1715587 - DNA, 21 bp, Homo sapiens
attgctcagcccgcttggcca

SEQ ID NO: 1715588 - DNA, 13 bp, Homo sapiens
attgctccagagc

SEQ ID NO: 1715589 - DNA, 23 bp, Homo sapiens
attgctcccatcagggaagaacc

SEQ ID NO: 1715590 - DNA, 18 bp, Homo sapiens
attgctcgcccagacacc

SEQ ID NO: 1715591 - DNA, 17 bp, Homo sapiens
attgctctggagcagcc

SEQ ID NO: 1715592 - DNA, 12 bp, Homo sapiens
attgctgaaatt

SEQ ID NO: 1715593 - DNA, 16 bp, Homo sapiens
attgctgaaattttat

SEQ ID NO: 1715594 - DNA, 12 bp, Homo sapiens
attgctgaggca

SEQ ID NO: 1715595 - DNA, 14 bp, Homo sapiens
attgctgatgtagt

SEQ ID NO: 1715596 - DNA, 14 bp, Homo sapiens
attgctgcatattt

SEQ ID NO: 1715597 - DNA, 20 bp, Homo sapiens
attgctgcatatttgacctt

SEQ ID NO: 1715598 - DNA, 23 bp, Homo sapiens
attgctgccaaggtggagggaag

SEQ ID NO: 1715599 - DNA, 15 bp, Homo sapiens
cttgtacttctgtgt

SEQ ID NO: 1715600 - DNA, 18 bp, Homo sapiens
cttgtacttctgtgttca

SEQ ID NO: 1715601 - DNA, 21 bp, Homo sapiens
cttgtacttctgtgttcattt

SEQ ID NO: 1715602 - DNA, 20 bp, Homo sapiens
cttgtagaactcactctggg

SEQ ID NO: 1715603 - DNA, 21 bp, Homo sapiens
cttgtagaactcactctgggc

SEQ ID NO: 1715604 - DNA, 23 bp, Homo sapiens
cttgtagaactcactctgggctg

SEQ ID NO: 1715605 - DNA, 23 bp, Homo sapiens
cttgtagcattcggccttggtga

SEQ ID NO: 1715606 - DNA, 19 bp, Homo sapiens
cttgtataagatcctagat

SEQ ID NO: 1715607 - DNA, 12 bp, Homo sapiens
cttgtataatat

SEQ ID NO: 1715608 - DNA, 14 bp, Homo sapiens
cttgtatatttgta

SEQ ID NO: 1715609 - DNA, 18 bp, Homo sapiens
cttgtatttaaatattaa

SEQ ID NO: 1715610 - DNA, 22 bp, Homo sapiens
cttgtcacgaattccatcttgt

SEQ ID NO: 1715611 - DNA, 17 bp, Homo sapiens
cttgtcactagcagctg

SEQ ID NO: 1715612 - DNA, 20 bp, Homo sapiens
cttgtcactagcagctgcag

SEQ ID NO: 1715613 - DNA, 15 bp, Homo sapiens
cttgtcactggtaga

SEQ ID NO: 1715614 - DNA, 15 bp, Homo sapiens
cttgtcagaaacact

SEQ ID NO: 1715615 - DNA, 17 bp, Homo sapiens
cttgtcatgtaccatca

SEQ ID NO: 1715616 - DNA, 12 bp, Homo sapiens
cttgtcatgtgt

SEQ ID NO: 1715617 - DNA, 15 bp, Homo sapiens
cttgtcatgtgtata

SEQ ID NO: 1715618 - DNA, 18 bp, Homo sapiens
cttgtcattccagagtgc

SEQ ID NO: 1715619 - DNA, 14 bp, Homo sapiens
cttgtccagcgcct

SEQ ID NO: 1715620 - DNA, 14 bp, Homo sapiens
cttgtccaggtctc

SEQ ID NO: 1715621 - DNA, 20 bp, Homo sapiens
cttgtccaggtctcactgct

SEQ ID NO: 1715622 - DNA, 20 bp, Homo sapiens
cttgtccctctcactcccca

SEQ ID NO: 1715623 - DNA, 14 bp, Homo sapiens
cttgtccctttccc

SEQ ID NO: 1715624 - DNA, 18 bp, Homo sapiens
cttgtccctttccctacc

SEQ ID NO: 1715625 - DNA, 15 bp, Homo sapiens
cttgtcctgccagct

SEQ ID NO: 1715626 - DNA, 18 bp, Homo sapiens
cttgtcctgccagctgcc

SEQ ID NO: 1715627 - DNA, 19 bp, Homo sapiens
cttgtcctgccagctgcct

SEQ ID NO: 1715628 - DNA, 14 bp, Homo sapiens
cttgtcctggccct

SEQ ID NO: 1715629 - DNA, 17 bp, Homo sapiens
cttgtcctgggcctgcc

SEQ ID NO: 1715630 - DNA, 15 bp, Homo sapiens
cttgtcgtgggatgg

SEQ ID NO: 1715631 - DNA, 17 bp, Homo sapiens
cttgtctatttttgtct

SEQ ID NO: 1715632 - DNA, 12 bp, Homo sapiens
cttgtctccact

SEQ ID NO: 1715633 - DNA, 14 bp, Homo sapiens
cttgtctctgggct

SEQ ID NO: 1715634 - DNA, 15 bp, Homo sapiens
cttgtctgaggcctc

SEQ ID NO: 1715635 - DNA, 17 bp, Homo sapiens
cttgtctgaggcctcat

SEQ ID NO: 1715636 - DNA, 14 bp, Homo sapiens
cttgtctgatttct

SEQ ID NO: 1715637 - DNA, 16 bp, Homo sapiens
cttgtctgggaattgt

SEQ ID NO: 1715638 - DNA, 21 bp, Homo sapiens
cttgtctgtagcgtctgtata

SEQ ID NO: 1715639 - DNA, 17 bp, Homo sapiens
cttgtcttagctctgga

SEQ ID NO: 1715640 - DNA, 18 bp, Homo sapiens
cttgtcttagctctggac

SEQ ID NO: 1715641 - DNA, 14 bp, Homo sapiens
cttgtcttgttcac

SEQ ID NO: 1715642 - DNA, 17 bp, Homo sapiens
cttgtctttactgacaa

SEQ ID NO: 1715643 - DNA, 12 bp, Homo sapiens
cttgtcttttga

SEQ ID NO: 1715644 - DNA, 13 bp, Homo sapiens
cttgtgaaaatgt

SEQ ID NO: 1715645 - DNA, 18 bp, Homo sapiens
cttgtgaaaatgtgttct

SEQ ID NO: 1715646 - DNA, 19 bp, Homo sapiens
cttgtgaaacacagctgtt

SEQ ID NO: 1715647 - DNA, 20 bp, Homo sapiens
cttgtgaaacacagctgttc

SEQ ID NO: 1715648 - DNA, 22 bp, Homo sapiens
cttgtgacagtgcctcttccag

SEQ ID NO: 1715649 - DNA, 18 bp, Homo sapiens
cttgtgacgtgcactgtg

SEQ ID NO: 1715650 - DNA, 18 bp, Homo sapiens
cttgtgactgaaggggca

SEQ ID NO: 1715651 - DNA, 16 bp, Homo sapiens
cttgtgacttttgctt

SEQ ID NO: 1715652 - DNA, 19 bp, Homo sapiens
cttgtgagagcccattccc

SEQ ID NO: 1715653 - DNA, 22 bp, Homo sapiens
cttgtgagagcccattcccacc

SEQ ID NO: 1715654 - DNA, 18 bp, Homo sapiens
cttgtgagatccttcaca

SEQ ID NO: 1715655 - DNA, 19 bp, Homo sapiens
cttgtgagcatcagagggc

SEQ ID NO: 1715656 - DNA, 21 bp, Homo sapiens
cttgtgagtggataatcagga

SEQ ID NO: 1715657 - DNA, 13 bp, Homo sapiens
cttgtgattggct

SEQ ID NO: 1715658 - DNA, 15 bp, Homo sapiens
cttgtgattggctgc

SEQ ID NO: 1715659 - DNA, 17 bp, Homo sapiens
cttgtgattggctgcag

SEQ ID NO: 1715660 - DNA, 18 bp, Homo sapiens
cttgtgattggctgcagg

SEQ ID NO: 1715661 - DNA, 19 bp, Homo sapiens
cttgtgattggctgcagga

SEQ ID NO: 1715662 - DNA, 15 bp, Homo sapiens
cttgtgcaattgtct

SEQ ID NO: 1715663 - DNA, 22 bp, Homo sapiens
cttgtgctcctcttgattcctg

SEQ ID NO: 1715664 - DNA, 20 bp, Homo sapiens
cttgtgctgatcgtgctaaa

SEQ ID NO: 1715665 - DNA, 20 bp, Homo sapiens
cttgtggccccttttacttt

SEQ ID NO: 1715666 - DNA, 21 bp, Homo sapiens
cttgtggccccttttactttt

SEQ ID NO: 1715667 - DNA, 23 bp, Homo sapiens
cttgtgggaccagtcccacaccg

SEQ ID NO: 1715668 - DNA, 23 bp, Homo sapiens
cttgtgggagacagcagcctgta

SEQ ID NO: 1715669 - DNA, 16 bp, Homo sapiens
cttgtggtgtgaccat

SEQ ID NO: 1715670 - DNA, 24 bp, Homo sapiens
cttgtggtgtgaccatgttcatta

SEQ ID NO: 1715671 - DNA, 17 bp, Homo sapiens
cttgtggtgttcctgaa

SEQ ID NO: 1715672 - DNA, 14 bp, Homo sapiens
cttgtggttaaaaa

SEQ ID NO: 1715673 - DNA, 20 bp, Homo sapiens
cttgtggttaaaaacctgcc

SEQ ID NO: 1715674 - DNA, 21 bp, Homo sapiens
cttgtggttgaaaaccacagt

SEQ ID NO: 1715675 - DNA, 16 bp, Homo sapiens
cttgtgtaactaattt

SEQ ID NO: 1715676 - DNA, 18 bp, Homo sapiens
cttgtgtaactaatttgt

SEQ ID NO: 1715677 - DNA, 23 bp, Homo sapiens
cttgtgtatattttaatgaatat

SEQ ID NO: 1715678 - DNA, 18 bp, Homo sapiens
cttgtgtcaagacatttc

SEQ ID NO: 1715679 - DNA, 21 bp, Homo sapiens
cttgtgtcaagacatttctct

SEQ ID NO: 1715680 - DNA, 12 bp, Homo sapiens
cttgtgtcctgg

SEQ ID NO: 1715681 - DNA, 19 bp, Homo sapiens
cttgtgtcctgtcctttct

SEQ ID NO: 1715682 - DNA, 21 bp, Homo sapiens
cttgtgtcctgtcctttcttg

SEQ ID NO: 1715683 - DNA, 18 bp, Homo sapiens
cttgtgtctctgtgcttt

SEQ ID NO: 1715684 - DNA, 10 bp, Homo sapiens
cttgtgtctg

SEQ ID NO: 1715685 - DNA, 12 bp, Homo sapiens
cttgtgtctgta

SEQ ID NO: 1715686 - DNA, 14 bp, Homo sapiens
cttgtgtctgtaca

SEQ ID NO: 1715687 - DNA, 18 bp, Homo sapiens
cttgtgtctgtacacgtg

SEQ ID NO: 1715688 - DNA, 16 bp, Homo sapiens
cttgtgtgtcaggccc

SEQ ID NO: 1715689 - DNA, 17 bp, Homo sapiens
cttgtgttacttgccaa

SEQ ID NO: 1715690 - DNA, 21 bp, Homo sapiens
cttgtgttcagctctttccaa

SEQ ID NO: 1715691 - DNA, 23 bp, Homo sapiens
cttgtgttcagctctttccaaat

SEQ ID NO: 1715692 - DNA, 13 bp, Homo sapiens
cttgttaatgtca

SEQ ID NO: 1715693 - DNA, 13 bp, Homo sapiens
cttgttactgctg

SEQ ID NO: 1715694 - DNA, 23 bp, Homo sapiens
cttgttactgctgattcttgtaa

SEQ ID NO: 1715695 - DNA, 13 bp, Homo sapiens
cttgttactgtga

SEQ ID NO: 1715696 - DNA, 17 bp, Homo sapiens
cttgttacttctgaggt

SEQ ID NO: 1715697 - DNA, 13 bp, Homo sapiens
cttgttagaaaac

SEQ ID NO: 1715698 - DNA, 15 bp, Homo sapiens
cttgttatttataac

SEQ ID NO: 1715699 - DNA, 14 bp, Homo sapiens
cttgttcaggaaaa

SEQ ID NO: 1715700 - DNA, 19 bp, Homo sapiens
cttgttcaggaaaaggttg

SEQ ID NO: 1715701 - DNA, 13 bp, Homo sapiens
cttgttcatatgg

SEQ ID NO: 1715702 - DNA, 12 bp, Homo sapiens
cttgttcatttt

SEQ ID NO: 1715703 - DNA, 13 bp, Homo sapiens
cttgttccagctc

SEQ ID NO: 1715704 - DNA, 21 bp, Homo sapiens
cttgttccccactgacagcct

SEQ ID NO: 1715705 - DNA, 12 bp, Homo sapiens
cttgttctagag

SEQ ID NO: 1715706 - DNA, 23 bp, Homo sapiens
cttgttgcctgcacccttccctc

SEQ ID NO: 1715707 - DNA, 15 bp, Homo sapiens
cttgttggagcctgc

SEQ ID NO: 1715708 - DNA, 19 bp, Homo sapiens
cttgttggagcctgcaggg

SEQ ID NO: 1715709 - DNA, 23 bp, Homo sapiens
cttgttgtttgttgacagcttgg

SEQ ID NO: 1715710 - DNA, 16 bp, Homo sapiens
cttgtttaccaaagaa

SEQ ID NO: 1715711 - DNA, 13 bp, Homo sapiens
cttgtttatgata

SEQ ID NO: 1715712 - DNA, 19 bp, Homo sapiens
cttgtttatgatatttctt

SEQ ID NO: 1715713 - DNA, 22 bp, Homo sapiens
cttgtttcaattccacctgcaa

SEQ ID NO: 1715714 - DNA, 15 bp, Homo sapiens
cttgtttcactgaaa

SEQ ID NO: 1715715 - DNA, 23 bp, Homo sapiens
cttgtttctatactgtttgtaat

SEQ ID NO: 1715716 - DNA, 14 bp, Homo sapiens
cttgtttctgttgt
